United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 105

SEQ ID NO: 3727113 - RNA, 14 nt, Salmonella enterica enterica serovar Typhi Ty2
ugcagcguuuccag

SEQ ID NO: 3727114 - RNA, 16 nt, Salmonella enterica enterica serovar Typhi Ty2
ugcagcguuuccagcc

SEQ ID NO: 3727115 - RNA, 16 nt, Salmonella enterica enterica serovar Typhi Ty2
ugcagcucaagcgccg

SEQ ID NO: 3727116 - RNA, 13 nt, Salmonella enterica enterica serovar Typhi Ty2
ugcaggaagggca

SEQ ID NO: 3727117 - RNA, 22 nt, Salmonella enterica enterica serovar Typhi Ty2
ugcaggagcucggccaucuggc

SEQ ID NO: 3727118 - RNA, 13 nt, Salmonella enterica enterica serovar Typhi Ty2
ugcaggaggcgcg

SEQ ID NO: 3727119 - RNA, 22 nt, Salmonella enterica enterica serovar Typhi Ty2
ugcaggaggcgcguuuacuggc

SEQ ID NO: 3727120 - RNA, 18 nt, Salmonella enterica enterica serovar Typhi Ty2
ugcaggcaggucuccagc

SEQ ID NO: 3727121 - RNA, 18 nt, Salmonella enterica enterica serovar Typhi Ty2
ugcaggcauaaaaaagag

SEQ ID NO: 3727122 - RNA, 22 nt, Salmonella enterica enterica serovar Typhi Ty2
ugcaggccggauaaggcagcaa

SEQ ID NO: 3727123 - RNA, 22 nt, Salmonella enterica enterica serovar Typhi Ty2
ugcaggcucccuuauacaggcg

SEQ ID NO: 3727124 - RNA, 22 nt, Salmonella enterica enterica serovar Typhi Ty2
ugcagggacuuauuaaaaauag

SEQ ID NO: 3727125 - RNA, 14 nt, Salmonella enterica enterica serovar Typhi Ty2
ugcaguacaggcau

SEQ ID NO: 3727126 - RNA, 19 nt, Salmonella enterica enterica serovar Typhi Ty2
ugcaguacaggcauuguca

SEQ ID NO: 3727127 - RNA, 19 nt, Salmonella enterica enterica serovar Typhi Ty2
ugcaguauugcaccaggaa

SEQ ID NO: 3727128 - RNA, 19 nt, Salmonella enterica enterica serovar Typhi Ty2
ugcagucgcggaauaauca

SEQ ID NO: 3727129 - RNA, 15 nt, Salmonella enterica enterica serovar Typhi Ty2
ugcaguucaaaaggu

SEQ ID NO: 3727130 - RNA, 22 nt, Salmonella enterica enterica serovar Typhi Ty2
ugcaguucaucauccugcaggg

SEQ ID NO: 3727131 - RNA, 14 nt, Salmonella enterica enterica serovar Typhi Ty2
ugcauaaaaaaacg

SEQ ID NO: 3727132 - RNA, 20 nt, Salmonella enterica enterica serovar Typhi Ty2
ugcauaaaacgguuuucaaa

SEQ ID NO: 3727133 - RNA, 22 nt, Salmonella enterica enterica serovar Typhi Ty2
ugcauaaaauccugguaacggc

SEQ ID NO: 3727134 - RNA, 18 nt, Salmonella enterica enterica serovar Typhi Ty2
ugcauaaaggaguaacag

SEQ ID NO: 3727135 - RNA, 15 nt, Salmonella enterica enterica serovar Typhi Ty2
ugcauaaauaucugc

SEQ ID NO: 3727136 - RNA, 12 nt, Salmonella enterica enterica serovar Typhi Ty2
ugcauaagaggu

SEQ ID NO: 3727137 - RNA, 17 nt, Salmonella enterica enterica serovar Typhi Ty2
ugcauaauauccaggag

SEQ ID NO: 3727138 - RNA, 15 nt, Salmonella enterica enterica serovar Typhi Ty2
ugcauaauugcugac

SEQ ID NO: 3727139 - RNA, 13 nt, Salmonella enterica enterica serovar Typhi Ty2
ugcauacauaaau

SEQ ID NO: 3727140 - RNA, 19 nt, Salmonella enterica enterica serovar Typhi Ty2
ugcauacguuucaccagca

SEQ ID NO: 3727141 - RNA, 19 nt, Salmonella enterica enterica serovar Typhi Ty2
ugcauacucacauucauaa

SEQ ID NO: 3727142 - RNA, 22 nt, Salmonella enterica enterica serovar Typhi Ty2
ugcauacucacauucauaaaag

SEQ ID NO: 3727143 - RNA, 16 nt, Salmonella enterica enterica serovar Typhi Ty2
ugcauauaacuuucaa

SEQ ID NO: 3727144 - RNA, 22 nt, Salmonella enterica enterica serovar Typhi Ty2
ugcauauacguugcggcgcguu

SEQ ID NO: 3727145 - RNA, 22 nt, Salmonella enterica enterica serovar Typhi Ty2
ugcauaucgccuugcugcggca

SEQ ID NO: 3727146 - RNA, 14 nt, Salmonella enterica enterica serovar Typhi Ty2
ugccaucggccagc

SEQ ID NO: 3727147 - RNA, 19 nt, Salmonella enterica enterica serovar Typhi Ty2
ugccaucggccagcaggcg

SEQ ID NO: 3727148 - RNA, 15 nt, Salmonella enterica enterica serovar Typhi Ty2
ugccaucuccugcga

SEQ ID NO: 3727149 - RNA, 15 nt, Salmonella enterica enterica serovar Typhi Ty2
ugccauguuaauacc

SEQ ID NO: 3727150 - RNA, 23 nt, Salmonella enterica enterica serovar Typhi Ty2
ugccauuaucaccauucccagcg

SEQ ID NO: 3727151 - RNA, 16 nt, Salmonella enterica enterica serovar Typhi Ty2
ugccauucgcccaguc

SEQ ID NO: 3727152 - RNA, 21 nt, Salmonella enterica enterica serovar Typhi Ty2
ugccauuuuaucgacgcuauu

SEQ ID NO: 3727153 - RNA, 21 nt, Salmonella enterica enterica serovar Typhi Ty2
ugcccaacaucaguucagaaa

SEQ ID NO: 3727154 - RNA, 16 nt, Salmonella enterica enterica serovar Typhi Ty2
ugcccaaccugcgcag

SEQ ID NO: 3727155 - RNA, 15 nt, Salmonella enterica enterica serovar Typhi Ty2
ugcccacccgggccg

SEQ ID NO: 3727156 - RNA, 16 nt, Salmonella enterica enterica serovar Typhi Ty2
ugcccaccuucgcgga

SEQ ID NO: 3727157 - RNA, 18 nt, Salmonella enterica enterica serovar Typhi Ty2
ugcccagcaucccgcugg

SEQ ID NO: 3727158 - RNA, 16 nt, Salmonella enterica enterica serovar Typhi Ty2
ugcccagcgcaaucac

SEQ ID NO: 3727159 - RNA, 15 nt, Salmonella enterica enterica serovar Typhi Ty2
ugcccagcgccguca

SEQ ID NO: 3727160 - RNA, 22 nt, Salmonella enterica enterica serovar Typhi Ty2
ugcccagcgcgaccugcauccc

SEQ ID NO: 3727161 - RNA, 16 nt, Salmonella enterica enterica serovar Typhi Ty2
ugcccagcucagcuuu

SEQ ID NO: 3727162 - RNA, 11 nt, Salmonella enterica enterica serovar Typhi Ty2
ugcccagguua

SEQ ID NO: 3727163 - RNA, 13 nt, Salmonella enterica enterica serovar Typhi Ty2
ugcccaguuuacc

SEQ ID NO: 3727164 - RNA, 18 nt, Salmonella enterica enterica serovar Typhi Ty2
ugcccaucgcaacgccgg

SEQ ID NO: 3727165 - RNA, 17 nt, Salmonella enterica enterica serovar Typhi Ty2
ugcccaucgcgccauga

SEQ ID NO: 3727166 - RNA, 13 nt, Salmonella enterica enterica serovar Typhi Ty2
ugcccauuccgcc

SEQ ID NO: 3727167 - RNA, 18 nt, Salmonella enterica enterica serovar Typhi Ty2
ugcccauucuucgucguc

SEQ ID NO: 3727168 - RNA, 15 nt, Salmonella enterica enterica serovar Typhi Ty2
ugcccauuuccugca

SEQ ID NO: 3727169 - RNA, 19 nt, Salmonella enterica enterica serovar Typhi Ty2
ugcccauuuccugcauuaa

SEQ ID NO: 3727170 - RNA, 21 nt, Salmonella enterica enterica serovar Typhi Ty2
ugccccacgauacgccccugc

SEQ ID NO: 3727171 - RNA, 18 nt, Salmonella enterica enterica serovar Typhi Ty2
ugccccaucucuuucaga

SEQ ID NO: 3727172 - RNA, 19 nt, Salmonella enterica enterica serovar Typhi Ty2
ugcccccauacgcgcgcca

SEQ ID NO: 3727173 - RNA, 12 nt, Salmonella enterica enterica serovar Typhi Ty2
ugccccucuucc

SEQ ID NO: 3727174 - RNA, 21 nt, Salmonella enterica enterica serovar Typhi Ty2
ugccccuuccgccacggcuuu

SEQ ID NO: 3727175 - RNA, 19 nt, Salmonella enterica enterica serovar Typhi Ty2
ugcccgaaagcaauacugu

SEQ ID NO: 3727176 - RNA, 20 nt, Salmonella enterica enterica serovar Typhi Ty2
ugcccgaaagcaauacugua

SEQ ID NO: 3727177 - RNA, 21 nt, Salmonella enterica enterica serovar Typhi Ty2
ugcccgaugagcuugcacuau

SEQ ID NO: 3727178 - RNA, 15 nt, Salmonella enterica enterica serovar Typhi Ty2
ugcccgauggcgcua

SEQ ID NO: 3727179 - RNA, 16 nt, Salmonella enterica enterica serovar Typhi Ty2
ugcccgauggcgcugc

SEQ ID NO: 3727180 - RNA, 14 nt, Salmonella enterica enterica serovar Typhi Ty2
ugcccgccagcggg

SEQ ID NO: 3727181 - RNA, 15 nt, Salmonella enterica enterica serovar Typhi Ty2
ugcccgccgccggcc

SEQ ID NO: 3727182 - RNA, 18 nt, Salmonella enterica enterica serovar Typhi Ty2
ugcccgcgaucgcuucca

SEQ ID NO: 3727183 - RNA, 21 nt, Salmonella enterica enterica serovar Typhi Ty2
ugcccgcucgcuuacgcggcg

SEQ ID NO: 3727184 - RNA, 21 nt, Salmonella enterica enterica serovar Typhi Ty2
ugcccggcaugucgccagcca

SEQ ID NO: 3727185 - RNA, 23 nt, Salmonella enterica enterica serovar Typhi Ty2
ugcccggcgcguuuuggcagaca

SEQ ID NO: 3727186 - RNA, 16 nt, Salmonella enterica enterica serovar Typhi Ty2
ugcccgguuuuuuaau

SEQ ID NO: 3727187 - RNA, 20 nt, Salmonella enterica enterica serovar Typhi Ty2
ugcccguugucacaggcuug

SEQ ID NO: 3727188 - RNA, 22 nt, Salmonella enterica enterica serovar Typhi Ty2
ugcccguuugcgagacggcgaa

SEQ ID NO: 3727189 - RNA, 15 nt, Salmonella enterica enterica serovar Typhi Ty2
ugcccucggaaaacu

SEQ ID NO: 3727190 - RNA, 22 nt, Salmonella enterica enterica serovar Typhi Ty2
ugcccugcuugucgaucaucag

SEQ ID NO: 3727191 - RNA, 17 nt, Salmonella enterica enterica serovar Typhi Ty2
ugcccuuaaauccggcc

SEQ ID NO: 3727192 - RNA, 16 nt, Salmonella enterica enterica serovar Typhi Ty2
ugcccuuccagcagcc

SEQ ID NO: 3727193 - RNA, 17 nt, Salmonella enterica enterica serovar Typhi Ty2
ugcccuuccagcagcca

SEQ ID NO: 3727194 - RNA, 14 nt, Salmonella enterica enterica serovar Typhi Ty2
ugcccuuuuccaga

SEQ ID NO: 3727195 - RNA, 23 nt, Salmonella enterica enterica serovar Typhi Ty2
ugcccuuuuugcauucgcuccuc

SEQ ID NO: 3727196 - RNA, 17 nt, Salmonella enterica enterica serovar Typhi Ty2
ugccgacagaacugauu

SEQ ID NO: 3727197 - RNA, 23 nt, Salmonella enterica enterica serovar Typhi Ty2
ugccgacagaacugauuuccgga

SEQ ID NO: 3727198 - RNA, 13 nt, Salmonella enterica enterica serovar Typhi Ty2
ugccgacaggcag

SEQ ID NO: 3727199 - RNA, 15 nt, Salmonella enterica enterica serovar Typhi Ty2
ugccgaccuggcuug

SEQ ID NO: 3727200 - RNA, 13 nt, Salmonella enterica enterica serovar Typhi Ty2
ugccgacgccagc

SEQ ID NO: 3727201 - RNA, 15 nt, Salmonella enterica enterica serovar Typhi Ty2
ugccgacgcgaugcc

SEQ ID NO: 3727202 - RNA, 15 nt, Salmonella enterica enterica serovar Typhi Ty2
ugccgacuggcguga

SEQ ID NO: 3727203 - RNA, 14 nt, Salmonella enterica enterica serovar Typhi Ty2
ugccgagcaacaga

SEQ ID NO: 3727204 - RNA, 19 nt, Salmonella enterica enterica serovar Typhi Ty2
ugccgagcaacagaaacca

SEQ ID NO: 3727205 - RNA, 17 nt, Salmonella enterica enterica serovar Typhi Ty2
ugccgauaauaaacgcg

SEQ ID NO: 3727206 - RNA, 20 nt, Salmonella enterica enterica serovar Typhi Ty2
ugccgauaauaaacgcgcca

SEQ ID NO: 3727207 - RNA, 18 nt, Salmonella enterica enterica serovar Typhi Ty2
ugccgauagucuccgcca

SEQ ID NO: 3727208 - RNA, 21 nt, Salmonella enterica enterica serovar Typhi Ty2
ugccgaucaccagcgcaucuc

SEQ ID NO: 3727209 - RNA, 17 nt, Salmonella enterica enterica serovar Typhi Ty2
ugccgaugccugcgaga

SEQ ID NO: 3727210 - RNA, 21 nt, Salmonella enterica enterica serovar Typhi Ty2
ugccgauggcgcuccugaauc

SEQ ID NO: 3727211 - RNA, 16 nt, Salmonella enterica enterica serovar Typhi Ty2
ugccgauggcuauuac

SEQ ID NO: 3727212 - RNA, 20 nt, Salmonella enterica enterica serovar Typhi Ty2
ugccgauuccaugcccaguu

SEQ ID NO: 3727213 - RNA, 22 nt, Salmonella enterica enterica serovar Typhi Ty2
ugccgauuccaugcccaguuca

SEQ ID NO: 3727214 - RNA, 23 nt, Salmonella enterica enterica serovar Typhi Ty2
ugccgauuuaccucucaccagua

SEQ ID NO: 3727215 - RNA, 22 nt, Salmonella enterica enterica serovar Typhi Ty2
ugccgcaaacgccgaagccagc

SEQ ID NO: 3727216 - RNA, 20 nt, Salmonella enterica enterica serovar Typhi Ty2
ugccgcaaacgccugcuccg

SEQ ID NO: 3727217 - RNA, 14 nt, Salmonella enterica enterica serovar Typhi Ty2
ugccgcacucccca

SEQ ID NO: 3727218 - RNA, 12 nt, Salmonella enterica enterica serovar Typhi Ty2
ugccgcaggcaa

SEQ ID NO: 3727219 - RNA, 18 nt, Salmonella enterica enterica serovar Typhi Ty2
ugccgccacgccgcucca

SEQ ID NO: 3727220 - RNA, 15 nt, Salmonella enterica enterica serovar Typhi Ty2
ugccgccagcaguug

SEQ ID NO: 3727221 - RNA, 18 nt, Salmonella enterica enterica serovar Typhi Ty2
ugccgccauaacgccggc

SEQ ID NO: 3727222 - RNA, 21 nt, Salmonella enterica enterica serovar Typhi Ty2
ugccgccauaacgccggcgcu

SEQ ID NO: 3727223 - RNA, 13 nt, Salmonella enterica enterica serovar Typhi Ty2
ugccgccaucgcu

SEQ ID NO: 3727224 - RNA, 20 nt, Salmonella enterica enterica serovar Typhi Ty2
ugccgccauucgcuuccgcc

SEQ ID NO: 3727225 - RNA, 16 nt, Salmonella enterica enterica serovar Typhi Ty2
ugccgcccaggccaug

SEQ ID NO: 3727226 - RNA, 16 nt, Salmonella enterica enterica serovar Typhi Ty2
ugccgcccauccagag

SEQ ID NO: 3727227 - RNA, 19 nt, Salmonella enterica enterica serovar Typhi Ty2
ugccgccgcgaugcaucuu

SEQ ID NO: 3727228 - RNA, 18 nt, Salmonella enterica enterica serovar Typhi Ty2
ugccuucgccgccgcuga

SEQ ID NO: 3727229 - RNA, 18 nt, Salmonella enterica enterica serovar Typhi Ty2
ugccuucucugucgagca

SEQ ID NO: 3727230 - RNA, 15 nt, Salmonella enterica enterica serovar Typhi Ty2
ugccuucugaaaguu

SEQ ID NO: 3727231 - RNA, 21 nt, Salmonella enterica enterica serovar Typhi Ty2
ugccuucuguuuuuugccaca

SEQ ID NO: 3727232 - RNA, 16 nt, Salmonella enterica enterica serovar Typhi Ty2
ugccuugcgaauggag

SEQ ID NO: 3727233 - RNA, 22 nt, Salmonella enterica enterica serovar Typhi Ty2
ugccuuuuacaauaaccggcag

SEQ ID NO: 3727234 - RNA, 18 nt, Salmonella enterica enterica serovar Typhi Ty2
ugccuuuuugcagcgcgg

SEQ ID NO: 3727235 - RNA, 20 nt, Salmonella enterica enterica serovar Typhi Ty2
ugccuuuuuuaauuccggag

SEQ ID NO: 3727236 - RNA, 17 nt, Salmonella enterica enterica serovar Typhi Ty2
ugcgaaaaaaagcccga

SEQ ID NO: 3727237 - RNA, 13 nt, Salmonella enterica enterica serovar Typhi Ty2
ugcgaaaagccgg

SEQ ID NO: 3727238 - RNA, 12 nt, Salmonella enterica enterica serovar Typhi Ty2
ugcgaaacgucc

SEQ ID NO: 3727239 - RNA, 21 nt, Salmonella enterica enterica serovar Typhi Ty2
ugcgaacgauaccauccccuu

SEQ ID NO: 3727240 - RNA, 23 nt, Salmonella enterica enterica serovar Typhi Ty2
ugcgaagcgcccggaaagugggc

SEQ ID NO: 3727241 - RNA, 15 nt, Salmonella enterica enterica serovar Typhi Ty2
ugcgaauaaacacau

SEQ ID NO: 3727242 - RNA, 16 nt, Salmonella enterica enterica serovar Typhi Ty2
ugcgaauaacaucauc

SEQ ID NO: 3727243 - RNA, 18 nt, Salmonella enterica enterica serovar Typhi Ty2
ugcgaauaacaucauccg

SEQ ID NO: 3727244 - RNA, 13 nt, Salmonella enterica enterica serovar Typhi Ty2
ugcgaaucuucau

SEQ ID NO: 3727245 - RNA, 14 nt, Salmonella enterica enterica serovar Typhi Ty2
ugcgaaucuucauc

SEQ ID NO: 3727246 - RNA, 15 nt, Salmonella enterica enterica serovar Typhi Ty2
ugcgacaucagccag

SEQ ID NO: 3727247 - RNA, 21 nt, Salmonella enterica enterica serovar Typhi Ty2
ugcgacaucagccagccgcca

SEQ ID NO: 3727248 - RNA, 21 nt, Salmonella enterica enterica serovar Typhi Ty2
ugcgaccacggguagagcuuu

SEQ ID NO: 3727249 - RNA, 13 nt, Salmonella enterica enterica serovar Typhi Ty2
ugcgacgccagau

SEQ ID NO: 3727250 - RNA, 14 nt, Salmonella enterica enterica serovar Typhi Ty2
ugcgacgccaggcg

SEQ ID NO: 3727251 - RNA, 22 nt, Salmonella enterica enterica serovar Typhi Ty2
ugcgacgcgcucaccuccgcca

SEQ ID NO: 3727252 - RNA, 21 nt, Salmonella enterica enterica serovar Typhi Ty2
ugcgacucggugccgcugcug

SEQ ID NO: 3727253 - RNA, 18 nt, Salmonella enterica enterica serovar Typhi Ty2
ugcgacugaaaaucaaaa

SEQ ID NO: 3727254 - RNA, 12 nt, Salmonella enterica enterica serovar Typhi Ty2
ugcgagaaaaag

SEQ ID NO: 3727255 - RNA, 15 nt, Salmonella enterica enterica serovar Typhi Ty2
ugcgaggggccaaaa

SEQ ID NO: 3727256 - RNA, 15 nt, Salmonella enterica enterica serovar Typhi Ty2
ugcgaggucugguca

SEQ ID NO: 3727257 - RNA, 23 nt, Salmonella enterica enterica serovar Typhi Ty2
ugcgauaaugguugaacaggcug

SEQ ID NO: 3727258 - RNA, 16 nt, Salmonella enterica enterica serovar Typhi Ty2
ugcgauagcccggcau

SEQ ID NO: 3727259 - RNA, 17 nt, Salmonella enterica enterica serovar Typhi Ty2
ugcgauagcccggcaug

SEQ ID NO: 3727260 - RNA, 18 nt, Salmonella enterica enterica serovar Typhi Ty2
ugcgauagcccggcaugu

SEQ ID NO: 3727261 - RNA, 19 nt, Salmonella enterica enterica serovar Typhi Ty2
ugcgaucucauaccaggug

SEQ ID NO: 3727262 - RNA, 21 nt, Salmonella enterica enterica serovar Typhi Ty2
ugcgaucugugucguccaggc

SEQ ID NO: 3727263 - RNA, 14 nt, Salmonella enterica enterica serovar Typhi Ty2
ugcgauggccgcug

SEQ ID NO: 3727264 - RNA, 16 nt, Salmonella enterica enterica serovar Typhi Ty2
ugcgauggccgcugac

SEQ ID NO: 3727265 - RNA, 12 nt, Salmonella enterica enterica serovar Typhi Ty2
ugcgcaaacgua

SEQ ID NO: 3727266 - RNA, 12 nt, Salmonella enterica enterica serovar Typhi Ty2
ugcgcaaaugcc

SEQ ID NO: 3727267 - RNA, 15 nt, Salmonella enterica enterica serovar Typhi Ty2
ugcgcaaccuccgcg

SEQ ID NO: 3727268 - RNA, 18 nt, Salmonella enterica enterica serovar Typhi Ty2
ugcgcaacguuucuuuca

SEQ ID NO: 3727269 - RNA, 14 nt, Salmonella enterica enterica serovar Typhi Ty2
ugcgcaagaaacau

SEQ ID NO: 3727270 - RNA, 21 nt, Salmonella enterica enterica serovar Typhi Ty2
ugcgcaagcacugaaugcuga

SEQ ID NO: 3727271 - RNA, 13 nt, Salmonella enterica enterica serovar Typhi Ty2
ugcgcacgccagc

SEQ ID NO: 3727272 - RNA, 15 nt, Salmonella enterica enterica serovar Typhi Ty2
ugcgcacgccagcgg

SEQ ID NO: 3727273 - RNA, 22 nt, Salmonella enterica enterica serovar Typhi Ty2
ugcgcacgccagcggucgcgga

SEQ ID NO: 3727274 - RNA, 16 nt, Salmonella enterica enterica serovar Typhi Ty2
ugcgcacucagaaaau

SEQ ID NO: 3727275 - RNA, 18 nt, Salmonella enterica enterica serovar Typhi Ty2
ugcgcagccccagcgcca

SEQ ID NO: 3727276 - RNA, 20 nt, Salmonella enterica enterica serovar Typhi Ty2
ugcgcagccccagcgccagc

SEQ ID NO: 3727277 - RNA, 21 nt, Salmonella enterica enterica serovar Typhi Ty2
ugcgcagccccagcgccagcc

SEQ ID NO: 3727278 - RNA, 17 nt, Salmonella enterica enterica serovar Typhi Ty2
ugcgcagcguuuccaga

SEQ ID NO: 3727279 - RNA, 16 nt, Salmonella enterica enterica serovar Typhi Ty2
ugcgcaggccgcgccg

SEQ ID NO: 3727280 - RNA, 17 nt, Salmonella enterica enterica serovar Typhi Ty2
ugcgcauauuccggcga

SEQ ID NO: 3727281 - RNA, 16 nt, Salmonella enterica enterica serovar Typhi Ty2
ugcgcaucaccguuac

SEQ ID NO: 3727282 - RNA, 18 nt, Salmonella enterica enterica serovar Typhi Ty2
ugcgcauccucuuuccgu

SEQ ID NO: 3727283 - RNA, 14 nt, Salmonella enterica enterica serovar Typhi Ty2
ugcgccaaaucggu

SEQ ID NO: 3727284 - RNA, 14 nt, Salmonella enterica enterica serovar Typhi Ty2
ugcgccacaucauu

SEQ ID NO: 3727285 - RNA, 13 nt, Salmonella enterica enterica serovar Typhi Ty2
ugcgccaccagcg

SEQ ID NO: 3727286 - RNA, 20 nt, Salmonella enterica enterica serovar Typhi Ty2
ugcgccaccagcgcaguaaa

SEQ ID NO: 3727287 - RNA, 13 nt, Salmonella enterica enterica serovar Typhi Ty2
ugcgccacggaug

SEQ ID NO: 3727288 - RNA, 20 nt, Salmonella enterica enterica serovar Typhi Ty2
ugcgccacguucggcgugua

SEQ ID NO: 3727289 - RNA, 12 nt, Salmonella enterica enterica serovar Typhi Ty2
ugcgccagauca

SEQ ID NO: 3727290 - RNA, 13 nt, Salmonella enterica enterica serovar Typhi Ty2
ugcgccagauuca

SEQ ID NO: 3727291 - RNA, 21 nt, Salmonella enterica enterica serovar Typhi Ty2
ugcgccagcccggcgaaagcg

SEQ ID NO: 3727292 - RNA, 15 nt, Salmonella enterica enterica serovar Typhi Ty2
ugcgccagccugcug

SEQ ID NO: 3727293 - RNA, 18 nt, Salmonella enterica enterica serovar Typhi Ty2
ugcgccagccugcugguc

SEQ ID NO: 3727294 - RNA, 13 nt, Salmonella enterica enterica serovar Typhi Ty2
ugcgccagcgccg

SEQ ID NO: 3727295 - RNA, 15 nt, Salmonella enterica enterica serovar Typhi Ty2
ugcgccaggcagcac

SEQ ID NO: 3727296 - RNA, 19 nt, Salmonella enterica enterica serovar Typhi Ty2
ugcgccaggcccagccgcu

SEQ ID NO: 3727297 - RNA, 22 nt, Salmonella enterica enterica serovar Typhi Ty2
ugcgccauauaggcauguuccu

SEQ ID NO: 3727298 - RNA, 16 nt, Salmonella enterica enterica serovar Typhi Ty2
ugcgccaucauccggc

SEQ ID NO: 3727299 - RNA, 22 nt, Salmonella enterica enterica serovar Typhi Ty2
ugcgccauccaccaggcaugca

SEQ ID NO: 3727300 - RNA, 15 nt, Salmonella enterica enterica serovar Typhi Ty2
ugcgccaucgggccg

SEQ ID NO: 3727301 - RNA, 14 nt, Salmonella enterica enterica serovar Typhi Ty2
ugcgcccacaauga

SEQ ID NO: 3727302 - RNA, 21 nt, Salmonella enterica enterica serovar Typhi Ty2
ugcgcccagcccggaaauaaa

SEQ ID NO: 3727303 - RNA, 19 nt, Salmonella enterica enterica serovar Typhi Ty2
ugcgcccaucaucaucggc

SEQ ID NO: 3727304 - RNA, 18 nt, Salmonella enterica enterica serovar Typhi Ty2
ugcgcccaugacaugaaa

SEQ ID NO: 3727305 - RNA, 17 nt, Salmonella enterica enterica serovar Typhi Ty2
ugcgccccuugcagcaa

SEQ ID NO: 3727306 - RNA, 17 nt, Salmonella enterica enterica serovar Typhi Ty2
ugcgcccuuccgucagc

SEQ ID NO: 3727307 - RNA, 23 nt, Salmonella enterica enterica serovar Typhi Ty2
ugcgccgacggaacccagcaaau

SEQ ID NO: 3727308 - RNA, 14 nt, Salmonella enterica enterica serovar Typhi Ty2
ugcgccgccaggca

SEQ ID NO: 3727309 - RNA, 16 nt, Salmonella enterica enterica serovar Typhi Ty2
ugcgccgccauccggc

SEQ ID NO: 3727310 - RNA, 16 nt, Salmonella enterica enterica serovar Typhi Ty2
ugcguaaaaucgcagu

SEQ ID NO: 3727311 - RNA, 21 nt, Salmonella enterica enterica serovar Typhi Ty2
ugcguaauacggagcaaaaaa

SEQ ID NO: 3727312 - RNA, 17 nt, Salmonella enterica enterica serovar Typhi Ty2
ugcguaaucagcuuuuc

SEQ ID NO: 3727313 - RNA, 17 nt, Salmonella enterica enterica serovar Typhi Ty2
ugcguaauccggccugg

SEQ ID NO: 3727314 - RNA, 14 nt, Salmonella enterica enterica serovar Typhi Ty2
ugcguacucagcag

SEQ ID NO: 3727315 - RNA, 20 nt, Salmonella enterica enterica serovar Typhi Ty2
ugcguagaucauuuacggcg

SEQ ID NO: 3727316 - RNA, 16 nt, Salmonella enterica enterica serovar Typhi Ty2
ugcguaucgcccaccg

SEQ ID NO: 3727317 - RNA, 14 nt, Salmonella enterica enterica serovar Typhi Ty2
ugcguauugagcgc

SEQ ID NO: 3727318 - RNA, 13 nt, Salmonella enterica enterica serovar Typhi Ty2
ugcguauuuccac

SEQ ID NO: 3727319 - RNA, 11 nt, Salmonella enterica enterica serovar Typhi Ty2
ugcgucaacgc

SEQ ID NO: 3727320 - RNA, 23 nt, Salmonella enterica enterica serovar Typhi Ty2
ugcgucaaucaggaaagagccgc

SEQ ID NO: 3727321 - RNA, 24 nt, Salmonella enterica enterica serovar Typhi Ty2
ugcgucaggcgauagccguccaug

SEQ ID NO: 3727322 - RNA, 23 nt, Salmonella enterica enterica serovar Typhi Ty2
ugcgucaugauuaacgucacgau

SEQ ID NO: 3727323 - RNA, 18 nt, Salmonella enterica enterica serovar Typhi Ty2
ugcgucaugcuuuuuuuc

SEQ ID NO: 3727324 - RNA, 14 nt, Salmonella enterica enterica serovar Typhi Ty2
ugcguccgccgcua

SEQ ID NO: 3727325 - RNA, 20 nt, Salmonella enterica enterica serovar Typhi Ty2
ugcgucgcgcuuucaaucgu

SEQ ID NO: 3727326 - RNA, 20 nt, Salmonella enterica enterica serovar Typhi Ty2
ugcgucgcguaccagcgccc

SEQ ID NO: 3727327 - RNA, 23 nt, Salmonella enterica enterica serovar Typhi Ty2
ugcgucguuggcauggucagcau

SEQ ID NO: 3727328 - RNA, 17 nt, Salmonella enterica enterica serovar Typhi Ty2
ugcgugacaaucuccuc

SEQ ID NO: 3727329 - RNA, 21 nt, Salmonella enterica enterica serovar Typhi Ty2
ugcgugcgccgugaaauaucc

SEQ ID NO: 3727330 - RNA, 16 nt, Salmonella enterica enterica serovar Typhi Ty2
ugcgugcuggcggccg

SEQ ID NO: 3727331 - RNA, 14 nt, Salmonella enterica enterica serovar Typhi Ty2
ugcgugucaucaaa

SEQ ID NO: 3727332 - RNA, 19 nt, Salmonella enterica enterica serovar Typhi Ty2
ugcguuaacccgcuuacaa

SEQ ID NO: 3727333 - RNA, 20 nt, Salmonella enterica enterica serovar Typhi Ty2
ugcguucacagcaccauguu

SEQ ID NO: 3727334 - RNA, 20 nt, Salmonella enterica enterica serovar Typhi Ty2
ugcguucaggcggcaaaaaa

SEQ ID NO: 3727335 - RNA, 16 nt, Salmonella enterica enterica serovar Typhi Ty2
ugcguucauggcgcga

SEQ ID NO: 3727336 - RNA, 12 nt, Salmonella enterica enterica serovar Typhi Ty2
ugcguucuucca

SEQ ID NO: 3727337 - RNA, 13 nt, Salmonella enterica enterica serovar Typhi Ty2
ugcguucuuccac

SEQ ID NO: 3727338 - RNA, 21 nt, Salmonella enterica enterica serovar Typhi Ty2
ugcguucuuccacuucagcag

SEQ ID NO: 3727339 - RNA, 20 nt, Salmonella enterica enterica serovar Typhi Ty2
ugcguugcgcgcgucacaau

SEQ ID NO: 3727340 - RNA, 16 nt, Salmonella enterica enterica serovar Typhi Ty2
ugcguugucgcugauu

SEQ ID NO: 3727341 - RNA, 13 nt, Salmonella enterica enterica serovar Typhi Ty2
ugcguuguggacg

SEQ ID NO: 3727342 - RNA, 21 nt, Salmonella enterica enterica serovar Typhi Ty2
ugcguuuaaagagaugacugg

SEQ ID NO: 3727343 - RNA, 19 nt, Salmonella enterica enterica serovar Typhi Ty2
ugcguuuaucaggccuaca

SEQ ID NO: 3727344 - RNA, 18 nt, Salmonella enterica enterica serovar Typhi Ty2
ugcguuuugugcggccua

SEQ ID NO: 3727345 - RNA, 20 nt, Salmonella enterica enterica serovar Typhi Ty2
ugcguuuuuucgguaaucgc

SEQ ID NO: 3727346 - RNA, 22 nt, Salmonella enterica enterica serovar Typhi Ty2
ugcuacaggcaaguuuaauucc

SEQ ID NO: 3727347 - RNA, 12 nt, Salmonella enterica enterica serovar Typhi Ty2
ugcuacgcgcca

SEQ ID NO: 3727348 - RNA, 22 nt, Salmonella enterica enterica serovar Typhi Ty2
ugcuagaacauuucccgaaaaa

SEQ ID NO: 3727349 - RNA, 19 nt, Salmonella enterica enterica serovar Typhi Ty2
ugcuauaugcaggcauaaa

SEQ ID NO: 3727350 - RNA, 14 nt, Salmonella enterica enterica serovar Typhi Ty2
ugcuaucaaacuga

SEQ ID NO: 3727351 - RNA, 19 nt, Salmonella enterica enterica serovar Typhi Ty2
ugcuaucaaacugaaaauc

SEQ ID NO: 3727352 - RNA, 12 nt, Salmonella enterica enterica serovar Typhi Ty2
ugcuaucaggau

SEQ ID NO: 3727353 - RNA, 16 nt, Salmonella enterica enterica serovar Typhi Ty2
ugcuauccgccgccag

SEQ ID NO: 3727354 - RNA, 16 nt, Salmonella enterica enterica serovar Typhi Ty2
ugcucaaaggcgcuga

SEQ ID NO: 3727355 - RNA, 21 nt, Salmonella enterica enterica serovar Typhi Ty2
ugcucaaccaguaccgggccu

SEQ ID NO: 3727356 - RNA, 22 nt, Salmonella enterica enterica serovar Typhi Ty2
ugcucaaccaguaccgggccuc

SEQ ID NO: 3727357 - RNA, 12 nt, Salmonella enterica enterica serovar Typhi Ty2
ugcucaauaagc

SEQ ID NO: 3727358 - RNA, 18 nt, Salmonella enterica enterica serovar Typhi Ty2
ugcucaauaagccaugug

SEQ ID NO: 3727359 - RNA, 21 nt, Salmonella enterica enterica serovar Typhi Ty2
ugcucaauacuuuccgggccg

SEQ ID NO: 3727360 - RNA, 16 nt, Salmonella enterica enterica serovar Typhi Ty2
ugcucaaucgcaugac

SEQ ID NO: 3727361 - RNA, 11 nt, Salmonella enterica enterica serovar Typhi Ty2
ugcucaaugau

SEQ ID NO: 3727362 - RNA, 10 nt, Salmonella enterica enterica serovar Typhi Ty2
ugcucaccca

SEQ ID NO: 3727363 - RNA, 22 nt, Salmonella enterica enterica serovar Typhi Ty2
ugcucacccauuuuauccucuu

SEQ ID NO: 3727364 - RNA, 23 nt, Salmonella enterica enterica serovar Typhi Ty2
ugcucacccauuuuauccucuuc

SEQ ID NO: 3727365 - RNA, 12 nt, Salmonella enterica enterica serovar Typhi Ty2
ugcucagccccu

SEQ ID NO: 3727366 - RNA, 19 nt, Salmonella enterica enterica serovar Typhi Ty2
ugcucagcuuguagaaagg

SEQ ID NO: 3727367 - RNA, 16 nt, Salmonella enterica enterica serovar Typhi Ty2
ugcucaggaucaauuc

SEQ ID NO: 3727368 - RNA, 13 nt, Salmonella enterica enterica serovar Typhi Ty2
ugcucauauugug

SEQ ID NO: 3727369 - RNA, 18 nt, Salmonella enterica enterica serovar Typhi Ty2
ugcucaucgacagaacgg

SEQ ID NO: 3727370 - RNA, 21 nt, Salmonella enterica enterica serovar Typhi Ty2
ugcucaugacaucgcccuggg

SEQ ID NO: 3727371 - RNA, 23 nt, Salmonella enterica enterica serovar Typhi Ty2
ugcucaugcgagguauacgccac

SEQ ID NO: 3727372 - RNA, 16 nt, Salmonella enterica enterica serovar Typhi Ty2
ugcuccaguuguucca

SEQ ID NO: 3727373 - RNA, 20 nt, Salmonella enterica enterica serovar Typhi Ty2
ugcuccaguuguuccagcag

SEQ ID NO: 3727374 - RNA, 14 nt, Salmonella enterica enterica serovar Typhi Ty2
ugcuccaugcuguc

SEQ ID NO: 3727375 - RNA, 19 nt, Salmonella enterica enterica serovar Typhi Ty2
ugcuccauugcagcguggu

SEQ ID NO: 3727376 - RNA, 14 nt, Salmonella enterica enterica serovar Typhi Ty2
ugcuccgccagcaa

SEQ ID NO: 3727377 - RNA, 22 nt, Salmonella enterica enterica serovar Typhi Ty2
ugcuccggcuuaaugcccggcc

SEQ ID NO: 3727378 - RNA, 17 nt, Salmonella enterica enterica serovar Typhi Ty2
ugcuccugcggcgugga

SEQ ID NO: 3727379 - RNA, 14 nt, Salmonella enterica enterica serovar Typhi Ty2
ugcucgacaauaaa

SEQ ID NO: 3727380 - RNA, 18 nt, Salmonella enterica enterica serovar Typhi Ty2
ugcucgccauaaaucccg

SEQ ID NO: 3727381 - RNA, 21 nt, Salmonella enterica enterica serovar Typhi Ty2
ugcucgcuaugaaaacgcagc

SEQ ID NO: 3727382 - RNA, 20 nt, Salmonella enterica enterica serovar Typhi Ty2
ugcucggcggucagccacau

SEQ ID NO: 3727383 - RNA, 20 nt, Salmonella enterica enterica serovar Typhi Ty2
ugcucguaaagcaucagacu

SEQ ID NO: 3727384 - RNA, 22 nt, Salmonella enterica enterica serovar Typhi Ty2
ugcucguaaagcaucagacuac

SEQ ID NO: 3727385 - RNA, 19 nt, Salmonella enterica enterica serovar Typhi Ty2
ugcucguagcguuuaaaga

SEQ ID NO: 3727386 - RNA, 23 nt, Salmonella enterica enterica serovar Typhi Ty2
ugcucgucggcaauuugacuaca

SEQ ID NO: 3727387 - RNA, 23 nt, Salmonella enterica enterica serovar Typhi Ty2
ugcucucccagcugagcuaauca

SEQ ID NO: 3727388 - RNA, 14 nt, Salmonella enterica enterica serovar Typhi Ty2
ugcucuccuggcau

SEQ ID NO: 3727389 - RNA, 16 nt, Salmonella enterica enterica serovar Typhi Ty2
ugcucuucguggaacu

SEQ ID NO: 3727390 - RNA, 13 nt, Salmonella enterica enterica serovar Typhi Ty2
ugcucuuuaacaa

SEQ ID NO: 3727391 - RNA, 15 nt, Salmonella enterica enterica serovar Typhi Ty2
ugcugaaaugauaag

SEQ ID NO: 3727392 - RNA, 23 nt, Salmonella enterica enterica serovar Typhi Ty2
ugcuucgccacgaccuacaccgu

SEQ ID NO: 3727393 - RNA, 16 nt, Salmonella enterica enterica serovar Typhi Ty2
ugcuucgucccugcau

SEQ ID NO: 3727394 - RNA, 20 nt, Salmonella enterica enterica serovar Typhi Ty2
ugcuucguggcaaucagcaa

SEQ ID NO: 3727395 - RNA, 13 nt, Salmonella enterica enterica serovar Typhi Ty2
ugcuucucuucaa

SEQ ID NO: 3727396 - RNA, 19 nt, Salmonella enterica enterica serovar Typhi Ty2
ugcuuuaaaugccuguuua

SEQ ID NO: 3727397 - RNA, 12 nt, Salmonella enterica enterica serovar Typhi Ty2
ugcuuuaauauu

SEQ ID NO: 3727398 - RNA, 13 nt, Salmonella enterica enterica serovar Typhi Ty2
ugcuuuauaaaaa

SEQ ID NO: 3727399 - RNA, 15 nt, Salmonella enterica enterica serovar Typhi Ty2
ugcuuucuccugcgg

SEQ ID NO: 3727400 - RNA, 15 nt, Salmonella enterica enterica serovar Typhi Ty2
ugcuuucuggaugau

SEQ ID NO: 3727401 - RNA, 12 nt, Salmonella enterica enterica serovar Typhi Ty2
ugcuuugcggca

SEQ ID NO: 3727402 - RNA, 21 nt, Salmonella enterica enterica serovar Typhi Ty2
ugcuuuuaauagcguagccug

SEQ ID NO: 3727403 - RNA, 16 nt, Salmonella enterica enterica serovar Typhi Ty2
ugcuuuuuauuuuucu

SEQ ID NO: 3727404 - RNA, 21 nt, Salmonella enterica enterica serovar Typhi Ty2
ugcuuuuucagcgaggaaaac

SEQ ID NO: 3727405 - RNA, 17 nt, Salmonella enterica enterica serovar Typhi Ty2
ugcuuuuuuucucuguc

SEQ ID NO: 3727406 - RNA, 12 nt, Salmonella enterica enterica serovar Typhi Ty2
uggaaaaaaaga

SEQ ID NO: 3727407 - RNA, 13 nt, Salmonella enterica enterica serovar Typhi Ty2
uggaaaaaaagaa

SEQ ID NO: 3727408 - RNA, 22 nt, Salmonella enterica enterica serovar Typhi Ty2
uggaaaaaucuguaggcccggu

SEQ ID NO: 3727409 - RNA, 21 nt, Salmonella enterica enterica serovar Typhi Ty2
uggaaaacagcauaauaaagc

SEQ ID NO: 3727410 - RNA, 22 nt, Salmonella enterica enterica serovar Typhi Ty2
uggaaaacagcauaauaaagca

SEQ ID NO: 3727411 - RNA, 17 nt, Salmonella enterica enterica serovar Typhi Ty2
uggaaaaccccaucccg

SEQ ID NO: 3727412 - RNA, 22 nt, Salmonella enterica enterica serovar Typhi Ty2
uggaaaaccccaucccggcaac

SEQ ID NO: 3727413 - RNA, 15 nt, Salmonella enterica enterica serovar Typhi Ty2
uggaaaauaauaauc

SEQ ID NO: 3727414 - RNA, 15 nt, Salmonella enterica enterica serovar Typhi Ty2
uggaaaaucacgcug

SEQ ID NO: 3727415 - RNA, 14 nt, Salmonella enterica enterica serovar Typhi Ty2
uggaaaauuucagu

SEQ ID NO: 3727416 - RNA, 14 nt, Salmonella enterica enterica serovar Typhi Ty2
uggaaaccgcagaa

SEQ ID NO: 3727417 - RNA, 16 nt, Salmonella enterica enterica serovar Typhi Ty2
uggaaacuaugcaaaa

SEQ ID NO: 3727418 - RNA, 17 nt, Salmonella enterica enterica serovar Typhi Ty2
uggaaacuccagcggca

SEQ ID NO: 3727419 - RNA, 19 nt, Salmonella enterica enterica serovar Typhi Ty2
uggaaauaaucuguagauu

SEQ ID NO: 3727420 - RNA, 15 nt, Salmonella enterica enterica serovar Typhi Ty2
uggaaauauucucag

SEQ ID NO: 3727421 - RNA, 18 nt, Salmonella enterica enterica serovar Typhi Ty2
uggaaauauucucagcca

SEQ ID NO: 3727422 - RNA, 15 nt, Salmonella enterica enterica serovar Typhi Ty2
uggaaauucagggug

SEQ ID NO: 3727423 - RNA, 23 nt, Salmonella enterica enterica serovar Typhi Ty2
uggaacagauguuuacgcugcuc

SEQ ID NO: 3727424 - RNA, 19 nt, Salmonella enterica enterica serovar Typhi Ty2
uggaacaggccaaacccug

SEQ ID NO: 3727425 - RNA, 18 nt, Salmonella enterica enterica serovar Typhi Ty2
uggaaccaaacaccagau

SEQ ID NO: 3727426 - RNA, 14 nt, Salmonella enterica enterica serovar Typhi Ty2
uggaaccaggcgcg

SEQ ID NO: 3727427 - RNA, 15 nt, Salmonella enterica enterica serovar Typhi Ty2
uggaaccgccggaga

SEQ ID NO: 3727428 - RNA, 15 nt, Salmonella enterica enterica serovar Typhi Ty2
uggaacgcauccagc

SEQ ID NO: 3727429 - RNA, 21 nt, Salmonella enterica enterica serovar Typhi Ty2
uggaagcguuacuggccuucu

SEQ ID NO: 3727430 - RNA, 19 nt, Salmonella enterica enterica serovar Typhi Ty2
uggaaggaagggcgcugcc

SEQ ID NO: 3727431 - RNA, 22 nt, Salmonella enterica enterica serovar Typhi Ty2
uggaaguaugccucgcgcacca

SEQ ID NO: 3727432 - RNA, 18 nt, Salmonella enterica enterica serovar Typhi Ty2
uggaauaaacgguaagag

SEQ ID NO: 3727433 - RNA, 22 nt, Salmonella enterica enterica serovar Typhi Ty2
uggaaucaauuucccuucaauc

SEQ ID NO: 3727434 - RNA, 16 nt, Salmonella enterica enterica serovar Typhi Ty2
uggaaucauccaccag

SEQ ID NO: 3727435 - RNA, 14 nt, Salmonella enterica enterica serovar Typhi Ty2
uggaaugagcaucu

SEQ ID NO: 3727436 - RNA, 15 nt, Salmonella enterica enterica serovar Typhi Ty2
uggaaugcccacucc

SEQ ID NO: 3727437 - RNA, 24 nt, Salmonella enterica enterica serovar Typhi Ty2
uggaauuugucgucaugcgccagg

SEQ ID NO: 3727438 - RNA, 14 nt, Salmonella enterica enterica serovar Typhi Ty2
uggaauuuuuccag

SEQ ID NO: 3727439 - RNA, 13 nt, Salmonella enterica enterica serovar Typhi Ty2
uggacaaggcacc

SEQ ID NO: 3727440 - RNA, 15 nt, Salmonella enterica enterica serovar Typhi Ty2
uggacaauccgcgaa

SEQ ID NO: 3727441 - RNA, 13 nt, Salmonella enterica enterica serovar Typhi Ty2
uggacgaggaaaa

SEQ ID NO: 3727442 - RNA, 13 nt, Salmonella enterica enterica serovar Typhi Ty2
uggacggcaucag

SEQ ID NO: 3727443 - RNA, 16 nt, Salmonella enterica enterica serovar Typhi Ty2
uggacggcaucaggaa

SEQ ID NO: 3727444 - RNA, 14 nt, Salmonella enterica enterica serovar Typhi Ty2
uggacgucaugccg

SEQ ID NO: 3727445 - RNA, 16 nt, Salmonella enterica enterica serovar Typhi Ty2
uggagaucagcauggu

SEQ ID NO: 3727446 - RNA, 16 nt, Salmonella enterica enterica serovar Typhi Ty2
uggaggguaagaaagu

SEQ ID NO: 3727447 - RNA, 13 nt, Salmonella enterica enterica serovar Typhi Ty2
uggagguuguuuu

SEQ ID NO: 3727448 - RNA, 15 nt, Salmonella enterica enterica serovar Typhi Ty2
uggagguuucuucau

SEQ ID NO: 3727449 - RNA, 20 nt, Salmonella enterica enterica serovar Typhi Ty2
uggaguacgggcagaugguc

SEQ ID NO: 3727450 - RNA, 18 nt, Salmonella enterica enterica serovar Typhi Ty2
uggaguagauguagcuga

SEQ ID NO: 3727451 - RNA, 14 nt, Salmonella enterica enterica serovar Typhi Ty2
uggagucugaaaau

SEQ ID NO: 3727452 - RNA, 23 nt, Salmonella enterica enterica serovar Typhi Ty2
uggaguuaucauuauauagucuu

SEQ ID NO: 3727453 - RNA, 18 nt, Salmonella enterica enterica serovar Typhi Ty2
uggauaaagccaauggug

SEQ ID NO: 3727454 - RNA, 15 nt, Salmonella enterica enterica serovar Typhi Ty2
uggauaacagcgcgg

SEQ ID NO: 3727455 - RNA, 19 nt, Salmonella enterica enterica serovar Typhi Ty2
uggauaacgaaaaggguca

SEQ ID NO: 3727456 - RNA, 23 nt, Salmonella enterica enterica serovar Typhi Ty2
uggauaagacgacgguuaaaaag

SEQ ID NO: 3727457 - RNA, 18 nt, Salmonella enterica enterica serovar Typhi Ty2
uggauaauugcucugcca

SEQ ID NO: 3727458 - RNA, 19 nt, Salmonella enterica enterica serovar Typhi Ty2
uggauaauugcucugccag

SEQ ID NO: 3727459 - RNA, 14 nt, Salmonella enterica enterica serovar Typhi Ty2
uggauaccgcgcca

SEQ ID NO: 3727460 - RNA, 20 nt, Salmonella enterica enterica serovar Typhi Ty2
uggauagcaccauaaacggc

SEQ ID NO: 3727461 - RNA, 15 nt, Salmonella enterica enterica serovar Typhi Ty2
uggauauucaucgcc

SEQ ID NO: 3727462 - RNA, 23 nt, Salmonella enterica enterica serovar Typhi Ty2
uggauauuccaguuaucacggua

SEQ ID NO: 3727463 - RNA, 20 nt, Salmonella enterica enterica serovar Typhi Ty2
uggaucacuuuugccgucag

SEQ ID NO: 3727464 - RNA, 18 nt, Salmonella enterica enterica serovar Typhi Ty2
uggaucagacgccgcgcu

SEQ ID NO: 3727465 - RNA, 16 nt, Salmonella enterica enterica serovar Typhi Ty2
uggaucaucggcucag

SEQ ID NO: 3727466 - RNA, 16 nt, Salmonella enterica enterica serovar Typhi Ty2
uggaucccccuggccc

SEQ ID NO: 3727467 - RNA, 13 nt, Salmonella enterica enterica serovar Typhi Ty2
uggaugaacucaa

SEQ ID NO: 3727468 - RNA, 23 nt, Salmonella enterica enterica serovar Typhi Ty2
uggaugcccaccugaaaaagggu

SEQ ID NO: 3727469 - RNA, 17 nt, Salmonella enterica enterica serovar Typhi Ty2
uggaugcgcugaauagc

SEQ ID NO: 3727470 - RNA, 22 nt, Salmonella enterica enterica serovar Typhi Ty2
uggaugcgcugaauagcgcugc

SEQ ID NO: 3727471 - RNA, 15 nt, Salmonella enterica enterica serovar Typhi Ty2
uggauggacuguuuc

SEQ ID NO: 3727472 - RNA, 22 nt, Salmonella enterica enterica serovar Typhi Ty2
uggaugguuucuucgcuggcgg

SEQ ID NO: 3727473 - RNA, 22 nt, Salmonella enterica enterica serovar Typhi Ty2
uggauuaaaaaaggcagaagaa

SEQ ID NO: 3727474 - RNA, 16 nt, Salmonella enterica enterica serovar Typhi Ty2
uggccucccaguuccc

SEQ ID NO: 3727475 - RNA, 14 nt, Salmonella enterica enterica serovar Typhi Ty2
uggccucugccagu

SEQ ID NO: 3727476 - RNA, 20 nt, Salmonella enterica enterica serovar Typhi Ty2
uggccucugccaguugcuca

SEQ ID NO: 3727477 - RNA, 15 nt, Salmonella enterica enterica serovar Typhi Ty2
uggccugcucaucag

SEQ ID NO: 3727478 - RNA, 11 nt, Salmonella enterica enterica serovar Typhi Ty2
uggccugcugg

SEQ ID NO: 3727479 - RNA, 12 nt, Salmonella enterica enterica serovar Typhi Ty2
uggccuucuuuc

SEQ ID NO: 3727480 - RNA, 20 nt, Salmonella enterica enterica serovar Typhi Ty2
uggcgaacagccccaccgcc

SEQ ID NO: 3727481 - RNA, 21 nt, Salmonella enterica enterica serovar Typhi Ty2
uggcgaauaaaauucagcgca

SEQ ID NO: 3727482 - RNA, 22 nt, Salmonella enterica enterica serovar Typhi Ty2
uggcgaauccuaaacucaacug

SEQ ID NO: 3727483 - RNA, 17 nt, Salmonella enterica enterica serovar Typhi Ty2
uggcgaauuuacgggcg

SEQ ID NO: 3727484 - RNA, 16 nt, Salmonella enterica enterica serovar Typhi Ty2
uggcgacacuugcgca

SEQ ID NO: 3727485 - RNA, 15 nt, Salmonella enterica enterica serovar Typhi Ty2
uggcgaccagcagau

SEQ ID NO: 3727486 - RNA, 17 nt, Salmonella enterica enterica serovar Typhi Ty2
uggcgaccggcagccgu

SEQ ID NO: 3727487 - RNA, 15 nt, Salmonella enterica enterica serovar Typhi Ty2
uggcgaccgggucga

SEQ ID NO: 3727488 - RNA, 16 nt, Salmonella enterica enterica serovar Typhi Ty2
uggcgacgaccgguca

SEQ ID NO: 3727489 - RNA, 21 nt, Salmonella enterica enterica serovar Typhi Ty2
uggcgacgacgcuguuuaugc

SEQ ID NO: 3727490 - RNA, 14 nt, Salmonella enterica enterica serovar Typhi Ty2
uggcgacgccagcc

SEQ ID NO: 3727491 - RNA, 21 nt, Salmonella enterica enterica serovar Typhi Ty2
uggcgacgccagccggaaaag

SEQ ID NO: 3727492 - RNA, 21 nt, Salmonella enterica enterica serovar Typhi Ty2
uggcgacuaacgucuuauccg

SEQ ID NO: 3727493 - RNA, 20 nt, Salmonella enterica enterica serovar Typhi Ty2
uggcgacuaccucuuauccg

SEQ ID NO: 3727494 - RNA, 13 nt, Salmonella enterica enterica serovar Typhi Ty2
uggcgagcaacuu

SEQ ID NO: 3727495 - RNA, 22 nt, Salmonella enterica enterica serovar Typhi Ty2
uggcgauaauagaaccgaauaa

SEQ ID NO: 3727496 - RNA, 16 nt, Salmonella enterica enterica serovar Typhi Ty2
uggcgauauccgugcc

SEQ ID NO: 3727497 - RNA, 17 nt, Salmonella enterica enterica serovar Typhi Ty2
uggcgauauccgugccg

SEQ ID NO: 3727498 - RNA, 16 nt, Salmonella enterica enterica serovar Typhi Ty2
uggcgaucagcgccac

SEQ ID NO: 3727499 - RNA, 20 nt, Salmonella enterica enterica serovar Typhi Ty2
uggcgaucagcgccaccaca

SEQ ID NO: 3727500 - RNA, 21 nt, Salmonella enterica enterica serovar Typhi Ty2
uggcgaugcuaucgguagugu

SEQ ID NO: 3727501 - RNA, 13 nt, Salmonella enterica enterica serovar Typhi Ty2
uggcgauuuccag

SEQ ID NO: 3727502 - RNA, 16 nt, Salmonella enterica enterica serovar Typhi Ty2
uggcgauuucggugac

SEQ ID NO: 3727503 - RNA, 19 nt, Salmonella enterica enterica serovar Typhi Ty2
uggcgauuuucauagcugg

SEQ ID NO: 3727504 - RNA, 15 nt, Salmonella enterica enterica serovar Typhi Ty2
uggcgcaaugucccu

SEQ ID NO: 3727505 - RNA, 18 nt, Salmonella enterica enterica serovar Typhi Ty2
uggcgcacaucgugcgcc

SEQ ID NO: 3727506 - RNA, 19 nt, Salmonella enterica enterica serovar Typhi Ty2
uggcgcagcauacgcugca

SEQ ID NO: 3727507 - RNA, 13 nt, Salmonella enterica enterica serovar Typhi Ty2
uggcgcagcgcgg

SEQ ID NO: 3727508 - RNA, 12 nt, Salmonella enterica enterica serovar Typhi Ty2
uggcgcagcgcu

SEQ ID NO: 3727509 - RNA, 15 nt, Salmonella enterica enterica serovar Typhi Ty2
uggcgccagccuguc

SEQ ID NO: 3727510 - RNA, 18 nt, Salmonella enterica enterica serovar Typhi Ty2
uggcgccgcaaaccagac

SEQ ID NO: 3727511 - RNA, 21 nt, Salmonella enterica enterica serovar Typhi Ty2
uggcgccuuuuggcagcagcg

SEQ ID NO: 3727512 - RNA, 20 nt, Salmonella enterica enterica serovar Typhi Ty2
uggcgcgaagugccagguuu

SEQ ID NO: 3727513 - RNA, 21 nt, Salmonella enterica enterica serovar Typhi Ty2
uggcgcgaucaguucuugcag

SEQ ID NO: 3727514 - RNA, 23 nt, Salmonella enterica enterica serovar Typhi Ty2
uggcgcggacgcuuaccgggccu

SEQ ID NO: 3727515 - RNA, 17 nt, Salmonella enterica enterica serovar Typhi Ty2
uggcgcgucacaacagc

SEQ ID NO: 3727516 - RNA, 21 nt, Salmonella enterica enterica serovar Typhi Ty2
uggcgcgucuguguuuauccg

SEQ ID NO: 3727517 - RNA, 18 nt, Salmonella enterica enterica serovar Typhi Ty2
uggcgcuaaaauccacuc

SEQ ID NO: 3727518 - RNA, 16 nt, Salmonella enterica enterica serovar Typhi Ty2
uggcgcuaagacguga

SEQ ID NO: 3727519 - RNA, 19 nt, Salmonella enterica enterica serovar Typhi Ty2
uggcgcuaaugcuuauccg

SEQ ID NO: 3727520 - RNA, 18 nt, Salmonella enterica enterica serovar Typhi Ty2
uggcgcuacgcuuaucag

SEQ ID NO: 3727521 - RNA, 18 nt, Salmonella enterica enterica serovar Typhi Ty2
uggcgcuacgcuuauccg

SEQ ID NO: 3727522 - RNA, 16 nt, Salmonella enterica enterica serovar Typhi Ty2
uggcgcucagcgccgu

SEQ ID NO: 3727523 - RNA, 16 nt, Salmonella enterica enterica serovar Typhi Ty2
uggcgcuccugaaucg

SEQ ID NO: 3727524 - RNA, 17 nt, Salmonella enterica enterica serovar Typhi Ty2
uggcgcucggaugugca

SEQ ID NO: 3727525 - RNA, 19 nt, Salmonella enterica enterica serovar Typhi Ty2
uggcgcugccgcuuauccg

SEQ ID NO: 3727526 - RNA, 16 nt, Salmonella enterica enterica serovar Typhi Ty2
uggcgcugcgcuuacc

SEQ ID NO: 3727527 - RNA, 18 nt, Salmonella enterica enterica serovar Typhi Ty2
uggcgcugcgcuuaucag

SEQ ID NO: 3727528 - RNA, 18 nt, Salmonella enterica enterica serovar Typhi Ty2
uggcgcuguucuugcugc

SEQ ID NO: 3727529 - RNA, 21 nt, Salmonella enterica enterica serovar Typhi Ty2
uggcgcuguucuugcugcugc

SEQ ID NO: 3727530 - RNA, 17 nt, Salmonella enterica enterica serovar Typhi Ty2
uggcgcuuaauacgcga

SEQ ID NO: 3727531 - RNA, 18 nt, Salmonella enterica enterica serovar Typhi Ty2
uggcgcuuugcuuauccg

SEQ ID NO: 3727532 - RNA, 13 nt, Salmonella enterica enterica serovar Typhi Ty2
uggcgcuuuucca

SEQ ID NO: 3727533 - RNA, 14 nt, Salmonella enterica enterica serovar Typhi Ty2
uggcggaaagaagc

SEQ ID NO: 3727534 - RNA, 19 nt, Salmonella enterica enterica serovar Typhi Ty2
uggcggaauaucgcggaaa

SEQ ID NO: 3727535 - RNA, 22 nt, Salmonella enterica enterica serovar Typhi Ty2
uggcggacccaaaagaaguggc

SEQ ID NO: 3727536 - RNA, 18 nt, Salmonella enterica enterica serovar Typhi Ty2
uggcggagaucuccagau

SEQ ID NO: 3727537 - RNA, 17 nt, Salmonella enterica enterica serovar Typhi Ty2
uggcggagggauuuuaa

SEQ ID NO: 3727538 - RNA, 22 nt, Salmonella enterica enterica serovar Typhi Ty2
uggcggcaaggcgacucaaaac

SEQ ID NO: 3727539 - RNA, 15 nt, Salmonella enterica enterica serovar Typhi Ty2
uggcggcauaauaug

SEQ ID NO: 3727540 - RNA, 21 nt, Salmonella enterica enterica serovar Typhi Ty2
uggcggcggacaugguaauaa

SEQ ID NO: 3727541 - RNA, 14 nt, Salmonella enterica enterica serovar Typhi Ty2
uggcggcggucgua

SEQ ID NO: 3727542 - RNA, 20 nt, Salmonella enterica enterica serovar Typhi Ty2
uggcggcuacgccuuacccg

SEQ ID NO: 3727543 - RNA, 15 nt, Salmonella enterica enterica serovar Typhi Ty2
uggcgggcuuauccc

SEQ ID NO: 3727544 - RNA, 23 nt, Salmonella enterica enterica serovar Typhi Ty2
uggcgguauaacugccuuauccg

SEQ ID NO: 3727545 - RNA, 14 nt, Salmonella enterica enterica serovar Typhi Ty2
uggcguaaacgcca

SEQ ID NO: 3727546 - RNA, 21 nt, Salmonella enterica enterica serovar Typhi Ty2
uggcguaaagaggguaacggc

SEQ ID NO: 3727547 - RNA, 13 nt, Salmonella enterica enterica serovar Typhi Ty2
uggcguaaauauu

SEQ ID NO: 3727548 - RNA, 17 nt, Salmonella enterica enterica serovar Typhi Ty2
uggcguaaauauucguu

SEQ ID NO: 3727549 - RNA, 12 nt, Salmonella enterica enterica serovar Typhi Ty2
uggcguaaauca

SEQ ID NO: 3727550 - RNA, 16 nt, Salmonella enterica enterica serovar Typhi Ty2
uggcguaaaucaggcc

SEQ ID NO: 3727551 - RNA, 15 nt, Salmonella enterica enterica serovar Typhi Ty2
uggcguacgcagauc

SEQ ID NO: 3727552 - RNA, 23 nt, Salmonella enterica enterica serovar Typhi Ty2
uggcguacgcagaucguauccag

SEQ ID NO: 3727553 - RNA, 23 nt, Salmonella enterica enterica serovar Typhi Ty2
uggcguacgcauccgcguuaccc

SEQ ID NO: 3727554 - RNA, 17 nt, Salmonella enterica enterica serovar Typhi Ty2
uggcguagaagcuuacc

SEQ ID NO: 3727555 - RNA, 15 nt, Salmonella enterica enterica serovar Typhi Ty2
uggcgucaaucaacu

SEQ ID NO: 3727556 - RNA, 22 nt, Salmonella enterica enterica serovar Typhi Ty2
uacgcauaaugcgccccgcaac

SEQ ID NO: 3727557 - RNA, 14 nt, Salmonella enterica enterica serovar Typhi Ty2
uacgcaucaccagg

SEQ ID NO: 3727558 - RNA, 14 nt, Salmonella enterica enterica serovar Typhi Ty2
uacgccaagcugca

SEQ ID NO: 3727559 - RNA, 20 nt, Salmonella enterica enterica serovar Typhi Ty2
uacgccacggcaauuuacaa

SEQ ID NO: 3727560 - RNA, 19 nt, Salmonella enterica enterica serovar Typhi Ty2
uacgccagcagacagguga

SEQ ID NO: 3727561 - RNA, 19 nt, Salmonella enterica enterica serovar Typhi Ty2
uacgccagccgucaugaug

SEQ ID NO: 3727562 - RNA, 16 nt, Salmonella enterica enterica serovar Typhi Ty2
uacgccaucaggcaug

SEQ ID NO: 3727563 - RNA, 22 nt, Salmonella enterica enterica serovar Typhi Ty2
uacgccaugcaucaauggcguc

SEQ ID NO: 3727564 - RNA, 18 nt, Salmonella enterica enterica serovar Typhi Ty2
uacgccccggcgcgccau

SEQ ID NO: 3727565 - RNA, 17 nt, Salmonella enterica enterica serovar Typhi Ty2
uacgcccuauccggccg

SEQ ID NO: 3727566 - RNA, 16 nt, Salmonella enterica enterica serovar Typhi Ty2
uacgccgccauccggc

SEQ ID NO: 3727567 - RNA, 13 nt, Salmonella enterica enterica serovar Typhi Ty2
uacgccgccgccc

SEQ ID NO: 3727568 - RNA, 15 nt, Salmonella enterica enterica serovar Typhi Ty2
uacgccgccgcccag

SEQ ID NO: 3727569 - RNA, 20 nt, Salmonella enterica enterica serovar Typhi Ty2
uacgccgccgcccagauguu

SEQ ID NO: 3727570 - RNA, 22 nt, Salmonella enterica enterica serovar Typhi Ty2
uacgccggcgcguaauuccgca

SEQ ID NO: 3727571 - RNA, 15 nt, Salmonella enterica enterica serovar Typhi Ty2
uacgccugaaaacag

SEQ ID NO: 3727572 - RNA, 15 nt, Salmonella enterica enterica serovar Typhi Ty2
uacgccugucgcaac

SEQ ID NO: 3727573 - RNA, 13 nt, Salmonella enterica enterica serovar Typhi Ty2
uacgccugucgcg

SEQ ID NO: 3727574 - RNA, 21 nt, Salmonella enterica enterica serovar Typhi Ty2
uacgcgaugagauaauaaaug

SEQ ID NO: 3727575 - RNA, 20 nt, Salmonella enterica enterica serovar Typhi Ty2
uacgcgcguucguugaugua

SEQ ID NO: 3727576 - RNA, 23 nt, Salmonella enterica enterica serovar Typhi Ty2
uacgcgcucaccgacuccucaac

SEQ ID NO: 3727577 - RNA, 17 nt, Salmonella enterica enterica serovar Typhi Ty2
uacgcgcugcaaauacu

SEQ ID NO: 3727578 - RNA, 22 nt, Salmonella enterica enterica serovar Typhi Ty2
uacgcggcgcgccguaaacaau

SEQ ID NO: 3727579 - RNA, 22 nt, Salmonella enterica enterica serovar Typhi Ty2
uacgcggcgcgcucuuuuucuu

SEQ ID NO: 3727580 - RNA, 16 nt, Salmonella enterica enterica serovar Typhi Ty2
uacgcgggguaaaaug

SEQ ID NO: 3727581 - RNA, 17 nt, Salmonella enterica enterica serovar Typhi Ty2
uacgcgucaaagcacau

SEQ ID NO: 3727582 - RNA, 14 nt, Salmonella enterica enterica serovar Typhi Ty2
uacgcgucaauuac

SEQ ID NO: 3727583 - RNA, 15 nt, Salmonella enterica enterica serovar Typhi Ty2
uacgcgucaauuacc

SEQ ID NO: 3727584 - RNA, 18 nt, Salmonella enterica enterica serovar Typhi Ty2
uacgcgucgccauccggc

SEQ ID NO: 3727585 - RNA, 18 nt, Salmonella enterica enterica serovar Typhi Ty2
uacgcguuucacaaccuc

SEQ ID NO: 3727586 - RNA, 16 nt, Salmonella enterica enterica serovar Typhi Ty2
uacgcuauuuaaaaac

SEQ ID NO: 3727587 - RNA, 19 nt, Salmonella enterica enterica serovar Typhi Ty2
uacgcugcuauccggcaac

SEQ ID NO: 3727588 - RNA, 14 nt, Salmonella enterica enterica serovar Typhi Ty2
uacgcuuauugaug

SEQ ID NO: 3727589 - RNA, 17 nt, Salmonella enterica enterica serovar Typhi Ty2
uacggaaauagcgccau

SEQ ID NO: 3727590 - RNA, 21 nt, Salmonella enterica enterica serovar Typhi Ty2
uacggaauaucccgcaagaaa

SEQ ID NO: 3727591 - RNA, 20 nt, Salmonella enterica enterica serovar Typhi Ty2
uacggacugcggccugcaaa

SEQ ID NO: 3727592 - RNA, 16 nt, Salmonella enterica enterica serovar Typhi Ty2
uacggaugcgcggaug

SEQ ID NO: 3727593 - RNA, 22 nt, Salmonella enterica enterica serovar Typhi Ty2
uacggcaaacacaaucacgccc

SEQ ID NO: 3727594 - RNA, 23 nt, Salmonella enterica enterica serovar Typhi Ty2
uacggcaaacacaaucacgccca

SEQ ID NO: 3727595 - RNA, 20 nt, Salmonella enterica enterica serovar Typhi Ty2
uacggcaacgggacggcggc

SEQ ID NO: 3727596 - RNA, 14 nt, Salmonella enterica enterica serovar Typhi Ty2
uacggcgcacccau

SEQ ID NO: 3727597 - RNA, 18 nt, Salmonella enterica enterica serovar Typhi Ty2
uacgggcaugaagaaaau

SEQ ID NO: 3727598 - RNA, 13 nt, Salmonella enterica enterica serovar Typhi Ty2
uacgguaaaccag

SEQ ID NO: 3727599 - RNA, 14 nt, Salmonella enterica enterica serovar Typhi Ty2
uacgguacugccca

SEQ ID NO: 3727600 - RNA, 21 nt, Salmonella enterica enterica serovar Typhi Ty2
uacgguccguuuucgccccca

SEQ ID NO: 3727601 - RNA, 22 nt, Salmonella enterica enterica serovar Typhi Ty2
uacggugaauauuugcgcuagu

SEQ ID NO: 3727602 - RNA, 15 nt, Salmonella enterica enterica serovar Typhi Ty2
uacgguuggccagca

SEQ ID NO: 3727603 - RNA, 22 nt, Salmonella enterica enterica serovar Typhi Ty2
uacgguuuauccccgcuggugc

SEQ ID NO: 3727604 - RNA, 12 nt, Salmonella enterica enterica serovar Typhi Ty2
uacguaaauaua

SEQ ID NO: 3727605 - RNA, 15 nt, Salmonella enterica enterica serovar Typhi Ty2
uacguaacaugaccu

SEQ ID NO: 3727606 - RNA, 21 nt, Salmonella enterica enterica serovar Typhi Ty2
uacguaacugcgguaaauaau

SEQ ID NO: 3727607 - RNA, 18 nt, Salmonella enterica enterica serovar Typhi Ty2
uacgucauaucauccagc

SEQ ID NO: 3727608 - RNA, 14 nt, Salmonella enterica enterica serovar Typhi Ty2
uacgucaucaugcu

SEQ ID NO: 3727609 - RNA, 12 nt, Salmonella enterica enterica serovar Typhi Ty2
uacguccauccg

SEQ ID NO: 3727610 - RNA, 23 nt, Salmonella enterica enterica serovar Typhi Ty2
uacgucgcacggaucaucuaccc

SEQ ID NO: 3727611 - RNA, 16 nt, Salmonella enterica enterica serovar Typhi Ty2
uacgugaaacugauag

SEQ ID NO: 3727612 - RNA, 14 nt, Salmonella enterica enterica serovar Typhi Ty2
uacgugcgaaccac

SEQ ID NO: 3727613 - RNA, 16 nt, Salmonella enterica enterica serovar Typhi Ty2
uacgugcucucaccau

SEQ ID NO: 3727614 - RNA, 13 nt, Salmonella enterica enterica serovar Typhi Ty2
uacguucaaauug

SEQ ID NO: 3727615 - RNA, 12 nt, Salmonella enterica enterica serovar Typhi Ty2
uacguucggacu

SEQ ID NO: 3727616 - RNA, 18 nt, Salmonella enterica enterica serovar Typhi Ty2
uacguugauuaucaccca

SEQ ID NO: 3727617 - RNA, 16 nt, Salmonella enterica enterica serovar Typhi Ty2
uacguuuauucuuuuc

SEQ ID NO: 3727618 - RNA, 13 nt, Salmonella enterica enterica serovar Typhi Ty2
uacguuuuuauua

SEQ ID NO: 3727619 - RNA, 20 nt, Salmonella enterica enterica serovar Typhi Ty2
uacguuuuuccauucacaca

SEQ ID NO: 3727620 - RNA, 13 nt, Salmonella enterica enterica serovar Typhi Ty2
uacuaauaaaauu

SEQ ID NO: 3727621 - RNA, 21 nt, Salmonella enterica enterica serovar Typhi Ty2
uacuaaucucacccauagaua

SEQ ID NO: 3727622 - RNA, 11 nt, Salmonella enterica enterica serovar Typhi Ty2
uacuauuuccu

SEQ ID NO: 3727623 - RNA, 13 nt, Salmonella enterica enterica serovar Typhi Ty2
uacuauuuuucac

SEQ ID NO: 3727624 - RNA, 14 nt, Salmonella enterica enterica serovar Typhi Ty2
uacucaacaucauu

SEQ ID NO: 3727625 - RNA, 24 nt, Salmonella enterica enterica serovar Typhi Ty2
uacucaccaguccggcagaaagca

SEQ ID NO: 3727626 - RNA, 20 nt, Salmonella enterica enterica serovar Typhi Ty2
uacucagcacauucagagcg

SEQ ID NO: 3727627 - RNA, 14 nt, Salmonella enterica enterica serovar Typhi Ty2
uacucagggcaaaa

SEQ ID NO: 3727628 - RNA, 22 nt, Salmonella enterica enterica serovar Typhi Ty2
uacucagggcaaaaaugaucac

SEQ ID NO: 3727629 - RNA, 14 nt, Salmonella enterica enterica serovar Typhi Ty2
uacuccacaguuca

SEQ ID NO: 3727630 - RNA, 13 nt, Salmonella enterica enterica serovar Typhi Ty2
uacuccagcagac

SEQ ID NO: 3727631 - RNA, 22 nt, Salmonella enterica enterica serovar Typhi Ty2
uacuccagcagaccggcaaaaa

SEQ ID NO: 3727632 - RNA, 12 nt, Salmonella enterica enterica serovar Typhi Ty2
uacuccagccca

SEQ ID NO: 3727633 - RNA, 21 nt, Salmonella enterica enterica serovar Typhi Ty2
uacuccagcccaucagucccc

SEQ ID NO: 3727634 - RNA, 14 nt, Salmonella enterica enterica serovar Typhi Ty2
uacuccguuuuaau

SEQ ID NO: 3727635 - RNA, 15 nt, Salmonella enterica enterica serovar Typhi Ty2
uacuccguuuuaauc

SEQ ID NO: 3727636 - RNA, 17 nt, Salmonella enterica enterica serovar Typhi Ty2
uacuccguuuuaaucuu

SEQ ID NO: 3727637 - RNA, 18 nt, Salmonella enterica enterica serovar Typhi Ty2
uacuccguuuuaaucuuu

SEQ ID NO: 3727638 - RNA, 16 nt, Salmonella enterica enterica serovar Typhi Ty2
uagccgccgagcgccg

SEQ ID NO: 3727639 - RNA, 19 nt, Salmonella enterica enterica serovar Typhi Ty2
uagccgcgcgucagcgugu

SEQ ID NO: 3727640 - RNA, 14 nt, Salmonella enterica enterica serovar Typhi Ty2
uagccggauaaaau

SEQ ID NO: 3727641 - RNA, 13 nt, Salmonella enterica enterica serovar Typhi Ty2
uagccggcgauag

SEQ ID NO: 3727642 - RNA, 20 nt, Salmonella enterica enterica serovar Typhi Ty2
uagccggugccgcaaucggu

SEQ ID NO: 3727643 - RNA, 12 nt, Salmonella enterica enterica serovar Typhi Ty2
uagccguggcug

SEQ ID NO: 3727644 - RNA, 18 nt, Salmonella enterica enterica serovar Typhi Ty2
uagccguuaccgccgagc

SEQ ID NO: 3727645 - RNA, 15 nt, Salmonella enterica enterica serovar Typhi Ty2
uagccguucaugcac

SEQ ID NO: 3727646 - RNA, 18 nt, Salmonella enterica enterica serovar Typhi Ty2
uagccguucaugcacucg

SEQ ID NO: 3727647 - RNA, 14 nt, Salmonella enterica enterica serovar Typhi Ty2
uagccguucuccag

SEQ ID NO: 3727648 - RNA, 21 nt, Salmonella enterica enterica serovar Typhi Ty2
uagccuaaugacggacgcaga

SEQ ID NO: 3727649 - RNA, 21 nt, Salmonella enterica enterica serovar Typhi Ty2
uagccucaagagaugcagaca

SEQ ID NO: 3727650 - RNA, 18 nt, Salmonella enterica enterica serovar Typhi Ty2
uagccuguuauucaauuc

SEQ ID NO: 3727651 - RNA, 18 nt, Salmonella enterica enterica serovar Typhi Ty2
uagccuucccggggaaca

SEQ ID NO: 3727652 - RNA, 14 nt, Salmonella enterica enterica serovar Typhi Ty2
uagccuugacgcaa

SEQ ID NO: 3727653 - RNA, 23 nt, Salmonella enterica enterica serovar Typhi Ty2
uagccuuuauugaugacauuaau

SEQ ID NO: 3727654 - RNA, 14 nt, Salmonella enterica enterica serovar Typhi Ty2
uagcgacugauaag

SEQ ID NO: 3727655 - RNA, 21 nt, Salmonella enterica enterica serovar Typhi Ty2
uagcgaggcagcaggaucucc

SEQ ID NO: 3727656 - RNA, 14 nt, Salmonella enterica enterica serovar Typhi Ty2
uagcgccagacaga

SEQ ID NO: 3727657 - RNA, 15 nt, Salmonella enterica enterica serovar Typhi Ty2
uagcgccagacagau

SEQ ID NO: 3727658 - RNA, 22 nt, Salmonella enterica enterica serovar Typhi Ty2
uagcgccagacagauaacacca

SEQ ID NO: 3727659 - RNA, 17 nt, Salmonella enterica enterica serovar Typhi Ty2
uagcgccagcagcauaa

SEQ ID NO: 3727660 - RNA, 14 nt, Salmonella enterica enterica serovar Typhi Ty2
uagcgcccuuuuuu

SEQ ID NO: 3727661 - RNA, 22 nt, Salmonella enterica enterica serovar Typhi Ty2
uagcgcgaaugauuuuacgguc

SEQ ID NO: 3727662 - RNA, 23 nt, Salmonella enterica enterica serovar Typhi Ty2
uagcgcgacgccaaaccugccac

SEQ ID NO: 3727663 - RNA, 16 nt, Salmonella enterica enterica serovar Typhi Ty2
uagcgcgauuuucucg

SEQ ID NO: 3727664 - RNA, 18 nt, Salmonella enterica enterica serovar Typhi Ty2
uagcgcgcccaugccgcc

SEQ ID NO: 3727665 - RNA, 16 nt, Salmonella enterica enterica serovar Typhi Ty2
uagcgcggcagcgcgc

SEQ ID NO: 3727666 - RNA, 20 nt, Salmonella enterica enterica serovar Typhi Ty2
uagcgcuccuuuaauucguu

SEQ ID NO: 3727667 - RNA, 18 nt, Salmonella enterica enterica serovar Typhi Ty2
uagcgcugaggcgcuggc

SEQ ID NO: 3727668 - RNA, 14 nt, Salmonella enterica enterica serovar Typhi Ty2
uagcgcuuuccugc

SEQ ID NO: 3727669 - RNA, 24 nt, Salmonella enterica enterica serovar Typhi Ty2
uagcggauugccgcgcucaaucug

SEQ ID NO: 3727670 - RNA, 18 nt, Salmonella enterica enterica serovar Typhi Ty2
uagcggcaugucugucua

SEQ ID NO: 3727671 - RNA, 21 nt, Salmonella enterica enterica serovar Typhi Ty2
uagcggcguuuauauaaaaau

SEQ ID NO: 3727672 - RNA, 20 nt, Salmonella enterica enterica serovar Typhi Ty2
uagcggcuaaucaccaccuc

SEQ ID NO: 3727673 - RNA, 23 nt, Salmonella enterica enterica serovar Typhi Ty2
uagcgggcaaugccaccagcgcc

SEQ ID NO: 3727674 - RNA, 19 nt, Salmonella enterica enterica serovar Typhi Ty2
uagcguacuuucaaauagc

SEQ ID NO: 3727675 - RNA, 22 nt, Salmonella enterica enterica serovar Typhi Ty2
uagcguacuuucaaauagcugg

SEQ ID NO: 3727676 - RNA, 19 nt, Salmonella enterica enterica serovar Typhi Ty2
uagcguaucagacuuauac

SEQ ID NO: 3727677 - RNA, 18 nt, Salmonella enterica enterica serovar Typhi Ty2
uagcgucaacgcuuuuau

SEQ ID NO: 3727678 - RNA, 15 nt, Salmonella enterica enterica serovar Typhi Ty2
uagcgucauccggca

SEQ ID NO: 3727679 - RNA, 13 nt, Salmonella enterica enterica serovar Typhi Ty2
uagcgucccggca

SEQ ID NO: 3727680 - RNA, 13 nt, Salmonella enterica enterica serovar Typhi Ty2
uagcgugacggca

SEQ ID NO: 3727681 - RNA, 15 nt, Salmonella enterica enterica serovar Typhi Ty2
uagcguggugacgcc

SEQ ID NO: 3727682 - RNA, 18 nt, Salmonella enterica enterica serovar Typhi Ty2
uagcguucauucccgcca

SEQ ID NO: 3727683 - RNA, 13 nt, Salmonella enterica enterica serovar Typhi Ty2
uagcguucugguu

SEQ ID NO: 3727684 - RNA, 16 nt, Salmonella enterica enterica serovar Typhi Ty2
uagcguucuuuccagu

SEQ ID NO: 3727685 - RNA, 20 nt, Salmonella enterica enterica serovar Typhi Ty2
uagcguugauaugcucgaca

SEQ ID NO: 3727686 - RNA, 23 nt, Salmonella enterica enterica serovar Typhi Ty2
uagcguuucgaacucuucgcaac

SEQ ID NO: 3727687 - RNA, 13 nt, Salmonella enterica enterica serovar Typhi Ty2
uagcguuuuccag

SEQ ID NO: 3727688 - RNA, 18 nt, Salmonella enterica enterica serovar Typhi Ty2
uagcguuuuuucaucggc

SEQ ID NO: 3727689 - RNA, 15 nt, Salmonella enterica enterica serovar Typhi Ty2
uagcuaaauaaaaau

SEQ ID NO: 3727690 - RNA, 22 nt, Salmonella enterica enterica serovar Typhi Ty2
uagcuacguagcgcauugcgcc

SEQ ID NO: 3727691 - RNA, 16 nt, Salmonella enterica enterica serovar Typhi Ty2
uagcuauauuuagccg

SEQ ID NO: 3727692 - RNA, 12 nt, Salmonella enterica enterica serovar Typhi Ty2
uagcuaugguca

SEQ ID NO: 3727693 - RNA, 18 nt, Salmonella enterica enterica serovar Typhi Ty2
uagcuauuccaaaauaau

SEQ ID NO: 3727694 - RNA, 13 nt, Salmonella enterica enterica serovar Typhi Ty2
uagcucagcgcgg

SEQ ID NO: 3727695 - RNA, 23 nt, Salmonella enterica enterica serovar Typhi Ty2
uagcucagcuggauagagcgcug

SEQ ID NO: 3727696 - RNA, 22 nt, Salmonella enterica enterica serovar Typhi Ty2
uagcucaguugguagagcccug

SEQ ID NO: 3727697 - RNA, 20 nt, Salmonella enterica enterica serovar Typhi Ty2
uagcuccgaauaauccuucc

SEQ ID NO: 3727698 - RNA, 16 nt, Salmonella enterica enterica serovar Typhi Ty2
uagcucgucuguuuug

SEQ ID NO: 3727699 - RNA, 22 nt, Salmonella enterica enterica serovar Typhi Ty2
uagcucuuucauuucugccugc

SEQ ID NO: 3727700 - RNA, 20 nt, Salmonella enterica enterica serovar Typhi Ty2
uagcugcgcaagaaacauca

SEQ ID NO: 3727701 - RNA, 16 nt, Salmonella enterica enterica serovar Typhi Ty2
uagcugcggcucgcca

SEQ ID NO: 3727702 - RNA, 17 nt, Salmonella enterica enterica serovar Typhi Ty2
uagcugcguuuccagcc

SEQ ID NO: 3727703 - RNA, 15 nt, Salmonella enterica enterica serovar Typhi Ty2
uagcuggcaagaccg

SEQ ID NO: 3727704 - RNA, 15 nt, Salmonella enterica enterica serovar Typhi Ty2
uagcuuaaaaaaucc

SEQ ID NO: 3727705 - RNA, 21 nt, Salmonella enterica enterica serovar Typhi Ty2
uagcuuacuuuuagaauuauc

SEQ ID NO: 3727706 - RNA, 18 nt, Salmonella enterica enterica serovar Typhi Ty2
uagcuuaucgggccuacc

SEQ ID NO: 3727707 - RNA, 14 nt, Salmonella enterica enterica serovar Typhi Ty2
uagcuucagcggcg

SEQ ID NO: 3727708 - RNA, 14 nt, Salmonella enterica enterica serovar Typhi Ty2
uagcuucugucugc

SEQ ID NO: 3727709 - RNA, 21 nt, Salmonella enterica enterica serovar Typhi Ty2
uagcuuuuuacucucuuucug

SEQ ID NO: 3727710 - RNA, 13 nt, Salmonella enterica enterica serovar Typhi Ty2
uagcuuuuuuaug

SEQ ID NO: 3727711 - RNA, 16 nt, Salmonella enterica enterica serovar Typhi Ty2
uaggaaaggcagagaa

SEQ ID NO: 3727712 - RNA, 18 nt, Salmonella enterica enterica serovar Typhi Ty2
uaggaagacgagaagcga

SEQ ID NO: 3727713 - RNA, 12 nt, Salmonella enterica enterica serovar Typhi Ty2
uaggauaaaauc

SEQ ID NO: 3727714 - RNA, 15 nt, Salmonella enterica enterica serovar Typhi Ty2
uaggcacuuuccaga

SEQ ID NO: 3727715 - RNA, 17 nt, Salmonella enterica enterica serovar Typhi Ty2
uaggcauuaauggcgau

SEQ ID NO: 3727716 - RNA, 13 nt, Salmonella enterica enterica serovar Typhi Ty2
uaggccaaacuua

SEQ ID NO: 3727717 - RNA, 20 nt, Salmonella enterica enterica serovar Typhi Ty2
uaggccaaacuuacgcagcu

SEQ ID NO: 3727718 - RNA, 21 nt, Salmonella enterica enterica serovar Typhi Ty2
uaggccagacgaaguuuugcg

SEQ ID NO: 3727719 - RNA, 20 nt, Salmonella enterica enterica serovar Typhi Ty2
uaggccagccgacgcucuuc

SEQ ID NO: 3727720 - RNA, 12 nt, Salmonella enterica enterica serovar Typhi Ty2
uauaagcgccau

SEQ ID NO: 3727721 - RNA, 18 nt, Salmonella enterica enterica serovar Typhi Ty2
uauaagcgccgucauccg

SEQ ID NO: 3727722 - RNA, 19 nt, Salmonella enterica enterica serovar Typhi Ty2
uauaagcgguauucagguu

SEQ ID NO: 3727723 - RNA, 23 nt, Salmonella enterica enterica serovar Typhi Ty2
uauaaguacgccugaaaacagaa

SEQ ID NO: 3727724 - RNA, 14 nt, Salmonella enterica enterica serovar Typhi Ty2
uauaauuaacauuu

SEQ ID NO: 3727725 - RNA, 14 nt, Salmonella enterica enterica serovar Typhi Ty2
uauaauuauuuguu

SEQ ID NO: 3727726 - RNA, 19 nt, Salmonella enterica enterica serovar Typhi Ty2
uauaauucgucaauaccua

SEQ ID NO: 3727727 - RNA, 18 nt, Salmonella enterica enterica serovar Typhi Ty2
uauaauugcuuuuuucca

SEQ ID NO: 3727728 - RNA, 17 nt, Salmonella enterica enterica serovar Typhi Ty2
uauaauuuuauuauauu

SEQ ID NO: 3727729 - RNA, 20 nt, Salmonella enterica enterica serovar Typhi Ty2
uauacaaaacccauaucccc

SEQ ID NO: 3727730 - RNA, 14 nt, Salmonella enterica enterica serovar Typhi Ty2
uauacacucaacca

SEQ ID NO: 3727731 - RNA, 17 nt, Salmonella enterica enterica serovar Typhi Ty2
uauacaguaaaacgcca

SEQ ID NO: 3727732 - RNA, 21 nt, Salmonella enterica enterica serovar Typhi Ty2
uauaccauaaaugaaaccuca

SEQ ID NO: 3727733 - RNA, 15 nt, Salmonella enterica enterica serovar Typhi Ty2
uauaccaugcugcca

SEQ ID NO: 3727734 - RNA, 23 nt, Salmonella enterica enterica serovar Typhi Ty2
uauaccgucaguaccagcgagau

SEQ ID NO: 3727735 - RNA, 19 nt, Salmonella enterica enterica serovar Typhi Ty2
uauacggcggcaaugccgc

SEQ ID NO: 3727736 - RNA, 15 nt, Salmonella enterica enterica serovar Typhi Ty2
uauacucaaaaaauc

SEQ ID NO: 3727737 - RNA, 14 nt, Salmonella enterica enterica serovar Typhi Ty2
uauacuccagcaga

SEQ ID NO: 3727738 - RNA, 19 nt, Salmonella enterica enterica serovar Typhi Ty2
uauacuccgcgacgaccug

SEQ ID NO: 3727739 - RNA, 13 nt, Salmonella enterica enterica serovar Typhi Ty2
uauacugauaaac

SEQ ID NO: 3727740 - RNA, 13 nt, Salmonella enterica enterica serovar Typhi Ty2
uauacugugacga

SEQ ID NO: 3727741 - RNA, 15 nt, Salmonella enterica enterica serovar Typhi Ty2
uauagacaccuuaua

SEQ ID NO: 3727742 - RNA, 19 nt, Salmonella enterica enterica serovar Typhi Ty2
uauagagcgccauauugcu

SEQ ID NO: 3727743 - RNA, 15 nt, Salmonella enterica enterica serovar Typhi Ty2
uauagaucagacgac

SEQ ID NO: 3727744 - RNA, 12 nt, Salmonella enterica enterica serovar Typhi Ty2
uauagaugaugg

SEQ ID NO: 3727745 - RNA, 14 nt, Salmonella enterica enterica serovar Typhi Ty2
uauagcaaacccuc

SEQ ID NO: 3727746 - RNA, 15 nt, Salmonella enterica enterica serovar Typhi Ty2
uauagcaacccacuu

SEQ ID NO: 3727747 - RNA, 16 nt, Salmonella enterica enterica serovar Typhi Ty2
uauagcaacuuaauaa

SEQ ID NO: 3727748 - RNA, 13 nt, Salmonella enterica enterica serovar Typhi Ty2
uauagccaggcag

SEQ ID NO: 3727749 - RNA, 15 nt, Salmonella enterica enterica serovar Typhi Ty2
uauagccaggcagau

SEQ ID NO: 3727750 - RNA, 21 nt, Salmonella enterica enterica serovar Typhi Ty2
uauagcccagaaucaccccaa

SEQ ID NO: 3727751 - RNA, 18 nt, Salmonella enterica enterica serovar Typhi Ty2
uauagccuuuauugauga

SEQ ID NO: 3727752 - RNA, 15 nt, Salmonella enterica enterica serovar Typhi Ty2
uauagccuuuuucuu

SEQ ID NO: 3727753 - RNA, 11 nt, Salmonella enterica enterica serovar Typhi Ty2
uauagcgccau

SEQ ID NO: 3727754 - RNA, 22 nt, Salmonella enterica enterica serovar Typhi Ty2
uauagcucagcgcggcagccgg

SEQ ID NO: 3727755 - RNA, 16 nt, Salmonella enterica enterica serovar Typhi Ty2
uauagcucaguuggua

SEQ ID NO: 3727756 - RNA, 13 nt, Salmonella enterica enterica serovar Typhi Ty2
uauaggaaaauga

SEQ ID NO: 3727757 - RNA, 15 nt, Salmonella enterica enterica serovar Typhi Ty2
uauaggcauguuccu

SEQ ID NO: 3727758 - RNA, 20 nt, Salmonella enterica enterica serovar Typhi Ty2
uauaggccugauaaacguag

SEQ ID NO: 3727759 - RNA, 14 nt, Salmonella enterica enterica serovar Typhi Ty2
uauaggggccaagc

SEQ ID NO: 3727760 - RNA, 23 nt, Salmonella enterica enterica serovar Typhi Ty2
uauagguguaaaccguuuuuccg

SEQ ID NO: 3727761 - RNA, 21 nt, Salmonella enterica enterica serovar Typhi Ty2
uauaguacgauagcaauuaau

SEQ ID NO: 3727762 - RNA, 19 nt, Salmonella enterica enterica serovar Typhi Ty2
uauaguccacuuucuguaa

SEQ ID NO: 3727763 - RNA, 14 nt, Salmonella enterica enterica serovar Typhi Ty2
uauagucuuaauuu

SEQ ID NO: 3727764 - RNA, 20 nt, Salmonella enterica enterica serovar Typhi Ty2
uauaguggaacgucaggccg

SEQ ID NO: 3727765 - RNA, 14 nt, Salmonella enterica enterica serovar Typhi Ty2
uauaguuuauugaa

SEQ ID NO: 3727766 - RNA, 21 nt, Salmonella enterica enterica serovar Typhi Ty2
uauaguuuuacgguuuauccc

SEQ ID NO: 3727767 - RNA, 12 nt, Salmonella enterica enterica serovar Typhi Ty2
uauauaaaaaua

SEQ ID NO: 3727768 - RNA, 17 nt, Salmonella enterica enterica serovar Typhi Ty2
uauauaauuuauagcca

SEQ ID NO: 3727769 - RNA, 23 nt, Salmonella enterica enterica serovar Typhi Ty2
uauauacuucaccauaaaucauu

SEQ ID NO: 3727770 - RNA, 21 nt, Salmonella enterica enterica serovar Typhi Ty2
uauaucaggcaaaaaucguca

SEQ ID NO: 3727771 - RNA, 15 nt, Salmonella enterica enterica serovar Typhi Ty2
uauaucgcgauaaac

SEQ ID NO: 3727772 - RNA, 16 nt, Salmonella enterica enterica serovar Typhi Ty2
uauaucgcgauaaacu

SEQ ID NO: 3727773 - RNA, 20 nt, Salmonella enterica enterica serovar Typhi Ty2
uauaucggcugcuguaacag

SEQ ID NO: 3727774 - RNA, 21 nt, Salmonella enterica enterica serovar Typhi Ty2
uauaugaaaucgccuguuaau

SEQ ID NO: 3727775 - RNA, 16 nt, Salmonella enterica enterica serovar Typhi Ty2
uauaugacaacacuca

SEQ ID NO: 3727776 - RNA, 14 nt, Salmonella enterica enterica serovar Typhi Ty2
uauaugagcgggcc

SEQ ID NO: 3727777 - RNA, 23 nt, Salmonella enterica enterica serovar Typhi Ty2
uauaugagcgggccgucaggccc

SEQ ID NO: 3727778 - RNA, 17 nt, Salmonella enterica enterica serovar Typhi Ty2
uauaugcaaaacuguag

SEQ ID NO: 3727779 - RNA, 20 nt, Salmonella enterica enterica serovar Typhi Ty2
uauaugcgacagaaauugaa

SEQ ID NO: 3727780 - RNA, 13 nt, Salmonella enterica enterica serovar Typhi Ty2
uauauuacuggcu

SEQ ID NO: 3727781 - RNA, 18 nt, Salmonella enterica enterica serovar Typhi Ty2
uauauuaguguuauauaa

SEQ ID NO: 3727782 - RNA, 18 nt, Salmonella enterica enterica serovar Typhi Ty2
uauauucagcaaaugcgc

SEQ ID NO: 3727783 - RNA, 15 nt, Salmonella enterica enterica serovar Typhi Ty2
uauauucaugauagu

SEQ ID NO: 3727784 - RNA, 16 nt, Salmonella enterica enterica serovar Typhi Ty2
uauauuccccuuaugg

SEQ ID NO: 3727785 - RNA, 21 nt, Salmonella enterica enterica serovar Typhi Ty2
uauauucgcgaugcucaacca

SEQ ID NO: 3727786 - RNA, 15 nt, Salmonella enterica enterica serovar Typhi Ty2
uauauucuucuuaga

SEQ ID NO: 3727787 - RNA, 15 nt, Salmonella enterica enterica serovar Typhi Ty2
uauauugcauuuuau

SEQ ID NO: 3727788 - RNA, 13 nt, Salmonella enterica enterica serovar Typhi Ty2
uauauuuaaaauu

SEQ ID NO: 3727789 - RNA, 13 nt, Salmonella enterica enterica serovar Typhi Ty2
uauauuuuucccu

SEQ ID NO: 3727790 - RNA, 20 nt, Salmonella enterica enterica serovar Typhi Ty2
uaucaaaccagcuuuucauu

SEQ ID NO: 3727791 - RNA, 17 nt, Salmonella enterica enterica serovar Typhi Ty2
uaucaaacugaaaauca

SEQ ID NO: 3727792 - RNA, 15 nt, Salmonella enterica enterica serovar Typhi Ty2
uaucaagauaaaaag

SEQ ID NO: 3727793 - RNA, 18 nt, Salmonella enterica enterica serovar Typhi Ty2
uaucaagauaaaaagaca

SEQ ID NO: 3727794 - RNA, 23 nt, Salmonella enterica enterica serovar Typhi Ty2
uaucaagauaaaaagacagauag

SEQ ID NO: 3727795 - RNA, 17 nt, Salmonella enterica enterica serovar Typhi Ty2
uaucaauaguuaauuaa

SEQ ID NO: 3727796 - RNA, 15 nt, Salmonella enterica enterica serovar Typhi Ty2
uaucaauuucauauu

SEQ ID NO: 3727797 - RNA, 19 nt, Salmonella enterica enterica serovar Typhi Ty2
uaucaauuucauauuauua

SEQ ID NO: 3727798 - RNA, 22 nt, Salmonella enterica enterica serovar Typhi Ty2
uaucacacauaucgccagccau

SEQ ID NO: 3727799 - RNA, 21 nt, Salmonella enterica enterica serovar Typhi Ty2
uaucaccagcgauuacgccag

SEQ ID NO: 3727800 - RNA, 20 nt, Salmonella enterica enterica serovar Typhi Ty2
uaucaccaucuuuuugcuca

SEQ ID NO: 3727801 - RNA, 22 nt, Salmonella enterica enterica serovar Typhi Ty2
uaucaccgccgcccguccgcua

SEQ ID NO: 3727802 - RNA, 20 nt, Salmonella enterica enterica serovar Typhi Ty2
uaucgguaguguuaucgccg

SEQ ID NO: 3727803 - RNA, 19 nt, Salmonella enterica enterica serovar Typhi Ty2
uaucguaagccaccgccca

SEQ ID NO: 3727804 - RNA, 12 nt, Salmonella enterica enterica serovar Typhi Ty2
uaucgucaauac

SEQ ID NO: 3727805 - RNA, 13 nt, Salmonella enterica enterica serovar Typhi Ty2
uaucgucaauacg

SEQ ID NO: 3727806 - RNA, 17 nt, Salmonella enterica enterica serovar Typhi Ty2
uaucguguuauuuucaa

SEQ ID NO: 3727807 - RNA, 23 nt, Salmonella enterica enterica serovar Typhi Ty2
uaucguuauauauacuucaccau

SEQ ID NO: 3727808 - RNA, 15 nt, Salmonella enterica enterica serovar Typhi Ty2
uaucguuuacguuau

SEQ ID NO: 3727809 - RNA, 16 nt, Salmonella enterica enterica serovar Typhi Ty2
uaucuauucgcugaca

SEQ ID NO: 3727810 - RNA, 17 nt, Salmonella enterica enterica serovar Typhi Ty2
uaucucacggaaugacu

SEQ ID NO: 3727811 - RNA, 14 nt, Salmonella enterica enterica serovar Typhi Ty2
uaucucuauugcuu

SEQ ID NO: 3727812 - RNA, 12 nt, Salmonella enterica enterica serovar Typhi Ty2
uaucugcugcug

SEQ ID NO: 3727813 - RNA, 18 nt, Salmonella enterica enterica serovar Typhi Ty2
uaucuggauacccccuau

SEQ ID NO: 3727814 - RNA, 18 nt, Salmonella enterica enterica serovar Typhi Ty2
uaucuguaauuauaaaua

SEQ ID NO: 3727815 - RNA, 15 nt, Salmonella enterica enterica serovar Typhi Ty2
uaucuguaauugacg

SEQ ID NO: 3727816 - RNA, 17 nt, Salmonella enterica enterica serovar Typhi Ty2
uaucugucccagccuuc

SEQ ID NO: 3727817 - RNA, 23 nt, Salmonella enterica enterica serovar Typhi Ty2
uaucugucugcuguaauuuauaa

SEQ ID NO: 3727818 - RNA, 21 nt, Salmonella enterica enterica serovar Typhi Ty2
uaucuguugauaaaacacucu

SEQ ID NO: 3727819 - RNA, 22 nt, Salmonella enterica enterica serovar Typhi Ty2
uaucuucaagguuaugcgcaca

SEQ ID NO: 3727820 - RNA, 18 nt, Salmonella enterica enterica serovar Typhi Ty2
uaucuuccacgguaaaac

SEQ ID NO: 3727821 - RNA, 14 nt, Salmonella enterica enterica serovar Typhi Ty2
uaucuuccagcgcg

SEQ ID NO: 3727822 - RNA, 23 nt, Salmonella enterica enterica serovar Typhi Ty2
uaucuuccggugugaccagcgcg

SEQ ID NO: 3727823 - RNA, 19 nt, Salmonella enterica enterica serovar Typhi Ty2
uaucuucgauaaacucaau

SEQ ID NO: 3727824 - RNA, 23 nt, Salmonella enterica enterica serovar Typhi Ty2
uaucuucggucgagcuuuugcug

SEQ ID NO: 3727825 - RNA, 18 nt, Salmonella enterica enterica serovar Typhi Ty2
uaucuugacaugaaaaau

SEQ ID NO: 3727826 - RNA, 22 nt, Salmonella enterica enterica serovar Typhi Ty2
uaucuugagucaaaagauugau

SEQ ID NO: 3727827 - RNA, 20 nt, Salmonella enterica enterica serovar Typhi Ty2
uaucuugaugauucacccuc

SEQ ID NO: 3727828 - RNA, 24 nt, Salmonella enterica enterica serovar Typhi Ty2
uaucuuuaccagggaauaugauuu

SEQ ID NO: 3727829 - RNA, 13 nt, Salmonella enterica enterica serovar Typhi Ty2
uaucuuucuuuuu

SEQ ID NO: 3727830 - RNA, 14 nt, Salmonella enterica enterica serovar Typhi Ty2
uaucuuucuuuuua

SEQ ID NO: 3727831 - RNA, 23 nt, Salmonella enterica enterica serovar Typhi Ty2
uaucuuugccuuuugacagcaca

SEQ ID NO: 3727832 - RNA, 20 nt, Salmonella enterica enterica serovar Typhi Ty2
uaucuuuuuuagucuccugc

SEQ ID NO: 3727833 - RNA, 20 nt, Salmonella enterica enterica serovar Typhi Ty2
uaugaaaccccaaaucagca

SEQ ID NO: 3727834 - RNA, 22 nt, Salmonella enterica enterica serovar Typhi Ty2
uaugaaaccccaaaucagcaaa

SEQ ID NO: 3727835 - RNA, 17 nt, Salmonella enterica enterica serovar Typhi Ty2
uaugaaagagaaaucuc

SEQ ID NO: 3727836 - RNA, 17 nt, Salmonella enterica enterica serovar Typhi Ty2
uaugaagagaaacauac

SEQ ID NO: 3727837 - RNA, 16 nt, Salmonella enterica enterica serovar Typhi Ty2
uaugaaucaucagaau

SEQ ID NO: 3727838 - RNA, 15 nt, Salmonella enterica enterica serovar Typhi Ty2
uaugacaacauaaag

SEQ ID NO: 3727839 - RNA, 15 nt, Salmonella enterica enterica serovar Typhi Ty2
uaugaccaauggcgc

SEQ ID NO: 3727840 - RNA, 23 nt, Salmonella enterica enterica serovar Typhi Ty2
uaugaccccuccggccagcgcca

SEQ ID NO: 3727841 - RNA, 17 nt, Salmonella enterica enterica serovar Typhi Ty2
uaugaccgagucuacau

SEQ ID NO: 3727842 - RNA, 18 nt, Salmonella enterica enterica serovar Typhi Ty2
uaugaccgagucuacauc

SEQ ID NO: 3727843 - RNA, 24 nt, Salmonella enterica enterica serovar Typhi Ty2
uaugauaagccugacuacgucaga

SEQ ID NO: 3727844 - RNA, 21 nt, Salmonella enterica enterica serovar Typhi Ty2
uaugauagccguucuccagcg

SEQ ID NO: 3727845 - RNA, 23 nt, Salmonella enterica enterica serovar Typhi Ty2
uaugauagccguucuccagcguu

SEQ ID NO: 3727846 - RNA, 16 nt, Salmonella enterica enterica serovar Typhi Ty2
uaugaucugcacaaca

SEQ ID NO: 3727847 - RNA, 18 nt, Salmonella enterica enterica serovar Typhi Ty2
uaugaugccgcuucgcca

SEQ ID NO: 3727848 - RNA, 15 nt, Salmonella enterica enterica serovar Typhi Ty2
uaugauuuaaaaaag

SEQ ID NO: 3727849 - RNA, 15 nt, Salmonella enterica enterica serovar Typhi Ty2
uaugauuuucuuauu

SEQ ID NO: 3727850 - RNA, 14 nt, Salmonella enterica enterica serovar Typhi Ty2
uaugcaaaagaaaa

SEQ ID NO: 3727851 - RNA, 22 nt, Salmonella enterica enterica serovar Typhi Ty2
uaugcaaaagaaaaaacuuauu

SEQ ID NO: 3727852 - RNA, 11 nt, Salmonella enterica enterica serovar Typhi Ty2
uaugcaaaaua

SEQ ID NO: 3727853 - RNA, 20 nt, Salmonella enterica enterica serovar Typhi Ty2
uaugcacaggcggcgguuca

SEQ ID NO: 3727854 - RNA, 14 nt, Salmonella enterica enterica serovar Typhi Ty2
uaugcagcagccag

SEQ ID NO: 3727855 - RNA, 13 nt, Salmonella enterica enterica serovar Typhi Ty2
uaugcaugguguu

SEQ ID NO: 3727856 - RNA, 23 nt, Salmonella enterica enterica serovar Typhi Ty2
uaugccacucuuuuaaggcccuc

SEQ ID NO: 3727857 - RNA, 18 nt, Salmonella enterica enterica serovar Typhi Ty2
uaugccccgacaucagau

SEQ ID NO: 3727858 - RNA, 20 nt, Salmonella enterica enterica serovar Typhi Ty2
uaugcccgccgcuggcgggc

SEQ ID NO: 3727859 - RNA, 19 nt, Salmonella enterica enterica serovar Typhi Ty2
uaugccggaggauauuuau

SEQ ID NO: 3727860 - RNA, 20 nt, Salmonella enterica enterica serovar Typhi Ty2
uaugccggaggauauuuauu

SEQ ID NO: 3727861 - RNA, 20 nt, Salmonella enterica enterica serovar Typhi Ty2
uaugccggaugacgcuaacg

SEQ ID NO: 3727862 - RNA, 21 nt, Salmonella enterica enterica serovar Typhi Ty2
uaugccugccagcauuaaccc

SEQ ID NO: 3727863 - RNA, 21 nt, Salmonella enterica enterica serovar Typhi Ty2
uaugccuuccagaaauaaaau

SEQ ID NO: 3727864 - RNA, 21 nt, Salmonella enterica enterica serovar Typhi Ty2
uaugcgacugaaaaucaaaaa

SEQ ID NO: 3727865 - RNA, 18 nt, Salmonella enterica enterica serovar Typhi Ty2
uaugcgauuucgucaaac

SEQ ID NO: 3727866 - RNA, 15 nt, Salmonella enterica enterica serovar Typhi Ty2
uaugcgcauagauau

SEQ ID NO: 3727867 - RNA, 14 nt, Salmonella enterica enterica serovar Typhi Ty2
uaugcgccuguuag

SEQ ID NO: 3727868 - RNA, 18 nt, Salmonella enterica enterica serovar Typhi Ty2
uaugcgcuuccagcauga

SEQ ID NO: 3727869 - RNA, 16 nt, Salmonella enterica enterica serovar Typhi Ty2
uaugcgcuuuuuucag

SEQ ID NO: 3727870 - RNA, 15 nt, Salmonella enterica enterica serovar Typhi Ty2
uaugcggcgccauca

SEQ ID NO: 3727871 - RNA, 19 nt, Salmonella enterica enterica serovar Typhi Ty2
uaugcggcuaauacgccag

SEQ ID NO: 3727872 - RNA, 19 nt, Salmonella enterica enterica serovar Typhi Ty2
uaugcgggggcaguaaauu

SEQ ID NO: 3727873 - RNA, 22 nt, Salmonella enterica enterica serovar Typhi Ty2
uaugcggucguauuaccaaccc

SEQ ID NO: 3727874 - RNA, 20 nt, Salmonella enterica enterica serovar Typhi Ty2
uaugcguuuuuaucuuucuu

SEQ ID NO: 3727875 - RNA, 20 nt, Salmonella enterica enterica serovar Typhi Ty2
uaugcucccggggauuucuu

SEQ ID NO: 3727876 - RNA, 16 nt, Salmonella enterica enterica serovar Typhi Ty2
uauggaggauauaaaa

SEQ ID NO: 3727877 - RNA, 12 nt, Salmonella enterica enterica serovar Typhi Ty2
uauggcaaugcc

SEQ ID NO: 3727878 - RNA, 17 nt, Salmonella enterica enterica serovar Typhi Ty2
uaugggauaacgcagaa

SEQ ID NO: 3727879 - RNA, 22 nt, Salmonella enterica enterica serovar Typhi Ty2
uaugggauaacgcagaagacag

SEQ ID NO: 3727880 - RNA, 12 nt, Salmonella enterica enterica serovar Typhi Ty2
uaugggcagcac

SEQ ID NO: 3727881 - RNA, 17 nt, Salmonella enterica enterica serovar Typhi Ty2
uauggguguagcucaua

SEQ ID NO: 3727882 - RNA, 17 nt, Salmonella enterica enterica serovar Typhi Ty2
uaugguacacauauggg

SEQ ID NO: 3727883 - RNA, 16 nt, Salmonella enterica enterica serovar Typhi Ty2
uauugccuaaauaacu

SEQ ID NO: 3727884 - RNA, 19 nt, Salmonella enterica enterica serovar Typhi Ty2
uauugccuaagauggcgcc

SEQ ID NO: 3727885 - RNA, 17 nt, Salmonella enterica enterica serovar Typhi Ty2
uauugccugaagaacau

SEQ ID NO: 3727886 - RNA, 17 nt, Salmonella enterica enterica serovar Typhi Ty2
uauugcggaucagcaaa

SEQ ID NO: 3727887 - RNA, 16 nt, Salmonella enterica enterica serovar Typhi Ty2
uauugcuucagccaga

SEQ ID NO: 3727888 - RNA, 22 nt, Salmonella enterica enterica serovar Typhi Ty2
uauugcuucguggcaaucagca

SEQ ID NO: 3727889 - RNA, 15 nt, Salmonella enterica enterica serovar Typhi Ty2
uauuggcaggaugua

SEQ ID NO: 3727890 - RNA, 13 nt, Salmonella enterica enterica serovar Typhi Ty2
uauugucaugcua

SEQ ID NO: 3727891 - RNA, 17 nt, Salmonella enterica enterica serovar Typhi Ty2
uauugucgcccugcaau

SEQ ID NO: 3727892 - RNA, 19 nt, Salmonella enterica enterica serovar Typhi Ty2
uauugucgcccugcaauuc

SEQ ID NO: 3727893 - RNA, 22 nt, Salmonella enterica enterica serovar Typhi Ty2
uauugucgcccugcaauucaua

SEQ ID NO: 3727894 - RNA, 14 nt, Salmonella enterica enterica serovar Typhi Ty2
uauugugagaaaag

SEQ ID NO: 3727895 - RNA, 13 nt, Salmonella enterica enterica serovar Typhi Ty2
uauugugucacca

SEQ ID NO: 3727896 - RNA, 13 nt, Salmonella enterica enterica serovar Typhi Ty2
uauuguuaaaaag

SEQ ID NO: 3727897 - RNA, 17 nt, Salmonella enterica enterica serovar Typhi Ty2
uauuguuuagacagaca

SEQ ID NO: 3727898 - RNA, 12 nt, Salmonella enterica enterica serovar Typhi Ty2
uauuguuuucua

SEQ ID NO: 3727899 - RNA, 14 nt, Salmonella enterica enterica serovar Typhi Ty2
uauuuaaaauucca

SEQ ID NO: 3727900 - RNA, 22 nt, Salmonella enterica enterica serovar Typhi Ty2
uauuuaaauaucgguucaauac

SEQ ID NO: 3727901 - RNA, 12 nt, Salmonella enterica enterica serovar Typhi Ty2
uauuuaacccug

SEQ ID NO: 3727902 - RNA, 13 nt, Salmonella enterica enterica serovar Typhi Ty2
uauuuaacgccag

SEQ ID NO: 3727903 - RNA, 19 nt, Salmonella enterica enterica serovar Typhi Ty2
uauuuagccguucaugcac

SEQ ID NO: 3727904 - RNA, 12 nt, Salmonella enterica enterica serovar Typhi Ty2
uauuuauuuaau

SEQ ID NO: 3727905 - RNA, 14 nt, Salmonella enterica enterica serovar Typhi Ty2
uauuuauuuuuagu

SEQ ID NO: 3727906 - RNA, 18 nt, Salmonella enterica enterica serovar Typhi Ty2
uauuucacguuucaucuc

SEQ ID NO: 3727907 - RNA, 13 nt, Salmonella enterica enterica serovar Typhi Ty2
uauuucaguacag

SEQ ID NO: 3727908 - RNA, 14 nt, Salmonella enterica enterica serovar Typhi Ty2
uauuucauaaugug

SEQ ID NO: 3727909 - RNA, 17 nt, Salmonella enterica enterica serovar Typhi Ty2
uauuuccaccuucucuu

SEQ ID NO: 3727910 - RNA, 17 nt, Salmonella enterica enterica serovar Typhi Ty2
uauuuccauuuuucaga

SEQ ID NO: 3727911 - RNA, 15 nt, Salmonella enterica enterica serovar Typhi Ty2
uauuuccucagaaag

SEQ ID NO: 3727912 - RNA, 17 nt, Salmonella enterica enterica serovar Typhi Ty2
uauuucuaucgcuaucg

SEQ ID NO: 3727913 - RNA, 18 nt, Salmonella enterica enterica serovar Typhi Ty2
uauuucucuugcagacag

SEQ ID NO: 3727914 - RNA, 14 nt, Salmonella enterica enterica serovar Typhi Ty2
uauuucugaaaaac

SEQ ID NO: 3727915 - RNA, 19 nt, Salmonella enterica enterica serovar Typhi Ty2
uauuucugugagugcgcca

SEQ ID NO: 3727916 - RNA, 13 nt, Salmonella enterica enterica serovar Typhi Ty2
uauuugcauuuuc

SEQ ID NO: 3727917 - RNA, 13 nt, Salmonella enterica enterica serovar Typhi Ty2
uauuugcccuguu

SEQ ID NO: 3727918 - RNA, 13 nt, Salmonella enterica enterica serovar Typhi Ty2
uauuugugaccaa

SEQ ID NO: 3727919 - RNA, 14 nt, Salmonella enterica enterica serovar Typhi Ty2
uauuuguuccggca

SEQ ID NO: 3727920 - RNA, 15 nt, Salmonella enterica enterica serovar Typhi Ty2
uauuuguuccggcaa

SEQ ID NO: 3727921 - RNA, 16 nt, Salmonella enterica enterica serovar Typhi Ty2
uauuuuacuugccauu

SEQ ID NO: 3727922 - RNA, 16 nt, Salmonella enterica enterica serovar Typhi Ty2
uauuuuauucgccauu

SEQ ID NO: 3727923 - RNA, 16 nt, Salmonella enterica enterica serovar Typhi Ty2
uauuuucaaaaacaag

SEQ ID NO: 3727924 - RNA, 14 nt, Salmonella enterica enterica serovar Typhi Ty2
uauuuuccaucacg

SEQ ID NO: 3727925 - RNA, 18 nt, Salmonella enterica enterica serovar Typhi Ty2
uauuuuccguuagccaau

SEQ ID NO: 3727926 - RNA, 20 nt, Salmonella enterica enterica serovar Typhi Ty2
uauuuucuccggcaguccau

SEQ ID NO: 3727927 - RNA, 23 nt, Salmonella enterica enterica serovar Typhi Ty2
uauuuuggcucccgaacgauaau

SEQ ID NO: 3727928 - RNA, 20 nt, Salmonella enterica enterica serovar Typhi Ty2
uauuuugguguaacagcaac

SEQ ID NO: 3727929 - RNA, 13 nt, Salmonella enterica enterica serovar Typhi Ty2
uauuuuucacaca

SEQ ID NO: 3727930 - RNA, 14 nt, Salmonella enterica enterica serovar Typhi Ty2
uauuuuucaccuca

SEQ ID NO: 3727931 - RNA, 14 nt, Salmonella enterica enterica serovar Typhi Ty2
uauuuuuucugcua

SEQ ID NO: 3727932 - RNA, 15 nt, Salmonella enterica enterica serovar Typhi Ty2
ucaaaaaaaaccaga

SEQ ID NO: 3727933 - RNA, 13 nt, Salmonella enterica enterica serovar Typhi Ty2
ucaaaaaaaauag

SEQ ID NO: 3727934 - RNA, 21 nt, Salmonella enterica enterica serovar Typhi Ty2
ucaaaaaaaauagccauugcu

SEQ ID NO: 3727935 - RNA, 22 nt, Salmonella enterica enterica serovar Typhi Ty2
ucaaaaaagcgacgcugucaau

SEQ ID NO: 3727936 - RNA, 14 nt, Salmonella enterica enterica serovar Typhi Ty2
ucaaaaaauaucuc

SEQ ID NO: 3727937 - RNA, 19 nt, Salmonella enterica enterica serovar Typhi Ty2
ucaaaaaauaucucucccu

SEQ ID NO: 3727938 - RNA, 16 nt, Salmonella enterica enterica serovar Typhi Ty2
ucaaaaaaucagcaau

SEQ ID NO: 3727939 - RNA, 21 nt, Salmonella enterica enterica serovar Typhi Ty2
ucaaaaaaucgaccaacgcac

SEQ ID NO: 3727940 - RNA, 18 nt, Salmonella enterica enterica serovar Typhi Ty2
ucaaaaaguugucuuccu

SEQ ID NO: 3727941 - RNA, 14 nt, Salmonella enterica enterica serovar Typhi Ty2
ucaaaaauaaaaac

SEQ ID NO: 3727942 - RNA, 19 nt, Salmonella enterica enterica serovar Typhi Ty2
ucaaaaauagcauuaagcu

SEQ ID NO: 3727943 - RNA, 21 nt, Salmonella enterica enterica serovar Typhi Ty2
ucaaaacagaaccccaucgcc

SEQ ID NO: 3727944 - RNA, 23 nt, Salmonella enterica enterica serovar Typhi Ty2
ucaaaaccagcgcggauaaaaaa

SEQ ID NO: 3727945 - RNA, 23 nt, Salmonella enterica enterica serovar Typhi Ty2
ucaaaacccagcccaauacgcca

SEQ ID NO: 3727946 - RNA, 18 nt, Salmonella enterica enterica serovar Typhi Ty2
ucaaaagauugauuuauu

SEQ ID NO: 3727947 - RNA, 16 nt, Salmonella enterica enterica serovar Typhi Ty2
ucaaaaggugagaaaa

SEQ ID NO: 3727948 - RNA, 16 nt, Salmonella enterica enterica serovar Typhi Ty2
ucaaaaucaucgccac

SEQ ID NO: 3727949 - RNA, 21 nt, Salmonella enterica enterica serovar Typhi Ty2
ucaaaaugaucagaccaucgg

SEQ ID NO: 3727950 - RNA, 17 nt, Salmonella enterica enterica serovar Typhi Ty2
ucaaacacaaauuucga

SEQ ID NO: 3727951 - RNA, 16 nt, Salmonella enterica enterica serovar Typhi Ty2
ucaaacacgaccagcg

SEQ ID NO: 3727952 - RNA, 19 nt, Salmonella enterica enterica serovar Typhi Ty2
ucaaacaggcgaaaacgua

SEQ ID NO: 3727953 - RNA, 23 nt, Salmonella enterica enterica serovar Typhi Ty2
ucaaacaggcggcuguugguuua

SEQ ID NO: 3727954 - RNA, 16 nt, Salmonella enterica enterica serovar Typhi Ty2
ucaaacaggcugucug

SEQ ID NO: 3727955 - RNA, 21 nt, Salmonella enterica enterica serovar Typhi Ty2
ucaaacaggcugucugccaug

SEQ ID NO: 3727956 - RNA, 13 nt, Salmonella enterica enterica serovar Typhi Ty2
ucaaaccacgcug

SEQ ID NO: 3727957 - RNA, 20 nt, Salmonella enterica enterica serovar Typhi Ty2
ucaaacccuuccagacagcu

SEQ ID NO: 3727958 - RNA, 14 nt, Salmonella enterica enterica serovar Typhi Ty2
ucaaacccuuccgc

SEQ ID NO: 3727959 - RNA, 12 nt, Salmonella enterica enterica serovar Typhi Ty2
ucaaacgcagca

SEQ ID NO: 3727960 - RNA, 21 nt, Salmonella enterica enterica serovar Typhi Ty2
ucaaacuccccugucguuaau

SEQ ID NO: 3727961 - RNA, 21 nt, Salmonella enterica enterica serovar Typhi Ty2
ucaaacuccgcgcuggcaaua

SEQ ID NO: 3727962 - RNA, 22 nt, Salmonella enterica enterica serovar Typhi Ty2
ucaaacugacugaugcuggcgc

SEQ ID NO: 3727963 - RNA, 20 nt, Salmonella enterica enterica serovar Typhi Ty2
ucaaacuuuuaaauugaaga

SEQ ID NO: 3727964 - RNA, 13 nt, Salmonella enterica enterica serovar Typhi Ty2
ucaaacuuuuaua

SEQ ID NO: 3727965 - RNA, 20 nt, Salmonella enterica enterica serovar Typhi Ty2
ucaagcugauugauuuugua

SEQ ID NO: 3727966 - RNA, 21 nt, Salmonella enterica enterica serovar Typhi Ty2
ucaagcuggacgguaaccauu

SEQ ID NO: 3727967 - RNA, 22 nt, Salmonella enterica enterica serovar Typhi Ty2
ucaaggauggagauaucaccau

SEQ ID NO: 3727968 - RNA, 23 nt, Salmonella enterica enterica serovar Typhi Ty2
ucaaggauggagauaucaccauc

SEQ ID NO: 3727969 - RNA, 13 nt, Salmonella enterica enterica serovar Typhi Ty2
ucaaggcaauaga

SEQ ID NO: 3727970 - RNA, 13 nt, Salmonella enterica enterica serovar Typhi Ty2
ucaaguacagcuu

SEQ ID NO: 3727971 - RNA, 22 nt, Salmonella enterica enterica serovar Typhi Ty2
ucaaguuauguuauccccacuu

SEQ ID NO: 3727972 - RNA, 21 nt, Salmonella enterica enterica serovar Typhi Ty2
ucaaguuuagaaaaaauuaaa

SEQ ID NO: 3727973 - RNA, 16 nt, Salmonella enterica enterica serovar Typhi Ty2
ucaauaaacagcuccg

SEQ ID NO: 3727974 - RNA, 18 nt, Salmonella enterica enterica serovar Typhi Ty2
ucaauaaacagcuccgca

SEQ ID NO: 3727975 - RNA, 21 nt, Salmonella enterica enterica serovar Typhi Ty2
ucaauaaacauuuuuuuugca

SEQ ID NO: 3727976 - RNA, 22 nt, Salmonella enterica enterica serovar Typhi Ty2
ucaauaagaaacugcuguagca

SEQ ID NO: 3727977 - RNA, 15 nt, Salmonella enterica enterica serovar Typhi Ty2
ucaauaauauuauca

SEQ ID NO: 3727978 - RNA, 19 nt, Salmonella enterica enterica serovar Typhi Ty2
ucaauaauauuaucauaau

SEQ ID NO: 3727979 - RNA, 21 nt, Salmonella enterica enterica serovar Typhi Ty2
ucaauaauggcgcgaaaacag

SEQ ID NO: 3727980 - RNA, 18 nt, Salmonella enterica enterica serovar Typhi Ty2
ucaauacagagauauuaa

SEQ ID NO: 3727981 - RNA, 17 nt, Salmonella enterica enterica serovar Typhi Ty2
ucaauaccuuaguaaaa

SEQ ID NO: 3727982 - RNA, 22 nt, Salmonella enterica enterica serovar Typhi Ty2
ucaauacgagugacauuauuca

SEQ ID NO: 3727983 - RNA, 15 nt, Salmonella enterica enterica serovar Typhi Ty2
ucaauacgcauaaug

SEQ ID NO: 3727984 - RNA, 19 nt, Salmonella enterica enterica serovar Typhi Ty2
ucaaucaacuccauaauuu

SEQ ID NO: 3727985 - RNA, 13 nt, Salmonella enterica enterica serovar Typhi Ty2
ucaaucaacucuu

SEQ ID NO: 3727986 - RNA, 22 nt, Salmonella enterica enterica serovar Typhi Ty2
ucaaucacugaugccacacccu

SEQ ID NO: 3727987 - RNA, 12 nt, Salmonella enterica enterica serovar Typhi Ty2
ucaaucaggcua

SEQ ID NO: 3727988 - RNA, 17 nt, Salmonella enterica enterica serovar Typhi Ty2
ucaaucaucauaucccg

SEQ ID NO: 3727989 - RNA, 19 nt, Salmonella enterica enterica serovar Typhi Ty2
ucaauccaacgaaacucag

SEQ ID NO: 3727990 - RNA, 20 nt, Salmonella enterica enterica serovar Typhi Ty2
ucaauccaacgaaacucagc

SEQ ID NO: 3727991 - RNA, 17 nt, Salmonella enterica enterica serovar Typhi Ty2
ucaaucggcgauagagu

SEQ ID NO: 3727992 - RNA, 15 nt, Salmonella enterica enterica serovar Typhi Ty2
ucaaugcacgccaca

SEQ ID NO: 3727993 - RNA, 16 nt, Salmonella enterica enterica serovar Typhi Ty2
ucaaugcccagcgcaa

SEQ ID NO: 3727994 - RNA, 22 nt, Salmonella enterica enterica serovar Typhi Ty2
ucaaugcccuuaaauccggccu

SEQ ID NO: 3727995 - RNA, 22 nt, Salmonella enterica enterica serovar Typhi Ty2
ucaaugccgucggcaauuaaca

SEQ ID NO: 3727996 - RNA, 17 nt, Salmonella enterica enterica serovar Typhi Ty2
ucaauggccuugccagc

SEQ ID NO: 3727997 - RNA, 22 nt, Salmonella enterica enterica serovar Typhi Ty2
ucaauggcgcgaagugccaggu

SEQ ID NO: 3727998 - RNA, 23 nt, Salmonella enterica enterica serovar Typhi Ty2
ucaauggcgcgaagugccagguu

SEQ ID NO: 3727999 - RNA, 20 nt, Salmonella enterica enterica serovar Typhi Ty2
ucaauggcgucaaacagcuu

SEQ ID NO: 3728000 - RNA, 20 nt, Salmonella enterica enterica serovar Typhi Ty2
ucaaugggauagugccugcc

SEQ ID NO: 3728001 - RNA, 19 nt, Salmonella enterica enterica serovar Typhi Ty2
ucaaugucugauggcgcug

SEQ ID NO: 3728002 - RNA, 14 nt, Salmonella enterica enterica serovar Typhi Ty2
ucaauuccacaggc

SEQ ID NO: 3728003 - RNA, 19 nt, Salmonella enterica enterica serovar Typhi Ty2
ucaauuccuuuuaauuuaa

SEQ ID NO: 3728004 - RNA, 14 nt, Salmonella enterica enterica serovar Typhi Ty2
ucaauucuuuaauu

SEQ ID NO: 3728005 - RNA, 11 nt, Salmonella enterica enterica serovar Typhi Ty2
ucaauuuccag

SEQ ID NO: 3728006 - RNA, 16 nt, Salmonella enterica enterica serovar Typhi Ty2
ucaauuuuacagccuc

SEQ ID NO: 3728007 - RNA, 13 nt, Salmonella enterica enterica serovar Typhi Ty2
ucaauuuuucgcc

SEQ ID NO: 3728008 - RNA, 15 nt, Salmonella enterica enterica serovar Typhi Ty2
ucacaaaauggcuga

SEQ ID NO: 3728009 - RNA, 15 nt, Salmonella enterica enterica serovar Typhi Ty2
ucacaaacaauuucc

SEQ ID NO: 3728010 - RNA, 22 nt, Salmonella enterica enterica serovar Typhi Ty2
ucacaaacaauuucccccacuu

SEQ ID NO: 3728011 - RNA, 14 nt, Salmonella enterica enterica serovar Typhi Ty2
ucacaaacaccacc

SEQ ID NO: 3728012 - RNA, 22 nt, Salmonella enterica enterica serovar Typhi Ty2
ucacaaacaccaccaguaaccg

SEQ ID NO: 3728013 - RNA, 23 nt, Salmonella enterica enterica serovar Typhi Ty2
ucacaaacaccaccaguaaccgc

SEQ ID NO: 3728014 - RNA, 13 nt, Salmonella enterica enterica serovar Typhi Ty2
ucacaaaccagac

SEQ ID NO: 3728015 - RNA, 16 nt, Salmonella enterica enterica serovar Typhi Ty2
ucacaaauuaaaaauc

SEQ ID NO: 3728016 - RNA, 13 nt, Salmonella enterica enterica serovar Typhi Ty2
ucacaaccuccac

SEQ ID NO: 3728017 - RNA, 18 nt, Salmonella enterica enterica serovar Typhi Ty2
ucacaaccuccacgccca

SEQ ID NO: 3728018 - RNA, 13 nt, Salmonella enterica enterica serovar Typhi Ty2
ucacaaggaauga

SEQ ID NO: 3728019 - RNA, 17 nt, Salmonella enterica enterica serovar Typhi Ty2
ucacaauaucgagauga

SEQ ID NO: 3728020 - RNA, 17 nt, Salmonella enterica enterica serovar Typhi Ty2
ucacaaucgcgccugcc

SEQ ID NO: 3728021 - RNA, 16 nt, Salmonella enterica enterica serovar Typhi Ty2
ucacaaugaccucuuu

SEQ ID NO: 3728022 - RNA, 19 nt, Salmonella enterica enterica serovar Typhi Ty2
ucacacauaagcacaccau

SEQ ID NO: 3728023 - RNA, 16 nt, Salmonella enterica enterica serovar Typhi Ty2
ucacacauaucgccag

SEQ ID NO: 3728024 - RNA, 21 nt, Salmonella enterica enterica serovar Typhi Ty2
ucacaccaacgcuggcccggc

SEQ ID NO: 3728025 - RNA, 22 nt, Salmonella enterica enterica serovar Typhi Ty2
ucacaccggcggagucgguaca

SEQ ID NO: 3728026 - RNA, 16 nt, Salmonella enterica enterica serovar Typhi Ty2
ucacacgcucacccag

SEQ ID NO: 3728027 - RNA, 18 nt, Salmonella enterica enterica serovar Typhi Ty2
ucacacuacacgaauacc

SEQ ID NO: 3728028 - RNA, 15 nt, Salmonella enterica enterica serovar Typhi Ty2
ucacacugcgccgcc

SEQ ID NO: 3728029 - RNA, 20 nt, Salmonella enterica enterica serovar Typhi Ty2
ucacacugcgccgccagcga

SEQ ID NO: 3728030 - RNA, 19 nt, Salmonella enterica enterica serovar Typhi Ty2
ucacagccacacugcugug

SEQ ID NO: 3728031 - RNA, 17 nt, Salmonella enterica enterica serovar Typhi Ty2
ucacagcgguuacgcua

SEQ ID NO: 3728032 - RNA, 15 nt, Salmonella enterica enterica serovar Typhi Ty2
ucacaggcauacaga

SEQ ID NO: 3728033 - RNA, 14 nt, Salmonella enterica enterica serovar Typhi Ty2
ucacaggcuuauac

SEQ ID NO: 3728034 - RNA, 20 nt, Salmonella enterica enterica serovar Typhi Ty2
ucacaggcuucgacaaacag

SEQ ID NO: 3728035 - RNA, 17 nt, Salmonella enterica enterica serovar Typhi Ty2
ucacagggggaacauuu

SEQ ID NO: 3728036 - RNA, 17 nt, Salmonella enterica enterica serovar Typhi Ty2
ucacauacagcacuucc

SEQ ID NO: 3728037 - RNA, 15 nt, Salmonella enterica enterica serovar Typhi Ty2
ucacauaucccagac

SEQ ID NO: 3728038 - RNA, 17 nt, Salmonella enterica enterica serovar Typhi Ty2
ucacauauucaauaaua

SEQ ID NO: 3728039 - RNA, 19 nt, Salmonella enterica enterica serovar Typhi Ty2
ucacaucgccggagaucag

SEQ ID NO: 3728040 - RNA, 22 nt, Salmonella enterica enterica serovar Typhi Ty2
ucacaucguaaaucagcgugau

SEQ ID NO: 3728041 - RNA, 18 nt, Salmonella enterica enterica serovar Typhi Ty2
ucacaugcuuauccagcu

SEQ ID NO: 3728042 - RNA, 13 nt, Salmonella enterica enterica serovar Typhi Ty2
ucacauguagcgc

SEQ ID NO: 3728043 - RNA, 16 nt, Salmonella enterica enterica serovar Typhi Ty2
ucacauuggcaaaccc

SEQ ID NO: 3728044 - RNA, 15 nt, Salmonella enterica enterica serovar Typhi Ty2
ucaccaaaaggcaga

SEQ ID NO: 3728045 - RNA, 14 nt, Salmonella enterica enterica serovar Typhi Ty2
ucaccacaaaggcg

SEQ ID NO: 3728046 - RNA, 16 nt, Salmonella enterica enterica serovar Typhi Ty2
ucaccaccgcaggcag

SEQ ID NO: 3728047 - RNA, 15 nt, Salmonella enterica enterica serovar Typhi Ty2
gugcaggagcaguga

SEQ ID NO: 3728048 - RNA, 13 nt, Salmonella enterica enterica serovar Typhi Ty2
gugcaggccggau

SEQ ID NO: 3728049 - RNA, 13 nt, Salmonella enterica enterica serovar Typhi Ty2
gugcagugaacca

SEQ ID NO: 3728050 - RNA, 22 nt, Salmonella enterica enterica serovar Typhi Ty2
gugcauaaagauuggcaucugc

SEQ ID NO: 3728051 - RNA, 13 nt, Salmonella enterica enterica serovar Typhi Ty2
gugcaucuccucg

SEQ ID NO: 3728052 - RNA, 14 nt, Salmonella enterica enterica serovar Typhi Ty2
gugcaucuccucgc

SEQ ID NO: 3728053 - RNA, 11 nt, Salmonella enterica enterica serovar Typhi Ty2
gugcauggugu

SEQ ID NO: 3728054 - RNA, 20 nt, Salmonella enterica enterica serovar Typhi Ty2
gugcauuauuuuagugaaaa

SEQ ID NO: 3728055 - RNA, 15 nt, Salmonella enterica enterica serovar Typhi Ty2
gugcauuccaggugu

SEQ ID NO: 3728056 - RNA, 14 nt, Salmonella enterica enterica serovar Typhi Ty2
gugccaauggcgau

SEQ ID NO: 3728057 - RNA, 12 nt, Salmonella enterica enterica serovar Typhi Ty2
gugccaccagcc

SEQ ID NO: 3728058 - RNA, 12 nt, Salmonella enterica enterica serovar Typhi Ty2
gugccagguuuu

SEQ ID NO: 3728059 - RNA, 19 nt, Salmonella enterica enterica serovar Typhi Ty2
gugccaguaacucaucgcc

SEQ ID NO: 3728060 - RNA, 20 nt, Salmonella enterica enterica serovar Typhi Ty2
gugccaguaacucaucgcca

SEQ ID NO: 3728061 - RNA, 16 nt, Salmonella enterica enterica serovar Typhi Ty2
gugccaugaccauuca

SEQ ID NO: 3728062 - RNA, 13 nt, Salmonella enterica enterica serovar Typhi Ty2
gugccaugaguaa

SEQ ID NO: 3728063 - RNA, 19 nt, Salmonella enterica enterica serovar Typhi Ty2
gugcccgcgaucgcuucca

SEQ ID NO: 3728064 - RNA, 18 nt, Salmonella enterica enterica serovar Typhi Ty2
gugcccgcgguuugacug

SEQ ID NO: 3728065 - RNA, 23 nt, Salmonella enterica enterica serovar Typhi Ty2
gugccgaaaucaucaauggcgau

SEQ ID NO: 3728066 - RNA, 17 nt, Salmonella enterica enterica serovar Typhi Ty2
gugccgacaaccugccc

SEQ ID NO: 3728067 - RNA, 21 nt, Salmonella enterica enterica serovar Typhi Ty2
gugccgauggcgcuccugaau

SEQ ID NO: 3728068 - RNA, 17 nt, Salmonella enterica enterica serovar Typhi Ty2
gugccgcggcuucauca

SEQ ID NO: 3728069 - RNA, 12 nt, Salmonella enterica enterica serovar Typhi Ty2
gugccgcuggug

SEQ ID NO: 3728070 - RNA, 19 nt, Salmonella enterica enterica serovar Typhi Ty2
gugccggaaagacggcagc

SEQ ID NO: 3728071 - RNA, 19 nt, Salmonella enterica enterica serovar Typhi Ty2
gugccgguaaagggcggga

SEQ ID NO: 3728072 - RNA, 12 nt, Salmonella enterica enterica serovar Typhi Ty2
gugccgguggga

SEQ ID NO: 3728073 - RNA, 13 nt, Salmonella enterica enterica serovar Typhi Ty2
gugccgucaucca

SEQ ID NO: 3728074 - RNA, 17 nt, Salmonella enterica enterica serovar Typhi Ty2
gugccguccggcaucac

SEQ ID NO: 3728075 - RNA, 23 nt, Salmonella enterica enterica serovar Typhi Ty2
gugccgugagcgcguaggccaga

SEQ ID NO: 3728076 - RNA, 16 nt, Salmonella enterica enterica serovar Typhi Ty2
gugccguguaaggcaa

SEQ ID NO: 3728077 - RNA, 21 nt, Salmonella enterica enterica serovar Typhi Ty2
gugccguuaaucgauaagcca

SEQ ID NO: 3728078 - RNA, 17 nt, Salmonella enterica enterica serovar Typhi Ty2
gugccguugaccagcug

SEQ ID NO: 3728079 - RNA, 17 nt, Salmonella enterica enterica serovar Typhi Ty2
gugccugacagcaauga

SEQ ID NO: 3728080 - RNA, 14 nt, Salmonella enterica enterica serovar Typhi Ty2
gugcgacaccacgc

SEQ ID NO: 3728081 - RNA, 13 nt, Salmonella enterica enterica serovar Typhi Ty2
gugcgagaaaaag

SEQ ID NO: 3728082 - RNA, 21 nt, Salmonella enterica enterica serovar Typhi Ty2
gugcgaguucaagucucgccu

SEQ ID NO: 3728083 - RNA, 16 nt, Salmonella enterica enterica serovar Typhi Ty2
gugcgcaauuccagca

SEQ ID NO: 3728084 - RNA, 18 nt, Salmonella enterica enterica serovar Typhi Ty2
gugcgcagccccagcgcc

SEQ ID NO: 3728085 - RNA, 18 nt, Salmonella enterica enterica serovar Typhi Ty2
gugcgccagccuuauccc

SEQ ID NO: 3728086 - RNA, 13 nt, Salmonella enterica enterica serovar Typhi Ty2
gugcgccauccgg

SEQ ID NO: 3728087 - RNA, 18 nt, Salmonella enterica enterica serovar Typhi Ty2
gugcgccccuugcagcaa

SEQ ID NO: 3728088 - RNA, 17 nt, Salmonella enterica enterica serovar Typhi Ty2
gugcgccguccugcaag

SEQ ID NO: 3728089 - RNA, 15 nt, Salmonella enterica enterica serovar Typhi Ty2
gugcgcggcgaaaaa

SEQ ID NO: 3728090 - RNA, 16 nt, Salmonella enterica enterica serovar Typhi Ty2
gugcgcgggaggcggu

SEQ ID NO: 3728091 - RNA, 22 nt, Salmonella enterica enterica serovar Typhi Ty2
gugcgcggucauaucuggacgg

SEQ ID NO: 3728092 - RNA, 15 nt, Salmonella enterica enterica serovar Typhi Ty2
gugcgcuguggucgu

SEQ ID NO: 3728093 - RNA, 14 nt, Salmonella enterica enterica serovar Typhi Ty2
gugcggacguagcg

SEQ ID NO: 3728094 - RNA, 16 nt, Salmonella enterica enterica serovar Typhi Ty2
gugcggcaaccaccag

SEQ ID NO: 3728095 - RNA, 22 nt, Salmonella enterica enterica serovar Typhi Ty2
gugcggcauauucaggagcaug

SEQ ID NO: 3728096 - RNA, 20 nt, Salmonella enterica enterica serovar Typhi Ty2
gugcggccuaaaucgcugcu

SEQ ID NO: 3728097 - RNA, 18 nt, Salmonella enterica enterica serovar Typhi Ty2
gugcggcgcacugccuga

SEQ ID NO: 3728098 - RNA, 13 nt, Salmonella enterica enterica serovar Typhi Ty2
gugcggcuuaucg

SEQ ID NO: 3728099 - RNA, 19 nt, Salmonella enterica enterica serovar Typhi Ty2
gugcgggaggaauaaaaga

SEQ ID NO: 3728100 - RNA, 21 nt, Salmonella enterica enterica serovar Typhi Ty2
gugguuaugaucgucaacgca

SEQ ID NO: 3728101 - RNA, 16 nt, Salmonella enterica enterica serovar Typhi Ty2
guguaaaagccagcaa

SEQ ID NO: 3728102 - RNA, 19 nt, Salmonella enterica enterica serovar Typhi Ty2
guguaauaaccguggcggc

SEQ ID NO: 3728103 - RNA, 21 nt, Salmonella enterica enterica serovar Typhi Ty2
guguaauaaccguggcggcag

SEQ ID NO: 3728104 - RNA, 15 nt, Salmonella enterica enterica serovar Typhi Ty2
guguaauguuuucug

SEQ ID NO: 3728105 - RNA, 12 nt, Salmonella enterica enterica serovar Typhi Ty2
guguacauccag

SEQ ID NO: 3728106 - RNA, 13 nt, Salmonella enterica enterica serovar Typhi Ty2
guguaccagcagc

SEQ ID NO: 3728107 - RNA, 14 nt, Salmonella enterica enterica serovar Typhi Ty2
guguaccagcagcg

SEQ ID NO: 3728108 - RNA, 19 nt, Salmonella enterica enterica serovar Typhi Ty2
guguagaauguaggccggg

SEQ ID NO: 3728109 - RNA, 15 nt, Salmonella enterica enterica serovar Typhi Ty2
guguagagauucugc

SEQ ID NO: 3728110 - RNA, 19 nt, Salmonella enterica enterica serovar Typhi Ty2
guguaggaaaggcagagaa

SEQ ID NO: 3728111 - RNA, 15 nt, Salmonella enterica enterica serovar Typhi Ty2
guguauaccaaaaau

SEQ ID NO: 3728112 - RNA, 18 nt, Salmonella enterica enterica serovar Typhi Ty2
guguaucgcccugccagc

SEQ ID NO: 3728113 - RNA, 11 nt, Salmonella enterica enterica serovar Typhi Ty2
gugucaaagcg

SEQ ID NO: 3728114 - RNA, 19 nt, Salmonella enterica enterica serovar Typhi Ty2
gugucauaacgaccaaaca

SEQ ID NO: 3728115 - RNA, 19 nt, Salmonella enterica enterica serovar Typhi Ty2
gugucaucauuacaggcga

SEQ ID NO: 3728116 - RNA, 21 nt, Salmonella enterica enterica serovar Typhi Ty2
guguccaggucaucaccucca

SEQ ID NO: 3728117 - RNA, 15 nt, Salmonella enterica enterica serovar Typhi Ty2
guguccaucaggcuu

SEQ ID NO: 3728118 - RNA, 13 nt, Salmonella enterica enterica serovar Typhi Ty2
gugucccgcugug

SEQ ID NO: 3728119 - RNA, 18 nt, Salmonella enterica enterica serovar Typhi Ty2
guguccguaagcggcgga

SEQ ID NO: 3728120 - RNA, 13 nt, Salmonella enterica enterica serovar Typhi Ty2
gugucgaccggca

SEQ ID NO: 3728121 - RNA, 23 nt, Salmonella enterica enterica serovar Typhi Ty2
gugucgaugagcucguuauaagc

SEQ ID NO: 3728122 - RNA, 15 nt, Salmonella enterica enterica serovar Typhi Ty2
gugucgccauaaauc

SEQ ID NO: 3728123 - RNA, 14 nt, Salmonella enterica enterica serovar Typhi Ty2
gugucguaguggca

SEQ ID NO: 3728124 - RNA, 17 nt, Salmonella enterica enterica serovar Typhi Ty2
gugucucgucgccaggg

SEQ ID NO: 3728125 - RNA, 16 nt, Salmonella enterica enterica serovar Typhi Ty2
gugucugcuucgucug

SEQ ID NO: 3728126 - RNA, 22 nt, Salmonella enterica enterica serovar Typhi Ty2
gugucuucccugaccagcgacg

SEQ ID NO: 3728127 - RNA, 19 nt, Salmonella enterica enterica serovar Typhi Ty2
gugucuuuuucaucuuuua

SEQ ID NO: 3728128 - RNA, 12 nt, Salmonella enterica enterica serovar Typhi Ty2
gugugaccagcg

SEQ ID NO: 3728129 - RNA, 14 nt, Salmonella enterica enterica serovar Typhi Ty2
gugugcagugacag

SEQ ID NO: 3728130 - RNA, 16 nt, Salmonella enterica enterica serovar Typhi Ty2
gugugcggaugcgcca

SEQ ID NO: 3728131 - RNA, 17 nt, Salmonella enterica enterica serovar Typhi Ty2
guguggcuaucggccug

SEQ ID NO: 3728132 - RNA, 16 nt, Salmonella enterica enterica serovar Typhi Ty2
gugugggcacucgaag

SEQ ID NO: 3728133 - RNA, 18 nt, Salmonella enterica enterica serovar Typhi Ty2
guguggucgcggcucacc

SEQ ID NO: 3728134 - RNA, 18 nt, Salmonella enterica enterica serovar Typhi Ty2
guguguaauugacauggc

SEQ ID NO: 3728135 - RNA, 19 nt, Salmonella enterica enterica serovar Typhi Ty2
guguguaccagcagcgcca

SEQ ID NO: 3728136 - RNA, 23 nt, Salmonella enterica enterica serovar Typhi Ty2
guguguuauagcguuuuauccgu

SEQ ID NO: 3728137 - RNA, 18 nt, Salmonella enterica enterica serovar Typhi Ty2
guguguuuuuuaauauaa

SEQ ID NO: 3728138 - RNA, 15 nt, Salmonella enterica enterica serovar Typhi Ty2
guguuaaucauuuuc

SEQ ID NO: 3728139 - RNA, 22 nt, Salmonella enterica enterica serovar Typhi Ty2
guguuaucgcuaucaagcugau

SEQ ID NO: 3728140 - RNA, 21 nt, Salmonella enterica enterica serovar Typhi Ty2
guguuauuuucaaaaacaagg

SEQ ID NO: 3728141 - RNA, 15 nt, Salmonella enterica enterica serovar Typhi Ty2
guguucacaauugug

SEQ ID NO: 3728142 - RNA, 18 nt, Salmonella enterica enterica serovar Typhi Ty2
guguucaugcgcggcgga

SEQ ID NO: 3728143 - RNA, 19 nt, Salmonella enterica enterica serovar Typhi Ty2
guguugguacacagcacaa

SEQ ID NO: 3728144 - RNA, 18 nt, Salmonella enterica enterica serovar Typhi Ty2
guguuguaaaacgcgccc

SEQ ID NO: 3728145 - RNA, 13 nt, Salmonella enterica enterica serovar Typhi Ty2
guguuugccagac

SEQ ID NO: 3728146 - RNA, 15 nt, Salmonella enterica enterica serovar Typhi Ty2
guguuugucggcucc

SEQ ID NO: 3728147 - RNA, 19 nt, Salmonella enterica enterica serovar Typhi Ty2
guguuuuuuaauauauuca

SEQ ID NO: 3728148 - RNA, 15 nt, Salmonella enterica enterica serovar Typhi Ty2
guuaaaaccggcugc

SEQ ID NO: 3728149 - RNA, 20 nt, Salmonella enterica enterica serovar Typhi Ty2
guuaaaccaggcgaacccca

SEQ ID NO: 3728150 - RNA, 19 nt, Salmonella enterica enterica serovar Typhi Ty2
guuaaaccugguauuacaa

SEQ ID NO: 3728151 - RNA, 12 nt, Salmonella enterica enterica serovar Typhi Ty2
guuaaauaccag

SEQ ID NO: 3728152 - RNA, 20 nt, Salmonella enterica enterica serovar Typhi Ty2
guuaaauagugacuucugcu

SEQ ID NO: 3728153 - RNA, 13 nt, Salmonella enterica enterica serovar Typhi Ty2
guuaaaucauaac

SEQ ID NO: 3728154 - RNA, 17 nt, Salmonella enterica enterica serovar Typhi Ty2
guuaacaauauugcgcu

SEQ ID NO: 3728155 - RNA, 20 nt, Salmonella enterica enterica serovar Typhi Ty2
guuaacaauccccgucacag

SEQ ID NO: 3728156 - RNA, 23 nt, Salmonella enterica enterica serovar Typhi Ty2
guuaacagacccgcuuucgcgua

SEQ ID NO: 3728157 - RNA, 19 nt, Salmonella enterica enterica serovar Typhi Ty2
guuaacaucaucaggccug

SEQ ID NO: 3728158 - RNA, 14 nt, Salmonella enterica enterica serovar Typhi Ty2
guuaacccaaaaac

SEQ ID NO: 3728159 - RNA, 19 nt, Salmonella enterica enterica serovar Typhi Ty2
guuaacccacaacgcgcca

SEQ ID NO: 3728160 - RNA, 22 nt, Salmonella enterica enterica serovar Typhi Ty2
guuaacgacccaucaauaacga

SEQ ID NO: 3728161 - RNA, 19 nt, Salmonella enterica enterica serovar Typhi Ty2
guuaacgcagcaucgccau

SEQ ID NO: 3728162 - RNA, 18 nt, Salmonella enterica enterica serovar Typhi Ty2
guuaacgcggccguaaua

SEQ ID NO: 3728163 - RNA, 14 nt, Salmonella enterica enterica serovar Typhi Ty2
guuaacucaaggua

SEQ ID NO: 3728164 - RNA, 13 nt, Salmonella enterica enterica serovar Typhi Ty2
guuaacugcugcu

SEQ ID NO: 3728165 - RNA, 21 nt, Salmonella enterica enterica serovar Typhi Ty2
guuaacuggauauuccaguua

SEQ ID NO: 3728166 - RNA, 17 nt, Salmonella enterica enterica serovar Typhi Ty2
guuaacuggcgcaucug

SEQ ID NO: 3728167 - RNA, 17 nt, Salmonella enterica enterica serovar Typhi Ty2
guuaacuucuccgccau

SEQ ID NO: 3728168 - RNA, 19 nt, Salmonella enterica enterica serovar Typhi Ty2
guuaagaggauugcguaau

SEQ ID NO: 3728169 - RNA, 14 nt, Salmonella enterica enterica serovar Typhi Ty2
guuaagcauuucgc

SEQ ID NO: 3728170 - RNA, 21 nt, Salmonella enterica enterica serovar Typhi Ty2
guuaaggcaucaauaccuguc

SEQ ID NO: 3728171 - RNA, 23 nt, Salmonella enterica enterica serovar Typhi Ty2
guuaaggccgcaaacagcacgcc

SEQ ID NO: 3728172 - RNA, 19 nt, Salmonella enterica enterica serovar Typhi Ty2
guuaaggggcaggcgucaa

SEQ ID NO: 3728173 - RNA, 18 nt, Salmonella enterica enterica serovar Typhi Ty2
guuaauaccguggucucc

SEQ ID NO: 3728174 - RNA, 12 nt, Salmonella enterica enterica serovar Typhi Ty2
guuaauacgccg

SEQ ID NO: 3728175 - RNA, 11 nt, Salmonella enterica enterica serovar Typhi Ty2
guuaauacuga

SEQ ID NO: 3728176 - RNA, 15 nt, Salmonella enterica enterica serovar Typhi Ty2
guuaauauacauuca

SEQ ID NO: 3728177 - RNA, 20 nt, Salmonella enterica enterica serovar Typhi Ty2
guuaauauacauucauuuua

SEQ ID NO: 3728178 - RNA, 19 nt, Salmonella enterica enterica serovar Typhi Ty2
guuaauauccuucagcguu

SEQ ID NO: 3728179 - RNA, 14 nt, Salmonella enterica enterica serovar Typhi Ty2
guuaaucauuuucu

SEQ ID NO: 3728180 - RNA, 19 nt, Salmonella enterica enterica serovar Typhi Ty2
guuaauccagagcggauaa

SEQ ID NO: 3728181 - RNA, 23 nt, Salmonella enterica enterica serovar Typhi Ty2
guuaauccuuagaauguuuuuua

SEQ ID NO: 3728182 - RNA, 16 nt, Salmonella enterica enterica serovar Typhi Ty2
guuaaugccaucauca

SEQ ID NO: 3728183 - RNA, 17 nt, Salmonella enterica enterica serovar Typhi Ty2
guuaaugccaucaucag

SEQ ID NO: 3728184 - RNA, 21 nt, Salmonella enterica enterica serovar Typhi Ty2
guuaaugguaccaauagccuu

SEQ ID NO: 3728185 - RNA, 12 nt, Salmonella enterica enterica serovar Typhi Ty2
guuaauuuuccc

SEQ ID NO: 3728186 - RNA, 14 nt, Salmonella enterica enterica serovar Typhi Ty2
guuacagacgcugc

SEQ ID NO: 3728187 - RNA, 17 nt, Salmonella enterica enterica serovar Typhi Ty2
guuacaggcuccaagua

SEQ ID NO: 3728188 - RNA, 20 nt, Salmonella enterica enterica serovar Typhi Ty2
guuaccaaugccaaaaaaac

SEQ ID NO: 3728189 - RNA, 19 nt, Salmonella enterica enterica serovar Typhi Ty2
guuacccagccugauggcg

SEQ ID NO: 3728190 - RNA, 19 nt, Salmonella enterica enterica serovar Typhi Ty2
guuaccccaucauugacuu

SEQ ID NO: 3728191 - RNA, 23 nt, Salmonella enterica enterica serovar Typhi Ty2
guuaccccgaagcgcccaugaau

SEQ ID NO: 3728192 - RNA, 14 nt, Salmonella enterica enterica serovar Typhi Ty2
guuacccgccaguc

SEQ ID NO: 3728193 - RNA, 19 nt, Salmonella enterica enterica serovar Typhi Ty2
guuacccuccugcaauccg

SEQ ID NO: 3728194 - RNA, 16 nt, Salmonella enterica enterica serovar Typhi Ty2
guuaccggcuccggca

SEQ ID NO: 3728195 - RNA, 20 nt, Salmonella enterica enterica serovar Typhi Ty2
guuaccggcuccggcaaauu

SEQ ID NO: 3728196 - RNA, 24 nt, Salmonella enterica enterica serovar Typhi Ty2
guuaccgggcaaacggcacuacag

SEQ ID NO: 3728197 - RNA, 18 nt, Salmonella enterica enterica serovar Typhi Ty2
guuaccguaaucaucgcg

SEQ ID NO: 3728198 - RNA, 16 nt, Salmonella enterica enterica serovar Typhi Ty2
guuaccguuuaacgca

SEQ ID NO: 3728199 - RNA, 19 nt, Salmonella enterica enterica serovar Typhi Ty2
guuaccucguuucacgucc

SEQ ID NO: 3728200 - RNA, 21 nt, Salmonella enterica enterica serovar Typhi Ty2
guuacgcacgccagauaaauc

SEQ ID NO: 3728201 - RNA, 13 nt, Salmonella enterica enterica serovar Typhi Ty2
guuacgcgccacg

SEQ ID NO: 3728202 - RNA, 14 nt, Salmonella enterica enterica serovar Typhi Ty2
guuacggaaaaaau

SEQ ID NO: 3728203 - RNA, 23 nt, Salmonella enterica enterica serovar Typhi Ty2
guuacggcugaagcugccguccc

SEQ ID NO: 3728204 - RNA, 13 nt, Salmonella enterica enterica serovar Typhi Ty2
guuacgggaacag

SEQ ID NO: 3728205 - RNA, 23 nt, Salmonella enterica enterica serovar Typhi Ty2
guuacgggaacagaauuaccugg

SEQ ID NO: 3728206 - RNA, 17 nt, Salmonella enterica enterica serovar Typhi Ty2
guuacucacugccgccc

SEQ ID NO: 3728207 - RNA, 14 nt, Salmonella enterica enterica serovar Typhi Ty2
guuacucuuccucc

SEQ ID NO: 3728208 - RNA, 16 nt, Salmonella enterica enterica serovar Typhi Ty2
guuacugcauuccgcg

SEQ ID NO: 3728209 - RNA, 15 nt, Salmonella enterica enterica serovar Typhi Ty2
guuacuggcgaccgg

SEQ ID NO: 3728210 - RNA, 14 nt, Salmonella enterica enterica serovar Typhi Ty2
guuacugguuuuuu

SEQ ID NO: 3728211 - RNA, 22 nt, Salmonella enterica enterica serovar Typhi Ty2
guuagagcacaucacucauaau

SEQ ID NO: 3728212 - RNA, 14 nt, Salmonella enterica enterica serovar Typhi Ty2
guuagauauuaaua

SEQ ID NO: 3728213 - RNA, 14 nt, Salmonella enterica enterica serovar Typhi Ty2
guuagcaacacaga

SEQ ID NO: 3728214 - RNA, 22 nt, Salmonella enterica enterica serovar Typhi Ty2
guuagcacauuuuuaucaggcc

SEQ ID NO: 3728215 - RNA, 16 nt, Salmonella enterica enterica serovar Typhi Ty2
guuagcauuauuuuua

SEQ ID NO: 3728216 - RNA, 18 nt, Salmonella enterica enterica serovar Typhi Ty2
guuagcgaacguccagcg

SEQ ID NO: 3728217 - RNA, 13 nt, Salmonella enterica enterica serovar Typhi Ty2
guuaggaaagcag

SEQ ID NO: 3728218 - RNA, 20 nt, Salmonella enterica enterica serovar Typhi Ty2
guuaggcaagcugguaaaug

SEQ ID NO: 3728219 - RNA, 14 nt, Salmonella enterica enterica serovar Typhi Ty2
guuaggcgcaaagg

SEQ ID NO: 3728220 - RNA, 16 nt, Salmonella enterica enterica serovar Typhi Ty2
guuaggguagaaaaag

SEQ ID NO: 3728221 - RNA, 22 nt, Salmonella enterica enterica serovar Typhi Ty2
guuagugacguuaucugucagc

SEQ ID NO: 3728222 - RNA, 17 nt, Salmonella enterica enterica serovar Typhi Ty2
guuaguuucuauuaaau

SEQ ID NO: 3728223 - RNA, 18 nt, Salmonella enterica enterica serovar Typhi Ty2
guuauaaauccccgccgc

SEQ ID NO: 3728224 - RNA, 22 nt, Salmonella enterica enterica serovar Typhi Ty2
guuauaaauuuauuuuuugcug

SEQ ID NO: 3728225 - RNA, 22 nt, Salmonella enterica enterica serovar Typhi Ty2
guuauaaggccugccguccuga

SEQ ID NO: 3728226 - RNA, 12 nt, Salmonella enterica enterica serovar Typhi Ty2
guuauacgguaa

SEQ ID NO: 3728227 - RNA, 23 nt, Salmonella enterica enterica serovar Typhi Ty2
guuauaguuuuacgguuuauccc

SEQ ID NO: 3728228 - RNA, 21 nt, Salmonella enterica enterica serovar Typhi Ty2
guuauauauuuuucagcuucu

SEQ ID NO: 3728229 - RNA, 11 nt, Salmonella enterica enterica serovar Typhi Ty2
guuauaugaau

SEQ ID NO: 3728230 - RNA, 17 nt, Salmonella enterica enterica serovar Typhi Ty2
guuaucaaaaaaaacca

SEQ ID NO: 3728231 - RNA, 19 nt, Salmonella enterica enterica serovar Typhi Ty2
guuauccagcaaccaggua

SEQ ID NO: 3728232 - RNA, 19 nt, Salmonella enterica enterica serovar Typhi Ty2
guuauccgccggagggcga

SEQ ID NO: 3728233 - RNA, 16 nt, Salmonella enterica enterica serovar Typhi Ty2
guuaucgaauccagca

SEQ ID NO: 3728234 - RNA, 17 nt, Salmonella enterica enterica serovar Typhi Ty2
guuaucguagugccaca

SEQ ID NO: 3728235 - RNA, 14 nt, Salmonella enterica enterica serovar Typhi Ty2
guuaucucgccagg

SEQ ID NO: 3728236 - RNA, 14 nt, Salmonella enterica enterica serovar Typhi Ty2
guuaucucuauuga

SEQ ID NO: 3728237 - RNA, 12 nt, Salmonella enterica enterica serovar Typhi Ty2
guuaugcaucug

SEQ ID NO: 3728238 - RNA, 16 nt, Salmonella enterica enterica serovar Typhi Ty2
guuaugcauugcugau

SEQ ID NO: 3728239 - RNA, 11 nt, Salmonella enterica enterica serovar Typhi Ty2
guuaugccauc

SEQ ID NO: 3728240 - RNA, 20 nt, Salmonella enterica enterica serovar Typhi Ty2
guuaugccgacaguuuuacc

SEQ ID NO: 3728241 - RNA, 15 nt, Salmonella enterica enterica serovar Typhi Ty2
guuauuaaguuuuac

SEQ ID NO: 3728242 - RNA, 15 nt, Salmonella enterica enterica serovar Typhi Ty2
guuauucagcaggag

SEQ ID NO: 3728243 - RNA, 15 nt, Salmonella enterica enterica serovar Typhi Ty2
guuauucauucaccc

SEQ ID NO: 3728244 - RNA, 23 nt, Salmonella enterica enterica serovar Typhi Ty2
guuauucgcccaaaugcacugca

SEQ ID NO: 3728245 - RNA, 18 nt, Salmonella enterica enterica serovar Typhi Ty2
guuauuugugauuuucug

SEQ ID NO: 3728246 - RNA, 19 nt, Salmonella enterica enterica serovar Typhi Ty2
guuauuuucaaaaacaagg

SEQ ID NO: 3728247 - RNA, 23 nt, Salmonella enterica enterica serovar Typhi Ty2
guucaaaaaugauguguuucagc

SEQ ID NO: 3728248 - RNA, 23 nt, Salmonella enterica enterica serovar Typhi Ty2
guucaacggcaaaucgcgguaaa

SEQ ID NO: 3728249 - RNA, 23 nt, Salmonella enterica enterica serovar Typhi Ty2
guucaauacccuuuucuuuaaac

SEQ ID NO: 3728250 - RNA, 18 nt, Salmonella enterica enterica serovar Typhi Ty2
guucaauagagcgcagca

SEQ ID NO: 3728251 - RNA, 23 nt, Salmonella enterica enterica serovar Typhi Ty2
guucaauagagcgcagcaaaacg

SEQ ID NO: 3728252 - RNA, 22 nt, Salmonella enterica enterica serovar Typhi Ty2
guucaauaugccaggcauuuuc

SEQ ID NO: 3728253 - RNA, 23 nt, Salmonella enterica enterica serovar Typhi Ty2
guucaaugagcguccagucgggc

SEQ ID NO: 3728254 - RNA, 15 nt, Salmonella enterica enterica serovar Typhi Ty2
guucacagauugcug

SEQ ID NO: 3728255 - RNA, 22 nt, Salmonella enterica enterica serovar Typhi Ty2
guucaccaccacccagugccac

SEQ ID NO: 3728256 - RNA, 21 nt, Salmonella enterica enterica serovar Typhi Ty2
guucaccguuuaaaaacauca

SEQ ID NO: 3728257 - RNA, 18 nt, Salmonella enterica enterica serovar Typhi Ty2
guucacgaucaccuggug

SEQ ID NO: 3728258 - RNA, 20 nt, Salmonella enterica enterica serovar Typhi Ty2
guucacgccgccauccgaca

SEQ ID NO: 3728259 - RNA, 17 nt, Salmonella enterica enterica serovar Typhi Ty2
guucacgccgccgccga

SEQ ID NO: 3728260 - RNA, 17 nt, Salmonella enterica enterica serovar Typhi Ty2
guucacgcgacggccca

SEQ ID NO: 3728261 - RNA, 15 nt, Salmonella enterica enterica serovar Typhi Ty2
guucacguaaucgcc

SEQ ID NO: 3728262 - RNA, 17 nt, Salmonella enterica enterica serovar Typhi Ty2
guucacuaacgcggcau

SEQ ID NO: 3728263 - RNA, 16 nt, Salmonella enterica enterica serovar Typhi Ty2
guucacuccuaagaga

SEQ ID NO: 3728264 - RNA, 19 nt, Salmonella enterica enterica serovar Typhi Ty2
guucagaaauguauucucc

SEQ ID NO: 3728265 - RNA, 15 nt, Salmonella enterica enterica serovar Typhi Ty2
guucagacguagcgc

SEQ ID NO: 3728266 - RNA, 18 nt, Salmonella enterica enterica serovar Typhi Ty2
guucagauaggcgcgaaa

SEQ ID NO: 3728267 - RNA, 11 nt, Salmonella enterica enterica serovar Typhi Ty2
guucagccagc

SEQ ID NO: 3728268 - RNA, 12 nt, Salmonella enterica enterica serovar Typhi Ty2
guucagccagca

SEQ ID NO: 3728269 - RNA, 12 nt, Salmonella enterica enterica serovar Typhi Ty2
guucagccgcca

SEQ ID NO: 3728270 - RNA, 14 nt, Salmonella enterica enterica serovar Typhi Ty2
guucagccgccagu

SEQ ID NO: 3728271 - RNA, 19 nt, Salmonella enterica enterica serovar Typhi Ty2
guucagcuacuucaggcug

SEQ ID NO: 3728272 - RNA, 18 nt, Salmonella enterica enterica serovar Typhi Ty2
guucagcucgauccggca

SEQ ID NO: 3728273 - RNA, 14 nt, Salmonella enterica enterica serovar Typhi Ty2
guucaggcggcaaa

SEQ ID NO: 3728274 - RNA, 14 nt, Salmonella enterica enterica serovar Typhi Ty2
guucagggcgacga

SEQ ID NO: 3728275 - RNA, 16 nt, Salmonella enterica enterica serovar Typhi Ty2
guucagucagcgcgag

SEQ ID NO: 3728276 - RNA, 12 nt, Salmonella enterica enterica serovar Typhi Ty2
guucaguuuuuc

SEQ ID NO: 3728277 - RNA, 16 nt, Salmonella enterica enterica serovar Typhi Ty2
guucauaagucaucca

SEQ ID NO: 3728278 - RNA, 15 nt, Salmonella enterica enterica serovar Typhi Ty2
guucaucauccugca

SEQ ID NO: 3728279 - RNA, 21 nt, Salmonella enterica enterica serovar Typhi Ty2
guucaucauccugcaggguaa

SEQ ID NO: 3728280 - RNA, 22 nt, Salmonella enterica enterica serovar Typhi Ty2
guucaucccacuccaucgccug

SEQ ID NO: 3728281 - RNA, 21 nt, Salmonella enterica enterica serovar Typhi Ty2
guucaucgcuggcguacgcca

SEQ ID NO: 3728282 - RNA, 22 nt, Salmonella enterica enterica serovar Typhi Ty2
guucaucgcuggcguacgccau

SEQ ID NO: 3728283 - RNA, 22 nt, Salmonella enterica enterica serovar Typhi Ty2
guucaucggcauacagcgauaa

SEQ ID NO: 3728284 - RNA, 20 nt, Salmonella enterica enterica serovar Typhi Ty2
guucaucgugaaauuauucc

SEQ ID NO: 3728285 - RNA, 15 nt, Salmonella enterica enterica serovar Typhi Ty2
guucaucucuucccg

SEQ ID NO: 3728286 - RNA, 19 nt, Salmonella enterica enterica serovar Typhi Ty2
guucaugaaccacgccaac

SEQ ID NO: 3728287 - RNA, 15 nt, Salmonella enterica enterica serovar Typhi Ty2
guucaugcacucgcg

SEQ ID NO: 3728288 - RNA, 15 nt, Salmonella enterica enterica serovar Typhi Ty2
guucaugcgcggcgg

SEQ ID NO: 3728289 - RNA, 16 nt, Salmonella enterica enterica serovar Typhi Ty2
guucauuaacaucugu

SEQ ID NO: 3728290 - RNA, 20 nt, Salmonella enterica enterica serovar Typhi Ty2
guucauucccgccaauaacc

SEQ ID NO: 3728291 - RNA, 21 nt, Salmonella enterica enterica serovar Typhi Ty2
guucauucccgccaauaacca

SEQ ID NO: 3728292 - RNA, 21 nt, Salmonella enterica enterica serovar Typhi Ty2
guucauugaugaugaagcugc

SEQ ID NO: 3728293 - RNA, 16 nt, Salmonella enterica enterica serovar Typhi Ty2
guucauugcuuucuug

SEQ ID NO: 3728294 - RNA, 18 nt, Salmonella enterica enterica serovar Typhi Ty2
guuccaccgccaauaaaa

SEQ ID NO: 3728295 - RNA, 20 nt, Salmonella enterica enterica serovar Typhi Ty2
guuccaccgccaauaaaaac

SEQ ID NO: 3728296 - RNA, 12 nt, Salmonella enterica enterica serovar Typhi Ty2
guuccaccugcg

SEQ ID NO: 3728297 - RNA, 22 nt, Salmonella enterica enterica serovar Typhi Ty2
guuccacgggaucguuuuaucu

SEQ ID NO: 3728298 - RNA, 15 nt, Salmonella enterica enterica serovar Typhi Ty2
guuccagaaugguua

SEQ ID NO: 3728299 - RNA, 12 nt, Salmonella enterica enterica serovar Typhi Ty2
guuccagcagcu

SEQ ID NO: 3728300 - RNA, 21 nt, Salmonella enterica enterica serovar Typhi Ty2
guuccagcagcucaucaauaa

SEQ ID NO: 3728301 - RNA, 16 nt, Salmonella enterica enterica serovar Typhi Ty2
guuccagccgccaggc

SEQ ID NO: 3728302 - RNA, 21 nt, Salmonella enterica enterica serovar Typhi Ty2
guuccagccguaacuaugcca

SEQ ID NO: 3728303 - RNA, 14 nt, Salmonella enterica enterica serovar Typhi Ty2
guuccagcgccacg

SEQ ID NO: 3728304 - RNA, 19 nt, Salmonella enterica enterica serovar Typhi Ty2
guuccagcguggcgauugc

SEQ ID NO: 3728305 - RNA, 16 nt, Salmonella enterica enterica serovar Typhi Ty2
guuccaguaaggucca

SEQ ID NO: 3728306 - RNA, 22 nt, Salmonella enterica enterica serovar Typhi Ty2
guuccccaacagcgaccacgcc

SEQ ID NO: 3728307 - RNA, 15 nt, Salmonella enterica enterica serovar Typhi Ty2
guucccgccugcugc

SEQ ID NO: 3728308 - RNA, 17 nt, Salmonella enterica enterica serovar Typhi Ty2
guucccgcgccagcguc

SEQ ID NO: 3728309 - RNA, 15 nt, Salmonella enterica enterica serovar Typhi Ty2
guucccggcaacagu

SEQ ID NO: 3728310 - RNA, 14 nt, Salmonella enterica enterica serovar Typhi Ty2
guucccuacgccca

SEQ ID NO: 3728311 - RNA, 14 nt, Salmonella enterica enterica serovar Typhi Ty2
guucccugcgcugg

SEQ ID NO: 3728312 - RNA, 14 nt, Salmonella enterica enterica serovar Typhi Ty2
guuccgaaauaaau

SEQ ID NO: 3728313 - RNA, 23 nt, Salmonella enterica enterica serovar Typhi Ty2
guuccgcgacaaugauuugcaac

SEQ ID NO: 3728314 - RNA, 18 nt, Salmonella enterica enterica serovar Typhi Ty2
guuccgcuaccugcgagc

SEQ ID NO: 3728315 - RNA, 18 nt, Salmonella enterica enterica serovar Typhi Ty2
guuccgcuuuucuggcuu

SEQ ID NO: 3728316 - RNA, 20 nt, Salmonella enterica enterica serovar Typhi Ty2
guuccgcuuuucuggcuuca

SEQ ID NO: 3728317 - RNA, 15 nt, Salmonella enterica enterica serovar Typhi Ty2
guuccggcacgguaa

SEQ ID NO: 3728318 - RNA, 16 nt, Salmonella enterica enterica serovar Typhi Ty2
guuccggcagacggcu

SEQ ID NO: 3728319 - RNA, 18 nt, Salmonella enterica enterica serovar Typhi Ty2
guuccggcggucagccag

SEQ ID NO: 3728320 - RNA, 19 nt, Salmonella enterica enterica serovar Typhi Ty2
guuccggcggucagccagc

SEQ ID NO: 3728321 - RNA, 21 nt, Salmonella enterica enterica serovar Typhi Ty2
guuccugcgggaacagauaaa

SEQ ID NO: 3728322 - RNA, 22 nt, Salmonella enterica enterica serovar Typhi Ty2
guuccugcgggaacagauaaau

SEQ ID NO: 3728323 - RNA, 22 nt, Salmonella enterica enterica serovar Typhi Ty2
guuccuuuacuucuuugcgauu

SEQ ID NO: 3728324 - RNA, 21 nt, Salmonella enterica enterica serovar Typhi Ty2
guucgaauagccgguaccaaa

SEQ ID NO: 3728325 - RNA, 24 nt, Salmonella enterica enterica serovar Typhi Ty2
guucgaaucccgucguagccacca

SEQ ID NO: 3728326 - RNA, 18 nt, Salmonella enterica enterica serovar Typhi Ty2
guucgacaauguccgcca

SEQ ID NO: 3728327 - RNA, 20 nt, Salmonella enterica enterica serovar Typhi Ty2
guucgauaaucccggcgcgc

SEQ ID NO: 3728328 - RNA, 15 nt, Salmonella enterica enterica serovar Typhi Ty2
guucgaucagcuggc

SEQ ID NO: 3728329 - RNA, 14 nt, Salmonella enterica enterica serovar Typhi Ty2
guucgccauccaga

SEQ ID NO: 3728330 - RNA, 23 nt, Salmonella enterica enterica serovar Typhi Ty2
guucgcccggcaugacaucagaa

SEQ ID NO: 3728331 - RNA, 20 nt, Salmonella enterica enterica serovar Typhi Ty2
guucgcccuucaucuuccag

SEQ ID NO: 3728332 - RNA, 17 nt, Salmonella enterica enterica serovar Typhi Ty2
guucgccggcaaucugu

SEQ ID NO: 3728333 - RNA, 19 nt, Salmonella enterica enterica serovar Typhi Ty2
guucgcgaauuucacgcag

SEQ ID NO: 3728334 - RNA, 16 nt, Salmonella enterica enterica serovar Typhi Ty2
guucgcgauuuucauc

SEQ ID NO: 3728335 - RNA, 15 nt, Salmonella enterica enterica serovar Typhi Ty2
guucgcgcaguucau

SEQ ID NO: 3728336 - RNA, 17 nt, Salmonella enterica enterica serovar Typhi Ty2
guucgcgcaguucaucc

SEQ ID NO: 3728337 - RNA, 15 nt, Salmonella enterica enterica serovar Typhi Ty2
guucgcgcauaccuu

SEQ ID NO: 3728338 - RNA, 13 nt, Salmonella enterica enterica serovar Typhi Ty2
guucgcguacgca

SEQ ID NO: 3728339 - RNA, 22 nt, Salmonella enterica enterica serovar Typhi Ty2
guucgcguauuggcgcgaucag

SEQ ID NO: 3728340 - RNA, 17 nt, Salmonella enterica enterica serovar Typhi Ty2
guucgcuuauuccuccg

SEQ ID NO: 3728341 - RNA, 23 nt, Salmonella enterica enterica serovar Typhi Ty2
guucggaagacugcuccggcaag

SEQ ID NO: 3728342 - RNA, 15 nt, Salmonella enterica enterica serovar Typhi Ty2
guucggauaaacgcu

SEQ ID NO: 3728343 - RNA, 23 nt, Salmonella enterica enterica serovar Typhi Ty2
guucgguauaugaaucaucagaa

SEQ ID NO: 3728344 - RNA, 17 nt, Salmonella enterica enterica serovar Typhi Ty2
guucguacccgcaggcc

SEQ ID NO: 3728345 - RNA, 21 nt, Salmonella enterica enterica serovar Typhi Ty2
guucgucccugcaacgccugc

SEQ ID NO: 3728346 - RNA, 22 nt, Salmonella enterica enterica serovar Typhi Ty2
guucguucaacguaaagcuggc

SEQ ID NO: 3728347 - RNA, 19 nt, Salmonella enterica enterica serovar Typhi Ty2
guucuaaacguucaucuuc

SEQ ID NO: 3728348 - RNA, 14 nt, Salmonella enterica enterica serovar Typhi Ty2
guucuaucuuucag

SEQ ID NO: 3728349 - RNA, 13 nt, Salmonella enterica enterica serovar Typhi Ty2
guucucacccaug

SEQ ID NO: 3728350 - RNA, 17 nt, Salmonella enterica enterica serovar Typhi Ty2
guucucgcucuuccagu

SEQ ID NO: 3728351 - RNA, 21 nt, Salmonella enterica enterica serovar Typhi Ty2
guucugauacucguagccaaa

SEQ ID NO: 3728352 - RNA, 22 nt, Salmonella enterica enterica serovar Typhi Ty2
guucugcauaucgccuugcugc

SEQ ID NO: 3728353 - RNA, 20 nt, Salmonella enterica enterica serovar Typhi Ty2
guucugcgccauuuccagcc

SEQ ID NO: 3728354 - RNA, 16 nt, Salmonella enterica enterica serovar Typhi Ty2
guucuucgccguuauc

SEQ ID NO: 3728355 - RNA, 22 nt, Salmonella enterica enterica serovar Typhi Ty2
guucuuucaccauuaagacagg

SEQ ID NO: 3728356 - RNA, 13 nt, Salmonella enterica enterica serovar Typhi Ty2
guucuuucauuuu

SEQ ID NO: 3728357 - RNA, 18 nt, Salmonella enterica enterica serovar Typhi Ty2
guucuuugauuagcucau

SEQ ID NO: 3728358 - RNA, 20 nt, Salmonella enterica enterica serovar Typhi Ty2
guugaaaaaacgggcccgcg

SEQ ID NO: 3728359 - RNA, 13 nt, Salmonella enterica enterica serovar Typhi Ty2
guugaacaauggu

SEQ ID NO: 3728360 - RNA, 22 nt, Salmonella enterica enterica serovar Typhi Ty2
guugaacauuucaucuaucugc

SEQ ID NO: 3728361 - RNA, 19 nt, Salmonella enterica enterica serovar Typhi Ty2
guugaauaucgcuuuuucu

SEQ ID NO: 3728362 - RNA, 23 nt, Salmonella enterica enterica serovar Typhi Ty2
guugaccguuaggaaagcaguaa

SEQ ID NO: 3728363 - RNA, 16 nt, Salmonella enterica enterica serovar Typhi Ty2
guugacgacauccgaa

SEQ ID NO: 3728364 - RNA, 21 nt, Salmonella enterica enterica serovar Typhi Ty2
guugacgccccauguggccag

SEQ ID NO: 3728365 - RNA, 13 nt, Salmonella enterica enterica serovar Typhi Ty2
guugacgggcgac

SEQ ID NO: 3728366 - RNA, 18 nt, Salmonella enterica enterica serovar Typhi Ty2
guugacugcgcuccgacu

SEQ ID NO: 3728367 - RNA, 21 nt, Salmonella enterica enterica serovar Typhi Ty2
guugagcgcuugcugcguaaa

SEQ ID NO: 3728368 - RNA, 17 nt, Salmonella enterica enterica serovar Typhi Ty2
guugagcuuaucgguaa

SEQ ID NO: 3728369 - RNA, 20 nt, Salmonella enterica enterica serovar Typhi Ty2
guugauaaaacacucuuuuu

SEQ ID NO: 3728370 - RNA, 17 nt, Salmonella enterica enterica serovar Typhi Ty2
guugaucggccagcaag

SEQ ID NO: 3728371 - RNA, 18 nt, Salmonella enterica enterica serovar Typhi Ty2
guugaugauuacugcuga

SEQ ID NO: 3728372 - RNA, 20 nt, Salmonella enterica enterica serovar Typhi Ty2
guugauuaucacccacagga

SEQ ID NO: 3728373 - RNA, 14 nt, Salmonella enterica enterica serovar Typhi Ty2
guugauucagcguc

SEQ ID NO: 3728374 - RNA, 18 nt, Salmonella enterica enterica serovar Typhi Ty2
guugauugaaacucgcca

SEQ ID NO: 3728375 - RNA, 18 nt, Salmonella enterica enterica serovar Typhi Ty2
guugauuuuaugaugcau

SEQ ID NO: 3728376 - RNA, 15 nt, Salmonella enterica enterica serovar Typhi Ty2
guugcaguuuacgag

SEQ ID NO: 3728377 - RNA, 19 nt, Salmonella enterica enterica serovar Typhi Ty2
guugcaguuuuaccguaaa

SEQ ID NO: 3728378 - RNA, 13 nt, Salmonella enterica enterica serovar Typhi Ty2
guugccacaggcu

SEQ ID NO: 3728379 - RNA, 16 nt, Salmonella enterica enterica serovar Typhi Ty2
guugccagcggccagg

SEQ ID NO: 3728380 - RNA, 18 nt, Salmonella enterica enterica serovar Typhi Ty2
guugccaggguucaaccu

SEQ ID NO: 3728381 - RNA, 19 nt, Salmonella enterica enterica serovar Typhi Ty2
guugccaggguucaaccug

SEQ ID NO: 3728382 - RNA, 18 nt, Salmonella enterica enterica serovar Typhi Ty2
guugccaguacagcagcg

SEQ ID NO: 3728383 - RNA, 18 nt, Salmonella enterica enterica serovar Typhi Ty2
guugccaugauccaucuc

SEQ ID NO: 3728384 - RNA, 20 nt, Salmonella enterica enterica serovar Typhi Ty2
guugcccauuuuccucccau

SEQ ID NO: 3728385 - RNA, 23 nt, Salmonella enterica enterica serovar Typhi Ty2
guugccgcccguuuuuuccagcg

SEQ ID NO: 3728386 - RNA, 22 nt, Salmonella enterica enterica serovar Typhi Ty2
guugccggaaacgaaucuuuua

SEQ ID NO: 3728387 - RNA, 16 nt, Salmonella enterica enterica serovar Typhi Ty2
guugcgaauaaacaca

SEQ ID NO: 3728388 - RNA, 21 nt, Salmonella enterica enterica serovar Typhi Ty2
guugcgcagcguuuccagacu

SEQ ID NO: 3728389 - RNA, 16 nt, Salmonella enterica enterica serovar Typhi Ty2
guugcgcccaggccaa

SEQ ID NO: 3728390 - RNA, 14 nt, Salmonella enterica enterica serovar Typhi Ty2
guugcgcccaucau

SEQ ID NO: 3728391 - RNA, 14 nt, Salmonella enterica enterica serovar Typhi Ty2
guugcgcugguugg

SEQ ID NO: 3728392 - RNA, 15 nt, Salmonella enterica enterica serovar Typhi Ty2
guugcguaaauaaau

SEQ ID NO: 3728393 - RNA, 17 nt, Salmonella enterica enterica serovar Typhi Ty2
guugcgucaccgggcug

SEQ ID NO: 3728394 - RNA, 18 nt, Salmonella enterica enterica serovar Typhi Ty2
guugcguguuguacagca

SEQ ID NO: 3728395 - RNA, 20 nt, Salmonella enterica enterica serovar Typhi Ty2
guugcguucccuacgcccag

SEQ ID NO: 3728396 - RNA, 13 nt, Salmonella enterica enterica serovar Typhi Ty2
guugcuaaaucca

SEQ ID NO: 3728397 - RNA, 14 nt, Salmonella enterica enterica serovar Typhi Ty2
guugcuacgcgcca

SEQ ID NO: 3728398 - RNA, 14 nt, Salmonella enterica enterica serovar Typhi Ty2
guugcuccagcauc

SEQ ID NO: 3728399 - RNA, 14 nt, Salmonella enterica enterica serovar Typhi Ty2
guugcugcaaaaga

SEQ ID NO: 3728400 - RNA, 18 nt, Salmonella enterica enterica serovar Typhi Ty2
guugcuguuccagccgcc

SEQ ID NO: 3728401 - RNA, 21 nt, Salmonella enterica enterica serovar Typhi Ty2
guugcuuaccuuguucuucca

SEQ ID NO: 3728402 - RNA, 21 nt, Salmonella enterica enterica serovar Typhi Ty2
guugcuucuguccuuucugcu

SEQ ID NO: 3728403 - RNA, 16 nt, Salmonella enterica enterica serovar Typhi Ty2
guuggaguaauguuca

SEQ ID NO: 3728404 - RNA, 18 nt, Salmonella enterica enterica serovar Typhi Ty2
guuggcaacgucuugcca

SEQ ID NO: 3728405 - RNA, 19 nt, Salmonella enterica enterica serovar Typhi Ty2
guuggcaacgucuugccau

SEQ ID NO: 3728406 - RNA, 15 nt, Salmonella enterica enterica serovar Typhi Ty2
guuggcaaucagcgg

SEQ ID NO: 3728407 - RNA, 17 nt, Salmonella enterica enterica serovar Typhi Ty2
guuggcauccugcgggu

SEQ ID NO: 3728408 - RNA, 19 nt, Salmonella enterica enterica serovar Typhi Ty2
guuggcauggucagcauaa

SEQ ID NO: 3728409 - RNA, 21 nt, Salmonella enterica enterica serovar Typhi Ty2
guuggcauucgaauccuccug

SEQ ID NO: 3728410 - RNA, 19 nt, Salmonella enterica enterica serovar Typhi Ty2
guuggcgacauacgcgcuc

SEQ ID NO: 3728411 - RNA, 15 nt, Salmonella enterica enterica serovar Typhi Ty2
guuggcgauuuccag

SEQ ID NO: 3728412 - RNA, 18 nt, Salmonella enterica enterica serovar Typhi Ty2
guuggcgccaaaaccgcu

SEQ ID NO: 3728413 - RNA, 19 nt, Salmonella enterica enterica serovar Typhi Ty2
guuggcgccaaaaccgcuc

SEQ ID NO: 3728414 - RNA, 18 nt, Salmonella enterica enterica serovar Typhi Ty2
guuggcguaaaucaggcc

SEQ ID NO: 3728415 - RNA, 17 nt, Salmonella enterica enterica serovar Typhi Ty2
guuggcguaccaucagc

SEQ ID NO: 3728416 - RNA, 19 nt, Salmonella enterica enterica serovar Typhi Ty2
guuggcugcgcucagaaac

SEQ ID NO: 3728417 - RNA, 23 nt, Salmonella enterica enterica serovar Typhi Ty2
guugggauaaugucgacgcgcuc

SEQ ID NO: 3728418 - RNA, 23 nt, Salmonella enterica enterica serovar Typhi Ty2
guugggcagaaacguaccugaga

SEQ ID NO: 3728419 - RNA, 23 nt, Salmonella enterica enterica serovar Typhi Ty2
guugggcuuccgucggcuggaag

SEQ ID NO: 3728420 - RNA, 13 nt, Salmonella enterica enterica serovar Typhi Ty2
guugguauucaac

SEQ ID NO: 3728421 - RNA, 23 nt, Salmonella enterica enterica serovar Typhi Ty2
guugguauugcgaaacggcagcg

SEQ ID NO: 3728422 - RNA, 23 nt, Salmonella enterica enterica serovar Typhi Ty2
guuguacggaugggguaucgcca

SEQ ID NO: 3728423 - RNA, 15 nt, Salmonella enterica enterica serovar Typhi Ty2
guuguaguuaucgcc

SEQ ID NO: 3728424 - RNA, 15 nt, Salmonella enterica enterica serovar Typhi Ty2
guugucaaaaucgcg

SEQ ID NO: 3728425 - RNA, 23 nt, Salmonella enterica enterica serovar Typhi Ty2
guuguccccucaugacuuuuuuc

SEQ ID NO: 3728426 - RNA, 17 nt, Salmonella enterica enterica serovar Typhi Ty2
guugucggggcuuuaau

SEQ ID NO: 3728427 - RNA, 15 nt, Salmonella enterica enterica serovar Typhi Ty2
guugucucaaaaaau

SEQ ID NO: 3728428 - RNA, 20 nt, Salmonella enterica enterica serovar Typhi Ty2
guugucuucaccuugcugcg

SEQ ID NO: 3728429 - RNA, 17 nt, Salmonella enterica enterica serovar Typhi Ty2
guugugcauuccaggug

SEQ ID NO: 3728430 - RNA, 16 nt, Salmonella enterica enterica serovar Typhi Ty2
guugugguuaaacaca

SEQ ID NO: 3728431 - RNA, 14 nt, Salmonella enterica enterica serovar Typhi Ty2
guuguuccagcagc

SEQ ID NO: 3728432 - RNA, 12 nt, Salmonella enterica enterica serovar Typhi Ty2
guuguucugggu

SEQ ID NO: 3728433 - RNA, 15 nt, Salmonella enterica enterica serovar Typhi Ty2
guuguuuacacggca

SEQ ID NO: 3728434 - RNA, 18 nt, Salmonella enterica enterica serovar Typhi Ty2
guuguuucugccuuuaac

SEQ ID NO: 3728435 - RNA, 21 nt, Salmonella enterica enterica serovar Typhi Ty2
guuguuuuauuaccuccugca

SEQ ID NO: 3728436 - RNA, 13 nt, Salmonella enterica enterica serovar Typhi Ty2
guuuaaagcgcuc

SEQ ID NO: 3728437 - RNA, 22 nt, Salmonella enterica enterica serovar Typhi Ty2
guuuaacguuucauggaaauca

SEQ ID NO: 3728438 - RNA, 21 nt, Salmonella enterica enterica serovar Typhi Ty2
guuuaacugaacuuccguaaa

SEQ ID NO: 3728439 - RNA, 13 nt, Salmonella enterica enterica serovar Typhi Ty2
guuuaagcggaua

SEQ ID NO: 3728440 - RNA, 16 nt, Salmonella enterica enterica serovar Typhi Ty2
guuuaaguaagguaaa

SEQ ID NO: 3728441 - RNA, 23 nt, Salmonella enterica enterica serovar Typhi Ty2
guuuaaucucuucaucuguggca

SEQ ID NO: 3728442 - RNA, 19 nt, Salmonella enterica enterica serovar Typhi Ty2
guuuaauucuuugagcauc

SEQ ID NO: 3728443 - RNA, 21 nt, Salmonella enterica enterica serovar Typhi Ty2
guuuacacagaggaugccugc

SEQ ID NO: 3728444 - RNA, 20 nt, Salmonella enterica enterica serovar Typhi Ty2
guuuacaccgccauccggca

SEQ ID NO: 3728445 - RNA, 20 nt, Salmonella enterica enterica serovar Typhi Ty2
guuuaccauuacgcuauaaa

SEQ ID NO: 3728446 - RNA, 18 nt, Salmonella enterica enterica serovar Typhi Ty2
guuuacccaggaagagua

SEQ ID NO: 3728447 - RNA, 21 nt, Salmonella enterica enterica serovar Typhi Ty2
guuuaccggugcagaccucug

SEQ ID NO: 3728448 - RNA, 22 nt, Salmonella enterica enterica serovar Typhi Ty2
guuuacgagccauuaaugcagg

SEQ ID NO: 3728449 - RNA, 19 nt, Salmonella enterica enterica serovar Typhi Ty2
guuuacgagugcguucuuc

SEQ ID NO: 3728450 - RNA, 21 nt, Salmonella enterica enterica serovar Typhi Ty2
guuuacgagugcguucuucca

SEQ ID NO: 3728451 - RNA, 18 nt, Salmonella enterica enterica serovar Typhi Ty2
guuuacgcccucaucggc

SEQ ID NO: 3728452 - RNA, 20 nt, Salmonella enterica enterica serovar Typhi Ty2
guuuacgccgccauccggca

SEQ ID NO: 3728453 - RNA, 20 nt, Salmonella enterica enterica serovar Typhi Ty2
guuuacgcugcuauccggca

SEQ ID NO: 3728454 - RNA, 13 nt, Salmonella enterica enterica serovar Typhi Ty2
guuuacuccauuc

SEQ ID NO: 3728455 - RNA, 19 nt, Salmonella enterica enterica serovar Typhi Ty2
guuuacuccauucccagcu

SEQ ID NO: 3728456 - RNA, 22 nt, Salmonella enterica enterica serovar Typhi Ty2
guuuagacagacagcguaaaua

SEQ ID NO: 3728457 - RNA, 18 nt, Salmonella enterica enterica serovar Typhi Ty2
guuuagccugcgcguaaa

SEQ ID NO: 3728458 - RNA, 14 nt, Salmonella enterica enterica serovar Typhi Ty2
guuuauauaaaaau

SEQ ID NO: 3728459 - RNA, 22 nt, Salmonella enterica enterica serovar Typhi Ty2
guuuauaugcguguagcagaua

SEQ ID NO: 3728460 - RNA, 16 nt, Salmonella enterica enterica serovar Typhi Ty2
guuuaucaggccuaca

SEQ ID NO: 3728461 - RNA, 14 nt, Salmonella enterica enterica serovar Typhi Ty2
guuuauccacaggc

SEQ ID NO: 3728462 - RNA, 13 nt, Salmonella enterica enterica serovar Typhi Ty2
guuuauccagcac

SEQ ID NO: 3728463 - RNA, 17 nt, Salmonella enterica enterica serovar Typhi Ty2
guuuaucugaugccuga

SEQ ID NO: 3728464 - RNA, 22 nt, Salmonella enterica enterica serovar Typhi Ty2
guuuauugaaauuaaucaggca

SEQ ID NO: 3728465 - RNA, 20 nt, Salmonella enterica enterica serovar Typhi Ty2
guuuauugagauaauuuaug

SEQ ID NO: 3728466 - RNA, 22 nt, Salmonella enterica enterica serovar Typhi Ty2
guuuauuuaacguguuacguuu

SEQ ID NO: 3728467 - RNA, 21 nt, Salmonella enterica enterica serovar Typhi Ty2
guuucaacccccucagcaaug

SEQ ID NO: 3728468 - RNA, 22 nt, Salmonella enterica enterica serovar Typhi Ty2
guuucaacuuccaccaccuccu

SEQ ID NO: 3728469 - RNA, 23 nt, Salmonella enterica enterica serovar Typhi Ty2
guuucaauauagccguggcuggc

SEQ ID NO: 3728470 - RNA, 18 nt, Salmonella enterica enterica serovar Typhi Ty2
guuucacaucgccaguua

SEQ ID NO: 3728471 - RNA, 19 nt, Salmonella enterica enterica serovar Typhi Ty2
guuucaccguuuucgucaa

SEQ ID NO: 3728472 - RNA, 22 nt, Salmonella enterica enterica serovar Typhi Ty2
guuucaggacggcauaagccag

SEQ ID NO: 3728473 - RNA, 15 nt, Salmonella enterica enterica serovar Typhi Ty2
guuucauauccgaca

SEQ ID NO: 3728474 - RNA, 14 nt, Salmonella enterica enterica serovar Typhi Ty2
guuucaucucuccg

SEQ ID NO: 3728475 - RNA, 17 nt, Salmonella enterica enterica serovar Typhi Ty2
guuucaugccauacucc

SEQ ID NO: 3728476 - RNA, 19 nt, Salmonella enterica enterica serovar Typhi Ty2
guuucauggagauccagua

SEQ ID NO: 3728477 - RNA, 16 nt, Salmonella enterica enterica serovar Typhi Ty2
guuucauggcuuuguu

SEQ ID NO: 3728478 - RNA, 20 nt, Salmonella enterica enterica serovar Typhi Ty2
guuuccacugagcuucaccg

SEQ ID NO: 3728479 - RNA, 22 nt, Salmonella enterica enterica serovar Typhi Ty2
guuuccacugagcuucaccgcc

SEQ ID NO: 3728480 - RNA, 21 nt, Salmonella enterica enterica serovar Typhi Ty2
guuuccagcaucgaccaggau

SEQ ID NO: 3728481 - RNA, 21 nt, Salmonella enterica enterica serovar Typhi Ty2
guuucccaacaaugccacgcc

SEQ ID NO: 3728482 - RNA, 20 nt, Salmonella enterica enterica serovar Typhi Ty2
guuucccauugggccagcag

SEQ ID NO: 3728483 - RNA, 21 nt, Salmonella enterica enterica serovar Typhi Ty2
guuucccccuccauacccuau

SEQ ID NO: 3728484 - RNA, 16 nt, Salmonella enterica enterica serovar Typhi Ty2
guuucccucauauuug

SEQ ID NO: 3728485 - RNA, 15 nt, Salmonella enterica enterica serovar Typhi Ty2
guuuccgcguuauca

SEQ ID NO: 3728486 - RNA, 19 nt, Salmonella enterica enterica serovar Typhi Ty2
guuuccgcuagggcaucag

SEQ ID NO: 3728487 - RNA, 19 nt, Salmonella enterica enterica serovar Typhi Ty2
guuuccguuuguaacauau

SEQ ID NO: 3728488 - RNA, 21 nt, Salmonella enterica enterica serovar Typhi Ty2
guuuccguuuguaacauauuu

SEQ ID NO: 3728489 - RNA, 17 nt, Salmonella enterica enterica serovar Typhi Ty2
guuucgacgggagguga

SEQ ID NO: 3728490 - RNA, 16 nt, Salmonella enterica enterica serovar Typhi Ty2
guuucgauagcaggca

SEQ ID NO: 3728491 - RNA, 13 nt, Salmonella enterica enterica serovar Typhi Ty2
guuucgccagcgc

SEQ ID NO: 3728492 - RNA, 14 nt, Salmonella enterica enterica serovar Typhi Ty2
guuucgccagcgcg

SEQ ID NO: 3728493 - RNA, 13 nt, Salmonella enterica enterica serovar Typhi Ty2
guuucgccaggcc

SEQ ID NO: 3728494 - RNA, 15 nt, Salmonella enterica enterica serovar Typhi Ty2
guuucgccgcagggu

SEQ ID NO: 3728495 - RNA, 15 nt, Salmonella enterica enterica serovar Typhi Ty2
guuucggcgaucacc

SEQ ID NO: 3728496 - RNA, 18 nt, Salmonella enterica enterica serovar Typhi Ty2
guuucguuuagcgccugc

SEQ ID NO: 3728497 - RNA, 15 nt, Salmonella enterica enterica serovar Typhi Ty2
guuucuacaauagag

SEQ ID NO: 3728498 - RNA, 14 nt, Salmonella enterica enterica serovar Typhi Ty2
guuucuacggccac

SEQ ID NO: 3728499 - RNA, 12 nt, Salmonella enterica enterica serovar Typhi Ty2
guuucucaaaca

SEQ ID NO: 3728500 - RNA, 19 nt, Salmonella enterica enterica serovar Typhi Ty2
guuucucccgccagaugca

SEQ ID NO: 3728501 - RNA, 21 nt, Salmonella enterica enterica serovar Typhi Ty2
guuucucgccgguagccagcc

SEQ ID NO: 3728502 - RNA, 13 nt, Salmonella enterica enterica serovar Typhi Ty2
guuucugauagcc

SEQ ID NO: 3728503 - RNA, 23 nt, Salmonella enterica enterica serovar Typhi Ty2
guuucugccgguucggcaucgcc

SEQ ID NO: 3728504 - RNA, 18 nt, Salmonella enterica enterica serovar Typhi Ty2
guuucuggcaacagccau

SEQ ID NO: 3728505 - RNA, 13 nt, Salmonella enterica enterica serovar Typhi Ty2
guuucuucaucaa

SEQ ID NO: 3728506 - RNA, 14 nt, Salmonella enterica enterica serovar Typhi Ty2
guuucuuucaucag

SEQ ID NO: 3728507 - RNA, 20 nt, Salmonella enterica enterica serovar Typhi Ty2
guuucuuuuaaggcggcaaa

SEQ ID NO: 3728508 - RNA, 17 nt, Salmonella enterica enterica serovar Typhi Ty2
guuucuuuucguuucuu

SEQ ID NO: 3728509 - RNA, 15 nt, Salmonella enterica enterica serovar Typhi Ty2
guuugaacagcaguu

SEQ ID NO: 3728510 - RNA, 17 nt, Salmonella enterica enterica serovar Typhi Ty2
guuugacgaaaucgcau

SEQ ID NO: 3728511 - RNA, 22 nt, Salmonella enterica enterica serovar Typhi Ty2
guuugaggaaaccuuucuucuc

SEQ ID NO: 3728512 - RNA, 19 nt, Salmonella enterica enterica serovar Typhi Ty2
guuugaggcuugcagcauu

SEQ ID NO: 3728513 - RNA, 15 nt, Salmonella enterica enterica serovar Typhi Ty2
guuugaucauggcuc

SEQ ID NO: 3728514 - RNA, 13 nt, Salmonella enterica enterica serovar Typhi Ty2
guuugcagccaga

SEQ ID NO: 3728515 - RNA, 22 nt, Salmonella enterica enterica serovar Typhi Ty2
guuugccagagagaugccgccg

SEQ ID NO: 3728516 - RNA, 21 nt, Salmonella enterica enterica serovar Typhi Ty2
guuugccgcauacaucgcaga

SEQ ID NO: 3728517 - RNA, 15 nt, Salmonella enterica enterica serovar Typhi Ty2
guuugcgauccagua

SEQ ID NO: 3728518 - RNA, 18 nt, Salmonella enterica enterica serovar Typhi Ty2
guuugcggauuggauaaa

SEQ ID NO: 3728519 - RNA, 18 nt, Salmonella enterica enterica serovar Typhi Ty2
guuugcucgccauaaauc

SEQ ID NO: 3728520 - RNA, 18 nt, Salmonella enterica enterica serovar Typhi Ty2
guuugcugacaaucugcu

SEQ ID NO: 3728521 - RNA, 15 nt, Salmonella enterica enterica serovar Typhi Ty2
guuuggcaaucaaau

SEQ ID NO: 3728522 - RNA, 17 nt, Salmonella enterica enterica serovar Typhi Ty2
guuuggccugcugcggu

SEQ ID NO: 3728523 - RNA, 14 nt, Salmonella enterica enterica serovar Typhi Ty2
guuuguaaaaauag

SEQ ID NO: 3728524 - RNA, 14 nt, Salmonella enterica enterica serovar Typhi Ty2
guuuguaaaauaca

SEQ ID NO: 3728525 - RNA, 21 nt, Salmonella enterica enterica serovar Typhi Ty2
guuuguccugcagcgccagaa

SEQ ID NO: 3728526 - RNA, 17 nt, Salmonella enterica enterica serovar Typhi Ty2
guuugugccgccacggc

SEQ ID NO: 3728527 - RNA, 16 nt, Salmonella enterica enterica serovar Typhi Ty2
guuuguuguagccaga

SEQ ID NO: 3728528 - RNA, 15 nt, Salmonella enterica enterica serovar Typhi Ty2
guuuguuuaauuuug

SEQ ID NO: 3728529 - RNA, 13 nt, Salmonella enterica enterica serovar Typhi Ty2
guuuuaaaaauaa

SEQ ID NO: 3728530 - RNA, 14 nt, Salmonella enterica enterica serovar Typhi Ty2
guuuuaaaaauaac

SEQ ID NO: 3728531 - RNA, 20 nt, Salmonella enterica enterica serovar Typhi Ty2
guuuuaacccccagcacauu

SEQ ID NO: 3728532 - RNA, 19 nt, Salmonella enterica enterica serovar Typhi Ty2
guuuuaauacacgauaaac

SEQ ID NO: 3728533 - RNA, 19 nt, Salmonella enterica enterica serovar Typhi Ty2
guuuuaaucuuuuauaugu

SEQ ID NO: 3728534 - RNA, 13 nt, Salmonella enterica enterica serovar Typhi Ty2
guuuuaccggcag

SEQ ID NO: 3728535 - RNA, 19 nt, Salmonella enterica enterica serovar Typhi Ty2
guuuuacgaugguugugug

SEQ ID NO: 3728536 - RNA, 17 nt, Salmonella enterica enterica serovar Typhi Ty2
guuuuacgccgcuaaaa

SEQ ID NO: 3728537 - RNA, 16 nt, Salmonella enterica enterica serovar Typhi Ty2
guuuuacgguuuaucc

SEQ ID NO: 3728538 - RNA, 22 nt, Salmonella enterica enterica serovar Typhi Ty2
guuuuacuuuuuuaaauguuuu

SEQ ID NO: 3728539 - RNA, 20 nt, Salmonella enterica enterica serovar Typhi Ty2
guuuuagcagaguaugcugc

SEQ ID NO: 3728540 - RNA, 22 nt, Salmonella enterica enterica serovar Typhi Ty2
guuuuauccguuuccgcaauaa

SEQ ID NO: 3728541 - RNA, 20 nt, Salmonella enterica enterica serovar Typhi Ty2
guuuuauugcuucagccaga

SEQ ID NO: 3728542 - RNA, 13 nt, Salmonella enterica enterica serovar Typhi Ty2
guuuuccagcauc

SEQ ID NO: 3728543 - RNA, 14 nt, Salmonella enterica enterica serovar Typhi Ty2
guuuuccagcguaa

SEQ ID NO: 3728544 - RNA, 22 nt, Salmonella enterica enterica serovar Typhi Ty2
guuuuccaggugcugccacauc

SEQ ID NO: 3728545 - RNA, 14 nt, Salmonella enterica enterica serovar Typhi Ty2
guuuucgcagaguc

SEQ ID NO: 3728546 - RNA, 15 nt, Salmonella enterica enterica serovar Typhi Ty2
guuuugauguccaga

SEQ ID NO: 3728547 - RNA, 22 nt, Salmonella enterica enterica serovar Typhi Ty2
guuuugcaggaaaaacuguccc

SEQ ID NO: 3728548 - RNA, 18 nt, Salmonella enterica enterica serovar Typhi Ty2
guuuugccaguuucucaa

SEQ ID NO: 3728549 - RNA, 14 nt, Salmonella enterica enterica serovar Typhi Ty2
guuuugcccauuuc

SEQ ID NO: 3728550 - RNA, 18 nt, Salmonella enterica enterica serovar Typhi Ty2
guuuuggguaaauaccag

SEQ ID NO: 3728551 - RNA, 15 nt, Salmonella enterica enterica serovar Typhi Ty2
guuuugucaucagau

SEQ ID NO: 3728552 - RNA, 21 nt, Salmonella enterica enterica serovar Typhi Ty2
guuuuuagccuguuauucaau

SEQ ID NO: 3728553 - RNA, 13 nt, Salmonella enterica enterica serovar Typhi Ty2
guuuuuauacauu

SEQ ID NO: 3728554 - RNA, 19 nt, Salmonella enterica enterica serovar Typhi Ty2
guuuuuccccguugcucau

SEQ ID NO: 3728555 - RNA, 16 nt, Salmonella enterica enterica serovar Typhi Ty2
guuuuucccgcuggcu

SEQ ID NO: 3728556 - RNA, 13 nt, Salmonella enterica enterica serovar Typhi Ty2
guuuuucccggau

SEQ ID NO: 3728557 - RNA, 19 nt, Salmonella enterica enterica serovar Typhi Ty2
guuuuuccgugaaugccaa

SEQ ID NO: 3728558 - RNA, 16 nt, Salmonella enterica enterica serovar Typhi Ty2
guuuuucgaaaauuuc

SEQ ID NO: 3728559 - RNA, 18 nt, Salmonella enterica enterica serovar Typhi Ty2
guuuuucgccgaccaucc

SEQ ID NO: 3728560 - RNA, 14 nt, Salmonella enterica enterica serovar Typhi Ty2
guuuuucuuccugu

SEQ ID NO: 3728561 - RNA, 15 nt, Salmonella enterica enterica serovar Typhi Ty2
guuuuugaacauugc

SEQ ID NO: 3728562 - RNA, 13 nt, Salmonella enterica enterica serovar Typhi Ty2
guuuuugaaccau

SEQ ID NO: 3728563 - RNA, 22 nt, Salmonella enterica enterica serovar Typhi Ty2
guuuuuggaaacuaugcaaaac

SEQ ID NO: 3728564 - RNA, 22 nt, Salmonella enterica enterica serovar Typhi Ty2
guuuuuuaaccguucuuccugg

SEQ ID NO: 3728565 - RNA, 15 nt, Salmonella enterica enterica serovar Typhi Ty2
guuuuuuaauauaag

SEQ ID NO: 3728566 - RNA, 21 nt, Salmonella enterica enterica serovar Typhi Ty2
guuuuuuaaugagaaauuuua

SEQ ID NO: 3728567 - RNA, 14 nt, Salmonella enterica enterica serovar Typhi Ty2
guuuuuuccagcgc

SEQ ID NO: 3728568 - RNA, 14 nt, Salmonella enterica enterica serovar Typhi Ty2
guuuuuucguucca

SEQ ID NO: 3728569 - RNA, 16 nt, Salmonella enterica enterica serovar Typhi Ty2
guuuuuuuaugcguuu

SEQ ID NO: 3728570 - RNA, 18 nt, Salmonella enterica enterica serovar Typhi Ty2
uaaaaaaaagccgaccug

SEQ ID NO: 3728571 - RNA, 22 nt, Salmonella enterica enterica serovar Typhi Ty2
uaaaaaaaccucuaccuacaca

SEQ ID NO: 3728572 - RNA, 12 nt, Salmonella enterica enterica serovar Typhi Ty2
uaaaaaaauaaa

SEQ ID NO: 3728573 - RNA, 16 nt, Salmonella enterica enterica serovar Typhi Ty2
uaaaaaaauaaaaaag

SEQ ID NO: 3728574 - RNA, 15 nt, Salmonella enterica enterica serovar Typhi Ty2
uaaaaaagaggaaug

SEQ ID NO: 3728575 - RNA, 13 nt, Salmonella enterica enterica serovar Typhi Ty2
uaaaaaagcugcg

SEQ ID NO: 3728576 - RNA, 11 nt, Salmonella enterica enterica serovar Typhi Ty2
uaaaaaaggca

SEQ ID NO: 3728577 - RNA, 21 nt, Salmonella enterica enterica serovar Typhi Ty2
uaaaaaaggggagucgguacu

SEQ ID NO: 3728578 - RNA, 18 nt, Salmonella enterica enterica serovar Typhi Ty2
uaaaaaagucacuuacuu

SEQ ID NO: 3728579 - RNA, 12 nt, Salmonella enterica enterica serovar Typhi Ty2
uaaaaaaugaga

SEQ ID NO: 3728580 - RNA, 20 nt, Salmonella enterica enterica serovar Typhi Ty2
uaaaaacaauaaauaacgug

SEQ ID NO: 3728581 - RNA, 10 nt, Salmonella enterica enterica serovar Typhi Ty2
uaaaaaccag

SEQ ID NO: 3728582 - RNA, 21 nt, Salmonella enterica enterica serovar Typhi Ty2
uaaaaaccaggcaaaaauagg

SEQ ID NO: 3728583 - RNA, 16 nt, Salmonella enterica enterica serovar Typhi Ty2
uaaaaacccugccgaa

SEQ ID NO: 3728584 - RNA, 18 nt, Salmonella enterica enterica serovar Typhi Ty2
uaaaaacugcuaaaagaa

SEQ ID NO: 3728585 - RNA, 18 nt, Salmonella enterica enterica serovar Typhi Ty2
uaaaaagaccaugaacac

SEQ ID NO: 3728586 - RNA, 18 nt, Salmonella enterica enterica serovar Typhi Ty2
uaaaaagccagcguaaau

SEQ ID NO: 3728587 - RNA, 18 nt, Salmonella enterica enterica serovar Typhi Ty2
uaaaaagcgcgggcuggc

SEQ ID NO: 3728588 - RNA, 19 nt, Salmonella enterica enterica serovar Typhi Ty2
uaaaaagcgucaguaaaag

SEQ ID NO: 3728589 - RNA, 16 nt, Salmonella enterica enterica serovar Typhi Ty2
uaaaaagcugcauaau

SEQ ID NO: 3728590 - RNA, 11 nt, Salmonella enterica enterica serovar Typhi Ty2
uaaaaaggaaa

SEQ ID NO: 3728591 - RNA, 21 nt, Salmonella enterica enterica serovar Typhi Ty2
uaaagcccgucccuuccgcca

SEQ ID NO: 3728592 - RNA, 15 nt, Salmonella enterica enterica serovar Typhi Ty2
uaaagcccugacaga

SEQ ID NO: 3728593 - RNA, 17 nt, Salmonella enterica enterica serovar Typhi Ty2
uaaagccgccauccggc

SEQ ID NO: 3728594 - RNA, 21 nt, Salmonella enterica enterica serovar Typhi Ty2
uaaagccgccauccggcauuu

SEQ ID NO: 3728595 - RNA, 19 nt, Salmonella enterica enterica serovar Typhi Ty2
uaaagccgccgugcucacu

SEQ ID NO: 3728596 - RNA, 18 nt, Salmonella enterica enterica serovar Typhi Ty2
uaaagccgucggugcccg

SEQ ID NO: 3728597 - RNA, 20 nt, Salmonella enterica enterica serovar Typhi Ty2
uaaagccucucguaagagag

SEQ ID NO: 3728598 - RNA, 15 nt, Salmonella enterica enterica serovar Typhi Ty2
uaaagccuucaugcu

SEQ ID NO: 3728599 - RNA, 18 nt, Salmonella enterica enterica serovar Typhi Ty2
uaaagccuucaugcuucu

SEQ ID NO: 3728600 - RNA, 15 nt, Salmonella enterica enterica serovar Typhi Ty2
uaaagcgaauaacau

SEQ ID NO: 3728601 - RNA, 15 nt, Salmonella enterica enterica serovar Typhi Ty2
uaaagcgcaaaauag

SEQ ID NO: 3728602 - RNA, 15 nt, Salmonella enterica enterica serovar Typhi Ty2
uaaagcgcauccagc

SEQ ID NO: 3728603 - RNA, 16 nt, Salmonella enterica enterica serovar Typhi Ty2
uaaagcgccacaacgu

SEQ ID NO: 3728604 - RNA, 21 nt, Salmonella enterica enterica serovar Typhi Ty2
uaaagcgcgggccugccuguu

SEQ ID NO: 3728605 - RNA, 22 nt, Salmonella enterica enterica serovar Typhi Ty2
uaaagcgcgggccugccuguuu

SEQ ID NO: 3728606 - RNA, 16 nt, Salmonella enterica enterica serovar Typhi Ty2
uaaagcguaucgccca

SEQ ID NO: 3728607 - RNA, 23 nt, Salmonella enterica enterica serovar Typhi Ty2
uaaaggacaggugcgcugugguc

SEQ ID NO: 3728608 - RNA, 13 nt, Salmonella enterica enterica serovar Typhi Ty2
uaaaggcgaaacc

SEQ ID NO: 3728609 - RNA, 23 nt, Salmonella enterica enterica serovar Typhi Ty2
uaaaggucggcugcccugcggua

SEQ ID NO: 3728610 - RNA, 17 nt, Salmonella enterica enterica serovar Typhi Ty2
uaaagguuuucacgcua

SEQ ID NO: 3728611 - RNA, 21 nt, Salmonella enterica enterica serovar Typhi Ty2
uaaaguacggcgcgccaauaa

SEQ ID NO: 3728612 - RNA, 18 nt, Salmonella enterica enterica serovar Typhi Ty2
uaaaguccugcgucgcuu

SEQ ID NO: 3728613 - RNA, 14 nt, Salmonella enterica enterica serovar Typhi Ty2
uaaagugaguguua

SEQ ID NO: 3728614 - RNA, 19 nt, Salmonella enterica enterica serovar Typhi Ty2
uaaagugaguguuacucuu

SEQ ID NO: 3728615 - RNA, 19 nt, Salmonella enterica enterica serovar Typhi Ty2
uaaagugcugaacaauaac

SEQ ID NO: 3728616 - RNA, 15 nt, Salmonella enterica enterica serovar Typhi Ty2
uaaaguguuaucaug

SEQ ID NO: 3728617 - RNA, 17 nt, Salmonella enterica enterica serovar Typhi Ty2
uaaaguuuuucauaucc

SEQ ID NO: 3728618 - RNA, 12 nt, Salmonella enterica enterica serovar Typhi Ty2
uaaauaaacagc

SEQ ID NO: 3728619 - RNA, 22 nt, Salmonella enterica enterica serovar Typhi Ty2
uaaauaaauaguaaauagaaaa

SEQ ID NO: 3728620 - RNA, 17 nt, Salmonella enterica enterica serovar Typhi Ty2
uaaauaaccgguaacug

SEQ ID NO: 3728621 - RNA, 13 nt, Salmonella enterica enterica serovar Typhi Ty2
uaaauaauuuugu

SEQ ID NO: 3728622 - RNA, 22 nt, Salmonella enterica enterica serovar Typhi Ty2
uaaauacaccaaacgaauuuaa

SEQ ID NO: 3728623 - RNA, 20 nt, Salmonella enterica enterica serovar Typhi Ty2
uaaauaccuucgugaugugg

SEQ ID NO: 3728624 - RNA, 13 nt, Salmonella enterica enterica serovar Typhi Ty2
uaaauagaaaaua

SEQ ID NO: 3728625 - RNA, 14 nt, Salmonella enterica enterica serovar Typhi Ty2
uaaauagaaaauaa

SEQ ID NO: 3728626 - RNA, 18 nt, Salmonella enterica enterica serovar Typhi Ty2
uaaauagacuguugaaag

SEQ ID NO: 3728627 - RNA, 16 nt, Salmonella enterica enterica serovar Typhi Ty2
uaaauagagaaaucaa

SEQ ID NO: 3728628 - RNA, 16 nt, Salmonella enterica enterica serovar Typhi Ty2
uaaauaggcgccgccg

SEQ ID NO: 3728629 - RNA, 19 nt, Salmonella enterica enterica serovar Typhi Ty2
uaaauaggcgccgccgaca

SEQ ID NO: 3728630 - RNA, 16 nt, Salmonella enterica enterica serovar Typhi Ty2
uaaauaguaaauagaa

SEQ ID NO: 3728631 - RNA, 16 nt, Salmonella enterica enterica serovar Typhi Ty2
uaaauauaagaucuau

SEQ ID NO: 3728632 - RNA, 12 nt, Salmonella enterica enterica serovar Typhi Ty2
uaaauauucauc

SEQ ID NO: 3728633 - RNA, 20 nt, Salmonella enterica enterica serovar Typhi Ty2
uaaauauucaucaaaaugca

SEQ ID NO: 3728634 - RNA, 20 nt, Salmonella enterica enterica serovar Typhi Ty2
uaaauauuggcggcaaagaa

SEQ ID NO: 3728635 - RNA, 19 nt, Salmonella enterica enterica serovar Typhi Ty2
uaaaucaauagauuauucg

SEQ ID NO: 3728636 - RNA, 20 nt, Salmonella enterica enterica serovar Typhi Ty2
uaaaucaauagauuauucgu

SEQ ID NO: 3728637 - RNA, 12 nt, Salmonella enterica enterica serovar Typhi Ty2
uaaaucagcgau

SEQ ID NO: 3728638 - RNA, 20 nt, Salmonella enterica enterica serovar Typhi Ty2
uaaaucagcgcggcaaggau

SEQ ID NO: 3728639 - RNA, 23 nt, Salmonella enterica enterica serovar Typhi Ty2
uaaaucagcuuugcggccagcau

SEQ ID NO: 3728640 - RNA, 17 nt, Salmonella enterica enterica serovar Typhi Ty2
uaaaucaggccaagcaa

SEQ ID NO: 3728641 - RNA, 14 nt, Salmonella enterica enterica serovar Typhi Ty2
uaaaucaucauaau

SEQ ID NO: 3728642 - RNA, 19 nt, Salmonella enterica enterica serovar Typhi Ty2
uaaaucauuacuuauauuu

SEQ ID NO: 3728643 - RNA, 21 nt, Salmonella enterica enterica serovar Typhi Ty2
uaaaucauuacuuauauuuau

SEQ ID NO: 3728644 - RNA, 16 nt, Salmonella enterica enterica serovar Typhi Ty2
uaaauccagccucucc

SEQ ID NO: 3728645 - RNA, 14 nt, Salmonella enterica enterica serovar Typhi Ty2
uaaauccauauucu

SEQ ID NO: 3728646 - RNA, 19 nt, Salmonella enterica enterica serovar Typhi Ty2
uaaaucccggcgauuaaua

SEQ ID NO: 3728647 - RNA, 21 nt, Salmonella enterica enterica serovar Typhi Ty2
uaaauccguuaagcccugaau

SEQ ID NO: 3728648 - RNA, 16 nt, Salmonella enterica enterica serovar Typhi Ty2
uaaaucgcgcaaauau

SEQ ID NO: 3728649 - RNA, 17 nt, Salmonella enterica enterica serovar Typhi Ty2
uaaaucgcgcaaauauu

SEQ ID NO: 3728650 - RNA, 19 nt, Salmonella enterica enterica serovar Typhi Ty2
uaaaucgcgcaaauauuac

SEQ ID NO: 3728651 - RNA, 14 nt, Salmonella enterica enterica serovar Typhi Ty2
uaaaucgcggcgcu

SEQ ID NO: 3728652 - RNA, 22 nt, Salmonella enterica enterica serovar Typhi Ty2
uaaaucuacccaauugaauuua

SEQ ID NO: 3728653 - RNA, 14 nt, Salmonella enterica enterica serovar Typhi Ty2
uaaaucugccguca

SEQ ID NO: 3728654 - RNA, 20 nt, Salmonella enterica enterica serovar Typhi Ty2
uaaaugaauuauuuuuucau

SEQ ID NO: 3728655 - RNA, 16 nt, Salmonella enterica enterica serovar Typhi Ty2
uaaaugcauagcccca

SEQ ID NO: 3728656 - RNA, 20 nt, Salmonella enterica enterica serovar Typhi Ty2
uaaaugcugaugacguccag

SEQ ID NO: 3728657 - RNA, 15 nt, Salmonella enterica enterica serovar Typhi Ty2
uaaaugggcaggaga

SEQ ID NO: 3728658 - RNA, 14 nt, Salmonella enterica enterica serovar Typhi Ty2
uaaauuaacaccca

SEQ ID NO: 3728659 - RNA, 21 nt, Salmonella enterica enterica serovar Typhi Ty2
uaaauuaacgcgaauccgcca

SEQ ID NO: 3728660 - RNA, 20 nt, Salmonella enterica enterica serovar Typhi Ty2
uaaauuaaugauuaaaauaa

SEQ ID NO: 3728661 - RNA, 19 nt, Salmonella enterica enterica serovar Typhi Ty2
uaaauucauauuuaaauau

SEQ ID NO: 3728662 - RNA, 18 nt, Salmonella enterica enterica serovar Typhi Ty2
uaaauuccggcucgccuu

SEQ ID NO: 3728663 - RNA, 17 nt, Salmonella enterica enterica serovar Typhi Ty2
uaaauugccugauggcg

SEQ ID NO: 3728664 - RNA, 13 nt, Salmonella enterica enterica serovar Typhi Ty2
uaaauuuacucag

SEQ ID NO: 3728665 - RNA, 18 nt, Salmonella enterica enterica serovar Typhi Ty2
uaaauuuccgcagccaga

SEQ ID NO: 3728666 - RNA, 21 nt, Salmonella enterica enterica serovar Typhi Ty2
uaaauuuccucuugucaggca

SEQ ID NO: 3728667 - RNA, 19 nt, Salmonella enterica enterica serovar Typhi Ty2
uaaauuuguuuaucauccu

SEQ ID NO: 3728668 - RNA, 14 nt, Salmonella enterica enterica serovar Typhi Ty2
uaacaaaaaacaua

SEQ ID NO: 3728669 - RNA, 23 nt, Salmonella enterica enterica serovar Typhi Ty2
uaacaaaccgguaaucccuucac

SEQ ID NO: 3728670 - RNA, 17 nt, Salmonella enterica enterica serovar Typhi Ty2
uaacaaaucacaaggaa

SEQ ID NO: 3728671 - RNA, 11 nt, Salmonella enterica enterica serovar Typhi Ty2
uaacaaaucau

SEQ ID NO: 3728672 - RNA, 16 nt, Salmonella enterica enterica serovar Typhi Ty2
uaacaacauugaggcu

SEQ ID NO: 3728673 - RNA, 18 nt, Salmonella enterica enterica serovar Typhi Ty2
uaacgccgauuaaugcuc

SEQ ID NO: 3728674 - RNA, 15 nt, Salmonella enterica enterica serovar Typhi Ty2
uaacgccgcauagcg

SEQ ID NO: 3728675 - RNA, 13 nt, Salmonella enterica enterica serovar Typhi Ty2
uaacgcgccaucu

SEQ ID NO: 3728676 - RNA, 23 nt, Salmonella enterica enterica serovar Typhi Ty2
uaacgcgcuggaugcgcaaaugc

SEQ ID NO: 3728677 - RNA, 23 nt, Salmonella enterica enterica serovar Typhi Ty2
uaacgcguccaacuggcuuucau

SEQ ID NO: 3728678 - RNA, 23 nt, Salmonella enterica enterica serovar Typhi Ty2
uaacgcguguucuuuuucgccuu

SEQ ID NO: 3728679 - RNA, 14 nt, Salmonella enterica enterica serovar Typhi Ty2
uaacgcuaugcuua

SEQ ID NO: 3728680 - RNA, 14 nt, Salmonella enterica enterica serovar Typhi Ty2
uaacgcugcaaagu

SEQ ID NO: 3728681 - RNA, 17 nt, Salmonella enterica enterica serovar Typhi Ty2
uaacgcugcaaaguuau

SEQ ID NO: 3728682 - RNA, 21 nt, Salmonella enterica enterica serovar Typhi Ty2
uaacgcuguaccggcagguga

SEQ ID NO: 3728683 - RNA, 15 nt, Salmonella enterica enterica serovar Typhi Ty2
uaacgcuucaccucu

SEQ ID NO: 3728684 - RNA, 17 nt, Salmonella enterica enterica serovar Typhi Ty2
uaacggaaaagcauugc

SEQ ID NO: 3728685 - RNA, 13 nt, Salmonella enterica enterica serovar Typhi Ty2
uaacggaaucaga

SEQ ID NO: 3728686 - RNA, 16 nt, Salmonella enterica enterica serovar Typhi Ty2
uaacggcaaaaacguu

SEQ ID NO: 3728687 - RNA, 15 nt, Salmonella enterica enterica serovar Typhi Ty2
uaacggccagaaacc

SEQ ID NO: 3728688 - RNA, 18 nt, Salmonella enterica enterica serovar Typhi Ty2
uaacggcgucauccugca

SEQ ID NO: 3728689 - RNA, 15 nt, Salmonella enterica enterica serovar Typhi Ty2
uaacgggcaucgccg

SEQ ID NO: 3728690 - RNA, 19 nt, Salmonella enterica enterica serovar Typhi Ty2
uaacguacagguugugcau

SEQ ID NO: 3728691 - RNA, 22 nt, Salmonella enterica enterica serovar Typhi Ty2
uaacgucgcgguuacagucuuu

SEQ ID NO: 3728692 - RNA, 19 nt, Salmonella enterica enterica serovar Typhi Ty2
uaacgucguaaauuccugc

SEQ ID NO: 3728693 - RNA, 19 nt, Salmonella enterica enterica serovar Typhi Ty2
uaacguuaauacaucaugc

SEQ ID NO: 3728694 - RNA, 15 nt, Salmonella enterica enterica serovar Typhi Ty2
uaacguuacauuuuc

SEQ ID NO: 3728695 - RNA, 22 nt, Salmonella enterica enterica serovar Typhi Ty2
uaacguuuggcaucaaaguuau

SEQ ID NO: 3728696 - RNA, 17 nt, Salmonella enterica enterica serovar Typhi Ty2
uaacguuuuacgcugcc

SEQ ID NO: 3728697 - RNA, 22 nt, Salmonella enterica enterica serovar Typhi Ty2
uaacuaauuguuuguagaaagu

SEQ ID NO: 3728698 - RNA, 13 nt, Salmonella enterica enterica serovar Typhi Ty2
uaacuauuucuau

SEQ ID NO: 3728699 - RNA, 12 nt, Salmonella enterica enterica serovar Typhi Ty2
uaacucaauagc

SEQ ID NO: 3728700 - RNA, 18 nt, Salmonella enterica enterica serovar Typhi Ty2
uaacucaauagcggugcu

SEQ ID NO: 3728701 - RNA, 23 nt, Salmonella enterica enterica serovar Typhi Ty2
uaacuccagugcagaaaguguga

SEQ ID NO: 3728702 - RNA, 19 nt, Salmonella enterica enterica serovar Typhi Ty2
uaacuccuucuaauuccag

SEQ ID NO: 3728703 - RNA, 14 nt, Salmonella enterica enterica serovar Typhi Ty2
uaacucguccuguu

SEQ ID NO: 3728704 - RNA, 12 nt, Salmonella enterica enterica serovar Typhi Ty2
uaacucuucauc

SEQ ID NO: 3728705 - RNA, 13 nt, Salmonella enterica enterica serovar Typhi Ty2
uaacucuucaucg

SEQ ID NO: 3728706 - RNA, 15 nt, Salmonella enterica enterica serovar Typhi Ty2
uaacugaacaucgcc

SEQ ID NO: 3728707 - RNA, 23 nt, Salmonella enterica enterica serovar Typhi Ty2
uaacugaacuuccguaaaaagaa

SEQ ID NO: 3728708 - RNA, 18 nt, Salmonella enterica enterica serovar Typhi Ty2
uaacugaagguuuuuccc

SEQ ID NO: 3728709 - RNA, 17 nt, Salmonella enterica enterica serovar Typhi Ty2
uaacugacaauuuccag

SEQ ID NO: 3728710 - RNA, 12 nt, Salmonella enterica enterica serovar Typhi Ty2
uaacugacagac

SEQ ID NO: 3728711 - RNA, 16 nt, Salmonella enterica enterica serovar Typhi Ty2
uaacugacucugccuc

SEQ ID NO: 3728712 - RNA, 15 nt, Salmonella enterica enterica serovar Typhi Ty2
uaacugcaaacgcgg

SEQ ID NO: 3728713 - RNA, 16 nt, Salmonella enterica enterica serovar Typhi Ty2
uaacugccagaacgcu

SEQ ID NO: 3728714 - RNA, 19 nt, Salmonella enterica enterica serovar Typhi Ty2
uaacugccuuauccggccu

SEQ ID NO: 3728715 - RNA, 13 nt, Salmonella enterica enterica serovar Typhi Ty2
uaacuggaaaaag

SEQ ID NO: 3728716 - RNA, 15 nt, Salmonella enterica enterica serovar Typhi Ty2
uaacuggcaaucaug

SEQ ID NO: 3728717 - RNA, 22 nt, Salmonella enterica enterica serovar Typhi Ty2
uaacuuaaacgccggauuccag

SEQ ID NO: 3728718 - RNA, 16 nt, Salmonella enterica enterica serovar Typhi Ty2
uaacuucacgccaucg

SEQ ID NO: 3728719 - RNA, 23 nt, Salmonella enterica enterica serovar Typhi Ty2
uaacuuccuuugccuuucuuauu

SEQ ID NO: 3728720 - RNA, 18 nt, Salmonella enterica enterica serovar Typhi Ty2
uaacuucgcgguuagaaa

SEQ ID NO: 3728721 - RNA, 21 nt, Salmonella enterica enterica serovar Typhi Ty2
uaacuucggcaaauucuuuuc

SEQ ID NO: 3728722 - RNA, 22 nt, Salmonella enterica enterica serovar Typhi Ty2
uaacuucggcaaauucuuuuca

SEQ ID NO: 3728723 - RNA, 16 nt, Salmonella enterica enterica serovar Typhi Ty2
uaacuucggccagcga

SEQ ID NO: 3728724 - RNA, 14 nt, Salmonella enterica enterica serovar Typhi Ty2
uaacuucuccgcca

SEQ ID NO: 3728725 - RNA, 15 nt, Salmonella enterica enterica serovar Typhi Ty2
uaacuucugcaggga

SEQ ID NO: 3728726 - RNA, 23 nt, Salmonella enterica enterica serovar Typhi Ty2
uaacuucuugguaccaaacagca

SEQ ID NO: 3728727 - RNA, 22 nt, Salmonella enterica enterica serovar Typhi Ty2
uaacuuucccgcuauccaucau

SEQ ID NO: 3728728 - RNA, 14 nt, Salmonella enterica enterica serovar Typhi Ty2
uaagaaaaaacugg

SEQ ID NO: 3728729 - RNA, 20 nt, Salmonella enterica enterica serovar Typhi Ty2
uaagaaaaaacuggugcagg

SEQ ID NO: 3728730 - RNA, 16 nt, Salmonella enterica enterica serovar Typhi Ty2
uaagaaagauaaaaua

SEQ ID NO: 3728731 - RNA, 12 nt, Salmonella enterica enterica serovar Typhi Ty2
uaagaagaacca

SEQ ID NO: 3728732 - RNA, 21 nt, Salmonella enterica enterica serovar Typhi Ty2
uaagaaugcgcgucaggccag

SEQ ID NO: 3728733 - RNA, 19 nt, Salmonella enterica enterica serovar Typhi Ty2
uaagaauuauuaccaauga

SEQ ID NO: 3728734 - RNA, 14 nt, Salmonella enterica enterica serovar Typhi Ty2
uaagaccagcauca

SEQ ID NO: 3728735 - RNA, 22 nt, Salmonella enterica enterica serovar Typhi Ty2
uaagaccauacuuugcauugcc

SEQ ID NO: 3728736 - RNA, 19 nt, Salmonella enterica enterica serovar Typhi Ty2
uaagacgcuuacaucgcca

SEQ ID NO: 3728737 - RNA, 18 nt, Salmonella enterica enterica serovar Typhi Ty2
uaagacguuuaugccgcc

SEQ ID NO: 3728738 - RNA, 19 nt, Salmonella enterica enterica serovar Typhi Ty2
uaagagaccgguuauugag

SEQ ID NO: 3728739 - RNA, 14 nt, Salmonella enterica enterica serovar Typhi Ty2
uaagagacugacaa

SEQ ID NO: 3728740 - RNA, 23 nt, Salmonella enterica enterica serovar Typhi Ty2
uaagagacugacaaugacgcaau

SEQ ID NO: 3728741 - RNA, 17 nt, Salmonella enterica enterica serovar Typhi Ty2
uaagagccugucccacc

SEQ ID NO: 3728742 - RNA, 16 nt, Salmonella enterica enterica serovar Typhi Ty2
uaagagcguuacccag

SEQ ID NO: 3728743 - RNA, 16 nt, Salmonella enterica enterica serovar Typhi Ty2
uaagauagcaggcgau

SEQ ID NO: 3728744 - RNA, 12 nt, Salmonella enterica enterica serovar Typhi Ty2
uaagauguuuua

SEQ ID NO: 3728745 - RNA, 15 nt, Salmonella enterica enterica serovar Typhi Ty2
uaagauuuaaaacaa

SEQ ID NO: 3728746 - RNA, 16 nt, Salmonella enterica enterica serovar Typhi Ty2
uaagauuuaaaacaag

SEQ ID NO: 3728747 - RNA, 18 nt, Salmonella enterica enterica serovar Typhi Ty2
uaagcaacguuuccgcua

SEQ ID NO: 3728748 - RNA, 20 nt, Salmonella enterica enterica serovar Typhi Ty2
uaagcaacuugaaguaugaa

SEQ ID NO: 3728749 - RNA, 14 nt, Salmonella enterica enterica serovar Typhi Ty2
uaagcaagcgccau

SEQ ID NO: 3728750 - RNA, 14 nt, Salmonella enterica enterica serovar Typhi Ty2
uaagcaauauggcu

SEQ ID NO: 3728751 - RNA, 23 nt, Salmonella enterica enterica serovar Typhi Ty2
uaagcaauccauuuuaaauacac

SEQ ID NO: 3728752 - RNA, 12 nt, Salmonella enterica enterica serovar Typhi Ty2
uaagcaauuaau

SEQ ID NO: 3728753 - RNA, 14 nt, Salmonella enterica enterica serovar Typhi Ty2
uaagcacaggccau

SEQ ID NO: 3728754 - RNA, 15 nt, Salmonella enterica enterica serovar Typhi Ty2
uaagcauccaggaag

SEQ ID NO: 3728755 - RNA, 22 nt, Salmonella enterica enterica serovar Typhi Ty2
uaauacuggcgccuuuuggcag

SEQ ID NO: 3728756 - RNA, 19 nt, Salmonella enterica enterica serovar Typhi Ty2
uaauagccucauccccagc

SEQ ID NO: 3728757 - RNA, 20 nt, Salmonella enterica enterica serovar Typhi Ty2
uaauaguuucgacuuucauu

SEQ ID NO: 3728758 - RNA, 17 nt, Salmonella enterica enterica serovar Typhi Ty2
uaauauaaccaauuuaa

SEQ ID NO: 3728759 - RNA, 15 nt, Salmonella enterica enterica serovar Typhi Ty2
uaauauacauucauu

SEQ ID NO: 3728760 - RNA, 21 nt, Salmonella enterica enterica serovar Typhi Ty2
uaauauaugaaccaagauaag

SEQ ID NO: 3728761 - RNA, 13 nt, Salmonella enterica enterica serovar Typhi Ty2
uaauaucauccgg

SEQ ID NO: 3728762 - RNA, 20 nt, Salmonella enterica enterica serovar Typhi Ty2
uaauaucgcgcucuuccgcc

SEQ ID NO: 3728763 - RNA, 23 nt, Salmonella enterica enterica serovar Typhi Ty2
uaauaucguuaagccuucaauuu

SEQ ID NO: 3728764 - RNA, 13 nt, Salmonella enterica enterica serovar Typhi Ty2
uaauaugccaggc

SEQ ID NO: 3728765 - RNA, 17 nt, Salmonella enterica enterica serovar Typhi Ty2
uaauaugcgcaaucacc

SEQ ID NO: 3728766 - RNA, 19 nt, Salmonella enterica enterica serovar Typhi Ty2
uaauaugcgcaaucaccuc

SEQ ID NO: 3728767 - RNA, 14 nt, Salmonella enterica enterica serovar Typhi Ty2
uaauauuaagcagc

SEQ ID NO: 3728768 - RNA, 13 nt, Salmonella enterica enterica serovar Typhi Ty2
uaauauuauugac

SEQ ID NO: 3728769 - RNA, 15 nt, Salmonella enterica enterica serovar Typhi Ty2
uaauauucauucugu

SEQ ID NO: 3728770 - RNA, 20 nt, Salmonella enterica enterica serovar Typhi Ty2
uaauauugaccgcuuuuucc

SEQ ID NO: 3728771 - RNA, 21 nt, Salmonella enterica enterica serovar Typhi Ty2
uaauauugaccgcuuuuucca

SEQ ID NO: 3728772 - RNA, 16 nt, Salmonella enterica enterica serovar Typhi Ty2
uaauauuuaacacauu

SEQ ID NO: 3728773 - RNA, 17 nt, Salmonella enterica enterica serovar Typhi Ty2
uaaucaacguagaaucu

SEQ ID NO: 3728774 - RNA, 15 nt, Salmonella enterica enterica serovar Typhi Ty2
uaaucaacucuccuu

SEQ ID NO: 3728775 - RNA, 21 nt, Salmonella enterica enterica serovar Typhi Ty2
uaaucaacugcgccacaucau

SEQ ID NO: 3728776 - RNA, 12 nt, Salmonella enterica enterica serovar Typhi Ty2
uaaucaauaagu

SEQ ID NO: 3728777 - RNA, 13 nt, Salmonella enterica enterica serovar Typhi Ty2
uaaucaauaaguu

SEQ ID NO: 3728778 - RNA, 20 nt, Salmonella enterica enterica serovar Typhi Ty2
uaaucacaggggucaucggc

SEQ ID NO: 3728779 - RNA, 14 nt, Salmonella enterica enterica serovar Typhi Ty2
uaaucaccaccuca

SEQ ID NO: 3728780 - RNA, 14 nt, Salmonella enterica enterica serovar Typhi Ty2
uaaucaccagcccg

SEQ ID NO: 3728781 - RNA, 19 nt, Salmonella enterica enterica serovar Typhi Ty2
uaaucaccagcccgaaucc

SEQ ID NO: 3728782 - RNA, 12 nt, Salmonella enterica enterica serovar Typhi Ty2
uaaucaccagcg

SEQ ID NO: 3728783 - RNA, 22 nt, Salmonella enterica enterica serovar Typhi Ty2
uaaucacuaacugaccauauau

SEQ ID NO: 3728784 - RNA, 13 nt, Salmonella enterica enterica serovar Typhi Ty2
uaaucagcacauu

SEQ ID NO: 3728785 - RNA, 19 nt, Salmonella enterica enterica serovar Typhi Ty2
uaaucagcacauucagcag

SEQ ID NO: 3728786 - RNA, 21 nt, Salmonella enterica enterica serovar Typhi Ty2
uaaucaggacaucaaaggcag

SEQ ID NO: 3728787 - RNA, 16 nt, Salmonella enterica enterica serovar Typhi Ty2
uaaucaggagggcugc

SEQ ID NO: 3728788 - RNA, 18 nt, Salmonella enterica enterica serovar Typhi Ty2
uaaucaggagggcugccc

SEQ ID NO: 3728789 - RNA, 17 nt, Salmonella enterica enterica serovar Typhi Ty2
uaaucaggcauccugcc

SEQ ID NO: 3728790 - RNA, 15 nt, Salmonella enterica enterica serovar Typhi Ty2
uaaucaggguaauaa

SEQ ID NO: 3728791 - RNA, 20 nt, Salmonella enterica enterica serovar Typhi Ty2
uaaucaucaccguuuuccag

SEQ ID NO: 3728792 - RNA, 19 nt, Salmonella enterica enterica serovar Typhi Ty2
uaaucaucacgcuauggcc

SEQ ID NO: 3728793 - RNA, 13 nt, Salmonella enterica enterica serovar Typhi Ty2
uaaucaucaugcu

SEQ ID NO: 3728794 - RNA, 14 nt, Salmonella enterica enterica serovar Typhi Ty2
uaaucaugaacguu

SEQ ID NO: 3728795 - RNA, 20 nt, Salmonella enterica enterica serovar Typhi Ty2
uaaucaugaacguuaucggc

SEQ ID NO: 3728796 - RNA, 22 nt, Salmonella enterica enterica serovar Typhi Ty2
uaaucaugaacguuaucggcau

SEQ ID NO: 3728797 - RNA, 18 nt, Salmonella enterica enterica serovar Typhi Ty2
uaauccaacauuaucaaa

SEQ ID NO: 3728798 - RNA, 21 nt, Salmonella enterica enterica serovar Typhi Ty2
uaauccagaggguaauuucuu

SEQ ID NO: 3728799 - RNA, 15 nt, Salmonella enterica enterica serovar Typhi Ty2
uaauccccgauaucg

SEQ ID NO: 3728800 - RNA, 18 nt, Salmonella enterica enterica serovar Typhi Ty2
uaaucccgaaucacuuac

SEQ ID NO: 3728801 - RNA, 23 nt, Salmonella enterica enterica serovar Typhi Ty2
uaaucccgcggcggacagcggca

SEQ ID NO: 3728802 - RNA, 13 nt, Salmonella enterica enterica serovar Typhi Ty2
uaauccgcuccac

SEQ ID NO: 3728803 - RNA, 18 nt, Salmonella enterica enterica serovar Typhi Ty2
uaauccgcugcaacuccc

SEQ ID NO: 3728804 - RNA, 13 nt, Salmonella enterica enterica serovar Typhi Ty2
uaauccggcaacu

SEQ ID NO: 3728805 - RNA, 18 nt, Salmonella enterica enterica serovar Typhi Ty2
uaauccgugaauguccug

SEQ ID NO: 3728806 - RNA, 15 nt, Salmonella enterica enterica serovar Typhi Ty2
uaauccuuauuuaau

SEQ ID NO: 3728807 - RNA, 22 nt, Salmonella enterica enterica serovar Typhi Ty2
uaauccuuguccauguaaacuc

SEQ ID NO: 3728808 - RNA, 14 nt, Salmonella enterica enterica serovar Typhi Ty2
uaaucgaaauaaag

SEQ ID NO: 3728809 - RNA, 14 nt, Salmonella enterica enterica serovar Typhi Ty2
uaaucgaaucgccu

SEQ ID NO: 3728810 - RNA, 16 nt, Salmonella enterica enterica serovar Typhi Ty2
uaaucgaaucgccuca

SEQ ID NO: 3728811 - RNA, 22 nt, Salmonella enterica enterica serovar Typhi Ty2
uaaucgagcccagacuuuccag

SEQ ID NO: 3728812 - RNA, 16 nt, Salmonella enterica enterica serovar Typhi Ty2
uaaucgauaagccagc

SEQ ID NO: 3728813 - RNA, 15 nt, Salmonella enterica enterica serovar Typhi Ty2
uaaucgauacuaaaa

SEQ ID NO: 3728814 - RNA, 17 nt, Salmonella enterica enterica serovar Typhi Ty2
uaaucgauauaauuuua

SEQ ID NO: 3728815 - RNA, 18 nt, Salmonella enterica enterica serovar Typhi Ty2
uaaucgauauaauuuuau

SEQ ID NO: 3728816 - RNA, 21 nt, Salmonella enterica enterica serovar Typhi Ty2
uaaucgccugcauauuagcaa

SEQ ID NO: 3728817 - RNA, 21 nt, Salmonella enterica enterica serovar Typhi Ty2
uaaucgcgauacugccgccca

SEQ ID NO: 3728818 - RNA, 20 nt, Salmonella enterica enterica serovar Typhi Ty2
uaaucgcgauuuuuuuccgc

SEQ ID NO: 3728819 - RNA, 13 nt, Salmonella enterica enterica serovar Typhi Ty2
uaaucgcgcgcuu

SEQ ID NO: 3728820 - RNA, 15 nt, Salmonella enterica enterica serovar Typhi Ty2
uaaucguaucaaagc

SEQ ID NO: 3728821 - RNA, 13 nt, Salmonella enterica enterica serovar Typhi Ty2
uaaucgucauccc

SEQ ID NO: 3728822 - RNA, 15 nt, Salmonella enterica enterica serovar Typhi Ty2
uaaucuaaaauuauu

SEQ ID NO: 3728823 - RNA, 18 nt, Salmonella enterica enterica serovar Typhi Ty2
uaaucuaaaauuauuuuu

SEQ ID NO: 3728824 - RNA, 13 nt, Salmonella enterica enterica serovar Typhi Ty2
uaaucuacaaacg

SEQ ID NO: 3728825 - RNA, 23 nt, Salmonella enterica enterica serovar Typhi Ty2
uaaucugccagcuuaaaucgcgg

SEQ ID NO: 3728826 - RNA, 16 nt, Salmonella enterica enterica serovar Typhi Ty2
uaaucuguagauugcg

SEQ ID NO: 3728827 - RNA, 21 nt, Salmonella enterica enterica serovar Typhi Ty2
uaaucugugauugaauucacc

SEQ ID NO: 3728828 - RNA, 19 nt, Salmonella enterica enterica serovar Typhi Ty2
uaaugaaagaaaucaccgu

SEQ ID NO: 3728829 - RNA, 20 nt, Salmonella enterica enterica serovar Typhi Ty2
uaaugaaaucgucgccaaca

SEQ ID NO: 3728830 - RNA, 17 nt, Salmonella enterica enterica serovar Typhi Ty2
uaaugaacaccagcaac

SEQ ID NO: 3728831 - RNA, 19 nt, Salmonella enterica enterica serovar Typhi Ty2
uaaugaagacguugaauau

SEQ ID NO: 3728832 - RNA, 13 nt, Salmonella enterica enterica serovar Typhi Ty2
uaaugaauuuaau

SEQ ID NO: 3728833 - RNA, 13 nt, Salmonella enterica enterica serovar Typhi Ty2
uaaugacauccag

SEQ ID NO: 3728834 - RNA, 16 nt, Salmonella enterica enterica serovar Typhi Ty2
uaaugacuaauuauua

SEQ ID NO: 3728835 - RNA, 17 nt, Salmonella enterica enterica serovar Typhi Ty2
uaaugacuaauuauuau

SEQ ID NO: 3728836 - RNA, 21 nt, Salmonella enterica enterica serovar Typhi Ty2
uaaugaguacggguauuccag

SEQ ID NO: 3728837 - RNA, 19 nt, Salmonella enterica enterica serovar Typhi Ty2
uacaaagggcaauauauua

SEQ ID NO: 3728838 - RNA, 20 nt, Salmonella enterica enterica serovar Typhi Ty2
uacaaagggcaauauauuau

SEQ ID NO: 3728839 - RNA, 13 nt, Salmonella enterica enterica serovar Typhi Ty2
uacaaaucacugg

SEQ ID NO: 3728840 - RNA, 15 nt, Salmonella enterica enterica serovar Typhi Ty2
uacaaauuuaaacau

SEQ ID NO: 3728841 - RNA, 16 nt, Salmonella enterica enterica serovar Typhi Ty2
uacaaauuuaaacaug

SEQ ID NO: 3728842 - RNA, 21 nt, Salmonella enterica enterica serovar Typhi Ty2
uacaaccguggcguuuucauu

SEQ ID NO: 3728843 - RNA, 22 nt, Salmonella enterica enterica serovar Typhi Ty2
uacaaccguggcguuuucauua

SEQ ID NO: 3728844 - RNA, 19 nt, Salmonella enterica enterica serovar Typhi Ty2
uacaacgacuacguucauc

SEQ ID NO: 3728845 - RNA, 19 nt, Salmonella enterica enterica serovar Typhi Ty2
uacaagaaaguaccugcac

SEQ ID NO: 3728846 - RNA, 20 nt, Salmonella enterica enterica serovar Typhi Ty2
uacaagaaaguaccugcacc

SEQ ID NO: 3728847 - RNA, 18 nt, Salmonella enterica enterica serovar Typhi Ty2
uacaagagccgccgccau

SEQ ID NO: 3728848 - RNA, 16 nt, Salmonella enterica enterica serovar Typhi Ty2
uacaaggaaagaaaau

SEQ ID NO: 3728849 - RNA, 20 nt, Salmonella enterica enterica serovar Typhi Ty2
uacaaggaaagaaaaugcca

SEQ ID NO: 3728850 - RNA, 14 nt, Salmonella enterica enterica serovar Typhi Ty2
uacaaguaauaaaa

SEQ ID NO: 3728851 - RNA, 22 nt, Salmonella enterica enterica serovar Typhi Ty2
uacaauaagggcauguuucaug

SEQ ID NO: 3728852 - RNA, 21 nt, Salmonella enterica enterica serovar Typhi Ty2
uacaauccaggacgucuugca

SEQ ID NO: 3728853 - RNA, 18 nt, Salmonella enterica enterica serovar Typhi Ty2
uacaaucgucuucagcaa

SEQ ID NO: 3728854 - RNA, 22 nt, Salmonella enterica enterica serovar Typhi Ty2
uacaaucgucuucagcaauuac

SEQ ID NO: 3728855 - RNA, 16 nt, Salmonella enterica enterica serovar Typhi Ty2
uacaauggcaggcaua

SEQ ID NO: 3728856 - RNA, 16 nt, Salmonella enterica enterica serovar Typhi Ty2
uacaauucaacucacu

SEQ ID NO: 3728857 - RNA, 19 nt, Salmonella enterica enterica serovar Typhi Ty2
uacaauuucuggccccuga

SEQ ID NO: 3728858 - RNA, 22 nt, Salmonella enterica enterica serovar Typhi Ty2
uacacaaagacgaauaaggaau

SEQ ID NO: 3728859 - RNA, 15 nt, Salmonella enterica enterica serovar Typhi Ty2
uacacacucggugca

SEQ ID NO: 3728860 - RNA, 12 nt, Salmonella enterica enterica serovar Typhi Ty2
uacacagcacaa

SEQ ID NO: 3728861 - RNA, 20 nt, Salmonella enterica enterica serovar Typhi Ty2
uacacauaugggaagacauu

SEQ ID NO: 3728862 - RNA, 22 nt, Salmonella enterica enterica serovar Typhi Ty2
uacacaucauuaccauagccgu

SEQ ID NO: 3728863 - RNA, 17 nt, Salmonella enterica enterica serovar Typhi Ty2
uacaccaacuaccaaca

SEQ ID NO: 3728864 - RNA, 13 nt, Salmonella enterica enterica serovar Typhi Ty2
uacaccagacgau

SEQ ID NO: 3728865 - RNA, 19 nt, Salmonella enterica enterica serovar Typhi Ty2
uacaccugacggcagccac

SEQ ID NO: 3728866 - RNA, 18 nt, Salmonella enterica enterica serovar Typhi Ty2
uacaccuucacauuggca

SEQ ID NO: 3728867 - RNA, 12 nt, Salmonella enterica enterica serovar Typhi Ty2
uacaccuuugcc

SEQ ID NO: 3728868 - RNA, 18 nt, Salmonella enterica enterica serovar Typhi Ty2
uacacgccuuccuccagc

SEQ ID NO: 3728869 - RNA, 16 nt, Salmonella enterica enterica serovar Typhi Ty2
uacacgcgaauagcca

SEQ ID NO: 3728870 - RNA, 18 nt, Salmonella enterica enterica serovar Typhi Ty2
uacacgcgaauagccaga

SEQ ID NO: 3728871 - RNA, 20 nt, Salmonella enterica enterica serovar Typhi Ty2
uacacgcgaauagccagaca

SEQ ID NO: 3728872 - RNA, 20 nt, Salmonella enterica enterica serovar Typhi Ty2
uacacguauaaacgccgccg

SEQ ID NO: 3728873 - RNA, 15 nt, Salmonella enterica enterica serovar Typhi Ty2
uacacucugcgcgcg

SEQ ID NO: 3728874 - RNA, 16 nt, Salmonella enterica enterica serovar Typhi Ty2
uacacugauaccccag

SEQ ID NO: 3728875 - RNA, 17 nt, Salmonella enterica enterica serovar Typhi Ty2
uacacuucagccagacg

SEQ ID NO: 3728876 - RNA, 14 nt, Salmonella enterica enterica serovar Typhi Ty2
uacacuucauccgg

SEQ ID NO: 3728877 - RNA, 21 nt, Salmonella enterica enterica serovar Typhi Ty2
uacagaauccggcgcucauca

SEQ ID NO: 3728878 - RNA, 22 nt, Salmonella enterica enterica serovar Typhi Ty2
uacagacaucaucgaacgccgc

SEQ ID NO: 3728879 - RNA, 15 nt, Salmonella enterica enterica serovar Typhi Ty2
uacagcacuucccgc

SEQ ID NO: 3728880 - RNA, 14 nt, Salmonella enterica enterica serovar Typhi Ty2
uacagccaaaaaua

SEQ ID NO: 3728881 - RNA, 17 nt, Salmonella enterica enterica serovar Typhi Ty2
uacagccaaaucagcag

SEQ ID NO: 3728882 - RNA, 21 nt, Salmonella enterica enterica serovar Typhi Ty2
uacagccaaaucagcaggaca

SEQ ID NO: 3728883 - RNA, 13 nt, Salmonella enterica enterica serovar Typhi Ty2
uacagccaccaug

SEQ ID NO: 3728884 - RNA, 19 nt, Salmonella enterica enterica serovar Typhi Ty2
uacagccagguugccagaa

SEQ ID NO: 3728885 - RNA, 13 nt, Salmonella enterica enterica serovar Typhi Ty2
uacagcgccauga

SEQ ID NO: 3728886 - RNA, 19 nt, Salmonella enterica enterica serovar Typhi Ty2
uacagcgucgacagccccc

SEQ ID NO: 3728887 - RNA, 19 nt, Salmonella enterica enterica serovar Typhi Ty2
uacagcguuaacgacgcuc

SEQ ID NO: 3728888 - RNA, 18 nt, Salmonella enterica enterica serovar Typhi Ty2
uacaggaauuccaguccu

SEQ ID NO: 3728889 - RNA, 14 nt, Salmonella enterica enterica serovar Typhi Ty2
uacaggacagaugu

SEQ ID NO: 3728890 - RNA, 21 nt, Salmonella enterica enterica serovar Typhi Ty2
uacaggauauacuucaucagg

SEQ ID NO: 3728891 - RNA, 17 nt, Salmonella enterica enterica serovar Typhi Ty2
uacaggcaucuuccagc

SEQ ID NO: 3728892 - RNA, 19 nt, Salmonella enterica enterica serovar Typhi Ty2
uacaggcauggccuucaau

SEQ ID NO: 3728893 - RNA, 21 nt, Salmonella enterica enterica serovar Typhi Ty2
uacaggcgaccgggcagacau

SEQ ID NO: 3728894 - RNA, 17 nt, Salmonella enterica enterica serovar Typhi Ty2
uacaggcgcaucagaaa

SEQ ID NO: 3728895 - RNA, 19 nt, Salmonella enterica enterica serovar Typhi Ty2
uacaggcgcaucagaaaaa

SEQ ID NO: 3728896 - RNA, 20 nt, Salmonella enterica enterica serovar Typhi Ty2
uacaggcgcaucagaaaaac

SEQ ID NO: 3728897 - RNA, 22 nt, Salmonella enterica enterica serovar Typhi Ty2
uacaggcgcaucagaaaaaccu

SEQ ID NO: 3728898 - RNA, 15 nt, Salmonella enterica enterica serovar Typhi Ty2
uacaggcggaaauca

SEQ ID NO: 3728899 - RNA, 18 nt, Salmonella enterica enterica serovar Typhi Ty2
uacaggcgguaagcgucg

SEQ ID NO: 3728900 - RNA, 18 nt, Salmonella enterica enterica serovar Typhi Ty2
uacaggcuuaacacccgg

SEQ ID NO: 3728901 - RNA, 18 nt, Salmonella enterica enterica serovar Typhi Ty2
uacaggggauuguuaacg

SEQ ID NO: 3728902 - RNA, 22 nt, Salmonella enterica enterica serovar Typhi Ty2
uacagguugugcaucuccugac

SEQ ID NO: 3728903 - RNA, 14 nt, Salmonella enterica enterica serovar Typhi Ty2
uacaguggaaagua

SEQ ID NO: 3728904 - RNA, 19 nt, Salmonella enterica enterica serovar Typhi Ty2
uacaguguaaaaauuuuug

SEQ ID NO: 3728905 - RNA, 18 nt, Salmonella enterica enterica serovar Typhi Ty2
uacaguuaccacacaugc

SEQ ID NO: 3728906 - RNA, 16 nt, Salmonella enterica enterica serovar Typhi Ty2
uacauagaaaauauau

SEQ ID NO: 3728907 - RNA, 22 nt, Salmonella enterica enterica serovar Typhi Ty2
uacauaggcaauauccuccggc

SEQ ID NO: 3728908 - RNA, 22 nt, Salmonella enterica enterica serovar Typhi Ty2
uacauaguucuggcuuugcgcc

SEQ ID NO: 3728909 - RNA, 18 nt, Salmonella enterica enterica serovar Typhi Ty2
uacauauuguuuucuauu

SEQ ID NO: 3728910 - RNA, 15 nt, Salmonella enterica enterica serovar Typhi Ty2
uacaucagaguaauu

SEQ ID NO: 3728911 - RNA, 18 nt, Salmonella enterica enterica serovar Typhi Ty2
uacaucagauaaacggga

SEQ ID NO: 3728912 - RNA, 21 nt, Salmonella enterica enterica serovar Typhi Ty2
uacauccagaaggcaaaaugc

SEQ ID NO: 3728913 - RNA, 18 nt, Salmonella enterica enterica serovar Typhi Ty2
uacauccaucacuccuua

SEQ ID NO: 3728914 - RNA, 16 nt, Salmonella enterica enterica serovar Typhi Ty2
uacauccaugccaucc

SEQ ID NO: 3728915 - RNA, 18 nt, Salmonella enterica enterica serovar Typhi Ty2
uacauccggcucaagagu

SEQ ID NO: 3728916 - RNA, 14 nt, Salmonella enterica enterica serovar Typhi Ty2
uacaucgucugcuu

SEQ ID NO: 3728917 - RNA, 18 nt, Salmonella enterica enterica serovar Typhi Ty2
uacaucuacuucagcacg

SEQ ID NO: 3728918 - RNA, 12 nt, Salmonella enterica enterica serovar Typhi Ty2
uacaugaauaau

SEQ ID NO: 3728919 - RNA, 19 nt, Salmonella enterica enterica serovar Typhi Ty2
uaccgauaauuaagccggu

SEQ ID NO: 3728920 - RNA, 17 nt, Salmonella enterica enterica serovar Typhi Ty2
uaccgauagcgcggaau

SEQ ID NO: 3728921 - RNA, 23 nt, Salmonella enterica enterica serovar Typhi Ty2
uaccgauuguuuggugcugaaau

SEQ ID NO: 3728922 - RNA, 18 nt, Salmonella enterica enterica serovar Typhi Ty2
uaccgcaauaaacacgau

SEQ ID NO: 3728923 - RNA, 23 nt, Salmonella enterica enterica serovar Typhi Ty2
uaccgcaauacgcuucauauccg

SEQ ID NO: 3728924 - RNA, 13 nt, Salmonella enterica enterica serovar Typhi Ty2
uaccgcacaucac

SEQ ID NO: 3728925 - RNA, 18 nt, Salmonella enterica enterica serovar Typhi Ty2
uaccgcagcgaaugugcu

SEQ ID NO: 3728926 - RNA, 13 nt, Salmonella enterica enterica serovar Typhi Ty2
uaccgcagcgcgg

SEQ ID NO: 3728927 - RNA, 18 nt, Salmonella enterica enterica serovar Typhi Ty2
uaccgccaaucaacgccg

SEQ ID NO: 3728928 - RNA, 16 nt, Salmonella enterica enterica serovar Typhi Ty2
uaccgccauccggcau

SEQ ID NO: 3728929 - RNA, 19 nt, Salmonella enterica enterica serovar Typhi Ty2
uaccgcccagaacggcagc

SEQ ID NO: 3728930 - RNA, 23 nt, Salmonella enterica enterica serovar Typhi Ty2
uaccgccgagcauuuccgcagcc

SEQ ID NO: 3728931 - RNA, 15 nt, Salmonella enterica enterica serovar Typhi Ty2
uaccgccgcgaaccu

SEQ ID NO: 3728932 - RNA, 22 nt, Salmonella enterica enterica serovar Typhi Ty2
uaccgcgcaguucaauauucac

SEQ ID NO: 3728933 - RNA, 17 nt, Salmonella enterica enterica serovar Typhi Ty2
uaccgcguuugcgcaac

SEQ ID NO: 3728934 - RNA, 16 nt, Salmonella enterica enterica serovar Typhi Ty2
uaccgcuaaaauaccc

SEQ ID NO: 3728935 - RNA, 14 nt, Salmonella enterica enterica serovar Typhi Ty2
uaccgcuuuaucau

SEQ ID NO: 3728936 - RNA, 20 nt, Salmonella enterica enterica serovar Typhi Ty2
uaccggaaucgccugcgucg

SEQ ID NO: 3728937 - RNA, 13 nt, Salmonella enterica enterica serovar Typhi Ty2
uaccggcaaccgg

SEQ ID NO: 3728938 - RNA, 17 nt, Salmonella enterica enterica serovar Typhi Ty2
uaccggcaacgccgggg

SEQ ID NO: 3728939 - RNA, 16 nt, Salmonella enterica enterica serovar Typhi Ty2
uaccggcgaagucgcc

SEQ ID NO: 3728940 - RNA, 19 nt, Salmonella enterica enterica serovar Typhi Ty2
uaccgggccuauauuucug

SEQ ID NO: 3728941 - RNA, 23 nt, Salmonella enterica enterica serovar Typhi Ty2
uaccgggccuccuuuccugugcu

SEQ ID NO: 3728942 - RNA, 21 nt, Salmonella enterica enterica serovar Typhi Ty2
uaccggugcgauucagcgcag

SEQ ID NO: 3728943 - RNA, 14 nt, Salmonella enterica enterica serovar Typhi Ty2
uaccguaaaaugcu

SEQ ID NO: 3728944 - RNA, 15 nt, Salmonella enterica enterica serovar Typhi Ty2
uaccguaaaaugcug

SEQ ID NO: 3728945 - RNA, 18 nt, Salmonella enterica enterica serovar Typhi Ty2
uaccguaggccggauaag

SEQ ID NO: 3728946 - RNA, 20 nt, Salmonella enterica enterica serovar Typhi Ty2
uaccgucagauucugcggua

SEQ ID NO: 3728947 - RNA, 17 nt, Salmonella enterica enterica serovar Typhi Ty2
uaccgucgccgacaacg

SEQ ID NO: 3728948 - RNA, 16 nt, Salmonella enterica enterica serovar Typhi Ty2
agacucgcggguuuca

SEQ ID NO: 3728949 - RNA, 22 nt, Salmonella enterica enterica serovar Typhi Ty2
agacucgcuucacgcggauugc

SEQ ID NO: 3728950 - RNA, 17 nt, Salmonella enterica enterica serovar Typhi Ty2
agacugcacuuccugcg

SEQ ID NO: 3728951 - RNA, 21 nt, Salmonella enterica enterica serovar Typhi Ty2
agacugcacuuccugcgucag

SEQ ID NO: 3728952 - RNA, 13 nt, Salmonella enterica enterica serovar Typhi Ty2
agacugcccggca

SEQ ID NO: 3728953 - RNA, 14 nt, Salmonella enterica enterica serovar Typhi Ty2
agacugcccggcau

SEQ ID NO: 3728954 - RNA, 12 nt, Salmonella enterica enterica serovar Typhi Ty2
agacuggaugga

SEQ ID NO: 3728955 - RNA, 16 nt, Salmonella enterica enterica serovar Typhi Ty2
agacuggucgcccgga

SEQ ID NO: 3728956 - RNA, 21 nt, Salmonella enterica enterica serovar Typhi Ty2
agacuguugaaagccccggcu

SEQ ID NO: 3728957 - RNA, 14 nt, Salmonella enterica enterica serovar Typhi Ty2
agacuuagcccugg

SEQ ID NO: 3728958 - RNA, 13 nt, Salmonella enterica enterica serovar Typhi Ty2
agacuucuuccau

SEQ ID NO: 3728959 - RNA, 10 nt, Salmonella enterica enterica serovar Typhi Ty2
agagaaaaaa

SEQ ID NO: 3728960 - RNA, 11 nt, Salmonella enterica enterica serovar Typhi Ty2
agagaaaaaaa

SEQ ID NO: 3728961 - RNA, 17 nt, Salmonella enterica enterica serovar Typhi Ty2
agagaaaaaaauccagu

SEQ ID NO: 3728962 - RNA, 15 nt, Salmonella enterica enterica serovar Typhi Ty2
agagaaacaacaccg

SEQ ID NO: 3728963 - RNA, 22 nt, Salmonella enterica enterica serovar Typhi Ty2
agagaaacaacaccguaaaagg

SEQ ID NO: 3728964 - RNA, 14 nt, Salmonella enterica enterica serovar Typhi Ty2
agagaaagcgcuga

SEQ ID NO: 3728965 - RNA, 12 nt, Salmonella enterica enterica serovar Typhi Ty2
agagaaccguuc

SEQ ID NO: 3728966 - RNA, 14 nt, Salmonella enterica enterica serovar Typhi Ty2
agagaaccugaaca

SEQ ID NO: 3728967 - RNA, 15 nt, Salmonella enterica enterica serovar Typhi Ty2
agagaaccugaacaa

SEQ ID NO: 3728968 - RNA, 20 nt, Salmonella enterica enterica serovar Typhi Ty2
agagaaccugaacaauaauc

SEQ ID NO: 3728969 - RNA, 22 nt, Salmonella enterica enterica serovar Typhi Ty2
agagaacgaaauauggcacagc

SEQ ID NO: 3728970 - RNA, 14 nt, Salmonella enterica enterica serovar Typhi Ty2
agagaagucugagc

SEQ ID NO: 3728971 - RNA, 22 nt, Salmonella enterica enterica serovar Typhi Ty2
agagaagucugagcgcaaacau

SEQ ID NO: 3728972 - RNA, 19 nt, Salmonella enterica enterica serovar Typhi Ty2
agagaauaacgaugaugaa

SEQ ID NO: 3728973 - RNA, 17 nt, Salmonella enterica enterica serovar Typhi Ty2
agagaauggccagcaca

SEQ ID NO: 3728974 - RNA, 17 nt, Salmonella enterica enterica serovar Typhi Ty2
agagacauugccuucca

SEQ ID NO: 3728975 - RNA, 12 nt, Salmonella enterica enterica serovar Typhi Ty2
agagacugacaa

SEQ ID NO: 3728976 - RNA, 19 nt, Salmonella enterica enterica serovar Typhi Ty2
agagacuggcgacagccgc

SEQ ID NO: 3728977 - RNA, 13 nt, Salmonella enterica enterica serovar Typhi Ty2
agagagccuuaca

SEQ ID NO: 3728978 - RNA, 19 nt, Salmonella enterica enterica serovar Typhi Ty2
agagagcgggccguggcca

SEQ ID NO: 3728979 - RNA, 12 nt, Salmonella enterica enterica serovar Typhi Ty2
agagagugagaa

SEQ ID NO: 3728980 - RNA, 12 nt, Salmonella enterica enterica serovar Typhi Ty2
agagaguuccuc

SEQ ID NO: 3728981 - RNA, 16 nt, Salmonella enterica enterica serovar Typhi Ty2
agagauaauuuuccca

SEQ ID NO: 3728982 - RNA, 21 nt, Salmonella enterica enterica serovar Typhi Ty2
agagauaauuuucccaguuca

SEQ ID NO: 3728983 - RNA, 12 nt, Salmonella enterica enterica serovar Typhi Ty2
agagauagaacg

SEQ ID NO: 3728984 - RNA, 13 nt, Salmonella enterica enterica serovar Typhi Ty2
agagauccagaac

SEQ ID NO: 3728985 - RNA, 17 nt, Salmonella enterica enterica serovar Typhi Ty2
agagaucgacagcgcgc

SEQ ID NO: 3728986 - RNA, 17 nt, Salmonella enterica enterica serovar Typhi Ty2
agagauucugcaggcca

SEQ ID NO: 3728987 - RNA, 20 nt, Salmonella enterica enterica serovar Typhi Ty2
agagcaaauacuggaaaaaa

SEQ ID NO: 3728988 - RNA, 18 nt, Salmonella enterica enterica serovar Typhi Ty2
agagcaacauaccgcaga

SEQ ID NO: 3728989 - RNA, 13 nt, Salmonella enterica enterica serovar Typhi Ty2
agagcaacgccau

SEQ ID NO: 3728990 - RNA, 18 nt, Salmonella enterica enterica serovar Typhi Ty2
agagcaacgccaucagca

SEQ ID NO: 3728991 - RNA, 20 nt, Salmonella enterica enterica serovar Typhi Ty2
agagcaacgccaucagcaaa

SEQ ID NO: 3728992 - RNA, 17 nt, Salmonella enterica enterica serovar Typhi Ty2
agagcaacuggcaauag

SEQ ID NO: 3728993 - RNA, 18 nt, Salmonella enterica enterica serovar Typhi Ty2
agagcaguuuuacgugga

SEQ ID NO: 3728994 - RNA, 14 nt, Salmonella enterica enterica serovar Typhi Ty2
agagcauccgcagc

SEQ ID NO: 3728995 - RNA, 15 nt, Salmonella enterica enterica serovar Typhi Ty2
agagcaucgcggcau

SEQ ID NO: 3728996 - RNA, 21 nt, Salmonella enterica enterica serovar Typhi Ty2
agagcaucuaccgcauacuga

SEQ ID NO: 3728997 - RNA, 21 nt, Salmonella enterica enterica serovar Typhi Ty2
agagcauuuguagcggcaaca

SEQ ID NO: 3728998 - RNA, 16 nt, Salmonella enterica enterica serovar Typhi Ty2
agagccuuacaggcgc

SEQ ID NO: 3728999 - RNA, 16 nt, Salmonella enterica enterica serovar Typhi Ty2
agagcgacguugucuu

SEQ ID NO: 3729000 - RNA, 15 nt, Salmonella enterica enterica serovar Typhi Ty2
agagcgcgcucugcc

SEQ ID NO: 3729001 - RNA, 22 nt, Salmonella enterica enterica serovar Typhi Ty2
agagcggauaagcgcagcgcca

SEQ ID NO: 3729002 - RNA, 18 nt, Salmonella enterica enterica serovar Typhi Ty2
agagcgggucaacgccaa

SEQ ID NO: 3729003 - RNA, 16 nt, Salmonella enterica enterica serovar Typhi Ty2
agagcguccacgccau

SEQ ID NO: 3729004 - RNA, 20 nt, Salmonella enterica enterica serovar Typhi Ty2
agagcuaaucaauaaguuuu

SEQ ID NO: 3729005 - RNA, 13 nt, Salmonella enterica enterica serovar Typhi Ty2
agagcucgucaaa

SEQ ID NO: 3729006 - RNA, 23 nt, Salmonella enterica enterica serovar Typhi Ty2
agagcuuuuccuguucgcuuauu

SEQ ID NO: 3729007 - RNA, 15 nt, Salmonella enterica enterica serovar Typhi Ty2
agaggaauguccagc

SEQ ID NO: 3729008 - RNA, 23 nt, Salmonella enterica enterica serovar Typhi Ty2
agaggaucuggacgccaauuccu

SEQ ID NO: 3729009 - RNA, 20 nt, Salmonella enterica enterica serovar Typhi Ty2
agaggcgccgacuuuacggc

SEQ ID NO: 3729010 - RNA, 23 nt, Salmonella enterica enterica serovar Typhi Ty2
agaggcugaaggcgcuccccugc

SEQ ID NO: 3729011 - RNA, 20 nt, Salmonella enterica enterica serovar Typhi Ty2
agaggguuggacaaaauuuu

SEQ ID NO: 3729012 - RNA, 20 nt, Salmonella enterica enterica serovar Typhi Ty2
agagguguuauggcaggcga

SEQ ID NO: 3729013 - RNA, 18 nt, Salmonella enterica enterica serovar Typhi Ty2
agagguuagcgcaggggg

SEQ ID NO: 3729014 - RNA, 20 nt, Salmonella enterica enterica serovar Typhi Ty2
agagguuccccagccgcuuu

SEQ ID NO: 3729015 - RNA, 15 nt, Salmonella enterica enterica serovar Typhi Ty2
agaguaacccuuuag

SEQ ID NO: 3729016 - RNA, 19 nt, Salmonella enterica enterica serovar Typhi Ty2
agagucaaggcauccagca

SEQ ID NO: 3729017 - RNA, 20 nt, Salmonella enterica enterica serovar Typhi Ty2
agagucaaggcauccagcag

SEQ ID NO: 3729018 - RNA, 13 nt, Salmonella enterica enterica serovar Typhi Ty2
agaguccugacgu

SEQ ID NO: 3729019 - RNA, 22 nt, Salmonella enterica enterica serovar Typhi Ty2
agagucucgaaacgaaucucau

SEQ ID NO: 3729020 - RNA, 20 nt, Salmonella enterica enterica serovar Typhi Ty2
agagugagccacguuuuccu

SEQ ID NO: 3729021 - RNA, 20 nt, Salmonella enterica enterica serovar Typhi Ty2
agagugauccaccaccagca

SEQ ID NO: 3729022 - RNA, 20 nt, Salmonella enterica enterica serovar Typhi Ty2
agaguguaggccugauaaga

SEQ ID NO: 3729023 - RNA, 18 nt, Salmonella enterica enterica serovar Typhi Ty2
agaguucacguagcucaa

SEQ ID NO: 3729024 - RNA, 18 nt, Salmonella enterica enterica serovar Typhi Ty2
agaguucguuaaucucaa

SEQ ID NO: 3729025 - RNA, 15 nt, Salmonella enterica enterica serovar Typhi Ty2
agaguugaugccgga

SEQ ID NO: 3729026 - RNA, 20 nt, Salmonella enterica enterica serovar Typhi Ty2
agauaaaguacggcgcgcca

SEQ ID NO: 3729027 - RNA, 13 nt, Salmonella enterica enterica serovar Typhi Ty2
agauaaaucagcc

SEQ ID NO: 3729028 - RNA, 16 nt, Salmonella enterica enterica serovar Typhi Ty2
agauaacaccgcaugg

SEQ ID NO: 3729029 - RNA, 22 nt, Salmonella enterica enterica serovar Typhi Ty2
agauaaccgucggcgccggcgu

SEQ ID NO: 3729030 - RNA, 12 nt, Salmonella enterica enterica serovar Typhi Ty2
agauaacgcuau

SEQ ID NO: 3729031 - RNA, 16 nt, Salmonella enterica enterica serovar Typhi Ty2
agauaacgcuaugcuu

SEQ ID NO: 3729032 - RNA, 17 nt, Salmonella enterica enterica serovar Typhi Ty2
agauaagaaaaaacugg

SEQ ID NO: 3729033 - RNA, 16 nt, Salmonella enterica enterica serovar Typhi Ty2
agauaagaaguaaaca

SEQ ID NO: 3729034 - RNA, 12 nt, Salmonella enterica enterica serovar Typhi Ty2
agauaagaucuu

SEQ ID NO: 3729035 - RNA, 17 nt, Salmonella enterica enterica serovar Typhi Ty2
agauaagcgucugcaau

SEQ ID NO: 3729036 - RNA, 19 nt, Salmonella enterica enterica serovar Typhi Ty2
agauaaggagaaagaccuu

SEQ ID NO: 3729037 - RNA, 14 nt, Salmonella enterica enterica serovar Typhi Ty2
agauaaguguugga

SEQ ID NO: 3729038 - RNA, 12 nt, Salmonella enterica enterica serovar Typhi Ty2
agauaauagcug

SEQ ID NO: 3729039 - RNA, 17 nt, Salmonella enterica enterica serovar Typhi Ty2
agauaauccagcgucgc

SEQ ID NO: 3729040 - RNA, 20 nt, Salmonella enterica enterica serovar Typhi Ty2
agauaauccagcgucgccag

SEQ ID NO: 3729041 - RNA, 16 nt, Salmonella enterica enterica serovar Typhi Ty2
agauaauuaugccugu

SEQ ID NO: 3729042 - RNA, 18 nt, Salmonella enterica enterica serovar Typhi Ty2
agauacauggcuauucca

SEQ ID NO: 3729043 - RNA, 20 nt, Salmonella enterica enterica serovar Typhi Ty2
agauaccuacuuuauuuuuc

SEQ ID NO: 3729044 - RNA, 19 nt, Salmonella enterica enterica serovar Typhi Ty2
agauacugcgcguggcaaa

SEQ ID NO: 3729045 - RNA, 22 nt, Salmonella enterica enterica serovar Typhi Ty2
agauacuggaagugauccuuca

SEQ ID NO: 3729046 - RNA, 21 nt, Salmonella enterica enterica serovar Typhi Ty2
agauagcccgccagcaccagc

SEQ ID NO: 3729047 - RNA, 23 nt, Salmonella enterica enterica serovar Typhi Ty2
agauagcccgccagcaccagcag

SEQ ID NO: 3729048 - RNA, 23 nt, Salmonella enterica enterica serovar Typhi Ty2
agauagcgcugcgccagaucagg

SEQ ID NO: 3729049 - RNA, 20 nt, Salmonella enterica enterica serovar Typhi Ty2
agauagcugcuuaccauacu

SEQ ID NO: 3729050 - RNA, 17 nt, Salmonella enterica enterica serovar Typhi Ty2
agauagcuuccaugccg

SEQ ID NO: 3729051 - RNA, 15 nt, Salmonella enterica enterica serovar Typhi Ty2
agauagggccaggcg

SEQ ID NO: 3729052 - RNA, 20 nt, Salmonella enterica enterica serovar Typhi Ty2
agauagucacgauaguuugc

SEQ ID NO: 3729053 - RNA, 16 nt, Salmonella enterica enterica serovar Typhi Ty2
agauagucgaucccca

SEQ ID NO: 3729054 - RNA, 15 nt, Salmonella enterica enterica serovar Typhi Ty2
agauaguugagcagc

SEQ ID NO: 3729055 - RNA, 20 nt, Salmonella enterica enterica serovar Typhi Ty2
agauauaggguggcuuucua

SEQ ID NO: 3729056 - RNA, 17 nt, Salmonella enterica enterica serovar Typhi Ty2
agauaucccaugaaacu

SEQ ID NO: 3729057 - RNA, 14 nt, Salmonella enterica enterica serovar Typhi Ty2
agauauggcgggga

SEQ ID NO: 3729058 - RNA, 15 nt, Salmonella enterica enterica serovar Typhi Ty2
agauauuaauaucga

SEQ ID NO: 3729059 - RNA, 15 nt, Salmonella enterica enterica serovar Typhi Ty2
agauauuauaaaaua

SEQ ID NO: 3729060 - RNA, 16 nt, Salmonella enterica enterica serovar Typhi Ty2
agauauuauaaaauaa

SEQ ID NO: 3729061 - RNA, 13 nt, Salmonella enterica enterica serovar Typhi Ty2
agaucaaaaaucu

SEQ ID NO: 3729062 - RNA, 17 nt, Salmonella enterica enterica serovar Typhi Ty2
agaucaaacaggcgaaa

SEQ ID NO: 3729063 - RNA, 18 nt, Salmonella enterica enterica serovar Typhi Ty2
agaucagacgaccaucca

SEQ ID NO: 3729064 - RNA, 15 nt, Salmonella enterica enterica serovar Typhi Ty2
agaucaggcgucagc

SEQ ID NO: 3729065 - RNA, 19 nt, Salmonella enterica enterica serovar Typhi Ty2
agaucaggcgucagcaugg

SEQ ID NO: 3729066 - RNA, 21 nt, Salmonella enterica enterica serovar Typhi Ty2
agaucaggcgucagcauggug

SEQ ID NO: 3729067 - RNA, 20 nt, Salmonella enterica enterica serovar Typhi Ty2
agaucauuaccugucgccca

SEQ ID NO: 3729068 - RNA, 18 nt, Salmonella enterica enterica serovar Typhi Ty2
agaucauuccugaauacc

SEQ ID NO: 3729069 - RNA, 21 nt, Salmonella enterica enterica serovar Typhi Ty2
agauccacugagcgcgccaug

SEQ ID NO: 3729070 - RNA, 17 nt, Salmonella enterica enterica serovar Typhi Ty2
agaucccagggcggcgu

SEQ ID NO: 3729071 - RNA, 17 nt, Salmonella enterica enterica serovar Typhi Ty2
agauccuuaacgucaaa

SEQ ID NO: 3729072 - RNA, 14 nt, Salmonella enterica enterica serovar Typhi Ty2
agauccuucauuca

SEQ ID NO: 3729073 - RNA, 17 nt, Salmonella enterica enterica serovar Typhi Ty2
agaucgaccagcgcaua

SEQ ID NO: 3729074 - RNA, 19 nt, Salmonella enterica enterica serovar Typhi Ty2
agaucgcagucgauuuaau

SEQ ID NO: 3729075 - RNA, 20 nt, Salmonella enterica enterica serovar Typhi Ty2
agaucgccgccgguaacgau

SEQ ID NO: 3729076 - RNA, 17 nt, Salmonella enterica enterica serovar Typhi Ty2
agaucggcauagcggga

SEQ ID NO: 3729077 - RNA, 17 nt, Salmonella enterica enterica serovar Typhi Ty2
agaucgguaauuuccac

SEQ ID NO: 3729078 - RNA, 23 nt, Salmonella enterica enterica serovar Typhi Ty2
agaucguaagaauaaucauccgc

SEQ ID NO: 3729079 - RNA, 20 nt, Salmonella enterica enterica serovar Typhi Ty2
agaucguaugcgccuguuag

SEQ ID NO: 3729080 - RNA, 16 nt, Salmonella enterica enterica serovar Typhi Ty2
agaucgugcauccgga

SEQ ID NO: 3729081 - RNA, 22 nt, Salmonella enterica enterica serovar Typhi Ty2
agaucgugcauccggacgccag

SEQ ID NO: 3729082 - RNA, 18 nt, Salmonella enterica enterica serovar Typhi Ty2
agaucguuauccagcagc

SEQ ID NO: 3729083 - RNA, 19 nt, Salmonella enterica enterica serovar Typhi Ty2
agaucguuauccagcagcc

SEQ ID NO: 3729084 - RNA, 15 nt, Salmonella enterica enterica serovar Typhi Ty2
agaucucuaucggca

SEQ ID NO: 3729085 - RNA, 18 nt, Salmonella enterica enterica serovar Typhi Ty2
agaucuucacgcgucagg

SEQ ID NO: 3729086 - RNA, 14 nt, Salmonella enterica enterica serovar Typhi Ty2
agaucuuccggcgu

SEQ ID NO: 3729087 - RNA, 18 nt, Salmonella enterica enterica serovar Typhi Ty2
agaugaagacaacgucgc

SEQ ID NO: 3729088 - RNA, 21 nt, Salmonella enterica enterica serovar Typhi Ty2
agaugaccaaagcuauucaca

SEQ ID NO: 3729089 - RNA, 18 nt, Salmonella enterica enterica serovar Typhi Ty2
agaugauaaucauccggg

SEQ ID NO: 3729090 - RNA, 14 nt, Salmonella enterica enterica serovar Typhi Ty2
agaugauagccauu

SEQ ID NO: 3729091 - RNA, 19 nt, Salmonella enterica enterica serovar Typhi Ty2
agaugaugauuuaugaaua

SEQ ID NO: 3729092 - RNA, 17 nt, Salmonella enterica enterica serovar Typhi Ty2
agaugauggaugucagc

SEQ ID NO: 3729093 - RNA, 23 nt, Salmonella enterica enterica serovar Typhi Ty2
agaugcagcggcaguuccggcgu

SEQ ID NO: 3729094 - RNA, 15 nt, Salmonella enterica enterica serovar Typhi Ty2
agaugcaggccaagc

SEQ ID NO: 3729095 - RNA, 17 nt, Salmonella enterica enterica serovar Typhi Ty2
agaugcccgcagaucug

SEQ ID NO: 3729096 - RNA, 16 nt, Salmonella enterica enterica serovar Typhi Ty2
agaugccggagcgaug

SEQ ID NO: 3729097 - RNA, 13 nt, Salmonella enterica enterica serovar Typhi Ty2
agaugcgaaucuu

SEQ ID NO: 3729098 - RNA, 16 nt, Salmonella enterica enterica serovar Typhi Ty2
agaugcugucggaaaa

SEQ ID NO: 3729099 - RNA, 16 nt, Salmonella enterica enterica serovar Typhi Ty2
agauggcaagauuaac

SEQ ID NO: 3729100 - RNA, 21 nt, Salmonella enterica enterica serovar Typhi Ty2
agauggcauugcccggcggca

SEQ ID NO: 3729101 - RNA, 16 nt, Salmonella enterica enterica serovar Typhi Ty2
agauggcgcuaaaacc

SEQ ID NO: 3729102 - RNA, 20 nt, Salmonella enterica enterica serovar Typhi Ty2
agauggcgucacauggcgaa

SEQ ID NO: 3729103 - RNA, 15 nt, Salmonella enterica enterica serovar Typhi Ty2
agauggcguggccaa

SEQ ID NO: 3729104 - RNA, 21 nt, Salmonella enterica enterica serovar Typhi Ty2
agaugguauaaaucacgcuga

SEQ ID NO: 3729105 - RNA, 22 nt, Salmonella enterica enterica serovar Typhi Ty2
agauggucuguaccaccagaau

SEQ ID NO: 3729106 - RNA, 19 nt, Salmonella enterica enterica serovar Typhi Ty2
agauguucuaucuuucaga

SEQ ID NO: 3729107 - RNA, 20 nt, Salmonella enterica enterica serovar Typhi Ty2
agauguugauacagaaaacc

SEQ ID NO: 3729108 - RNA, 21 nt, Salmonella enterica enterica serovar Typhi Ty2
agauguuuuaaucucuucuau

SEQ ID NO: 3729109 - RNA, 16 nt, Salmonella enterica enterica serovar Typhi Ty2
agauuaacagcuucau

SEQ ID NO: 3729110 - RNA, 20 nt, Salmonella enterica enterica serovar Typhi Ty2
agauuaauaauugagcgcaa

SEQ ID NO: 3729111 - RNA, 20 nt, Salmonella enterica enterica serovar Typhi Ty2
agauuacucucuugccagcg

SEQ ID NO: 3729112 - RNA, 19 nt, Salmonella enterica enterica serovar Typhi Ty2
agauuaucggccagcgcca

SEQ ID NO: 3729113 - RNA, 19 nt, Salmonella enterica enterica serovar Typhi Ty2
agauucaccaccacccgau

SEQ ID NO: 3729114 - RNA, 18 nt, Salmonella enterica enterica serovar Typhi Ty2
agauucaggccgccagca

SEQ ID NO: 3729115 - RNA, 14 nt, Salmonella enterica enterica serovar Typhi Ty2
agauucuaacauaa

SEQ ID NO: 3729116 - RNA, 23 nt, Salmonella enterica enterica serovar Typhi Ty2
agauucugcgguaaucugccagc

SEQ ID NO: 3729117 - RNA, 18 nt, Salmonella enterica enterica serovar Typhi Ty2
agauugaaacgaaaacug

SEQ ID NO: 3729118 - RNA, 14 nt, Salmonella enterica enterica serovar Typhi Ty2
agauugaacgcugg

SEQ ID NO: 3729119 - RNA, 14 nt, Salmonella enterica enterica serovar Typhi Ty2
agauugauuuauuc

SEQ ID NO: 3729120 - RNA, 16 nt, Salmonella enterica enterica serovar Typhi Ty2
agauuggcaucugcaa

SEQ ID NO: 3729121 - RNA, 18 nt, Salmonella enterica enterica serovar Typhi Ty2
agauuggcccgcccagca

SEQ ID NO: 3729122 - RNA, 15 nt, Salmonella enterica enterica serovar Typhi Ty2
agauugucaccguaa

SEQ ID NO: 3729123 - RNA, 21 nt, Salmonella enterica enterica serovar Typhi Ty2
agauugugcuuuagcuuuacu

SEQ ID NO: 3729124 - RNA, 20 nt, Salmonella enterica enterica serovar Typhi Ty2
agauuguggaacuuuaucgc

SEQ ID NO: 3729125 - RNA, 23 nt, Salmonella enterica enterica serovar Typhi Ty2
agauuguuucggauaauucugac

SEQ ID NO: 3729126 - RNA, 13 nt, Salmonella enterica enterica serovar Typhi Ty2
agauuuaaaacaa

SEQ ID NO: 3729127 - RNA, 14 nt, Salmonella enterica enterica serovar Typhi Ty2
agauuuaaaacaag

SEQ ID NO: 3729128 - RNA, 15 nt, Salmonella enterica enterica serovar Typhi Ty2
agauuuaaaacaagc

SEQ ID NO: 3729129 - RNA, 17 nt, Salmonella enterica enterica serovar Typhi Ty2
agauuuaucaauuuuua

SEQ ID NO: 3729130 - RNA, 20 nt, Salmonella enterica enterica serovar Typhi Ty2
agauuucacaauguuuuugu

SEQ ID NO: 3729131 - RNA, 17 nt, Salmonella enterica enterica serovar Typhi Ty2
agauuucaucaggcuga

SEQ ID NO: 3729132 - RNA, 24 nt, Salmonella enterica enterica serovar Typhi Ty2
agauuucaucaggcugacgaagaa

SEQ ID NO: 3729133 - RNA, 15 nt, Salmonella enterica enterica serovar Typhi Ty2
agauuucgcgucagg

SEQ ID NO: 3729134 - RNA, 16 nt, Salmonella enterica enterica serovar Typhi Ty2
agauuucuuaauuccu

SEQ ID NO: 3729135 - RNA, 18 nt, Salmonella enterica enterica serovar Typhi Ty2
agauuucuuaauuccuca

SEQ ID NO: 3729136 - RNA, 19 nt, Salmonella enterica enterica serovar Typhi Ty2
agauuucuuaauuccucag

SEQ ID NO: 3729137 - RNA, 17 nt, Salmonella enterica enterica serovar Typhi Ty2
agauuuuucucacacau

SEQ ID NO: 3729138 - RNA, 16 nt, Salmonella enterica enterica serovar Typhi Ty2
agcaaaaucacgcaca

SEQ ID NO: 3729139 - RNA, 20 nt, Salmonella enterica enterica serovar Typhi Ty2
agcaaacauccccgcuugca

SEQ ID NO: 3729140 - RNA, 18 nt, Salmonella enterica enterica serovar Typhi Ty2
agcaaaccgacccaaaaa

SEQ ID NO: 3729141 - RNA, 18 nt, Salmonella enterica enterica serovar Typhi Ty2
agcaaaccggcaugaaga

SEQ ID NO: 3729142 - RNA, 21 nt, Salmonella enterica enterica serovar Typhi Ty2
agcaaacgccauagcaucgac

SEQ ID NO: 3729143 - RNA, 13 nt, Salmonella enterica enterica serovar Typhi Ty2
agcaaacuggcgc

SEQ ID NO: 3729144 - RNA, 17 nt, Salmonella enterica enterica serovar Typhi Ty2
agcaaacuggcgcguac

SEQ ID NO: 3729145 - RNA, 21 nt, Salmonella enterica enterica serovar Typhi Ty2
agcaaagcguacaugaauaau

SEQ ID NO: 3729146 - RNA, 14 nt, Salmonella enterica enterica serovar Typhi Ty2
agcaaaucagcuac

SEQ ID NO: 3729147 - RNA, 21 nt, Salmonella enterica enterica serovar Typhi Ty2
agcaaaucgcccaucacaugu

SEQ ID NO: 3729148 - RNA, 13 nt, Salmonella enterica enterica serovar Typhi Ty2
agcaaauucaggg

SEQ ID NO: 3729149 - RNA, 14 nt, Salmonella enterica enterica serovar Typhi Ty2
agcaaauugcugau

SEQ ID NO: 3729150 - RNA, 18 nt, Salmonella enterica enterica serovar Typhi Ty2
agcaacacagccagcacg

SEQ ID NO: 3729151 - RNA, 22 nt, Salmonella enterica enterica serovar Typhi Ty2
agcaacacuuugcgcugcgcau

SEQ ID NO: 3729152 - RNA, 20 nt, Salmonella enterica enterica serovar Typhi Ty2
agcaacagauugaugcccuc

SEQ ID NO: 3729153 - RNA, 19 nt, Salmonella enterica enterica serovar Typhi Ty2
agcaacagugggcuaugaa

SEQ ID NO: 3729154 - RNA, 16 nt, Salmonella enterica enterica serovar Typhi Ty2
agcaacccaccugcca

SEQ ID NO: 3729155 - RNA, 22 nt, Salmonella enterica enterica serovar Typhi Ty2
agcaacccugccgucucaacca

SEQ ID NO: 3729156 - RNA, 20 nt, Salmonella enterica enterica serovar Typhi Ty2
agcaacccuggcgcuuuaaa

SEQ ID NO: 3729157 - RNA, 20 nt, Salmonella enterica enterica serovar Typhi Ty2
agcaacgccaucagcaaaau

SEQ ID NO: 3729158 - RNA, 19 nt, Salmonella enterica enterica serovar Typhi Ty2
agcaacguaaucccgccag

SEQ ID NO: 3729159 - RNA, 23 nt, Salmonella enterica enterica serovar Typhi Ty2
agcaacguaaucccgccagccuu

SEQ ID NO: 3729160 - RNA, 22 nt, Salmonella enterica enterica serovar Typhi Ty2
agcaacgugaacugcgccugca

SEQ ID NO: 3729161 - RNA, 20 nt, Salmonella enterica enterica serovar Typhi Ty2
agcaacguuuguaacagcag

SEQ ID NO: 3729162 - RNA, 13 nt, Salmonella enterica enterica serovar Typhi Ty2
agcaacugccagg

SEQ ID NO: 3729163 - RNA, 20 nt, Salmonella enterica enterica serovar Typhi Ty2
agcaacugcgcgcggguuuc

SEQ ID NO: 3729164 - RNA, 18 nt, Salmonella enterica enterica serovar Typhi Ty2
agcaagaacagagcaauu

SEQ ID NO: 3729165 - RNA, 19 nt, Salmonella enterica enterica serovar Typhi Ty2
agcaagaacagagcaauua

SEQ ID NO: 3729166 - RNA, 22 nt, Salmonella enterica enterica serovar Typhi Ty2
agcaagaaguuccgcuuuucug

SEQ ID NO: 3729167 - RNA, 16 nt, Salmonella enterica enterica serovar Typhi Ty2
agcaagaauaccacuu

SEQ ID NO: 3729168 - RNA, 18 nt, Salmonella enterica enterica serovar Typhi Ty2
agcaagcgcacgguuaau

SEQ ID NO: 3729169 - RNA, 13 nt, Salmonella enterica enterica serovar Typhi Ty2
agcaaggcaagaa

SEQ ID NO: 3729170 - RNA, 21 nt, Salmonella enterica enterica serovar Typhi Ty2
agcaauaaaaauaucauuaaa

SEQ ID NO: 3729171 - RNA, 14 nt, Salmonella enterica enterica serovar Typhi Ty2
agcaauaaaaggaa

SEQ ID NO: 3729172 - RNA, 12 nt, Salmonella enterica enterica serovar Typhi Ty2
agcaauaauccg

SEQ ID NO: 3729173 - RNA, 16 nt, Salmonella enterica enterica serovar Typhi Ty2
agcaauacaauuauug

SEQ ID NO: 3729174 - RNA, 17 nt, Salmonella enterica enterica serovar Typhi Ty2
agcaauacaauuauugc

SEQ ID NO: 3729175 - RNA, 21 nt, Salmonella enterica enterica serovar Typhi Ty2
agcaauagguuugaccagaua

SEQ ID NO: 3729176 - RNA, 15 nt, Salmonella enterica enterica serovar Typhi Ty2
agcaauauuuuuccg

SEQ ID NO: 3729177 - RNA, 16 nt, Salmonella enterica enterica serovar Typhi Ty2
agcaaucacuuccgcc

SEQ ID NO: 3729178 - RNA, 20 nt, Salmonella enterica enterica serovar Typhi Ty2
agcaaucagguauuuccugc

SEQ ID NO: 3729179 - RNA, 20 nt, Salmonella enterica enterica serovar Typhi Ty2
agcaauccauuuuaaauaca

SEQ ID NO: 3729180 - RNA, 22 nt, Salmonella enterica enterica serovar Typhi Ty2
agcaaucucuauaccauaaaug

SEQ ID NO: 3729181 - RNA, 13 nt, Salmonella enterica enterica serovar Typhi Ty2
agcaaugauuuua

SEQ ID NO: 3729182 - RNA, 15 nt, Salmonella enterica enterica serovar Typhi Ty2
agcaaugauuuuuag

SEQ ID NO: 3729183 - RNA, 17 nt, Salmonella enterica enterica serovar Typhi Ty2
agcaaugugcgccagaa

SEQ ID NO: 3729184 - RNA, 19 nt, Salmonella enterica enterica serovar Typhi Ty2
agcaauuccgccaucucau

SEQ ID NO: 3729185 - RNA, 21 nt, Salmonella enterica enterica serovar Typhi Ty2
agcaauugccauaaaaacaau

SEQ ID NO: 3729186 - RNA, 18 nt, Salmonella enterica enterica serovar Typhi Ty2
agcaauuggccaucuucg

SEQ ID NO: 3729187 - RNA, 19 nt, Salmonella enterica enterica serovar Typhi Ty2
agcaauuucagcauccucc

SEQ ID NO: 3729188 - RNA, 19 nt, Salmonella enterica enterica serovar Typhi Ty2
agcaauuucucgcccgcca

SEQ ID NO: 3729189 - RNA, 22 nt, Salmonella enterica enterica serovar Typhi Ty2
agcacaacgcauuggcaauuaa

SEQ ID NO: 3729190 - RNA, 15 nt, Salmonella enterica enterica serovar Typhi Ty2
agcacaagaacuuaa

SEQ ID NO: 3729191 - RNA, 20 nt, Salmonella enterica enterica serovar Typhi Ty2
agcacaauaacgaccccaau

SEQ ID NO: 3729192 - RNA, 16 nt, Salmonella enterica enterica serovar Typhi Ty2
agcacaccauuucaca

SEQ ID NO: 3729193 - RNA, 12 nt, Salmonella enterica enterica serovar Typhi Ty2
agcacacgcauc

SEQ ID NO: 3729194 - RNA, 16 nt, Salmonella enterica enterica serovar Typhi Ty2
agcacagcccaguaau

SEQ ID NO: 3729195 - RNA, 13 nt, Salmonella enterica enterica serovar Typhi Ty2
agcacagcccuac

SEQ ID NO: 3729196 - RNA, 17 nt, Salmonella enterica enterica serovar Typhi Ty2
agcacagcucuaauuga

SEQ ID NO: 3729197 - RNA, 18 nt, Salmonella enterica enterica serovar Typhi Ty2
agcacauagaagcucaug

SEQ ID NO: 3729198 - RNA, 18 nt, Salmonella enterica enterica serovar Typhi Ty2
agcacaucagcaaaugaa

SEQ ID NO: 3729199 - RNA, 22 nt, Salmonella enterica enterica serovar Typhi Ty2
agcacaucagccguaucuuccg

SEQ ID NO: 3729200 - RNA, 14 nt, Salmonella enterica enterica serovar Typhi Ty2
agcacauccucaau

SEQ ID NO: 3729201 - RNA, 22 nt, Salmonella enterica enterica serovar Typhi Ty2
agcacauuacaggcaucuucca

SEQ ID NO: 3729202 - RNA, 15 nt, Salmonella enterica enterica serovar Typhi Ty2
agcacauucagcagc

SEQ ID NO: 3729203 - RNA, 12 nt, Salmonella enterica enterica serovar Typhi Ty2
agcaccaccugc

SEQ ID NO: 3729204 - RNA, 10 nt, Salmonella enterica enterica serovar Typhi Ty2
agcaccacgc

SEQ ID NO: 3729205 - RNA, 15 nt, Salmonella enterica enterica serovar Typhi Ty2
agcaccacgcccgga

SEQ ID NO: 3729206 - RNA, 13 nt, Salmonella enterica enterica serovar Typhi Ty2
agcaccagcagcg

SEQ ID NO: 3729207 - RNA, 13 nt, Salmonella enterica enterica serovar Typhi Ty2
agcaccagcaggu

SEQ ID NO: 3729208 - RNA, 15 nt, Salmonella enterica enterica serovar Typhi Ty2
agcaccagcaggugg

SEQ ID NO: 3729209 - RNA, 12 nt, Salmonella enterica enterica serovar Typhi Ty2
agcaccagcagu

SEQ ID NO: 3729210 - RNA, 12 nt, Salmonella enterica enterica serovar Typhi Ty2
agcaccagcauu

SEQ ID NO: 3729211 - RNA, 14 nt, Salmonella enterica enterica serovar Typhi Ty2
agcaccaggccaac

SEQ ID NO: 3729212 - RNA, 15 nt, Salmonella enterica enterica serovar Typhi Ty2
agcacccaccaucac

SEQ ID NO: 3729213 - RNA, 20 nt, Salmonella enterica enterica serovar Typhi Ty2
agcacccaccaucacuucca

SEQ ID NO: 3729214 - RNA, 13 nt, Salmonella enterica enterica serovar Typhi Ty2
agcacccaggcac

SEQ ID NO: 3729215 - RNA, 18 nt, Salmonella enterica enterica serovar Typhi Ty2
agcaccgauccaauauua

SEQ ID NO: 3729216 - RNA, 20 nt, Salmonella enterica enterica serovar Typhi Ty2
agcaccggaacagaagccug

SEQ ID NO: 3729217 - RNA, 18 nt, Salmonella enterica enterica serovar Typhi Ty2
agcaccucaauaugaaau

SEQ ID NO: 3729218 - RNA, 21 nt, Salmonella enterica enterica serovar Typhi Ty2
agcaccucgguauguccugcc

SEQ ID NO: 3729219 - RNA, 16 nt, Salmonella enterica enterica serovar Typhi Ty2
agcaccuuauccggcc

SEQ ID NO: 3729220 - RNA, 17 nt, Salmonella enterica enterica serovar Typhi Ty2
agcaccuuauccggccu

SEQ ID NO: 3729221 - RNA, 22 nt, Salmonella enterica enterica serovar Typhi Ty2
agcaccuuugaacgucgcugau

SEQ ID NO: 3729222 - RNA, 17 nt, Salmonella enterica enterica serovar Typhi Ty2
agcacgauauccagcac

SEQ ID NO: 3729223 - RNA, 13 nt, Salmonella enterica enterica serovar Typhi Ty2
agcacgcccgguc

SEQ ID NO: 3729224 - RNA, 16 nt, Salmonella enterica enterica serovar Typhi Ty2
agcacgcgcugcgccg

SEQ ID NO: 3729225 - RNA, 21 nt, Salmonella enterica enterica serovar Typhi Ty2
agcacgcggaagaaauagaac

SEQ ID NO: 3729226 - RNA, 17 nt, Salmonella enterica enterica serovar Typhi Ty2
agcacgcuuacccagca

SEQ ID NO: 3729227 - RNA, 17 nt, Salmonella enterica enterica serovar Typhi Ty2
agcacgguaaaccucuu

SEQ ID NO: 3729228 - RNA, 18 nt, Salmonella enterica enterica serovar Typhi Ty2
agcacgguaacuucgcgg

SEQ ID NO: 3729229 - RNA, 14 nt, Salmonella enterica enterica serovar Typhi Ty2
agcacguaggccug

SEQ ID NO: 3729230 - RNA, 15 nt, Salmonella enterica enterica serovar Typhi Ty2
agcacgugcauggga

SEQ ID NO: 3729231 - RNA, 14 nt, Salmonella enterica enterica serovar Typhi Ty2
agcacuaacagcag

SEQ ID NO: 3729232 - RNA, 21 nt, Salmonella enterica enterica serovar Typhi Ty2
agcacuaacagcagcagcaaa

SEQ ID NO: 3729233 - RNA, 21 nt, Salmonella enterica enterica serovar Typhi Ty2
agcacuacggauggcccugcc

SEQ ID NO: 3729234 - RNA, 18 nt, Salmonella enterica enterica serovar Typhi Ty2
agcacuacggcaaacaca

SEQ ID NO: 3729235 - RNA, 15 nt, Salmonella enterica enterica serovar Typhi Ty2
agcacugcccaggac

SEQ ID NO: 3729236 - RNA, 19 nt, Salmonella enterica enterica serovar Typhi Ty2
agcacugcuuaaauuuuuu

SEQ ID NO: 3729237 - RNA, 17 nt, Salmonella enterica enterica serovar Typhi Ty2
agcacuguagcggcugc

SEQ ID NO: 3729238 - RNA, 23 nt, Salmonella enterica enterica serovar Typhi Ty2
agcacugucccagggccaaacug

SEQ ID NO: 3729239 - RNA, 16 nt, Salmonella enterica enterica serovar Typhi Ty2
agcacuuccggaucgc

SEQ ID NO: 3729240 - RNA, 22 nt, Salmonella enterica enterica serovar Typhi Ty2
agcacuuccggaucgcuaucuu

SEQ ID NO: 3729241 - RNA, 13 nt, Salmonella enterica enterica serovar Typhi Ty2
agcacuucuccac

SEQ ID NO: 3729242 - RNA, 18 nt, Salmonella enterica enterica serovar Typhi Ty2
agcagaaagcaacagcaa

SEQ ID NO: 3729243 - RNA, 21 nt, Salmonella enterica enterica serovar Typhi Ty2
agcagaacuggcgcgaugacu

SEQ ID NO: 3729244 - RNA, 22 nt, Salmonella enterica enterica serovar Typhi Ty2
agcagaauauugcugauaauca

SEQ ID NO: 3729245 - RNA, 13 nt, Salmonella enterica enterica serovar Typhi Ty2
agcagacagguga

SEQ ID NO: 3729246 - RNA, 13 nt, Salmonella enterica enterica serovar Typhi Ty2
agcagacgagaaa

SEQ ID NO: 3729247 - RNA, 22 nt, Salmonella enterica enterica serovar Typhi Ty2
agcagacguuuaagcaugguga

SEQ ID NO: 3729248 - RNA, 13 nt, Salmonella enterica enterica serovar Typhi Ty2
agcagacuguaaa

SEQ ID NO: 3729249 - RNA, 15 nt, Salmonella enterica enterica serovar Typhi Ty2
agcagagccggaacc

SEQ ID NO: 3729250 - RNA, 22 nt, Salmonella enterica enterica serovar Typhi Ty2
agcagauaagcgacucuguauu

SEQ ID NO: 3729251 - RNA, 20 nt, Salmonella enterica enterica serovar Typhi Ty2
agcagauaccagccuucgga

SEQ ID NO: 3729252 - RNA, 20 nt, Salmonella enterica enterica serovar Typhi Ty2
agcagauaccgaccgugaga

SEQ ID NO: 3729253 - RNA, 15 nt, Salmonella enterica enterica serovar Typhi Ty2
agcagauagcccgcc

SEQ ID NO: 3729254 - RNA, 16 nt, Salmonella enterica enterica serovar Typhi Ty2
agcagaugaacggcaa

SEQ ID NO: 3729255 - RNA, 20 nt, Salmonella enterica enterica serovar Typhi Ty2
agcagauuuuucgccaggua

SEQ ID NO: 3729256 - RNA, 22 nt, Salmonella enterica enterica serovar Typhi Ty2
agcagcaaaccgauaaucacca

SEQ ID NO: 3729257 - RNA, 15 nt, Salmonella enterica enterica serovar Typhi Ty2
agcagcaacccugcc

SEQ ID NO: 3729258 - RNA, 15 nt, Salmonella enterica enterica serovar Typhi Ty2
agcagcagagccgga

SEQ ID NO: 3729259 - RNA, 15 nt, Salmonella enterica enterica serovar Typhi Ty2
agcagcagauaagcg

SEQ ID NO: 3729260 - RNA, 16 nt, Salmonella enterica enterica serovar Typhi Ty2
agcagcaggcuggaga

SEQ ID NO: 3729261 - RNA, 16 nt, Salmonella enterica enterica serovar Typhi Ty2
agcagcauaaaaccgc

SEQ ID NO: 3729262 - RNA, 20 nt, Salmonella enterica enterica serovar Typhi Ty2
agcagcauacgacaucgcca

SEQ ID NO: 3729263 - RNA, 16 nt, Salmonella enterica enterica serovar Typhi Ty2
agcagcaucccggcaa

SEQ ID NO: 3729264 - RNA, 15 nt, Salmonella enterica enterica serovar Typhi Ty2
agcagccagaaaaag

SEQ ID NO: 3729265 - RNA, 21 nt, Salmonella enterica enterica serovar Typhi Ty2
agcagccaguuauuaaucaag

SEQ ID NO: 3729266 - RNA, 17 nt, Salmonella enterica enterica serovar Typhi Ty2
agcagcgaugacagcag

SEQ ID NO: 3729267 - RNA, 15 nt, Salmonella enterica enterica serovar Typhi Ty2
agcagcgcaccugcc

SEQ ID NO: 3729268 - RNA, 14 nt, Salmonella enterica enterica serovar Typhi Ty2
agcagcgcaucaug

SEQ ID NO: 3729269 - RNA, 17 nt, Salmonella enterica enterica serovar Typhi Ty2
agcagcgcaucaugguc

SEQ ID NO: 3729270 - RNA, 16 nt, Salmonella enterica enterica serovar Typhi Ty2
agcagcucaacggcag

SEQ ID NO: 3729271 - RNA, 13 nt, Salmonella enterica enterica serovar Typhi Ty2
agcagcugcugua

SEQ ID NO: 3729272 - RNA, 20 nt, Salmonella enterica enterica serovar Typhi Ty2
agcagcugcuuaacuucugc

SEQ ID NO: 3729273 - RNA, 13 nt, Salmonella enterica enterica serovar Typhi Ty2
agcagcuucagca

SEQ ID NO: 3729274 - RNA, 14 nt, Salmonella enterica enterica serovar Typhi Ty2
agcagcuucaugca

SEQ ID NO: 3729275 - RNA, 15 nt, Salmonella enterica enterica serovar Typhi Ty2
agcagcuuggcggcu

SEQ ID NO: 3729276 - RNA, 15 nt, Salmonella enterica enterica serovar Typhi Ty2
agcaggaacggcagg

SEQ ID NO: 3729277 - RNA, 21 nt, Salmonella enterica enterica serovar Typhi Ty2
acugauggaguuucaucagca

SEQ ID NO: 3729278 - RNA, 22 nt, Salmonella enterica enterica serovar Typhi Ty2
acugauggaguuucaucagcac

SEQ ID NO: 3729279 - RNA, 13 nt, Salmonella enterica enterica serovar Typhi Ty2
acugauggcuggc

SEQ ID NO: 3729280 - RNA, 22 nt, Salmonella enterica enterica serovar Typhi Ty2
acugauggcuggcgucgccaaa

SEQ ID NO: 3729281 - RNA, 15 nt, Salmonella enterica enterica serovar Typhi Ty2
acugauuaauugcga

SEQ ID NO: 3729282 - RNA, 18 nt, Salmonella enterica enterica serovar Typhi Ty2
acugauuaauugcgacaa

SEQ ID NO: 3729283 - RNA, 21 nt, Salmonella enterica enterica serovar Typhi Ty2
acugauucaaaaggugagaaa

SEQ ID NO: 3729284 - RNA, 13 nt, Salmonella enterica enterica serovar Typhi Ty2
acugcaaauacca

SEQ ID NO: 3729285 - RNA, 16 nt, Salmonella enterica enterica serovar Typhi Ty2
acugcaaauaccacau

SEQ ID NO: 3729286 - RNA, 13 nt, Salmonella enterica enterica serovar Typhi Ty2
acugcaacugcgc

SEQ ID NO: 3729287 - RNA, 15 nt, Salmonella enterica enterica serovar Typhi Ty2
acugcacgccagggu

SEQ ID NO: 3729288 - RNA, 13 nt, Salmonella enterica enterica serovar Typhi Ty2
acugcacuuccug

SEQ ID NO: 3729289 - RNA, 22 nt, Salmonella enterica enterica serovar Typhi Ty2
acugcacuuccugcgucaggcu

SEQ ID NO: 3729290 - RNA, 13 nt, Salmonella enterica enterica serovar Typhi Ty2
acugcagcgcguc

SEQ ID NO: 3729291 - RNA, 14 nt, Salmonella enterica enterica serovar Typhi Ty2
acugcauaucgccg

SEQ ID NO: 3729292 - RNA, 13 nt, Salmonella enterica enterica serovar Typhi Ty2
acugccaaaccac

SEQ ID NO: 3729293 - RNA, 15 nt, Salmonella enterica enterica serovar Typhi Ty2
acugccagaccggcg

SEQ ID NO: 3729294 - RNA, 23 nt, Salmonella enterica enterica serovar Typhi Ty2
acugcccaaauaaaagccgccgu

SEQ ID NO: 3729295 - RNA, 13 nt, Salmonella enterica enterica serovar Typhi Ty2
acugcccggcaua

SEQ ID NO: 3729296 - RNA, 15 nt, Salmonella enterica enterica serovar Typhi Ty2
acugccgcagccgcu

SEQ ID NO: 3729297 - RNA, 21 nt, Salmonella enterica enterica serovar Typhi Ty2
acugccgcagccgcucagggu

SEQ ID NO: 3729298 - RNA, 15 nt, Salmonella enterica enterica serovar Typhi Ty2
acugccgcccaucgc

SEQ ID NO: 3729299 - RNA, 21 nt, Salmonella enterica enterica serovar Typhi Ty2
acugccgcccaucgccacagc

SEQ ID NO: 3729300 - RNA, 16 nt, Salmonella enterica enterica serovar Typhi Ty2
acugccguauccaggg

SEQ ID NO: 3729301 - RNA, 22 nt, Salmonella enterica enterica serovar Typhi Ty2
acugccuaaauugacgcugccu

SEQ ID NO: 3729302 - RNA, 20 nt, Salmonella enterica enterica serovar Typhi Ty2
acugcgaaaucaccgacagg

SEQ ID NO: 3729303 - RNA, 22 nt, Salmonella enterica enterica serovar Typhi Ty2
acugcgaacgcaucaaagccac

SEQ ID NO: 3729304 - RNA, 13 nt, Salmonella enterica enterica serovar Typhi Ty2
acugcgaauuucc

SEQ ID NO: 3729305 - RNA, 22 nt, Salmonella enterica enterica serovar Typhi Ty2
acugcgaauuuccugccagacc

SEQ ID NO: 3729306 - RNA, 15 nt, Salmonella enterica enterica serovar Typhi Ty2
acugcgccagccugc

SEQ ID NO: 3729307 - RNA, 16 nt, Salmonella enterica enterica serovar Typhi Ty2
acugcgccauuaacgc

SEQ ID NO: 3729308 - RNA, 12 nt, Salmonella enterica enterica serovar Typhi Ty2
acugcgcccgca

SEQ ID NO: 3729309 - RNA, 20 nt, Salmonella enterica enterica serovar Typhi Ty2
acugcgcccgcucugcgcca

SEQ ID NO: 3729310 - RNA, 18 nt, Salmonella enterica enterica serovar Typhi Ty2
acugcgccgccagcgaca

SEQ ID NO: 3729311 - RNA, 12 nt, Salmonella enterica enterica serovar Typhi Ty2
acugcgccugcu

SEQ ID NO: 3729312 - RNA, 19 nt, Salmonella enterica enterica serovar Typhi Ty2
acugcggagguuucuuuuu

SEQ ID NO: 3729313 - RNA, 17 nt, Salmonella enterica enterica serovar Typhi Ty2
acugcggccugcaaaga

SEQ ID NO: 3729314 - RNA, 16 nt, Salmonella enterica enterica serovar Typhi Ty2
acugcggcuuacccug

SEQ ID NO: 3729315 - RNA, 21 nt, Salmonella enterica enterica serovar Typhi Ty2
acugcggucguauuuaccgcu

SEQ ID NO: 3729316 - RNA, 16 nt, Salmonella enterica enterica serovar Typhi Ty2
acugcguaaucuuuuc

SEQ ID NO: 3729317 - RNA, 17 nt, Salmonella enterica enterica serovar Typhi Ty2
acugcuaaggagauaac

SEQ ID NO: 3729318 - RNA, 22 nt, Salmonella enterica enterica serovar Typhi Ty2
acugcucuaccaacugagcuaa

SEQ ID NO: 3729319 - RNA, 18 nt, Salmonella enterica enterica serovar Typhi Ty2
acugcugacaaucagcac

SEQ ID NO: 3729320 - RNA, 22 nt, Salmonella enterica enterica serovar Typhi Ty2
acugcugccgcagcacccgcuc

SEQ ID NO: 3729321 - RNA, 13 nt, Salmonella enterica enterica serovar Typhi Ty2
acugcugcgcgug

SEQ ID NO: 3729322 - RNA, 18 nt, Salmonella enterica enterica serovar Typhi Ty2
acugcugcgcuuuaucaa

SEQ ID NO: 3729323 - RNA, 10 nt, Salmonella enterica enterica serovar Typhi Ty2
acugcugcuc

SEQ ID NO: 3729324 - RNA, 22 nt, Salmonella enterica enterica serovar Typhi Ty2
acugcuggcgcgucacaacagc

SEQ ID NO: 3729325 - RNA, 23 nt, Salmonella enterica enterica serovar Typhi Ty2
acugcuuaaauuuuuugccgcuc

SEQ ID NO: 3729326 - RNA, 18 nt, Salmonella enterica enterica serovar Typhi Ty2
acugcuuagcucaucagc

SEQ ID NO: 3729327 - RNA, 14 nt, Salmonella enterica enterica serovar Typhi Ty2
acugcuuuaauacc

SEQ ID NO: 3729328 - RNA, 14 nt, Salmonella enterica enterica serovar Typhi Ty2
acugcuuugaucac

SEQ ID NO: 3729329 - RNA, 23 nt, Salmonella enterica enterica serovar Typhi Ty2
acugcuuuuccggcagcgcauaa

SEQ ID NO: 3729330 - RNA, 15 nt, Salmonella enterica enterica serovar Typhi Ty2
acuggaauucguuac

SEQ ID NO: 3729331 - RNA, 20 nt, Salmonella enterica enterica serovar Typhi Ty2
acuggaucaccugaaugcaa

SEQ ID NO: 3729332 - RNA, 15 nt, Salmonella enterica enterica serovar Typhi Ty2
acuggaucacuuuug

SEQ ID NO: 3729333 - RNA, 16 nt, Salmonella enterica enterica serovar Typhi Ty2
acuggaucgguugcag

SEQ ID NO: 3729334 - RNA, 16 nt, Salmonella enterica enterica serovar Typhi Ty2
acuggauggacuguuu

SEQ ID NO: 3729335 - RNA, 14 nt, Salmonella enterica enterica serovar Typhi Ty2
acuggcaaauaaaa

SEQ ID NO: 3729336 - RNA, 22 nt, Salmonella enterica enterica serovar Typhi Ty2
acuggcaaccagauaauucagg

SEQ ID NO: 3729337 - RNA, 22 nt, Salmonella enterica enterica serovar Typhi Ty2
acuggcagccucguccugcaau

SEQ ID NO: 3729338 - RNA, 15 nt, Salmonella enterica enterica serovar Typhi Ty2
acuggcauaccggug

SEQ ID NO: 3729339 - RNA, 16 nt, Salmonella enterica enterica serovar Typhi Ty2
acuggcccugccggaa

SEQ ID NO: 3729340 - RNA, 21 nt, Salmonella enterica enterica serovar Typhi Ty2
acuggccguuuucccggcaau

SEQ ID NO: 3729341 - RNA, 12 nt, Salmonella enterica enterica serovar Typhi Ty2
acuggccuccca

SEQ ID NO: 3729342 - RNA, 17 nt, Salmonella enterica enterica serovar Typhi Ty2
acuggcgacagccgcgu

SEQ ID NO: 3729343 - RNA, 14 nt, Salmonella enterica enterica serovar Typhi Ty2
acuggcgaccggca

SEQ ID NO: 3729344 - RNA, 15 nt, Salmonella enterica enterica serovar Typhi Ty2
acuggcgauuuucau

SEQ ID NO: 3729345 - RNA, 22 nt, Salmonella enterica enterica serovar Typhi Ty2
acuggcggugcggucacaggca

SEQ ID NO: 3729346 - RNA, 14 nt, Salmonella enterica enterica serovar Typhi Ty2
acuggcuaucgccg

SEQ ID NO: 3729347 - RNA, 22 nt, Salmonella enterica enterica serovar Typhi Ty2
acuggcugugcgugacccacag

SEQ ID NO: 3729348 - RNA, 15 nt, Salmonella enterica enterica serovar Typhi Ty2
acuggcuuuccugau

SEQ ID NO: 3729349 - RNA, 18 nt, Salmonella enterica enterica serovar Typhi Ty2
acuggcuuuccugaucaa

SEQ ID NO: 3729350 - RNA, 21 nt, Salmonella enterica enterica serovar Typhi Ty2
acuggcuuuccugaucaauca

SEQ ID NO: 3729351 - RNA, 19 nt, Salmonella enterica enterica serovar Typhi Ty2
acugggcgcaugaggccug

SEQ ID NO: 3729352 - RNA, 16 nt, Salmonella enterica enterica serovar Typhi Ty2
acuggguaugcagugg

SEQ ID NO: 3729353 - RNA, 16 nt, Salmonella enterica enterica serovar Typhi Ty2
acugguaaaccgugcg

SEQ ID NO: 3729354 - RNA, 23 nt, Salmonella enterica enterica serovar Typhi Ty2
acugguaaccuguuccucacuga

SEQ ID NO: 3729355 - RNA, 21 nt, Salmonella enterica enterica serovar Typhi Ty2
acugguaaugucauccagcga

SEQ ID NO: 3729356 - RNA, 19 nt, Salmonella enterica enterica serovar Typhi Ty2
acuggugcccgcaaaaccu

SEQ ID NO: 3729357 - RNA, 20 nt, Salmonella enterica enterica serovar Typhi Ty2
acuggugcccgcaaaaccuu

SEQ ID NO: 3729358 - RNA, 23 nt, Salmonella enterica enterica serovar Typhi Ty2
acugguggaauaaauauaagauc

SEQ ID NO: 3729359 - RNA, 12 nt, Salmonella enterica enterica serovar Typhi Ty2
acuucuaauuuu

SEQ ID NO: 3729360 - RNA, 18 nt, Salmonella enterica enterica serovar Typhi Ty2
acuucugacccaaucaga

SEQ ID NO: 3729361 - RNA, 10 nt, Salmonella enterica enterica serovar Typhi Ty2
acuucuucca

SEQ ID NO: 3729362 - RNA, 21 nt, Salmonella enterica enterica serovar Typhi Ty2
acuucuugguaccaaacagca

SEQ ID NO: 3729363 - RNA, 22 nt, Salmonella enterica enterica serovar Typhi Ty2
acuucuugguaccaaacagcag

SEQ ID NO: 3729364 - RNA, 16 nt, Salmonella enterica enterica serovar Typhi Ty2
acuugaagccuuucug

SEQ ID NO: 3729365 - RNA, 17 nt, Salmonella enterica enterica serovar Typhi Ty2
acuugacgcuuugcauu

SEQ ID NO: 3729366 - RNA, 20 nt, Salmonella enterica enterica serovar Typhi Ty2
acuugagaaauuauuuuaaa

SEQ ID NO: 3729367 - RNA, 22 nt, Salmonella enterica enterica serovar Typhi Ty2
acuugccguuuuucucaucaag

SEQ ID NO: 3729368 - RNA, 20 nt, Salmonella enterica enterica serovar Typhi Ty2
acuuguucaauauuccuggc

SEQ ID NO: 3729369 - RNA, 13 nt, Salmonella enterica enterica serovar Typhi Ty2
acuuguucuucug

SEQ ID NO: 3729370 - RNA, 22 nt, Salmonella enterica enterica serovar Typhi Ty2
acuuuaaagcccagcacggcaa

SEQ ID NO: 3729371 - RNA, 21 nt, Salmonella enterica enterica serovar Typhi Ty2
acuuuacccacaucaaucacc

SEQ ID NO: 3729372 - RNA, 13 nt, Salmonella enterica enterica serovar Typhi Ty2
acuuuacugaaua

SEQ ID NO: 3729373 - RNA, 18 nt, Salmonella enterica enterica serovar Typhi Ty2
acuuuauuuuucgccaga

SEQ ID NO: 3729374 - RNA, 12 nt, Salmonella enterica enterica serovar Typhi Ty2
acuuucagauuu

SEQ ID NO: 3729375 - RNA, 17 nt, Salmonella enterica enterica serovar Typhi Ty2
acuuucagauuuuuaau

SEQ ID NO: 3729376 - RNA, 15 nt, Salmonella enterica enterica serovar Typhi Ty2
acuuucauuccuuua

SEQ ID NO: 3729377 - RNA, 19 nt, Salmonella enterica enterica serovar Typhi Ty2
acuuucauuucacuuguuc

SEQ ID NO: 3729378 - RNA, 20 nt, Salmonella enterica enterica serovar Typhi Ty2
acuuucauuucacuuguucu

SEQ ID NO: 3729379 - RNA, 17 nt, Salmonella enterica enterica serovar Typhi Ty2
acuuuccaaaauccagg

SEQ ID NO: 3729380 - RNA, 23 nt, Salmonella enterica enterica serovar Typhi Ty2
acuuuccauauacucuuuguggg

SEQ ID NO: 3729381 - RNA, 19 nt, Salmonella enterica enterica serovar Typhi Ty2
acuuuccuggcugucggca

SEQ ID NO: 3729382 - RNA, 17 nt, Salmonella enterica enterica serovar Typhi Ty2
acuuuccugguaaucga

SEQ ID NO: 3729383 - RNA, 23 nt, Salmonella enterica enterica serovar Typhi Ty2
acuuucgcccggcgccagcucaa

SEQ ID NO: 3729384 - RNA, 13 nt, Salmonella enterica enterica serovar Typhi Ty2
acuuucuacaaau

SEQ ID NO: 3729385 - RNA, 18 nt, Salmonella enterica enterica serovar Typhi Ty2
acuuucugcuuuggccgg

SEQ ID NO: 3729386 - RNA, 21 nt, Salmonella enterica enterica serovar Typhi Ty2
acuuucuuuugauacucugcu

SEQ ID NO: 3729387 - RNA, 19 nt, Salmonella enterica enterica serovar Typhi Ty2
acuuugcccuuuuugcauu

SEQ ID NO: 3729388 - RNA, 20 nt, Salmonella enterica enterica serovar Typhi Ty2
acuuugcccuuuuugcauuc

SEQ ID NO: 3729389 - RNA, 16 nt, Salmonella enterica enterica serovar Typhi Ty2
acuuugcgcuccugcu

SEQ ID NO: 3729390 - RNA, 18 nt, Salmonella enterica enterica serovar Typhi Ty2
acuuugcucuccuuaaaa

SEQ ID NO: 3729391 - RNA, 18 nt, Salmonella enterica enterica serovar Typhi Ty2
acuuuuacccuucagaua

SEQ ID NO: 3729392 - RNA, 18 nt, Salmonella enterica enterica serovar Typhi Ty2
acuuuucuuuccugcaaa

SEQ ID NO: 3729393 - RNA, 15 nt, Salmonella enterica enterica serovar Typhi Ty2
acuuuugcaaucgca

SEQ ID NO: 3729394 - RNA, 20 nt, Salmonella enterica enterica serovar Typhi Ty2
acuuuuguagagauccagaa

SEQ ID NO: 3729395 - RNA, 22 nt, Salmonella enterica enterica serovar Typhi Ty2
acuuuuuggcuguugguaugca

SEQ ID NO: 3729396 - RNA, 18 nt, Salmonella enterica enterica serovar Typhi Ty2
agaaaaaacucaggaaau

SEQ ID NO: 3729397 - RNA, 15 nt, Salmonella enterica enterica serovar Typhi Ty2
agaaaaaacuggugc

SEQ ID NO: 3729398 - RNA, 15 nt, Salmonella enterica enterica serovar Typhi Ty2
agaaaaaauuaaaaa

SEQ ID NO: 3729399 - RNA, 17 nt, Salmonella enterica enterica serovar Typhi Ty2
agaaaaacaucauggcu

SEQ ID NO: 3729400 - RNA, 18 nt, Salmonella enterica enterica serovar Typhi Ty2
agaaaaaccuccggcuau

SEQ ID NO: 3729401 - RNA, 12 nt, Salmonella enterica enterica serovar Typhi Ty2
agaaaaacgcgc

SEQ ID NO: 3729402 - RNA, 18 nt, Salmonella enterica enterica serovar Typhi Ty2
agaaaaacgcgcaaaacu

SEQ ID NO: 3729403 - RNA, 20 nt, Salmonella enterica enterica serovar Typhi Ty2
agaaaaagguaacuauuucu

SEQ ID NO: 3729404 - RNA, 13 nt, Salmonella enterica enterica serovar Typhi Ty2
agaaaaaguagaa

SEQ ID NO: 3729405 - RNA, 23 nt, Salmonella enterica enterica serovar Typhi Ty2
agaaaaaucagucauuugcaggu

SEQ ID NO: 3729406 - RNA, 16 nt, Salmonella enterica enterica serovar Typhi Ty2
agaaaaccccguacag

SEQ ID NO: 3729407 - RNA, 18 nt, Salmonella enterica enterica serovar Typhi Ty2
agaaaaccgacagcaaua

SEQ ID NO: 3729408 - RNA, 19 nt, Salmonella enterica enterica serovar Typhi Ty2
agaaaaccuuugcugacgc

SEQ ID NO: 3729409 - RNA, 19 nt, Salmonella enterica enterica serovar Typhi Ty2
agaaaaggaagaauaaaua

SEQ ID NO: 3729410 - RNA, 12 nt, Salmonella enterica enterica serovar Typhi Ty2
agaaaauaacaa

SEQ ID NO: 3729411 - RNA, 21 nt, Salmonella enterica enterica serovar Typhi Ty2
agaaaauaacaauauuaaaua

SEQ ID NO: 3729412 - RNA, 19 nt, Salmonella enterica enterica serovar Typhi Ty2
agaaaauagaggaaauaac

SEQ ID NO: 3729413 - RNA, 22 nt, Salmonella enterica enterica serovar Typhi Ty2
agaaaauauauuggccuuaugc

SEQ ID NO: 3729414 - RNA, 16 nt, Salmonella enterica enterica serovar Typhi Ty2
agaaaaucagugaaca

SEQ ID NO: 3729415 - RNA, 19 nt, Salmonella enterica enterica serovar Typhi Ty2
agaaaaugacgggcgaucg

SEQ ID NO: 3729416 - RNA, 13 nt, Salmonella enterica enterica serovar Typhi Ty2
agaaaaugcgcug

SEQ ID NO: 3729417 - RNA, 23 nt, Salmonella enterica enterica serovar Typhi Ty2
agaaaaugcgcugggaaucgcga

SEQ ID NO: 3729418 - RNA, 17 nt, Salmonella enterica enterica serovar Typhi Ty2
agaaaauggucugccag

SEQ ID NO: 3729419 - RNA, 20 nt, Salmonella enterica enterica serovar Typhi Ty2
agaaaauuaacgacaaaaau

SEQ ID NO: 3729420 - RNA, 17 nt, Salmonella enterica enterica serovar Typhi Ty2
agaaaauuauuuuaaau

SEQ ID NO: 3729421 - RNA, 19 nt, Salmonella enterica enterica serovar Typhi Ty2
agaaacaacaccguaaaag

SEQ ID NO: 3729422 - RNA, 18 nt, Salmonella enterica enterica serovar Typhi Ty2
agaaacaauccguuauuu

SEQ ID NO: 3729423 - RNA, 14 nt, Salmonella enterica enterica serovar Typhi Ty2
agaaacaccagaau

SEQ ID NO: 3729424 - RNA, 11 nt, Salmonella enterica enterica serovar Typhi Ty2
agaaacaucau

SEQ ID NO: 3729425 - RNA, 20 nt, Salmonella enterica enterica serovar Typhi Ty2
agaaaccauaaacaaaacaa

SEQ ID NO: 3729426 - RNA, 17 nt, Salmonella enterica enterica serovar Typhi Ty2
agaaaccgcagaaaaag

SEQ ID NO: 3729427 - RNA, 19 nt, Salmonella enterica enterica serovar Typhi Ty2
agaaaccgcucgccgccuc

SEQ ID NO: 3729428 - RNA, 14 nt, Salmonella enterica enterica serovar Typhi Ty2
agaaacgcugaucu

SEQ ID NO: 3729429 - RNA, 18 nt, Salmonella enterica enterica serovar Typhi Ty2
agaaacggaaaucacgca

SEQ ID NO: 3729430 - RNA, 14 nt, Salmonella enterica enterica serovar Typhi Ty2
agaaacugcuguag

SEQ ID NO: 3729431 - RNA, 22 nt, Salmonella enterica enterica serovar Typhi Ty2
agaaagauaaaauacgugcgga

SEQ ID NO: 3729432 - RNA, 17 nt, Salmonella enterica enterica serovar Typhi Ty2
agaaagcauuaaaucau

SEQ ID NO: 3729433 - RNA, 16 nt, Salmonella enterica enterica serovar Typhi Ty2
agaaagcgaauggcgu

SEQ ID NO: 3729434 - RNA, 23 nt, Salmonella enterica enterica serovar Typhi Ty2
agaaagcuacguuugaacagcag

SEQ ID NO: 3729435 - RNA, 15 nt, Salmonella enterica enterica serovar Typhi Ty2
agaaagggagaauac

SEQ ID NO: 3729436 - RNA, 18 nt, Salmonella enterica enterica serovar Typhi Ty2
agaaaggggagggcaaca

SEQ ID NO: 3729437 - RNA, 17 nt, Salmonella enterica enterica serovar Typhi Ty2
agaaaguggcauaucau

SEQ ID NO: 3729438 - RNA, 14 nt, Salmonella enterica enterica serovar Typhi Ty2
agaaauaaaaccag

SEQ ID NO: 3729439 - RNA, 22 nt, Salmonella enterica enterica serovar Typhi Ty2
agaaauaaaauacgcucaauau

SEQ ID NO: 3729440 - RNA, 20 nt, Salmonella enterica enterica serovar Typhi Ty2
agaaauagaacagcuggugc

SEQ ID NO: 3729441 - RNA, 17 nt, Salmonella enterica enterica serovar Typhi Ty2
accaauggcgcgucuua

SEQ ID NO: 3729442 - RNA, 19 nt, Salmonella enterica enterica serovar Typhi Ty2
accaauggcgcgucuuaaa

SEQ ID NO: 3729443 - RNA, 13 nt, Salmonella enterica enterica serovar Typhi Ty2
accaaugugcaaa

SEQ ID NO: 3729444 - RNA, 15 nt, Salmonella enterica enterica serovar Typhi Ty2
accaaugugcaaaga

SEQ ID NO: 3729445 - RNA, 22 nt, Salmonella enterica enterica serovar Typhi Ty2
accacaaacgccgucacaaagc

SEQ ID NO: 3729446 - RNA, 18 nt, Salmonella enterica enterica serovar Typhi Ty2
accacaaagcgguaaauc

SEQ ID NO: 3729447 - RNA, 15 nt, Salmonella enterica enterica serovar Typhi Ty2
accacaaaggcgcgu

SEQ ID NO: 3729448 - RNA, 16 nt, Salmonella enterica enterica serovar Typhi Ty2
accacaaaggcgcgua

SEQ ID NO: 3729449 - RNA, 21 nt, Salmonella enterica enterica serovar Typhi Ty2
accacaaguuuauccagcacg

SEQ ID NO: 3729450 - RNA, 18 nt, Salmonella enterica enterica serovar Typhi Ty2
accacaccugaugguuau

SEQ ID NO: 3729451 - RNA, 21 nt, Salmonella enterica enterica serovar Typhi Ty2
accacacggaauccccggcuu

SEQ ID NO: 3729452 - RNA, 15 nt, Salmonella enterica enterica serovar Typhi Ty2
accacagccgugucc

SEQ ID NO: 3729453 - RNA, 21 nt, Salmonella enterica enterica serovar Typhi Ty2
accacagccuuauaagaacca

SEQ ID NO: 3729454 - RNA, 18 nt, Salmonella enterica enterica serovar Typhi Ty2
accacagucaucgcgcca

SEQ ID NO: 3729455 - RNA, 20 nt, Salmonella enterica enterica serovar Typhi Ty2
accacaguugcgacugauaa

SEQ ID NO: 3729456 - RNA, 20 nt, Salmonella enterica enterica serovar Typhi Ty2
accacaucaauagcgcuaca

SEQ ID NO: 3729457 - RNA, 15 nt, Salmonella enterica enterica serovar Typhi Ty2
accacaucagaccgc

SEQ ID NO: 3729458 - RNA, 14 nt, Salmonella enterica enterica serovar Typhi Ty2
accacauccacccc

SEQ ID NO: 3729459 - RNA, 16 nt, Salmonella enterica enterica serovar Typhi Ty2
accacaugaccagcgc

SEQ ID NO: 3729460 - RNA, 17 nt, Salmonella enterica enterica serovar Typhi Ty2
accacaugaccagcgcc

SEQ ID NO: 3729461 - RNA, 14 nt, Salmonella enterica enterica serovar Typhi Ty2
accacauuuucucg

SEQ ID NO: 3729462 - RNA, 15 nt, Salmonella enterica enterica serovar Typhi Ty2
accaccaauuucacc

SEQ ID NO: 3729463 - RNA, 12 nt, Salmonella enterica enterica serovar Typhi Ty2
accaccacgccc

SEQ ID NO: 3729464 - RNA, 17 nt, Salmonella enterica enterica serovar Typhi Ty2
accaccaggaacgccau

SEQ ID NO: 3729465 - RNA, 21 nt, Salmonella enterica enterica serovar Typhi Ty2
accaccaguaaccgccacagc

SEQ ID NO: 3729466 - RNA, 14 nt, Salmonella enterica enterica serovar Typhi Ty2
accaccaguacaug

SEQ ID NO: 3729467 - RNA, 18 nt, Salmonella enterica enterica serovar Typhi Ty2
accaccauacccaguagc

SEQ ID NO: 3729468 - RNA, 20 nt, Salmonella enterica enterica serovar Typhi Ty2
accaccauacccaguagcag

SEQ ID NO: 3729469 - RNA, 17 nt, Salmonella enterica enterica serovar Typhi Ty2
accaccccacaguaaug

SEQ ID NO: 3729470 - RNA, 17 nt, Salmonella enterica enterica serovar Typhi Ty2
accacccgggaaaaaug

SEQ ID NO: 3729471 - RNA, 22 nt, Salmonella enterica enterica serovar Typhi Ty2
accacccgggaaaaaugacgcc

SEQ ID NO: 3729472 - RNA, 14 nt, Salmonella enterica enterica serovar Typhi Ty2
accacccugaaaag

SEQ ID NO: 3729473 - RNA, 23 nt, Salmonella enterica enterica serovar Typhi Ty2
accaccgaauuccgcuaaucuuu

SEQ ID NO: 3729474 - RNA, 21 nt, Salmonella enterica enterica serovar Typhi Ty2
accaccgcgcuagugccgcca

SEQ ID NO: 3729475 - RNA, 18 nt, Salmonella enterica enterica serovar Typhi Ty2
accaccguuuaaucgccc

SEQ ID NO: 3729476 - RNA, 14 nt, Salmonella enterica enterica serovar Typhi Ty2
accaccugcuguug

SEQ ID NO: 3729477 - RNA, 13 nt, Salmonella enterica enterica serovar Typhi Ty2
accaccuguucgc

SEQ ID NO: 3729478 - RNA, 16 nt, Salmonella enterica enterica serovar Typhi Ty2
accacgaaaauuauuu

SEQ ID NO: 3729479 - RNA, 16 nt, Salmonella enterica enterica serovar Typhi Ty2
accacgacgccggaga

SEQ ID NO: 3729480 - RNA, 22 nt, Salmonella enterica enterica serovar Typhi Ty2
accacgaucuugucacaauaac

SEQ ID NO: 3729481 - RNA, 16 nt, Salmonella enterica enterica serovar Typhi Ty2
accacgcagcccguaa

SEQ ID NO: 3729482 - RNA, 17 nt, Salmonella enterica enterica serovar Typhi Ty2
accacgcauaccagcca

SEQ ID NO: 3729483 - RNA, 19 nt, Salmonella enterica enterica serovar Typhi Ty2
accacgccauggccgcagc

SEQ ID NO: 3729484 - RNA, 17 nt, Salmonella enterica enterica serovar Typhi Ty2
accacgcccgccgccag

SEQ ID NO: 3729485 - RNA, 19 nt, Salmonella enterica enterica serovar Typhi Ty2
accacgcccggaucaaaca

SEQ ID NO: 3729486 - RNA, 14 nt, Salmonella enterica enterica serovar Typhi Ty2
accacgcugccgcc

SEQ ID NO: 3729487 - RNA, 17 nt, Salmonella enterica enterica serovar Typhi Ty2
accacggccacagccau

SEQ ID NO: 3729488 - RNA, 14 nt, Salmonella enterica enterica serovar Typhi Ty2
accacggcuucagc

SEQ ID NO: 3729489 - RNA, 17 nt, Salmonella enterica enterica serovar Typhi Ty2
accacgggguuggcccu

SEQ ID NO: 3729490 - RNA, 21 nt, Salmonella enterica enterica serovar Typhi Ty2
accacgguauuaacaggcgcc

SEQ ID NO: 3729491 - RNA, 19 nt, Salmonella enterica enterica serovar Typhi Ty2
accacgguguaccccgccu

SEQ ID NO: 3729492 - RNA, 21 nt, Salmonella enterica enterica serovar Typhi Ty2
accacgguguccggguucagc

SEQ ID NO: 3729493 - RNA, 18 nt, Salmonella enterica enterica serovar Typhi Ty2
accacguaacucggcagc

SEQ ID NO: 3729494 - RNA, 15 nt, Salmonella enterica enterica serovar Typhi Ty2
accacguaaugcgcc

SEQ ID NO: 3729495 - RNA, 19 nt, Salmonella enterica enterica serovar Typhi Ty2
accacgucauccggcaagc

SEQ ID NO: 3729496 - RNA, 15 nt, Salmonella enterica enterica serovar Typhi Ty2
accacgucugaagaa

SEQ ID NO: 3729497 - RNA, 14 nt, Salmonella enterica enterica serovar Typhi Ty2
accacguuaucuuc

SEQ ID NO: 3729498 - RNA, 17 nt, Salmonella enterica enterica serovar Typhi Ty2
accacguucauuucgua

SEQ ID NO: 3729499 - RNA, 21 nt, Salmonella enterica enterica serovar Typhi Ty2
accacuccggcauaauaugca

SEQ ID NO: 3729500 - RNA, 20 nt, Salmonella enterica enterica serovar Typhi Ty2
accacuccggugcccauucc

SEQ ID NO: 3729501 - RNA, 18 nt, Salmonella enterica enterica serovar Typhi Ty2
accacugacacggaacaa

SEQ ID NO: 3729502 - RNA, 17 nt, Salmonella enterica enterica serovar Typhi Ty2
accacuucggcagaaaa

SEQ ID NO: 3729503 - RNA, 16 nt, Salmonella enterica enterica serovar Typhi Ty2
accacuuuguuuuugu

SEQ ID NO: 3729504 - RNA, 21 nt, Salmonella enterica enterica serovar Typhi Ty2
accagaaaaccgacagcaaua

SEQ ID NO: 3729505 - RNA, 16 nt, Salmonella enterica enterica serovar Typhi Ty2
accagaauaaugggga

SEQ ID NO: 3729506 - RNA, 17 nt, Salmonella enterica enterica serovar Typhi Ty2
accagaauacacuucuc

SEQ ID NO: 3729507 - RNA, 17 nt, Salmonella enterica enterica serovar Typhi Ty2
accagaaucaccgacag

SEQ ID NO: 3729508 - RNA, 22 nt, Salmonella enterica enterica serovar Typhi Ty2
accagaaucccacggagaaaag

SEQ ID NO: 3729509 - RNA, 14 nt, Salmonella enterica enterica serovar Typhi Ty2
accagaaucgccag

SEQ ID NO: 3729510 - RNA, 16 nt, Salmonella enterica enterica serovar Typhi Ty2
accagaccaacccagc

SEQ ID NO: 3729511 - RNA, 21 nt, Salmonella enterica enterica serovar Typhi Ty2
accagaccggcaucucaucuu

SEQ ID NO: 3729512 - RNA, 18 nt, Salmonella enterica enterica serovar Typhi Ty2
accagauagucaucacca

SEQ ID NO: 3729513 - RNA, 16 nt, Salmonella enterica enterica serovar Typhi Ty2
accagcaaugagacaa

SEQ ID NO: 3729514 - RNA, 14 nt, Salmonella enterica enterica serovar Typhi Ty2
accagcacaaaaaa

SEQ ID NO: 3729515 - RNA, 14 nt, Salmonella enterica enterica serovar Typhi Ty2
accagcacagccca

SEQ ID NO: 3729516 - RNA, 15 nt, Salmonella enterica enterica serovar Typhi Ty2
accagcagaugcagu

SEQ ID NO: 3729517 - RNA, 12 nt, Salmonella enterica enterica serovar Typhi Ty2
accagcagcaga

SEQ ID NO: 3729518 - RNA, 22 nt, Salmonella enterica enterica serovar Typhi Ty2
accagcagcgcggcguacacuu

SEQ ID NO: 3729519 - RNA, 21 nt, Salmonella enterica enterica serovar Typhi Ty2
accagcaggugguacaucaaa

SEQ ID NO: 3729520 - RNA, 12 nt, Salmonella enterica enterica serovar Typhi Ty2
accagcauaaua

SEQ ID NO: 3729521 - RNA, 16 nt, Salmonella enterica enterica serovar Typhi Ty2
accagcauaauauuca

SEQ ID NO: 3729522 - RNA, 22 nt, Salmonella enterica enterica serovar Typhi Ty2
accagcaucaauagcagcuuca

SEQ ID NO: 3729523 - RNA, 20 nt, Salmonella enterica enterica serovar Typhi Ty2
accaugcucagcggcggcgg

SEQ ID NO: 3729524 - RNA, 14 nt, Salmonella enterica enterica serovar Typhi Ty2
accaugcugguugg

SEQ ID NO: 3729525 - RNA, 14 nt, Salmonella enterica enterica serovar Typhi Ty2
accauuaacaucag

SEQ ID NO: 3729526 - RNA, 19 nt, Salmonella enterica enterica serovar Typhi Ty2
accauuaagacagguaacu

SEQ ID NO: 3729527 - RNA, 17 nt, Salmonella enterica enterica serovar Typhi Ty2
accauuaccauuccuca

SEQ ID NO: 3729528 - RNA, 21 nt, Salmonella enterica enterica serovar Typhi Ty2
accauuacgcccccucgcccu

SEQ ID NO: 3729529 - RNA, 16 nt, Salmonella enterica enterica serovar Typhi Ty2
accauuaucgcuccgg

SEQ ID NO: 3729530 - RNA, 23 nt, Salmonella enterica enterica serovar Typhi Ty2
accauuccgauagcgaaacugau

SEQ ID NO: 3729531 - RNA, 16 nt, Salmonella enterica enterica serovar Typhi Ty2
accauugauuuccgcg

SEQ ID NO: 3729532 - RNA, 22 nt, Salmonella enterica enterica serovar Typhi Ty2
accauuguuguaagggcuggaa

SEQ ID NO: 3729533 - RNA, 16 nt, Salmonella enterica enterica serovar Typhi Ty2
acccaaaaaccccgac

SEQ ID NO: 3729534 - RNA, 10 nt, Salmonella enterica enterica serovar Typhi Ty2
acccaaaaau

SEQ ID NO: 3729535 - RNA, 16 nt, Salmonella enterica enterica serovar Typhi Ty2
acccaaacagauaaca

SEQ ID NO: 3729536 - RNA, 13 nt, Salmonella enterica enterica serovar Typhi Ty2
acccaacaccaga

SEQ ID NO: 3729537 - RNA, 13 nt, Salmonella enterica enterica serovar Typhi Ty2
acccacaagaaau

SEQ ID NO: 3729538 - RNA, 19 nt, Salmonella enterica enterica serovar Typhi Ty2
acccacaagaaaugcaggc

SEQ ID NO: 3729539 - RNA, 13 nt, Salmonella enterica enterica serovar Typhi Ty2
acccacacauaga

SEQ ID NO: 3729540 - RNA, 17 nt, Salmonella enterica enterica serovar Typhi Ty2
acccacaucagcggcac

SEQ ID NO: 3729541 - RNA, 22 nt, Salmonella enterica enterica serovar Typhi Ty2
acccaccacgaucuugucacaa

SEQ ID NO: 3729542 - RNA, 13 nt, Salmonella enterica enterica serovar Typhi Ty2
acccaccagcagg

SEQ ID NO: 3729543 - RNA, 13 nt, Salmonella enterica enterica serovar Typhi Ty2
acccaccagcgcc

SEQ ID NO: 3729544 - RNA, 21 nt, Salmonella enterica enterica serovar Typhi Ty2
acccacggcaaagaccgcguc

SEQ ID NO: 3729545 - RNA, 18 nt, Salmonella enterica enterica serovar Typhi Ty2
acccacuguaucgacaua

SEQ ID NO: 3729546 - RNA, 16 nt, Salmonella enterica enterica serovar Typhi Ty2
acccacuuugcuuuuc

SEQ ID NO: 3729547 - RNA, 18 nt, Salmonella enterica enterica serovar Typhi Ty2
acccacuuugcuuuucug

SEQ ID NO: 3729548 - RNA, 22 nt, Salmonella enterica enterica serovar Typhi Ty2
acccagaaucaguaacacaauc

SEQ ID NO: 3729549 - RNA, 21 nt, Salmonella enterica enterica serovar Typhi Ty2
acccagacugugauggcgguc

SEQ ID NO: 3729550 - RNA, 14 nt, Salmonella enterica enterica serovar Typhi Ty2
acccagauaucagu

SEQ ID NO: 3729551 - RNA, 19 nt, Salmonella enterica enterica serovar Typhi Ty2
acccagauuauggguaaug

SEQ ID NO: 3729552 - RNA, 17 nt, Salmonella enterica enterica serovar Typhi Ty2
acccagccagacgccag

SEQ ID NO: 3729553 - RNA, 18 nt, Salmonella enterica enterica serovar Typhi Ty2
acccagccagacgccagc

SEQ ID NO: 3729554 - RNA, 12 nt, Salmonella enterica enterica serovar Typhi Ty2
acccagcccaau

SEQ ID NO: 3729555 - RNA, 22 nt, Salmonella enterica enterica serovar Typhi Ty2
acccagcccaauacgccagccu

SEQ ID NO: 3729556 - RNA, 19 nt, Salmonella enterica enterica serovar Typhi Ty2
acccagcgcuaacggcggu

SEQ ID NO: 3729557 - RNA, 15 nt, Salmonella enterica enterica serovar Typhi Ty2
acccaggcaucagau

SEQ ID NO: 3729558 - RNA, 15 nt, Salmonella enterica enterica serovar Typhi Ty2
acccaggccaucaga

SEQ ID NO: 3729559 - RNA, 16 nt, Salmonella enterica enterica serovar Typhi Ty2
acccagucgcagccac

SEQ ID NO: 3729560 - RNA, 20 nt, Salmonella enterica enterica serovar Typhi Ty2
acccaguucaaaucgaugcc

SEQ ID NO: 3729561 - RNA, 16 nt, Salmonella enterica enterica serovar Typhi Ty2
acccaguucauuaaca

SEQ ID NO: 3729562 - RNA, 22 nt, Salmonella enterica enterica serovar Typhi Ty2
acccaguuuuaagcgcaggugc

SEQ ID NO: 3729563 - RNA, 18 nt, Salmonella enterica enterica serovar Typhi Ty2
acccauacaguacagacu

SEQ ID NO: 3729564 - RNA, 16 nt, Salmonella enterica enterica serovar Typhi Ty2
acccauagcagcuccg

SEQ ID NO: 3729565 - RNA, 19 nt, Salmonella enterica enterica serovar Typhi Ty2
acccauaguagcuaaugau

SEQ ID NO: 3729566 - RNA, 21 nt, Salmonella enterica enterica serovar Typhi Ty2
acccauauuccugcggcccca

SEQ ID NO: 3729567 - RNA, 19 nt, Salmonella enterica enterica serovar Typhi Ty2
acccaucagggaaaaaugu

SEQ ID NO: 3729568 - RNA, 15 nt, Salmonella enterica enterica serovar Typhi Ty2
acccaugacgguagc

SEQ ID NO: 3729569 - RNA, 15 nt, Salmonella enterica enterica serovar Typhi Ty2
acccauuuuauccuc

SEQ ID NO: 3729570 - RNA, 18 nt, Salmonella enterica enterica serovar Typhi Ty2
accccaaaucagcaaaaa

SEQ ID NO: 3729571 - RNA, 16 nt, Salmonella enterica enterica serovar Typhi Ty2
accccaaucuugcgua

SEQ ID NO: 3729572 - RNA, 20 nt, Salmonella enterica enterica serovar Typhi Ty2
accccacgcuuuuuuauuuu

SEQ ID NO: 3729573 - RNA, 12 nt, Salmonella enterica enterica serovar Typhi Ty2
accccagcugcg

SEQ ID NO: 3729574 - RNA, 18 nt, Salmonella enterica enterica serovar Typhi Ty2
accccaguaauccggcaa

SEQ ID NO: 3729575 - RNA, 11 nt, Salmonella enterica enterica serovar Typhi Ty2
accccaucccg

SEQ ID NO: 3729576 - RNA, 18 nt, Salmonella enterica enterica serovar Typhi Ty2
accccaugccgauaauaa

SEQ ID NO: 3729577 - RNA, 15 nt, Salmonella enterica enterica serovar Typhi Ty2
accccauggcgucuu

SEQ ID NO: 3729578 - RNA, 20 nt, Salmonella enterica enterica serovar Typhi Ty2
accccauuaugugcgacgua

SEQ ID NO: 3729579 - RNA, 12 nt, Salmonella enterica enterica serovar Typhi Ty2
acccccagccau

SEQ ID NO: 3729580 - RNA, 22 nt, Salmonella enterica enterica serovar Typhi Ty2
acccccuccuuguaagggaggu

SEQ ID NO: 3729581 - RNA, 20 nt, Salmonella enterica enterica serovar Typhi Ty2
accccgauaaaccaggcagc

SEQ ID NO: 3729582 - RNA, 19 nt, Salmonella enterica enterica serovar Typhi Ty2
accccgccgucagacaggc

SEQ ID NO: 3729583 - RNA, 21 nt, Salmonella enterica enterica serovar Typhi Ty2
accccgccgucagacaggccu

SEQ ID NO: 3729584 - RNA, 20 nt, Salmonella enterica enterica serovar Typhi Ty2
accccuccggccagcgccag

SEQ ID NO: 3729585 - RNA, 14 nt, Salmonella enterica enterica serovar Typhi Ty2
accccuuaguuuuc

SEQ ID NO: 3729586 - RNA, 17 nt, Salmonella enterica enterica serovar Typhi Ty2
accccuucgcccucgcc

SEQ ID NO: 3729587 - RNA, 22 nt, Salmonella enterica enterica serovar Typhi Ty2
accccuucgcccucgccagcaa

SEQ ID NO: 3729588 - RNA, 20 nt, Salmonella enterica enterica serovar Typhi Ty2
accccuucuggagaauaucc

SEQ ID NO: 3729589 - RNA, 20 nt, Salmonella enterica enterica serovar Typhi Ty2
accccuugcgcguuucugaa

SEQ ID NO: 3729590 - RNA, 16 nt, Salmonella enterica enterica serovar Typhi Ty2
acccgaccgucuuugu

SEQ ID NO: 3729591 - RNA, 17 nt, Salmonella enterica enterica serovar Typhi Ty2
acccgauaccgccagcc

SEQ ID NO: 3729592 - RNA, 19 nt, Salmonella enterica enterica serovar Typhi Ty2
acccgauaccgccagcccc

SEQ ID NO: 3729593 - RNA, 20 nt, Salmonella enterica enterica serovar Typhi Ty2
acccgauaccgccagcccca

SEQ ID NO: 3729594 - RNA, 21 nt, Salmonella enterica enterica serovar Typhi Ty2
acccgauagcgccgcgcuauc

SEQ ID NO: 3729595 - RNA, 22 nt, Salmonella enterica enterica serovar Typhi Ty2
acccgaucgccauccugcaccg

SEQ ID NO: 3729596 - RNA, 20 nt, Salmonella enterica enterica serovar Typhi Ty2
acccgaugcgaguagcaaau

SEQ ID NO: 3729597 - RNA, 15 nt, Salmonella enterica enterica serovar Typhi Ty2
acccgauucugccag

SEQ ID NO: 3729598 - RNA, 20 nt, Salmonella enterica enterica serovar Typhi Ty2
acccgauucugccaguucac

SEQ ID NO: 3729599 - RNA, 15 nt, Salmonella enterica enterica serovar Typhi Ty2
acccgcagccagaac

SEQ ID NO: 3729600 - RNA, 13 nt, Salmonella enterica enterica serovar Typhi Ty2
acccgcaggccug

SEQ ID NO: 3729601 - RNA, 21 nt, Salmonella enterica enterica serovar Typhi Ty2
acccgcauacaggaagccggu

SEQ ID NO: 3729602 - RNA, 16 nt, Salmonella enterica enterica serovar Typhi Ty2
acccgcccgguuuugu

SEQ ID NO: 3729603 - RNA, 19 nt, Salmonella enterica enterica serovar Typhi Ty2
acccgccgccagcaccgcc

SEQ ID NO: 3729604 - RNA, 13 nt, Salmonella enterica enterica serovar Typhi Ty2
acccgccggcagc

SEQ ID NO: 3729605 - RNA, 18 nt, Salmonella enterica enterica serovar Typhi Ty2
accgccgccaaacugcgc

SEQ ID NO: 3729606 - RNA, 18 nt, Salmonella enterica enterica serovar Typhi Ty2
accgccgccaccaaaaac

SEQ ID NO: 3729607 - RNA, 13 nt, Salmonella enterica enterica serovar Typhi Ty2
accgccgcccguc

SEQ ID NO: 3729608 - RNA, 22 nt, Salmonella enterica enterica serovar Typhi Ty2
accgccgcgauacauugucgca

SEQ ID NO: 3729609 - RNA, 23 nt, Salmonella enterica enterica serovar Typhi Ty2
accgccgcgauagaccacgccau

SEQ ID NO: 3729610 - RNA, 16 nt, Salmonella enterica enterica serovar Typhi Ty2
accgccguccuggcga

SEQ ID NO: 3729611 - RNA, 16 nt, Salmonella enterica enterica serovar Typhi Ty2
accgccguuagcgccu

SEQ ID NO: 3729612 - RNA, 20 nt, Salmonella enterica enterica serovar Typhi Ty2
accgccuacacaaaaucauu

SEQ ID NO: 3729613 - RNA, 19 nt, Salmonella enterica enterica serovar Typhi Ty2
accgccucgccaaagcgcu

SEQ ID NO: 3729614 - RNA, 14 nt, Salmonella enterica enterica serovar Typhi Ty2
accgccuucagcgc

SEQ ID NO: 3729615 - RNA, 14 nt, Salmonella enterica enterica serovar Typhi Ty2
accgccuuccugcu

SEQ ID NO: 3729616 - RNA, 17 nt, Salmonella enterica enterica serovar Typhi Ty2
accgccuuccugcugcg

SEQ ID NO: 3729617 - RNA, 16 nt, Salmonella enterica enterica serovar Typhi Ty2
accgcgaacauuggaa

SEQ ID NO: 3729618 - RNA, 20 nt, Salmonella enterica enterica serovar Typhi Ty2
accgcgacaauaugauccuc

SEQ ID NO: 3729619 - RNA, 22 nt, Salmonella enterica enterica serovar Typhi Ty2
accgcgacuuggaaaguugcgc

SEQ ID NO: 3729620 - RNA, 14 nt, Salmonella enterica enterica serovar Typhi Ty2
accgcgcaaucaaa

SEQ ID NO: 3729621 - RNA, 19 nt, Salmonella enterica enterica serovar Typhi Ty2
accgcgcgcccgacgcgcc

SEQ ID NO: 3729622 - RNA, 13 nt, Salmonella enterica enterica serovar Typhi Ty2
accgcgcggcguu

SEQ ID NO: 3729623 - RNA, 14 nt, Salmonella enterica enterica serovar Typhi Ty2
accgcgcggcguuc

SEQ ID NO: 3729624 - RNA, 20 nt, Salmonella enterica enterica serovar Typhi Ty2
accgcgcggcguucugcgcc

SEQ ID NO: 3729625 - RNA, 21 nt, Salmonella enterica enterica serovar Typhi Ty2
accgcgcuccuggaaccagug

SEQ ID NO: 3729626 - RNA, 18 nt, Salmonella enterica enterica serovar Typhi Ty2
accgcggcaaccagccca

SEQ ID NO: 3729627 - RNA, 14 nt, Salmonella enterica enterica serovar Typhi Ty2
accgcguaaaaagu

SEQ ID NO: 3729628 - RNA, 20 nt, Salmonella enterica enterica serovar Typhi Ty2
accgcguccugacggugcgc

SEQ ID NO: 3729629 - RNA, 24 nt, Salmonella enterica enterica serovar Typhi Ty2
accgcguuuaacgcagcgcgcgua

SEQ ID NO: 3729630 - RNA, 13 nt, Salmonella enterica enterica serovar Typhi Ty2
accgcguuugcgc

SEQ ID NO: 3729631 - RNA, 17 nt, Salmonella enterica enterica serovar Typhi Ty2
accgcguuugcgcaaca

SEQ ID NO: 3729632 - RNA, 19 nt, Salmonella enterica enterica serovar Typhi Ty2
accgcguuugcgcaacaga

SEQ ID NO: 3729633 - RNA, 16 nt, Salmonella enterica enterica serovar Typhi Ty2
accgcguuuugcugau

SEQ ID NO: 3729634 - RNA, 23 nt, Salmonella enterica enterica serovar Typhi Ty2
accgcguuuugcugaugaagcga

SEQ ID NO: 3729635 - RNA, 14 nt, Salmonella enterica enterica serovar Typhi Ty2
accgcuacaaucca

SEQ ID NO: 3729636 - RNA, 15 nt, Salmonella enterica enterica serovar Typhi Ty2
accgcuacccggcac

SEQ ID NO: 3729637 - RNA, 12 nt, Salmonella enterica enterica serovar Typhi Ty2
accgcuaugaau

SEQ ID NO: 3729638 - RNA, 21 nt, Salmonella enterica enterica serovar Typhi Ty2
accgcucacgguuucaacuuc

SEQ ID NO: 3729639 - RNA, 13 nt, Salmonella enterica enterica serovar Typhi Ty2
accgcucaggcgc

SEQ ID NO: 3729640 - RNA, 15 nt, Salmonella enterica enterica serovar Typhi Ty2
accgcuccgcgcauc

SEQ ID NO: 3729641 - RNA, 15 nt, Salmonella enterica enterica serovar Typhi Ty2
accgcucgccgccuc

SEQ ID NO: 3729642 - RNA, 21 nt, Salmonella enterica enterica serovar Typhi Ty2
accgcugauggaccuuuuggu

SEQ ID NO: 3729643 - RNA, 17 nt, Salmonella enterica enterica serovar Typhi Ty2
accgcugcggaacacca

SEQ ID NO: 3729644 - RNA, 18 nt, Salmonella enterica enterica serovar Typhi Ty2
accgcugcggaacaccag

SEQ ID NO: 3729645 - RNA, 22 nt, Salmonella enterica enterica serovar Typhi Ty2
accgcuggcgucuguccggcgc

SEQ ID NO: 3729646 - RNA, 17 nt, Salmonella enterica enterica serovar Typhi Ty2
accgcugggaugaccug

SEQ ID NO: 3729647 - RNA, 22 nt, Salmonella enterica enterica serovar Typhi Ty2
accgcugggaugaccugaaauc

SEQ ID NO: 3729648 - RNA, 18 nt, Salmonella enterica enterica serovar Typhi Ty2
accgcuuaacagcguaca

SEQ ID NO: 3729649 - RNA, 13 nt, Salmonella enterica enterica serovar Typhi Ty2
accgcuuaacucc

SEQ ID NO: 3729650 - RNA, 22 nt, Salmonella enterica enterica serovar Typhi Ty2
accgcuucgaaguuuugaguuu

SEQ ID NO: 3729651 - RNA, 15 nt, Salmonella enterica enterica serovar Typhi Ty2
accgcuucgcauugc

SEQ ID NO: 3729652 - RNA, 16 nt, Salmonella enterica enterica serovar Typhi Ty2
accgcuucgcauugcg

SEQ ID NO: 3729653 - RNA, 16 nt, Salmonella enterica enterica serovar Typhi Ty2
accgcuucgcgcgcca

SEQ ID NO: 3729654 - RNA, 18 nt, Salmonella enterica enterica serovar Typhi Ty2
accgcuugggccaccugc

SEQ ID NO: 3729655 - RNA, 24 nt, Salmonella enterica enterica serovar Typhi Ty2
accgcuuuaucauaccagugcaga

SEQ ID NO: 3729656 - RNA, 16 nt, Salmonella enterica enterica serovar Typhi Ty2
accgcuuuaugcgcuu

SEQ ID NO: 3729657 - RNA, 17 nt, Salmonella enterica enterica serovar Typhi Ty2
accgcuuucccggcaug

SEQ ID NO: 3729658 - RNA, 22 nt, Salmonella enterica enterica serovar Typhi Ty2
accgcuuuggcgcccauuucgu

SEQ ID NO: 3729659 - RNA, 13 nt, Salmonella enterica enterica serovar Typhi Ty2
accggaacagaag

SEQ ID NO: 3729660 - RNA, 18 nt, Salmonella enterica enterica serovar Typhi Ty2
accggauaccgguucuuu

SEQ ID NO: 3729661 - RNA, 15 nt, Salmonella enterica enterica serovar Typhi Ty2
accggauauggcaaa

SEQ ID NO: 3729662 - RNA, 19 nt, Salmonella enterica enterica serovar Typhi Ty2
accggaucgaucccggcaa

SEQ ID NO: 3729663 - RNA, 21 nt, Salmonella enterica enterica serovar Typhi Ty2
accggaugggcagauagaaug

SEQ ID NO: 3729664 - RNA, 20 nt, Salmonella enterica enterica serovar Typhi Ty2
accggauuggucugauucag

SEQ ID NO: 3729665 - RNA, 22 nt, Salmonella enterica enterica serovar Typhi Ty2
accggcaaauaccgucauaauc

SEQ ID NO: 3729666 - RNA, 22 nt, Salmonella enterica enterica serovar Typhi Ty2
accggcaccagcaaugauaacg

SEQ ID NO: 3729667 - RNA, 15 nt, Salmonella enterica enterica serovar Typhi Ty2
accggcacucaccuc

SEQ ID NO: 3729668 - RNA, 18 nt, Salmonella enterica enterica serovar Typhi Ty2
accggcacucaccucuuc

SEQ ID NO: 3729669 - RNA, 12 nt, Salmonella enterica enterica serovar Typhi Ty2
accggcagcggu

SEQ ID NO: 3729670 - RNA, 22 nt, Salmonella enterica enterica serovar Typhi Ty2
accggcagcggucaucaaugau

SEQ ID NO: 3729671 - RNA, 13 nt, Salmonella enterica enterica serovar Typhi Ty2
accggcagcguca

SEQ ID NO: 3729672 - RNA, 16 nt, Salmonella enterica enterica serovar Typhi Ty2
accggcagcgucagcc

SEQ ID NO: 3729673 - RNA, 20 nt, Salmonella enterica enterica serovar Typhi Ty2
accggcagcgucagcccaag

SEQ ID NO: 3729674 - RNA, 20 nt, Salmonella enterica enterica serovar Typhi Ty2
accggcaggugauggcggcu

SEQ ID NO: 3729675 - RNA, 21 nt, Salmonella enterica enterica serovar Typhi Ty2
accggcauacacgccgggcac

SEQ ID NO: 3729676 - RNA, 16 nt, Salmonella enterica enterica serovar Typhi Ty2
accggcaucucaucuu

SEQ ID NO: 3729677 - RNA, 13 nt, Salmonella enterica enterica serovar Typhi Ty2
accggcauuucac

SEQ ID NO: 3729678 - RNA, 22 nt, Salmonella enterica enterica serovar Typhi Ty2
accggcauuucaccgucaauaa

SEQ ID NO: 3729679 - RNA, 20 nt, Salmonella enterica enterica serovar Typhi Ty2
accggccacaauugccagca

SEQ ID NO: 3729680 - RNA, 15 nt, Salmonella enterica enterica serovar Typhi Ty2
accggccacgagcug

SEQ ID NO: 3729681 - RNA, 17 nt, Salmonella enterica enterica serovar Typhi Ty2
accggccacgagcuguc

SEQ ID NO: 3729682 - RNA, 18 nt, Salmonella enterica enterica serovar Typhi Ty2
accggccauugccgcgcc

SEQ ID NO: 3729683 - RNA, 12 nt, Salmonella enterica enterica serovar Typhi Ty2
accggcccagcu

SEQ ID NO: 3729684 - RNA, 14 nt, Salmonella enterica enterica serovar Typhi Ty2
accggcccccggcc

SEQ ID NO: 3729685 - RNA, 14 nt, Salmonella enterica enterica serovar Typhi Ty2
accggccgccaucg

SEQ ID NO: 3729686 - RNA, 15 nt, Salmonella enterica enterica serovar Typhi Ty2
accggccgcccggac

SEQ ID NO: 3729687 - RNA, 16 nt, Salmonella enterica enterica serovar Typhi Ty2
accucaccguccgcca

SEQ ID NO: 3729688 - RNA, 21 nt, Salmonella enterica enterica serovar Typhi Ty2
accucaccguccgccaggccc

SEQ ID NO: 3729689 - RNA, 18 nt, Salmonella enterica enterica serovar Typhi Ty2
accucagccaacccacgc

SEQ ID NO: 3729690 - RNA, 14 nt, Salmonella enterica enterica serovar Typhi Ty2
accucagccaccca

SEQ ID NO: 3729691 - RNA, 20 nt, Salmonella enterica enterica serovar Typhi Ty2
accucagguaaauccgccag

SEQ ID NO: 3729692 - RNA, 23 nt, Salmonella enterica enterica serovar Typhi Ty2
accucagucgcuuguaccgucgg

SEQ ID NO: 3729693 - RNA, 17 nt, Salmonella enterica enterica serovar Typhi Ty2
accucaucaacgccaag

SEQ ID NO: 3729694 - RNA, 17 nt, Salmonella enterica enterica serovar Typhi Ty2
accucaucaccuacccu

SEQ ID NO: 3729695 - RNA, 23 nt, Salmonella enterica enterica serovar Typhi Ty2
accucauccagauguuauaaacu

SEQ ID NO: 3729696 - RNA, 17 nt, Salmonella enterica enterica serovar Typhi Ty2
accucauccaucagcgc

SEQ ID NO: 3729697 - RNA, 13 nt, Salmonella enterica enterica serovar Typhi Ty2
accucaucgcuac

SEQ ID NO: 3729698 - RNA, 19 nt, Salmonella enterica enterica serovar Typhi Ty2
accucaugccggcuggcaa

SEQ ID NO: 3729699 - RNA, 12 nt, Salmonella enterica enterica serovar Typhi Ty2
accucaugcgcc

SEQ ID NO: 3729700 - RNA, 15 nt, Salmonella enterica enterica serovar Typhi Ty2
accuccaaagcgcua

SEQ ID NO: 3729701 - RNA, 17 nt, Salmonella enterica enterica serovar Typhi Ty2
accuccaaagcgcuaca

SEQ ID NO: 3729702 - RNA, 12 nt, Salmonella enterica enterica serovar Typhi Ty2
accuccgcccgg

SEQ ID NO: 3729703 - RNA, 19 nt, Salmonella enterica enterica serovar Typhi Ty2
accuccggcuaugccggag

SEQ ID NO: 3729704 - RNA, 18 nt, Salmonella enterica enterica serovar Typhi Ty2
accuccugcaaucguucu

SEQ ID NO: 3729705 - RNA, 14 nt, Salmonella enterica enterica serovar Typhi Ty2
accuccuucgcgcc

SEQ ID NO: 3729706 - RNA, 20 nt, Salmonella enterica enterica serovar Typhi Ty2
accucgcaauauucaugcca

SEQ ID NO: 3729707 - RNA, 16 nt, Salmonella enterica enterica serovar Typhi Ty2
accucgccacauucaa

SEQ ID NO: 3729708 - RNA, 15 nt, Salmonella enterica enterica serovar Typhi Ty2
accucgccagucagg

SEQ ID NO: 3729709 - RNA, 23 nt, Salmonella enterica enterica serovar Typhi Ty2
accucgcuucccugacgcgcagc

SEQ ID NO: 3729710 - RNA, 18 nt, Salmonella enterica enterica serovar Typhi Ty2
accucggguaaagguuug

SEQ ID NO: 3729711 - RNA, 18 nt, Salmonella enterica enterica serovar Typhi Ty2
accucgguauguccugcc

SEQ ID NO: 3729712 - RNA, 13 nt, Salmonella enterica enterica serovar Typhi Ty2
accucuaaaugga

SEQ ID NO: 3729713 - RNA, 22 nt, Salmonella enterica enterica serovar Typhi Ty2
accucuaaauggaucgcccguc

SEQ ID NO: 3729714 - RNA, 23 nt, Salmonella enterica enterica serovar Typhi Ty2
accucuuugcggccuuuauccag

SEQ ID NO: 3729715 - RNA, 20 nt, Salmonella enterica enterica serovar Typhi Ty2
accucuuuggcgcgaaccgu

SEQ ID NO: 3729716 - RNA, 15 nt, Salmonella enterica enterica serovar Typhi Ty2
accugaaaucagccu

SEQ ID NO: 3729717 - RNA, 16 nt, Salmonella enterica enterica serovar Typhi Ty2
accugaaaucagccug

SEQ ID NO: 3729718 - RNA, 21 nt, Salmonella enterica enterica serovar Typhi Ty2
accugaaugcaaagaagggca

SEQ ID NO: 3729719 - RNA, 16 nt, Salmonella enterica enterica serovar Typhi Ty2
accugacggcagccac

SEQ ID NO: 3729720 - RNA, 16 nt, Salmonella enterica enterica serovar Typhi Ty2
accugauagcggguaa

SEQ ID NO: 3729721 - RNA, 23 nt, Salmonella enterica enterica serovar Typhi Ty2
accugauauugcguaagcagcug

SEQ ID NO: 3729722 - RNA, 19 nt, Salmonella enterica enterica serovar Typhi Ty2
accugaugguuauuuucag

SEQ ID NO: 3729723 - RNA, 10 nt, Salmonella enterica enterica serovar Typhi Ty2
accugauguc

SEQ ID NO: 3729724 - RNA, 13 nt, Salmonella enterica enterica serovar Typhi Ty2
accugaugugcuu

SEQ ID NO: 3729725 - RNA, 16 nt, Salmonella enterica enterica serovar Typhi Ty2
accugauugaccagca

SEQ ID NO: 3729726 - RNA, 23 nt, Salmonella enterica enterica serovar Typhi Ty2
accugcagggugaagauggcgcc

SEQ ID NO: 3729727 - RNA, 24 nt, Salmonella enterica enterica serovar Typhi Ty2
accugcagguuuaaaaccggccag

SEQ ID NO: 3729728 - RNA, 21 nt, Salmonella enterica enterica serovar Typhi Ty2
accugcaucccuuucuuuaca

SEQ ID NO: 3729729 - RNA, 20 nt, Salmonella enterica enterica serovar Typhi Ty2
accugccacaggccaacaua

SEQ ID NO: 3729730 - RNA, 20 nt, Salmonella enterica enterica serovar Typhi Ty2
accugccaguccgcccgccu

SEQ ID NO: 3729731 - RNA, 20 nt, Salmonella enterica enterica serovar Typhi Ty2
accugcccuuucuucaaugg

SEQ ID NO: 3729732 - RNA, 18 nt, Salmonella enterica enterica serovar Typhi Ty2
accugccgaccucacugg

SEQ ID NO: 3729733 - RNA, 13 nt, Salmonella enterica enterica serovar Typhi Ty2
accugccgaugaa

SEQ ID NO: 3729734 - RNA, 18 nt, Salmonella enterica enterica serovar Typhi Ty2
accugccguuuuccagcc

SEQ ID NO: 3729735 - RNA, 19 nt, Salmonella enterica enterica serovar Typhi Ty2
accugcgcaaucaugacag

SEQ ID NO: 3729736 - RNA, 21 nt, Salmonella enterica enterica serovar Typhi Ty2
accugcgcugacggcggcaga

SEQ ID NO: 3729737 - RNA, 18 nt, Salmonella enterica enterica serovar Typhi Ty2
accugcggcaauggcuca

SEQ ID NO: 3729738 - RNA, 15 nt, Salmonella enterica enterica serovar Typhi Ty2
accugcggcgcgccc

SEQ ID NO: 3729739 - RNA, 16 nt, Salmonella enterica enterica serovar Typhi Ty2
accugcuggcggcgua

SEQ ID NO: 3729740 - RNA, 18 nt, Salmonella enterica enterica serovar Typhi Ty2
accugcuggucaccuggc

SEQ ID NO: 3729741 - RNA, 19 nt, Salmonella enterica enterica serovar Typhi Ty2
accugcuguaccucuugcu

SEQ ID NO: 3729742 - RNA, 24 nt, Salmonella enterica enterica serovar Typhi Ty2
accugcugucgcgguacuucugac

SEQ ID NO: 3729743 - RNA, 14 nt, Salmonella enterica enterica serovar Typhi Ty2
accugcuucagguu

SEQ ID NO: 3729744 - RNA, 18 nt, Salmonella enterica enterica serovar Typhi Ty2
accuggaaccaggcgcga

SEQ ID NO: 3729745 - RNA, 18 nt, Salmonella enterica enterica serovar Typhi Ty2
accuggaaguuuugcugg

SEQ ID NO: 3729746 - RNA, 22 nt, Salmonella enterica enterica serovar Typhi Ty2
accuggaauagcgugggcagac

SEQ ID NO: 3729747 - RNA, 19 nt, Salmonella enterica enterica serovar Typhi Ty2
accuggccguugauaaagu

SEQ ID NO: 3729748 - RNA, 15 nt, Salmonella enterica enterica serovar Typhi Ty2
accuggcggagcugc

SEQ ID NO: 3729749 - RNA, 20 nt, Salmonella enterica enterica serovar Typhi Ty2
accuggcguaguacgcgcgc

SEQ ID NO: 3729750 - RNA, 11 nt, Salmonella enterica enterica serovar Typhi Ty2
accuggcuggc

SEQ ID NO: 3729751 - RNA, 20 nt, Salmonella enterica enterica serovar Typhi Ty2
accuggguagcuucugucug

SEQ ID NO: 3729752 - RNA, 23 nt, Salmonella enterica enterica serovar Typhi Ty2
accuguaaccccagcaucugcau

SEQ ID NO: 3729753 - RNA, 19 nt, Salmonella enterica enterica serovar Typhi Ty2
accuguaucugcugacacc

SEQ ID NO: 3729754 - RNA, 23 nt, Salmonella enterica enterica serovar Typhi Ty2
accuguaucugcugacacccucu

SEQ ID NO: 3729755 - RNA, 15 nt, Salmonella enterica enterica serovar Typhi Ty2
accugucuaucaccg

SEQ ID NO: 3729756 - RNA, 17 nt, Salmonella enterica enterica serovar Typhi Ty2
accuguuucgccaggcc

SEQ ID NO: 3729757 - RNA, 20 nt, Salmonella enterica enterica serovar Typhi Ty2
accuuaaaaggcgcucgccu

SEQ ID NO: 3729758 - RNA, 20 nt, Salmonella enterica enterica serovar Typhi Ty2
accuuaaccgucugcucaga

SEQ ID NO: 3729759 - RNA, 11 nt, Salmonella enterica enterica serovar Typhi Ty2
accuuaaugau

SEQ ID NO: 3729760 - RNA, 23 nt, Salmonella enterica enterica serovar Typhi Ty2
accuuacgcacaugaucuucguu

SEQ ID NO: 3729761 - RNA, 20 nt, Salmonella enterica enterica serovar Typhi Ty2
accuuacguuucucacuaau

SEQ ID NO: 3729762 - RNA, 21 nt, Salmonella enterica enterica serovar Typhi Ty2
accuuacuuguaggccuggua

SEQ ID NO: 3729763 - RNA, 17 nt, Salmonella enterica enterica serovar Typhi Ty2
accuuaucaagcgauac

SEQ ID NO: 3729764 - RNA, 19 nt, Salmonella enterica enterica serovar Typhi Ty2
accuucaacagcucgccau

SEQ ID NO: 3729765 - RNA, 17 nt, Salmonella enterica enterica serovar Typhi Ty2
accuucaacccagcagc

SEQ ID NO: 3729766 - RNA, 19 nt, Salmonella enterica enterica serovar Typhi Ty2
accuucaagaaucaauaua

SEQ ID NO: 3729767 - RNA, 17 nt, Salmonella enterica enterica serovar Typhi Ty2
accuucacauuggcaaa

SEQ ID NO: 3729768 - RNA, 15 nt, Salmonella enterica enterica serovar Typhi Ty2
acgauaaaccucacg

SEQ ID NO: 3729769 - RNA, 18 nt, Salmonella enterica enterica serovar Typhi Ty2
acgauaaaccucacgcaa

SEQ ID NO: 3729770 - RNA, 14 nt, Salmonella enterica enterica serovar Typhi Ty2
acgauaaauuucac

SEQ ID NO: 3729771 - RNA, 19 nt, Salmonella enterica enterica serovar Typhi Ty2
acgauaaauuuucagacac

SEQ ID NO: 3729772 - RNA, 20 nt, Salmonella enterica enterica serovar Typhi Ty2
acgauaauguugguaaauuu

SEQ ID NO: 3729773 - RNA, 22 nt, Salmonella enterica enterica serovar Typhi Ty2
acgauacagcacggcaguacac

SEQ ID NO: 3729774 - RNA, 20 nt, Salmonella enterica enterica serovar Typhi Ty2
acgauaccgacacaucaucg

SEQ ID NO: 3729775 - RNA, 16 nt, Salmonella enterica enterica serovar Typhi Ty2
acgauagacagcacca

SEQ ID NO: 3729776 - RNA, 19 nt, Salmonella enterica enterica serovar Typhi Ty2
acgauagcgccgguuucuc

SEQ ID NO: 3729777 - RNA, 21 nt, Salmonella enterica enterica serovar Typhi Ty2
acgauaggcauacacaucuuc

SEQ ID NO: 3729778 - RNA, 18 nt, Salmonella enterica enterica serovar Typhi Ty2
acgauaguuugccagaga

SEQ ID NO: 3729779 - RNA, 16 nt, Salmonella enterica enterica serovar Typhi Ty2
acgauauaggguuuuc

SEQ ID NO: 3729780 - RNA, 14 nt, Salmonella enterica enterica serovar Typhi Ty2
acgauauagucgcc

SEQ ID NO: 3729781 - RNA, 15 nt, Salmonella enterica enterica serovar Typhi Ty2
acgauaucgccuggu

SEQ ID NO: 3729782 - RNA, 23 nt, Salmonella enterica enterica serovar Typhi Ty2
acgauaucgccuggugugaacau

SEQ ID NO: 3729783 - RNA, 19 nt, Salmonella enterica enterica serovar Typhi Ty2
acgauauucuguuagcgcc

SEQ ID NO: 3729784 - RNA, 16 nt, Salmonella enterica enterica serovar Typhi Ty2
acgaucaacagaccga

SEQ ID NO: 3729785 - RNA, 20 nt, Salmonella enterica enterica serovar Typhi Ty2
acgaucaauaaaauuaucca

SEQ ID NO: 3729786 - RNA, 21 nt, Salmonella enterica enterica serovar Typhi Ty2
acgaucaauaaaauuauccag

SEQ ID NO: 3729787 - RNA, 15 nt, Salmonella enterica enterica serovar Typhi Ty2
acgaucaugccgccc

SEQ ID NO: 3729788 - RNA, 14 nt, Salmonella enterica enterica serovar Typhi Ty2
acgaucauuucacu

SEQ ID NO: 3729789 - RNA, 13 nt, Salmonella enterica enterica serovar Typhi Ty2
acgaucgcgcaca

SEQ ID NO: 3729790 - RNA, 20 nt, Salmonella enterica enterica serovar Typhi Ty2
acgaucgguuaucacgguau

SEQ ID NO: 3729791 - RNA, 22 nt, Salmonella enterica enterica serovar Typhi Ty2
acgaucugacauuugcaucaaa

SEQ ID NO: 3729792 - RNA, 22 nt, Salmonella enterica enterica serovar Typhi Ty2
acgaugauaauacauugccgca

SEQ ID NO: 3729793 - RNA, 17 nt, Salmonella enterica enterica serovar Typhi Ty2
acgauggcaaauaauac

SEQ ID NO: 3729794 - RNA, 11 nt, Salmonella enterica enterica serovar Typhi Ty2
acgauggcgau

SEQ ID NO: 3729795 - RNA, 14 nt, Salmonella enterica enterica serovar Typhi Ty2
acgaugucaucgcc

SEQ ID NO: 3729796 - RNA, 17 nt, Salmonella enterica enterica serovar Typhi Ty2
acgauguucgucccugc

SEQ ID NO: 3729797 - RNA, 19 nt, Salmonella enterica enterica serovar Typhi Ty2
acgauucagguuuugcuga

SEQ ID NO: 3729798 - RNA, 15 nt, Salmonella enterica enterica serovar Typhi Ty2
acgauugaucucauc

SEQ ID NO: 3729799 - RNA, 15 nt, Salmonella enterica enterica serovar Typhi Ty2
acgauuucucgccau

SEQ ID NO: 3729800 - RNA, 19 nt, Salmonella enterica enterica serovar Typhi Ty2
acgauuuugguagcgcuga

SEQ ID NO: 3729801 - RNA, 19 nt, Salmonella enterica enterica serovar Typhi Ty2
acgcaaagacaccccagcc

SEQ ID NO: 3729802 - RNA, 20 nt, Salmonella enterica enterica serovar Typhi Ty2
acgcaaaggcguugugcugc

SEQ ID NO: 3729803 - RNA, 13 nt, Salmonella enterica enterica serovar Typhi Ty2
acgcaacaacagu

SEQ ID NO: 3729804 - RNA, 17 nt, Salmonella enterica enterica serovar Typhi Ty2
acgcaacaggccgcauc

SEQ ID NO: 3729805 - RNA, 20 nt, Salmonella enterica enterica serovar Typhi Ty2
acgcaacgcuucugagaauu

SEQ ID NO: 3729806 - RNA, 17 nt, Salmonella enterica enterica serovar Typhi Ty2
acgcaagagagcaacau

SEQ ID NO: 3729807 - RNA, 13 nt, Salmonella enterica enterica serovar Typhi Ty2
acgcaagcagcac

SEQ ID NO: 3729808 - RNA, 22 nt, Salmonella enterica enterica serovar Typhi Ty2
acgcaaggaaauauuaauuaag

SEQ ID NO: 3729809 - RNA, 23 nt, Salmonella enterica enterica serovar Typhi Ty2
acgcaaucucuuccgcccagaua

SEQ ID NO: 3729810 - RNA, 13 nt, Salmonella enterica enterica serovar Typhi Ty2
acgcacaaaccgc

SEQ ID NO: 3729811 - RNA, 16 nt, Salmonella enterica enterica serovar Typhi Ty2
acgcaccagccaggcg

SEQ ID NO: 3729812 - RNA, 21 nt, Salmonella enterica enterica serovar Typhi Ty2
acgcaccgccaaacgcgguca

SEQ ID NO: 3729813 - RNA, 17 nt, Salmonella enterica enterica serovar Typhi Ty2
acgcaccguagugacac

SEQ ID NO: 3729814 - RNA, 17 nt, Salmonella enterica enterica serovar Typhi Ty2
acgcacguacggaaggu

SEQ ID NO: 3729815 - RNA, 17 nt, Salmonella enterica enterica serovar Typhi Ty2
acgcacuguaacgcacu

SEQ ID NO: 3729816 - RNA, 18 nt, Salmonella enterica enterica serovar Typhi Ty2
acgcagacuauagguggc

SEQ ID NO: 3729817 - RNA, 15 nt, Salmonella enterica enterica serovar Typhi Ty2
acgcagauauucauu

SEQ ID NO: 3729818 - RNA, 18 nt, Salmonella enterica enterica serovar Typhi Ty2
acgcagcacguccagaua

SEQ ID NO: 3729819 - RNA, 19 nt, Salmonella enterica enterica serovar Typhi Ty2
acgcagcacguccagauac

SEQ ID NO: 3729820 - RNA, 15 nt, Salmonella enterica enterica serovar Typhi Ty2
acgcagcaucgccau

SEQ ID NO: 3729821 - RNA, 12 nt, Salmonella enterica enterica serovar Typhi Ty2
acgcagccaugu

SEQ ID NO: 3729822 - RNA, 17 nt, Salmonella enterica enterica serovar Typhi Ty2
acgcagccgaggcuuaa

SEQ ID NO: 3729823 - RNA, 15 nt, Salmonella enterica enterica serovar Typhi Ty2
acgcagcgcgcguag

SEQ ID NO: 3729824 - RNA, 16 nt, Salmonella enterica enterica serovar Typhi Ty2
acgcagcugaugcgaa

SEQ ID NO: 3729825 - RNA, 13 nt, Salmonella enterica enterica serovar Typhi Ty2
acgcagcuuaaag

SEQ ID NO: 3729826 - RNA, 14 nt, Salmonella enterica enterica serovar Typhi Ty2
acgcagcuucgccg

SEQ ID NO: 3729827 - RNA, 17 nt, Salmonella enterica enterica serovar Typhi Ty2
acgcaggcgaaaucaaa

SEQ ID NO: 3729828 - RNA, 22 nt, Salmonella enterica enterica serovar Typhi Ty2
acgcaggcuaacgcgccccagg

SEQ ID NO: 3729829 - RNA, 16 nt, Salmonella enterica enterica serovar Typhi Ty2
acgcaggcuugcccau

SEQ ID NO: 3729830 - RNA, 17 nt, Salmonella enterica enterica serovar Typhi Ty2
acgcaguggcaauuuaa

SEQ ID NO: 3729831 - RNA, 19 nt, Salmonella enterica enterica serovar Typhi Ty2
acgcauaaaaaaugagaaa

SEQ ID NO: 3729832 - RNA, 22 nt, Salmonella enterica enterica serovar Typhi Ty2
acgcauaaugagcgcuugaucc

SEQ ID NO: 3729833 - RNA, 20 nt, Salmonella enterica enterica serovar Typhi Ty2
acgcauaaugcgccccgcaa

SEQ ID NO: 3729834 - RNA, 15 nt, Salmonella enterica enterica serovar Typhi Ty2
acgcauaccagccau

SEQ ID NO: 3729835 - RNA, 16 nt, Salmonella enterica enterica serovar Typhi Ty2
acgcauauccagcaga

SEQ ID NO: 3729836 - RNA, 20 nt, Salmonella enterica enterica serovar Typhi Ty2
acgcauaucccacugcacgc

SEQ ID NO: 3729837 - RNA, 24 nt, Salmonella enterica enterica serovar Typhi Ty2
acgcauaucccacugcacgccagg

SEQ ID NO: 3729838 - RNA, 20 nt, Salmonella enterica enterica serovar Typhi Ty2
acgcaucaaagccacccacg

SEQ ID NO: 3729839 - RNA, 12 nt, Salmonella enterica enterica serovar Typhi Ty2
acgcaucaaaua

SEQ ID NO: 3729840 - RNA, 22 nt, Salmonella enterica enterica serovar Typhi Ty2
acgcaucauauucgcagcucug

SEQ ID NO: 3729841 - RNA, 13 nt, Salmonella enterica enterica serovar Typhi Ty2
acgcauccagcgu

SEQ ID NO: 3729842 - RNA, 18 nt, Salmonella enterica enterica serovar Typhi Ty2
acgcaucccgccaaccag

SEQ ID NO: 3729843 - RNA, 14 nt, Salmonella enterica enterica serovar Typhi Ty2
acgcauccugcacu

SEQ ID NO: 3729844 - RNA, 16 nt, Salmonella enterica enterica serovar Typhi Ty2
acgcauccugcacuuu

SEQ ID NO: 3729845 - RNA, 17 nt, Salmonella enterica enterica serovar Typhi Ty2
acgcaucgguaaagguu

SEQ ID NO: 3729846 - RNA, 17 nt, Salmonella enterica enterica serovar Typhi Ty2
acgcaucguggccgaua

SEQ ID NO: 3729847 - RNA, 18 nt, Salmonella enterica enterica serovar Typhi Ty2
acgcaucugggcugagaa

SEQ ID NO: 3729848 - RNA, 15 nt, Salmonella enterica enterica serovar Typhi Ty2
acgcaucuuuuuccc

SEQ ID NO: 3729849 - RNA, 18 nt, Salmonella enterica enterica serovar Typhi Ty2
acgcaugacccaggcauc

SEQ ID NO: 3729850 - RNA, 19 nt, Salmonella enterica enterica serovar Typhi Ty2
acaaagacgaauaaggaau

SEQ ID NO: 3729851 - RNA, 11 nt, Salmonella enterica enterica serovar Typhi Ty2
acaaagagcuc

SEQ ID NO: 3729852 - RNA, 14 nt, Salmonella enterica enterica serovar Typhi Ty2
acaaagccggauau

SEQ ID NO: 3729853 - RNA, 16 nt, Salmonella enterica enterica serovar Typhi Ty2
acaaagccugcuggaa

SEQ ID NO: 3729854 - RNA, 19 nt, Salmonella enterica enterica serovar Typhi Ty2
acaaagcgguaaaucgcaa

SEQ ID NO: 3729855 - RNA, 21 nt, Salmonella enterica enterica serovar Typhi Ty2
acaaaggcagccaacaaagag

SEQ ID NO: 3729856 - RNA, 17 nt, Salmonella enterica enterica serovar Typhi Ty2
acaaagguuuguuuaau

SEQ ID NO: 3729857 - RNA, 13 nt, Salmonella enterica enterica serovar Typhi Ty2
acaaauaaaucca

SEQ ID NO: 3729858 - RNA, 14 nt, Salmonella enterica enterica serovar Typhi Ty2
acaaauaaauccau

SEQ ID NO: 3729859 - RNA, 23 nt, Salmonella enterica enterica serovar Typhi Ty2
acaaauaacagacgaaaaaaaag

SEQ ID NO: 3729860 - RNA, 15 nt, Salmonella enterica enterica serovar Typhi Ty2
acaaauaacuuuccu

SEQ ID NO: 3729861 - RNA, 23 nt, Salmonella enterica enterica serovar Typhi Ty2
acaaauagaagccacaaucugau

SEQ ID NO: 3729862 - RNA, 21 nt, Salmonella enterica enterica serovar Typhi Ty2
acaaaucacuggagcgcauuu

SEQ ID NO: 3729863 - RNA, 19 nt, Salmonella enterica enterica serovar Typhi Ty2
acaaaucgacagccagcau

SEQ ID NO: 3729864 - RNA, 20 nt, Salmonella enterica enterica serovar Typhi Ty2
acaaaugaccucaagaauau

SEQ ID NO: 3729865 - RNA, 14 nt, Salmonella enterica enterica serovar Typhi Ty2
acaaauucgcuaau

SEQ ID NO: 3729866 - RNA, 15 nt, Salmonella enterica enterica serovar Typhi Ty2
acaaauucugaagag

SEQ ID NO: 3729867 - RNA, 17 nt, Salmonella enterica enterica serovar Typhi Ty2
acaaauuuugauaaaaa

SEQ ID NO: 3729868 - RNA, 15 nt, Salmonella enterica enterica serovar Typhi Ty2
acaacaaaaagauau

SEQ ID NO: 3729869 - RNA, 21 nt, Salmonella enterica enterica serovar Typhi Ty2
acaacaaaguauaaagcuggu

SEQ ID NO: 3729870 - RNA, 23 nt, Salmonella enterica enterica serovar Typhi Ty2
acaacacacguaacaaccagaau

SEQ ID NO: 3729871 - RNA, 20 nt, Salmonella enterica enterica serovar Typhi Ty2
acaacacgcuuuucagcgcc

SEQ ID NO: 3729872 - RNA, 17 nt, Salmonella enterica enterica serovar Typhi Ty2
acaacacucacaaaacu

SEQ ID NO: 3729873 - RNA, 15 nt, Salmonella enterica enterica serovar Typhi Ty2
acaacagccggaacg

SEQ ID NO: 3729874 - RNA, 15 nt, Salmonella enterica enterica serovar Typhi Ty2
acaacauaaaggggu

SEQ ID NO: 3729875 - RNA, 23 nt, Salmonella enterica enterica serovar Typhi Ty2
acaacauaucgccggggaaaaua

SEQ ID NO: 3729876 - RNA, 17 nt, Salmonella enterica enterica serovar Typhi Ty2
acaacaucccagaaaau

SEQ ID NO: 3729877 - RNA, 12 nt, Salmonella enterica enterica serovar Typhi Ty2
acaaccagcgaa

SEQ ID NO: 3729878 - RNA, 20 nt, Salmonella enterica enterica serovar Typhi Ty2
acaaccagcgaaaugacggc

SEQ ID NO: 3729879 - RNA, 23 nt, Salmonella enterica enterica serovar Typhi Ty2
acaaccaggauucaacgcgugau

SEQ ID NO: 3729880 - RNA, 19 nt, Salmonella enterica enterica serovar Typhi Ty2
acaaccaucgucuguacgg

SEQ ID NO: 3729881 - RNA, 13 nt, Salmonella enterica enterica serovar Typhi Ty2
acaacccggcugc

SEQ ID NO: 3729882 - RNA, 16 nt, Salmonella enterica enterica serovar Typhi Ty2
acaacccuuuuccgga

SEQ ID NO: 3729883 - RNA, 15 nt, Salmonella enterica enterica serovar Typhi Ty2
acaaccuccacgccc

SEQ ID NO: 3729884 - RNA, 13 nt, Salmonella enterica enterica serovar Typhi Ty2
acaacgagauuca

SEQ ID NO: 3729885 - RNA, 16 nt, Salmonella enterica enterica serovar Typhi Ty2
acaacgcauauuauga

SEQ ID NO: 3729886 - RNA, 21 nt, Salmonella enterica enterica serovar Typhi Ty2
acaacgccgguacgcagcagg

SEQ ID NO: 3729887 - RNA, 16 nt, Salmonella enterica enterica serovar Typhi Ty2
acaacggcaauuuuua

SEQ ID NO: 3729888 - RNA, 17 nt, Salmonella enterica enterica serovar Typhi Ty2
acaacggccagcaaaau

SEQ ID NO: 3729889 - RNA, 19 nt, Salmonella enterica enterica serovar Typhi Ty2
acaacguaauauuaagcag

SEQ ID NO: 3729890 - RNA, 21 nt, Salmonella enterica enterica serovar Typhi Ty2
acaacgucaguggaaaacagc

SEQ ID NO: 3729891 - RNA, 19 nt, Salmonella enterica enterica serovar Typhi Ty2
acaacguucggucauggau

SEQ ID NO: 3729892 - RNA, 19 nt, Salmonella enterica enterica serovar Typhi Ty2
acaagaacuuaaauuaaug

SEQ ID NO: 3729893 - RNA, 12 nt, Salmonella enterica enterica serovar Typhi Ty2
acaagaagggua

SEQ ID NO: 3729894 - RNA, 19 nt, Salmonella enterica enterica serovar Typhi Ty2
acaagaaggguauagagca

SEQ ID NO: 3729895 - RNA, 16 nt, Salmonella enterica enterica serovar Typhi Ty2
acaagaauuuaucgca

SEQ ID NO: 3729896 - RNA, 21 nt, Salmonella enterica enterica serovar Typhi Ty2
acaagaauuuaucgcaauaua

SEQ ID NO: 3729897 - RNA, 22 nt, Salmonella enterica enterica serovar Typhi Ty2
acaagaggaguguaacgccgaa

SEQ ID NO: 3729898 - RNA, 20 nt, Salmonella enterica enterica serovar Typhi Ty2
acaagaucaaugugcucaac

SEQ ID NO: 3729899 - RNA, 21 nt, Salmonella enterica enterica serovar Typhi Ty2
acaagcaaaccuauuucagua

SEQ ID NO: 3729900 - RNA, 23 nt, Salmonella enterica enterica serovar Typhi Ty2
acaagcaguaucguguuauuuuc

SEQ ID NO: 3729901 - RNA, 22 nt, Salmonella enterica enterica serovar Typhi Ty2
acaagccccccgcacagcacau

SEQ ID NO: 3729902 - RNA, 20 nt, Salmonella enterica enterica serovar Typhi Ty2
acaagccgccaacgccagca

SEQ ID NO: 3729903 - RNA, 15 nt, Salmonella enterica enterica serovar Typhi Ty2
acaagcuaaucccca

SEQ ID NO: 3729904 - RNA, 13 nt, Salmonella enterica enterica serovar Typhi Ty2
acaagcucauuuc

SEQ ID NO: 3729905 - RNA, 16 nt, Salmonella enterica enterica serovar Typhi Ty2
acaaggcuuuuggcuu

SEQ ID NO: 3729906 - RNA, 17 nt, Salmonella enterica enterica serovar Typhi Ty2
acaaggcuuuuggcuua

SEQ ID NO: 3729907 - RNA, 14 nt, Salmonella enterica enterica serovar Typhi Ty2
acaaguaauaaaau

SEQ ID NO: 3729908 - RNA, 15 nt, Salmonella enterica enterica serovar Typhi Ty2
acaaguaauaaaaua

SEQ ID NO: 3729909 - RNA, 20 nt, Salmonella enterica enterica serovar Typhi Ty2
acaaguagccugccagcaac

SEQ ID NO: 3729910 - RNA, 15 nt, Salmonella enterica enterica serovar Typhi Ty2
acaagugucgugaau

SEQ ID NO: 3729911 - RNA, 14 nt, Salmonella enterica enterica serovar Typhi Ty2
acaaguuuauccag

SEQ ID NO: 3729912 - RNA, 23 nt, Salmonella enterica enterica serovar Typhi Ty2
acaauaaauaacgugucaggaug

SEQ ID NO: 3729913 - RNA, 19 nt, Salmonella enterica enterica serovar Typhi Ty2
acaauaacaccacaacaca

SEQ ID NO: 3729914 - RNA, 20 nt, Salmonella enterica enterica serovar Typhi Ty2
acaauaacgccggauauguu

SEQ ID NO: 3729915 - RNA, 22 nt, Salmonella enterica enterica serovar Typhi Ty2
acaauaaucgcgagaaaauaga

SEQ ID NO: 3729916 - RNA, 17 nt, Salmonella enterica enterica serovar Typhi Ty2
acaauaccaauaagaac

SEQ ID NO: 3729917 - RNA, 18 nt, Salmonella enterica enterica serovar Typhi Ty2
acaauacuuaaaccugcg

SEQ ID NO: 3729918 - RNA, 18 nt, Salmonella enterica enterica serovar Typhi Ty2
acaauagcgcuaaacagc

SEQ ID NO: 3729919 - RNA, 23 nt, Salmonella enterica enterica serovar Typhi Ty2
acaauagcgcuaaacagcgccgc

SEQ ID NO: 3729920 - RNA, 14 nt, Salmonella enterica enterica serovar Typhi Ty2
acaauaucaucguc

SEQ ID NO: 3729921 - RNA, 18 nt, Salmonella enterica enterica serovar Typhi Ty2
acaauauccucgcauccu

SEQ ID NO: 3729922 - RNA, 12 nt, Salmonella enterica enterica serovar Typhi Ty2
acaaucagaaga

SEQ ID NO: 3729923 - RNA, 15 nt, Salmonella enterica enterica serovar Typhi Ty2
acaaucagaagaaau

SEQ ID NO: 3729924 - RNA, 15 nt, Salmonella enterica enterica serovar Typhi Ty2
acaaucagcacacua

SEQ ID NO: 3729925 - RNA, 17 nt, Salmonella enterica enterica serovar Typhi Ty2
acaaucagcacacuaca

SEQ ID NO: 3729926 - RNA, 14 nt, Salmonella enterica enterica serovar Typhi Ty2
acaaucagcaccau

SEQ ID NO: 3729927 - RNA, 20 nt, Salmonella enterica enterica serovar Typhi Ty2
acaaucaggcugcggaugau

SEQ ID NO: 3729928 - RNA, 14 nt, Salmonella enterica enterica serovar Typhi Ty2
acaaucccgccaga

SEQ ID NO: 3729929 - RNA, 16 nt, Salmonella enterica enterica serovar Typhi Ty2
acaauccgacgcucaa

SEQ ID NO: 3729930 - RNA, 18 nt, Salmonella enterica enterica serovar Typhi Ty2
acaauccguuauuucaca

SEQ ID NO: 3729931 - RNA, 19 nt, Salmonella enterica enterica serovar Typhi Ty2
acaaucgccgugaucccaa

SEQ ID NO: 3729932 - RNA, 17 nt, Salmonella enterica enterica serovar Typhi Ty2
acaaucguuaauucaug

SEQ ID NO: 3729933 - RNA, 15 nt, Salmonella enterica enterica serovar Typhi Ty2
acaaugaauccucgg

SEQ ID NO: 3729934 - RNA, 18 nt, Salmonella enterica enterica serovar Typhi Ty2
acaaugaucagacgcaca

SEQ ID NO: 3729935 - RNA, 16 nt, Salmonella enterica enterica serovar Typhi Ty2
acaaugccacgccccu

SEQ ID NO: 3729936 - RNA, 22 nt, Salmonella enterica enterica serovar Typhi Ty2
acaaugccauuauugcaucaau

SEQ ID NO: 3729937 - RNA, 13 nt, Salmonella enterica enterica serovar Typhi Ty2
acaaugcccggca

SEQ ID NO: 3729938 - RNA, 14 nt, Salmonella enterica enterica serovar Typhi Ty2
acaaugcccggcau

SEQ ID NO: 3729939 - RNA, 14 nt, Salmonella enterica enterica serovar Typhi Ty2
acaaugcugacacu

SEQ ID NO: 3729940 - RNA, 21 nt, Salmonella enterica enterica serovar Typhi Ty2
acaauggcgacgaucagcgcc

SEQ ID NO: 3729941 - RNA, 14 nt, Salmonella enterica enterica serovar Typhi Ty2
acaauguacagaau

SEQ ID NO: 3729942 - RNA, 22 nt, Salmonella enterica enterica serovar Typhi Ty2
acaaugugccggauggcgcuaa

SEQ ID NO: 3729943 - RNA, 14 nt, Salmonella enterica enterica serovar Typhi Ty2
acaauucauagcca

SEQ ID NO: 3729944 - RNA, 21 nt, Salmonella enterica enterica serovar Typhi Ty2
acaauucauagccacagcgcg

SEQ ID NO: 3729945 - RNA, 17 nt, Salmonella enterica enterica serovar Typhi Ty2
acaauuccggcccaggc

SEQ ID NO: 3729946 - RNA, 21 nt, Salmonella enterica enterica serovar Typhi Ty2
acaauugcugcguaacugcca

SEQ ID NO: 3729947 - RNA, 13 nt, Salmonella enterica enterica serovar Typhi Ty2
acaauuuaucugc

SEQ ID NO: 3729948 - RNA, 22 nt, Salmonella enterica enterica serovar Typhi Ty2
acaauuucccccacuucugaca

SEQ ID NO: 3729949 - RNA, 12 nt, Salmonella enterica enterica serovar Typhi Ty2
acaauuucuggc

SEQ ID NO: 3729950 - RNA, 15 nt, Salmonella enterica enterica serovar Typhi Ty2
acaauuugcccagcg

SEQ ID NO: 3729951 - RNA, 18 nt, Salmonella enterica enterica serovar Typhi Ty2
acaauuuugauaagagaa

SEQ ID NO: 3729952 - RNA, 22 nt, Salmonella enterica enterica serovar Typhi Ty2
acacaaaagcaucguaccuuca

SEQ ID NO: 3729953 - RNA, 13 nt, Salmonella enterica enterica serovar Typhi Ty2
acacaacggcaca

SEQ ID NO: 3729954 - RNA, 15 nt, Salmonella enterica enterica serovar Typhi Ty2
acacaauagcaaucu

SEQ ID NO: 3729955 - RNA, 13 nt, Salmonella enterica enterica serovar Typhi Ty2
acacaauuuucuu

SEQ ID NO: 3729956 - RNA, 15 nt, Salmonella enterica enterica serovar Typhi Ty2
acacacaacuaagug

SEQ ID NO: 3729957 - RNA, 14 nt, Salmonella enterica enterica serovar Typhi Ty2
acacacgcgcugac

SEQ ID NO: 3729958 - RNA, 19 nt, Salmonella enterica enterica serovar Typhi Ty2
acacacguaacaaccagaa

SEQ ID NO: 3729959 - RNA, 15 nt, Salmonella enterica enterica serovar Typhi Ty2
acacacucaucuucg

SEQ ID NO: 3729960 - RNA, 21 nt, Salmonella enterica enterica serovar Typhi Ty2
acacacucggugcauuugucg

SEQ ID NO: 3729961 - RNA, 20 nt, Salmonella enterica enterica serovar Typhi Ty2
acacagaaaaaccaaaaaau

SEQ ID NO: 3729962 - RNA, 22 nt, Salmonella enterica enterica serovar Typhi Ty2
acacagaugacaaagccggaua

SEQ ID NO: 3729963 - RNA, 13 nt, Salmonella enterica enterica serovar Typhi Ty2
acacagcagaaag

SEQ ID NO: 3729964 - RNA, 15 nt, Salmonella enterica enterica serovar Typhi Ty2
acacagcagaaagca

SEQ ID NO: 3729965 - RNA, 13 nt, Salmonella enterica enterica serovar Typhi Ty2
acacagcgucgcg

SEQ ID NO: 3729966 - RNA, 15 nt, Salmonella enterica enterica serovar Typhi Ty2
acacagcgucgcgcg

SEQ ID NO: 3729967 - RNA, 22 nt, Salmonella enterica enterica serovar Typhi Ty2
acacagggucgucaaacuuuua

SEQ ID NO: 3729968 - RNA, 14 nt, Salmonella enterica enterica serovar Typhi Ty2
acacaguaaaaaaa

SEQ ID NO: 3729969 - RNA, 19 nt, Salmonella enterica enterica serovar Typhi Ty2
acacagucucauugaucag

SEQ ID NO: 3729970 - RNA, 18 nt, Salmonella enterica enterica serovar Typhi Ty2
acacauaucgccagccau

SEQ ID NO: 3729971 - RNA, 15 nt, Salmonella enterica enterica serovar Typhi Ty2
acacaucacaaucuc

SEQ ID NO: 3729972 - RNA, 21 nt, Salmonella enterica enterica serovar Typhi Ty2
acacaugcaaaaaagcccauc

SEQ ID NO: 3729973 - RNA, 18 nt, Salmonella enterica enterica serovar Typhi Ty2
acaccaacggcgacgccc

SEQ ID NO: 3729974 - RNA, 16 nt, Salmonella enterica enterica serovar Typhi Ty2
acaccaccgcucguuc

SEQ ID NO: 3729975 - RNA, 15 nt, Salmonella enterica enterica serovar Typhi Ty2
acaccacgcaggcga

SEQ ID NO: 3729976 - RNA, 16 nt, Salmonella enterica enterica serovar Typhi Ty2
acaccacgccggaauc

SEQ ID NO: 3729977 - RNA, 19 nt, Salmonella enterica enterica serovar Typhi Ty2
acaccacuaaacgcgaucu

SEQ ID NO: 3729978 - RNA, 21 nt, Salmonella enterica enterica serovar Typhi Ty2
acaccagcccuggcuguccuu

SEQ ID NO: 3729979 - RNA, 15 nt, Salmonella enterica enterica serovar Typhi Ty2
acaccagccguucac

SEQ ID NO: 3729980 - RNA, 19 nt, Salmonella enterica enterica serovar Typhi Ty2
acaccagcgcaugacggua

SEQ ID NO: 3729981 - RNA, 20 nt, Salmonella enterica enterica serovar Typhi Ty2
acaccagggauuuugcuuuu

SEQ ID NO: 3729982 - RNA, 15 nt, Salmonella enterica enterica serovar Typhi Ty2
acacccgcagccaga

SEQ ID NO: 3729983 - RNA, 15 nt, Salmonella enterica enterica serovar Typhi Ty2
acacccucugcgccu

SEQ ID NO: 3729984 - RNA, 14 nt, Salmonella enterica enterica serovar Typhi Ty2
acaccgcaaaccgu

SEQ ID NO: 3729985 - RNA, 21 nt, Salmonella enterica enterica serovar Typhi Ty2
acaccgccuagcgucccggca

SEQ ID NO: 3729986 - RNA, 22 nt, Salmonella enterica enterica serovar Typhi Ty2
acaccgccuagcgucccggcaa

SEQ ID NO: 3729987 - RNA, 14 nt, Salmonella enterica enterica serovar Typhi Ty2
acaccgcuugccgg

SEQ ID NO: 3729988 - RNA, 13 nt, Salmonella enterica enterica serovar Typhi Ty2
acaccggccugcc

SEQ ID NO: 3729989 - RNA, 21 nt, Salmonella enterica enterica serovar Typhi Ty2
acaccguauccggccugcagg

SEQ ID NO: 3729990 - RNA, 23 nt, Salmonella enterica enterica serovar Typhi Ty2
acaccguuuaucguuaccggcuc

SEQ ID NO: 3729991 - RNA, 23 nt, Salmonella enterica enterica serovar Typhi Ty2
acaccugcuggucaccuggcugg

SEQ ID NO: 3729992 - RNA, 20 nt, Salmonella enterica enterica serovar Typhi Ty2
acaccuguaacgucacauuc

SEQ ID NO: 3729993 - RNA, 20 nt, Salmonella enterica enterica serovar Typhi Ty2
acaccuuuggggaaagguaa

SEQ ID NO: 3729994 - RNA, 14 nt, Salmonella enterica enterica serovar Typhi Ty2
acacgaacacagaa

SEQ ID NO: 3729995 - RNA, 14 nt, Salmonella enterica enterica serovar Typhi Ty2
acacgaccagcgac

SEQ ID NO: 3729996 - RNA, 16 nt, Salmonella enterica enterica serovar Typhi Ty2
acacgauaaaccucac

SEQ ID NO: 3729997 - RNA, 17 nt, Salmonella enterica enterica serovar Typhi Ty2
acacgauccccaucgau

SEQ ID NO: 3729998 - RNA, 14 nt, Salmonella enterica enterica serovar Typhi Ty2
acacgauggcaaau

SEQ ID NO: 3729999 - RNA, 18 nt, Salmonella enterica enterica serovar Typhi Ty2
acacgccacaaacugcgc

SEQ ID NO: 3730000 - RNA, 14 nt, Salmonella enterica enterica serovar Typhi Ty2
acacgcgaauagcc

SEQ ID NO: 3730001 - RNA, 17 nt, Salmonella enterica enterica serovar Typhi Ty2
acacgcgcgcugcgccu

SEQ ID NO: 3730002 - RNA, 16 nt, Salmonella enterica enterica serovar Typhi Ty2
acacgcguaaacuucc

SEQ ID NO: 3730003 - RNA, 14 nt, Salmonella enterica enterica serovar Typhi Ty2
acacgcucauguuc

SEQ ID NO: 3730004 - RNA, 17 nt, Salmonella enterica enterica serovar Typhi Ty2
acacgcuggaagagaac

SEQ ID NO: 3730005 - RNA, 16 nt, Salmonella enterica enterica serovar Typhi Ty2
acacgcuuagcuugcc

SEQ ID NO: 3730006 - RNA, 19 nt, Salmonella enterica enterica serovar Typhi Ty2
acacgcuuuucagcgccag

SEQ ID NO: 3730007 - RNA, 14 nt, Salmonella enterica enterica serovar Typhi Ty2
acacggcgcucagg

SEQ ID NO: 3730008 - RNA, 17 nt, Salmonella enterica enterica serovar Typhi Ty2
acacggcgcucaggauc

SEQ ID NO: 3730009 - RNA, 12 nt, Salmonella enterica enterica serovar Typhi Ty2
acacggcggcua

SEQ ID NO: 3730010 - RNA, 16 nt, Salmonella enterica enterica serovar Typhi Ty2
acacggggcgguaccg

SEQ ID NO: 3730011 - RNA, 16 nt, Salmonella enterica enterica serovar Typhi Ty2
acacggugugccgcca

SEQ ID NO: 3730012 - RNA, 19 nt, Salmonella enterica enterica serovar Typhi Ty2
acacguaauucauuacgaa

SEQ ID NO: 3730013 - RNA, 14 nt, Salmonella enterica enterica serovar Typhi Ty2
acacguugcgacaa

SEQ ID NO: 3730014 - RNA, 13 nt, Salmonella enterica enterica serovar Typhi Ty2
acacuaaaucaua

SEQ ID NO: 3730015 - RNA, 22 nt, Salmonella enterica enterica serovar Typhi Ty2
acacuaacuaauuguuuguaga

SEQ ID NO: 3730016 - RNA, 13 nt, Salmonella enterica enterica serovar Typhi Ty2
acacuauauugcg

SEQ ID NO: 3730017 - RNA, 18 nt, Salmonella enterica enterica serovar Typhi Ty2
acacucacaaaacuauuu

SEQ ID NO: 3730018 - RNA, 23 nt, Salmonella enterica enterica serovar Typhi Ty2
acacuccggcgcgcgcgccaucg

SEQ ID NO: 3730019 - RNA, 12 nt, Salmonella enterica enterica serovar Typhi Ty2
acacucgcggau

SEQ ID NO: 3730020 - RNA, 15 nt, Salmonella enterica enterica serovar Typhi Ty2
acacucgcggauaau

SEQ ID NO: 3730021 - RNA, 13 nt, Salmonella enterica enterica serovar Typhi Ty2
acacucucuccag

SEQ ID NO: 3730022 - RNA, 14 nt, Salmonella enterica enterica serovar Typhi Ty2
acacugaaacuccg

SEQ ID NO: 3730023 - RNA, 15 nt, Salmonella enterica enterica serovar Typhi Ty2
acacugaagccuggu

SEQ ID NO: 3730024 - RNA, 15 nt, Salmonella enterica enterica serovar Typhi Ty2
acacugccaccgcuc

SEQ ID NO: 3730025 - RNA, 22 nt, Salmonella enterica enterica serovar Typhi Ty2
acacuggaaacagccaaucaua

SEQ ID NO: 3730026 - RNA, 19 nt, Salmonella enterica enterica serovar Typhi Ty2
acacuuaccgacgcgcggu

SEQ ID NO: 3730027 - RNA, 14 nt, Salmonella enterica enterica serovar Typhi Ty2
acacuucagccaga

SEQ ID NO: 3730028 - RNA, 18 nt, Salmonella enterica enterica serovar Typhi Ty2
acacuucucaacauugac

SEQ ID NO: 3730029 - RNA, 21 nt, Salmonella enterica enterica serovar Typhi Ty2
acacuugcaacucgcacugau

SEQ ID NO: 3730030 - RNA, 14 nt, Salmonella enterica enterica serovar Typhi Ty2
acacuuucaucagc

SEQ ID NO: 3730031 - RNA, 16 nt, Salmonella enterica enterica serovar Typhi Ty2
acacuuucgcccggcg

SEQ ID NO: 3730032 - RNA, 17 nt, Salmonella enterica enterica serovar Typhi Ty2
acacuuucgcccggcgc

SEQ ID NO: 3730033 - RNA, 20 nt, Salmonella enterica enterica serovar Typhi Ty2
acagaaaaaaugcaccgccu

SEQ ID NO: 3730034 - RNA, 22 nt, Salmonella enterica enterica serovar Typhi Ty2
acagaaaaucacaaauaacaga

SEQ ID NO: 3730035 - RNA, 13 nt, Salmonella enterica enterica serovar Typhi Ty2
acagaacugauuu

SEQ ID NO: 3730036 - RNA, 13 nt, Salmonella enterica enterica serovar Typhi Ty2
acagaagcggccu

SEQ ID NO: 3730037 - RNA, 22 nt, Salmonella enterica enterica serovar Typhi Ty2
acagaaucaacgccacaccgag

SEQ ID NO: 3730038 - RNA, 13 nt, Salmonella enterica enterica serovar Typhi Ty2
acagaaucaucag

SEQ ID NO: 3730039 - RNA, 18 nt, Salmonella enterica enterica serovar Typhi Ty2
acagaaucaucaggcuau

SEQ ID NO: 3730040 - RNA, 14 nt, Salmonella enterica enterica serovar Typhi Ty2
acagaaucgcgaua

SEQ ID NO: 3730041 - RNA, 14 nt, Salmonella enterica enterica serovar Typhi Ty2
acagacaaggugga

SEQ ID NO: 3730042 - RNA, 13 nt, Salmonella enterica enterica serovar Typhi Ty2
acagacaauacca

SEQ ID NO: 3730043 - RNA, 13 nt, Salmonella enterica enterica serovar Typhi Ty2
acagacagcguaa

SEQ ID NO: 3730044 - RNA, 22 nt, Salmonella enterica enterica serovar Typhi Ty2
acagacccaguacaaacaaaua

SEQ ID NO: 3730045 - RNA, 23 nt, Salmonella enterica enterica serovar Typhi Ty2
acagaccccgcaucgcccgcucc

SEQ ID NO: 3730046 - RNA, 12 nt, Salmonella enterica enterica serovar Typhi Ty2
acagaccgccau

SEQ ID NO: 3730047 - RNA, 22 nt, Salmonella enterica enterica serovar Typhi Ty2
acagaccgccaugcggcgccau

SEQ ID NO: 3730048 - RNA, 19 nt, Salmonella enterica enterica serovar Typhi Ty2
acagaccuaaauaagcgcc

SEQ ID NO: 3730049 - RNA, 13 nt, Salmonella enterica enterica serovar Typhi Ty2
acagacgaaaaaa

SEQ ID NO: 3730050 - RNA, 14 nt, Salmonella enterica enterica serovar Typhi Ty2
acagacgcaggccg

SEQ ID NO: 3730051 - RNA, 19 nt, Salmonella enterica enterica serovar Typhi Ty2
acagacgccuuucagacuu

SEQ ID NO: 3730052 - RNA, 12 nt, Salmonella enterica enterica serovar Typhi Ty2
acagacgcugcg

SEQ ID NO: 3730053 - RNA, 17 nt, Salmonella enterica enterica serovar Typhi Ty2
acagacuucauuuucca

SEQ ID NO: 3730054 - RNA, 16 nt, Salmonella enterica enterica serovar Typhi Ty2
acagagaagcugugcc

SEQ ID NO: 3730055 - RNA, 15 nt, Salmonella enterica enterica serovar Typhi Ty2
acagagaaugcgccg

SEQ ID NO: 3730056 - RNA, 18 nt, Salmonella enterica enterica serovar Typhi Ty2
acagagagggaaaaaaau

SEQ ID NO: 3730057 - RNA, 22 nt, Salmonella enterica enterica serovar Typhi Ty2
acagagaucgugcauccggacg

SEQ ID NO: 3730058 - RNA, 13 nt, Salmonella enterica enterica serovar Typhi Ty2
acagaggaaugaa

SEQ ID NO: 3730059 - RNA, 18 nt, Salmonella enterica enterica serovar Typhi Ty2
acagaggaaugaaaacga

SEQ ID NO: 3730060 - RNA, 21 nt, Salmonella enterica enterica serovar Typhi Ty2
acagagucgcuuaucugcugc

SEQ ID NO: 3730061 - RNA, 18 nt, Salmonella enterica enterica serovar Typhi Ty2
acagagucguuagcagaa

SEQ ID NO: 3730062 - RNA, 14 nt, Salmonella enterica enterica serovar Typhi Ty2
acagauaacaccag

SEQ ID NO: 3730063 - RNA, 17 nt, Salmonella enterica enterica serovar Typhi Ty2
acagauaagcgucugca

SEQ ID NO: 3730064 - RNA, 14 nt, Salmonella enterica enterica serovar Typhi Ty2
acagauaauuaaua

SEQ ID NO: 3730065 - RNA, 16 nt, Salmonella enterica enterica serovar Typhi Ty2
acagauacggcgcguc

SEQ ID NO: 3730066 - RNA, 15 nt, Salmonella enterica enterica serovar Typhi Ty2
acagaugccuuguaa

SEQ ID NO: 3730067 - RNA, 21 nt, Salmonella enterica enterica serovar Typhi Ty2
acagaugccuuguaagccgga

SEQ ID NO: 3730068 - RNA, 20 nt, Salmonella enterica enterica serovar Typhi Ty2
acagauggcgcugcguuucc

SEQ ID NO: 3730069 - RNA, 12 nt, Salmonella enterica enterica serovar Typhi Ty2
acagauuaucag

SEQ ID NO: 3730070 - RNA, 17 nt, Salmonella enterica enterica serovar Typhi Ty2
acagauuuccacgaucu

SEQ ID NO: 3730071 - RNA, 22 nt, Salmonella enterica enterica serovar Typhi Ty2
acagauuuugcacuuuugccag

SEQ ID NO: 3730072 - RNA, 16 nt, Salmonella enterica enterica serovar Typhi Ty2
acagcaauaucagcca

SEQ ID NO: 3730073 - RNA, 16 nt, Salmonella enterica enterica serovar Typhi Ty2
acagcaaugcccaaaa

SEQ ID NO: 3730074 - RNA, 13 nt, Salmonella enterica enterica serovar Typhi Ty2
acagcacauagaa

SEQ ID NO: 3730075 - RNA, 14 nt, Salmonella enterica enterica serovar Typhi Ty2
acagcaccagcagg

SEQ ID NO: 3730076 - RNA, 20 nt, Salmonella enterica enterica serovar Typhi Ty2
acagcacuaacgaggccacc

SEQ ID NO: 3730077 - RNA, 18 nt, Salmonella enterica enterica serovar Typhi Ty2
acagcagaauauugcuga

SEQ ID NO: 3730078 - RNA, 14 nt, Salmonella enterica enterica serovar Typhi Ty2
acagcagcgcggca

SEQ ID NO: 3730079 - RNA, 22 nt, Salmonella enterica enterica serovar Typhi Ty2
acagcagcgcggcacacagcac

SEQ ID NO: 3730080 - RNA, 17 nt, Salmonella enterica enterica serovar Typhi Ty2
acagcaggcuuugcugc

SEQ ID NO: 3730081 - RNA, 21 nt, Salmonella enterica enterica serovar Typhi Ty2
acagcaguucgauaaucccgg

SEQ ID NO: 3730082 - RNA, 12 nt, Salmonella enterica enterica serovar Typhi Ty2
acagccaaaaau

SEQ ID NO: 3730083 - RNA, 22 nt, Salmonella enterica enterica serovar Typhi Ty2
acagccaaacugcuguagcugu

SEQ ID NO: 3730084 - RNA, 15 nt, Salmonella enterica enterica serovar Typhi Ty2
acagccaaucauaaa

SEQ ID NO: 3730085 - RNA, 13 nt, Salmonella enterica enterica serovar Typhi Ty2
acagccauccgac

SEQ ID NO: 3730086 - RNA, 22 nt, Salmonella enterica enterica serovar Typhi Ty2
acagcccauaccacaacagaau

SEQ ID NO: 3730087 - RNA, 18 nt, Salmonella enterica enterica serovar Typhi Ty2
acagcccgccagcaccag

SEQ ID NO: 3730088 - RNA, 16 nt, Salmonella enterica enterica serovar Typhi Ty2
acagccgcauuuuuuc

SEQ ID NO: 3730089 - RNA, 21 nt, Salmonella enterica enterica serovar Typhi Ty2
acagccuaaaaaaccggccca

SEQ ID NO: 3730090 - RNA, 17 nt, Salmonella enterica enterica serovar Typhi Ty2
acagcgacacuccgcgc

SEQ ID NO: 3730091 - RNA, 15 nt, Salmonella enterica enterica serovar Typhi Ty2
acagcgccagaauag

SEQ ID NO: 3730092 - RNA, 12 nt, Salmonella enterica enterica serovar Typhi Ty2
acagcgccauca

SEQ ID NO: 3730093 - RNA, 19 nt, Salmonella enterica enterica serovar Typhi Ty2
acagcgccgcgcaagcgau

SEQ ID NO: 3730094 - RNA, 19 nt, Salmonella enterica enterica serovar Typhi Ty2
acagcgcgaccaggaaacc

SEQ ID NO: 3730095 - RNA, 20 nt, Salmonella enterica enterica serovar Typhi Ty2
acagcgcgccaauccaugcc

SEQ ID NO: 3730096 - RNA, 22 nt, Salmonella enterica enterica serovar Typhi Ty2
acagcgcgcgcgacggcagccu

SEQ ID NO: 3730097 - RNA, 19 nt, Salmonella enterica enterica serovar Typhi Ty2
acagcgcuccacgcguccu

SEQ ID NO: 3730098 - RNA, 23 nt, Salmonella enterica enterica serovar Typhi Ty2
acagcgcuuuaguacgcguucac

SEQ ID NO: 3730099 - RNA, 13 nt, Salmonella enterica enterica serovar Typhi Ty2
acagcggaaaauc

SEQ ID NO: 3730100 - RNA, 21 nt, Salmonella enterica enterica serovar Typhi Ty2
acagcggacacccgcagccag

SEQ ID NO: 3730101 - RNA, 12 nt, Salmonella enterica enterica serovar Typhi Ty2
acagcggagaga

SEQ ID NO: 3730102 - RNA, 13 nt, Salmonella enterica enterica serovar Typhi Ty2
acagcggagagac

SEQ ID NO: 3730103 - RNA, 22 nt, Salmonella enterica enterica serovar Typhi Ty2
acagcggauuacgcgccugccu

SEQ ID NO: 3730104 - RNA, 14 nt, Salmonella enterica enterica serovar Typhi Ty2
acagcggcaggcgg

SEQ ID NO: 3730105 - RNA, 21 nt, Salmonella enterica enterica serovar Typhi Ty2
acagcggcggcaguugccgga

SEQ ID NO: 3730106 - RNA, 20 nt, Salmonella enterica enterica serovar Typhi Ty2
acagcggcucgaacuguucu

SEQ ID NO: 3730107 - RNA, 23 nt, Salmonella enterica enterica serovar Typhi Ty2
acagcgggguaaagccuuuaugc

SEQ ID NO: 3730108 - RNA, 14 nt, Salmonella enterica enterica serovar Typhi Ty2
acagcguaaauaag

SEQ ID NO: 3730109 - RNA, 22 nt, Salmonella enterica enterica serovar Typhi Ty2
acagcguaaugcgccaggcagc

SEQ ID NO: 3730110 - RNA, 15 nt, Salmonella enterica enterica serovar Typhi Ty2
acagcguacaauggc

SEQ ID NO: 3730111 - RNA, 13 nt, Salmonella enterica enterica serovar Typhi Ty2
acagcguacaggc

SEQ ID NO: 3730112 - RNA, 21 nt, Salmonella enterica enterica serovar Typhi Ty2
acagcguaguuuauucaucuc

SEQ ID NO: 3730113 - RNA, 15 nt, Salmonella enterica enterica serovar Typhi Ty2
acagcguauuaagcc

SEQ ID NO: 3730114 - RNA, 14 nt, Salmonella enterica enterica serovar Typhi Ty2
acagcgucauccag

SEQ ID NO: 3730115 - RNA, 13 nt, Salmonella enterica enterica serovar Typhi Ty2
acagcucaccccu

SEQ ID NO: 3730116 - RNA, 19 nt, Salmonella enterica enterica serovar Typhi Ty2
acagcuuaaucaccagcgc

SEQ ID NO: 3730117 - RNA, 16 nt, Salmonella enterica enterica serovar Typhi Ty2
acagcuuagcuguaau

SEQ ID NO: 3730118 - RNA, 23 nt, Salmonella enterica enterica serovar Typhi Ty2
acagcuucaggcucaucagcgcc

SEQ ID NO: 3730119 - RNA, 19 nt, Salmonella enterica enterica serovar Typhi Ty2
acaggaacaucguguccug

SEQ ID NO: 3730120 - RNA, 13 nt, Salmonella enterica enterica serovar Typhi Ty2
acaggaacgccgu

SEQ ID NO: 3730121 - RNA, 17 nt, Salmonella enterica enterica serovar Typhi Ty2
acaggaagcagcuugcu

SEQ ID NO: 3730122 - RNA, 16 nt, Salmonella enterica enterica serovar Typhi Ty2
acaggaauaaccacug

SEQ ID NO: 3730123 - RNA, 15 nt, Salmonella enterica enterica serovar Typhi Ty2
acaggaauuccaguc

SEQ ID NO: 3730124 - RNA, 21 nt, Salmonella enterica enterica serovar Typhi Ty2
acaggacgccagcgcggcaug

SEQ ID NO: 3730125 - RNA, 20 nt, Salmonella enterica enterica serovar Typhi Ty2
acaggaguuagcauguggga

SEQ ID NO: 3730126 - RNA, 19 nt, Salmonella enterica enterica serovar Typhi Ty2
acaggcaggcccgcgcuuu

SEQ ID NO: 3730127 - RNA, 16 nt, Salmonella enterica enterica serovar Typhi Ty2
acaggcagguugccga

SEQ ID NO: 3730128 - RNA, 13 nt, Salmonella enterica enterica serovar Typhi Ty2
acaggcauggccu

SEQ ID NO: 3730129 - RNA, 16 nt, Salmonella enterica enterica serovar Typhi Ty2
acaggcauggccuuca

SEQ ID NO: 3730130 - RNA, 19 nt, Salmonella enterica enterica serovar Typhi Ty2
acaggccaaacccugcgcc

SEQ ID NO: 3730131 - RNA, 20 nt, Salmonella enterica enterica serovar Typhi Ty2
acaggccaacauagcggcaa

SEQ ID NO: 3730132 - RNA, 20 nt, Salmonella enterica enterica serovar Typhi Ty2
acaggccgccauaagaaugu

SEQ ID NO: 3730133 - RNA, 23 nt, Salmonella enterica enterica serovar Typhi Ty2
acaggcgcaggcauuaaaaaaac

SEQ ID NO: 3730134 - RNA, 15 nt, Salmonella enterica enterica serovar Typhi Ty2
acaggcgcauacgau

SEQ ID NO: 3730135 - RNA, 14 nt, Salmonella enterica enterica serovar Typhi Ty2
acaggcgcaucaga

SEQ ID NO: 3730136 - RNA, 17 nt, Salmonella enterica enterica serovar Typhi Ty2
acaggcgcaucagaaaa

SEQ ID NO: 3730137 - RNA, 22 nt, Salmonella enterica enterica serovar Typhi Ty2
acaggcgcaucagaaaaaccuc

SEQ ID NO: 3730138 - RNA, 18 nt, Salmonella enterica enterica serovar Typhi Ty2
acaggcgcggagacguga

SEQ ID NO: 3730139 - RNA, 16 nt, Salmonella enterica enterica serovar Typhi Ty2
acaggcggaugaaaca

SEQ ID NO: 3730140 - RNA, 13 nt, Salmonella enterica enterica serovar Typhi Ty2
acaggcugacaaa

SEQ ID NO: 3730141 - RNA, 16 nt, Salmonella enterica enterica serovar Typhi Ty2
acaggcugucugccau

SEQ ID NO: 3730142 - RNA, 16 nt, Salmonella enterica enterica serovar Typhi Ty2
acaggcuuuucaggcu

SEQ ID NO: 3730143 - RNA, 22 nt, Salmonella enterica enterica serovar Typhi Ty2
acaggcuuuucaggcuguggcu

SEQ ID NO: 3730144 - RNA, 17 nt, Salmonella enterica enterica serovar Typhi Ty2
acagggcgaugccucac

SEQ ID NO: 3730145 - RNA, 15 nt, Salmonella enterica enterica serovar Typhi Ty2
acagggcggccuccu

SEQ ID NO: 3730146 - RNA, 18 nt, Salmonella enterica enterica serovar Typhi Ty2
acagggcggcgcgcugcc

SEQ ID NO: 3730147 - RNA, 23 nt, Salmonella enterica enterica serovar Typhi Ty2
acagggcguuuuauaagccgauc

SEQ ID NO: 3730148 - RNA, 23 nt, Salmonella enterica enterica serovar Typhi Ty2
acaggguuugccagcaccagcag

SEQ ID NO: 3730149 - RNA, 13 nt, Salmonella enterica enterica serovar Typhi Ty2
acagguaaaacaa

SEQ ID NO: 3730150 - RNA, 14 nt, Salmonella enterica enterica serovar Typhi Ty2
acagguaaaacaaa

SEQ ID NO: 3730151 - RNA, 19 nt, Salmonella enterica enterica serovar Typhi Ty2
acaggucgaugauuuucaa

SEQ ID NO: 3730152 - RNA, 15 nt, Salmonella enterica enterica serovar Typhi Ty2
acaggucggccaacc

SEQ ID NO: 3730153 - RNA, 17 nt, Salmonella enterica enterica serovar Typhi Ty2
acaggugaccaggcuuc

SEQ ID NO: 3730154 - RNA, 22 nt, Salmonella enterica enterica serovar Typhi Ty2
acagguuaacgaagguaaacgc

SEQ ID NO: 3730155 - RNA, 18 nt, Salmonella enterica enterica serovar Typhi Ty2
acagguugcguaacgcca

SEQ ID NO: 3730156 - RNA, 20 nt, Salmonella enterica enterica serovar Typhi Ty2
acagguugcguaacgccaca

SEQ ID NO: 3730157 - RNA, 22 nt, Salmonella enterica enterica serovar Typhi Ty2
acagguugcguaacgccacaua

SEQ ID NO: 3730158 - RNA, 17 nt, Salmonella enterica enterica serovar Typhi Ty2
acaguaaaaaaacgccu

SEQ ID NO: 3730159 - RNA, 12 nt, Salmonella enterica enterica serovar Typhi Ty2
acaguacgcccg

SEQ ID NO: 3730160 - RNA, 15 nt, Salmonella enterica enterica serovar Typhi Ty2
acaguacgccgaggg

SEQ ID NO: 3730161 - RNA, 21 nt, Salmonella enterica enterica serovar Typhi Ty2
acaguagagggggaccucauc

SEQ ID NO: 3730162 - RNA, 19 nt, Salmonella enterica enterica serovar Typhi Ty2
acaguauuuguucagacac

SEQ ID NO: 3730163 - RNA, 14 nt, Salmonella enterica enterica serovar Typhi Ty2
acagucgcagagcc

SEQ ID NO: 3730164 - RNA, 14 nt, Salmonella enterica enterica serovar Typhi Ty2
acagugaguacgca

SEQ ID NO: 3730165 - RNA, 21 nt, Salmonella enterica enterica serovar Typhi Ty2
acagugauuacaaaaugugca

SEQ ID NO: 3730166 - RNA, 20 nt, Salmonella enterica enterica serovar Typhi Ty2
acagugauuuacuccaaaaa

SEQ ID NO: 3730167 - RNA, 13 nt, Salmonella enterica enterica serovar Typhi Ty2
acagugcgccaua

SEQ ID NO: 3730168 - RNA, 18 nt, Salmonella enterica enterica serovar Typhi Ty2
acaguggaaaguaccaaa

SEQ ID NO: 3730169 - RNA, 16 nt, Salmonella enterica enterica serovar Typhi Ty2
acagugggcuaugaag

SEQ ID NO: 3730170 - RNA, 16 nt, Salmonella enterica enterica serovar Typhi Ty2
acaguguaaacgccag

SEQ ID NO: 3730171 - RNA, 23 nt, Salmonella enterica enterica serovar Typhi Ty2
acaguguugauugaaacucgcca

SEQ ID NO: 3730172 - RNA, 20 nt, Salmonella enterica enterica serovar Typhi Ty2
acaguucaaacggcccggcg

SEQ ID NO: 3730173 - RNA, 18 nt, Salmonella enterica enterica serovar Typhi Ty2
acaguucagacaccacgc

SEQ ID NO: 3730174 - RNA, 19 nt, Salmonella enterica enterica serovar Typhi Ty2
acaguucauuucaggcaaa

SEQ ID NO: 3730175 - RNA, 18 nt, Salmonella enterica enterica serovar Typhi Ty2
acaguugcgacugauaac

SEQ ID NO: 3730176 - RNA, 17 nt, Salmonella enterica enterica serovar Typhi Ty2
acaguuugugccgccac

SEQ ID NO: 3730177 - RNA, 20 nt, Salmonella enterica enterica serovar Typhi Ty2
acauaaaaugguuauugcuu

SEQ ID NO: 3730178 - RNA, 22 nt, Salmonella enterica enterica serovar Typhi Ty2
acauaaacagcgugaacacgcc

SEQ ID NO: 3730179 - RNA, 21 nt, Salmonella enterica enterica serovar Typhi Ty2
acauaacgcgauagauaccau

SEQ ID NO: 3730180 - RNA, 13 nt, Salmonella enterica enterica serovar Typhi Ty2
acauaaguaaaua

SEQ ID NO: 3730181 - RNA, 16 nt, Salmonella enterica enterica serovar Typhi Ty2
acauaagugcaggcug

SEQ ID NO: 3730182 - RNA, 20 nt, Salmonella enterica enterica serovar Typhi Ty2
acauaauguaaaggugagcu

SEQ ID NO: 3730183 - RNA, 21 nt, Salmonella enterica enterica serovar Typhi Ty2
acauaauuuccggccaguagc

SEQ ID NO: 3730184 - RNA, 23 nt, Salmonella enterica enterica serovar Typhi Ty2
acauacaccggcgccagcucugc

SEQ ID NO: 3730185 - RNA, 23 nt, Salmonella enterica enterica serovar Typhi Ty2
acauacugaaauuucuuuuccag

SEQ ID NO: 3730186 - RNA, 15 nt, Salmonella enterica enterica serovar Typhi Ty2
acauagaaaauauau

SEQ ID NO: 3730187 - RNA, 21 nt, Salmonella enterica enterica serovar Typhi Ty2
acauagaaaauauaugacaac

SEQ ID NO: 3730188 - RNA, 19 nt, Salmonella enterica enterica serovar Typhi Ty2
acauagccgccacccggca

SEQ ID NO: 3730189 - RNA, 14 nt, Salmonella enterica enterica serovar Typhi Ty2
acauagcuaaauaa

SEQ ID NO: 3730190 - RNA, 15 nt, Salmonella enterica enterica serovar Typhi Ty2
acauagcugaacaau

SEQ ID NO: 3730191 - RNA, 19 nt, Salmonella enterica enterica serovar Typhi Ty2
acauaggcaaacaccucag

SEQ ID NO: 3730192 - RNA, 13 nt, Salmonella enterica enterica serovar Typhi Ty2
acauagggcaucg

SEQ ID NO: 3730193 - RNA, 14 nt, Salmonella enterica enterica serovar Typhi Ty2
acauauaauuaaca

SEQ ID NO: 3730194 - RNA, 17 nt, Salmonella enterica enterica serovar Typhi Ty2
acauauacucuucgcca

SEQ ID NO: 3730195 - RNA, 21 nt, Salmonella enterica enterica serovar Typhi Ty2
acauauagcagcagucucuac

SEQ ID NO: 3730196 - RNA, 12 nt, Salmonella enterica enterica serovar Typhi Ty2
acauauccaguu

SEQ ID NO: 3730197 - RNA, 17 nt, Salmonella enterica enterica serovar Typhi Ty2
acauaucccauacguuu

SEQ ID NO: 3730198 - RNA, 16 nt, Salmonella enterica enterica serovar Typhi Ty2
acauauccgcgcacag

SEQ ID NO: 3730199 - RNA, 20 nt, Salmonella enterica enterica serovar Typhi Ty2
acauaucgccggggaaaaua

SEQ ID NO: 3730200 - RNA, 23 nt, Salmonella enterica enterica serovar Typhi Ty2
acauauucaauaauauuaucaua

SEQ ID NO: 3730201 - RNA, 16 nt, Salmonella enterica enterica serovar Typhi Ty2
acauauuccagaagcg

SEQ ID NO: 3730202 - RNA, 19 nt, Salmonella enterica enterica serovar Typhi Ty2
acauauuccagaagcgcuu

SEQ ID NO: 3730203 - RNA, 12 nt, Salmonella enterica enterica serovar Typhi Ty2
acauauuuuuau

SEQ ID NO: 3730204 - RNA, 22 nt, Salmonella enterica enterica serovar Typhi Ty2
acauauuuuuaugcacgcuaua

SEQ ID NO: 3730205 - RNA, 19 nt, Salmonella enterica enterica serovar Typhi Ty2
acauauuuuuguugaaaua

SEQ ID NO: 3730206 - RNA, 22 nt, Salmonella enterica enterica serovar Typhi Ty2
acaucaacaaagggcaccuggg

SEQ ID NO: 3730207 - RNA, 13 nt, Salmonella enterica enterica serovar Typhi Ty2
acaucaagagaaa

SEQ ID NO: 3730208 - RNA, 15 nt, Salmonella enterica enterica serovar Typhi Ty2
acaucacguucgcgc

SEQ ID NO: 3730209 - RNA, 19 nt, Salmonella enterica enterica serovar Typhi Ty2
acaucagaaaaaagccaag

SEQ ID NO: 3730210 - RNA, 15 nt, Salmonella enterica enterica serovar Typhi Ty2
acaucagcaaaugaa

SEQ ID NO: 3730211 - RNA, 18 nt, Salmonella enterica enterica serovar Typhi Ty2
acaucagccagcagcuca

SEQ ID NO: 3730212 - RNA, 16 nt, Salmonella enterica enterica serovar Typhi Ty2
acaucaugcuugcuuu

SEQ ID NO: 3730213 - RNA, 13 nt, Salmonella enterica enterica serovar Typhi Ty2
acauccacauagg

SEQ ID NO: 3730214 - RNA, 12 nt, Salmonella enterica enterica serovar Typhi Ty2
acauccacuggu

SEQ ID NO: 3730215 - RNA, 14 nt, Salmonella enterica enterica serovar Typhi Ty2
acauccagcgccag

SEQ ID NO: 3730216 - RNA, 15 nt, Salmonella enterica enterica serovar Typhi Ty2
acaucccagacaaaa

SEQ ID NO: 3730217 - RNA, 19 nt, Salmonella enterica enterica serovar Typhi Ty2
acauccccgccgagaaaau

SEQ ID NO: 3730218 - RNA, 21 nt, Salmonella enterica enterica serovar Typhi Ty2
acauccccgccgagaaaauac

SEQ ID NO: 3730219 - RNA, 21 nt, Salmonella enterica enterica serovar Typhi Ty2
acauccccgcguuaagccccu

SEQ ID NO: 3730220 - RNA, 22 nt, Salmonella enterica enterica serovar Typhi Ty2
acaucccgauaauggcgccgau

SEQ ID NO: 3730221 - RNA, 23 nt, Salmonella enterica enterica serovar Typhi Ty2
acauccgcuuuugguuuuucaac

SEQ ID NO: 3730222 - RNA, 15 nt, Salmonella enterica enterica serovar Typhi Ty2
acauccggcggcguc

SEQ ID NO: 3730223 - RNA, 17 nt, Salmonella enterica enterica serovar Typhi Ty2
acauccugugaaguaaa

SEQ ID NO: 3730224 - RNA, 17 nt, Salmonella enterica enterica serovar Typhi Ty2
acaucgcaaugccacca

SEQ ID NO: 3730225 - RNA, 22 nt, Salmonella enterica enterica serovar Typhi Ty2
acaucgccguuccauuccagaa

SEQ ID NO: 3730226 - RNA, 16 nt, Salmonella enterica enterica serovar Typhi Ty2
acaucgcgucgaggaa

SEQ ID NO: 3730227 - RNA, 16 nt, Salmonella enterica enterica serovar Typhi Ty2
acaucgcucccggcac

SEQ ID NO: 3730228 - RNA, 14 nt, Salmonella enterica enterica serovar Typhi Ty2
acaucgcucgcgcc

SEQ ID NO: 3730229 - RNA, 15 nt, Salmonella enterica enterica serovar Typhi Ty2
acaucgcuggcgcgc

SEQ ID NO: 3730230 - RNA, 20 nt, Salmonella enterica enterica serovar Typhi Ty2
acaucggagauuucauccuc

SEQ ID NO: 3730231 - RNA, 18 nt, Salmonella enterica enterica serovar Typhi Ty2
acaucggauuauuuucac

SEQ ID NO: 3730232 - RNA, 12 nt, Salmonella enterica enterica serovar Typhi Ty2
acaucguaaauc

SEQ ID NO: 3730233 - RNA, 15 nt, Salmonella enterica enterica serovar Typhi Ty2
acaucguaaaucaaa

SEQ ID NO: 3730234 - RNA, 22 nt, Salmonella enterica enterica serovar Typhi Ty2
acaucguaaaucaaaugagaau

SEQ ID NO: 3730235 - RNA, 24 nt, Salmonella enterica enterica serovar Typhi Ty2
acaucgucuuuuaccgcgucgcua

SEQ ID NO: 3730236 - RNA, 19 nt, Salmonella enterica enterica serovar Typhi Ty2
acaucguguauaccaaaaa

SEQ ID NO: 3730237 - RNA, 12 nt, Salmonella enterica enterica serovar Typhi Ty2
acaucguuaccc

SEQ ID NO: 3730238 - RNA, 23 nt, Salmonella enterica enterica serovar Typhi Ty2
acaucucaucggcuuuuuuguau

SEQ ID NO: 3730239 - RNA, 22 nt, Salmonella enterica enterica serovar Typhi Ty2
acaucugccgcuuugaggauca

SEQ ID NO: 3730240 - RNA, 12 nt, Salmonella enterica enterica serovar Typhi Ty2
acaucuuccagg

SEQ ID NO: 3730241 - RNA, 15 nt, Salmonella enterica enterica serovar Typhi Ty2
acaucuuccaugccu

SEQ ID NO: 3730242 - RNA, 13 nt, Salmonella enterica enterica serovar Typhi Ty2
acaucuuugccaa

SEQ ID NO: 3730243 - RNA, 14 nt, Salmonella enterica enterica serovar Typhi Ty2
acaugaccgcacag

SEQ ID NO: 3730244 - RNA, 16 nt, Salmonella enterica enterica serovar Typhi Ty2
acaugaccgcacagca

SEQ ID NO: 3730245 - RNA, 18 nt, Salmonella enterica enterica serovar Typhi Ty2
acaugaccugaauauggc

SEQ ID NO: 3730246 - RNA, 19 nt, Salmonella enterica enterica serovar Typhi Ty2
acaugauaaguuucucuuc

SEQ ID NO: 3730247 - RNA, 20 nt, Salmonella enterica enterica serovar Typhi Ty2
acaugccuucuuuggugcga

SEQ ID NO: 3730248 - RNA, 18 nt, Salmonella enterica enterica serovar Typhi Ty2
acaugcucaugaaggcau

SEQ ID NO: 3730249 - RNA, 22 nt, Salmonella enterica enterica serovar Typhi Ty2
acauggacaccggaagugaauu

SEQ ID NO: 3730250 - RNA, 16 nt, Salmonella enterica enterica serovar Typhi Ty2
acauggcaauggcuuc

SEQ ID NO: 3730251 - RNA, 22 nt, Salmonella enterica enterica serovar Typhi Ty2
acauggcgaaaaucggcaggcc

SEQ ID NO: 3730252 - RNA, 16 nt, Salmonella enterica enterica serovar Typhi Ty2
acauggcgcggcguaa

SEQ ID NO: 3730253 - RNA, 20 nt, Salmonella enterica enterica serovar Typhi Ty2
acauggcggucgccauaugu

SEQ ID NO: 3730254 - RNA, 14 nt, Salmonella enterica enterica serovar Typhi Ty2
acaugggcaggaac

SEQ ID NO: 3730255 - RNA, 14 nt, Salmonella enterica enterica serovar Typhi Ty2
acauguucagcgca

SEQ ID NO: 3730256 - RNA, 23 nt, Salmonella enterica enterica serovar Typhi Ty2
acauguucagcgcagaagcagac

SEQ ID NO: 3730257 - RNA, 16 nt, Salmonella enterica enterica serovar Typhi Ty2
acauguugugucggcc

SEQ ID NO: 3730258 - RNA, 18 nt, Salmonella enterica enterica serovar Typhi Ty2
acauuaaucgccauugca

SEQ ID NO: 3730259 - RNA, 15 nt, Salmonella enterica enterica serovar Typhi Ty2
acauuacaauguaca

SEQ ID NO: 3730260 - RNA, 23 nt, Salmonella enterica enterica serovar Typhi Ty2
agaaccuguucaugccagauuuu

SEQ ID NO: 3730261 - RNA, 14 nt, Salmonella enterica enterica serovar Typhi Ty2
agaacgagaggagg

SEQ ID NO: 3730262 - RNA, 19 nt, Salmonella enterica enterica serovar Typhi Ty2
agaacgccgggccugccag

SEQ ID NO: 3730263 - RNA, 11 nt, Salmonella enterica enterica serovar Typhi Ty2
agaacgcucgc

SEQ ID NO: 3730264 - RNA, 14 nt, Salmonella enterica enterica serovar Typhi Ty2
agaacgcucgcgca

SEQ ID NO: 3730265 - RNA, 19 nt, Salmonella enterica enterica serovar Typhi Ty2
agaacgcuugucuucggua

SEQ ID NO: 3730266 - RNA, 21 nt, Salmonella enterica enterica serovar Typhi Ty2
agaacggcacaauagcgcuaa

SEQ ID NO: 3730267 - RNA, 22 nt, Salmonella enterica enterica serovar Typhi Ty2
agaacgguucauccagcagcag

SEQ ID NO: 3730268 - RNA, 12 nt, Salmonella enterica enterica serovar Typhi Ty2
agaacguauuau

SEQ ID NO: 3730269 - RNA, 23 nt, Salmonella enterica enterica serovar Typhi Ty2
agaacguugacguuucagucacc

SEQ ID NO: 3730270 - RNA, 18 nt, Salmonella enterica enterica serovar Typhi Ty2
agaacucacgcucaagau

SEQ ID NO: 3730271 - RNA, 14 nt, Salmonella enterica enterica serovar Typhi Ty2
agaacucaggcaaa

SEQ ID NO: 3730272 - RNA, 18 nt, Salmonella enterica enterica serovar Typhi Ty2
agaacugcaaauaccaca

SEQ ID NO: 3730273 - RNA, 22 nt, Salmonella enterica enterica serovar Typhi Ty2
agaacugcaaauaccacaucag

SEQ ID NO: 3730274 - RNA, 14 nt, Salmonella enterica enterica serovar Typhi Ty2
agaacuuaaauuaa

SEQ ID NO: 3730275 - RNA, 20 nt, Salmonella enterica enterica serovar Typhi Ty2
agaagaaaccgcagaaaaag

SEQ ID NO: 3730276 - RNA, 14 nt, Salmonella enterica enterica serovar Typhi Ty2
agaagaauuauuau

SEQ ID NO: 3730277 - RNA, 19 nt, Salmonella enterica enterica serovar Typhi Ty2
agaagagaauggccagcac

SEQ ID NO: 3730278 - RNA, 15 nt, Salmonella enterica enterica serovar Typhi Ty2
agaagauuucuuaau

SEQ ID NO: 3730279 - RNA, 11 nt, Salmonella enterica enterica serovar Typhi Ty2
agaagcaaauu

SEQ ID NO: 3730280 - RNA, 13 nt, Salmonella enterica enterica serovar Typhi Ty2
agaagcaaauuca

SEQ ID NO: 3730281 - RNA, 13 nt, Salmonella enterica enterica serovar Typhi Ty2
agaagccaucaaa

SEQ ID NO: 3730282 - RNA, 20 nt, Salmonella enterica enterica serovar Typhi Ty2
agaagcgauuagcuggcugc

SEQ ID NO: 3730283 - RNA, 17 nt, Salmonella enterica enterica serovar Typhi Ty2
agaagcgccugucuauu

SEQ ID NO: 3730284 - RNA, 16 nt, Salmonella enterica enterica serovar Typhi Ty2
agaagcuguaacacug

SEQ ID NO: 3730285 - RNA, 13 nt, Salmonella enterica enterica serovar Typhi Ty2
agaagcuuaccac

SEQ ID NO: 3730286 - RNA, 20 nt, Salmonella enterica enterica serovar Typhi Ty2
agaagggcaggggaaagcug

SEQ ID NO: 3730287 - RNA, 23 nt, Salmonella enterica enterica serovar Typhi Ty2
agaaggucagguuaugcgcgcca

SEQ ID NO: 3730288 - RNA, 20 nt, Salmonella enterica enterica serovar Typhi Ty2
agaagguuauucgccuuuca

SEQ ID NO: 3730289 - RNA, 17 nt, Salmonella enterica enterica serovar Typhi Ty2
agaaguaaacagaauca

SEQ ID NO: 3730290 - RNA, 16 nt, Salmonella enterica enterica serovar Typhi Ty2
agaaguagcagagaaa

SEQ ID NO: 3730291 - RNA, 22 nt, Salmonella enterica enterica serovar Typhi Ty2
agaagucugugagaaaagcgaa

SEQ ID NO: 3730292 - RNA, 16 nt, Salmonella enterica enterica serovar Typhi Ty2
agaagugccaguaacu

SEQ ID NO: 3730293 - RNA, 21 nt, Salmonella enterica enterica serovar Typhi Ty2
agaauaaaaagugcgcacuca

SEQ ID NO: 3730294 - RNA, 21 nt, Salmonella enterica enterica serovar Typhi Ty2
agaauaacgaugaugaaaaag

SEQ ID NO: 3730295 - RNA, 13 nt, Salmonella enterica enterica serovar Typhi Ty2
agaauaacucagc

SEQ ID NO: 3730296 - RNA, 15 nt, Salmonella enterica enterica serovar Typhi Ty2
agaauaagccagguu

SEQ ID NO: 3730297 - RNA, 14 nt, Salmonella enterica enterica serovar Typhi Ty2
agaauacgaauauu

SEQ ID NO: 3730298 - RNA, 15 nt, Salmonella enterica enterica serovar Typhi Ty2
agaauacuuccugcu

SEQ ID NO: 3730299 - RNA, 16 nt, Salmonella enterica enterica serovar Typhi Ty2
agaauacuuccugcuc

SEQ ID NO: 3730300 - RNA, 14 nt, Salmonella enterica enterica serovar Typhi Ty2
agaauagacuggcg

SEQ ID NO: 3730301 - RNA, 21 nt, Salmonella enterica enterica serovar Typhi Ty2
agaauagcgccguggccgaua

SEQ ID NO: 3730302 - RNA, 19 nt, Salmonella enterica enterica serovar Typhi Ty2
agaauaucggcgucaacgu

SEQ ID NO: 3730303 - RNA, 14 nt, Salmonella enterica enterica serovar Typhi Ty2
agaauaugcagugc

SEQ ID NO: 3730304 - RNA, 12 nt, Salmonella enterica enterica serovar Typhi Ty2
agaauaugccag

SEQ ID NO: 3730305 - RNA, 15 nt, Salmonella enterica enterica serovar Typhi Ty2
agaauauguucuuuc

SEQ ID NO: 3730306 - RNA, 16 nt, Salmonella enterica enterica serovar Typhi Ty2
agaauauuuuucucag

SEQ ID NO: 3730307 - RNA, 20 nt, Salmonella enterica enterica serovar Typhi Ty2
agaaucaccucuuucuccac

SEQ ID NO: 3730308 - RNA, 12 nt, Salmonella enterica enterica serovar Typhi Ty2
agaaucagaugc

SEQ ID NO: 3730309 - RNA, 21 nt, Salmonella enterica enterica serovar Typhi Ty2
agaaucagccgacggcgauca

SEQ ID NO: 3730310 - RNA, 20 nt, Salmonella enterica enterica serovar Typhi Ty2
agaaucaguaacacaaucag

SEQ ID NO: 3730311 - RNA, 23 nt, Salmonella enterica enterica serovar Typhi Ty2
agaaucauuaauacacugcguag

SEQ ID NO: 3730312 - RNA, 19 nt, Salmonella enterica enterica serovar Typhi Ty2
agaaucccaccaauugcca

SEQ ID NO: 3730313 - RNA, 17 nt, Salmonella enterica enterica serovar Typhi Ty2
agaaucgaucagcuuaa

SEQ ID NO: 3730314 - RNA, 20 nt, Salmonella enterica enterica serovar Typhi Ty2
agaaucgguagcuacucagg

SEQ ID NO: 3730315 - RNA, 18 nt, Salmonella enterica enterica serovar Typhi Ty2
agacgcucgacguccagc

SEQ ID NO: 3730316 - RNA, 22 nt, Salmonella enterica enterica serovar Typhi Ty2
agacgcugacauccaucaucua

SEQ ID NO: 3730317 - RNA, 18 nt, Salmonella enterica enterica serovar Typhi Ty2
agacgcuggcacuggcag

SEQ ID NO: 3730318 - RNA, 13 nt, Salmonella enterica enterica serovar Typhi Ty2
agacgcugguugu

SEQ ID NO: 3730319 - RNA, 21 nt, Salmonella enterica enterica serovar Typhi Ty2
agacgcuucauaucgcccagc

SEQ ID NO: 3730320 - RNA, 15 nt, Salmonella enterica enterica serovar Typhi Ty2
agacggcagcgccau

SEQ ID NO: 3730321 - RNA, 12 nt, Salmonella enterica enterica serovar Typhi Ty2
agacggcugggc

SEQ ID NO: 3730322 - RNA, 15 nt, Salmonella enterica enterica serovar Typhi Ty2
agacgguaagaauaa

SEQ ID NO: 3730323 - RNA, 15 nt, Salmonella enterica enterica serovar Typhi Ty2
agacgguaaucagac

SEQ ID NO: 3730324 - RNA, 19 nt, Salmonella enterica enterica serovar Typhi Ty2
agacgucaaacaguuccug

SEQ ID NO: 3730325 - RNA, 13 nt, Salmonella enterica enterica serovar Typhi Ty2
agacgucauaccu

SEQ ID NO: 3730326 - RNA, 15 nt, Salmonella enterica enterica serovar Typhi Ty2
agacgucauaccugg

SEQ ID NO: 3730327 - RNA, 13 nt, Salmonella enterica enterica serovar Typhi Ty2
agacguuuaagca

SEQ ID NO: 3730328 - RNA, 20 nt, Salmonella enterica enterica serovar Typhi Ty2
agacguuuacaccgccaucc

SEQ ID NO: 3730329 - RNA, 16 nt, Salmonella enterica enterica serovar Typhi Ty2
agacguuuaugccgcc

SEQ ID NO: 3730330 - RNA, 20 nt, Salmonella enterica enterica serovar Typhi Ty2
agacguuuaugccgccaucc

SEQ ID NO: 3730331 - RNA, 19 nt, Salmonella enterica enterica serovar Typhi Ty2
agacuacccaucacgcccu

SEQ ID NO: 3730332 - RNA, 19 nt, Salmonella enterica enterica serovar Typhi Ty2
agacuacgcaaaaaaagcc

SEQ ID NO: 3730333 - RNA, 16 nt, Salmonella enterica enterica serovar Typhi Ty2
agacuacggaaacugu

SEQ ID NO: 3730334 - RNA, 18 nt, Salmonella enterica enterica serovar Typhi Ty2
agacuauccguccucuuu

SEQ ID NO: 3730335 - RNA, 21 nt, Salmonella enterica enterica serovar Typhi Ty2
agacucaaagaaaacaucagc

SEQ ID NO: 3730336 - RNA, 13 nt, Salmonella enterica enterica serovar Typhi Ty2
agacucagcagcg

SEQ ID NO: 3730337 - RNA, 12 nt, Salmonella enterica enterica serovar Typhi Ty2
agacucaggcgc

SEQ ID NO: 3730338 - RNA, 12 nt, Salmonella enterica enterica serovar Typhi Ty2
agacucaucgcc

SEQ ID NO: 3730339 - RNA, 15 nt, Salmonella enterica enterica serovar Typhi Ty2
agacucaucgccgca

SEQ ID NO: 3730340 - RNA, 18 nt, Salmonella enterica enterica serovar Typhi Ty2
agacucaucgccgcaaug

SEQ ID NO: 3730341 - RNA, 15 nt, Salmonella enterica enterica serovar Typhi Ty2
agacuccggcagcau

SEQ ID NO: 3730342 - RNA, 18 nt, Salmonella enterica enterica serovar Typhi Ty2
aaaaaaacaucgcugaua

SEQ ID NO: 3730343 - RNA, 13 nt, Salmonella enterica enterica serovar Typhi Ty2
aaaaaacaccugu

SEQ ID NO: 3730344 - RNA, 21 nt, Salmonella enterica enterica serovar Typhi Ty2
aaaaaacauauaauuaacauu

SEQ ID NO: 3730345 - RNA, 13 nt, Salmonella enterica enterica serovar Typhi Ty2
aaaaaacaucaug

SEQ ID NO: 3730346 - RNA, 11 nt, Salmonella enterica enterica serovar Typhi Ty2
aaaaaaccaga

SEQ ID NO: 3730347 - RNA, 12 nt, Salmonella enterica enterica serovar Typhi Ty2
aaaaaaccguau

SEQ ID NO: 3730348 - RNA, 20 nt, Salmonella enterica enterica serovar Typhi Ty2
aaaaaacgcccagaucgacc

SEQ ID NO: 3730349 - RNA, 11 nt, Salmonella enterica enterica serovar Typhi Ty2
aaaaaagaggg

SEQ ID NO: 3730350 - RNA, 11 nt, Salmonella enterica enterica serovar Typhi Ty2
aaaaaagccau

SEQ ID NO: 3730351 - RNA, 17 nt, Salmonella enterica enterica serovar Typhi Ty2
aaaaaagugauccccca

SEQ ID NO: 3730352 - RNA, 12 nt, Salmonella enterica enterica serovar Typhi Ty2
aaaaaaucagca

SEQ ID NO: 3730353 - RNA, 12 nt, Salmonella enterica enterica serovar Typhi Ty2
aaaaaauccuca

SEQ ID NO: 3730354 - RNA, 11 nt, Salmonella enterica enterica serovar Typhi Ty2
aaaaaauuccc

SEQ ID NO: 3730355 - RNA, 16 nt, Salmonella enterica enterica serovar Typhi Ty2
aaaaacagccagcagc

SEQ ID NO: 3730356 - RNA, 19 nt, Salmonella enterica enterica serovar Typhi Ty2
aaaaacagcgcaauaugca

SEQ ID NO: 3730357 - RNA, 21 nt, Salmonella enterica enterica serovar Typhi Ty2
aaaaacaggcgcaggcauuaa

SEQ ID NO: 3730358 - RNA, 19 nt, Salmonella enterica enterica serovar Typhi Ty2
aaaaacagguugcguaacg

SEQ ID NO: 3730359 - RNA, 16 nt, Salmonella enterica enterica serovar Typhi Ty2
aaaaacaucgcugaua

SEQ ID NO: 3730360 - RNA, 15 nt, Salmonella enterica enterica serovar Typhi Ty2
aaaaaccaaaaaaua

SEQ ID NO: 3730361 - RNA, 16 nt, Salmonella enterica enterica serovar Typhi Ty2
aaaaaccgccucaauu

SEQ ID NO: 3730362 - RNA, 13 nt, Salmonella enterica enterica serovar Typhi Ty2
aaaaaccugcucu

SEQ ID NO: 3730363 - RNA, 20 nt, Salmonella enterica enterica serovar Typhi Ty2
aaaaacgcgcucgccagcgc

SEQ ID NO: 3730364 - RNA, 13 nt, Salmonella enterica enterica serovar Typhi Ty2
aaaaacggcuuua

SEQ ID NO: 3730365 - RNA, 15 nt, Salmonella enterica enterica serovar Typhi Ty2
aaaaacguugcuggc

SEQ ID NO: 3730366 - RNA, 18 nt, Salmonella enterica enterica serovar Typhi Ty2
aaaaacucaggaaaucgu

SEQ ID NO: 3730367 - RNA, 18 nt, Salmonella enterica enterica serovar Typhi Ty2
aaaaacugcuaaaagaag

SEQ ID NO: 3730368 - RNA, 22 nt, Salmonella enterica enterica serovar Typhi Ty2
aaaaacuuauuucuaucgcuau

SEQ ID NO: 3730369 - RNA, 12 nt, Salmonella enterica enterica serovar Typhi Ty2
aaaaagaaaaaa

SEQ ID NO: 3730370 - RNA, 11 nt, Salmonella enterica enterica serovar Typhi Ty2
aaaaagagaag

SEQ ID NO: 3730371 - RNA, 15 nt, Salmonella enterica enterica serovar Typhi Ty2
aaaaagauaaccauu

SEQ ID NO: 3730372 - RNA, 21 nt, Salmonella enterica enterica serovar Typhi Ty2
aaaaagccacgcaagcagcac

SEQ ID NO: 3730373 - RNA, 22 nt, Salmonella enterica enterica serovar Typhi Ty2
aaaaagccagggaaauggcgaa

SEQ ID NO: 3730374 - RNA, 20 nt, Salmonella enterica enterica serovar Typhi Ty2
aaaaagccggcggaaaaaag

SEQ ID NO: 3730375 - RNA, 19 nt, Salmonella enterica enterica serovar Typhi Ty2
aaaaagccucugauuucga

SEQ ID NO: 3730376 - RNA, 24 nt, Salmonella enterica enterica serovar Typhi Ty2
aaaaagccugcacauugcaggcuu

SEQ ID NO: 3730377 - RNA, 19 nt, Salmonella enterica enterica serovar Typhi Ty2
aaaaagcgucaguaaaagc

SEQ ID NO: 3730378 - RNA, 15 nt, Salmonella enterica enterica serovar Typhi Ty2
aaaaagcuccggacg

SEQ ID NO: 3730379 - RNA, 11 nt, Salmonella enterica enterica serovar Typhi Ty2
aaaaagcugcg

SEQ ID NO: 3730380 - RNA, 10 nt, Salmonella enterica enterica serovar Typhi Ty2
aaaaaggaca

SEQ ID NO: 3730381 - RNA, 21 nt, Salmonella enterica enterica serovar Typhi Ty2
aaaaaggccgcuuaauaauaa

SEQ ID NO: 3730382 - RNA, 17 nt, Salmonella enterica enterica serovar Typhi Ty2
aaaaaggccgcuuucgc

SEQ ID NO: 3730383 - RNA, 20 nt, Salmonella enterica enterica serovar Typhi Ty2
aaaaaggcgaacuccagcgc

SEQ ID NO: 3730384 - RNA, 15 nt, Salmonella enterica enterica serovar Typhi Ty2
aaaaagguaacuauu

SEQ ID NO: 3730385 - RNA, 11 nt, Salmonella enterica enterica serovar Typhi Ty2
aaaaauaaaaa

SEQ ID NO: 3730386 - RNA, 14 nt, Salmonella enterica enterica serovar Typhi Ty2
aaaaauaaaaaaac

SEQ ID NO: 3730387 - RNA, 21 nt, Salmonella enterica enterica serovar Typhi Ty2
aaaaauaauuacuaucuucaa

SEQ ID NO: 3730388 - RNA, 13 nt, Salmonella enterica enterica serovar Typhi Ty2
aaaauaacgcgau

SEQ ID NO: 3730389 - RNA, 23 nt, Salmonella enterica enterica serovar Typhi Ty2
aaaauaagagggcgccaugcuga

SEQ ID NO: 3730390 - RNA, 23 nt, Salmonella enterica enterica serovar Typhi Ty2
aaaauaauagguacggggcaucu

SEQ ID NO: 3730391 - RNA, 14 nt, Salmonella enterica enterica serovar Typhi Ty2
aaaauaauugauaa

SEQ ID NO: 3730392 - RNA, 20 nt, Salmonella enterica enterica serovar Typhi Ty2
aaaauaccccaggggcauau

SEQ ID NO: 3730393 - RNA, 16 nt, Salmonella enterica enterica serovar Typhi Ty2
aaaauaccgcacauca

SEQ ID NO: 3730394 - RNA, 22 nt, Salmonella enterica enterica serovar Typhi Ty2
aaaauacugcuagaacauuucc

SEQ ID NO: 3730395 - RNA, 22 nt, Salmonella enterica enterica serovar Typhi Ty2
aaaauagccagaaugccagcgc

SEQ ID NO: 3730396 - RNA, 21 nt, Salmonella enterica enterica serovar Typhi Ty2
aaaauagccgaaacuuauacu

SEQ ID NO: 3730397 - RNA, 13 nt, Salmonella enterica enterica serovar Typhi Ty2
aaaauagcgaucg

SEQ ID NO: 3730398 - RNA, 22 nt, Salmonella enterica enterica serovar Typhi Ty2
aaaauagugcggccaaauugcu

SEQ ID NO: 3730399 - RNA, 23 nt, Salmonella enterica enterica serovar Typhi Ty2
aaaauauacaccugacggcagcc

SEQ ID NO: 3730400 - RNA, 20 nt, Salmonella enterica enterica serovar Typhi Ty2
aaaauaucauuaaaucaaaa

SEQ ID NO: 3730401 - RNA, 13 nt, Salmonella enterica enterica serovar Typhi Ty2
aaaauauccugua

SEQ ID NO: 3730402 - RNA, 15 nt, Salmonella enterica enterica serovar Typhi Ty2
aaaaucacuccccga

SEQ ID NO: 3730403 - RNA, 13 nt, Salmonella enterica enterica serovar Typhi Ty2
aaaaucagcaauc

SEQ ID NO: 3730404 - RNA, 22 nt, Salmonella enterica enterica serovar Typhi Ty2
aaaaucagcccggacaucaucc

SEQ ID NO: 3730405 - RNA, 17 nt, Salmonella enterica enterica serovar Typhi Ty2
aaaauccccaccugacu

SEQ ID NO: 3730406 - RNA, 15 nt, Salmonella enterica enterica serovar Typhi Ty2
aaaaucccgccagcg

SEQ ID NO: 3730407 - RNA, 18 nt, Salmonella enterica enterica serovar Typhi Ty2
aaaaucccggcuggguuc

SEQ ID NO: 3730408 - RNA, 21 nt, Salmonella enterica enterica serovar Typhi Ty2
aaaauccucuaccggaaaaca

SEQ ID NO: 3730409 - RNA, 23 nt, Salmonella enterica enterica serovar Typhi Ty2
aaaauccucuaccggaaaacagc

SEQ ID NO: 3730410 - RNA, 19 nt, Salmonella enterica enterica serovar Typhi Ty2
aaaauccugcacuuccagc

SEQ ID NO: 3730411 - RNA, 19 nt, Salmonella enterica enterica serovar Typhi Ty2
aaaaucgcgcuuuauguuu

SEQ ID NO: 3730412 - RNA, 15 nt, Salmonella enterica enterica serovar Typhi Ty2
aaaaucggaccuccg

SEQ ID NO: 3730413 - RNA, 23 nt, Salmonella enterica enterica serovar Typhi Ty2
aaaaucggcgggcaucauaucca

SEQ ID NO: 3730414 - RNA, 16 nt, Salmonella enterica enterica serovar Typhi Ty2
aaaaucgucaucagau

SEQ ID NO: 3730415 - RNA, 21 nt, Salmonella enterica enterica serovar Typhi Ty2
aaaaucugcgccaaucgcgau

SEQ ID NO: 3730416 - RNA, 23 nt, Salmonella enterica enterica serovar Typhi Ty2
aaaaucuggcgagagcauugccu

SEQ ID NO: 3730417 - RNA, 21 nt, Salmonella enterica enterica serovar Typhi Ty2
aaaaucugguggccggaggag

SEQ ID NO: 3730418 - RNA, 20 nt, Salmonella enterica enterica serovar Typhi Ty2
aaaaugaggacacaguaaug

SEQ ID NO: 3730419 - RNA, 23 nt, Salmonella enterica enterica serovar Typhi Ty2
aaaaugaugacucauuaaaaaaa

SEQ ID NO: 3730420 - RNA, 20 nt, Salmonella enterica enterica serovar Typhi Ty2
aaaaugaugccccagaacaa

SEQ ID NO: 3730421 - RNA, 13 nt, Salmonella enterica enterica serovar Typhi Ty2
aaaaugcacauua

SEQ ID NO: 3730422 - RNA, 18 nt, Salmonella enterica enterica serovar Typhi Ty2
aaaaugcauugauaggcu

SEQ ID NO: 3730423 - RNA, 15 nt, Salmonella enterica enterica serovar Typhi Ty2
aaaaugcgcaaagca

SEQ ID NO: 3730424 - RNA, 14 nt, Salmonella enterica enterica serovar Typhi Ty2
aaaaugcgcaugau

SEQ ID NO: 3730425 - RNA, 19 nt, Salmonella enterica enterica serovar Typhi Ty2
aaaaugcgccaggaaacuc

SEQ ID NO: 3730426 - RNA, 16 nt, Salmonella enterica enterica serovar Typhi Ty2
aaaauggaaaauaaua

SEQ ID NO: 3730427 - RNA, 21 nt, Salmonella enterica enterica serovar Typhi Ty2
aaaauggcugauaaauccggu

SEQ ID NO: 3730428 - RNA, 16 nt, Salmonella enterica enterica serovar Typhi Ty2
aaaaugggcuggaaau

SEQ ID NO: 3730429 - RNA, 13 nt, Salmonella enterica enterica serovar Typhi Ty2
aaaauggggaucg

SEQ ID NO: 3730430 - RNA, 20 nt, Salmonella enterica enterica serovar Typhi Ty2
aaaauggucggucacgcgau

SEQ ID NO: 3730431 - RNA, 22 nt, Salmonella enterica enterica serovar Typhi Ty2
aaaaugucuuuucgguauuuau

SEQ ID NO: 3730432 - RNA, 21 nt, Salmonella enterica enterica serovar Typhi Ty2
aaaaugugagccauaacaacu

SEQ ID NO: 3730433 - RNA, 20 nt, Salmonella enterica enterica serovar Typhi Ty2
aaaaugugcaaagagaccgg

SEQ ID NO: 3730434 - RNA, 13 nt, Salmonella enterica enterica serovar Typhi Ty2
aaaauuaccaggc

SEQ ID NO: 3730435 - RNA, 18 nt, Salmonella enterica enterica serovar Typhi Ty2
aaaauuacuucguagacu

SEQ ID NO: 3730436 - RNA, 23 nt, Salmonella enterica enterica serovar Typhi Ty2
aaaauuacuucguagacucaggc

SEQ ID NO: 3730437 - RNA, 23 nt, Salmonella enterica enterica serovar Typhi Ty2
aaaauuagacaagcaguucugaa

SEQ ID NO: 3730438 - RNA, 15 nt, Salmonella enterica enterica serovar Typhi Ty2
aaaauuauauucuaa

SEQ ID NO: 3730439 - RNA, 15 nt, Salmonella enterica enterica serovar Typhi Ty2
aaaauuauuuuaaau

SEQ ID NO: 3730440 - RNA, 15 nt, Salmonella enterica enterica serovar Typhi Ty2
aaaauuauuuuuacu

SEQ ID NO: 3730441 - RNA, 19 nt, Salmonella enterica enterica serovar Typhi Ty2
aaaauuauuuuuacuuaaa

SEQ ID NO: 3730442 - RNA, 22 nt, Salmonella enterica enterica serovar Typhi Ty2
aaaauuauuuuuacuuaaaauu

SEQ ID NO: 3730443 - RNA, 16 nt, Salmonella enterica enterica serovar Typhi Ty2
aaaauucaaaaaagca

SEQ ID NO: 3730444 - RNA, 15 nt, Salmonella enterica enterica serovar Typhi Ty2
aaaauucagacucaa

SEQ ID NO: 3730445 - RNA, 13 nt, Salmonella enterica enterica serovar Typhi Ty2
aaaauugaauuaa

SEQ ID NO: 3730446 - RNA, 14 nt, Salmonella enterica enterica serovar Typhi Ty2
aaaauugaauuaag

SEQ ID NO: 3730447 - RNA, 20 nt, Salmonella enterica enterica serovar Typhi Ty2
aaaauuuuuuaucagguugu

SEQ ID NO: 3730448 - RNA, 16 nt, Salmonella enterica enterica serovar Typhi Ty2
aaacaaauaaauccau

SEQ ID NO: 3730449 - RNA, 12 nt, Salmonella enterica enterica serovar Typhi Ty2
aaacaauauccc

SEQ ID NO: 3730450 - RNA, 14 nt, Salmonella enterica enterica serovar Typhi Ty2
aaacaaugcaggua

SEQ ID NO: 3730451 - RNA, 17 nt, Salmonella enterica enterica serovar Typhi Ty2
aaacaauuuacgcagcc

SEQ ID NO: 3730452 - RNA, 22 nt, Salmonella enterica enterica serovar Typhi Ty2
aaacacaaucacaacgucaucc

SEQ ID NO: 3730453 - RNA, 13 nt, Salmonella enterica enterica serovar Typhi Ty2
aaacaccagaucg

SEQ ID NO: 3730454 - RNA, 18 nt, Salmonella enterica enterica serovar Typhi Ty2
aaacaccggggcauuucc

SEQ ID NO: 3730455 - RNA, 14 nt, Salmonella enterica enterica serovar Typhi Ty2
aaacaccucagcca

SEQ ID NO: 3730456 - RNA, 23 nt, Salmonella enterica enterica serovar Typhi Ty2
aaacaccugucugucaaaaccca

SEQ ID NO: 3730457 - RNA, 17 nt, Salmonella enterica enterica serovar Typhi Ty2
aaacacgccuccauaca

SEQ ID NO: 3730458 - RNA, 15 nt, Salmonella enterica enterica serovar Typhi Ty2
aaacacgucuggaaa

SEQ ID NO: 3730459 - RNA, 14 nt, Salmonella enterica enterica serovar Typhi Ty2
aaacacuaaaucau

SEQ ID NO: 3730460 - RNA, 15 nt, Salmonella enterica enterica serovar Typhi Ty2
aaacacucuccacca

SEQ ID NO: 3730461 - RNA, 14 nt, Salmonella enterica enterica serovar Typhi Ty2
aaacagacaauuag

SEQ ID NO: 3730462 - RNA, 14 nt, Salmonella enterica enterica serovar Typhi Ty2
aaacagcaaaucgg

SEQ ID NO: 3730463 - RNA, 17 nt, Salmonella enterica enterica serovar Typhi Ty2
aaacagcacgcucaaau

SEQ ID NO: 3730464 - RNA, 15 nt, Salmonella enterica enterica serovar Typhi Ty2
aaacagcagaacaac

SEQ ID NO: 3730465 - RNA, 21 nt, Salmonella enterica enterica serovar Typhi Ty2
aaacagcagcgcggcacacag

SEQ ID NO: 3730466 - RNA, 16 nt, Salmonella enterica enterica serovar Typhi Ty2
aaacagccaaucauaa

SEQ ID NO: 3730467 - RNA, 20 nt, Salmonella enterica enterica serovar Typhi Ty2
aaacagcgccccgacaaaac

SEQ ID NO: 3730468 - RNA, 16 nt, Salmonella enterica enterica serovar Typhi Ty2
aaacagcuguaaaucg

SEQ ID NO: 3730469 - RNA, 15 nt, Salmonella enterica enterica serovar Typhi Ty2
aaacaggaaaaacau

SEQ ID NO: 3730470 - RNA, 13 nt, Salmonella enterica enterica serovar Typhi Ty2
aaacgcuggugcu

SEQ ID NO: 3730471 - RNA, 22 nt, Salmonella enterica enterica serovar Typhi Ty2
aaacggaaccaaaugcccagcu

SEQ ID NO: 3730472 - RNA, 14 nt, Salmonella enterica enterica serovar Typhi Ty2
aaacggaucuucca

SEQ ID NO: 3730473 - RNA, 15 nt, Salmonella enterica enterica serovar Typhi Ty2
aaacggaucuuccac

SEQ ID NO: 3730474 - RNA, 23 nt, Salmonella enterica enterica serovar Typhi Ty2
aaacggcagccgccaccacaaag

SEQ ID NO: 3730475 - RNA, 18 nt, Salmonella enterica enterica serovar Typhi Ty2
aaacggccagugaaauaa

SEQ ID NO: 3730476 - RNA, 15 nt, Salmonella enterica enterica serovar Typhi Ty2
aaacggccugcgcug

SEQ ID NO: 3730477 - RNA, 15 nt, Salmonella enterica enterica serovar Typhi Ty2
aaacggcgcguccag

SEQ ID NO: 3730478 - RNA, 14 nt, Salmonella enterica enterica serovar Typhi Ty2
aaacggcuuuaauc

SEQ ID NO: 3730479 - RNA, 14 nt, Salmonella enterica enterica serovar Typhi Ty2
aaacgguauuucca

SEQ ID NO: 3730480 - RNA, 17 nt, Salmonella enterica enterica serovar Typhi Ty2
aaacgguucagucagcg

SEQ ID NO: 3730481 - RNA, 13 nt, Salmonella enterica enterica serovar Typhi Ty2
aaacgucaugcug

SEQ ID NO: 3730482 - RNA, 17 nt, Salmonella enterica enterica serovar Typhi Ty2
aaacgucguaaaaccug

SEQ ID NO: 3730483 - RNA, 21 nt, Salmonella enterica enterica serovar Typhi Ty2
aaacgugcggcggccucuuug

SEQ ID NO: 3730484 - RNA, 19 nt, Salmonella enterica enterica serovar Typhi Ty2
aaacguuauuggcaggaug

SEQ ID NO: 3730485 - RNA, 17 nt, Salmonella enterica enterica serovar Typhi Ty2
aaacuaauccucuucuc

SEQ ID NO: 3730486 - RNA, 23 nt, Salmonella enterica enterica serovar Typhi Ty2
aaacuaauccucuucucugaaaa

SEQ ID NO: 3730487 - RNA, 19 nt, Salmonella enterica enterica serovar Typhi Ty2
aaacuaauggcgcagcggu

SEQ ID NO: 3730488 - RNA, 23 nt, Salmonella enterica enterica serovar Typhi Ty2
aaacuauuucaacccggcauuuc

SEQ ID NO: 3730489 - RNA, 13 nt, Salmonella enterica enterica serovar Typhi Ty2
aaacuauuuuuag

SEQ ID NO: 3730490 - RNA, 19 nt, Salmonella enterica enterica serovar Typhi Ty2
aaacuauuuuuagcccuug

SEQ ID NO: 3730491 - RNA, 13 nt, Salmonella enterica enterica serovar Typhi Ty2
aaacucaacuggg

SEQ ID NO: 3730492 - RNA, 16 nt, Salmonella enterica enterica serovar Typhi Ty2
aaacuccaccugaucg

SEQ ID NO: 3730493 - RNA, 12 nt, Salmonella enterica enterica serovar Typhi Ty2
aaacuccagcag

SEQ ID NO: 3730494 - RNA, 22 nt, Salmonella enterica enterica serovar Typhi Ty2
aaacuccauuaaauuacuuguu

SEQ ID NO: 3730495 - RNA, 22 nt, Salmonella enterica enterica serovar Typhi Ty2
aaacucccgcacgcuggcauca

SEQ ID NO: 3730496 - RNA, 19 nt, Salmonella enterica enterica serovar Typhi Ty2
aaacucuguguuaugaaug

SEQ ID NO: 3730497 - RNA, 21 nt, Salmonella enterica enterica serovar Typhi Ty2
aaacucuuuuucaauaaacgg

SEQ ID NO: 3730498 - RNA, 22 nt, Salmonella enterica enterica serovar Typhi Ty2
aaacugacaucccccucuugcc

SEQ ID NO: 3730499 - RNA, 14 nt, Salmonella enterica enterica serovar Typhi Ty2
aaacugauacugga

SEQ ID NO: 3730500 - RNA, 21 nt, Salmonella enterica enterica serovar Typhi Ty2
aaacugauaguuuaaauccag

SEQ ID NO: 3730501 - RNA, 19 nt, Salmonella enterica enterica serovar Typhi Ty2
aaacugcauccccugcagg

SEQ ID NO: 3730502 - RNA, 14 nt, Salmonella enterica enterica serovar Typhi Ty2
aaacugcugacaau

SEQ ID NO: 3730503 - RNA, 15 nt, Salmonella enterica enterica serovar Typhi Ty2
aaacugcugccgcag

SEQ ID NO: 3730504 - RNA, 23 nt, Salmonella enterica enterica serovar Typhi Ty2
aaacuggcacgccguuugccaua

SEQ ID NO: 3730505 - RNA, 16 nt, Salmonella enterica enterica serovar Typhi Ty2
aaacuggcgcuggcag

SEQ ID NO: 3730506 - RNA, 21 nt, Salmonella enterica enterica serovar Typhi Ty2
aaacuuaucaguaacagaaca

SEQ ID NO: 3730507 - RNA, 21 nt, Salmonella enterica enterica serovar Typhi Ty2
aaacuucaauucagaaaguua

SEQ ID NO: 3730508 - RNA, 14 nt, Salmonella enterica enterica serovar Typhi Ty2
aaacuucacgucgc

SEQ ID NO: 3730509 - RNA, 18 nt, Salmonella enterica enterica serovar Typhi Ty2
aaagaaaacuuucauuuc

SEQ ID NO: 3730510 - RNA, 14 nt, Salmonella enterica enterica serovar Typhi Ty2
aaagaaaaugccag

SEQ ID NO: 3730511 - RNA, 15 nt, Salmonella enterica enterica serovar Typhi Ty2
aaagaaacgcugauc

SEQ ID NO: 3730512 - RNA, 14 nt, Salmonella enterica enterica serovar Typhi Ty2
aaagaaagcauuaa

SEQ ID NO: 3730513 - RNA, 18 nt, Salmonella enterica enterica serovar Typhi Ty2
aaagaaaguagaucacca

SEQ ID NO: 3730514 - RNA, 12 nt, Salmonella enterica enterica serovar Typhi Ty2
aaagaaauuuaa

SEQ ID NO: 3730515 - RNA, 21 nt, Salmonella enterica enterica serovar Typhi Ty2
aaagaagaaaccgcagaaaaa

SEQ ID NO: 3730516 - RNA, 23 nt, Salmonella enterica enterica serovar Typhi Ty2
aaagaagaaaccgcagaaaaagc

SEQ ID NO: 3730517 - RNA, 12 nt, Salmonella enterica enterica serovar Typhi Ty2
aaagaagaauaa

SEQ ID NO: 3730518 - RNA, 17 nt, Salmonella enterica enterica serovar Typhi Ty2
aaagacaccguucuggc

SEQ ID NO: 3730519 - RNA, 17 nt, Salmonella enterica enterica serovar Typhi Ty2
aaagacauaggccggcg

SEQ ID NO: 3730520 - RNA, 15 nt, Salmonella enterica enterica serovar Typhi Ty2
aaagaccaauacuga

SEQ ID NO: 3730521 - RNA, 19 nt, Salmonella enterica enterica serovar Typhi Ty2
aaagaccauccgguuuuaa

SEQ ID NO: 3730522 - RNA, 14 nt, Salmonella enterica enterica serovar Typhi Ty2
aaagaccuucuugc

SEQ ID NO: 3730523 - RNA, 13 nt, Salmonella enterica enterica serovar Typhi Ty2
aaagacgccaugg

SEQ ID NO: 3730524 - RNA, 19 nt, Salmonella enterica enterica serovar Typhi Ty2
aaagacggcagcgccaucc

SEQ ID NO: 3730525 - RNA, 20 nt, Salmonella enterica enterica serovar Typhi Ty2
aaagacuacuuuaucgaaug

SEQ ID NO: 3730526 - RNA, 23 nt, Salmonella enterica enterica serovar Typhi Ty2
aaagacuuugaugcggaagagaa

SEQ ID NO: 3730527 - RNA, 23 nt, Salmonella enterica enterica serovar Typhi Ty2
aaagagaacgacgcauaaaaaau

SEQ ID NO: 3730528 - RNA, 18 nt, Salmonella enterica enterica serovar Typhi Ty2
aaagagagcgccaaaaag

SEQ ID NO: 3730529 - RNA, 16 nt, Salmonella enterica enterica serovar Typhi Ty2
aaagaggaauguccag

SEQ ID NO: 3730530 - RNA, 22 nt, Salmonella enterica enterica serovar Typhi Ty2
aaagagguugacgcuucaaggc

SEQ ID NO: 3730531 - RNA, 22 nt, Salmonella enterica enterica serovar Typhi Ty2
aaagauaaccauuucaaacguu

SEQ ID NO: 3730532 - RNA, 14 nt, Salmonella enterica enterica serovar Typhi Ty2
aaagauaaucugaa

SEQ ID NO: 3730533 - RNA, 15 nt, Salmonella enterica enterica serovar Typhi Ty2
aaagauaaucugaau

SEQ ID NO: 3730534 - RNA, 20 nt, Salmonella enterica enterica serovar Typhi Ty2
aaagauagcugcuuaccaua

SEQ ID NO: 3730535 - RNA, 15 nt, Salmonella enterica enterica serovar Typhi Ty2
aaagaucauuccuga

SEQ ID NO: 3730536 - RNA, 16 nt, Salmonella enterica enterica serovar Typhi Ty2
aaagauuagccccagc

SEQ ID NO: 3730537 - RNA, 14 nt, Salmonella enterica enterica serovar Typhi Ty2
aaagauuggcaucu

SEQ ID NO: 3730538 - RNA, 18 nt, Salmonella enterica enterica serovar Typhi Ty2
aaagcacagccccagcac

SEQ ID NO: 3730539 - RNA, 16 nt, Salmonella enterica enterica serovar Typhi Ty2
aaagcacuccccggcu

SEQ ID NO: 3730540 - RNA, 16 nt, Salmonella enterica enterica serovar Typhi Ty2
aaagcagaggucugca

SEQ ID NO: 3730541 - RNA, 14 nt, Salmonella enterica enterica serovar Typhi Ty2
aaagcagcggcggu

SEQ ID NO: 3730542 - RNA, 13 nt, Salmonella enterica enterica serovar Typhi Ty2
aaagcagcugcug

SEQ ID NO: 3730543 - RNA, 14 nt, Salmonella enterica enterica serovar Typhi Ty2
aaagcagcugcugg

SEQ ID NO: 3730544 - RNA, 23 nt, Salmonella enterica enterica serovar Typhi Ty2
aaagcagugaauccccagaauuu

SEQ ID NO: 3730545 - RNA, 23 nt, Salmonella enterica enterica serovar Typhi Ty2
aaagcauggcuggcgguuuuugu

SEQ ID NO: 3730546 - RNA, 17 nt, Salmonella enterica enterica serovar Typhi Ty2
aaagccacgcaagcagc

SEQ ID NO: 3730547 - RNA, 14 nt, Salmonella enterica enterica serovar Typhi Ty2
aaagccaggccgcc

SEQ ID NO: 3730548 - RNA, 16 nt, Salmonella enterica enterica serovar Typhi Ty2
aaagccaggccgccag

SEQ ID NO: 3730549 - RNA, 15 nt, Salmonella enterica enterica serovar Typhi Ty2
aaagccaguuucucu

SEQ ID NO: 3730550 - RNA, 19 nt, Salmonella enterica enterica serovar Typhi Ty2
aaagccaguuucucuucuu

SEQ ID NO: 3730551 - RNA, 23 nt, Salmonella enterica enterica serovar Typhi Ty2
aaagccaucuucgguaauacaau

SEQ ID NO: 3730552 - RNA, 21 nt, Salmonella enterica enterica serovar Typhi Ty2
aaauaaacgcuugacucugaa

SEQ ID NO: 3730553 - RNA, 17 nt, Salmonella enterica enterica serovar Typhi Ty2
aaauaaagguucauauu

SEQ ID NO: 3730554 - RNA, 19 nt, Salmonella enterica enterica serovar Typhi Ty2
aaauaaagugcugaacaau

SEQ ID NO: 3730555 - RNA, 18 nt, Salmonella enterica enterica serovar Typhi Ty2
aaauaaaguguuaucaug

SEQ ID NO: 3730556 - RNA, 18 nt, Salmonella enterica enterica serovar Typhi Ty2
aaauaaauauguuauuua

SEQ ID NO: 3730557 - RNA, 16 nt, Salmonella enterica enterica serovar Typhi Ty2
aaauaaauccaugaga

SEQ ID NO: 3730558 - RNA, 13 nt, Salmonella enterica enterica serovar Typhi Ty2
aaauaacagacga

SEQ ID NO: 3730559 - RNA, 21 nt, Salmonella enterica enterica serovar Typhi Ty2
aaauaacgccuuucaccauuc

SEQ ID NO: 3730560 - RNA, 19 nt, Salmonella enterica enterica serovar Typhi Ty2
aaauaacgcgauaaucccc

SEQ ID NO: 3730561 - RNA, 17 nt, Salmonella enterica enterica serovar Typhi Ty2
aaauaacgguagagaau

SEQ ID NO: 3730562 - RNA, 18 nt, Salmonella enterica enterica serovar Typhi Ty2
aaauaacucuggaucagu

SEQ ID NO: 3730563 - RNA, 21 nt, Salmonella enterica enterica serovar Typhi Ty2
aaauaacucuggaucaguucc

SEQ ID NO: 3730564 - RNA, 18 nt, Salmonella enterica enterica serovar Typhi Ty2
aaauaacuuuuaauuuuu

SEQ ID NO: 3730565 - RNA, 20 nt, Salmonella enterica enterica serovar Typhi Ty2
aaauaacuuuuaauuuuuau

SEQ ID NO: 3730566 - RNA, 21 nt, Salmonella enterica enterica serovar Typhi Ty2
aaauaacuuuuaauuuuuaug

SEQ ID NO: 3730567 - RNA, 12 nt, Salmonella enterica enterica serovar Typhi Ty2
aaauaagaguca

SEQ ID NO: 3730568 - RNA, 19 nt, Salmonella enterica enterica serovar Typhi Ty2
aaauaauaaucguuuuaug

SEQ ID NO: 3730569 - RNA, 22 nt, Salmonella enterica enterica serovar Typhi Ty2
aaauaauagguacggggcaucu

SEQ ID NO: 3730570 - RNA, 14 nt, Salmonella enterica enterica serovar Typhi Ty2
aaauaauucauauu

SEQ ID NO: 3730571 - RNA, 17 nt, Salmonella enterica enterica serovar Typhi Ty2
aaauaauuuuguuaaag

SEQ ID NO: 3730572 - RNA, 14 nt, Salmonella enterica enterica serovar Typhi Ty2
aaauaccaaauauu

SEQ ID NO: 3730573 - RNA, 12 nt, Salmonella enterica enterica serovar Typhi Ty2
aaauaccacauc

SEQ ID NO: 3730574 - RNA, 9 nt, Salmonella enterica enterica serovar Typhi Ty2
aaauaccag

SEQ ID NO: 3730575 - RNA, 12 nt, Salmonella enterica enterica serovar Typhi Ty2
aaauaccagcac

SEQ ID NO: 3730576 - RNA, 16 nt, Salmonella enterica enterica serovar Typhi Ty2
aaauaccagcaccuga

SEQ ID NO: 3730577 - RNA, 15 nt, Salmonella enterica enterica serovar Typhi Ty2
aaauacccucaguuc

SEQ ID NO: 3730578 - RNA, 13 nt, Salmonella enterica enterica serovar Typhi Ty2
aaauaccgcacau

SEQ ID NO: 3730579 - RNA, 15 nt, Salmonella enterica enterica serovar Typhi Ty2
aaauaccgcacauca

SEQ ID NO: 3730580 - RNA, 23 nt, Salmonella enterica enterica serovar Typhi Ty2
aaauaccggcagcggucaucaau

SEQ ID NO: 3730581 - RNA, 12 nt, Salmonella enterica enterica serovar Typhi Ty2
aaauaccuaacu

SEQ ID NO: 3730582 - RNA, 16 nt, Salmonella enterica enterica serovar Typhi Ty2
aaauacgcucaauaua

SEQ ID NO: 3730583 - RNA, 15 nt, Salmonella enterica enterica serovar Typhi Ty2
aaauacgcugcggcc

SEQ ID NO: 3730584 - RNA, 22 nt, Salmonella enterica enterica serovar Typhi Ty2
aaauacggcuuccacugcggca

SEQ ID NO: 3730585 - RNA, 14 nt, Salmonella enterica enterica serovar Typhi Ty2
aaauacugauuaau

SEQ ID NO: 3730586 - RNA, 14 nt, Salmonella enterica enterica serovar Typhi Ty2
aaauagaaaauaau

SEQ ID NO: 3730587 - RNA, 17 nt, Salmonella enterica enterica serovar Typhi Ty2
aaauagaaauugcaggg

SEQ ID NO: 3730588 - RNA, 13 nt, Salmonella enterica enterica serovar Typhi Ty2
aaauagagaaaau

SEQ ID NO: 3730589 - RNA, 16 nt, Salmonella enterica enterica serovar Typhi Ty2
aaauagagaaaauaac

SEQ ID NO: 3730590 - RNA, 17 nt, Salmonella enterica enterica serovar Typhi Ty2
aaauagccagaaugcca

SEQ ID NO: 3730591 - RNA, 14 nt, Salmonella enterica enterica serovar Typhi Ty2
aaauagccagcauc

SEQ ID NO: 3730592 - RNA, 22 nt, Salmonella enterica enterica serovar Typhi Ty2
aaauagccccggucaacgcgcc

SEQ ID NO: 3730593 - RNA, 18 nt, Salmonella enterica enterica serovar Typhi Ty2
aaauagcccuaauaggau

SEQ ID NO: 3730594 - RNA, 20 nt, Salmonella enterica enterica serovar Typhi Ty2
aaauagccgaaacuuauacu

SEQ ID NO: 3730595 - RNA, 18 nt, Salmonella enterica enterica serovar Typhi Ty2
aaauagccguuaccgccg

SEQ ID NO: 3730596 - RNA, 14 nt, Salmonella enterica enterica serovar Typhi Ty2
aaauagcuggcugu

SEQ ID NO: 3730597 - RNA, 18 nt, Salmonella enterica enterica serovar Typhi Ty2
aaauaguaaauagaaaau

SEQ ID NO: 3730598 - RNA, 17 nt, Salmonella enterica enterica serovar Typhi Ty2
aaauagugacuucugcu

SEQ ID NO: 3730599 - RNA, 22 nt, Salmonella enterica enterica serovar Typhi Ty2
aaauaguucaucgugaaauuau

SEQ ID NO: 3730600 - RNA, 20 nt, Salmonella enterica enterica serovar Typhi Ty2
aaauauagccauuuaaugau

SEQ ID NO: 3730601 - RNA, 21 nt, Salmonella enterica enterica serovar Typhi Ty2
aaauauagccauuuaaugaug

SEQ ID NO: 3730602 - RNA, 13 nt, Salmonella enterica enterica serovar Typhi Ty2
aaauauaugacaa

SEQ ID NO: 3730603 - RNA, 17 nt, Salmonella enterica enterica serovar Typhi Ty2
aaauaucaaauacgcua

SEQ ID NO: 3730604 - RNA, 23 nt, Salmonella enterica enterica serovar Typhi Ty2
aaauauccgccaucgacagcgcc

SEQ ID NO: 3730605 - RNA, 10 nt, Salmonella enterica enterica serovar Typhi Ty2
aaauauccua

SEQ ID NO: 3730606 - RNA, 17 nt, Salmonella enterica enterica serovar Typhi Ty2
aaauaucgcugcccaga

SEQ ID NO: 3730607 - RNA, 13 nt, Salmonella enterica enterica serovar Typhi Ty2
aaauaucucuccc

SEQ ID NO: 3730608 - RNA, 14 nt, Salmonella enterica enterica serovar Typhi Ty2
aaauauuaauuaag

SEQ ID NO: 3730609 - RNA, 22 nt, Salmonella enterica enterica serovar Typhi Ty2
aaauauugagguauaggaaaau

SEQ ID NO: 3730610 - RNA, 19 nt, Salmonella enterica enterica serovar Typhi Ty2
aaauauugcccguuuuaau

SEQ ID NO: 3730611 - RNA, 18 nt, Salmonella enterica enterica serovar Typhi Ty2
aaauauuggcggcaaaga

SEQ ID NO: 3730612 - RNA, 14 nt, Salmonella enterica enterica serovar Typhi Ty2
aaauauuucuuugu

SEQ ID NO: 3730613 - RNA, 13 nt, Salmonella enterica enterica serovar Typhi Ty2
aaaucaaauaaga

SEQ ID NO: 3730614 - RNA, 18 nt, Salmonella enterica enterica serovar Typhi Ty2
aaaucaacauuauuaaaa

SEQ ID NO: 3730615 - RNA, 22 nt, Salmonella enterica enterica serovar Typhi Ty2
aaaucaacgaaaucagagacaa

SEQ ID NO: 3730616 - RNA, 22 nt, Salmonella enterica enterica serovar Typhi Ty2
aaaucacagggggaacauuuaa

SEQ ID NO: 3730617 - RNA, 18 nt, Salmonella enterica enterica serovar Typhi Ty2
aaaucacccaacguucau

SEQ ID NO: 3730618 - RNA, 15 nt, Salmonella enterica enterica serovar Typhi Ty2
aaaucacgcuggaua

SEQ ID NO: 3730619 - RNA, 18 nt, Salmonella enterica enterica serovar Typhi Ty2
aaaucacguuuacuaaaa

SEQ ID NO: 3730620 - RNA, 20 nt, Salmonella enterica enterica serovar Typhi Ty2
aaaucacuaagaccagcauc

SEQ ID NO: 3730621 - RNA, 21 nt, Salmonella enterica enterica serovar Typhi Ty2
aaaucacuggagcgcauuuua

SEQ ID NO: 3730622 - RNA, 22 nt, Salmonella enterica enterica serovar Typhi Ty2
aaaucacuggagcgcauuuuac

SEQ ID NO: 3730623 - RNA, 20 nt, Salmonella enterica enterica serovar Typhi Ty2
aaaucagcaaaaacauuacc

SEQ ID NO: 3730624 - RNA, 21 nt, Salmonella enterica enterica serovar Typhi Ty2
aaaucagcaaucguuggcgua

SEQ ID NO: 3730625 - RNA, 14 nt, Salmonella enterica enterica serovar Typhi Ty2
aaaucagcauuacc

SEQ ID NO: 3730626 - RNA, 16 nt, Salmonella enterica enterica serovar Typhi Ty2
aaaucagcauuacccc

SEQ ID NO: 3730627 - RNA, 21 nt, Salmonella enterica enterica serovar Typhi Ty2
aaaucagcccggacaucaucc

SEQ ID NO: 3730628 - RNA, 14 nt, Salmonella enterica enterica serovar Typhi Ty2
aaaucaggaaaaag

SEQ ID NO: 3730629 - RNA, 15 nt, Salmonella enterica enterica serovar Typhi Ty2
aaaucaggaaaaagg

SEQ ID NO: 3730630 - RNA, 18 nt, Salmonella enterica enterica serovar Typhi Ty2
aaaucagguaugcuucag

SEQ ID NO: 3730631 - RNA, 20 nt, Salmonella enterica enterica serovar Typhi Ty2
aaaucagugaacacccugcc

SEQ ID NO: 3730632 - RNA, 17 nt, Salmonella enterica enterica serovar Typhi Ty2
aaaucagugauggauuu

SEQ ID NO: 3730633 - RNA, 15 nt, Salmonella enterica enterica serovar Typhi Ty2
aaaucauaccagcga

SEQ ID NO: 3730634 - RNA, 23 nt, Salmonella enterica enterica serovar Typhi Ty2
aaauuauugugagaaaagcagag

SEQ ID NO: 3730635 - RNA, 14 nt, Salmonella enterica enterica serovar Typhi Ty2
aaauuauuuuaaau

SEQ ID NO: 3730636 - RNA, 15 nt, Salmonella enterica enterica serovar Typhi Ty2
aaauuauuuuaaauu

SEQ ID NO: 3730637 - RNA, 12 nt, Salmonella enterica enterica serovar Typhi Ty2
aaauuauuuuca

SEQ ID NO: 3730638 - RNA, 19 nt, Salmonella enterica enterica serovar Typhi Ty2
aaauuauuuuuacuuaaaa

SEQ ID NO: 3730639 - RNA, 20 nt, Salmonella enterica enterica serovar Typhi Ty2
aaauucaaugagaaaguggu

SEQ ID NO: 3730640 - RNA, 16 nt, Salmonella enterica enterica serovar Typhi Ty2
aaauucacaccaaugu

SEQ ID NO: 3730641 - RNA, 20 nt, Salmonella enterica enterica serovar Typhi Ty2
aaauucacccguuauucauu

SEQ ID NO: 3730642 - RNA, 21 nt, Salmonella enterica enterica serovar Typhi Ty2
aaauucacccguuauucauuc

SEQ ID NO: 3730643 - RNA, 22 nt, Salmonella enterica enterica serovar Typhi Ty2
aaauucacgcuucucuggcgcg

SEQ ID NO: 3730644 - RNA, 14 nt, Salmonella enterica enterica serovar Typhi Ty2
aaauucaggguugu

SEQ ID NO: 3730645 - RNA, 23 nt, Salmonella enterica enterica serovar Typhi Ty2
aaauuccagcaaugagccgucgc

SEQ ID NO: 3730646 - RNA, 19 nt, Salmonella enterica enterica serovar Typhi Ty2
aaauuccccauaaucgacc

SEQ ID NO: 3730647 - RNA, 16 nt, Salmonella enterica enterica serovar Typhi Ty2
aaauuccuggauuaaa

SEQ ID NO: 3730648 - RNA, 17 nt, Salmonella enterica enterica serovar Typhi Ty2
aaauuccuuguuuuaac

SEQ ID NO: 3730649 - RNA, 12 nt, Salmonella enterica enterica serovar Typhi Ty2
aaauucgaaaua

SEQ ID NO: 3730650 - RNA, 16 nt, Salmonella enterica enterica serovar Typhi Ty2
aaauucgaaauaaaga

SEQ ID NO: 3730651 - RNA, 19 nt, Salmonella enterica enterica serovar Typhi Ty2
aaauucgcuaauccccccu

SEQ ID NO: 3730652 - RNA, 21 nt, Salmonella enterica enterica serovar Typhi Ty2
aaauucggcguuacccgucug

SEQ ID NO: 3730653 - RNA, 20 nt, Salmonella enterica enterica serovar Typhi Ty2
aaauucuuuacgcagcaaga

SEQ ID NO: 3730654 - RNA, 12 nt, Salmonella enterica enterica serovar Typhi Ty2
aaauucuuuuca

SEQ ID NO: 3730655 - RNA, 14 nt, Salmonella enterica enterica serovar Typhi Ty2
aaauugagaauuau

SEQ ID NO: 3730656 - RNA, 18 nt, Salmonella enterica enterica serovar Typhi Ty2
aaauugagaauuauucgu

SEQ ID NO: 3730657 - RNA, 15 nt, Salmonella enterica enterica serovar Typhi Ty2
aaauugaucacaaaa

SEQ ID NO: 3730658 - RNA, 21 nt, Salmonella enterica enterica serovar Typhi Ty2
aaauugccgcgcccugcggaa

SEQ ID NO: 3730659 - RNA, 17 nt, Salmonella enterica enterica serovar Typhi Ty2
aaauuggaguuaucauu

SEQ ID NO: 3730660 - RNA, 22 nt, Salmonella enterica enterica serovar Typhi Ty2
aaauuggguaguaauauuaaaa

SEQ ID NO: 3730661 - RNA, 15 nt, Salmonella enterica enterica serovar Typhi Ty2
aaauuggugauauaa

SEQ ID NO: 3730662 - RNA, 18 nt, Salmonella enterica enterica serovar Typhi Ty2
aaauuguuuaaaaacagg

SEQ ID NO: 3730663 - RNA, 14 nt, Salmonella enterica enterica serovar Typhi Ty2
aaauuuaauauaug

SEQ ID NO: 3730664 - RNA, 16 nt, Salmonella enterica enterica serovar Typhi Ty2
aaauuuaauauaugaa

SEQ ID NO: 3730665 - RNA, 13 nt, Salmonella enterica enterica serovar Typhi Ty2
aaauuuagcuauu

SEQ ID NO: 3730666 - RNA, 19 nt, Salmonella enterica enterica serovar Typhi Ty2
aaauuuagcuauuccaaaa

SEQ ID NO: 3730667 - RNA, 22 nt, Salmonella enterica enterica serovar Typhi Ty2
aaauuucaacccgaucgccauc

SEQ ID NO: 3730668 - RNA, 23 nt, Salmonella enterica enterica serovar Typhi Ty2
aaauuucacgucacguucauccu

SEQ ID NO: 3730669 - RNA, 20 nt, Salmonella enterica enterica serovar Typhi Ty2
aaauuuccgcagccagaauc

SEQ ID NO: 3730670 - RNA, 21 nt, Salmonella enterica enterica serovar Typhi Ty2
aaauuucgaaacaggaaaaac

SEQ ID NO: 3730671 - RNA, 14 nt, Salmonella enterica enterica serovar Typhi Ty2
aaauuucugaugug

SEQ ID NO: 3730672 - RNA, 20 nt, Salmonella enterica enterica serovar Typhi Ty2
aaauuugucagacaugauaa

SEQ ID NO: 3730673 - RNA, 20 nt, Salmonella enterica enterica serovar Typhi Ty2
aaauuuucaaccacggauaa

SEQ ID NO: 3730674 - RNA, 22 nt, Salmonella enterica enterica serovar Typhi Ty2
aacaaaaagauauuauaaaaua

SEQ ID NO: 3730675 - RNA, 14 nt, Salmonella enterica enterica serovar Typhi Ty2
aacaaaaccagcau

SEQ ID NO: 3730676 - RNA, 16 nt, Salmonella enterica enterica serovar Typhi Ty2
aacaaaacggaauguu

SEQ ID NO: 3730677 - RNA, 16 nt, Salmonella enterica enterica serovar Typhi Ty2
aacaaacacaaucaca

SEQ ID NO: 3730678 - RNA, 14 nt, Salmonella enterica enterica serovar Typhi Ty2
aacaaagggcaccu

SEQ ID NO: 3730679 - RNA, 14 nt, Salmonella enterica enterica serovar Typhi Ty2
aacaaauaaaucca

SEQ ID NO: 3730680 - RNA, 11 nt, Salmonella enterica enterica serovar Typhi Ty2
aacaaaugaag

SEQ ID NO: 3730681 - RNA, 18 nt, Salmonella enterica enterica serovar Typhi Ty2
aacaacacgaucgaugcc

SEQ ID NO: 3730682 - RNA, 22 nt, Salmonella enterica enterica serovar Typhi Ty2
aacaacauugaggcuacccaga

SEQ ID NO: 3730683 - RNA, 15 nt, Salmonella enterica enterica serovar Typhi Ty2
aacaaccagaauaau

SEQ ID NO: 3730684 - RNA, 14 nt, Salmonella enterica enterica serovar Typhi Ty2
aacaacggcacaca

SEQ ID NO: 3730685 - RNA, 19 nt, Salmonella enterica enterica serovar Typhi Ty2
aacaacggcauacaggccg

SEQ ID NO: 3730686 - RNA, 14 nt, Salmonella enterica enterica serovar Typhi Ty2
aacaacuguuuuuc

SEQ ID NO: 3730687 - RNA, 20 nt, Salmonella enterica enterica serovar Typhi Ty2
aacaacuguuuuucacuaau

SEQ ID NO: 3730688 - RNA, 23 nt, Salmonella enterica enterica serovar Typhi Ty2
aacaagccgccaacgccagcagc

SEQ ID NO: 3730689 - RNA, 13 nt, Salmonella enterica enterica serovar Typhi Ty2
aacaagggcauaa

SEQ ID NO: 3730690 - RNA, 22 nt, Salmonella enterica enterica serovar Typhi Ty2
aacaauagaccugaaaucagcc

SEQ ID NO: 3730691 - RNA, 12 nt, Salmonella enterica enterica serovar Typhi Ty2
aacaauauuaaa

SEQ ID NO: 3730692 - RNA, 19 nt, Salmonella enterica enterica serovar Typhi Ty2
aacaauccccgucacagcg

SEQ ID NO: 3730693 - RNA, 19 nt, Salmonella enterica enterica serovar Typhi Ty2
aacaaugccauuauugcau

SEQ ID NO: 3730694 - RNA, 20 nt, Salmonella enterica enterica serovar Typhi Ty2
aacaauuacgccuacuggga

SEQ ID NO: 3730695 - RNA, 17 nt, Salmonella enterica enterica serovar Typhi Ty2
aacacaaacuggaccca

SEQ ID NO: 3730696 - RNA, 18 nt, Salmonella enterica enterica serovar Typhi Ty2
aacacacaguugccuucg

SEQ ID NO: 3730697 - RNA, 16 nt, Salmonella enterica enterica serovar Typhi Ty2
aacacacuuucugcuu

SEQ ID NO: 3730698 - RNA, 22 nt, Salmonella enterica enterica serovar Typhi Ty2
aacacauaacgcccgacaaucg

SEQ ID NO: 3730699 - RNA, 15 nt, Salmonella enterica enterica serovar Typhi Ty2
aacaccacaacacac

SEQ ID NO: 3730700 - RNA, 13 nt, Salmonella enterica enterica serovar Typhi Ty2
aacaccagacuga

SEQ ID NO: 3730701 - RNA, 12 nt, Salmonella enterica enterica serovar Typhi Ty2
aacaccagauca

SEQ ID NO: 3730702 - RNA, 17 nt, Salmonella enterica enterica serovar Typhi Ty2
aacaccagcgauccaga

SEQ ID NO: 3730703 - RNA, 21 nt, Salmonella enterica enterica serovar Typhi Ty2
aacacccacaccaucgucgcg

SEQ ID NO: 3730704 - RNA, 18 nt, Salmonella enterica enterica serovar Typhi Ty2
aacaccgcauggcuggca

SEQ ID NO: 3730705 - RNA, 15 nt, Salmonella enterica enterica serovar Typhi Ty2
aacaccggggcauuu

SEQ ID NO: 3730706 - RNA, 20 nt, Salmonella enterica enterica serovar Typhi Ty2
aacaccucagccacccacug

SEQ ID NO: 3730707 - RNA, 22 nt, Salmonella enterica enterica serovar Typhi Ty2
aacaccuguaacgucacauucc

SEQ ID NO: 3730708 - RNA, 16 nt, Salmonella enterica enterica serovar Typhi Ty2
aacaccuuauccggcc

SEQ ID NO: 3730709 - RNA, 20 nt, Salmonella enterica enterica serovar Typhi Ty2
aacaccuuuggggaaaggua

SEQ ID NO: 3730710 - RNA, 13 nt, Salmonella enterica enterica serovar Typhi Ty2
aacacgaauaugc

SEQ ID NO: 3730711 - RNA, 15 nt, Salmonella enterica enterica serovar Typhi Ty2
aacacgauaaaacgc

SEQ ID NO: 3730712 - RNA, 18 nt, Salmonella enterica enterica serovar Typhi Ty2
aacacgauggcaaauaau

SEQ ID NO: 3730713 - RNA, 13 nt, Salmonella enterica enterica serovar Typhi Ty2
aacacgccgcgcu

SEQ ID NO: 3730714 - RNA, 15 nt, Salmonella enterica enterica serovar Typhi Ty2
aacacgucgauuuuc

SEQ ID NO: 3730715 - RNA, 20 nt, Salmonella enterica enterica serovar Typhi Ty2
aacacuaacuaauuguuugu

SEQ ID NO: 3730716 - RNA, 17 nt, Salmonella enterica enterica serovar Typhi Ty2
aacaucuuuuaccugug

SEQ ID NO: 3730717 - RNA, 14 nt, Salmonella enterica enterica serovar Typhi Ty2
aacaugaccagcgc

SEQ ID NO: 3730718 - RNA, 22 nt, Salmonella enterica enterica serovar Typhi Ty2
aacaugccugauggcgcugcgc

SEQ ID NO: 3730719 - RNA, 17 nt, Salmonella enterica enterica serovar Typhi Ty2
aacauggauucgcugga

SEQ ID NO: 3730720 - RNA, 16 nt, Salmonella enterica enterica serovar Typhi Ty2
aacauggggagcagca

SEQ ID NO: 3730721 - RNA, 16 nt, Salmonella enterica enterica serovar Typhi Ty2
aacauggguuucuugc

SEQ ID NO: 3730722 - RNA, 20 nt, Salmonella enterica enterica serovar Typhi Ty2
aacauggguuugacccauuu

SEQ ID NO: 3730723 - RNA, 16 nt, Salmonella enterica enterica serovar Typhi Ty2
aacaugucaaaauccu

SEQ ID NO: 3730724 - RNA, 20 nt, Salmonella enterica enterica serovar Typhi Ty2
aacauuaaucgccauugcaa

SEQ ID NO: 3730725 - RNA, 13 nt, Salmonella enterica enterica serovar Typhi Ty2
aacauuacugacc

SEQ ID NO: 3730726 - RNA, 17 nt, Salmonella enterica enterica serovar Typhi Ty2
aacauuaucaaaaguga

SEQ ID NO: 3730727 - RNA, 19 nt, Salmonella enterica enterica serovar Typhi Ty2
aacauuauuaaaaugucuu

SEQ ID NO: 3730728 - RNA, 17 nt, Salmonella enterica enterica serovar Typhi Ty2
aacauucaaaccuucaa

SEQ ID NO: 3730729 - RNA, 20 nt, Salmonella enterica enterica serovar Typhi Ty2
aacauuccgcccaagaacau

SEQ ID NO: 3730730 - RNA, 22 nt, Salmonella enterica enterica serovar Typhi Ty2
aacauuccgcccaagaacauga

SEQ ID NO: 3730731 - RNA, 12 nt, Salmonella enterica enterica serovar Typhi Ty2
aacauuccgcuu

SEQ ID NO: 3730732 - RNA, 14 nt, Salmonella enterica enterica serovar Typhi Ty2
aacauuucagcgcc

SEQ ID NO: 3730733 - RNA, 14 nt, Salmonella enterica enterica serovar Typhi Ty2
aaccaaaaaauaug

SEQ ID NO: 3730734 - RNA, 17 nt, Salmonella enterica enterica serovar Typhi Ty2
aaccaaagguauugccu

SEQ ID NO: 3730735 - RNA, 16 nt, Salmonella enterica enterica serovar Typhi Ty2
aaccaacgcauaaaaa

SEQ ID NO: 3730736 - RNA, 20 nt, Salmonella enterica enterica serovar Typhi Ty2
aaccaauuuaaaauccggcu

SEQ ID NO: 3730737 - RNA, 15 nt, Salmonella enterica enterica serovar Typhi Ty2
aaccacaaguuuauc

SEQ ID NO: 3730738 - RNA, 20 nt, Salmonella enterica enterica serovar Typhi Ty2
aaccacaaguuuauccagca

SEQ ID NO: 3730739 - RNA, 14 nt, Salmonella enterica enterica serovar Typhi Ty2
aaccaccaaaaagc

SEQ ID NO: 3730740 - RNA, 19 nt, Salmonella enterica enterica serovar Typhi Ty2
aaccaccagcggaaucccc

SEQ ID NO: 3730741 - RNA, 10 nt, Salmonella enterica enterica serovar Typhi Ty2
aaccacgcca

SEQ ID NO: 3730742 - RNA, 20 nt, Salmonella enterica enterica serovar Typhi Ty2
aaccacggagagacaguuca

SEQ ID NO: 3730743 - RNA, 22 nt, Salmonella enterica enterica serovar Typhi Ty2
aaccacuuugggccgaaggaag

SEQ ID NO: 3730744 - RNA, 17 nt, Salmonella enterica enterica serovar Typhi Ty2
aaccagaauaaugggga

SEQ ID NO: 3730745 - RNA, 21 nt, Salmonella enterica enterica serovar Typhi Ty2
aaccagacccguugcgucacg

SEQ ID NO: 3730746 - RNA, 23 nt, Salmonella enterica enterica serovar Typhi Ty2
aaccagaguccggcgccugaaua

SEQ ID NO: 3730747 - RNA, 18 nt, Salmonella enterica enterica serovar Typhi Ty2
aaccagcccaugaaggag

SEQ ID NO: 3730748 - RNA, 12 nt, Salmonella enterica enterica serovar Typhi Ty2
aaccagccgauc

SEQ ID NO: 3730749 - RNA, 16 nt, Salmonella enterica enterica serovar Typhi Ty2
aaccagcgaaaugacg

SEQ ID NO: 3730750 - RNA, 20 nt, Salmonella enterica enterica serovar Typhi Ty2
aaccagcgcgccgccaacgc

SEQ ID NO: 3730751 - RNA, 23 nt, Salmonella enterica enterica serovar Typhi Ty2
aaccagcggcgacacaacggcac

SEQ ID NO: 3730752 - RNA, 14 nt, Salmonella enterica enterica serovar Typhi Ty2
aaccagcuuuucau

SEQ ID NO: 3730753 - RNA, 11 nt, Salmonella enterica enterica serovar Typhi Ty2
aaccaggcaaa

SEQ ID NO: 3730754 - RNA, 16 nt, Salmonella enterica enterica serovar Typhi Ty2
aaccaggcaaaaauag

SEQ ID NO: 3730755 - RNA, 18 nt, Salmonella enterica enterica serovar Typhi Ty2
aaccaggcaaaccagcac

SEQ ID NO: 3730756 - RNA, 14 nt, Salmonella enterica enterica serovar Typhi Ty2
aaccaggcauuuua

SEQ ID NO: 3730757 - RNA, 10 nt, Salmonella enterica enterica serovar Typhi Ty2
aaccagggag

SEQ ID NO: 3730758 - RNA, 13 nt, Salmonella enterica enterica serovar Typhi Ty2
aaccagguaaucc

SEQ ID NO: 3730759 - RNA, 16 nt, Salmonella enterica enterica serovar Typhi Ty2
aaccaguaacggcagu

SEQ ID NO: 3730760 - RNA, 18 nt, Salmonella enterica enterica serovar Typhi Ty2
aaccagugaauacugcgc

SEQ ID NO: 3730761 - RNA, 14 nt, Salmonella enterica enterica serovar Typhi Ty2
aaccauaauaaaua

SEQ ID NO: 3730762 - RNA, 17 nt, Salmonella enterica enterica serovar Typhi Ty2
aaccauacauccugauu

SEQ ID NO: 3730763 - RNA, 13 nt, Salmonella enterica enterica serovar Typhi Ty2
aaccaucggcaaa

SEQ ID NO: 3730764 - RNA, 12 nt, Salmonella enterica enterica serovar Typhi Ty2
aaccaugaucac

SEQ ID NO: 3730765 - RNA, 18 nt, Salmonella enterica enterica serovar Typhi Ty2
aaccaugcgagaucggca

SEQ ID NO: 3730766 - RNA, 22 nt, Salmonella enterica enterica serovar Typhi Ty2
aaccauguugaucguaaaauga

SEQ ID NO: 3730767 - RNA, 21 nt, Salmonella enterica enterica serovar Typhi Ty2
aaccauucccguaaaagaaga

SEQ ID NO: 3730768 - RNA, 15 nt, Salmonella enterica enterica serovar Typhi Ty2
aaccauuuccucugc

SEQ ID NO: 3730769 - RNA, 16 nt, Salmonella enterica enterica serovar Typhi Ty2
aacccacaagaaaugc

SEQ ID NO: 3730770 - RNA, 14 nt, Salmonella enterica enterica serovar Typhi Ty2
aacccaccagcagg

SEQ ID NO: 3730771 - RNA, 13 nt, Salmonella enterica enterica serovar Typhi Ty2
aacccaccagcgc

SEQ ID NO: 3730772 - RNA, 14 nt, Salmonella enterica enterica serovar Typhi Ty2
aacccacuuugcuu

SEQ ID NO: 3730773 - RNA, 17 nt, Salmonella enterica enterica serovar Typhi Ty2
aacccagauaucagucu

SEQ ID NO: 3730774 - RNA, 15 nt, Salmonella enterica enterica serovar Typhi Ty2
aacccauauuccugc

SEQ ID NO: 3730775 - RNA, 15 nt, Salmonella enterica enterica serovar Typhi Ty2
aaccccaaaucagca

SEQ ID NO: 3730776 - RNA, 19 nt, Salmonella enterica enterica serovar Typhi Ty2
aaccccacccacugauaaa

SEQ ID NO: 3730777 - RNA, 16 nt, Salmonella enterica enterica serovar Typhi Ty2
aaccccagcugcggca

SEQ ID NO: 3730778 - RNA, 15 nt, Salmonella enterica enterica serovar Typhi Ty2
aaccccaucccggca

SEQ ID NO: 3730779 - RNA, 22 nt, Salmonella enterica enterica serovar Typhi Ty2
aaccccggcaaaccuaccggca

SEQ ID NO: 3730780 - RNA, 13 nt, Salmonella enterica enterica serovar Typhi Ty2
aaccccugcucgc

SEQ ID NO: 3730781 - RNA, 14 nt, Salmonella enterica enterica serovar Typhi Ty2
aacccgauacccug

SEQ ID NO: 3730782 - RNA, 20 nt, Salmonella enterica enterica serovar Typhi Ty2
aacccgaucgccauccugca

SEQ ID NO: 3730783 - RNA, 21 nt, Salmonella enterica enterica serovar Typhi Ty2
aacccgaucgccauccugcac

SEQ ID NO: 3730784 - RNA, 23 nt, Salmonella enterica enterica serovar Typhi Ty2
aacccgaucgccauccugcaccg

SEQ ID NO: 3730785 - RNA, 15 nt, Salmonella enterica enterica serovar Typhi Ty2
aacccgccgccauca

SEQ ID NO: 3730786 - RNA, 17 nt, Salmonella enterica enterica serovar Typhi Ty2
aacccgccgccaucaac

SEQ ID NO: 3730787 - RNA, 12 nt, Salmonella enterica enterica serovar Typhi Ty2
aacccggcauuu

SEQ ID NO: 3730788 - RNA, 14 nt, Salmonella enterica enterica serovar Typhi Ty2
aacccggcauuucu

SEQ ID NO: 3730789 - RNA, 15 nt, Salmonella enterica enterica serovar Typhi Ty2
aacccucaucgguca

SEQ ID NO: 3730790 - RNA, 20 nt, Salmonella enterica enterica serovar Typhi Ty2
aacccugguuugcuggaaau

SEQ ID NO: 3730791 - RNA, 23 nt, Salmonella enterica enterica serovar Typhi Ty2
aacccuuucauucgucaaauuca

SEQ ID NO: 3730792 - RNA, 19 nt, Salmonella enterica enterica serovar Typhi Ty2
aaccgaaagaagaaaccau

SEQ ID NO: 3730793 - RNA, 16 nt, Salmonella enterica enterica serovar Typhi Ty2
aaccgaauaacgccag

SEQ ID NO: 3730794 - RNA, 23 nt, Salmonella enterica enterica serovar Typhi Ty2
aaccgacaauauucgccgcgaua

SEQ ID NO: 3730795 - RNA, 16 nt, Salmonella enterica enterica serovar Typhi Ty2
aaccgacccaaaaaug

SEQ ID NO: 3730796 - RNA, 18 nt, Salmonella enterica enterica serovar Typhi Ty2
aaccgacgaaagauaaaa

SEQ ID NO: 3730797 - RNA, 20 nt, Salmonella enterica enterica serovar Typhi Ty2
aaccgacggugcucaugaca

SEQ ID NO: 3730798 - RNA, 19 nt, Salmonella enterica enterica serovar Typhi Ty2
aacggcgcguccagccagc

SEQ ID NO: 3730799 - RNA, 20 nt, Salmonella enterica enterica serovar Typhi Ty2
aacggcgcuggcguacgcau

SEQ ID NO: 3730800 - RNA, 14 nt, Salmonella enterica enterica serovar Typhi Ty2
aacggcguaccaga

SEQ ID NO: 3730801 - RNA, 19 nt, Salmonella enterica enterica serovar Typhi Ty2
aacggcgugaaucccccug

SEQ ID NO: 3730802 - RNA, 15 nt, Salmonella enterica enterica serovar Typhi Ty2
aacggcuacgcagcg

SEQ ID NO: 3730803 - RNA, 12 nt, Salmonella enterica enterica serovar Typhi Ty2
aacggcucugca

SEQ ID NO: 3730804 - RNA, 21 nt, Salmonella enterica enterica serovar Typhi Ty2
aacggcugacgcccaucagca

SEQ ID NO: 3730805 - RNA, 20 nt, Salmonella enterica enterica serovar Typhi Ty2
aacggcuugugagcgucgcg

SEQ ID NO: 3730806 - RNA, 18 nt, Salmonella enterica enterica serovar Typhi Ty2
aacggcuuuccagcagcc

SEQ ID NO: 3730807 - RNA, 17 nt, Salmonella enterica enterica serovar Typhi Ty2
aacgggcaucgccgcaa

SEQ ID NO: 3730808 - RNA, 12 nt, Salmonella enterica enterica serovar Typhi Ty2
aacgggcgauaa

SEQ ID NO: 3730809 - RNA, 15 nt, Salmonella enterica enterica serovar Typhi Ty2
aacgggcggcggcuu

SEQ ID NO: 3730810 - RNA, 12 nt, Salmonella enterica enterica serovar Typhi Ty2
aacgguaacgga

SEQ ID NO: 3730811 - RNA, 14 nt, Salmonella enterica enterica serovar Typhi Ty2
aacgguaacggaca

SEQ ID NO: 3730812 - RNA, 12 nt, Salmonella enterica enterica serovar Typhi Ty2
aacggucaggau

SEQ ID NO: 3730813 - RNA, 21 nt, Salmonella enterica enterica serovar Typhi Ty2
aacggucgguaaucgccugca

SEQ ID NO: 3730814 - RNA, 18 nt, Salmonella enterica enterica serovar Typhi Ty2
aacgguucauccagcagc

SEQ ID NO: 3730815 - RNA, 20 nt, Salmonella enterica enterica serovar Typhi Ty2
aacguaaacggcagccgcca

SEQ ID NO: 3730816 - RNA, 23 nt, Salmonella enterica enterica serovar Typhi Ty2
aacguaaagcuggccuucagguu

SEQ ID NO: 3730817 - RNA, 16 nt, Salmonella enterica enterica serovar Typhi Ty2
aacguaaauacccagg

SEQ ID NO: 3730818 - RNA, 19 nt, Salmonella enterica enterica serovar Typhi Ty2
aacguaaauacccaggcca

SEQ ID NO: 3730819 - RNA, 22 nt, Salmonella enterica enterica serovar Typhi Ty2
aacguaaauacccaggccauca

SEQ ID NO: 3730820 - RNA, 21 nt, Salmonella enterica enterica serovar Typhi Ty2
aacguaaauagagaaaucaac

SEQ ID NO: 3730821 - RNA, 20 nt, Salmonella enterica enterica serovar Typhi Ty2
aacguaaucaucaugcugca

SEQ ID NO: 3730822 - RNA, 18 nt, Salmonella enterica enterica serovar Typhi Ty2
aacguaccgaugacggca

SEQ ID NO: 3730823 - RNA, 19 nt, Salmonella enterica enterica serovar Typhi Ty2
aacguagcccauugucauc

SEQ ID NO: 3730824 - RNA, 21 nt, Salmonella enterica enterica serovar Typhi Ty2
aacguaugugauuagcccacc

SEQ ID NO: 3730825 - RNA, 13 nt, Salmonella enterica enterica serovar Typhi Ty2
aacgucagcgcca

SEQ ID NO: 3730826 - RNA, 20 nt, Salmonella enterica enterica serovar Typhi Ty2
aacgucagcgccacccauuu

SEQ ID NO: 3730827 - RNA, 21 nt, Salmonella enterica enterica serovar Typhi Ty2
aacgucagcuggaaugcccac

SEQ ID NO: 3730828 - RNA, 15 nt, Salmonella enterica enterica serovar Typhi Ty2
aacguccaacuaugc

SEQ ID NO: 3730829 - RNA, 16 nt, Salmonella enterica enterica serovar Typhi Ty2
aacgucguaaaaccug

SEQ ID NO: 3730830 - RNA, 19 nt, Salmonella enterica enterica serovar Typhi Ty2
aacgucguaaaaccugcgu

SEQ ID NO: 3730831 - RNA, 20 nt, Salmonella enterica enterica serovar Typhi Ty2
aacgucuuauccggccugca

SEQ ID NO: 3730832 - RNA, 17 nt, Salmonella enterica enterica serovar Typhi Ty2
aacgucuugccaugugc

SEQ ID NO: 3730833 - RNA, 12 nt, Salmonella enterica enterica serovar Typhi Ty2
aacgugcagaug

SEQ ID NO: 3730834 - RNA, 23 nt, Salmonella enterica enterica serovar Typhi Ty2
aacgugcauuauuuuagugaaaa

SEQ ID NO: 3730835 - RNA, 12 nt, Salmonella enterica enterica serovar Typhi Ty2
aacguggcggca

SEQ ID NO: 3730836 - RNA, 21 nt, Salmonella enterica enterica serovar Typhi Ty2
aacguguccaguuuuuuacuu

SEQ ID NO: 3730837 - RNA, 12 nt, Salmonella enterica enterica serovar Typhi Ty2
aacguguuaucg

SEQ ID NO: 3730838 - RNA, 22 nt, Salmonella enterica enterica serovar Typhi Ty2
aacguuacauuuuccaugccuu

SEQ ID NO: 3730839 - RNA, 19 nt, Salmonella enterica enterica serovar Typhi Ty2
aacguuauuggcaggaugu

SEQ ID NO: 3730840 - RNA, 22 nt, Salmonella enterica enterica serovar Typhi Ty2
aacguuguccagcggccaugac

SEQ ID NO: 3730841 - RNA, 21 nt, Salmonella enterica enterica serovar Typhi Ty2
aacguuuaaugucaccaucau

SEQ ID NO: 3730842 - RNA, 19 nt, Salmonella enterica enterica serovar Typhi Ty2
aacguuucuuucaucagau

SEQ ID NO: 3730843 - RNA, 14 nt, Salmonella enterica enterica serovar Typhi Ty2
aacguuugccagcg

SEQ ID NO: 3730844 - RNA, 15 nt, Salmonella enterica enterica serovar Typhi Ty2
aacguuuuacgcugc

SEQ ID NO: 3730845 - RNA, 19 nt, Salmonella enterica enterica serovar Typhi Ty2
aacguuuuucagccgcgca

SEQ ID NO: 3730846 - RNA, 22 nt, Salmonella enterica enterica serovar Typhi Ty2
aacguuuuuccuugauuucauu

SEQ ID NO: 3730847 - RNA, 16 nt, Salmonella enterica enterica serovar Typhi Ty2
aacuaaaaauucaaaa

SEQ ID NO: 3730848 - RNA, 21 nt, Salmonella enterica enterica serovar Typhi Ty2
aacuaauuguuuguagaaagu

SEQ ID NO: 3730849 - RNA, 14 nt, Salmonella enterica enterica serovar Typhi Ty2
aacuauuaauucuu

SEQ ID NO: 3730850 - RNA, 12 nt, Salmonella enterica enterica serovar Typhi Ty2
aacucaagguag

SEQ ID NO: 3730851 - RNA, 14 nt, Salmonella enterica enterica serovar Typhi Ty2
aacucaaucaggcu

SEQ ID NO: 3730852 - RNA, 17 nt, Salmonella enterica enterica serovar Typhi Ty2
aacucacguuccccagc

SEQ ID NO: 3730853 - RNA, 19 nt, Salmonella enterica enterica serovar Typhi Ty2
aacucacguuccccagcac

SEQ ID NO: 3730854 - RNA, 23 nt, Salmonella enterica enterica serovar Typhi Ty2
aacucauccaccuuauccuggca

SEQ ID NO: 3730855 - RNA, 20 nt, Salmonella enterica enterica serovar Typhi Ty2
aacucaucgcuuagcggcuc

SEQ ID NO: 3730856 - RNA, 22 nt, Salmonella enterica enterica serovar Typhi Ty2
aacucaugccguagaacagcau

SEQ ID NO: 3730857 - RNA, 14 nt, Salmonella enterica enterica serovar Typhi Ty2
aacuccaccugauc

SEQ ID NO: 3730858 - RNA, 17 nt, Salmonella enterica enterica serovar Typhi Ty2
aacuccagugcagaaag

SEQ ID NO: 3730859 - RNA, 17 nt, Salmonella enterica enterica serovar Typhi Ty2
aacucccgcauauauug

SEQ ID NO: 3730860 - RNA, 13 nt, Salmonella enterica enterica serovar Typhi Ty2
aacuccuccggcg

SEQ ID NO: 3730861 - RNA, 15 nt, Salmonella enterica enterica serovar Typhi Ty2
aacuccucuuccgac

SEQ ID NO: 3730862 - RNA, 20 nt, Salmonella enterica enterica serovar Typhi Ty2
aacucgccaugccaucggcc

SEQ ID NO: 3730863 - RNA, 14 nt, Salmonella enterica enterica serovar Typhi Ty2
aacucuaugcaaaa

SEQ ID NO: 3730864 - RNA, 23 nt, Salmonella enterica enterica serovar Typhi Ty2
aacucuaugcaaaagaaaaaacu

SEQ ID NO: 3730865 - RNA, 20 nt, Salmonella enterica enterica serovar Typhi Ty2
aacucucaccgaccugccuu

SEQ ID NO: 3730866 - RNA, 18 nt, Salmonella enterica enterica serovar Typhi Ty2
aacucucccacuuugcuc

SEQ ID NO: 3730867 - RNA, 20 nt, Salmonella enterica enterica serovar Typhi Ty2
aacucucguucggucaggau

SEQ ID NO: 3730868 - RNA, 23 nt, Salmonella enterica enterica serovar Typhi Ty2
aacucuggaucaguuccggauua

SEQ ID NO: 3730869 - RNA, 20 nt, Salmonella enterica enterica serovar Typhi Ty2
aacucuuccccgaucagaaa

SEQ ID NO: 3730870 - RNA, 19 nt, Salmonella enterica enterica serovar Typhi Ty2
aacucuuuuucagcaaaua

SEQ ID NO: 3730871 - RNA, 15 nt, Salmonella enterica enterica serovar Typhi Ty2
aacugaaccaacagc

SEQ ID NO: 3730872 - RNA, 13 nt, Salmonella enterica enterica serovar Typhi Ty2
aacugaauuucau

SEQ ID NO: 3730873 - RNA, 22 nt, Salmonella enterica enterica serovar Typhi Ty2
aacugaauuucauccccggcgc

SEQ ID NO: 3730874 - RNA, 20 nt, Salmonella enterica enterica serovar Typhi Ty2
aacugauaguuuaaauccag

SEQ ID NO: 3730875 - RNA, 20 nt, Salmonella enterica enterica serovar Typhi Ty2
aacugauauuacuaauaaaa

SEQ ID NO: 3730876 - RNA, 22 nt, Salmonella enterica enterica serovar Typhi Ty2
aacugauccugcguuaacgacc

SEQ ID NO: 3730877 - RNA, 20 nt, Salmonella enterica enterica serovar Typhi Ty2
aacugauggcgcuaagccag

SEQ ID NO: 3730878 - RNA, 23 nt, Salmonella enterica enterica serovar Typhi Ty2
aacugauggcgcuaagccagcca

SEQ ID NO: 3730879 - RNA, 22 nt, Salmonella enterica enterica serovar Typhi Ty2
aagaauagccggauaaaauuau

SEQ ID NO: 3730880 - RNA, 16 nt, Salmonella enterica enterica serovar Typhi Ty2
aagaauagccugggca

SEQ ID NO: 3730881 - RNA, 22 nt, Salmonella enterica enterica serovar Typhi Ty2
aagaauaucggcgucaacguuu

SEQ ID NO: 3730882 - RNA, 14 nt, Salmonella enterica enterica serovar Typhi Ty2
aagaaucacgccga

SEQ ID NO: 3730883 - RNA, 17 nt, Salmonella enterica enterica serovar Typhi Ty2
aagaaucacgccgauga

SEQ ID NO: 3730884 - RNA, 19 nt, Salmonella enterica enterica serovar Typhi Ty2
aagaaucgauguaguuguu

SEQ ID NO: 3730885 - RNA, 19 nt, Salmonella enterica enterica serovar Typhi Ty2
aagaaucuguauaaaauau

SEQ ID NO: 3730886 - RNA, 14 nt, Salmonella enterica enterica serovar Typhi Ty2
aagaauuucaauca

SEQ ID NO: 3730887 - RNA, 18 nt, Salmonella enterica enterica serovar Typhi Ty2
aagaauuucaaucaucau

SEQ ID NO: 3730888 - RNA, 19 nt, Salmonella enterica enterica serovar Typhi Ty2
aagacagaagcugagaaaa

SEQ ID NO: 3730889 - RNA, 20 nt, Salmonella enterica enterica serovar Typhi Ty2
aagacagcaggcuuugcugc

SEQ ID NO: 3730890 - RNA, 22 nt, Salmonella enterica enterica serovar Typhi Ty2
aagaccaauaaaacgcccccug

SEQ ID NO: 3730891 - RNA, 13 nt, Salmonella enterica enterica serovar Typhi Ty2
aagaccagauuaa

SEQ ID NO: 3730892 - RNA, 22 nt, Salmonella enterica enterica serovar Typhi Ty2
aagaccagauuaaucagcagau

SEQ ID NO: 3730893 - RNA, 11 nt, Salmonella enterica enterica serovar Typhi Ty2
aagaccagcau

SEQ ID NO: 3730894 - RNA, 17 nt, Salmonella enterica enterica serovar Typhi Ty2
aagaccgauagagacug

SEQ ID NO: 3730895 - RNA, 16 nt, Salmonella enterica enterica serovar Typhi Ty2
aagaccugcuucaggu

SEQ ID NO: 3730896 - RNA, 22 nt, Salmonella enterica enterica serovar Typhi Ty2
aagaccugcuucagguuaagug

SEQ ID NO: 3730897 - RNA, 22 nt, Salmonella enterica enterica serovar Typhi Ty2
aagacggcagcgccauccggca

SEQ ID NO: 3730898 - RNA, 22 nt, Salmonella enterica enterica serovar Typhi Ty2
aagacuacuuaccggcgccaga

SEQ ID NO: 3730899 - RNA, 16 nt, Salmonella enterica enterica serovar Typhi Ty2
aagacuccggcagcau

SEQ ID NO: 3730900 - RNA, 18 nt, Salmonella enterica enterica serovar Typhi Ty2
aagacuggcccugccgga

SEQ ID NO: 3730901 - RNA, 17 nt, Salmonella enterica enterica serovar Typhi Ty2
aagagaaaaaucaguca

SEQ ID NO: 3730902 - RNA, 11 nt, Salmonella enterica enterica serovar Typhi Ty2
aagagaaaacc

SEQ ID NO: 3730903 - RNA, 13 nt, Salmonella enterica enterica serovar Typhi Ty2
aagagaaaauacc

SEQ ID NO: 3730904 - RNA, 14 nt, Salmonella enterica enterica serovar Typhi Ty2
aagagaaaauaccg

SEQ ID NO: 3730905 - RNA, 17 nt, Salmonella enterica enterica serovar Typhi Ty2
aagagaauggccagcac

SEQ ID NO: 3730906 - RNA, 17 nt, Salmonella enterica enterica serovar Typhi Ty2
aagagacacgcugaccu

SEQ ID NO: 3730907 - RNA, 21 nt, Salmonella enterica enterica serovar Typhi Ty2
aagagagcaacauaccgcaga

SEQ ID NO: 3730908 - RNA, 21 nt, Salmonella enterica enterica serovar Typhi Ty2
aagagagccuuacaggcgcau

SEQ ID NO: 3730909 - RNA, 23 nt, Salmonella enterica enterica serovar Typhi Ty2
aagagagccuuacaggcgcauca

SEQ ID NO: 3730910 - RNA, 22 nt, Salmonella enterica enterica serovar Typhi Ty2
aagagaggcuuuaugcugacaa

SEQ ID NO: 3730911 - RNA, 14 nt, Salmonella enterica enterica serovar Typhi Ty2
aagagauuagaacg

SEQ ID NO: 3730912 - RNA, 16 nt, Salmonella enterica enterica serovar Typhi Ty2
aagagcacuuugguaa

SEQ ID NO: 3730913 - RNA, 21 nt, Salmonella enterica enterica serovar Typhi Ty2
aagagcacuuugguaaaacgg

SEQ ID NO: 3730914 - RNA, 16 nt, Salmonella enterica enterica serovar Typhi Ty2
aagagcauaugcgcug

SEQ ID NO: 3730915 - RNA, 21 nt, Salmonella enterica enterica serovar Typhi Ty2
aagagccgcgcagcgcaacgc

SEQ ID NO: 3730916 - RNA, 15 nt, Salmonella enterica enterica serovar Typhi Ty2
aagagcguuacccag

SEQ ID NO: 3730917 - RNA, 16 nt, Salmonella enterica enterica serovar Typhi Ty2
aagagcguuacccaga

SEQ ID NO: 3730918 - RNA, 21 nt, Salmonella enterica enterica serovar Typhi Ty2
aagagcguuacccagacagca

SEQ ID NO: 3730919 - RNA, 15 nt, Salmonella enterica enterica serovar Typhi Ty2
aagagcugaauguau

SEQ ID NO: 3730920 - RNA, 12 nt, Salmonella enterica enterica serovar Typhi Ty2
aagaggcagcaa

SEQ ID NO: 3730921 - RNA, 21 nt, Salmonella enterica enterica serovar Typhi Ty2
aagaguaucucucuggcgcau

SEQ ID NO: 3730922 - RNA, 20 nt, Salmonella enterica enterica serovar Typhi Ty2
aagaguccauucggccugcg

SEQ ID NO: 3730923 - RNA, 19 nt, Salmonella enterica enterica serovar Typhi Ty2
aagagugacgguuuucacu

SEQ ID NO: 3730924 - RNA, 11 nt, Salmonella enterica enterica serovar Typhi Ty2
aagaguuaacu

SEQ ID NO: 3730925 - RNA, 18 nt, Salmonella enterica enterica serovar Typhi Ty2
aagauaaaaagacagaua

SEQ ID NO: 3730926 - RNA, 12 nt, Salmonella enterica enterica serovar Typhi Ty2
aagauaaaauac

SEQ ID NO: 3730927 - RNA, 14 nt, Salmonella enterica enterica serovar Typhi Ty2
aagauaaagauauu

SEQ ID NO: 3730928 - RNA, 17 nt, Salmonella enterica enterica serovar Typhi Ty2
aagauaaccauuucaaa

SEQ ID NO: 3730929 - RNA, 14 nt, Salmonella enterica enterica serovar Typhi Ty2
aagauaagaaguaa

SEQ ID NO: 3730930 - RNA, 22 nt, Salmonella enterica enterica serovar Typhi Ty2
aagauauucuguuugcgcaguu

SEQ ID NO: 3730931 - RNA, 12 nt, Salmonella enterica enterica serovar Typhi Ty2
aagaucccaggg

SEQ ID NO: 3730932 - RNA, 15 nt, Salmonella enterica enterica serovar Typhi Ty2
aagaucgcguacagc

SEQ ID NO: 3730933 - RNA, 17 nt, Salmonella enterica enterica serovar Typhi Ty2
aagaucgcguacagcgc

SEQ ID NO: 3730934 - RNA, 20 nt, Salmonella enterica enterica serovar Typhi Ty2
aagaucgcguacagcgccau

SEQ ID NO: 3730935 - RNA, 18 nt, Salmonella enterica enterica serovar Typhi Ty2
aagaucuaaagccaguuu

SEQ ID NO: 3730936 - RNA, 22 nt, Salmonella enterica enterica serovar Typhi Ty2
aagaugcguaccgcuaucgcca

SEQ ID NO: 3730937 - RNA, 17 nt, Salmonella enterica enterica serovar Typhi Ty2
aagaugggucagugcau

SEQ ID NO: 3730938 - RNA, 23 nt, Salmonella enterica enterica serovar Typhi Ty2
aagaugggucagugcauguacaa

SEQ ID NO: 3730939 - RNA, 22 nt, Salmonella enterica enterica serovar Typhi Ty2
aagauuacucucuugccagcgc

SEQ ID NO: 3730940 - RNA, 18 nt, Salmonella enterica enterica serovar Typhi Ty2
aagauuggccgucacuuu

SEQ ID NO: 3730941 - RNA, 18 nt, Salmonella enterica enterica serovar Typhi Ty2
aagcaaaccuauuucagu

SEQ ID NO: 3730942 - RNA, 12 nt, Salmonella enterica enterica serovar Typhi Ty2
aagcaaauucag

SEQ ID NO: 3730943 - RNA, 23 nt, Salmonella enterica enterica serovar Typhi Ty2
aagcaacugauuaaucugccgac

SEQ ID NO: 3730944 - RNA, 20 nt, Salmonella enterica enterica serovar Typhi Ty2
aagcaagaggugacucacau

SEQ ID NO: 3730945 - RNA, 18 nt, Salmonella enterica enterica serovar Typhi Ty2
aagcacauaacugagacu

SEQ ID NO: 3730946 - RNA, 20 nt, Salmonella enterica enterica serovar Typhi Ty2
aagcacauaacugagacuca

SEQ ID NO: 3730947 - RNA, 19 nt, Salmonella enterica enterica serovar Typhi Ty2
aagcaccaucgcaaauuca

SEQ ID NO: 3730948 - RNA, 14 nt, Salmonella enterica enterica serovar Typhi Ty2
aagcaccgccagcg

SEQ ID NO: 3730949 - RNA, 17 nt, Salmonella enterica enterica serovar Typhi Ty2
aagcaccgccagcgccg

SEQ ID NO: 3730950 - RNA, 18 nt, Salmonella enterica enterica serovar Typhi Ty2
aagcacgccgcuuucugu

SEQ ID NO: 3730951 - RNA, 14 nt, Salmonella enterica enterica serovar Typhi Ty2
aagcacuucuccac

SEQ ID NO: 3730952 - RNA, 19 nt, Salmonella enterica enterica serovar Typhi Ty2
aagcacuucuccacgcgau

SEQ ID NO: 3730953 - RNA, 22 nt, Salmonella enterica enterica serovar Typhi Ty2
aagcacuucucgcgcaucagga

SEQ ID NO: 3730954 - RNA, 19 nt, Salmonella enterica enterica serovar Typhi Ty2
aagcagaacguagcccauu

SEQ ID NO: 3730955 - RNA, 20 nt, Salmonella enterica enterica serovar Typhi Ty2
aagcagaccaccccacagua

SEQ ID NO: 3730956 - RNA, 15 nt, Salmonella enterica enterica serovar Typhi Ty2
aagcagauaccagcc

SEQ ID NO: 3730957 - RNA, 16 nt, Salmonella enterica enterica serovar Typhi Ty2
aagcagcauaaugaau

SEQ ID NO: 3730958 - RNA, 15 nt, Salmonella enterica enterica serovar Typhi Ty2
aagcagcgacaauau

SEQ ID NO: 3730959 - RNA, 12 nt, Salmonella enterica enterica serovar Typhi Ty2
aagcagcugcug

SEQ ID NO: 3730960 - RNA, 23 nt, Salmonella enterica enterica serovar Typhi Ty2
aagcagcugcuuaacuucugcag

SEQ ID NO: 3730961 - RNA, 15 nt, Salmonella enterica enterica serovar Typhi Ty2
aagcgcccgauaaua

SEQ ID NO: 3730962 - RNA, 12 nt, Salmonella enterica enterica serovar Typhi Ty2
aagcgccgcgau

SEQ ID NO: 3730963 - RNA, 19 nt, Salmonella enterica enterica serovar Typhi Ty2
aagcgcgcccaccgaugac

SEQ ID NO: 3730964 - RNA, 15 nt, Salmonella enterica enterica serovar Typhi Ty2
aagcgcgccgaaaau

SEQ ID NO: 3730965 - RNA, 13 nt, Salmonella enterica enterica serovar Typhi Ty2
aagcgcggacagc

SEQ ID NO: 3730966 - RNA, 12 nt, Salmonella enterica enterica serovar Typhi Ty2
aagcgcgggcug

SEQ ID NO: 3730967 - RNA, 14 nt, Salmonella enterica enterica serovar Typhi Ty2
aagcgcuagcgcca

SEQ ID NO: 3730968 - RNA, 21 nt, Salmonella enterica enterica serovar Typhi Ty2
aagcgcuagcgccacccgaca

SEQ ID NO: 3730969 - RNA, 17 nt, Salmonella enterica enterica serovar Typhi Ty2
aagcgcuaugcccaccg

SEQ ID NO: 3730970 - RNA, 15 nt, Salmonella enterica enterica serovar Typhi Ty2
aagcgcuggcuggcg

SEQ ID NO: 3730971 - RNA, 16 nt, Salmonella enterica enterica serovar Typhi Ty2
aagcggaccaaugcug

SEQ ID NO: 3730972 - RNA, 17 nt, Salmonella enterica enterica serovar Typhi Ty2
aagcggacugccuaacu

SEQ ID NO: 3730973 - RNA, 21 nt, Salmonella enterica enterica serovar Typhi Ty2
aagcggauaagauagcaggcg

SEQ ID NO: 3730974 - RNA, 13 nt, Salmonella enterica enterica serovar Typhi Ty2
aagcggcacaaau

SEQ ID NO: 3730975 - RNA, 14 nt, Salmonella enterica enterica serovar Typhi Ty2
aagcggcagacgug

SEQ ID NO: 3730976 - RNA, 23 nt, Salmonella enterica enterica serovar Typhi Ty2
aagcggcagacgugauuuuggca

SEQ ID NO: 3730977 - RNA, 21 nt, Salmonella enterica enterica serovar Typhi Ty2
aagcggcagcgccauccggca

SEQ ID NO: 3730978 - RNA, 16 nt, Salmonella enterica enterica serovar Typhi Ty2
aagcggcugucaucaa

SEQ ID NO: 3730979 - RNA, 19 nt, Salmonella enterica enterica serovar Typhi Ty2
aagcgguaaggcaccgguu

SEQ ID NO: 3730980 - RNA, 21 nt, Salmonella enterica enterica serovar Typhi Ty2
aagcgguaguuaagcgucagc

SEQ ID NO: 3730981 - RNA, 22 nt, Salmonella enterica enterica serovar Typhi Ty2
aagcgguaguuaagcgucagcc

SEQ ID NO: 3730982 - RNA, 15 nt, Salmonella enterica enterica serovar Typhi Ty2
aagcgguuaucggca

SEQ ID NO: 3730983 - RNA, 15 nt, Salmonella enterica enterica serovar Typhi Ty2
aagcguaacagcgcu

SEQ ID NO: 3730984 - RNA, 16 nt, Salmonella enterica enterica serovar Typhi Ty2
aagcguaacagcgcua

SEQ ID NO: 3730985 - RNA, 20 nt, Salmonella enterica enterica serovar Typhi Ty2
aagcguacaugaauaauaau

SEQ ID NO: 3730986 - RNA, 16 nt, Salmonella enterica enterica serovar Typhi Ty2
aagcguagccgcgcca

SEQ ID NO: 3730987 - RNA, 12 nt, Salmonella enterica enterica serovar Typhi Ty2
aagcguagcgcc

SEQ ID NO: 3730988 - RNA, 20 nt, Salmonella enterica enterica serovar Typhi Ty2
aagcguagcgccaucaggca

SEQ ID NO: 3730989 - RNA, 20 nt, Salmonella enterica enterica serovar Typhi Ty2
aagcguagcgccauccggca

SEQ ID NO: 3730990 - RNA, 22 nt, Salmonella enterica enterica serovar Typhi Ty2
aagcguaguacguuccagcguu

SEQ ID NO: 3730991 - RNA, 15 nt, Salmonella enterica enterica serovar Typhi Ty2
aagcgucaggcgaag

SEQ ID NO: 3730992 - RNA, 18 nt, Salmonella enterica enterica serovar Typhi Ty2
aagcgucaguaaaagccc

SEQ ID NO: 3730993 - RNA, 23 nt, Salmonella enterica enterica serovar Typhi Ty2
aagcguccgguugcaguacaggc

SEQ ID NO: 3730994 - RNA, 23 nt, Salmonella enterica enterica serovar Typhi Ty2
aagcgucucagauggaaaaaaag

SEQ ID NO: 3730995 - RNA, 17 nt, Salmonella enterica enterica serovar Typhi Ty2
aagcguggcgcaaccga

SEQ ID NO: 3730996 - RNA, 19 nt, Salmonella enterica enterica serovar Typhi Ty2
aagcguuacggaaaaaaua

SEQ ID NO: 3730997 - RNA, 21 nt, Salmonella enterica enterica serovar Typhi Ty2
aagcguuagcgucauccggca

SEQ ID NO: 3730998 - RNA, 20 nt, Salmonella enterica enterica serovar Typhi Ty2
aagcguugccguaggcaacg

SEQ ID NO: 3730999 - RNA, 21 nt, Salmonella enterica enterica serovar Typhi Ty2
aagcguuguacggauggggua

SEQ ID NO: 3731000 - RNA, 15 nt, Salmonella enterica enterica serovar Typhi Ty2
aagcuaguaaagaaa

SEQ ID NO: 3731001 - RNA, 16 nt, Salmonella enterica enterica serovar Typhi Ty2
aagcuaguaaagaaau

SEQ ID NO: 3731002 - RNA, 16 nt, Salmonella enterica enterica serovar Typhi Ty2
aagcuauuacaaaaau

SEQ ID NO: 3731003 - RNA, 17 nt, Salmonella enterica enterica serovar Typhi Ty2
aagcucaacgcaggcug

SEQ ID NO: 3731004 - RNA, 13 nt, Salmonella enterica enterica serovar Typhi Ty2
aagcucauuuccc

SEQ ID NO: 3731005 - RNA, 22 nt, Salmonella enterica enterica serovar Typhi Ty2
aagcucauuucccaauaguuua

SEQ ID NO: 3731006 - RNA, 23 nt, Salmonella enterica enterica serovar Typhi Ty2
aagcucauuucccaauaguuuau

SEQ ID NO: 3731007 - RNA, 17 nt, Salmonella enterica enterica serovar Typhi Ty2
aagcucccgccagcgag

SEQ ID NO: 3731008 - RNA, 21 nt, Salmonella enterica enterica serovar Typhi Ty2
aagcugaccagggcaaauuau

SEQ ID NO: 3731009 - RNA, 16 nt, Salmonella enterica enterica serovar Typhi Ty2
aagcugauauuuuacu

SEQ ID NO: 3731010 - RNA, 12 nt, Salmonella enterica enterica serovar Typhi Ty2
aagcugcauaau

SEQ ID NO: 3731011 - RNA, 16 nt, Salmonella enterica enterica serovar Typhi Ty2
aagcugccgucccagc

SEQ ID NO: 3731012 - RNA, 15 nt, Salmonella enterica enterica serovar Typhi Ty2
aagcugcggcccaga

SEQ ID NO: 3731013 - RNA, 21 nt, Salmonella enterica enterica serovar Typhi Ty2
aagcugcggcccagauaacgc

SEQ ID NO: 3731014 - RNA, 19 nt, Salmonella enterica enterica serovar Typhi Ty2
aagcugcuggcgagcagga

SEQ ID NO: 3731015 - RNA, 17 nt, Salmonella enterica enterica serovar Typhi Ty2
aagcuggagccacaucg

SEQ ID NO: 3731016 - RNA, 18 nt, Salmonella enterica enterica serovar Typhi Ty2
aagcuggccuucagguuu

SEQ ID NO: 3731017 - RNA, 21 nt, Salmonella enterica enterica serovar Typhi Ty2
aagcugggaaacuuaucagua

SEQ ID NO: 3731018 - RNA, 18 nt, Salmonella enterica enterica serovar Typhi Ty2
aagcugggcguuacuggc

SEQ ID NO: 3731019 - RNA, 17 nt, Salmonella enterica enterica serovar Typhi Ty2
aagcugguaauccucuu

SEQ ID NO: 3731020 - RNA, 18 nt, Salmonella enterica enterica serovar Typhi Ty2
aagcugguagucgagggu

SEQ ID NO: 3731021 - RNA, 19 nt, Salmonella enterica enterica serovar Typhi Ty2
aagcuggucgagauacugc

SEQ ID NO: 3731022 - RNA, 16 nt, Salmonella enterica enterica serovar Typhi Ty2
aagcuguaacacugcc

SEQ ID NO: 3731023 - RNA, 23 nt, Salmonella enterica enterica serovar Typhi Ty2
aagcuguuaauuugcaucaggcc

SEQ ID NO: 3731024 - RNA, 21 nt, Salmonella enterica enterica serovar Typhi Ty2
aagcuguugugucccggccca

SEQ ID NO: 3731025 - RNA, 13 nt, Salmonella enterica enterica serovar Typhi Ty2
aagcuguuguugc

SEQ ID NO: 3731026 - RNA, 17 nt, Salmonella enterica enterica serovar Typhi Ty2
aagcuuaggauaagaau

SEQ ID NO: 3731027 - RNA, 17 nt, Salmonella enterica enterica serovar Typhi Ty2
aagcuucgucaggcggc

SEQ ID NO: 3731028 - RNA, 20 nt, Salmonella enterica enterica serovar Typhi Ty2
aagcuugaaagcagucccgc

SEQ ID NO: 3731029 - RNA, 14 nt, Salmonella enterica enterica serovar Typhi Ty2
aagcuuguagaaaa

SEQ ID NO: 3731030 - RNA, 19 nt, Salmonella enterica enterica serovar Typhi Ty2
aagcuuucugaauuucacg

SEQ ID NO: 3731031 - RNA, 13 nt, Salmonella enterica enterica serovar Typhi Ty2
aagcuuucuguua

SEQ ID NO: 3731032 - RNA, 20 nt, Salmonella enterica enterica serovar Typhi Ty2
aagcuuugcguaaaaaacau

SEQ ID NO: 3731033 - RNA, 21 nt, Salmonella enterica enterica serovar Typhi Ty2
aagcuuugcguaaaaaacauc

SEQ ID NO: 3731034 - RNA, 22 nt, Salmonella enterica enterica serovar Typhi Ty2
aagcuuuuaguuacgcacgcca

SEQ ID NO: 3731035 - RNA, 13 nt, Salmonella enterica enterica serovar Typhi Ty2
aaggaagauagcg

SEQ ID NO: 3731036 - RNA, 20 nt, Salmonella enterica enterica serovar Typhi Ty2
aaggacaagcugauuuuucg

SEQ ID NO: 3731037 - RNA, 14 nt, Salmonella enterica enterica serovar Typhi Ty2
aaggacaagcugcg

SEQ ID NO: 3731038 - RNA, 14 nt, Salmonella enterica enterica serovar Typhi Ty2
aaggacaggugcgc

SEQ ID NO: 3731039 - RNA, 21 nt, Salmonella enterica enterica serovar Typhi Ty2
aaggauaauaguguuagcguc

SEQ ID NO: 3731040 - RNA, 15 nt, Salmonella enterica enterica serovar Typhi Ty2
aaggauacagcgccg

SEQ ID NO: 3731041 - RNA, 16 nt, Salmonella enterica enterica serovar Typhi Ty2
aaggauacggaaugga

SEQ ID NO: 3731042 - RNA, 17 nt, Salmonella enterica enterica serovar Typhi Ty2
aaggauacucagcgacg

SEQ ID NO: 3731043 - RNA, 20 nt, Salmonella enterica enterica serovar Typhi Ty2
aagucgcaauauaaauauca

SEQ ID NO: 3731044 - RNA, 21 nt, Salmonella enterica enterica serovar Typhi Ty2
aagucgccaugaguucaauau

SEQ ID NO: 3731045 - RNA, 15 nt, Salmonella enterica enterica serovar Typhi Ty2
aagucugugagaaaa

SEQ ID NO: 3731046 - RNA, 21 nt, Salmonella enterica enterica serovar Typhi Ty2
aagucuuuuguauugcgcguc

SEQ ID NO: 3731047 - RNA, 22 nt, Salmonella enterica enterica serovar Typhi Ty2
aagugaguaaacgcucaagcaa

SEQ ID NO: 3731048 - RNA, 21 nt, Salmonella enterica enterica serovar Typhi Ty2
aagugcauguaaauaaggcug

SEQ ID NO: 3731049 - RNA, 18 nt, Salmonella enterica enterica serovar Typhi Ty2
aagugcgaaauuuaauau

SEQ ID NO: 3731050 - RNA, 17 nt, Salmonella enterica enterica serovar Typhi Ty2
aagugcgcacucagaaa

SEQ ID NO: 3731051 - RNA, 14 nt, Salmonella enterica enterica serovar Typhi Ty2
aaguggugggugau

SEQ ID NO: 3731052 - RNA, 20 nt, Salmonella enterica enterica serovar Typhi Ty2
aagugguugaaugaagccuu

SEQ ID NO: 3731053 - RNA, 22 nt, Salmonella enterica enterica serovar Typhi Ty2
aaguuaaucagcgccgucgcca

SEQ ID NO: 3731054 - RNA, 20 nt, Salmonella enterica enterica serovar Typhi Ty2
aaguuagccccuuaucaaag

SEQ ID NO: 3731055 - RNA, 18 nt, Salmonella enterica enterica serovar Typhi Ty2
aaguuaucccugcugagu

SEQ ID NO: 3731056 - RNA, 12 nt, Salmonella enterica enterica serovar Typhi Ty2
aaguuaugcauc

SEQ ID NO: 3731057 - RNA, 23 nt, Salmonella enterica enterica serovar Typhi Ty2
aaguuauuuuuucuuuggcgcug

SEQ ID NO: 3731058 - RNA, 15 nt, Salmonella enterica enterica serovar Typhi Ty2
aaguucaaacucauu

SEQ ID NO: 3731059 - RNA, 15 nt, Salmonella enterica enterica serovar Typhi Ty2
aaguucauaaaugua

SEQ ID NO: 3731060 - RNA, 15 nt, Salmonella enterica enterica serovar Typhi Ty2
aaguucuuguuucau

SEQ ID NO: 3731061 - RNA, 15 nt, Salmonella enterica enterica serovar Typhi Ty2
aaguugaaaggaaag

SEQ ID NO: 3731062 - RNA, 17 nt, Salmonella enterica enterica serovar Typhi Ty2
aaguugcgccacugcca

SEQ ID NO: 3731063 - RNA, 19 nt, Salmonella enterica enterica serovar Typhi Ty2
aaguuuaacgcgcguucau

SEQ ID NO: 3731064 - RNA, 15 nt, Salmonella enterica enterica serovar Typhi Ty2
aaguuuagaaaaaau

SEQ ID NO: 3731065 - RNA, 15 nt, Salmonella enterica enterica serovar Typhi Ty2
aaguuuauccagcac

SEQ ID NO: 3731066 - RNA, 19 nt, Salmonella enterica enterica serovar Typhi Ty2
aaguuugaaguguuccuga

SEQ ID NO: 3731067 - RNA, 15 nt, Salmonella enterica enterica serovar Typhi Ty2
aaguuuuucucuuau

SEQ ID NO: 3731068 - RNA, 14 nt, Salmonella enterica enterica serovar Typhi Ty2
aaguuuuuuuaaaa

SEQ ID NO: 3731069 - RNA, 18 nt, Salmonella enterica enterica serovar Typhi Ty2
aaguuuuuuuaaaaaacc

SEQ ID NO: 3731070 - RNA, 22 nt, Salmonella enterica enterica serovar Typhi Ty2
aauaaaaauaagcuauugcgcu

SEQ ID NO: 3731071 - RNA, 13 nt, Salmonella enterica enterica serovar Typhi Ty2
aauaaaaauuccc

SEQ ID NO: 3731072 - RNA, 14 nt, Salmonella enterica enterica serovar Typhi Ty2
aauaaaacgggccc

SEQ ID NO: 3731073 - RNA, 12 nt, Salmonella enterica enterica serovar Typhi Ty2
aauaaaaggaau

SEQ ID NO: 3731074 - RNA, 11 nt, Salmonella enterica enterica serovar Typhi Ty2
aauaaaaguug

SEQ ID NO: 3731075 - RNA, 13 nt, Salmonella enterica enterica serovar Typhi Ty2
aauaaaauaacua

SEQ ID NO: 3731076 - RNA, 15 nt, Salmonella enterica enterica serovar Typhi Ty2
aauaaaauucagcgc

SEQ ID NO: 3731077 - RNA, 23 nt, Salmonella enterica enterica serovar Typhi Ty2
aauaaacacgauggcaaauaaua

SEQ ID NO: 3731078 - RNA, 16 nt, Salmonella enterica enterica serovar Typhi Ty2
aauaaacacuaaauca

SEQ ID NO: 3731079 - RNA, 13 nt, Salmonella enterica enterica serovar Typhi Ty2
aauaaacauuuuu

SEQ ID NO: 3731080 - RNA, 20 nt, Salmonella enterica enterica serovar Typhi Ty2
aauaaacauuuuuuuugcau

SEQ ID NO: 3731081 - RNA, 22 nt, Salmonella enterica enterica serovar Typhi Ty2
aauaaacgccaguggaugcgcu

SEQ ID NO: 3731082 - RNA, 17 nt, Salmonella enterica enterica serovar Typhi Ty2
aauaaacugcauccccu

SEQ ID NO: 3731083 - RNA, 11 nt, Salmonella enterica enterica serovar Typhi Ty2
aauaaagaaag

SEQ ID NO: 3731084 - RNA, 22 nt, Salmonella enterica enterica serovar Typhi Ty2
aauaaagagcacuucugacauu

SEQ ID NO: 3731085 - RNA, 16 nt, Salmonella enterica enterica serovar Typhi Ty2
aauaaagccagauacg

SEQ ID NO: 3731086 - RNA, 20 nt, Salmonella enterica enterica serovar Typhi Ty2
aauaaagcccuguuauucag

SEQ ID NO: 3731087 - RNA, 21 nt, Salmonella enterica enterica serovar Typhi Ty2
aauaaaggauuguacuuauua

SEQ ID NO: 3731088 - RNA, 19 nt, Salmonella enterica enterica serovar Typhi Ty2
aauaaagugcugaacaaua

SEQ ID NO: 3731089 - RNA, 20 nt, Salmonella enterica enterica serovar Typhi Ty2
aauaaagugcugaacaauaa

SEQ ID NO: 3731090 - RNA, 14 nt, Salmonella enterica enterica serovar Typhi Ty2
aauaaauaccaaca

SEQ ID NO: 3731091 - RNA, 15 nt, Salmonella enterica enterica serovar Typhi Ty2
aauaaaucaaugaaa

SEQ ID NO: 3731092 - RNA, 22 nt, Salmonella enterica enterica serovar Typhi Ty2
aauaaaucacaacguaaucauc

SEQ ID NO: 3731093 - RNA, 23 nt, Salmonella enterica enterica serovar Typhi Ty2
aauaaauugaauucgcuaauaaa

SEQ ID NO: 3731094 - RNA, 16 nt, Salmonella enterica enterica serovar Typhi Ty2
aauaacaggaaucauu

SEQ ID NO: 3731095 - RNA, 22 nt, Salmonella enterica enterica serovar Typhi Ty2
aauaacaucguaaaucaaauga

SEQ ID NO: 3731096 - RNA, 12 nt, Salmonella enterica enterica serovar Typhi Ty2
aauaacaucuuc

SEQ ID NO: 3731097 - RNA, 15 nt, Salmonella enterica enterica serovar Typhi Ty2
aauaaccaccuguuc

SEQ ID NO: 3731098 - RNA, 19 nt, Salmonella enterica enterica serovar Typhi Ty2
aauaaccccagcugcggca

SEQ ID NO: 3731099 - RNA, 21 nt, Salmonella enterica enterica serovar Typhi Ty2
aauaaccgguaacugucagau

SEQ ID NO: 3731100 - RNA, 19 nt, Salmonella enterica enterica serovar Typhi Ty2
aauaaccucaacgucgcuc

SEQ ID NO: 3731101 - RNA, 22 nt, Salmonella enterica enterica serovar Typhi Ty2
aauaacgaagcgaucuccugca

SEQ ID NO: 3731102 - RNA, 19 nt, Salmonella enterica enterica serovar Typhi Ty2
aauaacgaugaugaaaaag

SEQ ID NO: 3731103 - RNA, 22 nt, Salmonella enterica enterica serovar Typhi Ty2
aauaacgaugaugaaaaagaau

SEQ ID NO: 3731104 - RNA, 19 nt, Salmonella enterica enterica serovar Typhi Ty2
aauaacgcacuaccagaaa

SEQ ID NO: 3731105 - RNA, 19 nt, Salmonella enterica enterica serovar Typhi Ty2
aauaacgcgagaagaagaa

SEQ ID NO: 3731106 - RNA, 21 nt, Salmonella enterica enterica serovar Typhi Ty2
aauaacgggcacggucugcug

SEQ ID NO: 3731107 - RNA, 20 nt, Salmonella enterica enterica serovar Typhi Ty2
aauaacgguaacggacauaa

SEQ ID NO: 3731108 - RNA, 15 nt, Salmonella enterica enterica serovar Typhi Ty2
aauaacgugucagga

SEQ ID NO: 3731109 - RNA, 16 nt, Salmonella enterica enterica serovar Typhi Ty2
aauaacuauaauugcu

SEQ ID NO: 3731110 - RNA, 17 nt, Salmonella enterica enterica serovar Typhi Ty2
aauaacuauaauugcuu

SEQ ID NO: 3731111 - RNA, 23 nt, Salmonella enterica enterica serovar Typhi Ty2
aauaacucagcccauaagcuuag

SEQ ID NO: 3731112 - RNA, 19 nt, Salmonella enterica enterica serovar Typhi Ty2
aauaacuccagugcagaaa

SEQ ID NO: 3731113 - RNA, 15 nt, Salmonella enterica enterica serovar Typhi Ty2
aauaacugacagacu

SEQ ID NO: 3731114 - RNA, 14 nt, Salmonella enterica enterica serovar Typhi Ty2
aauaagaaacugcu

SEQ ID NO: 3731115 - RNA, 21 nt, Salmonella enterica enterica serovar Typhi Ty2
aauaagaagguuaauauacau

SEQ ID NO: 3731116 - RNA, 14 nt, Salmonella enterica enterica serovar Typhi Ty2
aauaagccagacuc

SEQ ID NO: 3731117 - RNA, 12 nt, Salmonella enterica enterica serovar Typhi Ty2
aauaagcgaauu

SEQ ID NO: 3731118 - RNA, 19 nt, Salmonella enterica enterica serovar Typhi Ty2
aauaagcgcccaugaagau

SEQ ID NO: 3731119 - RNA, 15 nt, Salmonella enterica enterica serovar Typhi Ty2
aauaagcgcucaggc

SEQ ID NO: 3731120 - RNA, 12 nt, Salmonella enterica enterica serovar Typhi Ty2
aauaaggcuggc

SEQ ID NO: 3731121 - RNA, 13 nt, Salmonella enterica enterica serovar Typhi Ty2
aauaaggcuggca

SEQ ID NO: 3731122 - RNA, 20 nt, Salmonella enterica enterica serovar Typhi Ty2
aauaagggcauguuucaugu

SEQ ID NO: 3731123 - RNA, 21 nt, Salmonella enterica enterica serovar Typhi Ty2
aauaaguuagcuuuuuuaugc

SEQ ID NO: 3731124 - RNA, 13 nt, Salmonella enterica enterica serovar Typhi Ty2
aauaauaccacga

SEQ ID NO: 3731125 - RNA, 22 nt, Salmonella enterica enterica serovar Typhi Ty2
aauagcgcuacauccgccagcc

SEQ ID NO: 3731126 - RNA, 21 nt, Salmonella enterica enterica serovar Typhi Ty2
aauagcgcugaggcgcuggcu

SEQ ID NO: 3731127 - RNA, 20 nt, Salmonella enterica enterica serovar Typhi Ty2
aauagcgcuggcgccgcaaa

SEQ ID NO: 3731128 - RNA, 17 nt, Salmonella enterica enterica serovar Typhi Ty2
aauagcggcacagauac

SEQ ID NO: 3731129 - RNA, 20 nt, Salmonella enterica enterica serovar Typhi Ty2
aauagcuuuuuacucagggc

SEQ ID NO: 3731130 - RNA, 13 nt, Salmonella enterica enterica serovar Typhi Ty2
aauaggauggcgc

SEQ ID NO: 3731131 - RNA, 22 nt, Salmonella enterica enterica serovar Typhi Ty2
aauaggccaggcucgccagacc

SEQ ID NO: 3731132 - RNA, 17 nt, Salmonella enterica enterica serovar Typhi Ty2
aauaggcgaggaaaaca

SEQ ID NO: 3731133 - RNA, 21 nt, Salmonella enterica enterica serovar Typhi Ty2
aauaggcgaggaaaacauucg

SEQ ID NO: 3731134 - RNA, 14 nt, Salmonella enterica enterica serovar Typhi Ty2
aauaguaaauagaa

SEQ ID NO: 3731135 - RNA, 16 nt, Salmonella enterica enterica serovar Typhi Ty2
aauaguaaauagaaaa

SEQ ID NO: 3731136 - RNA, 19 nt, Salmonella enterica enterica serovar Typhi Ty2
aauaguaaauagaaaauaa

SEQ ID NO: 3731137 - RNA, 22 nt, Salmonella enterica enterica serovar Typhi Ty2
aauaguauggagcaggaaaaga

SEQ ID NO: 3731138 - RNA, 16 nt, Salmonella enterica enterica serovar Typhi Ty2
aauaguccagcagcca

SEQ ID NO: 3731139 - RNA, 17 nt, Salmonella enterica enterica serovar Typhi Ty2
aauaguccagcagccau

SEQ ID NO: 3731140 - RNA, 16 nt, Salmonella enterica enterica serovar Typhi Ty2
aauagugacuucugcu

SEQ ID NO: 3731141 - RNA, 14 nt, Salmonella enterica enterica serovar Typhi Ty2
aauagugcaggaag

SEQ ID NO: 3731142 - RNA, 16 nt, Salmonella enterica enterica serovar Typhi Ty2
aauaguggugcgcauc

SEQ ID NO: 3731143 - RNA, 18 nt, Salmonella enterica enterica serovar Typhi Ty2
aauaguguggaugucaua

SEQ ID NO: 3731144 - RNA, 17 nt, Salmonella enterica enterica serovar Typhi Ty2
aauaguguuagcgucag

SEQ ID NO: 3731145 - RNA, 15 nt, Salmonella enterica enterica serovar Typhi Ty2
aauaguuacuguuuc

SEQ ID NO: 3731146 - RNA, 20 nt, Salmonella enterica enterica serovar Typhi Ty2
aauaguugucagaccuucaa

SEQ ID NO: 3731147 - RNA, 23 nt, Salmonella enterica enterica serovar Typhi Ty2
aauaguuuauugagauaauuuau

SEQ ID NO: 3731148 - RNA, 14 nt, Salmonella enterica enterica serovar Typhi Ty2
aauauaaccaauuu

SEQ ID NO: 3731149 - RNA, 14 nt, Salmonella enterica enterica serovar Typhi Ty2
aauauaaucuacca

SEQ ID NO: 3731150 - RNA, 14 nt, Salmonella enterica enterica serovar Typhi Ty2
aauauaauuauuau

SEQ ID NO: 3731151 - RNA, 20 nt, Salmonella enterica enterica serovar Typhi Ty2
aauauacaccugacggcagc

SEQ ID NO: 3731152 - RNA, 21 nt, Salmonella enterica enterica serovar Typhi Ty2
aauauacauucauuuuaucga

SEQ ID NO: 3731153 - RNA, 22 nt, Salmonella enterica enterica serovar Typhi Ty2
aauauacgcaccugauaccuca

SEQ ID NO: 3731154 - RNA, 14 nt, Salmonella enterica enterica serovar Typhi Ty2
aauauacgccaccu

SEQ ID NO: 3731155 - RNA, 19 nt, Salmonella enterica enterica serovar Typhi Ty2
aauauagccguggcuggcg

SEQ ID NO: 3731156 - RNA, 16 nt, Salmonella enterica enterica serovar Typhi Ty2
aauauagcuaaugcaa

SEQ ID NO: 3731157 - RNA, 19 nt, Salmonella enterica enterica serovar Typhi Ty2
aauauagcuaaugcaauaa

SEQ ID NO: 3731158 - RNA, 22 nt, Salmonella enterica enterica serovar Typhi Ty2
aauauaucgcaggaugcgcugc

SEQ ID NO: 3731159 - RNA, 17 nt, Salmonella enterica enterica serovar Typhi Ty2
aauauaucuguuccaca

SEQ ID NO: 3731160 - RNA, 13 nt, Salmonella enterica enterica serovar Typhi Ty2
aauauaugaacca

SEQ ID NO: 3731161 - RNA, 17 nt, Salmonella enterica enterica serovar Typhi Ty2
aauauauuucacuucau

SEQ ID NO: 3731162 - RNA, 14 nt, Salmonella enterica enterica serovar Typhi Ty2
aauaucaauauaau

SEQ ID NO: 3731163 - RNA, 13 nt, Salmonella enterica enterica serovar Typhi Ty2
aauaucaaucagc

SEQ ID NO: 3731164 - RNA, 22 nt, Salmonella enterica enterica serovar Typhi Ty2
aauaucaucgucauuaaugccu

SEQ ID NO: 3731165 - RNA, 14 nt, Salmonella enterica enterica serovar Typhi Ty2
aauaucaugaauaa

SEQ ID NO: 3731166 - RNA, 16 nt, Salmonella enterica enterica serovar Typhi Ty2
aauaucaugaauaauc

SEQ ID NO: 3731167 - RNA, 18 nt, Salmonella enterica enterica serovar Typhi Ty2
aauaucauuaauuauacu

SEQ ID NO: 3731168 - RNA, 22 nt, Salmonella enterica enterica serovar Typhi Ty2
aauaucauucgcgucauacuua

SEQ ID NO: 3731169 - RNA, 11 nt, Salmonella enterica enterica serovar Typhi Ty2
aauauccauuu

SEQ ID NO: 3731170 - RNA, 13 nt, Salmonella enterica enterica serovar Typhi Ty2
aauauccccugac

SEQ ID NO: 3731171 - RNA, 14 nt, Salmonella enterica enterica serovar Typhi Ty2
aauauccccugaca

SEQ ID NO: 3731172 - RNA, 14 nt, Salmonella enterica enterica serovar Typhi Ty2
aauaucccgaugac

SEQ ID NO: 3731173 - RNA, 23 nt, Salmonella enterica enterica serovar Typhi Ty2
aauaucccgcaagaaacaggcug

SEQ ID NO: 3731174 - RNA, 15 nt, Salmonella enterica enterica serovar Typhi Ty2
aauauccgcugcggu

SEQ ID NO: 3731175 - RNA, 20 nt, Salmonella enterica enterica serovar Typhi Ty2
aauauccgguacaccaacua

SEQ ID NO: 3731176 - RNA, 19 nt, Salmonella enterica enterica serovar Typhi Ty2
aauauccuguaacucaucu

SEQ ID NO: 3731177 - RNA, 23 nt, Salmonella enterica enterica serovar Typhi Ty2
aauaucgaaauuggaguuaucau

SEQ ID NO: 3731178 - RNA, 17 nt, Salmonella enterica enterica serovar Typhi Ty2
aauaucgagcggcagua

SEQ ID NO: 3731179 - RNA, 15 nt, Salmonella enterica enterica serovar Typhi Ty2
aauaucgcugccggu

SEQ ID NO: 3731180 - RNA, 14 nt, Salmonella enterica enterica serovar Typhi Ty2
aauaucggcaaagu

SEQ ID NO: 3731181 - RNA, 16 nt, Salmonella enterica enterica serovar Typhi Ty2
aauaucggcgucaacg

SEQ ID NO: 3731182 - RNA, 14 nt, Salmonella enterica enterica serovar Typhi Ty2
aauaucgucaguau

SEQ ID NO: 3731183 - RNA, 22 nt, Salmonella enterica enterica serovar Typhi Ty2
aauaucucuauugcuuauuaga

SEQ ID NO: 3731184 - RNA, 12 nt, Salmonella enterica enterica serovar Typhi Ty2
aauaucucuccc

SEQ ID NO: 3731185 - RNA, 16 nt, Salmonella enterica enterica serovar Typhi Ty2
aauaugccagauauuu

SEQ ID NO: 3731186 - RNA, 13 nt, Salmonella enterica enterica serovar Typhi Ty2
aauaugccaggca

SEQ ID NO: 3731187 - RNA, 14 nt, Salmonella enterica enterica serovar Typhi Ty2
aauaugccaggcau

SEQ ID NO: 3731188 - RNA, 15 nt, Salmonella enterica enterica serovar Typhi Ty2
aauaugccugcacua

SEQ ID NO: 3731189 - RNA, 16 nt, Salmonella enterica enterica serovar Typhi Ty2
aauaugcgucagcgcg

SEQ ID NO: 3731190 - RNA, 21 nt, Salmonella enterica enterica serovar Typhi Ty2
aauaugcucaacuuccagagc

SEQ ID NO: 3731191 - RNA, 14 nt, Salmonella enterica enterica serovar Typhi Ty2
aauaugcuggcuua

SEQ ID NO: 3731192 - RNA, 20 nt, Salmonella enterica enterica serovar Typhi Ty2
aauauggcugcgauaaugaa

SEQ ID NO: 3731193 - RNA, 21 nt, Salmonella enterica enterica serovar Typhi Ty2
aauaugggauuugaugcccaa

SEQ ID NO: 3731194 - RNA, 15 nt, Salmonella enterica enterica serovar Typhi Ty2
aauaugguuauccag

SEQ ID NO: 3731195 - RNA, 17 nt, Salmonella enterica enterica serovar Typhi Ty2
aauauguuccacaauca

SEQ ID NO: 3731196 - RNA, 17 nt, Salmonella enterica enterica serovar Typhi Ty2
aauauuaacggucuuuc

SEQ ID NO: 3731197 - RNA, 16 nt, Salmonella enterica enterica serovar Typhi Ty2
aauauuaaugaauaaa

SEQ ID NO: 3731198 - RNA, 16 nt, Salmonella enterica enterica serovar Typhi Ty2
aauauuaucgccauca

SEQ ID NO: 3731199 - RNA, 18 nt, Salmonella enterica enterica serovar Typhi Ty2
aauauucagaauaugcca

SEQ ID NO: 3731200 - RNA, 19 nt, Salmonella enterica enterica serovar Typhi Ty2
aauauucagaauaugccag

SEQ ID NO: 3731201 - RNA, 16 nt, Salmonella enterica enterica serovar Typhi Ty2
aauauucaucaaaaug

SEQ ID NO: 3731202 - RNA, 10 nt, Salmonella enterica enterica serovar Typhi Ty2
aauauucauu

SEQ ID NO: 3731203 - RNA, 21 nt, Salmonella enterica enterica serovar Typhi Ty2
aauauucauucugucagaaau

SEQ ID NO: 3731204 - RNA, 15 nt, Salmonella enterica enterica serovar Typhi Ty2
aauauugacaguaau

SEQ ID NO: 3731205 - RNA, 15 nt, Salmonella enterica enterica serovar Typhi Ty2
aauauugagaauaaa

SEQ ID NO: 3731206 - RNA, 21 nt, Salmonella enterica enterica serovar Typhi Ty2
aauauugccauaaauacaauu

SEQ ID NO: 3731207 - RNA, 23 nt, Salmonella enterica enterica serovar Typhi Ty2
aauccaguaaugccauaauuuau

SEQ ID NO: 3731208 - RNA, 18 nt, Salmonella enterica enterica serovar Typhi Ty2
aauccauagccaacacau

SEQ ID NO: 3731209 - RNA, 13 nt, Salmonella enterica enterica serovar Typhi Ty2
aauccaucccccu

SEQ ID NO: 3731210 - RNA, 12 nt, Salmonella enterica enterica serovar Typhi Ty2
aauccaucucag

SEQ ID NO: 3731211 - RNA, 18 nt, Salmonella enterica enterica serovar Typhi Ty2
aauccaugagaagaaaaa

SEQ ID NO: 3731212 - RNA, 17 nt, Salmonella enterica enterica serovar Typhi Ty2
aaucccacgccgcugau

SEQ ID NO: 3731213 - RNA, 19 nt, Salmonella enterica enterica serovar Typhi Ty2
aauccccccuuuuuugcug

SEQ ID NO: 3731214 - RNA, 17 nt, Salmonella enterica enterica serovar Typhi Ty2
aaucccccugccacaac

SEQ ID NO: 3731215 - RNA, 15 nt, Salmonella enterica enterica serovar Typhi Ty2
aauccccgaaagccg

SEQ ID NO: 3731216 - RNA, 21 nt, Salmonella enterica enterica serovar Typhi Ty2
aaucccgcaucacccgcauau

SEQ ID NO: 3731217 - RNA, 17 nt, Salmonella enterica enterica serovar Typhi Ty2
aaucccgcguucgcgca

SEQ ID NO: 3731218 - RNA, 22 nt, Salmonella enterica enterica serovar Typhi Ty2
aaucccggcgauuaauaaaauc

SEQ ID NO: 3731219 - RNA, 21 nt, Salmonella enterica enterica serovar Typhi Ty2
aauccgagacgguaagaauaa

SEQ ID NO: 3731220 - RNA, 18 nt, Salmonella enterica enterica serovar Typhi Ty2
aauccgccggaaacuggc

SEQ ID NO: 3731221 - RNA, 14 nt, Salmonella enterica enterica serovar Typhi Ty2
aauccgcgcccugg

SEQ ID NO: 3731222 - RNA, 17 nt, Salmonella enterica enterica serovar Typhi Ty2
aauccgcuccacauccu

SEQ ID NO: 3731223 - RNA, 18 nt, Salmonella enterica enterica serovar Typhi Ty2
aauccgcuccacauccug

SEQ ID NO: 3731224 - RNA, 13 nt, Salmonella enterica enterica serovar Typhi Ty2
aauccggcugccu

SEQ ID NO: 3731225 - RNA, 15 nt, Salmonella enterica enterica serovar Typhi Ty2
aauccucacugccga

SEQ ID NO: 3731226 - RNA, 23 nt, Salmonella enterica enterica serovar Typhi Ty2
aauccucauuaguucaaguuuag

SEQ ID NO: 3731227 - RNA, 19 nt, Salmonella enterica enterica serovar Typhi Ty2
aauccucuaccggaaaaca

SEQ ID NO: 3731228 - RNA, 16 nt, Salmonella enterica enterica serovar Typhi Ty2
aauccugauuaaguuu

SEQ ID NO: 3731229 - RNA, 12 nt, Salmonella enterica enterica serovar Typhi Ty2
aauccugcaccc

SEQ ID NO: 3731230 - RNA, 18 nt, Salmonella enterica enterica serovar Typhi Ty2
aauccugcacuuccagcc

SEQ ID NO: 3731231 - RNA, 23 nt, Salmonella enterica enterica serovar Typhi Ty2
aauccugcuccaucguauagcga

SEQ ID NO: 3731232 - RNA, 15 nt, Salmonella enterica enterica serovar Typhi Ty2
aauccuuauuuaaua

SEQ ID NO: 3731233 - RNA, 21 nt, Salmonella enterica enterica serovar Typhi Ty2
aauccuuuuucaugcaauaau

SEQ ID NO: 3731234 - RNA, 21 nt, Salmonella enterica enterica serovar Typhi Ty2
aaucgaaucguucgccaguga

SEQ ID NO: 3731235 - RNA, 12 nt, Salmonella enterica enterica serovar Typhi Ty2
aaucgacucacg

SEQ ID NO: 3731236 - RNA, 16 nt, Salmonella enterica enterica serovar Typhi Ty2
aaucgaguucgcuuuu

SEQ ID NO: 3731237 - RNA, 18 nt, Salmonella enterica enterica serovar Typhi Ty2
aaucgauaagccagcgau

SEQ ID NO: 3731238 - RNA, 19 nt, Salmonella enterica enterica serovar Typhi Ty2
aaucgauagcgauuuuuga

SEQ ID NO: 3731239 - RNA, 22 nt, Salmonella enterica enterica serovar Typhi Ty2
aaucgaugccacagcgcauuca

SEQ ID NO: 3731240 - RNA, 19 nt, Salmonella enterica enterica serovar Typhi Ty2
aaucgauguaguuguucuu

SEQ ID NO: 3731241 - RNA, 15 nt, Salmonella enterica enterica serovar Typhi Ty2
aaucgcaaacgccag

SEQ ID NO: 3731242 - RNA, 17 nt, Salmonella enterica enterica serovar Typhi Ty2
aaucgcaucauaaaugg

SEQ ID NO: 3731243 - RNA, 17 nt, Salmonella enterica enterica serovar Typhi Ty2
aaucgccagcagcgcga

SEQ ID NO: 3731244 - RNA, 20 nt, Salmonella enterica enterica serovar Typhi Ty2
aaucgccagcaucggcagcg

SEQ ID NO: 3731245 - RNA, 17 nt, Salmonella enterica enterica serovar Typhi Ty2
aaucgccaucagcgcga

SEQ ID NO: 3731246 - RNA, 23 nt, Salmonella enterica enterica serovar Typhi Ty2
aaucgccgcgccggacuccagca

SEQ ID NO: 3731247 - RNA, 11 nt, Salmonella enterica enterica serovar Typhi Ty2
aaucgccgcuu

SEQ ID NO: 3731248 - RNA, 21 nt, Salmonella enterica enterica serovar Typhi Ty2
aaucgccgucagugagcccuc

SEQ ID NO: 3731249 - RNA, 17 nt, Salmonella enterica enterica serovar Typhi Ty2
aaucgccgugaucccaa

SEQ ID NO: 3731250 - RNA, 16 nt, Salmonella enterica enterica serovar Typhi Ty2
aaucgccucaaccaac

SEQ ID NO: 3731251 - RNA, 21 nt, Salmonella enterica enterica serovar Typhi Ty2
aaucgcgagaaaauagaggaa

SEQ ID NO: 3731252 - RNA, 18 nt, Salmonella enterica enterica serovar Typhi Ty2
aaucgcgagccuucaaca

SEQ ID NO: 3731253 - RNA, 20 nt, Salmonella enterica enterica serovar Typhi Ty2
aaucgcgauaucaacccagu

SEQ ID NO: 3731254 - RNA, 14 nt, Salmonella enterica enterica serovar Typhi Ty2
aaucgcuaaacaua

SEQ ID NO: 3731255 - RNA, 14 nt, Salmonella enterica enterica serovar Typhi Ty2
aaucgcuuccuggg

SEQ ID NO: 3731256 - RNA, 22 nt, Salmonella enterica enterica serovar Typhi Ty2
aaucgcuuuuaccggaucgauc

SEQ ID NO: 3731257 - RNA, 19 nt, Salmonella enterica enterica serovar Typhi Ty2
aaucggaugccauguuucu

SEQ ID NO: 3731258 - RNA, 20 nt, Salmonella enterica enterica serovar Typhi Ty2
aaucggcaaauacaucgcca

SEQ ID NO: 3731259 - RNA, 13 nt, Salmonella enterica enterica serovar Typhi Ty2
aaucggcaggcca

SEQ ID NO: 3731260 - RNA, 14 nt, Salmonella enterica enterica serovar Typhi Ty2
aaucggccagcgaa

SEQ ID NO: 3731261 - RNA, 17 nt, Salmonella enterica enterica serovar Typhi Ty2
aaucggccagcgaaaac

SEQ ID NO: 3731262 - RNA, 23 nt, Salmonella enterica enterica serovar Typhi Ty2
aaucgggaucagaaauucgcagc

SEQ ID NO: 3731263 - RNA, 19 nt, Salmonella enterica enterica serovar Typhi Ty2
aaucgggcgcuaaacccaa

SEQ ID NO: 3731264 - RNA, 23 nt, Salmonella enterica enterica serovar Typhi Ty2
aaucgguaacaucaaguacagcu

SEQ ID NO: 3731265 - RNA, 20 nt, Salmonella enterica enterica serovar Typhi Ty2
aaucguagcgugcgcaauau

SEQ ID NO: 3731266 - RNA, 22 nt, Salmonella enterica enterica serovar Typhi Ty2
aaucguaugcgccugucuuaaa

SEQ ID NO: 3731267 - RNA, 20 nt, Salmonella enterica enterica serovar Typhi Ty2
aaucgucgccaacaccgauc

SEQ ID NO: 3731268 - RNA, 18 nt, Salmonella enterica enterica serovar Typhi Ty2
aaucgugaccaccgccau

SEQ ID NO: 3731269 - RNA, 15 nt, Salmonella enterica enterica serovar Typhi Ty2
aaucgugcaauccug

SEQ ID NO: 3731270 - RNA, 20 nt, Salmonella enterica enterica serovar Typhi Ty2
aaucgugguuagacaucacg

SEQ ID NO: 3731271 - RNA, 14 nt, Salmonella enterica enterica serovar Typhi Ty2
aaucguucuugcac

SEQ ID NO: 3731272 - RNA, 13 nt, Salmonella enterica enterica serovar Typhi Ty2
aaucguuuuaugc

SEQ ID NO: 3731273 - RNA, 13 nt, Salmonella enterica enterica serovar Typhi Ty2
aaucuaaaauuau

SEQ ID NO: 3731274 - RNA, 17 nt, Salmonella enterica enterica serovar Typhi Ty2
aaucuaccagaucgcgg

SEQ ID NO: 3731275 - RNA, 19 nt, Salmonella enterica enterica serovar Typhi Ty2
aaucuaccauugauaccaa

SEQ ID NO: 3731276 - RNA, 14 nt, Salmonella enterica enterica serovar Typhi Ty2
aaucucaauaccac

SEQ ID NO: 3731277 - RNA, 20 nt, Salmonella enterica enterica serovar Typhi Ty2
aaucucacgcucauagccgc

SEQ ID NO: 3731278 - RNA, 13 nt, Salmonella enterica enterica serovar Typhi Ty2
aaucucagauaau

SEQ ID NO: 3731279 - RNA, 23 nt, Salmonella enterica enterica serovar Typhi Ty2
aaucucagauaauagcugcggcu

SEQ ID NO: 3731280 - RNA, 20 nt, Salmonella enterica enterica serovar Typhi Ty2
aaucucaucugcaaaauaua

SEQ ID NO: 3731281 - RNA, 20 nt, Salmonella enterica enterica serovar Typhi Ty2
aaucuccagaccgcugcgga

SEQ ID NO: 3731282 - RNA, 12 nt, Salmonella enterica enterica serovar Typhi Ty2
aaucuccagcau

SEQ ID NO: 3731283 - RNA, 15 nt, Salmonella enterica enterica serovar Typhi Ty2
aaucucgaaacaaua

SEQ ID NO: 3731284 - RNA, 16 nt, Salmonella enterica enterica serovar Typhi Ty2
aaucucuacgccggcg

SEQ ID NO: 3731285 - RNA, 16 nt, Salmonella enterica enterica serovar Typhi Ty2
aaucucuggccaggca

SEQ ID NO: 3731286 - RNA, 15 nt, Salmonella enterica enterica serovar Typhi Ty2
aaucugccaucagca

SEQ ID NO: 3731287 - RNA, 17 nt, Salmonella enterica enterica serovar Typhi Ty2
aaucugccgucaucgac

SEQ ID NO: 3731288 - RNA, 18 nt, Salmonella enterica enterica serovar Typhi Ty2
aaucugccgucaucgacu

SEQ ID NO: 3731289 - RNA, 20 nt, Salmonella enterica enterica serovar Typhi Ty2
aaucugccgucaucgacuuc

SEQ ID NO: 3731290 - RNA, 23 nt, Salmonella enterica enterica serovar Typhi Ty2
aaucugcgccaaucgcgauauca

SEQ ID NO: 3731291 - RNA, 12 nt, Salmonella enterica enterica serovar Typhi Ty2
aaucugcuuuuu

SEQ ID NO: 3731292 - RNA, 16 nt, Salmonella enterica enterica serovar Typhi Ty2
aaucuggauagucagg

SEQ ID NO: 3731293 - RNA, 20 nt, Salmonella enterica enterica serovar Typhi Ty2
aaucuggccuacggaaagcu

SEQ ID NO: 3731294 - RNA, 18 nt, Salmonella enterica enterica serovar Typhi Ty2
aaucuggucguaagaauu

SEQ ID NO: 3731295 - RNA, 21 nt, Salmonella enterica enterica serovar Typhi Ty2
aaucuuuacacucgcggauaa

SEQ ID NO: 3731296 - RNA, 23 nt, Salmonella enterica enterica serovar Typhi Ty2
aaucuuucuguaagagacugaca

SEQ ID NO: 3731297 - RNA, 20 nt, Salmonella enterica enterica serovar Typhi Ty2
aaucuuuuugugcaaucaca

SEQ ID NO: 3731298 - RNA, 15 nt, Salmonella enterica enterica serovar Typhi Ty2
aaugaaaacgaaucg

SEQ ID NO: 3731299 - RNA, 22 nt, Salmonella enterica enterica serovar Typhi Ty2
aaugaaaucgucgccaacaccg

SEQ ID NO: 3731300 - RNA, 18 nt, Salmonella enterica enterica serovar Typhi Ty2
aaugaacguuuuguguca

SEQ ID NO: 3731301 - RNA, 21 nt, Salmonella enterica enterica serovar Typhi Ty2
aaugaacuacggcccuggcuc

SEQ ID NO: 3731302 - RNA, 13 nt, Salmonella enterica enterica serovar Typhi Ty2
aaugaagcauaaa

SEQ ID NO: 3731303 - RNA, 15 nt, Salmonella enterica enterica serovar Typhi Ty2
aaugaagcauaaaaa

SEQ ID NO: 3731304 - RNA, 14 nt, Salmonella enterica enterica serovar Typhi Ty2
aaugaagcgacgcu

SEQ ID NO: 3731305 - RNA, 22 nt, Salmonella enterica enterica serovar Typhi Ty2
aaugaaucaucgguaaaugcuu

SEQ ID NO: 3731306 - RNA, 13 nt, Salmonella enterica enterica serovar Typhi Ty2
aaugaaucccccc

SEQ ID NO: 3731307 - RNA, 15 nt, Salmonella enterica enterica serovar Typhi Ty2
aaugaauguaggccg

SEQ ID NO: 3731308 - RNA, 15 nt, Salmonella enterica enterica serovar Typhi Ty2
aaugaccauuaacgc

SEQ ID NO: 3731309 - RNA, 21 nt, Salmonella enterica enterica serovar Typhi Ty2
aaugaccgucgaccagcguac

SEQ ID NO: 3731310 - RNA, 13 nt, Salmonella enterica enterica serovar Typhi Ty2
aaugaccucaaga

SEQ ID NO: 3731311 - RNA, 15 nt, Salmonella enterica enterica serovar Typhi Ty2
aaugaccucaagaau

SEQ ID NO: 3731312 - RNA, 16 nt, Salmonella enterica enterica serovar Typhi Ty2
aaugaccucaagaaua

SEQ ID NO: 3731313 - RNA, 23 nt, Salmonella enterica enterica serovar Typhi Ty2
aaugacgcgcgagaacugcugca

SEQ ID NO: 3731314 - RNA, 20 nt, Salmonella enterica enterica serovar Typhi Ty2
aaugacggaccaacaaccca

SEQ ID NO: 3731315 - RNA, 22 nt, Salmonella enterica enterica serovar Typhi Ty2
aaugacggacgcagaccaaagu

SEQ ID NO: 3731316 - RNA, 21 nt, Salmonella enterica enterica serovar Typhi Ty2
aaugacgggcuacgucgucga

SEQ ID NO: 3731317 - RNA, 17 nt, Salmonella enterica enterica serovar Typhi Ty2
aaugacuggcuuugcgc

SEQ ID NO: 3731318 - RNA, 18 nt, Salmonella enterica enterica serovar Typhi Ty2
aaugagaaaaggaagaau

SEQ ID NO: 3731319 - RNA, 13 nt, Salmonella enterica enterica serovar Typhi Ty2
aaugagaugcacg

SEQ ID NO: 3731320 - RNA, 14 nt, Salmonella enterica enterica serovar Typhi Ty2
aaugagccgucgcu

SEQ ID NO: 3731321 - RNA, 24 nt, Salmonella enterica enterica serovar Typhi Ty2
aaugagcggaacgcguuccacgau

SEQ ID NO: 3731322 - RNA, 21 nt, Salmonella enterica enterica serovar Typhi Ty2
aaugaggacggcccgcugucu

SEQ ID NO: 3731323 - RNA, 21 nt, Salmonella enterica enterica serovar Typhi Ty2
aaugagugaaaugguugcguu

SEQ ID NO: 3731324 - RNA, 15 nt, Salmonella enterica enterica serovar Typhi Ty2
aaugaucaauggcgc

SEQ ID NO: 3731325 - RNA, 20 nt, Salmonella enterica enterica serovar Typhi Ty2
aaugaucagaacucacauau

SEQ ID NO: 3731326 - RNA, 19 nt, Salmonella enterica enterica serovar Typhi Ty2
aaugaucagcaaaauagug

SEQ ID NO: 3731327 - RNA, 15 nt, Salmonella enterica enterica serovar Typhi Ty2
aaugauccacggcgu

SEQ ID NO: 3731328 - RNA, 15 nt, Salmonella enterica enterica serovar Typhi Ty2
aaugauccgaugcgc

SEQ ID NO: 3731329 - RNA, 21 nt, Salmonella enterica enterica serovar Typhi Ty2
aaugaucguaugcagccaggc

SEQ ID NO: 3731330 - RNA, 17 nt, Salmonella enterica enterica serovar Typhi Ty2
aaugaugccccagaaca

SEQ ID NO: 3731331 - RNA, 22 nt, Salmonella enterica enterica serovar Typhi Ty2
aaugauggcgagaguuugugau

SEQ ID NO: 3731332 - RNA, 19 nt, Salmonella enterica enterica serovar Typhi Ty2
aaugauggggucacagguu

SEQ ID NO: 3731333 - RNA, 22 nt, Salmonella enterica enterica serovar Typhi Ty2
aaugaugguagacaggcuggcu

SEQ ID NO: 3731334 - RNA, 20 nt, Salmonella enterica enterica serovar Typhi Ty2
aaugauguccagaaugcaaa

SEQ ID NO: 3731335 - RNA, 14 nt, Salmonella enterica enterica serovar Typhi Ty2
aaugauuaaaauaa

SEQ ID NO: 3731336 - RNA, 18 nt, Salmonella enterica enterica serovar Typhi Ty2
aaugauuacggaacaaaa

SEQ ID NO: 3731337 - RNA, 23 nt, Salmonella enterica enterica serovar Typhi Ty2
aaugauuacggaacaaaacggaa

SEQ ID NO: 3731338 - RNA, 14 nt, Salmonella enterica enterica serovar Typhi Ty2
aaugauuaucuuuu

SEQ ID NO: 3731339 - RNA, 20 nt, Salmonella enterica enterica serovar Typhi Ty2
aaugcaauauuacaaagcag

SEQ ID NO: 3731340 - RNA, 21 nt, Salmonella enterica enterica serovar Typhi Ty2
aaugcagcggaauucccacau

SEQ ID NO: 3731341 - RNA, 19 nt, Salmonella enterica enterica serovar Typhi Ty2
aaugcagggguguccagau

SEQ ID NO: 3731342 - RNA, 14 nt, Salmonella enterica enterica serovar Typhi Ty2
aaugccaaaaaaac

SEQ ID NO: 3731343 - RNA, 16 nt, Salmonella enterica enterica serovar Typhi Ty2
aaugccaaaaaaacua

SEQ ID NO: 3731344 - RNA, 16 nt, Salmonella enterica enterica serovar Typhi Ty2
aaugccaccagcgcca

SEQ ID NO: 3731345 - RNA, 17 nt, Salmonella enterica enterica serovar Typhi Ty2
aaugccacuauagauga

SEQ ID NO: 3731346 - RNA, 13 nt, Salmonella enterica enterica serovar Typhi Ty2
aaugccacugccc

SEQ ID NO: 3731347 - RNA, 23 nt, Salmonella enterica enterica serovar Typhi Ty2
aaugccaucaucaguaacacccg

SEQ ID NO: 3731348 - RNA, 13 nt, Salmonella enterica enterica serovar Typhi Ty2
aaugcccacgccg

SEQ ID NO: 3731349 - RNA, 12 nt, Salmonella enterica enterica serovar Typhi Ty2
aaugcccggcgc

SEQ ID NO: 3731350 - RNA, 16 nt, Salmonella enterica enterica serovar Typhi Ty2
aaugcccguugacgaa

SEQ ID NO: 3731351 - RNA, 18 nt, Salmonella enterica enterica serovar Typhi Ty2
aaugcccucaacgcccug

SEQ ID NO: 3731352 - RNA, 20 nt, Salmonella enterica enterica serovar Typhi Ty2
aaugccgauagucuccgcca

SEQ ID NO: 3731353 - RNA, 19 nt, Salmonella enterica enterica serovar Typhi Ty2
aaugccgcgcuuucaguaa

SEQ ID NO: 3731354 - RNA, 20 nt, Salmonella enterica enterica serovar Typhi Ty2
aaugccgcgggaaauaccaa

SEQ ID NO: 3731355 - RNA, 22 nt, Salmonella enterica enterica serovar Typhi Ty2
aaugccggacgccaccacgccg

SEQ ID NO: 3731356 - RNA, 16 nt, Salmonella enterica enterica serovar Typhi Ty2
aaugccggaucaggcg

SEQ ID NO: 3731357 - RNA, 15 nt, Salmonella enterica enterica serovar Typhi Ty2
aaugccgggcaaaaa

SEQ ID NO: 3731358 - RNA, 14 nt, Salmonella enterica enterica serovar Typhi Ty2
aaugccugaccaac

SEQ ID NO: 3731359 - RNA, 16 nt, Salmonella enterica enterica serovar Typhi Ty2
aaugccuguuuauauu

SEQ ID NO: 3731360 - RNA, 24 nt, Salmonella enterica enterica serovar Typhi Ty2
aaugccuuauccggccugcaggca

SEQ ID NO: 3731361 - RNA, 16 nt, Salmonella enterica enterica serovar Typhi Ty2
aaugccuuaugcccgg

SEQ ID NO: 3731362 - RNA, 17 nt, Salmonella enterica enterica serovar Typhi Ty2
aaugccuuccuguggaa

SEQ ID NO: 3731363 - RNA, 14 nt, Salmonella enterica enterica serovar Typhi Ty2
aaugcgaaaaaaag

SEQ ID NO: 3731364 - RNA, 13 nt, Salmonella enterica enterica serovar Typhi Ty2
aaugcgagcaaaa

SEQ ID NO: 3731365 - RNA, 14 nt, Salmonella enterica enterica serovar Typhi Ty2
aaugcgauagguga

SEQ ID NO: 3731366 - RNA, 21 nt, Salmonella enterica enterica serovar Typhi Ty2
aaugcgcaaaauucacaccaa

SEQ ID NO: 3731367 - RNA, 19 nt, Salmonella enterica enterica serovar Typhi Ty2
aaugcgcaaucccggagag

SEQ ID NO: 3731368 - RNA, 15 nt, Salmonella enterica enterica serovar Typhi Ty2
aaugcgccccggcgg

SEQ ID NO: 3731369 - RNA, 18 nt, Salmonella enterica enterica serovar Typhi Ty2
aaugcgccccggcggcgu

SEQ ID NO: 3731370 - RNA, 17 nt, Salmonella enterica enterica serovar Typhi Ty2
aaugcgccgucaggcuu

SEQ ID NO: 3731371 - RNA, 16 nt, Salmonella enterica enterica serovar Typhi Ty2
aauuugauagcgccac

SEQ ID NO: 3731372 - RNA, 9 nt, Salmonella enterica enterica serovar Typhi Ty2
aauuugauu

SEQ ID NO: 3731373 - RNA, 21 nt, Salmonella enterica enterica serovar Typhi Ty2
aauuuguacuucagagcugaa

SEQ ID NO: 3731374 - RNA, 14 nt, Salmonella enterica enterica serovar Typhi Ty2
aauuugugagauaa

SEQ ID NO: 3731375 - RNA, 21 nt, Salmonella enterica enterica serovar Typhi Ty2
aauuuuacuuucauuccuuua

SEQ ID NO: 3731376 - RNA, 13 nt, Salmonella enterica enterica serovar Typhi Ty2
aauuuuagaaaua

SEQ ID NO: 3731377 - RNA, 16 nt, Salmonella enterica enterica serovar Typhi Ty2
aauuuucacuuauaaa

SEQ ID NO: 3731378 - RNA, 19 nt, Salmonella enterica enterica serovar Typhi Ty2
aauuuucagacacugcacc

SEQ ID NO: 3731379 - RNA, 11 nt, Salmonella enterica enterica serovar Typhi Ty2
aauuuugauaa

SEQ ID NO: 3731380 - RNA, 13 nt, Salmonella enterica enterica serovar Typhi Ty2
aauuuugcauaaa

SEQ ID NO: 3731381 - RNA, 15 nt, Salmonella enterica enterica serovar Typhi Ty2
aauuuugcauaaaua

SEQ ID NO: 3731382 - RNA, 22 nt, Salmonella enterica enterica serovar Typhi Ty2
aauuuuuccgccuccuccgguu

SEQ ID NO: 3731383 - RNA, 13 nt, Salmonella enterica enterica serovar Typhi Ty2
aauuuuuugauug

SEQ ID NO: 3731384 - RNA, 21 nt, Salmonella enterica enterica serovar Typhi Ty2
acaaaaagcgcgccgaaaaua

SEQ ID NO: 3731385 - RNA, 16 nt, Salmonella enterica enterica serovar Typhi Ty2
acaaaaaguaguucca

SEQ ID NO: 3731386 - RNA, 16 nt, Salmonella enterica enterica serovar Typhi Ty2
acaaaauaaagugaaa

SEQ ID NO: 3731387 - RNA, 13 nt, Salmonella enterica enterica serovar Typhi Ty2
acaaaauauugcc

SEQ ID NO: 3731388 - RNA, 13 nt, Salmonella enterica enterica serovar Typhi Ty2
acaaaauggcuga

SEQ ID NO: 3731389 - RNA, 17 nt, Salmonella enterica enterica serovar Typhi Ty2
acaaaauggcugauaaa

SEQ ID NO: 3731390 - RNA, 15 nt, Salmonella enterica enterica serovar Typhi Ty2
acaaacaaauaaauc

SEQ ID NO: 3731391 - RNA, 19 nt, Salmonella enterica enterica serovar Typhi Ty2
acaaacaaauaaauccaug

SEQ ID NO: 3731392 - RNA, 14 nt, Salmonella enterica enterica serovar Typhi Ty2
acaaacacagccau

SEQ ID NO: 3731393 - RNA, 19 nt, Salmonella enterica enterica serovar Typhi Ty2
acaaacaccaccaguaacc

SEQ ID NO: 3731394 - RNA, 23 nt, Salmonella enterica enterica serovar Typhi Ty2
acaaacagcgccccgacaaaacg

SEQ ID NO: 3731395 - RNA, 16 nt, Salmonella enterica enterica serovar Typhi Ty2
acaaaccacugcugua

SEQ ID NO: 3731396 - RNA, 19 nt, Salmonella enterica enterica serovar Typhi Ty2
acaaaccagacgcguaacc

SEQ ID NO: 3731397 - RNA, 18 nt, Salmonella enterica enterica serovar Typhi Ty2
acaaaccccacccacuga

SEQ ID NO: 3731398 - RNA, 16 nt, Salmonella enterica enterica serovar Typhi Ty2
acaaacccccagccau

SEQ ID NO: 3731399 - RNA, 16 nt, Salmonella enterica enterica serovar Typhi Ty2
acaaacgcaccgccaa

SEQ ID NO: 3731400 - RNA, 17 nt, Salmonella enterica enterica serovar Typhi Ty2
acaaacgccaccgccac

SEQ ID NO: 3731401 - RNA, 22 nt, Salmonella enterica enterica serovar Typhi Ty2
acaaacgccgucacaaagccca

SEQ ID NO: 3731402 - RNA, 14 nt, Salmonella enterica enterica serovar Typhi Ty2
acaaacgcuuuuuu

SEQ ID NO: 3731403 - RNA, 23 nt, Salmonella enterica enterica serovar Typhi Ty2
acaaacugcgcuagccgccgugu

SEQ ID NO: 3731404 - RNA, 15 nt, Salmonella enterica enterica serovar Typhi Ty2
acaaagagcucccca

SEQ ID NO: 3731405 - RNA, 16 nt, Salmonella enterica enterica serovar Typhi Ty2
acaaagagcuccccac

SEQ ID NO: 3731406 - RNA, 22 nt, Salmonella enterica enterica serovar Typhi Ty2
acaaagagcuccccacgaaagu

SEQ ID NO: 3731407 - RNA, 18 nt, Salmonella enterica enterica serovar Typhi Ty2
acaaagcgguaaaucgca

SEQ ID NO: 3731408 - RNA, 19 nt, Salmonella enterica enterica serovar Typhi Ty2
acaaagcguggggaaaacc

SEQ ID NO: 3731409 - RNA, 20 nt, Salmonella enterica enterica serovar Typhi Ty2
acaaagguugcgccaaagca

SEQ ID NO: 3731410 - RNA, 23 nt, Salmonella enterica enterica serovar Typhi Ty2
acaaagguugcgccaaagcaauc

SEQ ID NO: 3731411 - RNA, 13 nt, Salmonella enterica enterica serovar Typhi Ty2
acaaauacauggu

SEQ ID NO: 3731412 - RNA, 19 nt, Salmonella enterica enterica serovar Typhi Ty2
acaaauagcacacaaacga

SEQ ID NO: 3731413 - RNA, 16 nt, Salmonella enterica enterica serovar Typhi Ty2
acaaaucaaacucacc

SEQ ID NO: 3731414 - RNA, 22 nt, Salmonella enterica enterica serovar Typhi Ty2
acaaaucaucgguuacuccuua

SEQ ID NO: 3731415 - RNA, 16 nt, Salmonella enterica enterica serovar Typhi Ty2
acaaaucgacagccag

SEQ ID NO: 3731416 - RNA, 22 nt, Salmonella enterica enterica serovar Typhi Ty2
acaaaucgggcgggcauuauac

SEQ ID NO: 3731417 - RNA, 19 nt, Salmonella enterica enterica serovar Typhi Ty2
acaaauuccggcacaaccu

SEQ ID NO: 3731418 - RNA, 16 nt, Salmonella enterica enterica serovar Typhi Ty2
acaaauugcagcgcgc

SEQ ID NO: 3731419 - RNA, 20 nt, Salmonella enterica enterica serovar Typhi Ty2
acaaauuguuuaaaaacagg

SEQ ID NO: 3731420 - RNA, 12 nt, Salmonella enterica enterica serovar Typhi Ty2
acaaauuuaaac

SEQ ID NO: 3731421 - RNA, 13 nt, Salmonella enterica enterica serovar Typhi Ty2
acaacaaaaagau

SEQ ID NO: 3731422 - RNA, 21 nt, Salmonella enterica enterica serovar Typhi Ty2
acaacaaggauagcuuuguau

SEQ ID NO: 3731423 - RNA, 15 nt, Salmonella enterica enterica serovar Typhi Ty2
acaacacgcuuuuca

SEQ ID NO: 3731424 - RNA, 16 nt, Salmonella enterica enterica serovar Typhi Ty2
acaacaucccagaaaa

SEQ ID NO: 3731425 - RNA, 17 nt, Salmonella enterica enterica serovar Typhi Ty2
acaacauguuucuugug

SEQ ID NO: 3731426 - RNA, 14 nt, Salmonella enterica enterica serovar Typhi Ty2
acaacauugaggcu

SEQ ID NO: 3731427 - RNA, 17 nt, Salmonella enterica enterica serovar Typhi Ty2
acaacauugaggcuacc

SEQ ID NO: 3731428 - RNA, 18 nt, Salmonella enterica enterica serovar Typhi Ty2
acaacauuguuauguuuu

SEQ ID NO: 3731429 - RNA, 14 nt, Salmonella enterica enterica serovar Typhi Ty2
acaaccagaauaau

SEQ ID NO: 3731430 - RNA, 18 nt, Salmonella enterica enterica serovar Typhi Ty2
acaaccaucacugaaccc

SEQ ID NO: 3731431 - RNA, 20 nt, Salmonella enterica enterica serovar Typhi Ty2
acaaccgcccccaacugagc

SEQ ID NO: 3731432 - RNA, 19 nt, Salmonella enterica enterica serovar Typhi Ty2
acaaccuccacgcccagcg

SEQ ID NO: 3731433 - RNA, 13 nt, Salmonella enterica enterica serovar Typhi Ty2
acaaccugcccuu

SEQ ID NO: 3731434 - RNA, 15 nt, Salmonella enterica enterica serovar Typhi Ty2
acaaccugcccuuuc

SEQ ID NO: 3731435 - RNA, 14 nt, Salmonella enterica enterica serovar Typhi Ty2
acaaccuggcuugc

SEQ ID NO: 3731436 - RNA, 20 nt, Salmonella enterica enterica serovar Typhi Ty2
acaaccuguaggccggauaa

SEQ ID NO: 3731437 - RNA, 19 nt, Salmonella enterica enterica serovar Typhi Ty2
acaacgagauucaauaaug

SEQ ID NO: 3731438 - RNA, 17 nt, Salmonella enterica enterica serovar Typhi Ty2
acaacgccgccuggcau

SEQ ID NO: 3731439 - RNA, 20 nt, Salmonella enterica enterica serovar Typhi Ty2
acaacgccgguacgcagcag

SEQ ID NO: 3731440 - RNA, 19 nt, Salmonella enterica enterica serovar Typhi Ty2
acaacggcaauuuuuacaa

SEQ ID NO: 3731441 - RNA, 17 nt, Salmonella enterica enterica serovar Typhi Ty2
acaacggcgaccuucac

SEQ ID NO: 3731442 - RNA, 19 nt, Salmonella enterica enterica serovar Typhi Ty2
acaacgucaguggaaaaca

SEQ ID NO: 3731443 - RNA, 19 nt, Salmonella enterica enterica serovar Typhi Ty2
acaacuucuaauuuuucca

SEQ ID NO: 3731444 - RNA, 21 nt, Salmonella enterica enterica serovar Typhi Ty2
acaacuucuaauuuuuccagc

SEQ ID NO: 3731445 - RNA, 23 nt, Salmonella enterica enterica serovar Typhi Ty2
acaagaacuuaaauuaaugauua

SEQ ID NO: 3731446 - RNA, 13 nt, Salmonella enterica enterica serovar Typhi Ty2
acaagaauaugca

SEQ ID NO: 3731447 - RNA, 22 nt, Salmonella enterica enterica serovar Typhi Ty2
acaagcaguaugaccccuccgg

SEQ ID NO: 3731448 - RNA, 11 nt, Salmonella enterica enterica serovar Typhi Ty2
acaagcaguua

SEQ ID NO: 3731449 - RNA, 19 nt, Salmonella enterica enterica serovar Typhi Ty2
acaagccccccgcacagca

SEQ ID NO: 3731450 - RNA, 23 nt, Salmonella enterica enterica serovar Typhi Ty2
acaagccgccaacgccagcagcg

SEQ ID NO: 3731451 - RNA, 15 nt, Salmonella enterica enterica serovar Typhi Ty2
acaagcgaucgccag

SEQ ID NO: 3731452 - RNA, 14 nt, Salmonella enterica enterica serovar Typhi Ty2
acaagcugcgccau

SEQ ID NO: 3731453 - RNA, 12 nt, Salmonella enterica enterica serovar Typhi Ty2
acaccacgcagg

SEQ ID NO: 3731454 - RNA, 13 nt, Salmonella enterica enterica serovar Typhi Ty2
acaccagaaugcu

SEQ ID NO: 3731455 - RNA, 19 nt, Salmonella enterica enterica serovar Typhi Ty2
acaccagacugaugaugaa

SEQ ID NO: 3731456 - RNA, 23 nt, Salmonella enterica enterica serovar Typhi Ty2
acaccagaucauuaccugucgcc

SEQ ID NO: 3731457 - RNA, 14 nt, Salmonella enterica enterica serovar Typhi Ty2
acaccagccguuca

SEQ ID NO: 3731458 - RNA, 12 nt, Salmonella enterica enterica serovar Typhi Ty2
acaccagcgccg

SEQ ID NO: 3731459 - RNA, 18 nt, Salmonella enterica enterica serovar Typhi Ty2
acaccaggaguuaaaccu

SEQ ID NO: 3731460 - RNA, 15 nt, Salmonella enterica enterica serovar Typhi Ty2
acaccaucccgcucu

SEQ ID NO: 3731461 - RNA, 14 nt, Salmonella enterica enterica serovar Typhi Ty2
acaccauuucacaa

SEQ ID NO: 3731462 - RNA, 15 nt, Salmonella enterica enterica serovar Typhi Ty2
acaccauuucacaaa

SEQ ID NO: 3731463 - RNA, 22 nt, Salmonella enterica enterica serovar Typhi Ty2
acaccauuucacaaauuaaaaa

SEQ ID NO: 3731464 - RNA, 12 nt, Salmonella enterica enterica serovar Typhi Ty2
acacccaauaua

SEQ ID NO: 3731465 - RNA, 15 nt, Salmonella enterica enterica serovar Typhi Ty2
acacccauagcagcu

SEQ ID NO: 3731466 - RNA, 14 nt, Salmonella enterica enterica serovar Typhi Ty2
acacccgcacgccu

SEQ ID NO: 3731467 - RNA, 15 nt, Salmonella enterica enterica serovar Typhi Ty2
acacccgcagccgca

SEQ ID NO: 3731468 - RNA, 19 nt, Salmonella enterica enterica serovar Typhi Ty2
acacccggcuuuugcuuuc

SEQ ID NO: 3731469 - RNA, 22 nt, Salmonella enterica enterica serovar Typhi Ty2
acacccggcuuuugcuuucugg

SEQ ID NO: 3731470 - RNA, 12 nt, Salmonella enterica enterica serovar Typhi Ty2
acacccugcccc

SEQ ID NO: 3731471 - RNA, 13 nt, Salmonella enterica enterica serovar Typhi Ty2
acaccgagacaga

SEQ ID NO: 3731472 - RNA, 23 nt, Salmonella enterica enterica serovar Typhi Ty2
acaccgcaggccggauaaggcau

SEQ ID NO: 3731473 - RNA, 14 nt, Salmonella enterica enterica serovar Typhi Ty2
acaccggaagugaa

SEQ ID NO: 3731474 - RNA, 19 nt, Salmonella enterica enterica serovar Typhi Ty2
acaccggaauucuguucag

SEQ ID NO: 3731475 - RNA, 18 nt, Salmonella enterica enterica serovar Typhi Ty2
acaccggccauugccgcg

SEQ ID NO: 3731476 - RNA, 18 nt, Salmonella enterica enterica serovar Typhi Ty2
acaccggcgccagcucug

SEQ ID NO: 3731477 - RNA, 22 nt, Salmonella enterica enterica serovar Typhi Ty2
acaccggcggcgccaucgccuc

SEQ ID NO: 3731478 - RNA, 20 nt, Salmonella enterica enterica serovar Typhi Ty2
acaccgguugcgcaaccucc

SEQ ID NO: 3731479 - RNA, 21 nt, Salmonella enterica enterica serovar Typhi Ty2
acaccugggcuugcuuuucuc

SEQ ID NO: 3731480 - RNA, 12 nt, Salmonella enterica enterica serovar Typhi Ty2
acaccuuugggg

SEQ ID NO: 3731481 - RNA, 12 nt, Salmonella enterica enterica serovar Typhi Ty2
acacgauaguga

SEQ ID NO: 3731482 - RNA, 13 nt, Salmonella enterica enterica serovar Typhi Ty2
acacgauggcaaa

SEQ ID NO: 3731483 - RNA, 19 nt, Salmonella enterica enterica serovar Typhi Ty2
acacgcacaucccgaauac

SEQ ID NO: 3731484 - RNA, 16 nt, Salmonella enterica enterica serovar Typhi Ty2
acacgcagacccaggc

SEQ ID NO: 3731485 - RNA, 22 nt, Salmonella enterica enterica serovar Typhi Ty2
acacgccugaauuucgucagga

SEQ ID NO: 3731486 - RNA, 14 nt, Salmonella enterica enterica serovar Typhi Ty2
acacgccuuccucc

SEQ ID NO: 3731487 - RNA, 18 nt, Salmonella enterica enterica serovar Typhi Ty2
acacgccuuccuccagca

SEQ ID NO: 3731488 - RNA, 17 nt, Salmonella enterica enterica serovar Typhi Ty2
acacgcgaauagccaga

SEQ ID NO: 3731489 - RNA, 21 nt, Salmonella enterica enterica serovar Typhi Ty2
acacgcgcaccaguucacucc

SEQ ID NO: 3731490 - RNA, 17 nt, Salmonella enterica enterica serovar Typhi Ty2
acacgcggucgucaucg

SEQ ID NO: 3731491 - RNA, 19 nt, Salmonella enterica enterica serovar Typhi Ty2
acacgguuauaaccggaca

SEQ ID NO: 3731492 - RNA, 12 nt, Salmonella enterica enterica serovar Typhi Ty2
acacguaacaac

SEQ ID NO: 3731493 - RNA, 21 nt, Salmonella enterica enterica serovar Typhi Ty2
acacguaacugacaauuucca

SEQ ID NO: 3731494 - RNA, 18 nt, Salmonella enterica enterica serovar Typhi Ty2
acacguauaaacgccgcc

SEQ ID NO: 3731495 - RNA, 21 nt, Salmonella enterica enterica serovar Typhi Ty2
acacguuugcccgaugucgcu

SEQ ID NO: 3731496 - RNA, 17 nt, Salmonella enterica enterica serovar Typhi Ty2
acacuaacgcucuucuc

SEQ ID NO: 3731497 - RNA, 16 nt, Salmonella enterica enterica serovar Typhi Ty2
acacuauguugaugcu

SEQ ID NO: 3731498 - RNA, 11 nt, Salmonella enterica enterica serovar Typhi Ty2
acacucaacca

SEQ ID NO: 3731499 - RNA, 15 nt, Salmonella enterica enterica serovar Typhi Ty2
acacucaaccaacca

SEQ ID NO: 3731500 - RNA, 15 nt, Salmonella enterica enterica serovar Typhi Ty2
acacuccgcgcaugu

SEQ ID NO: 3731501 - RNA, 22 nt, Salmonella enterica enterica serovar Typhi Ty2
acacuguugccgacagcggaaa

SEQ ID NO: 3731502 - RNA, 13 nt, Salmonella enterica enterica serovar Typhi Ty2
acacuuuugccga

SEQ ID NO: 3731503 - RNA, 16 nt, Salmonella enterica enterica serovar Typhi Ty2
acagaaaccauaaaca

SEQ ID NO: 3731504 - RNA, 15 nt, Salmonella enterica enterica serovar Typhi Ty2
acagaagcgccuguc

SEQ ID NO: 3731505 - RNA, 18 nt, Salmonella enterica enterica serovar Typhi Ty2
acagaagcgcugguaaau

SEQ ID NO: 3731506 - RNA, 17 nt, Salmonella enterica enterica serovar Typhi Ty2
acagaagcugagaaaag

SEQ ID NO: 3731507 - RNA, 23 nt, Salmonella enterica enterica serovar Typhi Ty2
acagaagguuauucgccuuucac

SEQ ID NO: 3731508 - RNA, 20 nt, Salmonella enterica enterica serovar Typhi Ty2
acagaaugcugaacagccgu

SEQ ID NO: 3731509 - RNA, 16 nt, Salmonella enterica enterica serovar Typhi Ty2
acagaauuaacgcaga

SEQ ID NO: 3731510 - RNA, 18 nt, Salmonella enterica enterica serovar Typhi Ty2
acagaauuaacgcagaau

SEQ ID NO: 3731511 - RNA, 18 nt, Salmonella enterica enterica serovar Typhi Ty2
acagacaaugcugacacu

SEQ ID NO: 3731512 - RNA, 20 nt, Salmonella enterica enterica serovar Typhi Ty2
acagacaucggagauuucau

SEQ ID NO: 3731513 - RNA, 16 nt, Salmonella enterica enterica serovar Typhi Ty2
acagacgacuccaaua

SEQ ID NO: 3731514 - RNA, 16 nt, Salmonella enterica enterica serovar Typhi Ty2
acagauaagcgucugc

SEQ ID NO: 3731515 - RNA, 15 nt, Salmonella enterica enterica serovar Typhi Ty2
acagauacuggaagu

SEQ ID NO: 3731516 - RNA, 23 nt, Salmonella enterica enterica serovar Typhi Ty2
acagauagcccugagcccacagc

SEQ ID NO: 3731517 - RNA, 16 nt, Salmonella enterica enterica serovar Typhi Ty2
acagauaugaaaugag

SEQ ID NO: 3731518 - RNA, 23 nt, Salmonella enterica enterica serovar Typhi Ty2
acagauucccagugcgcggucau

SEQ ID NO: 3731519 - RNA, 17 nt, Salmonella enterica enterica serovar Typhi Ty2
acagauuggucagcagc

SEQ ID NO: 3731520 - RNA, 18 nt, Salmonella enterica enterica serovar Typhi Ty2
acagcaaaacgcgcuauc

SEQ ID NO: 3731521 - RNA, 14 nt, Salmonella enterica enterica serovar Typhi Ty2
acagcaacaucuau

SEQ ID NO: 3731522 - RNA, 18 nt, Salmonella enterica enterica serovar Typhi Ty2
acagcaauaucagccauu

SEQ ID NO: 3731523 - RNA, 15 nt, Salmonella enterica enterica serovar Typhi Ty2
acagcaaugagcagg

SEQ ID NO: 3731524 - RNA, 18 nt, Salmonella enterica enterica serovar Typhi Ty2
acagcaaugcccaaaaua

SEQ ID NO: 3731525 - RNA, 11 nt, Salmonella enterica enterica serovar Typhi Ty2
acagcacauag

SEQ ID NO: 3731526 - RNA, 13 nt, Salmonella enterica enterica serovar Typhi Ty2
acagcaccaucau

SEQ ID NO: 3731527 - RNA, 23 nt, Salmonella enterica enterica serovar Typhi Ty2
acagcacuacggauggcccugcc

SEQ ID NO: 3731528 - RNA, 21 nt, Salmonella enterica enterica serovar Typhi Ty2
acagcaggcuuugcugcugcg

SEQ ID NO: 3731529 - RNA, 14 nt, Salmonella enterica enterica serovar Typhi Ty2
acagccaaaucagc

SEQ ID NO: 3731530 - RNA, 14 nt, Salmonella enterica enterica serovar Typhi Ty2
acagccacacugcu

SEQ ID NO: 3731531 - RNA, 14 nt, Salmonella enterica enterica serovar Typhi Ty2
acagccagaagccu

SEQ ID NO: 3731532 - RNA, 13 nt, Salmonella enterica enterica serovar Typhi Ty2
acagccagcagcg

SEQ ID NO: 3731533 - RNA, 12 nt, Salmonella enterica enterica serovar Typhi Ty2
acagccagcauu

SEQ ID NO: 3731534 - RNA, 22 nt, Salmonella enterica enterica serovar Typhi Ty2
acagccaggcuuucccuucaga

SEQ ID NO: 3731535 - RNA, 18 nt, Salmonella enterica enterica serovar Typhi Ty2
acagugcuauacaguaaa

SEQ ID NO: 3731536 - RNA, 18 nt, Salmonella enterica enterica serovar Typhi Ty2
acagugugccgucaucca

SEQ ID NO: 3731537 - RNA, 14 nt, Salmonella enterica enterica serovar Typhi Ty2
acaguuaacgccaa

SEQ ID NO: 3731538 - RNA, 14 nt, Salmonella enterica enterica serovar Typhi Ty2
acaguuaccacaca

SEQ ID NO: 3731539 - RNA, 19 nt, Salmonella enterica enterica serovar Typhi Ty2
acaguuaccacacaugcaa

SEQ ID NO: 3731540 - RNA, 13 nt, Salmonella enterica enterica serovar Typhi Ty2
acaguucaaacgg

SEQ ID NO: 3731541 - RNA, 18 nt, Salmonella enterica enterica serovar Typhi Ty2
acaguucccggcaacagu

SEQ ID NO: 3731542 - RNA, 12 nt, Salmonella enterica enterica serovar Typhi Ty2
acaguuugucaa

SEQ ID NO: 3731543 - RNA, 21 nt, Salmonella enterica enterica serovar Typhi Ty2
acaguuuugucaucagaucau

SEQ ID NO: 3731544 - RNA, 21 nt, Salmonella enterica enterica serovar Typhi Ty2
acaguuuuuccuuucugcgcc

SEQ ID NO: 3731545 - RNA, 20 nt, Salmonella enterica enterica serovar Typhi Ty2
acaguuuuuucguuccagag

SEQ ID NO: 3731546 - RNA, 17 nt, Salmonella enterica enterica serovar Typhi Ty2
acauaaaaugguuauug

SEQ ID NO: 3731547 - RNA, 15 nt, Salmonella enterica enterica serovar Typhi Ty2
acauaaauaaacagc

SEQ ID NO: 3731548 - RNA, 17 nt, Salmonella enterica enterica serovar Typhi Ty2
acauaacagcagcagac

SEQ ID NO: 3731549 - RNA, 24 nt, Salmonella enterica enterica serovar Typhi Ty2
acauaaccggcaaccaaaguccaa

SEQ ID NO: 3731550 - RNA, 16 nt, Salmonella enterica enterica serovar Typhi Ty2
acauaacugagacuca

SEQ ID NO: 3731551 - RNA, 17 nt, Salmonella enterica enterica serovar Typhi Ty2
acauaauauuccagcgu

SEQ ID NO: 3731552 - RNA, 19 nt, Salmonella enterica enterica serovar Typhi Ty2
acauaauauuccagcgugc

SEQ ID NO: 3731553 - RNA, 14 nt, Salmonella enterica enterica serovar Typhi Ty2
acauaauggagaac

SEQ ID NO: 3731554 - RNA, 17 nt, Salmonella enterica enterica serovar Typhi Ty2
acauacaaagagaaaau

SEQ ID NO: 3731555 - RNA, 17 nt, Salmonella enterica enterica serovar Typhi Ty2
acauacaccggcgccag

SEQ ID NO: 3731556 - RNA, 13 nt, Salmonella enterica enterica serovar Typhi Ty2
acauaccgcagau

SEQ ID NO: 3731557 - RNA, 19 nt, Salmonella enterica enterica serovar Typhi Ty2
acauaccgucaccacgcgc

SEQ ID NO: 3731558 - RNA, 20 nt, Salmonella enterica enterica serovar Typhi Ty2
acauacgccgccagccacug

SEQ ID NO: 3731559 - RNA, 19 nt, Salmonella enterica enterica serovar Typhi Ty2
acauacguuuaaagcgcuc

SEQ ID NO: 3731560 - RNA, 21 nt, Salmonella enterica enterica serovar Typhi Ty2
acauacguuuaaagcgcucgu

SEQ ID NO: 3731561 - RNA, 20 nt, Salmonella enterica enterica serovar Typhi Ty2
acauacugaaauuucuuuuc

SEQ ID NO: 3731562 - RNA, 22 nt, Salmonella enterica enterica serovar Typhi Ty2
acauacugaaauuucuuuucca

SEQ ID NO: 3731563 - RNA, 20 nt, Salmonella enterica enterica serovar Typhi Ty2
acauacugcuuuuucggcuc

SEQ ID NO: 3731564 - RNA, 20 nt, Salmonella enterica enterica serovar Typhi Ty2
acauacuguuaugggucgcu

SEQ ID NO: 3731565 - RNA, 22 nt, Salmonella enterica enterica serovar Typhi Ty2
acauacuguuaugggucgcuuc

SEQ ID NO: 3731566 - RNA, 15 nt, Salmonella enterica enterica serovar Typhi Ty2
acauagcauaauaau

SEQ ID NO: 3731567 - RNA, 12 nt, Salmonella enterica enterica serovar Typhi Ty2
acauagcaucca

SEQ ID NO: 3731568 - RNA, 20 nt, Salmonella enterica enterica serovar Typhi Ty2
acauagccucaagagaugca

SEQ ID NO: 3731569 - RNA, 17 nt, Salmonella enterica enterica serovar Typhi Ty2
acauagcuaaauaaaaa

SEQ ID NO: 3731570 - RNA, 19 nt, Salmonella enterica enterica serovar Typhi Ty2
acauagcuaaauaaaaaua

SEQ ID NO: 3731571 - RNA, 15 nt, Salmonella enterica enterica serovar Typhi Ty2
acauagcuauauuua

SEQ ID NO: 3731572 - RNA, 19 nt, Salmonella enterica enterica serovar Typhi Ty2
acauaggcaauauccuccg

SEQ ID NO: 3731573 - RNA, 13 nt, Salmonella enterica enterica serovar Typhi Ty2
acauauacugucu

SEQ ID NO: 3731574 - RNA, 22 nt, Salmonella enterica enterica serovar Typhi Ty2
acauauauauccgcuauuacca

SEQ ID NO: 3731575 - RNA, 20 nt, Salmonella enterica enterica serovar Typhi Ty2
acauaucgacauaaguaaau

SEQ ID NO: 3731576 - RNA, 18 nt, Salmonella enterica enterica serovar Typhi Ty2
acauaucgcaauugauac

SEQ ID NO: 3731577 - RNA, 22 nt, Salmonella enterica enterica serovar Typhi Ty2
acauaucgcaauugauacauuu

SEQ ID NO: 3731578 - RNA, 19 nt, Salmonella enterica enterica serovar Typhi Ty2
acauaucgccggggaaaau

SEQ ID NO: 3731579 - RNA, 12 nt, Salmonella enterica enterica serovar Typhi Ty2
acauaugaagga

SEQ ID NO: 3731580 - RNA, 14 nt, Salmonella enterica enterica serovar Typhi Ty2
acauauucaauaau

SEQ ID NO: 3731581 - RNA, 15 nt, Salmonella enterica enterica serovar Typhi Ty2
acauauucaauaaua

SEQ ID NO: 3731582 - RNA, 14 nt, Salmonella enterica enterica serovar Typhi Ty2
acauauuccagaag

SEQ ID NO: 3731583 - RNA, 13 nt, Salmonella enterica enterica serovar Typhi Ty2
acauauugcgcuu

SEQ ID NO: 3731584 - RNA, 16 nt, Salmonella enterica enterica serovar Typhi Ty2
acauauugcgcuucac

SEQ ID NO: 3731585 - RNA, 15 nt, Salmonella enterica enterica serovar Typhi Ty2
acauauuguuuucua

SEQ ID NO: 3731586 - RNA, 19 nt, Salmonella enterica enterica serovar Typhi Ty2
acauauuguuuucuauuuu

SEQ ID NO: 3731587 - RNA, 14 nt, Salmonella enterica enterica serovar Typhi Ty2
acauauuugcgugu

SEQ ID NO: 3731588 - RNA, 21 nt, Salmonella enterica enterica serovar Typhi Ty2
acauauuugcgugucaucaaa

SEQ ID NO: 3731589 - RNA, 22 nt, Salmonella enterica enterica serovar Typhi Ty2
acauauuugcgugucaucaaaa

SEQ ID NO: 3731590 - RNA, 23 nt, Salmonella enterica enterica serovar Typhi Ty2
acauauuugcgugucaucaaaau

SEQ ID NO: 3731591 - RNA, 16 nt, Salmonella enterica enterica serovar Typhi Ty2
acauauuuuucacaca

SEQ ID NO: 3731592 - RNA, 22 nt, Salmonella enterica enterica serovar Typhi Ty2
acauauuuuucacacauaagca

SEQ ID NO: 3731593 - RNA, 13 nt, Salmonella enterica enterica serovar Typhi Ty2
acauauuuuuguu

SEQ ID NO: 3731594 - RNA, 12 nt, Salmonella enterica enterica serovar Typhi Ty2
acaucaagccca

SEQ ID NO: 3731595 - RNA, 16 nt, Salmonella enterica enterica serovar Typhi Ty2
acaucaagcccacaca

SEQ ID NO: 3731596 - RNA, 16 nt, Salmonella enterica enterica serovar Typhi Ty2
acaucaauagcgcuac

SEQ ID NO: 3731597 - RNA, 19 nt, Salmonella enterica enterica serovar Typhi Ty2
acaucacgcaaaugcagcg

SEQ ID NO: 3731598 - RNA, 16 nt, Salmonella enterica enterica serovar Typhi Ty2
acaucacguucgcgca

SEQ ID NO: 3731599 - RNA, 16 nt, Salmonella enterica enterica serovar Typhi Ty2
acaucagagguaauua

SEQ ID NO: 3731600 - RNA, 13 nt, Salmonella enterica enterica serovar Typhi Ty2
acaucagauaaac

SEQ ID NO: 3731601 - RNA, 17 nt, Salmonella enterica enterica serovar Typhi Ty2
acaucagcggcacauag

SEQ ID NO: 3731602 - RNA, 15 nt, Salmonella enterica enterica serovar Typhi Ty2
acaucaucaggccug

SEQ ID NO: 3731603 - RNA, 21 nt, Salmonella enterica enterica serovar Typhi Ty2
acaucauccggcugcgucgcu

SEQ ID NO: 3731604 - RNA, 14 nt, Salmonella enterica enterica serovar Typhi Ty2
acaucaucgcuggu

SEQ ID NO: 3731605 - RNA, 21 nt, Salmonella enterica enterica serovar Typhi Ty2
acaucaucguuugcgcgcacg

SEQ ID NO: 3731606 - RNA, 21 nt, Salmonella enterica enterica serovar Typhi Ty2
acaucaugaugaucuucagcc

SEQ ID NO: 3731607 - RNA, 22 nt, Salmonella enterica enterica serovar Typhi Ty2
acaucaugcuugcuuugcggca

SEQ ID NO: 3731608 - RNA, 13 nt, Salmonella enterica enterica serovar Typhi Ty2
acaucauuaucca

SEQ ID NO: 3731609 - RNA, 14 nt, Salmonella enterica enterica serovar Typhi Ty2
acauccagacagcc

SEQ ID NO: 3731610 - RNA, 19 nt, Salmonella enterica enterica serovar Typhi Ty2
acauccagcgccugcugua

SEQ ID NO: 3731611 - RNA, 12 nt, Salmonella enterica enterica serovar Typhi Ty2
acauccagcugu

SEQ ID NO: 3731612 - RNA, 17 nt, Salmonella enterica enterica serovar Typhi Ty2
acauccaucacuccuua

SEQ ID NO: 3731613 - RNA, 14 nt, Salmonella enterica enterica serovar Typhi Ty2
acaucccgaauacg

SEQ ID NO: 3731614 - RNA, 21 nt, Salmonella enterica enterica serovar Typhi Ty2
acauccgauuucauggucauc

SEQ ID NO: 3731615 - RNA, 13 nt, Salmonella enterica enterica serovar Typhi Ty2
acauccucuccug

SEQ ID NO: 3731616 - RNA, 15 nt, Salmonella enterica enterica serovar Typhi Ty2
acauccucuccugaa

SEQ ID NO: 3731617 - RNA, 15 nt, Salmonella enterica enterica serovar Typhi Ty2
accaacguuuuuccu

SEQ ID NO: 3731618 - RNA, 17 nt, Salmonella enterica enterica serovar Typhi Ty2
accaacguuuuuccuug

SEQ ID NO: 3731619 - RNA, 19 nt, Salmonella enterica enterica serovar Typhi Ty2
accaauaaaggucggcugc

SEQ ID NO: 3731620 - RNA, 14 nt, Salmonella enterica enterica serovar Typhi Ty2
accaauaagaacuu

SEQ ID NO: 3731621 - RNA, 16 nt, Salmonella enterica enterica serovar Typhi Ty2
accaauacccagcgcc

SEQ ID NO: 3731622 - RNA, 15 nt, Salmonella enterica enterica serovar Typhi Ty2
accaauaucgccguu

SEQ ID NO: 3731623 - RNA, 18 nt, Salmonella enterica enterica serovar Typhi Ty2
accaauggcgcgucuuaa

SEQ ID NO: 3731624 - RNA, 20 nt, Salmonella enterica enterica serovar Typhi Ty2
accaauguuaauaagcagaa

SEQ ID NO: 3731625 - RNA, 16 nt, Salmonella enterica enterica serovar Typhi Ty2
accaauuccaccaccu

SEQ ID NO: 3731626 - RNA, 17 nt, Salmonella enterica enterica serovar Typhi Ty2
accaauuccaccaccuc

SEQ ID NO: 3731627 - RNA, 14 nt, Salmonella enterica enterica serovar Typhi Ty2
accacaacacacgu

SEQ ID NO: 3731628 - RNA, 22 nt, Salmonella enterica enterica serovar Typhi Ty2
accacaauaaucgcgagaaaau

SEQ ID NO: 3731629 - RNA, 19 nt, Salmonella enterica enterica serovar Typhi Ty2
accacacgcuuauccugcc

SEQ ID NO: 3731630 - RNA, 22 nt, Salmonella enterica enterica serovar Typhi Ty2
accacagccuuauaagaaccau

SEQ ID NO: 3731631 - RNA, 17 nt, Salmonella enterica enterica serovar Typhi Ty2
accacaggcggaaaaca

SEQ ID NO: 3731632 - RNA, 14 nt, Salmonella enterica enterica serovar Typhi Ty2
accacagucaucgc

SEQ ID NO: 3731633 - RNA, 21 nt, Salmonella enterica enterica serovar Typhi Ty2
accacagugacccgccgccag

SEQ ID NO: 3731634 - RNA, 20 nt, Salmonella enterica enterica serovar Typhi Ty2
accacaucagaccgccaagc

SEQ ID NO: 3731635 - RNA, 14 nt, Salmonella enterica enterica serovar Typhi Ty2
accaccaggaacgc

SEQ ID NO: 3731636 - RNA, 16 nt, Salmonella enterica enterica serovar Typhi Ty2
accaccaguaaccgcc

SEQ ID NO: 3731637 - RNA, 18 nt, Salmonella enterica enterica serovar Typhi Ty2
accaccaguacauggcuc

SEQ ID NO: 3731638 - RNA, 12 nt, Salmonella enterica enterica serovar Typhi Ty2
accacccagcca

SEQ ID NO: 3731639 - RNA, 13 nt, Salmonella enterica enterica serovar Typhi Ty2
accacccagccag

SEQ ID NO: 3731640 - RNA, 20 nt, Salmonella enterica enterica serovar Typhi Ty2
accacccagccagacgccag

SEQ ID NO: 3731641 - RNA, 15 nt, Salmonella enterica enterica serovar Typhi Ty2
accaccgcccugucc

SEQ ID NO: 3731642 - RNA, 20 nt, Salmonella enterica enterica serovar Typhi Ty2
accaccggcgcgccagcgca

SEQ ID NO: 3731643 - RNA, 13 nt, Salmonella enterica enterica serovar Typhi Ty2
accaccguccgag

SEQ ID NO: 3731644 - RNA, 13 nt, Salmonella enterica enterica serovar Typhi Ty2
accaccucuuucg

SEQ ID NO: 3731645 - RNA, 13 nt, Salmonella enterica enterica serovar Typhi Ty2
accacgaaaauua

SEQ ID NO: 3731646 - RNA, 15 nt, Salmonella enterica enterica serovar Typhi Ty2
accacgaaucaggau

SEQ ID NO: 3731647 - RNA, 14 nt, Salmonella enterica enterica serovar Typhi Ty2
accacgaucuuguc

SEQ ID NO: 3731648 - RNA, 15 nt, Salmonella enterica enterica serovar Typhi Ty2
accacgcacaugggc

SEQ ID NO: 3731649 - RNA, 13 nt, Salmonella enterica enterica serovar Typhi Ty2
accacgcagccau

SEQ ID NO: 3731650 - RNA, 15 nt, Salmonella enterica enterica serovar Typhi Ty2
accacgccaccgccg

SEQ ID NO: 3731651 - RNA, 22 nt, Salmonella enterica enterica serovar Typhi Ty2
accacgccaucaacagcggaga

SEQ ID NO: 3731652 - RNA, 19 nt, Salmonella enterica enterica serovar Typhi Ty2
accacggaaugaauguuag

SEQ ID NO: 3731653 - RNA, 20 nt, Salmonella enterica enterica serovar Typhi Ty2
accacggagagacaguucag

SEQ ID NO: 3731654 - RNA, 16 nt, Salmonella enterica enterica serovar Typhi Ty2
accacggauaagccag

SEQ ID NO: 3731655 - RNA, 18 nt, Salmonella enterica enterica serovar Typhi Ty2
accacggauaagccagcc

SEQ ID NO: 3731656 - RNA, 15 nt, Salmonella enterica enterica serovar Typhi Ty2
accacggcuucagcg

SEQ ID NO: 3731657 - RNA, 15 nt, Salmonella enterica enterica serovar Typhi Ty2
accacgggguuggcc

SEQ ID NO: 3731658 - RNA, 15 nt, Salmonella enterica enterica serovar Typhi Ty2
accacgguagagauu

SEQ ID NO: 3731659 - RNA, 20 nt, Salmonella enterica enterica serovar Typhi Ty2
accacguaacgggauucgcc

SEQ ID NO: 3731660 - RNA, 16 nt, Salmonella enterica enterica serovar Typhi Ty2
accacgucauccggca

SEQ ID NO: 3731661 - RNA, 17 nt, Salmonella enterica enterica serovar Typhi Ty2
accacguuaccgcgcag

SEQ ID NO: 3731662 - RNA, 23 nt, Salmonella enterica enterica serovar Typhi Ty2
accacuccccaacguaauaacca

SEQ ID NO: 3731663 - RNA, 22 nt, Salmonella enterica enterica serovar Typhi Ty2
accacuguccgguuacaaccgu

SEQ ID NO: 3731664 - RNA, 21 nt, Salmonella enterica enterica serovar Typhi Ty2
accacuucaacgccgcgcuuc

SEQ ID NO: 3731665 - RNA, 22 nt, Salmonella enterica enterica serovar Typhi Ty2
accagaaaaccgacagcaauau

SEQ ID NO: 3731666 - RNA, 13 nt, Salmonella enterica enterica serovar Typhi Ty2
accagaaccucac

SEQ ID NO: 3731667 - RNA, 17 nt, Salmonella enterica enterica serovar Typhi Ty2
accagaauaauggggau

SEQ ID NO: 3731668 - RNA, 17 nt, Salmonella enterica enterica serovar Typhi Ty2
accagaaucauuaauaa

SEQ ID NO: 3731669 - RNA, 18 nt, Salmonella enterica enterica serovar Typhi Ty2
accagaaucgccagcauc

SEQ ID NO: 3731670 - RNA, 21 nt, Salmonella enterica enterica serovar Typhi Ty2
accagacacggugugccgcca

SEQ ID NO: 3731671 - RNA, 16 nt, Salmonella enterica enterica serovar Typhi Ty2
accagaccgacaagcc

SEQ ID NO: 3731672 - RNA, 14 nt, Salmonella enterica enterica serovar Typhi Ty2
accagaccggcauc

SEQ ID NO: 3731673 - RNA, 21 nt, Salmonella enterica enterica serovar Typhi Ty2
accagacgcgaacguuugacc

SEQ ID NO: 3731674 - RNA, 22 nt, Salmonella enterica enterica serovar Typhi Ty2
accagacgcuggcacuggcagc

SEQ ID NO: 3731675 - RNA, 15 nt, Salmonella enterica enterica serovar Typhi Ty2
accagacuaaaacgu

SEQ ID NO: 3731676 - RNA, 18 nt, Salmonella enterica enterica serovar Typhi Ty2
accagacucaccccuucu

SEQ ID NO: 3731677 - RNA, 23 nt, Salmonella enterica enterica serovar Typhi Ty2
accagacugaugaugaagaacag

SEQ ID NO: 3731678 - RNA, 16 nt, Salmonella enterica enterica serovar Typhi Ty2
accagagacauugccu

SEQ ID NO: 3731679 - RNA, 18 nt, Salmonella enterica enterica serovar Typhi Ty2
accagaucaacauggugu

SEQ ID NO: 3731680 - RNA, 20 nt, Salmonella enterica enterica serovar Typhi Ty2
accagaucaacaugguguuu

SEQ ID NO: 3731681 - RNA, 22 nt, Salmonella enterica enterica serovar Typhi Ty2
accagaucuucaaucgugacca

SEQ ID NO: 3731682 - RNA, 21 nt, Salmonella enterica enterica serovar Typhi Ty2
accagauguacagaaugguau

SEQ ID NO: 3731683 - RNA, 20 nt, Salmonella enterica enterica serovar Typhi Ty2
accagcaaugauaacggcgc

SEQ ID NO: 3731684 - RNA, 22 nt, Salmonella enterica enterica serovar Typhi Ty2
accagcaaugauaacggcgcca

SEQ ID NO: 3731685 - RNA, 22 nt, Salmonella enterica enterica serovar Typhi Ty2
accagcaauuggccaucuucgu

SEQ ID NO: 3731686 - RNA, 11 nt, Salmonella enterica enterica serovar Typhi Ty2
accagcagcau

SEQ ID NO: 3731687 - RNA, 13 nt, Salmonella enterica enterica serovar Typhi Ty2
accagcagcgcca

SEQ ID NO: 3731688 - RNA, 14 nt, Salmonella enterica enterica serovar Typhi Ty2
accagcagcgccag

SEQ ID NO: 3731689 - RNA, 21 nt, Salmonella enterica enterica serovar Typhi Ty2
accagcagcgccagcgaagua

SEQ ID NO: 3731690 - RNA, 15 nt, Salmonella enterica enterica serovar Typhi Ty2
accagcagcgggcug

SEQ ID NO: 3731691 - RNA, 17 nt, Salmonella enterica enterica serovar Typhi Ty2
accagcagcgggcuguc

SEQ ID NO: 3731692 - RNA, 23 nt, Salmonella enterica enterica serovar Typhi Ty2
accagcaggugcggauaguccug

SEQ ID NO: 3731693 - RNA, 22 nt, Salmonella enterica enterica serovar Typhi Ty2
accagcaguguaucguugucgc

SEQ ID NO: 3731694 - RNA, 12 nt, Salmonella enterica enterica serovar Typhi Ty2
accagcauaaug

SEQ ID NO: 3731695 - RNA, 23 nt, Salmonella enterica enterica serovar Typhi Ty2
accagcaucccacgaaugccgau

SEQ ID NO: 3731696 - RNA, 18 nt, Salmonella enterica enterica serovar Typhi Ty2
accagccaggaaccgccg

SEQ ID NO: 3731697 - RNA, 21 nt, Salmonella enterica enterica serovar Typhi Ty2
accagcccaucuuucgccagc

SEQ ID NO: 3731698 - RNA, 12 nt, Salmonella enterica enterica serovar Typhi Ty2
accagcccauga

SEQ ID NO: 3731699 - RNA, 17 nt, Salmonella enterica enterica serovar Typhi Ty2
accaugauaucgccaau

SEQ ID NO: 3731700 - RNA, 22 nt, Salmonella enterica enterica serovar Typhi Ty2
accaugauccguucgaucagcu

SEQ ID NO: 3731701 - RNA, 16 nt, Salmonella enterica enterica serovar Typhi Ty2
accaugccacaacaga

SEQ ID NO: 3731702 - RNA, 19 nt, Salmonella enterica enterica serovar Typhi Ty2
accaugguucccgccacug

SEQ ID NO: 3731703 - RNA, 13 nt, Salmonella enterica enterica serovar Typhi Ty2
accauuaacgcca

SEQ ID NO: 3731704 - RNA, 22 nt, Salmonella enterica enterica serovar Typhi Ty2
accauuaacuccggacguaccc

SEQ ID NO: 3731705 - RNA, 15 nt, Salmonella enterica enterica serovar Typhi Ty2
accauuaccauuccu

SEQ ID NO: 3731706 - RNA, 20 nt, Salmonella enterica enterica serovar Typhi Ty2
accauuaccgcuaacaucgc

SEQ ID NO: 3731707 - RNA, 13 nt, Salmonella enterica enterica serovar Typhi Ty2
accauuccagguc

SEQ ID NO: 3731708 - RNA, 21 nt, Salmonella enterica enterica serovar Typhi Ty2
accauucccacgcauaguccu

SEQ ID NO: 3731709 - RNA, 18 nt, Salmonella enterica enterica serovar Typhi Ty2
accauucccguaaaagaa

SEQ ID NO: 3731710 - RNA, 18 nt, Salmonella enterica enterica serovar Typhi Ty2
accauuccgauagcgaaa

SEQ ID NO: 3731711 - RNA, 22 nt, Salmonella enterica enterica serovar Typhi Ty2
accauucugggaggugaaggau

SEQ ID NO: 3731712 - RNA, 22 nt, Salmonella enterica enterica serovar Typhi Ty2
accauucuucaacaaucguuaa

SEQ ID NO: 3731713 - RNA, 14 nt, Salmonella enterica enterica serovar Typhi Ty2
accauugauaccaa

SEQ ID NO: 3731714 - RNA, 17 nt, Salmonella enterica enterica serovar Typhi Ty2
accauugcguauuucac

SEQ ID NO: 3731715 - RNA, 18 nt, Salmonella enterica enterica serovar Typhi Ty2
accauugcguauuucacc

SEQ ID NO: 3731716 - RNA, 17 nt, Salmonella enterica enterica serovar Typhi Ty2
accauuggcaccaccag

SEQ ID NO: 3731717 - RNA, 22 nt, Salmonella enterica enterica serovar Typhi Ty2
accauuuauuuaggugcuugag

SEQ ID NO: 3731718 - RNA, 14 nt, Salmonella enterica enterica serovar Typhi Ty2
accauuuccucugc

SEQ ID NO: 3731719 - RNA, 16 nt, Salmonella enterica enterica serovar Typhi Ty2
acccaaauaucaaaua

SEQ ID NO: 3731720 - RNA, 15 nt, Salmonella enterica enterica serovar Typhi Ty2
acccaacaccagacu

SEQ ID NO: 3731721 - RNA, 15 nt, Salmonella enterica enterica serovar Typhi Ty2
acccaacgcaaugcg

SEQ ID NO: 3731722 - RNA, 14 nt, Salmonella enterica enterica serovar Typhi Ty2
acccaacguuauaa

SEQ ID NO: 3731723 - RNA, 15 nt, Salmonella enterica enterica serovar Typhi Ty2
acccaaugauccgga

SEQ ID NO: 3731724 - RNA, 16 nt, Salmonella enterica enterica serovar Typhi Ty2
acccaauugaauuuaa

SEQ ID NO: 3731725 - RNA, 17 nt, Salmonella enterica enterica serovar Typhi Ty2
acccacaacgcgccaac

SEQ ID NO: 3731726 - RNA, 12 nt, Salmonella enterica enterica serovar Typhi Ty2
acccacaagaaa

SEQ ID NO: 3731727 - RNA, 17 nt, Salmonella enterica enterica serovar Typhi Ty2
acccacaccacagccac

SEQ ID NO: 3731728 - RNA, 15 nt, Salmonella enterica enterica serovar Typhi Ty2
acccaccaacuuuuc

SEQ ID NO: 3731729 - RNA, 14 nt, Salmonella enterica enterica serovar Typhi Ty2
acccaccagcgcca

SEQ ID NO: 3731730 - RNA, 16 nt, Salmonella enterica enterica serovar Typhi Ty2
acccaccauaaaacca

SEQ ID NO: 3731731 - RNA, 17 nt, Salmonella enterica enterica serovar Typhi Ty2
acccaccucguucaaac

SEQ ID NO: 3731732 - RNA, 15 nt, Salmonella enterica enterica serovar Typhi Ty2
acccacgccagcagc

SEQ ID NO: 3731733 - RNA, 16 nt, Salmonella enterica enterica serovar Typhi Ty2
acccacgccggaaauc

SEQ ID NO: 3731734 - RNA, 15 nt, Salmonella enterica enterica serovar Typhi Ty2
acccacuucuuccag

SEQ ID NO: 3731735 - RNA, 13 nt, Salmonella enterica enterica serovar Typhi Ty2
acccagacggcga

SEQ ID NO: 3731736 - RNA, 16 nt, Salmonella enterica enterica serovar Typhi Ty2
acccagauuaugggua

SEQ ID NO: 3731737 - RNA, 13 nt, Salmonella enterica enterica serovar Typhi Ty2
acccagcagcaga

SEQ ID NO: 3731738 - RNA, 20 nt, Salmonella enterica enterica serovar Typhi Ty2
acccagccacaugauguugu

SEQ ID NO: 3731739 - RNA, 16 nt, Salmonella enterica enterica serovar Typhi Ty2
acccagcgaauuauga

SEQ ID NO: 3731740 - RNA, 18 nt, Salmonella enterica enterica serovar Typhi Ty2
acccagcgccaacgccac

SEQ ID NO: 3731741 - RNA, 19 nt, Salmonella enterica enterica serovar Typhi Ty2
acccagcgcgaauuugccc

SEQ ID NO: 3731742 - RNA, 17 nt, Salmonella enterica enterica serovar Typhi Ty2
acccagucgcagccacc

SEQ ID NO: 3731743 - RNA, 14 nt, Salmonella enterica enterica serovar Typhi Ty2
acccagugccacca

SEQ ID NO: 3731744 - RNA, 18 nt, Salmonella enterica enterica serovar Typhi Ty2
acccaguuuuaagcgcag

SEQ ID NO: 3731745 - RNA, 19 nt, Salmonella enterica enterica serovar Typhi Ty2
acccauaacgggaagccgu

SEQ ID NO: 3731746 - RNA, 19 nt, Salmonella enterica enterica serovar Typhi Ty2
acccauacucuuucccggc

SEQ ID NO: 3731747 - RNA, 18 nt, Salmonella enterica enterica serovar Typhi Ty2
acccauauucgucuucau

SEQ ID NO: 3731748 - RNA, 21 nt, Salmonella enterica enterica serovar Typhi Ty2
acccauauucgucuucaucuu

SEQ ID NO: 3731749 - RNA, 12 nt, Salmonella enterica enterica serovar Typhi Ty2
acccaucaauaa

SEQ ID NO: 3731750 - RNA, 14 nt, Salmonella enterica enterica serovar Typhi Ty2
acccaucaauaacg

SEQ ID NO: 3731751 - RNA, 13 nt, Salmonella enterica enterica serovar Typhi Ty2
acccauccccaua

SEQ ID NO: 3731752 - RNA, 19 nt, Salmonella enterica enterica serovar Typhi Ty2
acccaugccgcgacgaagu

SEQ ID NO: 3731753 - RNA, 19 nt, Salmonella enterica enterica serovar Typhi Ty2
acccauuaccuggcaacau

SEQ ID NO: 3731754 - RNA, 17 nt, Salmonella enterica enterica serovar Typhi Ty2
acccauuuuauccucuu

SEQ ID NO: 3731755 - RNA, 18 nt, Salmonella enterica enterica serovar Typhi Ty2
accccaggcauagaaaaa

SEQ ID NO: 3731756 - RNA, 19 nt, Salmonella enterica enterica serovar Typhi Ty2
accccaggcgauaccgcgc

SEQ ID NO: 3731757 - RNA, 22 nt, Salmonella enterica enterica serovar Typhi Ty2
accccaggcgauaccgcgcugg

SEQ ID NO: 3731758 - RNA, 18 nt, Salmonella enterica enterica serovar Typhi Ty2
accccagggagacggcca

SEQ ID NO: 3731759 - RNA, 22 nt, Salmonella enterica enterica serovar Typhi Ty2
accccagggagacggccaccca

SEQ ID NO: 3731760 - RNA, 16 nt, Salmonella enterica enterica serovar Typhi Ty2
accccaggucagcagu

SEQ ID NO: 3731761 - RNA, 15 nt, Salmonella enterica enterica serovar Typhi Ty2
accccaguagcccug

SEQ ID NO: 3731762 - RNA, 20 nt, Salmonella enterica enterica serovar Typhi Ty2
accccaguagcccugacgaa

SEQ ID NO: 3731763 - RNA, 15 nt, Salmonella enterica enterica serovar Typhi Ty2
accccaucccggcaa

SEQ ID NO: 3731764 - RNA, 13 nt, Salmonella enterica enterica serovar Typhi Ty2
accccauggcguc

SEQ ID NO: 3731765 - RNA, 18 nt, Salmonella enterica enterica serovar Typhi Ty2
acccccaccucaaucacc

SEQ ID NO: 3731766 - RNA, 17 nt, Salmonella enterica enterica serovar Typhi Ty2
acccccagcacauuaca

SEQ ID NO: 3731767 - RNA, 13 nt, Salmonella enterica enterica serovar Typhi Ty2
acccccuggccgg

SEQ ID NO: 3731768 - RNA, 18 nt, Salmonella enterica enterica serovar Typhi Ty2
accccgcaucgcccgcuc

SEQ ID NO: 3731769 - RNA, 16 nt, Salmonella enterica enterica serovar Typhi Ty2
accccgccaccgccgc

SEQ ID NO: 3731770 - RNA, 23 nt, Salmonella enterica enterica serovar Typhi Ty2
accccgccagcagguuaaacaga

SEQ ID NO: 3731771 - RNA, 14 nt, Salmonella enterica enterica serovar Typhi Ty2
accccggccucgcc

SEQ ID NO: 3731772 - RNA, 17 nt, Salmonella enterica enterica serovar Typhi Ty2
accccggcgcggcgcgc

SEQ ID NO: 3731773 - RNA, 19 nt, Salmonella enterica enterica serovar Typhi Ty2
accccggucacaucguuau

SEQ ID NO: 3731774 - RNA, 13 nt, Salmonella enterica enterica serovar Typhi Ty2
accccugcggcug

SEQ ID NO: 3731775 - RNA, 18 nt, Salmonella enterica enterica serovar Typhi Ty2
accccuguucaaaauagc

SEQ ID NO: 3731776 - RNA, 14 nt, Salmonella enterica enterica serovar Typhi Ty2
acccgacacggcuc

SEQ ID NO: 3731777 - RNA, 21 nt, Salmonella enterica enterica serovar Typhi Ty2
acccgaccauuuuugacacag

SEQ ID NO: 3731778 - RNA, 16 nt, Salmonella enterica enterica serovar Typhi Ty2
acccgauaaaaucauc

SEQ ID NO: 3731779 - RNA, 15 nt, Salmonella enterica enterica serovar Typhi Ty2
acccgauaccgccag

SEQ ID NO: 3731780 - RNA, 20 nt, Salmonella enterica enterica serovar Typhi Ty2
acccgaucgccauccugcac

SEQ ID NO: 3731781 - RNA, 16 nt, Salmonella enterica enterica serovar Typhi Ty2
accgccaucaaacgca

SEQ ID NO: 3731782 - RNA, 19 nt, Salmonella enterica enterica serovar Typhi Ty2
accgccauccggcgauguc

SEQ ID NO: 3731783 - RNA, 17 nt, Salmonella enterica enterica serovar Typhi Ty2
accgccaugcggcgcca

SEQ ID NO: 3731784 - RNA, 20 nt, Salmonella enterica enterica serovar Typhi Ty2
accgcccagagaauauuggc

SEQ ID NO: 3731785 - RNA, 18 nt, Salmonella enterica enterica serovar Typhi Ty2
accgcccaucaacaccag

SEQ ID NO: 3731786 - RNA, 18 nt, Salmonella enterica enterica serovar Typhi Ty2
accgcccaucgccugauu

SEQ ID NO: 3731787 - RNA, 19 nt, Salmonella enterica enterica serovar Typhi Ty2
accgcccauggaugcgccg

SEQ ID NO: 3731788 - RNA, 21 nt, Salmonella enterica enterica serovar Typhi Ty2
accgccgagcauuuccgcagc

SEQ ID NO: 3731789 - RNA, 14 nt, Salmonella enterica enterica serovar Typhi Ty2
accgccgaugcuga

SEQ ID NO: 3731790 - RNA, 22 nt, Salmonella enterica enterica serovar Typhi Ty2
accgccgcgauagaccacgcca

SEQ ID NO: 3731791 - RNA, 14 nt, Salmonella enterica enterica serovar Typhi Ty2
accgccgcgcguca

SEQ ID NO: 3731792 - RNA, 13 nt, Salmonella enterica enterica serovar Typhi Ty2
accgccgcugcaa

SEQ ID NO: 3731793 - RNA, 22 nt, Salmonella enterica enterica serovar Typhi Ty2
accgccgcuuuucagggguccc

SEQ ID NO: 3731794 - RNA, 22 nt, Salmonella enterica enterica serovar Typhi Ty2
accgccuaacagcgccgcgccg

SEQ ID NO: 3731795 - RNA, 13 nt, Salmonella enterica enterica serovar Typhi Ty2
accgccuccaggc

SEQ ID NO: 3731796 - RNA, 14 nt, Salmonella enterica enterica serovar Typhi Ty2
accgccuccaggcc

SEQ ID NO: 3731797 - RNA, 15 nt, Salmonella enterica enterica serovar Typhi Ty2
accgccugcgcugau

SEQ ID NO: 3731798 - RNA, 16 nt, Salmonella enterica enterica serovar Typhi Ty2
accgccugcguuugcg

SEQ ID NO: 3731799 - RNA, 17 nt, Salmonella enterica enterica serovar Typhi Ty2
accgccuguuuaaugau

SEQ ID NO: 3731800 - RNA, 18 nt, Salmonella enterica enterica serovar Typhi Ty2
accgccuuauccggccua

SEQ ID NO: 3731801 - RNA, 21 nt, Salmonella enterica enterica serovar Typhi Ty2
accgccuuauccggccuacaa

SEQ ID NO: 3731802 - RNA, 18 nt, Salmonella enterica enterica serovar Typhi Ty2
accgccuucagcgcgccc

SEQ ID NO: 3731803 - RNA, 21 nt, Salmonella enterica enterica serovar Typhi Ty2
accgcgaucgaugugauaaau

SEQ ID NO: 3731804 - RNA, 16 nt, Salmonella enterica enterica serovar Typhi Ty2
accgcgaugaccauca

SEQ ID NO: 3731805 - RNA, 20 nt, Salmonella enterica enterica serovar Typhi Ty2
accgcgaugaccaucaaaua

SEQ ID NO: 3731806 - RNA, 22 nt, Salmonella enterica enterica serovar Typhi Ty2
accgcgccacggccaacgcgcc

SEQ ID NO: 3731807 - RNA, 13 nt, Salmonella enterica enterica serovar Typhi Ty2
accgcgcccgguu

SEQ ID NO: 3731808 - RNA, 19 nt, Salmonella enterica enterica serovar Typhi Ty2
accgcgcggcguucugcgc

SEQ ID NO: 3731809 - RNA, 15 nt, Salmonella enterica enterica serovar Typhi Ty2
accgcgcuccaucgc

SEQ ID NO: 3731810 - RNA, 15 nt, Salmonella enterica enterica serovar Typhi Ty2
accgcgcuccuggaa

SEQ ID NO: 3731811 - RNA, 17 nt, Salmonella enterica enterica serovar Typhi Ty2
accgcguuugcgucguu

SEQ ID NO: 3731812 - RNA, 16 nt, Salmonella enterica enterica serovar Typhi Ty2
accgcuaaaaaacagg

SEQ ID NO: 3731813 - RNA, 16 nt, Salmonella enterica enterica serovar Typhi Ty2
accgcuaaugaggaaa

SEQ ID NO: 3731814 - RNA, 23 nt, Salmonella enterica enterica serovar Typhi Ty2
accgcuaucauaccuacaccaac

SEQ ID NO: 3731815 - RNA, 18 nt, Salmonella enterica enterica serovar Typhi Ty2
accgcuauucaccagcgu

SEQ ID NO: 3731816 - RNA, 19 nt, Salmonella enterica enterica serovar Typhi Ty2
accgcucuccgcaauuaau

SEQ ID NO: 3731817 - RNA, 14 nt, Salmonella enterica enterica serovar Typhi Ty2
accgcugacugaac

SEQ ID NO: 3731818 - RNA, 14 nt, Salmonella enterica enterica serovar Typhi Ty2
accgcugcgauaau

SEQ ID NO: 3731819 - RNA, 13 nt, Salmonella enterica enterica serovar Typhi Ty2
accgcugcgcuca

SEQ ID NO: 3731820 - RNA, 19 nt, Salmonella enterica enterica serovar Typhi Ty2
accgcuucccacagucggc

SEQ ID NO: 3731821 - RNA, 17 nt, Salmonella enterica enterica serovar Typhi Ty2
accgcuucgccuucgcc

SEQ ID NO: 3731822 - RNA, 17 nt, Salmonella enterica enterica serovar Typhi Ty2
accgcuuuaugcgcuuc

SEQ ID NO: 3731823 - RNA, 16 nt, Salmonella enterica enterica serovar Typhi Ty2
accgcuuucccggcau

SEQ ID NO: 3731824 - RNA, 22 nt, Salmonella enterica enterica serovar Typhi Ty2
accgcuuugccgcgcucuuuaa

SEQ ID NO: 3731825 - RNA, 23 nt, Salmonella enterica enterica serovar Typhi Ty2
accggaaauggucgcuccggaac

SEQ ID NO: 3731826 - RNA, 20 nt, Salmonella enterica enterica serovar Typhi Ty2
accggaccuaauagccagcc

SEQ ID NO: 3731827 - RNA, 17 nt, Salmonella enterica enterica serovar Typhi Ty2
accggacggucggcgua

SEQ ID NO: 3731828 - RNA, 15 nt, Salmonella enterica enterica serovar Typhi Ty2
accggacuccaggca

SEQ ID NO: 3731829 - RNA, 14 nt, Salmonella enterica enterica serovar Typhi Ty2
accggacugcucgc

SEQ ID NO: 3731830 - RNA, 16 nt, Salmonella enterica enterica serovar Typhi Ty2
accggaggagugcgcc

SEQ ID NO: 3731831 - RNA, 17 nt, Salmonella enterica enterica serovar Typhi Ty2
accggauauggcaaaaa

SEQ ID NO: 3731832 - RNA, 18 nt, Salmonella enterica enterica serovar Typhi Ty2
accggaucaauaaacagc

SEQ ID NO: 3731833 - RNA, 20 nt, Salmonella enterica enterica serovar Typhi Ty2
accggaucaauaugccagau

SEQ ID NO: 3731834 - RNA, 16 nt, Salmonella enterica enterica serovar Typhi Ty2
accggaugauggccug

SEQ ID NO: 3731835 - RNA, 16 nt, Salmonella enterica enterica serovar Typhi Ty2
accggauggaucaucg

SEQ ID NO: 3731836 - RNA, 23 nt, Salmonella enterica enterica serovar Typhi Ty2
accggaugggcagauagaaugcu

SEQ ID NO: 3731837 - RNA, 15 nt, Salmonella enterica enterica serovar Typhi Ty2
accggaugugccaau

SEQ ID NO: 3731838 - RNA, 21 nt, Salmonella enterica enterica serovar Typhi Ty2
accggauuugacguuauccag

SEQ ID NO: 3731839 - RNA, 16 nt, Salmonella enterica enterica serovar Typhi Ty2
accggcaaccgguacu

SEQ ID NO: 3731840 - RNA, 21 nt, Salmonella enterica enterica serovar Typhi Ty2
accggcacgguuaaugaaauc

SEQ ID NO: 3731841 - RNA, 14 nt, Salmonella enterica enterica serovar Typhi Ty2
accggcagccugcc

SEQ ID NO: 3731842 - RNA, 18 nt, Salmonella enterica enterica serovar Typhi Ty2
accggcagccugccgcau

SEQ ID NO: 3731843 - RNA, 15 nt, Salmonella enterica enterica serovar Typhi Ty2
accggcagcgucagc

SEQ ID NO: 3731844 - RNA, 14 nt, Salmonella enterica enterica serovar Typhi Ty2
accggcaucggcag

SEQ ID NO: 3731845 - RNA, 12 nt, Salmonella enterica enterica serovar Typhi Ty2
accggccacaau

SEQ ID NO: 3731846 - RNA, 17 nt, Salmonella enterica enterica serovar Typhi Ty2
accggccagcgucauca

SEQ ID NO: 3731847 - RNA, 15 nt, Salmonella enterica enterica serovar Typhi Ty2
accggcccacgcagu

SEQ ID NO: 3731848 - RNA, 19 nt, Salmonella enterica enterica serovar Typhi Ty2
accggccccaauuugcugu

SEQ ID NO: 3731849 - RNA, 23 nt, Salmonella enterica enterica serovar Typhi Ty2
accggcccgggcacgauggccug

SEQ ID NO: 3731850 - RNA, 13 nt, Salmonella enterica enterica serovar Typhi Ty2
accggccgccauc

SEQ ID NO: 3731851 - RNA, 19 nt, Salmonella enterica enterica serovar Typhi Ty2
accggccgccaucgcaauc

SEQ ID NO: 3731852 - RNA, 14 nt, Salmonella enterica enterica serovar Typhi Ty2
accggccugccuau

SEQ ID NO: 3731853 - RNA, 21 nt, Salmonella enterica enterica serovar Typhi Ty2
accggcgaacguuggcugggu

SEQ ID NO: 3731854 - RNA, 12 nt, Salmonella enterica enterica serovar Typhi Ty2
accggcgcgccu

SEQ ID NO: 3731855 - RNA, 20 nt, Salmonella enterica enterica serovar Typhi Ty2
accggcgcgccuuccagcaa

SEQ ID NO: 3731856 - RNA, 15 nt, Salmonella enterica enterica serovar Typhi Ty2
accggcggaauagcu

SEQ ID NO: 3731857 - RNA, 22 nt, Salmonella enterica enterica serovar Typhi Ty2
accggcgguugagauuggcccg

SEQ ID NO: 3731858 - RNA, 17 nt, Salmonella enterica enterica serovar Typhi Ty2
accggcguaauugcgcc

SEQ ID NO: 3731859 - RNA, 19 nt, Salmonella enterica enterica serovar Typhi Ty2
accggcguaauugcgccug

SEQ ID NO: 3731860 - RNA, 20 nt, Salmonella enterica enterica serovar Typhi Ty2
accgggagaaaacgcggccu

SEQ ID NO: 3731861 - RNA, 16 nt, Salmonella enterica enterica serovar Typhi Ty2
accgggaucgggacau

SEQ ID NO: 3731862 - RNA, 14 nt, Salmonella enterica enterica serovar Typhi Ty2
accgggcaaacauu

SEQ ID NO: 3731863 - RNA, 22 nt, Salmonella enterica enterica serovar Typhi Ty2
accuccacgcccagcgccgaga

SEQ ID NO: 3731864 - RNA, 13 nt, Salmonella enterica enterica serovar Typhi Ty2
accuccagcgccu

SEQ ID NO: 3731865 - RNA, 19 nt, Salmonella enterica enterica serovar Typhi Ty2
accucccgccggggcuccc

SEQ ID NO: 3731866 - RNA, 14 nt, Salmonella enterica enterica serovar Typhi Ty2
accuccgcccggug

SEQ ID NO: 3731867 - RNA, 22 nt, Salmonella enterica enterica serovar Typhi Ty2
accuccgcccggugcucaauaa

SEQ ID NO: 3731868 - RNA, 18 nt, Salmonella enterica enterica serovar Typhi Ty2
accuccggcuaugccgga

SEQ ID NO: 3731869 - RNA, 11 nt, Salmonella enterica enterica serovar Typhi Ty2
accuccgggug

SEQ ID NO: 3731870 - RNA, 13 nt, Salmonella enterica enterica serovar Typhi Ty2
accuccugcaucg

SEQ ID NO: 3731871 - RNA, 15 nt, Salmonella enterica enterica serovar Typhi Ty2
accuccugcaucgac

SEQ ID NO: 3731872 - RNA, 20 nt, Salmonella enterica enterica serovar Typhi Ty2
accucgaaaagcgucuucuu

SEQ ID NO: 3731873 - RNA, 16 nt, Salmonella enterica enterica serovar Typhi Ty2
accucgcaauauucau

SEQ ID NO: 3731874 - RNA, 22 nt, Salmonella enterica enterica serovar Typhi Ty2
accucggguaaagguuugcugc

SEQ ID NO: 3731875 - RNA, 20 nt, Salmonella enterica enterica serovar Typhi Ty2
accucgguauguccugccgc

SEQ ID NO: 3731876 - RNA, 22 nt, Salmonella enterica enterica serovar Typhi Ty2
accucgguauguccugccgcaa

SEQ ID NO: 3731877 - RNA, 16 nt, Salmonella enterica enterica serovar Typhi Ty2
accucguccagauggg

SEQ ID NO: 3731878 - RNA, 13 nt, Salmonella enterica enterica serovar Typhi Ty2
accucguucggcg

SEQ ID NO: 3731879 - RNA, 18 nt, Salmonella enterica enterica serovar Typhi Ty2
accucuauaacuugcaaa

SEQ ID NO: 3731880 - RNA, 16 nt, Salmonella enterica enterica serovar Typhi Ty2
accucucaccgccuag

SEQ ID NO: 3731881 - RNA, 13 nt, Salmonella enterica enterica serovar Typhi Ty2
accucugcaaaca

SEQ ID NO: 3731882 - RNA, 15 nt, Salmonella enterica enterica serovar Typhi Ty2
accucuuccccgguc

SEQ ID NO: 3731883 - RNA, 18 nt, Salmonella enterica enterica serovar Typhi Ty2
accucuucguucauccgu

SEQ ID NO: 3731884 - RNA, 13 nt, Salmonella enterica enterica serovar Typhi Ty2
accucuuuuuccg

SEQ ID NO: 3731885 - RNA, 14 nt, Salmonella enterica enterica serovar Typhi Ty2
accugaaaucagcc

SEQ ID NO: 3731886 - RNA, 17 nt, Salmonella enterica enterica serovar Typhi Ty2
accugaagccauccuca

SEQ ID NO: 3731887 - RNA, 22 nt, Salmonella enterica enterica serovar Typhi Ty2
accugaagcccuuuagugaauu

SEQ ID NO: 3731888 - RNA, 13 nt, Salmonella enterica enterica serovar Typhi Ty2
accugaaugcaaa

SEQ ID NO: 3731889 - RNA, 16 nt, Salmonella enterica enterica serovar Typhi Ty2
accugaaugcaaagaa

SEQ ID NO: 3731890 - RNA, 23 nt, Salmonella enterica enterica serovar Typhi Ty2
accugaaugcaaagaagggcagg

SEQ ID NO: 3731891 - RNA, 17 nt, Salmonella enterica enterica serovar Typhi Ty2
accugacuauacccaaa

SEQ ID NO: 3731892 - RNA, 19 nt, Salmonella enterica enterica serovar Typhi Ty2
accugagcgugcaauguca

SEQ ID NO: 3731893 - RNA, 14 nt, Salmonella enterica enterica serovar Typhi Ty2
accugaucgccaac

SEQ ID NO: 3731894 - RNA, 21 nt, Salmonella enterica enterica serovar Typhi Ty2
accugauguagcucuucaucu

SEQ ID NO: 3731895 - RNA, 16 nt, Salmonella enterica enterica serovar Typhi Ty2
accugauucugcagcg

SEQ ID NO: 3731896 - RNA, 18 nt, Salmonella enterica enterica serovar Typhi Ty2
accugauugauacgcgcc

SEQ ID NO: 3731897 - RNA, 23 nt, Salmonella enterica enterica serovar Typhi Ty2
accugauugauacgcgcccgauc

SEQ ID NO: 3731898 - RNA, 20 nt, Salmonella enterica enterica serovar Typhi Ty2
accugcaaacguagcgcguc

SEQ ID NO: 3731899 - RNA, 22 nt, Salmonella enterica enterica serovar Typhi Ty2
accugcacaucgccauuaaaag

SEQ ID NO: 3731900 - RNA, 21 nt, Salmonella enterica enterica serovar Typhi Ty2
accugcagggugaagauggcg

SEQ ID NO: 3731901 - RNA, 14 nt, Salmonella enterica enterica serovar Typhi Ty2
accugcaucacgcc

SEQ ID NO: 3731902 - RNA, 12 nt, Salmonella enterica enterica serovar Typhi Ty2
accugccaggcu

SEQ ID NO: 3731903 - RNA, 19 nt, Salmonella enterica enterica serovar Typhi Ty2
accugccaguccgcccgcc

SEQ ID NO: 3731904 - RNA, 22 nt, Salmonella enterica enterica serovar Typhi Ty2
accugcccauccuuucucuggu

SEQ ID NO: 3731905 - RNA, 18 nt, Salmonella enterica enterica serovar Typhi Ty2
accugccgaugaaagagc

SEQ ID NO: 3731906 - RNA, 19 nt, Salmonella enterica enterica serovar Typhi Ty2
accugccguuuuccagccg

SEQ ID NO: 3731907 - RNA, 20 nt, Salmonella enterica enterica serovar Typhi Ty2
accugcgcgacggcggcguc

SEQ ID NO: 3731908 - RNA, 22 nt, Salmonella enterica enterica serovar Typhi Ty2
accugcggccaugaucgccgcc

SEQ ID NO: 3731909 - RNA, 20 nt, Salmonella enterica enterica serovar Typhi Ty2
accugcuccagauuacuaug

SEQ ID NO: 3731910 - RNA, 17 nt, Salmonella enterica enterica serovar Typhi Ty2
accugcuggcggcguaa

SEQ ID NO: 3731911 - RNA, 23 nt, Salmonella enterica enterica serovar Typhi Ty2
accugcuggcggcguaagcgggu

SEQ ID NO: 3731912 - RNA, 19 nt, Salmonella enterica enterica serovar Typhi Ty2
accuggaugcugccugccu

SEQ ID NO: 3731913 - RNA, 23 nt, Salmonella enterica enterica serovar Typhi Ty2
accuggauuccuccaauucaggu

SEQ ID NO: 3731914 - RNA, 18 nt, Salmonella enterica enterica serovar Typhi Ty2
accuggcccugcaucagc

SEQ ID NO: 3731915 - RNA, 21 nt, Salmonella enterica enterica serovar Typhi Ty2
accuggcccugcaucagcucg

SEQ ID NO: 3731916 - RNA, 23 nt, Salmonella enterica enterica serovar Typhi Ty2
accuggcgggcagccuucaaguu

SEQ ID NO: 3731917 - RNA, 17 nt, Salmonella enterica enterica serovar Typhi Ty2
accugggaaucgugcaa

SEQ ID NO: 3731918 - RNA, 21 nt, Salmonella enterica enterica serovar Typhi Ty2
accuggguagcuucugucugc

SEQ ID NO: 3731919 - RNA, 19 nt, Salmonella enterica enterica serovar Typhi Ty2
accugguacaccagacgau

SEQ ID NO: 3731920 - RNA, 17 nt, Salmonella enterica enterica serovar Typhi Ty2
accuguaaccuuaaaag

SEQ ID NO: 3731921 - RNA, 16 nt, Salmonella enterica enterica serovar Typhi Ty2
accuguaucaaaccaa

SEQ ID NO: 3731922 - RNA, 14 nt, Salmonella enterica enterica serovar Typhi Ty2
accuguauuuucgu

SEQ ID NO: 3731923 - RNA, 22 nt, Salmonella enterica enterica serovar Typhi Ty2
accugucguacgccuaaaugaa

SEQ ID NO: 3731924 - RNA, 16 nt, Salmonella enterica enterica serovar Typhi Ty2
accugucuuugcgccg

SEQ ID NO: 3731925 - RNA, 18 nt, Salmonella enterica enterica serovar Typhi Ty2
accuguucaugccagauu

SEQ ID NO: 3731926 - RNA, 12 nt, Salmonella enterica enterica serovar Typhi Ty2
accuguuuguuu

SEQ ID NO: 3731927 - RNA, 18 nt, Salmonella enterica enterica serovar Typhi Ty2
accuuaagcgcgaaauuu

SEQ ID NO: 3731928 - RNA, 21 nt, Salmonella enterica enterica serovar Typhi Ty2
accuuaauuugugauugcaga

SEQ ID NO: 3731929 - RNA, 17 nt, Salmonella enterica enterica serovar Typhi Ty2
accuuaucgagaauacu

SEQ ID NO: 3731930 - RNA, 17 nt, Salmonella enterica enterica serovar Typhi Ty2
accuuaucgcagucagc

SEQ ID NO: 3731931 - RNA, 20 nt, Salmonella enterica enterica serovar Typhi Ty2
accuucaacccagcagcaga

SEQ ID NO: 3731932 - RNA, 17 nt, Salmonella enterica enterica serovar Typhi Ty2
accuucacccccaucgc

SEQ ID NO: 3731933 - RNA, 18 nt, Salmonella enterica enterica serovar Typhi Ty2
accuucacgccgccaaag

SEQ ID NO: 3731934 - RNA, 14 nt, Salmonella enterica enterica serovar Typhi Ty2
accuucauggcguu

SEQ ID NO: 3731935 - RNA, 11 nt, Salmonella enterica enterica serovar Typhi Ty2
accuucgcguu

SEQ ID NO: 3731936 - RNA, 19 nt, Salmonella enterica enterica serovar Typhi Ty2
accuucggucccaucgcgc

SEQ ID NO: 3731937 - RNA, 13 nt, Salmonella enterica enterica serovar Typhi Ty2
accuucugugaaa

SEQ ID NO: 3731938 - RNA, 14 nt, Salmonella enterica enterica serovar Typhi Ty2
accuucuucacuaa

SEQ ID NO: 3731939 - RNA, 14 nt, Salmonella enterica enterica serovar Typhi Ty2
accuucuucgccaa

SEQ ID NO: 3731940 - RNA, 19 nt, Salmonella enterica enterica serovar Typhi Ty2
accuucuugcucaaaaagc

SEQ ID NO: 3731941 - RNA, 15 nt, Salmonella enterica enterica serovar Typhi Ty2
accuucuuuuggaaa

SEQ ID NO: 3731942 - RNA, 18 nt, Salmonella enterica enterica serovar Typhi Ty2
accuugauucccuuuugc

SEQ ID NO: 3731943 - RNA, 16 nt, Salmonella enterica enterica serovar Typhi Ty2
accuugcgccucuggu

SEQ ID NO: 3731944 - RNA, 13 nt, Salmonella enterica enterica serovar Typhi Ty2
accuuucuucucu

SEQ ID NO: 3731945 - RNA, 19 nt, Salmonella enterica enterica serovar Typhi Ty2
acgaucuggcaaaccaugu

SEQ ID NO: 3731946 - RNA, 15 nt, Salmonella enterica enterica serovar Typhi Ty2
acgaugaugaaaaag

SEQ ID NO: 3731947 - RNA, 17 nt, Salmonella enterica enterica serovar Typhi Ty2
acgaugaugaaaaagaa

SEQ ID NO: 3731948 - RNA, 16 nt, Salmonella enterica enterica serovar Typhi Ty2
acgaugauguagccgc

SEQ ID NO: 3731949 - RNA, 18 nt, Salmonella enterica enterica serovar Typhi Ty2
acgaugcagcaccagaua

SEQ ID NO: 3731950 - RNA, 20 nt, Salmonella enterica enterica serovar Typhi Ty2
acgaugcauaugcacagcgc

SEQ ID NO: 3731951 - RNA, 17 nt, Salmonella enterica enterica serovar Typhi Ty2
acgauguaaaaccuggc

SEQ ID NO: 3731952 - RNA, 19 nt, Salmonella enterica enterica serovar Typhi Ty2
acgauguaaaaccuggcac

SEQ ID NO: 3731953 - RNA, 20 nt, Salmonella enterica enterica serovar Typhi Ty2
acgaugugcauaaccgcgcc

SEQ ID NO: 3731954 - RNA, 12 nt, Salmonella enterica enterica serovar Typhi Ty2
acgauugcgcgu

SEQ ID NO: 3731955 - RNA, 19 nt, Salmonella enterica enterica serovar Typhi Ty2
acgauuggccgucucuuuc

SEQ ID NO: 3731956 - RNA, 13 nt, Salmonella enterica enterica serovar Typhi Ty2
acgauuuccccug

SEQ ID NO: 3731957 - RNA, 21 nt, Salmonella enterica enterica serovar Typhi Ty2
acgcaaagacaccccagccua

SEQ ID NO: 3731958 - RNA, 13 nt, Salmonella enterica enterica serovar Typhi Ty2
acgcaaaucaccg

SEQ ID NO: 3731959 - RNA, 14 nt, Salmonella enterica enterica serovar Typhi Ty2
acgcaacaccaucc

SEQ ID NO: 3731960 - RNA, 19 nt, Salmonella enterica enterica serovar Typhi Ty2
acgcaacaggccgcaucgg

SEQ ID NO: 3731961 - RNA, 14 nt, Salmonella enterica enterica serovar Typhi Ty2
acgcaacggcaugu

SEQ ID NO: 3731962 - RNA, 19 nt, Salmonella enterica enterica serovar Typhi Ty2
acgcaacucacgccauucc

SEQ ID NO: 3731963 - RNA, 16 nt, Salmonella enterica enterica serovar Typhi Ty2
acgcaaggaaauauua

SEQ ID NO: 3731964 - RNA, 17 nt, Salmonella enterica enterica serovar Typhi Ty2
acgcaaggaaauauuaa

SEQ ID NO: 3731965 - RNA, 14 nt, Salmonella enterica enterica serovar Typhi Ty2
acgcaaugccugac

SEQ ID NO: 3731966 - RNA, 15 nt, Salmonella enterica enterica serovar Typhi Ty2
acgcaauuguugcgc

SEQ ID NO: 3731967 - RNA, 16 nt, Salmonella enterica enterica serovar Typhi Ty2
acgcacaguacgcccg

SEQ ID NO: 3731968 - RNA, 22 nt, Salmonella enterica enterica serovar Typhi Ty2
acgcacaguacgcccggcgggu

SEQ ID NO: 3731969 - RNA, 13 nt, Salmonella enterica enterica serovar Typhi Ty2
acgcaccagccag

SEQ ID NO: 3731970 - RNA, 13 nt, Salmonella enterica enterica serovar Typhi Ty2
acgcacuaccaga

SEQ ID NO: 3731971 - RNA, 15 nt, Salmonella enterica enterica serovar Typhi Ty2
acgcagaagacagaa

SEQ ID NO: 3731972 - RNA, 19 nt, Salmonella enterica enterica serovar Typhi Ty2
acgcagaagcgcguuggcg

SEQ ID NO: 3731973 - RNA, 13 nt, Salmonella enterica enterica serovar Typhi Ty2
acgcagaccaaag

SEQ ID NO: 3731974 - RNA, 17 nt, Salmonella enterica enterica serovar Typhi Ty2
acgcagaucguauccag

SEQ ID NO: 3731975 - RNA, 18 nt, Salmonella enterica enterica serovar Typhi Ty2
acgcagaucuuuuugcuc

SEQ ID NO: 3731976 - RNA, 16 nt, Salmonella enterica enterica serovar Typhi Ty2
acgcagcaaacgccau

SEQ ID NO: 3731977 - RNA, 12 nt, Salmonella enterica enterica serovar Typhi Ty2
acgcagcaagaa

SEQ ID NO: 3731978 - RNA, 14 nt, Salmonella enterica enterica serovar Typhi Ty2
acgcagcaagaaca

SEQ ID NO: 3731979 - RNA, 15 nt, Salmonella enterica enterica serovar Typhi Ty2
acgcagcaagaacag

SEQ ID NO: 3731980 - RNA, 17 nt, Salmonella enterica enterica serovar Typhi Ty2
acgcagcaagaacagag

SEQ ID NO: 3731981 - RNA, 14 nt, Salmonella enterica enterica serovar Typhi Ty2
acgcagcaucgcca

SEQ ID NO: 3731982 - RNA, 18 nt, Salmonella enterica enterica serovar Typhi Ty2
acgcagcaucucaauauc

SEQ ID NO: 3731983 - RNA, 14 nt, Salmonella enterica enterica serovar Typhi Ty2
acgcagcauuucgu

SEQ ID NO: 3731984 - RNA, 11 nt, Salmonella enterica enterica serovar Typhi Ty2
acgcagcccca

SEQ ID NO: 3731985 - RNA, 20 nt, Salmonella enterica enterica serovar Typhi Ty2
acgcagcucauacccuucca

SEQ ID NO: 3731986 - RNA, 14 nt, Salmonella enterica enterica serovar Typhi Ty2
acgcagcuccagcu

SEQ ID NO: 3731987 - RNA, 17 nt, Salmonella enterica enterica serovar Typhi Ty2
acgcagcuuaaagccaa

SEQ ID NO: 3731988 - RNA, 22 nt, Salmonella enterica enterica serovar Typhi Ty2
acgcagcuuaaagccaauccag

SEQ ID NO: 3731989 - RNA, 15 nt, Salmonella enterica enterica serovar Typhi Ty2
acgcaggcgaaauca

SEQ ID NO: 3731990 - RNA, 16 nt, Salmonella enterica enterica serovar Typhi Ty2
acgcaggcuaacgcgc

SEQ ID NO: 3731991 - RNA, 20 nt, Salmonella enterica enterica serovar Typhi Ty2
acgcagggccgcgagaacuu

SEQ ID NO: 3731992 - RNA, 20 nt, Salmonella enterica enterica serovar Typhi Ty2
acgcagugcgcgaccgcauc

SEQ ID NO: 3731993 - RNA, 17 nt, Salmonella enterica enterica serovar Typhi Ty2
acgcauauccagcagau

SEQ ID NO: 3731994 - RNA, 15 nt, Salmonella enterica enterica serovar Typhi Ty2
acgcaucaaagccac

SEQ ID NO: 3731995 - RNA, 16 nt, Salmonella enterica enterica serovar Typhi Ty2
acgcaucaaagccacc

SEQ ID NO: 3731996 - RNA, 19 nt, Salmonella enterica enterica serovar Typhi Ty2
acgcaucaaauaccuuuuc

SEQ ID NO: 3731997 - RNA, 23 nt, Salmonella enterica enterica serovar Typhi Ty2
acgcaucaaauaccuuuucauug

SEQ ID NO: 3731998 - RNA, 22 nt, Salmonella enterica enterica serovar Typhi Ty2
acgcauccagcgcaaagggaca

SEQ ID NO: 3731999 - RNA, 13 nt, Salmonella enterica enterica serovar Typhi Ty2
acgcaucccgcca

SEQ ID NO: 3732000 - RNA, 17 nt, Salmonella enterica enterica serovar Typhi Ty2
acgcauccgcguuaccc

SEQ ID NO: 3732001 - RNA, 23 nt, Salmonella enterica enterica serovar Typhi Ty2
acgcaucgcugcgcuuacacacc

SEQ ID NO: 3732002 - RNA, 16 nt, Salmonella enterica enterica serovar Typhi Ty2
acgcaucuuuuucccg

SEQ ID NO: 3732003 - RNA, 13 nt, Salmonella enterica enterica serovar Typhi Ty2
acgcaugaagcgu

SEQ ID NO: 3732004 - RNA, 15 nt, Salmonella enterica enterica serovar Typhi Ty2
acgcaugguuagcca

SEQ ID NO: 3732005 - RNA, 18 nt, Salmonella enterica enterica serovar Typhi Ty2
acgcauugagacaugccg

SEQ ID NO: 3732006 - RNA, 22 nt, Salmonella enterica enterica serovar Typhi Ty2
acgcauugagacaugccgccag

SEQ ID NO: 3732007 - RNA, 22 nt, Salmonella enterica enterica serovar Typhi Ty2
acgcauugccauguuaauacca

SEQ ID NO: 3732008 - RNA, 23 nt, Salmonella enterica enterica serovar Typhi Ty2
acgcauugccauguuaauaccag

SEQ ID NO: 3732009 - RNA, 13 nt, Salmonella enterica enterica serovar Typhi Ty2
acgccaaaaagug

SEQ ID NO: 3732010 - RNA, 15 nt, Salmonella enterica enterica serovar Typhi Ty2
acgccaaaaagugaa

SEQ ID NO: 3732011 - RNA, 13 nt, Salmonella enterica enterica serovar Typhi Ty2
acgccaagcagcg

SEQ ID NO: 3732012 - RNA, 23 nt, Salmonella enterica enterica serovar Typhi Ty2
acgccaagcagcggcguaucuuc

SEQ ID NO: 3732013 - RNA, 21 nt, Salmonella enterica enterica serovar Typhi Ty2
acgccaagcgcggcagcagcu

SEQ ID NO: 3732014 - RNA, 12 nt, Salmonella enterica enterica serovar Typhi Ty2
acgccaaucggc

SEQ ID NO: 3732015 - RNA, 23 nt, Salmonella enterica enterica serovar Typhi Ty2
acgccaaucggcgucuugccgca

SEQ ID NO: 3732016 - RNA, 14 nt, Salmonella enterica enterica serovar Typhi Ty2
acgccacaaacugc

SEQ ID NO: 3732017 - RNA, 20 nt, Salmonella enterica enterica serovar Typhi Ty2
acgccacaaacugcgcuagc

SEQ ID NO: 3732018 - RNA, 15 nt, Salmonella enterica enterica serovar Typhi Ty2
acgccacaguugguu

SEQ ID NO: 3732019 - RNA, 18 nt, Salmonella enterica enterica serovar Typhi Ty2
acgccaccgccaccugcc

SEQ ID NO: 3732020 - RNA, 22 nt, Salmonella enterica enterica serovar Typhi Ty2
acgccaccgccgccaccaaaaa

SEQ ID NO: 3732021 - RNA, 22 nt, Salmonella enterica enterica serovar Typhi Ty2
acgccaccggguuaaagcccug

SEQ ID NO: 3732022 - RNA, 23 nt, Salmonella enterica enterica serovar Typhi Ty2
acgccaccggguuaaagcccuga

SEQ ID NO: 3732023 - RNA, 19 nt, Salmonella enterica enterica serovar Typhi Ty2
acgccaccuuugaaaauca

SEQ ID NO: 3732024 - RNA, 18 nt, Salmonella enterica enterica serovar Typhi Ty2
acgccagaccgacgccaa

SEQ ID NO: 3732025 - RNA, 17 nt, Salmonella enterica enterica serovar Typhi Ty2
acgccagauuaucggcc

SEQ ID NO: 3732026 - RNA, 11 nt, Salmonella enterica enterica serovar Typhi Ty2
acgccagcaga

SEQ ID NO: 3732027 - RNA, 22 nt, Salmonella enterica enterica serovar Typhi Ty2
acgccuucguccggauguucga

SEQ ID NO: 3732028 - RNA, 15 nt, Salmonella enterica enterica serovar Typhi Ty2
acgccuuugcccggu

SEQ ID NO: 3732029 - RNA, 16 nt, Salmonella enterica enterica serovar Typhi Ty2
acgccuuugcccggug

SEQ ID NO: 3732030 - RNA, 19 nt, Salmonella enterica enterica serovar Typhi Ty2
acgcgaagauuaacccggu

SEQ ID NO: 3732031 - RNA, 16 nt, Salmonella enterica enterica serovar Typhi Ty2
acgcgacaacgccgga

SEQ ID NO: 3732032 - RNA, 18 nt, Salmonella enterica enterica serovar Typhi Ty2
acgcgaccagacacggug

SEQ ID NO: 3732033 - RNA, 14 nt, Salmonella enterica enterica serovar Typhi Ty2
acgcgacgcgccag

SEQ ID NO: 3732034 - RNA, 20 nt, Salmonella enterica enterica serovar Typhi Ty2
acgcgacuuuuuucacccag

SEQ ID NO: 3732035 - RNA, 21 nt, Salmonella enterica enterica serovar Typhi Ty2
acgcgagaagaagaauuauua

SEQ ID NO: 3732036 - RNA, 15 nt, Salmonella enterica enterica serovar Typhi Ty2
acgcgagaagcccgg

SEQ ID NO: 3732037 - RNA, 22 nt, Salmonella enterica enterica serovar Typhi Ty2
acgcgagcugccaguucauucc

SEQ ID NO: 3732038 - RNA, 21 nt, Salmonella enterica enterica serovar Typhi Ty2
acgcgauaaaaaacgcccaga

SEQ ID NO: 3732039 - RNA, 20 nt, Salmonella enterica enterica serovar Typhi Ty2
acgcgauaaaaacccaccag

SEQ ID NO: 3732040 - RNA, 21 nt, Salmonella enterica enterica serovar Typhi Ty2
acgcgauacacuccggcgcgc

SEQ ID NO: 3732041 - RNA, 15 nt, Salmonella enterica enterica serovar Typhi Ty2
acgcgauagcgcagc

SEQ ID NO: 3732042 - RNA, 18 nt, Salmonella enterica enterica serovar Typhi Ty2
acgcgauauguuugcgcg

SEQ ID NO: 3732043 - RNA, 20 nt, Salmonella enterica enterica serovar Typhi Ty2
acgcgauauuacuccagcgu

SEQ ID NO: 3732044 - RNA, 18 nt, Salmonella enterica enterica serovar Typhi Ty2
acgcgaucgcgauucgcc

SEQ ID NO: 3732045 - RNA, 15 nt, Salmonella enterica enterica serovar Typhi Ty2
acgcgaugagauaau

SEQ ID NO: 3732046 - RNA, 15 nt, Salmonella enterica enterica serovar Typhi Ty2
acgcgaugccaguag

SEQ ID NO: 3732047 - RNA, 17 nt, Salmonella enterica enterica serovar Typhi Ty2
acgcgaugccuggcgau

SEQ ID NO: 3732048 - RNA, 20 nt, Salmonella enterica enterica serovar Typhi Ty2
acgcgcaucaacgccaggca

SEQ ID NO: 3732049 - RNA, 22 nt, Salmonella enterica enterica serovar Typhi Ty2
acgcgcauccugcauaauccaa

SEQ ID NO: 3732050 - RNA, 19 nt, Salmonella enterica enterica serovar Typhi Ty2
acgcgcauuaauaugcgca

SEQ ID NO: 3732051 - RNA, 23 nt, Salmonella enterica enterica serovar Typhi Ty2
acgcgcauuaauaugcgcaauca

SEQ ID NO: 3732052 - RNA, 15 nt, Salmonella enterica enterica serovar Typhi Ty2
acgcgccacgcgcca

SEQ ID NO: 3732053 - RNA, 20 nt, Salmonella enterica enterica serovar Typhi Ty2
acgcgccacuuccagcgcgc

SEQ ID NO: 3732054 - RNA, 15 nt, Salmonella enterica enterica serovar Typhi Ty2
acgcgccagcaaaau

SEQ ID NO: 3732055 - RNA, 22 nt, Salmonella enterica enterica serovar Typhi Ty2
acgcgccagcaaaauuuugcgc

SEQ ID NO: 3732056 - RNA, 13 nt, Salmonella enterica enterica serovar Typhi Ty2
acgcgccagccag

SEQ ID NO: 3732057 - RNA, 17 nt, Salmonella enterica enterica serovar Typhi Ty2
acgcgcccucugagcug

SEQ ID NO: 3732058 - RNA, 22 nt, Salmonella enterica enterica serovar Typhi Ty2
acgcgccgccaacgauacagca

SEQ ID NO: 3732059 - RNA, 18 nt, Salmonella enterica enterica serovar Typhi Ty2
acgcgccgccagcgacuu

SEQ ID NO: 3732060 - RNA, 14 nt, Salmonella enterica enterica serovar Typhi Ty2
acgcgccggaaggc

SEQ ID NO: 3732061 - RNA, 13 nt, Salmonella enterica enterica serovar Typhi Ty2
acgcgcgcccugc

SEQ ID NO: 3732062 - RNA, 23 nt, Salmonella enterica enterica serovar Typhi Ty2
acgcgcgccggugaucccaccag

SEQ ID NO: 3732063 - RNA, 14 nt, Salmonella enterica enterica serovar Typhi Ty2
acgcgcgcgaaaag

SEQ ID NO: 3732064 - RNA, 14 nt, Salmonella enterica enterica serovar Typhi Ty2
acgcgcgcggcguc

SEQ ID NO: 3732065 - RNA, 14 nt, Salmonella enterica enterica serovar Typhi Ty2
acgcgcgucaggac

SEQ ID NO: 3732066 - RNA, 17 nt, Salmonella enterica enterica serovar Typhi Ty2
acgcgcgucaggacggc

SEQ ID NO: 3732067 - RNA, 15 nt, Salmonella enterica enterica serovar Typhi Ty2
acgcgcuagcuucag

SEQ ID NO: 3732068 - RNA, 19 nt, Salmonella enterica enterica serovar Typhi Ty2
acgcgcucaccuccgccac

SEQ ID NO: 3732069 - RNA, 15 nt, Salmonella enterica enterica serovar Typhi Ty2
acgcgcuccagcaac

SEQ ID NO: 3732070 - RNA, 18 nt, Salmonella enterica enterica serovar Typhi Ty2
acgcgcugaccucaaucc

SEQ ID NO: 3732071 - RNA, 14 nt, Salmonella enterica enterica serovar Typhi Ty2
acgcgcugauaccg

SEQ ID NO: 3732072 - RNA, 23 nt, Salmonella enterica enterica serovar Typhi Ty2
acgcgcuuuuucuuccgucagcg

SEQ ID NO: 3732073 - RNA, 19 nt, Salmonella enterica enterica serovar Typhi Ty2
acgcggaacuggugaaaca

SEQ ID NO: 3732074 - RNA, 14 nt, Salmonella enterica enterica serovar Typhi Ty2
acgcggaagaaaua

SEQ ID NO: 3732075 - RNA, 12 nt, Salmonella enterica enterica serovar Typhi Ty2
acgcggaaguau

SEQ ID NO: 3732076 - RNA, 14 nt, Salmonella enterica enterica serovar Typhi Ty2
acgcggaucggcac

SEQ ID NO: 3732077 - RNA, 16 nt, Salmonella enterica enterica serovar Typhi Ty2
acgcggauguugcugu

SEQ ID NO: 3732078 - RNA, 16 nt, Salmonella enterica enterica serovar Typhi Ty2
acgcggauugccgccc

SEQ ID NO: 3732079 - RNA, 21 nt, Salmonella enterica enterica serovar Typhi Ty2
acgcggcacaaaguccgccgu

SEQ ID NO: 3732080 - RNA, 13 nt, Salmonella enterica enterica serovar Typhi Ty2
acgcggcaucagg

SEQ ID NO: 3732081 - RNA, 22 nt, Salmonella enterica enterica serovar Typhi Ty2
acgcggccaaaacccaccagca

SEQ ID NO: 3732082 - RNA, 23 nt, Salmonella enterica enterica serovar Typhi Ty2
acgcggccuggaagcgcccaggc

SEQ ID NO: 3732083 - RNA, 12 nt, Salmonella enterica enterica serovar Typhi Ty2
acgcggcgcgcu

SEQ ID NO: 3732084 - RNA, 13 nt, Salmonella enterica enterica serovar Typhi Ty2
acgcggcgugcgc

SEQ ID NO: 3732085 - RNA, 18 nt, Salmonella enterica enterica serovar Typhi Ty2
acgcggcuaaucagggua

SEQ ID NO: 3732086 - RNA, 21 nt, Salmonella enterica enterica serovar Typhi Ty2
acgcgggguaaaauggacuuc

SEQ ID NO: 3732087 - RNA, 19 nt, Salmonella enterica enterica serovar Typhi Ty2
acgcgguaaauuccgcagg

SEQ ID NO: 3732088 - RNA, 15 nt, Salmonella enterica enterica serovar Typhi Ty2
acgcgguacccaccu

SEQ ID NO: 3732089 - RNA, 16 nt, Salmonella enterica enterica serovar Typhi Ty2
acgcgguaugauuaua

SEQ ID NO: 3732090 - RNA, 15 nt, Salmonella enterica enterica serovar Typhi Ty2
acgcggucaggguga

SEQ ID NO: 3732091 - RNA, 19 nt, Salmonella enterica enterica serovar Typhi Ty2
acgcggucgccugccgcau

SEQ ID NO: 3732092 - RNA, 18 nt, Salmonella enterica enterica serovar Typhi Ty2
acgcggugacuuuggccg

SEQ ID NO: 3732093 - RNA, 16 nt, Salmonella enterica enterica serovar Typhi Ty2
acgcguaggccggaua

SEQ ID NO: 3732094 - RNA, 19 nt, Salmonella enterica enterica serovar Typhi Ty2
acgcgucagggcgauaaua

SEQ ID NO: 3732095 - RNA, 17 nt, Salmonella enterica enterica serovar Typhi Ty2
acgcgucugaaugacgc

SEQ ID NO: 3732096 - RNA, 21 nt, Salmonella enterica enterica serovar Typhi Ty2
acgcgucuguagcgcgcgcca

SEQ ID NO: 3732097 - RNA, 23 nt, Salmonella enterica enterica serovar Typhi Ty2
acgcgucuucaucagccagcauc

SEQ ID NO: 3732098 - RNA, 13 nt, Salmonella enterica enterica serovar Typhi Ty2
acgcgugcgaauu

SEQ ID NO: 3732099 - RNA, 16 nt, Salmonella enterica enterica serovar Typhi Ty2
acgcguucuacgguau

SEQ ID NO: 3732100 - RNA, 16 nt, Salmonella enterica enterica serovar Typhi Ty2
acgcuaaaaaaggcag

SEQ ID NO: 3732101 - RNA, 23 nt, Salmonella enterica enterica serovar Typhi Ty2
acgcuaaucccgcucgccaggug

SEQ ID NO: 3732102 - RNA, 22 nt, Salmonella enterica enterica serovar Typhi Ty2
acgcuaccgucgccgacaacgc

SEQ ID NO: 3732103 - RNA, 15 nt, Salmonella enterica enterica serovar Typhi Ty2
acgcuauuuaaaaac

SEQ ID NO: 3732104 - RNA, 13 nt, Salmonella enterica enterica serovar Typhi Ty2
acgcuauuuuuca

SEQ ID NO: 3732105 - RNA, 15 nt, Salmonella enterica enterica serovar Typhi Ty2
acgcucaaccgguuu

SEQ ID NO: 3732106 - RNA, 15 nt, Salmonella enterica enterica serovar Typhi Ty2
acgcucacccaguuu

SEQ ID NO: 3732107 - RNA, 12 nt, Salmonella enterica enterica serovar Typhi Ty2
acgcucacuuuu

SEQ ID NO: 3732108 - RNA, 22 nt, Salmonella enterica enterica serovar Typhi Ty2
acgcucauuaacgacaacuucu

SEQ ID NO: 3732109 - RNA, 18 nt, Salmonella enterica enterica serovar Typhi Ty2
acggccacgcgcgucagg

SEQ ID NO: 3732110 - RNA, 12 nt, Salmonella enterica enterica serovar Typhi Ty2
acggcccgcugu

SEQ ID NO: 3732111 - RNA, 19 nt, Salmonella enterica enterica serovar Typhi Ty2
acggcccguaaacaggcug

SEQ ID NO: 3732112 - RNA, 17 nt, Salmonella enterica enterica serovar Typhi Ty2
acggccuaagaccagca

SEQ ID NO: 3732113 - RNA, 20 nt, Salmonella enterica enterica serovar Typhi Ty2
acggccuagcugcguuucca

SEQ ID NO: 3732114 - RNA, 23 nt, Salmonella enterica enterica serovar Typhi Ty2
acggccugcaaacgaaucaccuc

SEQ ID NO: 3732115 - RNA, 16 nt, Salmonella enterica enterica serovar Typhi Ty2
acggccugcgcuggaa

SEQ ID NO: 3732116 - RNA, 22 nt, Salmonella enterica enterica serovar Typhi Ty2
acggcgacgcccgccaucugcu

SEQ ID NO: 3732117 - RNA, 20 nt, Salmonella enterica enterica serovar Typhi Ty2
acggcgauaaaugucaggau

SEQ ID NO: 3732118 - RNA, 18 nt, Salmonella enterica enterica serovar Typhi Ty2
acggcgauaccaguaaua

SEQ ID NO: 3732119 - RNA, 16 nt, Salmonella enterica enterica serovar Typhi Ty2
acggcgauacugcucc

SEQ ID NO: 3732120 - RNA, 22 nt, Salmonella enterica enterica serovar Typhi Ty2
acggcgcacacgaaauccaaac

SEQ ID NO: 3732121 - RNA, 13 nt, Salmonella enterica enterica serovar Typhi Ty2
acggcgcgccaau

SEQ ID NO: 3732122 - RNA, 23 nt, Salmonella enterica enterica serovar Typhi Ty2
acggcgcuaagcgcccguagcuc

SEQ ID NO: 3732123 - RNA, 22 nt, Salmonella enterica enterica serovar Typhi Ty2
acggcgcuccugucaggcgagc

SEQ ID NO: 3732124 - RNA, 14 nt, Salmonella enterica enterica serovar Typhi Ty2
acggcgcuggcgua

SEQ ID NO: 3732125 - RNA, 14 nt, Salmonella enterica enterica serovar Typhi Ty2
acggcggaccccuc

SEQ ID NO: 3732126 - RNA, 20 nt, Salmonella enterica enterica serovar Typhi Ty2
acggcggcauuaaagccgcc

SEQ ID NO: 3732127 - RNA, 18 nt, Salmonella enterica enterica serovar Typhi Ty2
acggcggcgaauagcgaa

SEQ ID NO: 3732128 - RNA, 16 nt, Salmonella enterica enterica serovar Typhi Ty2
acggcggguuuaagug

SEQ ID NO: 3732129 - RNA, 16 nt, Salmonella enterica enterica serovar Typhi Ty2
acggcguaagcgcuau

SEQ ID NO: 3732130 - RNA, 18 nt, Salmonella enterica enterica serovar Typhi Ty2
acggcguaccagaaugcc

SEQ ID NO: 3732131 - RNA, 23 nt, Salmonella enterica enterica serovar Typhi Ty2
acggcgucaccaccgcaggcagc

SEQ ID NO: 3732132 - RNA, 14 nt, Salmonella enterica enterica serovar Typhi Ty2
acggcgucagccac

SEQ ID NO: 3732133 - RNA, 16 nt, Salmonella enterica enterica serovar Typhi Ty2
acggcuaauaugccag

SEQ ID NO: 3732134 - RNA, 19 nt, Salmonella enterica enterica serovar Typhi Ty2
acggcuaauaugccaggcu

SEQ ID NO: 3732135 - RNA, 14 nt, Salmonella enterica enterica serovar Typhi Ty2
acggcuacccauga

SEQ ID NO: 3732136 - RNA, 13 nt, Salmonella enterica enterica serovar Typhi Ty2
acggcuaccugca

SEQ ID NO: 3732137 - RNA, 23 nt, Salmonella enterica enterica serovar Typhi Ty2
acggcuacuuguugucaaaaucg

SEQ ID NO: 3732138 - RNA, 23 nt, Salmonella enterica enterica serovar Typhi Ty2
acggcuauuccucgaucgccugg

SEQ ID NO: 3732139 - RNA, 15 nt, Salmonella enterica enterica serovar Typhi Ty2
acggcuccagcgcca

SEQ ID NO: 3732140 - RNA, 13 nt, Salmonella enterica enterica serovar Typhi Ty2
acggcugaagcug

SEQ ID NO: 3732141 - RNA, 22 nt, Salmonella enterica enterica serovar Typhi Ty2
acggcugccuuuguacagcuug

SEQ ID NO: 3732142 - RNA, 22 nt, Salmonella enterica enterica serovar Typhi Ty2
acggcuuuaauaccccuguuca

SEQ ID NO: 3732143 - RNA, 19 nt, Salmonella enterica enterica serovar Typhi Ty2
acggcuuuccagcagccag

SEQ ID NO: 3732144 - RNA, 20 nt, Salmonella enterica enterica serovar Typhi Ty2
acggcuuucuuucuccagcg

SEQ ID NO: 3732145 - RNA, 14 nt, Salmonella enterica enterica serovar Typhi Ty2
acggcuuuucuuca

SEQ ID NO: 3732146 - RNA, 17 nt, Salmonella enterica enterica serovar Typhi Ty2
acgggaaguaaggcaug

SEQ ID NO: 3732147 - RNA, 18 nt, Salmonella enterica enterica serovar Typhi Ty2
acgggacgaauuuccagc

SEQ ID NO: 3732148 - RNA, 11 nt, Salmonella enterica enterica serovar Typhi Ty2
acgggcaaagc

SEQ ID NO: 3732149 - RNA, 15 nt, Salmonella enterica enterica serovar Typhi Ty2
acgggcagagucgau

SEQ ID NO: 3732150 - RNA, 14 nt, Salmonella enterica enterica serovar Typhi Ty2
acgggcagucuggc

SEQ ID NO: 3732151 - RNA, 22 nt, Salmonella enterica enterica serovar Typhi Ty2
acgggcagucuggcggcagccg

SEQ ID NO: 3732152 - RNA, 19 nt, Salmonella enterica enterica serovar Typhi Ty2
acgggcauuguuaauccag

SEQ ID NO: 3732153 - RNA, 12 nt, Salmonella enterica enterica serovar Typhi Ty2
acgggccaggcg

SEQ ID NO: 3732154 - RNA, 16 nt, Salmonella enterica enterica serovar Typhi Ty2
acgggcccuggccgca

SEQ ID NO: 3732155 - RNA, 17 nt, Salmonella enterica enterica serovar Typhi Ty2
acgggcccuggccgcaa

SEQ ID NO: 3732156 - RNA, 22 nt, Salmonella enterica enterica serovar Typhi Ty2
acgggcgauggcucgcccggua

SEQ ID NO: 3732157 - RNA, 15 nt, Salmonella enterica enterica serovar Typhi Ty2
acgggcgcgacaaua

SEQ ID NO: 3732158 - RNA, 14 nt, Salmonella enterica enterica serovar Typhi Ty2
acgggcgcggcaua

SEQ ID NO: 3732159 - RNA, 21 nt, Salmonella enterica enterica serovar Typhi Ty2
acgggcgggguaguuaucacg

SEQ ID NO: 3732160 - RNA, 23 nt, Salmonella enterica enterica serovar Typhi Ty2
acgggcuuaaucaguucggcauc

SEQ ID NO: 3732161 - RNA, 15 nt, Salmonella enterica enterica serovar Typhi Ty2
acgggcuuccaguac

SEQ ID NO: 3732162 - RNA, 18 nt, Salmonella enterica enterica serovar Typhi Ty2
acgggcuuuuagccgcgc

SEQ ID NO: 3732163 - RNA, 14 nt, Salmonella enterica enterica serovar Typhi Ty2
acggguaacgccaa

SEQ ID NO: 3732164 - RNA, 14 nt, Salmonella enterica enterica serovar Typhi Ty2
acgguaaaccucuu

SEQ ID NO: 3732165 - RNA, 20 nt, Salmonella enterica enterica serovar Typhi Ty2
acgguaaccauuuccggauc

SEQ ID NO: 3732166 - RNA, 14 nt, Salmonella enterica enterica serovar Typhi Ty2
acgguaaguugaaa

SEQ ID NO: 3732167 - RNA, 21 nt, Salmonella enterica enterica serovar Typhi Ty2
acgguaaguugaaaggaaagg

SEQ ID NO: 3732168 - RNA, 20 nt, Salmonella enterica enterica serovar Typhi Ty2
acgguaauugccgggaaaac

SEQ ID NO: 3732169 - RNA, 23 nt, Salmonella enterica enterica serovar Typhi Ty2
acgguacaaaccccacccacuga

SEQ ID NO: 3732170 - RNA, 20 nt, Salmonella enterica enterica serovar Typhi Ty2
acgguaggccggguaggaca

SEQ ID NO: 3732171 - RNA, 12 nt, Salmonella enterica enterica serovar Typhi Ty2
acgguaucagcg

SEQ ID NO: 3732172 - RNA, 22 nt, Salmonella enterica enterica serovar Typhi Ty2
acgguaucagcgcguuuuccau

SEQ ID NO: 3732173 - RNA, 19 nt, Salmonella enterica enterica serovar Typhi Ty2
acgguaugaaacauauaua

SEQ ID NO: 3732174 - RNA, 16 nt, Salmonella enterica enterica serovar Typhi Ty2
acgguauucguuacca

SEQ ID NO: 3732175 - RNA, 21 nt, Salmonella enterica enterica serovar Typhi Ty2
acgguauucguuaccagcauc

SEQ ID NO: 3732176 - RNA, 14 nt, Salmonella enterica enterica serovar Typhi Ty2
acggucaaucauca

SEQ ID NO: 3732177 - RNA, 12 nt, Salmonella enterica enterica serovar Typhi Ty2
acggucaggcuc

SEQ ID NO: 3732178 - RNA, 19 nt, Salmonella enterica enterica serovar Typhi Ty2
acgguccuggccaggcuuc

SEQ ID NO: 3732179 - RNA, 16 nt, Salmonella enterica enterica serovar Typhi Ty2
acggugcugaauauua

SEQ ID NO: 3732180 - RNA, 19 nt, Salmonella enterica enterica serovar Typhi Ty2
acggugguaaaucagaaua

SEQ ID NO: 3732181 - RNA, 16 nt, Salmonella enterica enterica serovar Typhi Ty2
acggugugaucaccgc

SEQ ID NO: 3732182 - RNA, 17 nt, Salmonella enterica enterica serovar Typhi Ty2
acgguuaaaaacagcca

SEQ ID NO: 3732183 - RNA, 13 nt, Salmonella enterica enterica serovar Typhi Ty2
acgguuaaaaagu

SEQ ID NO: 3732184 - RNA, 17 nt, Salmonella enterica enterica serovar Typhi Ty2
acgguucauccagcagc

SEQ ID NO: 3732185 - RNA, 23 nt, Salmonella enterica enterica serovar Typhi Ty2
acgguuuuauccccuucaggaau

SEQ ID NO: 3732186 - RNA, 13 nt, Salmonella enterica enterica serovar Typhi Ty2
acguaaagcuggc

SEQ ID NO: 3732187 - RNA, 13 nt, Salmonella enterica enterica serovar Typhi Ty2
acguaaauaccca

SEQ ID NO: 3732188 - RNA, 17 nt, Salmonella enterica enterica serovar Typhi Ty2
acguaaauacccaggcc

SEQ ID NO: 3732189 - RNA, 21 nt, Salmonella enterica enterica serovar Typhi Ty2
acguaaauuacuuaugauaua

SEQ ID NO: 3732190 - RNA, 15 nt, Salmonella enterica enterica serovar Typhi Ty2
acguaaccggcguuc

SEQ ID NO: 3732191 - RNA, 17 nt, Salmonella enterica enterica serovar Typhi Ty2
acguugugauaaaucgu

SEQ ID NO: 3732192 - RNA, 22 nt, Salmonella enterica enterica serovar Typhi Ty2
acguuucaguuuuuucaguagc

SEQ ID NO: 3732193 - RNA, 22 nt, Salmonella enterica enterica serovar Typhi Ty2
acguuuccgcuagggcaucaga

SEQ ID NO: 3732194 - RNA, 17 nt, Salmonella enterica enterica serovar Typhi Ty2
acguuucuuucaucaga

SEQ ID NO: 3732195 - RNA, 18 nt, Salmonella enterica enterica serovar Typhi Ty2
acguuugaccugcagcuc

SEQ ID NO: 3732196 - RNA, 16 nt, Salmonella enterica enterica serovar Typhi Ty2
acguuuucagcagugc

SEQ ID NO: 3732197 - RNA, 23 nt, Salmonella enterica enterica serovar Typhi Ty2
acguuuugggaaaaccaguugca

SEQ ID NO: 3732198 - RNA, 19 nt, Salmonella enterica enterica serovar Typhi Ty2
acguuuuuccauucacaca

SEQ ID NO: 3732199 - RNA, 16 nt, Salmonella enterica enterica serovar Typhi Ty2
acguuuuuucgcacgc

SEQ ID NO: 3732200 - RNA, 16 nt, Salmonella enterica enterica serovar Typhi Ty2
acuaaaaauucaaaaa

SEQ ID NO: 3732201 - RNA, 15 nt, Salmonella enterica enterica serovar Typhi Ty2
acuaaaguuuauuua

SEQ ID NO: 3732202 - RNA, 22 nt, Salmonella enterica enterica serovar Typhi Ty2
acuaaccguucaucuaucgcca

SEQ ID NO: 3732203 - RNA, 22 nt, Salmonella enterica enterica serovar Typhi Ty2
acuaacugaccauauaugaaau

SEQ ID NO: 3732204 - RNA, 15 nt, Salmonella enterica enterica serovar Typhi Ty2
acuaagaccagcauc

SEQ ID NO: 3732205 - RNA, 17 nt, Salmonella enterica enterica serovar Typhi Ty2
acuaagaccagcaucag

SEQ ID NO: 3732206 - RNA, 20 nt, Salmonella enterica enterica serovar Typhi Ty2
acuaagaccagcaucagaau

SEQ ID NO: 3732207 - RNA, 19 nt, Salmonella enterica enterica serovar Typhi Ty2
acuaagguuuugucauggu

SEQ ID NO: 3732208 - RNA, 16 nt, Salmonella enterica enterica serovar Typhi Ty2
acuaaguaaggaggaa

SEQ ID NO: 3732209 - RNA, 22 nt, Salmonella enterica enterica serovar Typhi Ty2
acuaauccaguccucgcccacu

SEQ ID NO: 3732210 - RNA, 16 nt, Salmonella enterica enterica serovar Typhi Ty2
acuaauccccauuuuu

SEQ ID NO: 3732211 - RNA, 17 nt, Salmonella enterica enterica serovar Typhi Ty2
acuaauccucuucucug

SEQ ID NO: 3732212 - RNA, 21 nt, Salmonella enterica enterica serovar Typhi Ty2
acuaaucugucgcuaaagcac

SEQ ID NO: 3732213 - RNA, 17 nt, Salmonella enterica enterica serovar Typhi Ty2
acuaauuauuuuucaaa

SEQ ID NO: 3732214 - RNA, 18 nt, Salmonella enterica enterica serovar Typhi Ty2
acuaauuauuuuucaaau

SEQ ID NO: 3732215 - RNA, 14 nt, Salmonella enterica enterica serovar Typhi Ty2
acuacagaaagcca

SEQ ID NO: 3732216 - RNA, 18 nt, Salmonella enterica enterica serovar Typhi Ty2
acuacauaucuauauuuu

SEQ ID NO: 3732217 - RNA, 13 nt, Salmonella enterica enterica serovar Typhi Ty2
acuaccaacugau

SEQ ID NO: 3732218 - RNA, 14 nt, Salmonella enterica enterica serovar Typhi Ty2
acuaccacuuucuu

SEQ ID NO: 3732219 - RNA, 17 nt, Salmonella enterica enterica serovar Typhi Ty2
acuaccggcaccagcaa

SEQ ID NO: 3732220 - RNA, 20 nt, Salmonella enterica enterica serovar Typhi Ty2
acuaccucuuauccggcugc

SEQ ID NO: 3732221 - RNA, 14 nt, Salmonella enterica enterica serovar Typhi Ty2
acuacggcaaacac

SEQ ID NO: 3732222 - RNA, 23 nt, Salmonella enterica enterica serovar Typhi Ty2
acuacggcaaacacaaucacgcc

SEQ ID NO: 3732223 - RNA, 21 nt, Salmonella enterica enterica serovar Typhi Ty2
acuacggcaaacgcuggugcu

SEQ ID NO: 3732224 - RNA, 22 nt, Salmonella enterica enterica serovar Typhi Ty2
acuacggguuuuuguguugaaa

SEQ ID NO: 3732225 - RNA, 15 nt, Salmonella enterica enterica serovar Typhi Ty2
acuacgguaaaccag

SEQ ID NO: 3732226 - RNA, 15 nt, Salmonella enterica enterica serovar Typhi Ty2
acuacuacaccaccc

SEQ ID NO: 3732227 - RNA, 22 nt, Salmonella enterica enterica serovar Typhi Ty2
acuacuuuuacccuucagauau

SEQ ID NO: 3732228 - RNA, 16 nt, Salmonella enterica enterica serovar Typhi Ty2
acuagcgcgauuuucu

SEQ ID NO: 3732229 - RNA, 20 nt, Salmonella enterica enterica serovar Typhi Ty2
acuauaaaaauaccggcauc

SEQ ID NO: 3732230 - RNA, 20 nt, Salmonella enterica enterica serovar Typhi Ty2
acuauaauugcuuuuuucca

SEQ ID NO: 3732231 - RNA, 21 nt, Salmonella enterica enterica serovar Typhi Ty2
acuaucaauauuggugucgua

SEQ ID NO: 3732232 - RNA, 22 nt, Salmonella enterica enterica serovar Typhi Ty2
acuaucaguuuuggcaaucaca

SEQ ID NO: 3732233 - RNA, 16 nt, Salmonella enterica enterica serovar Typhi Ty2
acuaucaugauuucuu

SEQ ID NO: 3732234 - RNA, 18 nt, Salmonella enterica enterica serovar Typhi Ty2
acuaucgaaagagcaaau

SEQ ID NO: 3732235 - RNA, 22 nt, Salmonella enterica enterica serovar Typhi Ty2
acuaugcuaauccgcugauuaa

SEQ ID NO: 3732236 - RNA, 13 nt, Salmonella enterica enterica serovar Typhi Ty2
acuauuaaagcac

SEQ ID NO: 3732237 - RNA, 13 nt, Salmonella enterica enterica serovar Typhi Ty2
acuauucuucccc

SEQ ID NO: 3732238 - RNA, 18 nt, Salmonella enterica enterica serovar Typhi Ty2
acuauuucggcacugacu

SEQ ID NO: 3732239 - RNA, 18 nt, Salmonella enterica enterica serovar Typhi Ty2
acuauuuuccccuucugu

SEQ ID NO: 3732240 - RNA, 21 nt, Salmonella enterica enterica serovar Typhi Ty2
acuauuuuuuaugugacaauc

SEQ ID NO: 3732241 - RNA, 22 nt, Salmonella enterica enterica serovar Typhi Ty2
acuauuuuuuaugugacaauca

SEQ ID NO: 3732242 - RNA, 12 nt, Salmonella enterica enterica serovar Typhi Ty2
acucaaagaaaa

SEQ ID NO: 3732243 - RNA, 14 nt, Salmonella enterica enterica serovar Typhi Ty2
acucaaagaaaaca

SEQ ID NO: 3732244 - RNA, 12 nt, Salmonella enterica enterica serovar Typhi Ty2
acucaacaucau

SEQ ID NO: 3732245 - RNA, 20 nt, Salmonella enterica enterica serovar Typhi Ty2
acucaaggcuauuagccaaa

SEQ ID NO: 3732246 - RNA, 22 nt, Salmonella enterica enterica serovar Typhi Ty2
acucaaggcuauuagccaaagc

SEQ ID NO: 3732247 - RNA, 14 nt, Salmonella enterica enterica serovar Typhi Ty2
acucaauaaaaguu

SEQ ID NO: 3732248 - RNA, 14 nt, Salmonella enterica enterica serovar Typhi Ty2
acucaaucaggcua

SEQ ID NO: 3732249 - RNA, 19 nt, Salmonella enterica enterica serovar Typhi Ty2
acucaaugaauugaacuaa

SEQ ID NO: 3732250 - RNA, 24 nt, Salmonella enterica enterica serovar Typhi Ty2
acucacauaacaaaaccagcauca

SEQ ID NO: 3732251 - RNA, 23 nt, Salmonella enterica enterica serovar Typhi Ty2
acucaccacaaaggcgcguagcu

SEQ ID NO: 3732252 - RNA, 13 nt, Salmonella enterica enterica serovar Typhi Ty2
acucaccaguccg

SEQ ID NO: 3732253 - RNA, 23 nt, Salmonella enterica enterica serovar Typhi Ty2
acucacccaggcgaugcgcggaa

SEQ ID NO: 3732254 - RNA, 17 nt, Salmonella enterica enterica serovar Typhi Ty2
acucaccguuacaaaua

SEQ ID NO: 3732255 - RNA, 18 nt, Salmonella enterica enterica serovar Typhi Ty2
acucacgacuuucaccag

SEQ ID NO: 3732256 - RNA, 13 nt, Salmonella enterica enterica serovar Typhi Ty2
acucacgcgcgcu

SEQ ID NO: 3732257 - RNA, 21 nt, Salmonella enterica enterica serovar Typhi Ty2
acucacgcgcgcuuuucgcca

SEQ ID NO: 3732258 - RNA, 12 nt, Salmonella enterica enterica serovar Typhi Ty2
acucacgggcgu

SEQ ID NO: 3732259 - RNA, 15 nt, Salmonella enterica enterica serovar Typhi Ty2
acucacguuccccag

SEQ ID NO: 3732260 - RNA, 19 nt, Salmonella enterica enterica serovar Typhi Ty2
acucacguuccccagcacc

SEQ ID NO: 3732261 - RNA, 18 nt, Salmonella enterica enterica serovar Typhi Ty2
acucagaccgggcgaagu

SEQ ID NO: 3732262 - RNA, 11 nt, Salmonella enterica enterica serovar Typhi Ty2
acucagcaaua

SEQ ID NO: 3732263 - RNA, 13 nt, Salmonella enterica enterica serovar Typhi Ty2
acucagccagaua

SEQ ID NO: 3732264 - RNA, 13 nt, Salmonella enterica enterica serovar Typhi Ty2
acucagccagguc

SEQ ID NO: 3732265 - RNA, 16 nt, Salmonella enterica enterica serovar Typhi Ty2
acucagcgacguaauc

SEQ ID NO: 3732266 - RNA, 17 nt, Salmonella enterica enterica serovar Typhi Ty2
acucagcuaaaaacagc

SEQ ID NO: 3732267 - RNA, 14 nt, Salmonella enterica enterica serovar Typhi Ty2
acucaggcgcaucu

SEQ ID NO: 3732268 - RNA, 12 nt, Salmonella enterica enterica serovar Typhi Ty2
acucauaauauc

SEQ ID NO: 3732269 - RNA, 21 nt, Salmonella enterica enterica serovar Typhi Ty2
acucaucacagccacacugcu

SEQ ID NO: 3732270 - RNA, 13 nt, Salmonella enterica enterica serovar Typhi Ty2
acucauccaccuu

SEQ ID NO: 3732271 - RNA, 19 nt, Salmonella enterica enterica serovar Typhi Ty2
acucauccaccuuauccug

SEQ ID NO: 3732272 - RNA, 18 nt, Salmonella enterica enterica serovar Typhi Ty2
acucaucgccgcaaugac

SEQ ID NO: 3732273 - RNA, 15 nt, Salmonella enterica enterica serovar Typhi Ty2
acugaguauuggcaa

SEQ ID NO: 3732274 - RNA, 18 nt, Salmonella enterica enterica serovar Typhi Ty2
acugauaagggccuucau

SEQ ID NO: 3732275 - RNA, 18 nt, Salmonella enterica enterica serovar Typhi Ty2
acugauacagccaaauca

SEQ ID NO: 3732276 - RNA, 19 nt, Salmonella enterica enterica serovar Typhi Ty2
acugauacuggauaaccgc

SEQ ID NO: 3732277 - RNA, 17 nt, Salmonella enterica enterica serovar Typhi Ty2
acugauagcgaggcagc

SEQ ID NO: 3732278 - RNA, 19 nt, Salmonella enterica enterica serovar Typhi Ty2
acugaucaauuugccuuua

SEQ ID NO: 3732279 - RNA, 17 nt, Salmonella enterica enterica serovar Typhi Ty2
acugaucgccuaagauc

SEQ ID NO: 3732280 - RNA, 22 nt, Salmonella enterica enterica serovar Typhi Ty2
acugaucgccuaagaucgggug

SEQ ID NO: 3732281 - RNA, 20 nt, Salmonella enterica enterica serovar Typhi Ty2
acugaucgcuggugcccggu

SEQ ID NO: 3732282 - RNA, 14 nt, Salmonella enterica enterica serovar Typhi Ty2
acugaugccagccg

SEQ ID NO: 3732283 - RNA, 21 nt, Salmonella enterica enterica serovar Typhi Ty2
acugauggcgcuaagccagcc

SEQ ID NO: 3732284 - RNA, 17 nt, Salmonella enterica enterica serovar Typhi Ty2
acugauucaaaagguga

SEQ ID NO: 3732285 - RNA, 21 nt, Salmonella enterica enterica serovar Typhi Ty2
acugauuucgccccacuggcc

SEQ ID NO: 3732286 - RNA, 15 nt, Salmonella enterica enterica serovar Typhi Ty2
acugauuucggaaug

SEQ ID NO: 3732287 - RNA, 19 nt, Salmonella enterica enterica serovar Typhi Ty2
acugcaaauaccacaucag

SEQ ID NO: 3732288 - RNA, 14 nt, Salmonella enterica enterica serovar Typhi Ty2
acugcaaaucugcc

SEQ ID NO: 3732289 - RNA, 20 nt, Salmonella enterica enterica serovar Typhi Ty2
acugcaaaucugccgucauc

SEQ ID NO: 3732290 - RNA, 13 nt, Salmonella enterica enterica serovar Typhi Ty2
acugcaacgccag

SEQ ID NO: 3732291 - RNA, 16 nt, Salmonella enterica enterica serovar Typhi Ty2
acugcaacgccagaug

SEQ ID NO: 3732292 - RNA, 19 nt, Salmonella enterica enterica serovar Typhi Ty2
acugcacgccaggguaaua

SEQ ID NO: 3732293 - RNA, 22 nt, Salmonella enterica enterica serovar Typhi Ty2
acugcacgccaggguaauacug

SEQ ID NO: 3732294 - RNA, 20 nt, Salmonella enterica enterica serovar Typhi Ty2
acugcacuuccugcgucagg

SEQ ID NO: 3732295 - RNA, 14 nt, Salmonella enterica enterica serovar Typhi Ty2
acugccaaccauua

SEQ ID NO: 3732296 - RNA, 15 nt, Salmonella enterica enterica serovar Typhi Ty2
acugccagcgucgcu

SEQ ID NO: 3732297 - RNA, 14 nt, Salmonella enterica enterica serovar Typhi Ty2
acugcccaaauaaa

SEQ ID NO: 3732298 - RNA, 14 nt, Salmonella enterica enterica serovar Typhi Ty2
acugcccagccgcc

SEQ ID NO: 3732299 - RNA, 12 nt, Salmonella enterica enterica serovar Typhi Ty2
acugcccggcau

SEQ ID NO: 3732300 - RNA, 15 nt, Salmonella enterica enterica serovar Typhi Ty2
acugcccguggcgga

SEQ ID NO: 3732301 - RNA, 22 nt, Salmonella enterica enterica serovar Typhi Ty2
acugcccuacgcuucucuccau

SEQ ID NO: 3732302 - RNA, 17 nt, Salmonella enterica enterica serovar Typhi Ty2
acugcccugaccggcug

SEQ ID NO: 3732303 - RNA, 17 nt, Salmonella enterica enterica serovar Typhi Ty2
acugccgccacgccgcu

SEQ ID NO: 3732304 - RNA, 13 nt, Salmonella enterica enterica serovar Typhi Ty2
acugccgccaucg

SEQ ID NO: 3732305 - RNA, 14 nt, Salmonella enterica enterica serovar Typhi Ty2
acugccgcccaucg

SEQ ID NO: 3732306 - RNA, 18 nt, Salmonella enterica enterica serovar Typhi Ty2
acugccgccgucaucugc

SEQ ID NO: 3732307 - RNA, 23 nt, Salmonella enterica enterica serovar Typhi Ty2
acugcgaacgcaucaaagccacc

SEQ ID NO: 3732308 - RNA, 15 nt, Salmonella enterica enterica serovar Typhi Ty2
acugcgccaucuucc

SEQ ID NO: 3732309 - RNA, 16 nt, Salmonella enterica enterica serovar Typhi Ty2
acugcgccauguucau

SEQ ID NO: 3732310 - RNA, 22 nt, Salmonella enterica enterica serovar Typhi Ty2
acugcgccgccagcgacauggc

SEQ ID NO: 3732311 - RNA, 15 nt, Salmonella enterica enterica serovar Typhi Ty2
acugcgcgcccgccu

SEQ ID NO: 3732312 - RNA, 16 nt, Salmonella enterica enterica serovar Typhi Ty2
acugcgcgcccgccuc

SEQ ID NO: 3732313 - RNA, 23 nt, Salmonella enterica enterica serovar Typhi Ty2
acugcgcgccgcccugcaucaug

SEQ ID NO: 3732314 - RNA, 20 nt, Salmonella enterica enterica serovar Typhi Ty2
acugcgcggcaaugagcggc

SEQ ID NO: 3732315 - RNA, 20 nt, Salmonella enterica enterica serovar Typhi Ty2
acugcgcucuaucaccgccc

SEQ ID NO: 3732316 - RNA, 18 nt, Salmonella enterica enterica serovar Typhi Ty2
acugcggcauuacgcgcc

SEQ ID NO: 3732317 - RNA, 16 nt, Salmonella enterica enterica serovar Typhi Ty2
acugcgugagugugga

SEQ ID NO: 3732318 - RNA, 22 nt, Salmonella enterica enterica serovar Typhi Ty2
acugcguuugaaauaccaggcg

SEQ ID NO: 3732319 - RNA, 15 nt, Salmonella enterica enterica serovar Typhi Ty2
acugcuccgccggag

SEQ ID NO: 3732320 - RNA, 12 nt, Salmonella enterica enterica serovar Typhi Ty2
acugcuccggca

SEQ ID NO: 3732321 - RNA, 21 nt, Salmonella enterica enterica serovar Typhi Ty2
acugcucguaaagcaucagac

SEQ ID NO: 3732322 - RNA, 21 nt, Salmonella enterica enterica serovar Typhi Ty2
acugcucguuaaauccuccca

SEQ ID NO: 3732323 - RNA, 12 nt, Salmonella enterica enterica serovar Typhi Ty2
acugcugacucu

SEQ ID NO: 3732324 - RNA, 17 nt, Salmonella enterica enterica serovar Typhi Ty2
acugcugguaaauccaa

SEQ ID NO: 3732325 - RNA, 23 nt, Salmonella enterica enterica serovar Typhi Ty2
acugcuguguccaggucaucacc

SEQ ID NO: 3732326 - RNA, 20 nt, Salmonella enterica enterica serovar Typhi Ty2
acugcuuagcucaucagccu

SEQ ID NO: 3732327 - RNA, 20 nt, Salmonella enterica enterica serovar Typhi Ty2
acugcuuuuccggcagcgca

SEQ ID NO: 3732328 - RNA, 15 nt, Salmonella enterica enterica serovar Typhi Ty2
acuggaaacagccaa

SEQ ID NO: 3732329 - RNA, 20 nt, Salmonella enterica enterica serovar Typhi Ty2
acuggaauaguuacggacau

SEQ ID NO: 3732330 - RNA, 21 nt, Salmonella enterica enterica serovar Typhi Ty2
acuggaucaccugaaugcaaa

SEQ ID NO: 3732331 - RNA, 12 nt, Salmonella enterica enterica serovar Typhi Ty2
acuggauuaucg

SEQ ID NO: 3732332 - RNA, 15 nt, Salmonella enterica enterica serovar Typhi Ty2
acuggcaaucaugcg

SEQ ID NO: 3732333 - RNA, 17 nt, Salmonella enterica enterica serovar Typhi Ty2
acuggcagcagugacau

SEQ ID NO: 3732334 - RNA, 15 nt, Salmonella enterica enterica serovar Typhi Ty2
acuggcauugugagc

SEQ ID NO: 3732335 - RNA, 16 nt, Salmonella enterica enterica serovar Typhi Ty2
acuggcccccuguucc

SEQ ID NO: 3732336 - RNA, 16 nt, Salmonella enterica enterica serovar Typhi Ty2
acuggccccgcauuuu

SEQ ID NO: 3732337 - RNA, 20 nt, Salmonella enterica enterica serovar Typhi Ty2
acuggccguuuucccggcaa

SEQ ID NO: 3732338 - RNA, 15 nt, Salmonella enterica enterica serovar Typhi Ty2
acuggcgaccgccac

SEQ ID NO: 3732339 - RNA, 16 nt, Salmonella enterica enterica serovar Typhi Ty2
acuggcgaccggcagc

SEQ ID NO: 3732340 - RNA, 21 nt, Salmonella enterica enterica serovar Typhi Ty2
acuggcgcaucuggucauggc

SEQ ID NO: 3732341 - RNA, 13 nt, Salmonella enterica enterica serovar Typhi Ty2
acuggcgccggag

SEQ ID NO: 3732342 - RNA, 21 nt, Salmonella enterica enterica serovar Typhi Ty2
acuggcgccuuuuggcagcag

SEQ ID NO: 3732343 - RNA, 21 nt, Salmonella enterica enterica serovar Typhi Ty2
acuggcggcaaaaacgccggu

SEQ ID NO: 3732344 - RNA, 17 nt, Salmonella enterica enterica serovar Typhi Ty2
acuggcuuuccugauca

SEQ ID NO: 3732345 - RNA, 20 nt, Salmonella enterica enterica serovar Typhi Ty2
acuggguaaggcgcuugccu

SEQ ID NO: 3732346 - RNA, 23 nt, Salmonella enterica enterica serovar Typhi Ty2
acugggucgauguaguugccgcc

SEQ ID NO: 3732347 - RNA, 16 nt, Salmonella enterica enterica serovar Typhi Ty2
acugguaaccuguucc

SEQ ID NO: 3732348 - RNA, 19 nt, Salmonella enterica enterica serovar Typhi Ty2
acugguuaaggaugacuaa

SEQ ID NO: 3732349 - RNA, 14 nt, Salmonella enterica enterica serovar Typhi Ty2
acuguaaaucugcc

SEQ ID NO: 3732350 - RNA, 20 nt, Salmonella enterica enterica serovar Typhi Ty2
acuguaaaucugccgucauc

SEQ ID NO: 3732351 - RNA, 13 nt, Salmonella enterica enterica serovar Typhi Ty2
acuguaaccggcg

SEQ ID NO: 3732352 - RNA, 21 nt, Salmonella enterica enterica serovar Typhi Ty2
acuguacgccacggcuuaaau

SEQ ID NO: 3732353 - RNA, 18 nt, Salmonella enterica enterica serovar Typhi Ty2
acuguacgcgggaaauac

SEQ ID NO: 3732354 - RNA, 16 nt, Salmonella enterica enterica serovar Typhi Ty2
acuguagcaacugcca

SEQ ID NO: 3732355 - RNA, 17 nt, Salmonella enterica enterica serovar Typhi Ty2
acuuucuugccacuggc

SEQ ID NO: 3732356 - RNA, 18 nt, Salmonella enterica enterica serovar Typhi Ty2
acuuucuugccacuggcc

SEQ ID NO: 3732357 - RNA, 15 nt, Salmonella enterica enterica serovar Typhi Ty2
acuuugaccagcauc

SEQ ID NO: 3732358 - RNA, 17 nt, Salmonella enterica enterica serovar Typhi Ty2
acuuugaccagcaucgc

SEQ ID NO: 3732359 - RNA, 16 nt, Salmonella enterica enterica serovar Typhi Ty2
acuuugccaugaauaa

SEQ ID NO: 3732360 - RNA, 17 nt, Salmonella enterica enterica serovar Typhi Ty2
acuuugcuuuucugcuu

SEQ ID NO: 3732361 - RNA, 22 nt, Salmonella enterica enterica serovar Typhi Ty2
acuuuggccuaacagucgcgcc

SEQ ID NO: 3732362 - RNA, 17 nt, Salmonella enterica enterica serovar Typhi Ty2
acuuuuaaauugaagag

SEQ ID NO: 3732363 - RNA, 15 nt, Salmonella enterica enterica serovar Typhi Ty2
acuuuuagaauuauc

SEQ ID NO: 3732364 - RNA, 16 nt, Salmonella enterica enterica serovar Typhi Ty2
acuuuucgccccggac

SEQ ID NO: 3732365 - RNA, 17 nt, Salmonella enterica enterica serovar Typhi Ty2
acuuuucuuuccugcaa

SEQ ID NO: 3732366 - RNA, 13 nt, Salmonella enterica enterica serovar Typhi Ty2
acuuuugaacaua

SEQ ID NO: 3732367 - RNA, 23 nt, Salmonella enterica enterica serovar Typhi Ty2
acuuuugaacauaaagucagaca

SEQ ID NO: 3732368 - RNA, 22 nt, Salmonella enterica enterica serovar Typhi Ty2
acuuuugccaggcggauaaaac

SEQ ID NO: 3732369 - RNA, 16 nt, Salmonella enterica enterica serovar Typhi Ty2
acuuuuuuaaauguuu

SEQ ID NO: 3732370 - RNA, 17 nt, Salmonella enterica enterica serovar Typhi Ty2
acuuuuuuaaauguuuu

SEQ ID NO: 3732371 - RNA, 12 nt, Salmonella enterica enterica serovar Typhi Ty2
agaaaaaauuaa

SEQ ID NO: 3732372 - RNA, 22 nt, Salmonella enterica enterica serovar Typhi Ty2
agaaaaagaccgacaucgccag

SEQ ID NO: 3732373 - RNA, 22 nt, Salmonella enterica enterica serovar Typhi Ty2
agaaaaauuuaagccagaugua

SEQ ID NO: 3732374 - RNA, 23 nt, Salmonella enterica enterica serovar Typhi Ty2
agaaaacagcaugguguuaguuu

SEQ ID NO: 3732375 - RNA, 23 nt, Salmonella enterica enterica serovar Typhi Ty2
agaaaacagugauuacaaaaugu

SEQ ID NO: 3732376 - RNA, 19 nt, Salmonella enterica enterica serovar Typhi Ty2
agaaaaccgacagcaauau

SEQ ID NO: 3732377 - RNA, 19 nt, Salmonella enterica enterica serovar Typhi Ty2
agaaaacuuucauuucacu

SEQ ID NO: 3732378 - RNA, 12 nt, Salmonella enterica enterica serovar Typhi Ty2
agaaaagcagag

SEQ ID NO: 3732379 - RNA, 16 nt, Salmonella enterica enterica serovar Typhi Ty2
agaaaagcgaaaauaa

SEQ ID NO: 3732380 - RNA, 15 nt, Salmonella enterica enterica serovar Typhi Ty2
agaaaauaacaauau

SEQ ID NO: 3732381 - RNA, 18 nt, Salmonella enterica enterica serovar Typhi Ty2
agaaaauaacaauauuaa

SEQ ID NO: 3732382 - RNA, 13 nt, Salmonella enterica enterica serovar Typhi Ty2
agaaaauaauuca

SEQ ID NO: 3732383 - RNA, 20 nt, Salmonella enterica enterica serovar Typhi Ty2
agaaaauaauucuuaaccca

SEQ ID NO: 3732384 - RNA, 13 nt, Salmonella enterica enterica serovar Typhi Ty2
agaaaauauauug

SEQ ID NO: 3732385 - RNA, 13 nt, Salmonella enterica enterica serovar Typhi Ty2
agaaacaacacga

SEQ ID NO: 3732386 - RNA, 15 nt, Salmonella enterica enterica serovar Typhi Ty2
agaaacaccagaaug

SEQ ID NO: 3732387 - RNA, 23 nt, Salmonella enterica enterica serovar Typhi Ty2
agaaacaucaucguuugcgcgca

SEQ ID NO: 3732388 - RNA, 19 nt, Salmonella enterica enterica serovar Typhi Ty2
agaaaccaucuugcguuau

SEQ ID NO: 3732389 - RNA, 14 nt, Salmonella enterica enterica serovar Typhi Ty2
agaaaccgcagaaa

SEQ ID NO: 3732390 - RNA, 16 nt, Salmonella enterica enterica serovar Typhi Ty2
agaaaccgcagaaaaa

SEQ ID NO: 3732391 - RNA, 15 nt, Salmonella enterica enterica serovar Typhi Ty2
agaaacgcuuuccgg

SEQ ID NO: 3732392 - RNA, 17 nt, Salmonella enterica enterica serovar Typhi Ty2
agaaacugcuguagcac

SEQ ID NO: 3732393 - RNA, 23 nt, Salmonella enterica enterica serovar Typhi Ty2
agaaagcauuaaaucaucauaau

SEQ ID NO: 3732394 - RNA, 23 nt, Salmonella enterica enterica serovar Typhi Ty2
agaaagcgaauggcgugaagcca

SEQ ID NO: 3732395 - RNA, 23 nt, Salmonella enterica enterica serovar Typhi Ty2
agaaaguaggcgguuucaucgag

SEQ ID NO: 3732396 - RNA, 21 nt, Salmonella enterica enterica serovar Typhi Ty2
agaaaguaguauccccggcaa

SEQ ID NO: 3732397 - RNA, 20 nt, Salmonella enterica enterica serovar Typhi Ty2
agaaagucgcaauauaaaua

SEQ ID NO: 3732398 - RNA, 12 nt, Salmonella enterica enterica serovar Typhi Ty2
agaaauaaaaua

SEQ ID NO: 3732399 - RNA, 14 nt, Salmonella enterica enterica serovar Typhi Ty2
agaaauaaaauacg

SEQ ID NO: 3732400 - RNA, 14 nt, Salmonella enterica enterica serovar Typhi Ty2
agaaauaacucccu

SEQ ID NO: 3732401 - RNA, 14 nt, Salmonella enterica enterica serovar Typhi Ty2
agaaauauuuugcc

SEQ ID NO: 3732402 - RNA, 13 nt, Salmonella enterica enterica serovar Typhi Ty2
agaaauccacauu

SEQ ID NO: 3732403 - RNA, 14 nt, Salmonella enterica enterica serovar Typhi Ty2
agaaauccgcgaau

SEQ ID NO: 3732404 - RNA, 22 nt, Salmonella enterica enterica serovar Typhi Ty2
agaaaucucaucugcaaaauau

SEQ ID NO: 3732405 - RNA, 13 nt, Salmonella enterica enterica serovar Typhi Ty2
agaaaucugaaug

SEQ ID NO: 3732406 - RNA, 17 nt, Salmonella enterica enterica serovar Typhi Ty2
agaaauguccauaaaua

SEQ ID NO: 3732407 - RNA, 21 nt, Salmonella enterica enterica serovar Typhi Ty2
agaaauuauuuuaaauuuccu

SEQ ID NO: 3732408 - RNA, 23 nt, Salmonella enterica enterica serovar Typhi Ty2
agaaauugcagggugcagcaaau

SEQ ID NO: 3732409 - RNA, 23 nt, Salmonella enterica enterica serovar Typhi Ty2
agaaauuuaggucaaaaaagcga

SEQ ID NO: 3732410 - RNA, 14 nt, Salmonella enterica enterica serovar Typhi Ty2
agaacagcuggugc

SEQ ID NO: 3732411 - RNA, 19 nt, Salmonella enterica enterica serovar Typhi Ty2
agaacauuucccgaaaaaa

SEQ ID NO: 3732412 - RNA, 23 nt, Salmonella enterica enterica serovar Typhi Ty2
agaaccacuuauuuguauugacg

SEQ ID NO: 3732413 - RNA, 14 nt, Salmonella enterica enterica serovar Typhi Ty2
agaaccacuugaac

SEQ ID NO: 3732414 - RNA, 19 nt, Salmonella enterica enterica serovar Typhi Ty2
agaaccguugcgcccauca

SEQ ID NO: 3732415 - RNA, 13 nt, Salmonella enterica enterica serovar Typhi Ty2
agaacgaauuuac

SEQ ID NO: 3732416 - RNA, 20 nt, Salmonella enterica enterica serovar Typhi Ty2
agaacgacgaauaagcugaa

SEQ ID NO: 3732417 - RNA, 21 nt, Salmonella enterica enterica serovar Typhi Ty2
agaacgacgcauaaaaaauga

SEQ ID NO: 3732418 - RNA, 13 nt, Salmonella enterica enterica serovar Typhi Ty2
agaacgccgggcc

SEQ ID NO: 3732419 - RNA, 21 nt, Salmonella enterica enterica serovar Typhi Ty2
agaacggaaguugcauauaag

SEQ ID NO: 3732420 - RNA, 22 nt, Salmonella enterica enterica serovar Typhi Ty2
agaacggauauccagaaucaca

SEQ ID NO: 3732421 - RNA, 15 nt, Salmonella enterica enterica serovar Typhi Ty2
agaacguauuauuau

SEQ ID NO: 3732422 - RNA, 22 nt, Salmonella enterica enterica serovar Typhi Ty2
agaacguugacguuucagucac

SEQ ID NO: 3732423 - RNA, 21 nt, Salmonella enterica enterica serovar Typhi Ty2
agaacguugccgcaggcaacg

SEQ ID NO: 3732424 - RNA, 16 nt, Salmonella enterica enterica serovar Typhi Ty2
agaacucacgcucaag

SEQ ID NO: 3732425 - RNA, 12 nt, Salmonella enterica enterica serovar Typhi Ty2
agaacucaucuu

SEQ ID NO: 3732426 - RNA, 22 nt, Salmonella enterica enterica serovar Typhi Ty2
agaacugcugcauccgcgcuuu

SEQ ID NO: 3732427 - RNA, 16 nt, Salmonella enterica enterica serovar Typhi Ty2
agaacuggcgcgauga

SEQ ID NO: 3732428 - RNA, 14 nt, Salmonella enterica enterica serovar Typhi Ty2
agaacuuccgccac

SEQ ID NO: 3732429 - RNA, 17 nt, Salmonella enterica enterica serovar Typhi Ty2
agaacuuguaaaaaugc

SEQ ID NO: 3732430 - RNA, 16 nt, Salmonella enterica enterica serovar Typhi Ty2
agaagaauaagccgga

SEQ ID NO: 3732431 - RNA, 17 nt, Salmonella enterica enterica serovar Typhi Ty2
agaagaaucgccccauu

SEQ ID NO: 3732432 - RNA, 16 nt, Salmonella enterica enterica serovar Typhi Ty2
agaagacagaagcuga

SEQ ID NO: 3732433 - RNA, 20 nt, Salmonella enterica enterica serovar Typhi Ty2
agaagcacgacacaaaagca

SEQ ID NO: 3732434 - RNA, 15 nt, Salmonella enterica enterica serovar Typhi Ty2
agaagcccggccaca

SEQ ID NO: 3732435 - RNA, 19 nt, Salmonella enterica enterica serovar Typhi Ty2
agaagcucaugugcagcau

SEQ ID NO: 3732436 - RNA, 22 nt, Salmonella enterica enterica serovar Typhi Ty2
agaagcucaugugcagcaucca

SEQ ID NO: 3732437 - RNA, 19 nt, Salmonella enterica enterica serovar Typhi Ty2
agacauugguuucaugcau

SEQ ID NO: 3732438 - RNA, 16 nt, Salmonella enterica enterica serovar Typhi Ty2
agacauuuugaguugc

SEQ ID NO: 3732439 - RNA, 19 nt, Salmonella enterica enterica serovar Typhi Ty2
agaccaauacgaucggcug

SEQ ID NO: 3732440 - RNA, 15 nt, Salmonella enterica enterica serovar Typhi Ty2
agaccaccagcgaca

SEQ ID NO: 3732441 - RNA, 17 nt, Salmonella enterica enterica serovar Typhi Ty2
agaccacgaaucaggau

SEQ ID NO: 3732442 - RNA, 23 nt, Salmonella enterica enterica serovar Typhi Ty2
agaccacgccaucaacagcggag

SEQ ID NO: 3732443 - RNA, 21 nt, Salmonella enterica enterica serovar Typhi Ty2
agaccacuaacccggcgaccg

SEQ ID NO: 3732444 - RNA, 23 nt, Salmonella enterica enterica serovar Typhi Ty2
agaccagaaucccacggagaaaa

SEQ ID NO: 3732445 - RNA, 15 nt, Salmonella enterica enterica serovar Typhi Ty2
agaccauccaugaaa

SEQ ID NO: 3732446 - RNA, 16 nt, Salmonella enterica enterica serovar Typhi Ty2
agaccauccaugaaau

SEQ ID NO: 3732447 - RNA, 13 nt, Salmonella enterica enterica serovar Typhi Ty2
agacccaauaugc

SEQ ID NO: 3732448 - RNA, 21 nt, Salmonella enterica enterica serovar Typhi Ty2
agacccacauauugcgcuuca

SEQ ID NO: 3732449 - RNA, 14 nt, Salmonella enterica enterica serovar Typhi Ty2
agacccaggcgcgu

SEQ ID NO: 3732450 - RNA, 18 nt, Salmonella enterica enterica serovar Typhi Ty2
agacccaguacaaacaaa

SEQ ID NO: 3732451 - RNA, 19 nt, Salmonella enterica enterica serovar Typhi Ty2
agacccaguacaaacaaau

SEQ ID NO: 3732452 - RNA, 15 nt, Salmonella enterica enterica serovar Typhi Ty2
agaccccgcaucgcc

SEQ ID NO: 3732453 - RNA, 17 nt, Salmonella enterica enterica serovar Typhi Ty2
agacccgcaauaacgcc

SEQ ID NO: 3732454 - RNA, 11 nt, Salmonella enterica enterica serovar Typhi Ty2
agacccggcau

SEQ ID NO: 3732455 - RNA, 13 nt, Salmonella enterica enterica serovar Typhi Ty2
agacccggcauug

SEQ ID NO: 3732456 - RNA, 14 nt, Salmonella enterica enterica serovar Typhi Ty2
agaccgacaaaacu

SEQ ID NO: 3732457 - RNA, 23 nt, Salmonella enterica enterica serovar Typhi Ty2
agaccgccgcuuucaaaaccgac

SEQ ID NO: 3732458 - RNA, 16 nt, Salmonella enterica enterica serovar Typhi Ty2
agaccgccuaacagcg

SEQ ID NO: 3732459 - RNA, 20 nt, Salmonella enterica enterica serovar Typhi Ty2
agaccgcugcggaacaccag

SEQ ID NO: 3732460 - RNA, 23 nt, Salmonella enterica enterica serovar Typhi Ty2
agaccggagcgugcuucaacggu

SEQ ID NO: 3732461 - RNA, 18 nt, Salmonella enterica enterica serovar Typhi Ty2
agaccggcaaucaauaca

SEQ ID NO: 3732462 - RNA, 15 nt, Salmonella enterica enterica serovar Typhi Ty2
agaccggcagccugc

SEQ ID NO: 3732463 - RNA, 17 nt, Salmonella enterica enterica serovar Typhi Ty2
agaccggcaucucaucu

SEQ ID NO: 3732464 - RNA, 16 nt, Salmonella enterica enterica serovar Typhi Ty2
agaccggcgaaaucgu

SEQ ID NO: 3732465 - RNA, 16 nt, Salmonella enterica enterica serovar Typhi Ty2
agaccgugaauaagau

SEQ ID NO: 3732466 - RNA, 23 nt, Salmonella enterica enterica serovar Typhi Ty2
agaccguggaucucgucgccggu

SEQ ID NO: 3732467 - RNA, 14 nt, Salmonella enterica enterica serovar Typhi Ty2
agaccucugcaaac

SEQ ID NO: 3732468 - RNA, 16 nt, Salmonella enterica enterica serovar Typhi Ty2
agaccuguaaaaaaac

SEQ ID NO: 3732469 - RNA, 23 nt, Salmonella enterica enterica serovar Typhi Ty2
agaccuuaucgcagucagccuug

SEQ ID NO: 3732470 - RNA, 14 nt, Salmonella enterica enterica serovar Typhi Ty2
agaccuucaaccca

SEQ ID NO: 3732471 - RNA, 20 nt, Salmonella enterica enterica serovar Typhi Ty2
agaccuucaacccagcagca

SEQ ID NO: 3732472 - RNA, 18 nt, Salmonella enterica enterica serovar Typhi Ty2
agaccuuuuacuucacgu

SEQ ID NO: 3732473 - RNA, 17 nt, Salmonella enterica enterica serovar Typhi Ty2
agacgaagcgcaaacgg

SEQ ID NO: 3732474 - RNA, 16 nt, Salmonella enterica enterica serovar Typhi Ty2
agacgacaucuuuucc

SEQ ID NO: 3732475 - RNA, 18 nt, Salmonella enterica enterica serovar Typhi Ty2
agacgauaaccggacgau

SEQ ID NO: 3732476 - RNA, 19 nt, Salmonella enterica enterica serovar Typhi Ty2
agacgcaucaggaaccaca

SEQ ID NO: 3732477 - RNA, 20 nt, Salmonella enterica enterica serovar Typhi Ty2
agacgcaucuuuuucccggu

SEQ ID NO: 3732478 - RNA, 22 nt, Salmonella enterica enterica serovar Typhi Ty2
agacgcccugcaaagcaaaaau

SEQ ID NO: 3732479 - RNA, 20 nt, Salmonella enterica enterica serovar Typhi Ty2
agacgccgaaccuggcgggc

SEQ ID NO: 3732480 - RNA, 19 nt, Salmonella enterica enterica serovar Typhi Ty2
agacgccgaugagcugaug

SEQ ID NO: 3732481 - RNA, 18 nt, Salmonella enterica enterica serovar Typhi Ty2
agacgccgcgcugcggcg

SEQ ID NO: 3732482 - RNA, 14 nt, Salmonella enterica enterica serovar Typhi Ty2
agacgcgcagcacc

SEQ ID NO: 3732483 - RNA, 19 nt, Salmonella enterica enterica serovar Typhi Ty2
agacgcuccgcaguaauca

SEQ ID NO: 3732484 - RNA, 20 nt, Salmonella enterica enterica serovar Typhi Ty2
agacgcugaaaagcgucuuu

SEQ ID NO: 3732485 - RNA, 19 nt, Salmonella enterica enterica serovar Typhi Ty2
agacgcuggcacuggcagc

SEQ ID NO: 3732486 - RNA, 19 nt, Salmonella enterica enterica serovar Typhi Ty2
agacgcuuacaucgccauc

SEQ ID NO: 3732487 - RNA, 20 nt, Salmonella enterica enterica serovar Typhi Ty2
agacgcuuuucagcgucuuu

SEQ ID NO: 3732488 - RNA, 13 nt, Salmonella enterica enterica serovar Typhi Ty2
agacggccaccca

SEQ ID NO: 3732489 - RNA, 17 nt, Salmonella enterica enterica serovar Typhi Ty2
agacggcggcuuaccga

SEQ ID NO: 3732490 - RNA, 22 nt, Salmonella enterica enterica serovar Typhi Ty2
agacggcggcuuaccgaaucuu

SEQ ID NO: 3732491 - RNA, 14 nt, Salmonella enterica enterica serovar Typhi Ty2
agacgggccaggcg

SEQ ID NO: 3732492 - RNA, 23 nt, Salmonella enterica enterica serovar Typhi Ty2
agacggugaaucagauaacugag

SEQ ID NO: 3732493 - RNA, 19 nt, Salmonella enterica enterica serovar Typhi Ty2
agacgguuauuuuucagau

SEQ ID NO: 3732494 - RNA, 17 nt, Salmonella enterica enterica serovar Typhi Ty2
agacgucggcaccgaau

SEQ ID NO: 3732495 - RNA, 19 nt, Salmonella enterica enterica serovar Typhi Ty2
agacguuuauaccccacca

SEQ ID NO: 3732496 - RNA, 14 nt, Salmonella enterica enterica serovar Typhi Ty2
agacuaaaaagcgc

SEQ ID NO: 3732497 - RNA, 17 nt, Salmonella enterica enterica serovar Typhi Ty2
agacuaaaacgugcuga

SEQ ID NO: 3732498 - RNA, 21 nt, Salmonella enterica enterica serovar Typhi Ty2
agacuacuuuuacccuucaga

SEQ ID NO: 3732499 - RNA, 20 nt, Salmonella enterica enterica serovar Typhi Ty2
agacuauccagccagggauc

SEQ ID NO: 3732500 - RNA, 23 nt, Salmonella enterica enterica serovar Typhi Ty2
agacuauccguccucuuucccuu

SEQ ID NO: 3732501 - RNA, 18 nt, Salmonella enterica enterica serovar Typhi Ty2
agacucaccccuucuuua

SEQ ID NO: 3732502 - RNA, 13 nt, Salmonella enterica enterica serovar Typhi Ty2
agacucagccagg

SEQ ID NO: 3732503 - RNA, 18 nt, Salmonella enterica enterica serovar Typhi Ty2
agacucagccaggucugc

SEQ ID NO: 3732504 - RNA, 16 nt, Salmonella enterica enterica serovar Typhi Ty2
agacucagcgacugaa

SEQ ID NO: 3732505 - RNA, 17 nt, Salmonella enterica enterica serovar Typhi Ty2
agacuccgucaaagaaa

SEQ ID NO: 3732506 - RNA, 20 nt, Salmonella enterica enterica serovar Typhi Ty2
agacucgcucccuuccccca

SEQ ID NO: 3732507 - RNA, 13 nt, Salmonella enterica enterica serovar Typhi Ty2
agacugauaucca

SEQ ID NO: 3732508 - RNA, 16 nt, Salmonella enterica enterica serovar Typhi Ty2
agacugauauccauug

SEQ ID NO: 3732509 - RNA, 14 nt, Salmonella enterica enterica serovar Typhi Ty2
agacugcacuuccu

SEQ ID NO: 3732510 - RNA, 16 nt, Salmonella enterica enterica serovar Typhi Ty2
agacugcacuuccugc

SEQ ID NO: 3732511 - RNA, 14 nt, Salmonella enterica enterica serovar Typhi Ty2
agacugcuccggca

SEQ ID NO: 3732512 - RNA, 22 nt, Salmonella enterica enterica serovar Typhi Ty2
agacuggguaagcgcagcgcca

SEQ ID NO: 3732513 - RNA, 17 nt, Salmonella enterica enterica serovar Typhi Ty2
agacugugauggcgguc

SEQ ID NO: 3732514 - RNA, 18 nt, Salmonella enterica enterica serovar Typhi Ty2
agacuuaggaaugcccag

SEQ ID NO: 3732515 - RNA, 20 nt, Salmonella enterica enterica serovar Typhi Ty2
agacuuagggcggagauacc

SEQ ID NO: 3732516 - RNA, 12 nt, Salmonella enterica enterica serovar Typhi Ty2
agacuucaacgc

SEQ ID NO: 3732517 - RNA, 22 nt, Salmonella enterica enterica serovar Typhi Ty2
agacuucaacgccgcacacuca

SEQ ID NO: 3732518 - RNA, 14 nt, Salmonella enterica enterica serovar Typhi Ty2
agacuucuucaguc

SEQ ID NO: 3732519 - RNA, 15 nt, Salmonella enterica enterica serovar Typhi Ty2
agauaaaaaagcugc

SEQ ID NO: 3732520 - RNA, 21 nt, Salmonella enterica enterica serovar Typhi Ty2
agauaaaacugcugacaauca

SEQ ID NO: 3732521 - RNA, 22 nt, Salmonella enterica enterica serovar Typhi Ty2
agauaaaacugcugacaaucag

SEQ ID NO: 3732522 - RNA, 15 nt, Salmonella enterica enterica serovar Typhi Ty2
agauaaacagcagcg

SEQ ID NO: 3732523 - RNA, 17 nt, Salmonella enterica enterica serovar Typhi Ty2
agauaaacagcagcgcg

SEQ ID NO: 3732524 - RNA, 19 nt, Salmonella enterica enterica serovar Typhi Ty2
agauaaacagguaaaacaa

SEQ ID NO: 3732525 - RNA, 20 nt, Salmonella enterica enterica serovar Typhi Ty2
agauaaacagguaaaacaaa

SEQ ID NO: 3732526 - RNA, 15 nt, Salmonella enterica enterica serovar Typhi Ty2
agauaacgcaucaga

SEQ ID NO: 3732527 - RNA, 19 nt, Salmonella enterica enterica serovar Typhi Ty2
agauaacuauaugcccggg

SEQ ID NO: 3732528 - RNA, 20 nt, Salmonella enterica enterica serovar Typhi Ty2
agauaacugagcuugagcca

SEQ ID NO: 3732529 - RNA, 23 nt, Salmonella enterica enterica serovar Typhi Ty2
agauaacuuccuuugccuuucuu

SEQ ID NO: 3732530 - RNA, 22 nt, Salmonella enterica enterica serovar Typhi Ty2
agauaagccgucauaaaaucaa

SEQ ID NO: 3732531 - RNA, 18 nt, Salmonella enterica enterica serovar Typhi Ty2
agauaagccuccggauga

SEQ ID NO: 3732532 - RNA, 12 nt, Salmonella enterica enterica serovar Typhi Ty2
agauaagcgcca

SEQ ID NO: 3732533 - RNA, 16 nt, Salmonella enterica enterica serovar Typhi Ty2
agauaaguccuaacac

SEQ ID NO: 3732534 - RNA, 18 nt, Salmonella enterica enterica serovar Typhi Ty2
agauaauagcugaaaaga

SEQ ID NO: 3732535 - RNA, 22 nt, Salmonella enterica enterica serovar Typhi Ty2
agauaauccagcgucgccagca

SEQ ID NO: 3732536 - RNA, 12 nt, Salmonella enterica enterica serovar Typhi Ty2
agauaaugccgc

SEQ ID NO: 3732537 - RNA, 20 nt, Salmonella enterica enterica serovar Typhi Ty2
agauaaugcucauuauuugg

SEQ ID NO: 3732538 - RNA, 23 nt, Salmonella enterica enterica serovar Typhi Ty2
agauaauuuucccaguucaucca

SEQ ID NO: 3732539 - RNA, 16 nt, Salmonella enterica enterica serovar Typhi Ty2
agauacggcuccagca

SEQ ID NO: 3732540 - RNA, 22 nt, Salmonella enterica enterica serovar Typhi Ty2
agauagcugcuuaccauacuga

SEQ ID NO: 3732541 - RNA, 20 nt, Salmonella enterica enterica serovar Typhi Ty2
agauaggcgcgaaauguccc

SEQ ID NO: 3732542 - RNA, 17 nt, Salmonella enterica enterica serovar Typhi Ty2
agauagucaucaccauu

SEQ ID NO: 3732543 - RNA, 13 nt, Salmonella enterica enterica serovar Typhi Ty2
agauaguggcuga

SEQ ID NO: 3732544 - RNA, 11 nt, Salmonella enterica enterica serovar Typhi Ty2
agauaguuuuu

SEQ ID NO: 3732545 - RNA, 18 nt, Salmonella enterica enterica serovar Typhi Ty2
agauaguuuuuaauucca

SEQ ID NO: 3732546 - RNA, 15 nt, Salmonella enterica enterica serovar Typhi Ty2
agauaucaaacacaa

SEQ ID NO: 3732547 - RNA, 18 nt, Salmonella enterica enterica serovar Typhi Ty2
agauaucaaacacaaauu

SEQ ID NO: 3732548 - RNA, 17 nt, Salmonella enterica enterica serovar Typhi Ty2
agauaucaccaucuuuu

SEQ ID NO: 3732549 - RNA, 16 nt, Salmonella enterica enterica serovar Typhi Ty2
agauaucagucugcaa

SEQ ID NO: 3732550 - RNA, 20 nt, Salmonella enterica enterica serovar Typhi Ty2
agauaugaaaugagaccaau

SEQ ID NO: 3732551 - RNA, 22 nt, Salmonella enterica enterica serovar Typhi Ty2
agauauuccagcgacaucgcau

SEQ ID NO: 3732552 - RNA, 12 nt, Salmonella enterica enterica serovar Typhi Ty2
agauauucccgg

SEQ ID NO: 3732553 - RNA, 21 nt, Salmonella enterica enterica serovar Typhi Ty2
agauauuuuguuuuaaauuca

SEQ ID NO: 3732554 - RNA, 22 nt, Salmonella enterica enterica serovar Typhi Ty2
agauauuuuguuuuaaauucaa

SEQ ID NO: 3732555 - RNA, 20 nt, Salmonella enterica enterica serovar Typhi Ty2
agaucagcagaacaaaggcu

SEQ ID NO: 3732556 - RNA, 14 nt, Salmonella enterica enterica serovar Typhi Ty2
agaucagcauggua

SEQ ID NO: 3732557 - RNA, 19 nt, Salmonella enterica enterica serovar Typhi Ty2
agaucaggccgauuucauu

SEQ ID NO: 3732558 - RNA, 23 nt, Salmonella enterica enterica serovar Typhi Ty2
agaucauuuacggcgauuugccc

SEQ ID NO: 3732559 - RNA, 14 nt, Salmonella enterica enterica serovar Typhi Ty2
agauccaacacggc

SEQ ID NO: 3732560 - RNA, 17 nt, Salmonella enterica enterica serovar Typhi Ty2
agauccauaagaugaaa

SEQ ID NO: 3732561 - RNA, 19 nt, Salmonella enterica enterica serovar Typhi Ty2
agauccauaagaugaaaga

SEQ ID NO: 3732562 - RNA, 20 nt, Salmonella enterica enterica serovar Typhi Ty2
agauccauaagaugaaagau

SEQ ID NO: 3732563 - RNA, 21 nt, Salmonella enterica enterica serovar Typhi Ty2
agauccauuaaaugcgccagc

SEQ ID NO: 3732564 - RNA, 13 nt, Salmonella enterica enterica serovar Typhi Ty2
agaucccucaccu

SEQ ID NO: 3732565 - RNA, 13 nt, Salmonella enterica enterica serovar Typhi Ty2
agauccgcaagag

SEQ ID NO: 3732566 - RNA, 19 nt, Salmonella enterica enterica serovar Typhi Ty2
agauccggacugauaguca

SEQ ID NO: 3732567 - RNA, 22 nt, Salmonella enterica enterica serovar Typhi Ty2
agauccugcgagcuuuccacca

SEQ ID NO: 3732568 - RNA, 18 nt, Salmonella enterica enterica serovar Typhi Ty2
agauccuggcgaaagcga

SEQ ID NO: 3732569 - RNA, 23 nt, Salmonella enterica enterica serovar Typhi Ty2
agauccuucauucagaucaaaaa

SEQ ID NO: 3732570 - RNA, 17 nt, Salmonella enterica enterica serovar Typhi Ty2
agaucgaaacgguccag

SEQ ID NO: 3732571 - RNA, 23 nt, Salmonella enterica enterica serovar Typhi Ty2
agaucgaaugaaaauguaucaga

SEQ ID NO: 3732572 - RNA, 19 nt, Salmonella enterica enterica serovar Typhi Ty2
agaucgacagcgcgcgcga

SEQ ID NO: 3732573 - RNA, 16 nt, Salmonella enterica enterica serovar Typhi Ty2
agaucgaccagcgcau

SEQ ID NO: 3732574 - RNA, 17 nt, Salmonella enterica enterica serovar Typhi Ty2
agaucgagacgcgucag

SEQ ID NO: 3732575 - RNA, 20 nt, Salmonella enterica enterica serovar Typhi Ty2
agaucgcauaaaauuauaaa

SEQ ID NO: 3732576 - RNA, 17 nt, Salmonella enterica enterica serovar Typhi Ty2
agaucgcgggcaaucaa

SEQ ID NO: 3732577 - RNA, 22 nt, Salmonella enterica enterica serovar Typhi Ty2
agaucgcggggcaacagauacg

SEQ ID NO: 3732578 - RNA, 18 nt, Salmonella enterica enterica serovar Typhi Ty2
agaucgcguacagcgcca

SEQ ID NO: 3732579 - RNA, 12 nt, Salmonella enterica enterica serovar Typhi Ty2
agaucgcugcaa

SEQ ID NO: 3732580 - RNA, 17 nt, Salmonella enterica enterica serovar Typhi Ty2
agaucggcaugauggcg

SEQ ID NO: 3732581 - RNA, 20 nt, Salmonella enterica enterica serovar Typhi Ty2
agaucgguaaaagcguuuag

SEQ ID NO: 3732582 - RNA, 18 nt, Salmonella enterica enterica serovar Typhi Ty2
agaucguaugcgccuguu

SEQ ID NO: 3732583 - RNA, 20 nt, Salmonella enterica enterica serovar Typhi Ty2
agaucguuauuaaacagaca

SEQ ID NO: 3732584 - RNA, 12 nt, Salmonella enterica enterica serovar Typhi Ty2
agaucuaucuga

SEQ ID NO: 3732585 - RNA, 18 nt, Salmonella enterica enterica serovar Typhi Ty2
agaucugucgccgauaau

SEQ ID NO: 3732586 - RNA, 21 nt, Salmonella enterica enterica serovar Typhi Ty2
agaucuuuauccugcacgaag

SEQ ID NO: 3732587 - RNA, 22 nt, Salmonella enterica enterica serovar Typhi Ty2
agaucuuuugcgccuuccaguu

SEQ ID NO: 3732588 - RNA, 14 nt, Salmonella enterica enterica serovar Typhi Ty2
agaucuuuuugcuc

SEQ ID NO: 3732589 - RNA, 17 nt, Salmonella enterica enterica serovar Typhi Ty2
agaugaaacucgcugug

SEQ ID NO: 3732590 - RNA, 17 nt, Salmonella enterica enterica serovar Typhi Ty2
agaugaacguaacguga

SEQ ID NO: 3732591 - RNA, 13 nt, Salmonella enterica enterica serovar Typhi Ty2
agaugaagcgcau

SEQ ID NO: 3732592 - RNA, 22 nt, Salmonella enterica enterica serovar Typhi Ty2
agaugacaaagccggauaucgc

SEQ ID NO: 3732593 - RNA, 19 nt, Salmonella enterica enterica serovar Typhi Ty2
agaugaucguuuccagcau

SEQ ID NO: 3732594 - RNA, 14 nt, Salmonella enterica enterica serovar Typhi Ty2
agaugaugauuuau

SEQ ID NO: 3732595 - RNA, 20 nt, Salmonella enterica enterica serovar Typhi Ty2
agaugaugauuuaugaauag

SEQ ID NO: 3732596 - RNA, 23 nt, Salmonella enterica enterica serovar Typhi Ty2
agaugcggcgccaacgcgcuacc

SEQ ID NO: 3732597 - RNA, 19 nt, Salmonella enterica enterica serovar Typhi Ty2
agaugcucaggcaacacga

SEQ ID NO: 3732598 - RNA, 20 nt, Salmonella enterica enterica serovar Typhi Ty2
agaugcugggcgugucccug

SEQ ID NO: 3732599 - RNA, 13 nt, Salmonella enterica enterica serovar Typhi Ty2
agauggaaaaaaa

SEQ ID NO: 3732600 - RNA, 14 nt, Salmonella enterica enterica serovar Typhi Ty2
agauggaaaaaaag

SEQ ID NO: 3732601 - RNA, 16 nt, Salmonella enterica enterica serovar Typhi Ty2
agauggaaaaaaagaa

SEQ ID NO: 3732602 - RNA, 23 nt, Salmonella enterica enterica serovar Typhi Ty2
agauggcgccauuggcucggcgu

SEQ ID NO: 3732603 - RNA, 21 nt, Salmonella enterica enterica serovar Typhi Ty2
agauggcuaugaagcuggagc

SEQ ID NO: 3732604 - RNA, 16 nt, Salmonella enterica enterica serovar Typhi Ty2
agauguaccagcggca

SEQ ID NO: 3732605 - RNA, 17 nt, Salmonella enterica enterica serovar Typhi Ty2
agauguuaaaguuuuuc

SEQ ID NO: 3732606 - RNA, 16 nt, Salmonella enterica enterica serovar Typhi Ty2
agauguugauacagaa

SEQ ID NO: 3732607 - RNA, 22 nt, Salmonella enterica enterica serovar Typhi Ty2
agauuaacagcgcgaccagcgu

SEQ ID NO: 3732608 - RNA, 17 nt, Salmonella enterica enterica serovar Typhi Ty2
agauuaagaccguauaa

SEQ ID NO: 3732609 - RNA, 15 nt, Salmonella enterica enterica serovar Typhi Ty2
agauuaaucagcaga

SEQ ID NO: 3732610 - RNA, 21 nt, Salmonella enterica enterica serovar Typhi Ty2
agauuacucucuugccagcgc

SEQ ID NO: 3732611 - RNA, 21 nt, Salmonella enterica enterica serovar Typhi Ty2
agauuacuucaggcugccaac

SEQ ID NO: 3732612 - RNA, 17 nt, Salmonella enterica enterica serovar Typhi Ty2
agauuagccaggugacu

SEQ ID NO: 3732613 - RNA, 18 nt, Salmonella enterica enterica serovar Typhi Ty2
agauuagccccagcgcca

SEQ ID NO: 3732614 - RNA, 18 nt, Salmonella enterica enterica serovar Typhi Ty2
agauuagguacguacauc

SEQ ID NO: 3732615 - RNA, 19 nt, Salmonella enterica enterica serovar Typhi Ty2
agauuaugcaguucuucgc

SEQ ID NO: 3732616 - RNA, 19 nt, Salmonella enterica enterica serovar Typhi Ty2
agauuauuuuaucaucagc

SEQ ID NO: 3732617 - RNA, 14 nt, Salmonella enterica enterica serovar Typhi Ty2
agauucuucugccu

SEQ ID NO: 3732618 - RNA, 21 nt, Salmonella enterica enterica serovar Typhi Ty2
agauugagacaaauaacuuuc

SEQ ID NO: 3732619 - RNA, 21 nt, Salmonella enterica enterica serovar Typhi Ty2
agauugauuuauucacuggca

SEQ ID NO: 3732620 - RNA, 13 nt, Salmonella enterica enterica serovar Typhi Ty2
agauuggcaucug

SEQ ID NO: 3732621 - RNA, 19 nt, Salmonella enterica enterica serovar Typhi Ty2
agauuggcccgcccagcau

SEQ ID NO: 3732622 - RNA, 16 nt, Salmonella enterica enterica serovar Typhi Ty2
agauuggugaugcgca

SEQ ID NO: 3732623 - RNA, 17 nt, Salmonella enterica enterica serovar Typhi Ty2
agauugucaccguaaua

SEQ ID NO: 3732624 - RNA, 19 nt, Salmonella enterica enterica serovar Typhi Ty2
agauugucaccguaauaua

SEQ ID NO: 3732625 - RNA, 17 nt, Salmonella enterica enterica serovar Typhi Ty2
agauuguuucggauaau

SEQ ID NO: 3732626 - RNA, 15 nt, Salmonella enterica enterica serovar Typhi Ty2
agauuuacaacagau

SEQ ID NO: 3732627 - RNA, 15 nt, Salmonella enterica enterica serovar Typhi Ty2
agauuuaucaauuuu

SEQ ID NO: 3732628 - RNA, 15 nt, Salmonella enterica enterica serovar Typhi Ty2
agauuuaucuucucu

SEQ ID NO: 3732629 - RNA, 12 nt, Salmonella enterica enterica serovar Typhi Ty2
agauuucaucag

SEQ ID NO: 3732630 - RNA, 13 nt, Salmonella enterica enterica serovar Typhi Ty2
agauuucuuaauu

SEQ ID NO: 3732631 - RNA, 13 nt, Salmonella enterica enterica serovar Typhi Ty2
agauuuucaucau

SEQ ID NO: 3732632 - RNA, 20 nt, Salmonella enterica enterica serovar Typhi Ty2
agauuuucaucauaucugau

SEQ ID NO: 3732633 - RNA, 15 nt, Salmonella enterica enterica serovar Typhi Ty2
agauuuuucgccagg

SEQ ID NO: 3732634 - RNA, 19 nt, Salmonella enterica enterica serovar Typhi Ty2
agauuuuucugcgccacca

SEQ ID NO: 3732635 - RNA, 19 nt, Salmonella enterica enterica serovar Typhi Ty2
agcaaaaaagcgccuuuag

SEQ ID NO: 3732636 - RNA, 15 nt, Salmonella enterica enterica serovar Typhi Ty2
agcaaaaacauuacc

SEQ ID NO: 3732637 - RNA, 14 nt, Salmonella enterica enterica serovar Typhi Ty2
agcaaaaaucacca

SEQ ID NO: 3732638 - RNA, 15 nt, Salmonella enterica enterica serovar Typhi Ty2
agcaaaaaucaccac

SEQ ID NO: 3732639 - RNA, 16 nt, Salmonella enterica enterica serovar Typhi Ty2
agcaaaaucaccauca

SEQ ID NO: 3732640 - RNA, 15 nt, Salmonella enterica enterica serovar Typhi Ty2
agcaaaauggcaauu

SEQ ID NO: 3732641 - RNA, 22 nt, Salmonella enterica enterica serovar Typhi Ty2
agcaaacgaccuuucgccguca

SEQ ID NO: 3732642 - RNA, 17 nt, Salmonella enterica enterica serovar Typhi Ty2
agcaaagcguacaugaa

SEQ ID NO: 3732643 - RNA, 12 nt, Salmonella enterica enterica serovar Typhi Ty2
agcaaaucagcu

SEQ ID NO: 3732644 - RNA, 16 nt, Salmonella enterica enterica serovar Typhi Ty2
agcaaaucgcccauca

SEQ ID NO: 3732645 - RNA, 18 nt, Salmonella enterica enterica serovar Typhi Ty2
agcaaaucgggaaaauga

SEQ ID NO: 3732646 - RNA, 21 nt, Salmonella enterica enterica serovar Typhi Ty2
agcaaauucaggguugucuca

SEQ ID NO: 3732647 - RNA, 13 nt, Salmonella enterica enterica serovar Typhi Ty2
agcaaauugcuga

SEQ ID NO: 3732648 - RNA, 15 nt, Salmonella enterica enterica serovar Typhi Ty2
agcaaauuuaaucau

SEQ ID NO: 3732649 - RNA, 19 nt, Salmonella enterica enterica serovar Typhi Ty2
agcaacagcguaccuuuau

SEQ ID NO: 3732650 - RNA, 21 nt, Salmonella enterica enterica serovar Typhi Ty2
agcaacagugggcuaugaaga

SEQ ID NO: 3732651 - RNA, 16 nt, Salmonella enterica enterica serovar Typhi Ty2
agcaacaguugcugga

SEQ ID NO: 3732652 - RNA, 19 nt, Salmonella enterica enterica serovar Typhi Ty2
agcaaccagcuaaccuguu

SEQ ID NO: 3732653 - RNA, 16 nt, Salmonella enterica enterica serovar Typhi Ty2
agcaacccacuuucgg

SEQ ID NO: 3732654 - RNA, 12 nt, Salmonella enterica enterica serovar Typhi Ty2
agcaacccuuuu

SEQ ID NO: 3732655 - RNA, 16 nt, Salmonella enterica enterica serovar Typhi Ty2
agcaacggaagcugac

SEQ ID NO: 3732656 - RNA, 16 nt, Salmonella enterica enterica serovar Typhi Ty2
agcaacgggcagucug

SEQ ID NO: 3732657 - RNA, 18 nt, Salmonella enterica enterica serovar Typhi Ty2
agcaacguuaaggccgca

SEQ ID NO: 3732658 - RNA, 21 nt, Salmonella enterica enterica serovar Typhi Ty2
agcaacguuaaggccgcaaac

SEQ ID NO: 3732659 - RNA, 15 nt, Salmonella enterica enterica serovar Typhi Ty2
agcaacuguagaaug

SEQ ID NO: 3732660 - RNA, 22 nt, Salmonella enterica enterica serovar Typhi Ty2
agcaacuguuuuaccaaaucaa

SEQ ID NO: 3732661 - RNA, 12 nt, Salmonella enterica enterica serovar Typhi Ty2
agcaagaacaga

SEQ ID NO: 3732662 - RNA, 13 nt, Salmonella enterica enterica serovar Typhi Ty2
agcaagaacagag

SEQ ID NO: 3732663 - RNA, 16 nt, Salmonella enterica enterica serovar Typhi Ty2
agcaagaacagagcaa

SEQ ID NO: 3732664 - RNA, 14 nt, Salmonella enterica enterica serovar Typhi Ty2
agcaagauuucaaa

SEQ ID NO: 3732665 - RNA, 17 nt, Salmonella enterica enterica serovar Typhi Ty2
agcaaggagacgcccgu

SEQ ID NO: 3732666 - RNA, 21 nt, Salmonella enterica enterica serovar Typhi Ty2
agcaaggcauuggacggaauc

SEQ ID NO: 3732667 - RNA, 13 nt, Salmonella enterica enterica serovar Typhi Ty2
agcaaggcggcgg

SEQ ID NO: 3732668 - RNA, 14 nt, Salmonella enterica enterica serovar Typhi Ty2
agcaauacgcccgc

SEQ ID NO: 3732669 - RNA, 22 nt, Salmonella enterica enterica serovar Typhi Ty2
agcaauauuuuguaguuguuuu

SEQ ID NO: 3732670 - RNA, 14 nt, Salmonella enterica enterica serovar Typhi Ty2
agcaaucaguucuc

SEQ ID NO: 3732671 - RNA, 17 nt, Salmonella enterica enterica serovar Typhi Ty2
agcaaugauaacggcgc

SEQ ID NO: 3732672 - RNA, 14 nt, Salmonella enterica enterica serovar Typhi Ty2
agcaaugauuuuua

SEQ ID NO: 3732673 - RNA, 16 nt, Salmonella enterica enterica serovar Typhi Ty2
agcaaugcccaaaaua

SEQ ID NO: 3732674 - RNA, 20 nt, Salmonella enterica enterica serovar Typhi Ty2
agcaaugcccaaaauagcgu

SEQ ID NO: 3732675 - RNA, 20 nt, Salmonella enterica enterica serovar Typhi Ty2
agcaaugcgaauaacaucau

SEQ ID NO: 3732676 - RNA, 12 nt, Salmonella enterica enterica serovar Typhi Ty2
agcaauggcgug

SEQ ID NO: 3732677 - RNA, 20 nt, Salmonella enterica enterica serovar Typhi Ty2
agcaauggguaggccggaua

SEQ ID NO: 3732678 - RNA, 15 nt, Salmonella enterica enterica serovar Typhi Ty2
agcaauuaacaaaua

SEQ ID NO: 3732679 - RNA, 20 nt, Salmonella enterica enterica serovar Typhi Ty2
agcaauuaacaaauaaagcg

SEQ ID NO: 3732680 - RNA, 16 nt, Salmonella enterica enterica serovar Typhi Ty2
agcaauuaauaaacaa

SEQ ID NO: 3732681 - RNA, 22 nt, Salmonella enterica enterica serovar Typhi Ty2
agcaauuaauauuuaacacauu

SEQ ID NO: 3732682 - RNA, 20 nt, Salmonella enterica enterica serovar Typhi Ty2
agcagggcaugauuacagau

SEQ ID NO: 3732683 - RNA, 16 nt, Salmonella enterica enterica serovar Typhi Ty2
agcagggucaggaacu

SEQ ID NO: 3732684 - RNA, 15 nt, Salmonella enterica enterica serovar Typhi Ty2
agcaggguuaugccg

SEQ ID NO: 3732685 - RNA, 21 nt, Salmonella enterica enterica serovar Typhi Ty2
agcaggugcggacugggcuga

SEQ ID NO: 3732686 - RNA, 20 nt, Salmonella enterica enterica serovar Typhi Ty2
agcagucccgccgggaucug

SEQ ID NO: 3732687 - RNA, 12 nt, Salmonella enterica enterica serovar Typhi Ty2
agcagugagcuu

SEQ ID NO: 3732688 - RNA, 19 nt, Salmonella enterica enterica serovar Typhi Ty2
agcagugagcuuugcacgc

SEQ ID NO: 3732689 - RNA, 15 nt, Salmonella enterica enterica serovar Typhi Ty2
agcaguuccagcauc

SEQ ID NO: 3732690 - RNA, 17 nt, Salmonella enterica enterica serovar Typhi Ty2
agcaguucgauaauccc

SEQ ID NO: 3732691 - RNA, 17 nt, Salmonella enterica enterica serovar Typhi Ty2
agcauaaaaaacaucau

SEQ ID NO: 3732692 - RNA, 13 nt, Salmonella enterica enterica serovar Typhi Ty2
agcauaaaaagac

SEQ ID NO: 3732693 - RNA, 17 nt, Salmonella enterica enterica serovar Typhi Ty2
agcauaauaaagcagcg

SEQ ID NO: 3732694 - RNA, 21 nt, Salmonella enterica enterica serovar Typhi Ty2
agcauaccgugugcagugaca

SEQ ID NO: 3732695 - RNA, 14 nt, Salmonella enterica enterica serovar Typhi Ty2
agcauacugauguc

SEQ ID NO: 3732696 - RNA, 15 nt, Salmonella enterica enterica serovar Typhi Ty2
agcauacugcgucgg

SEQ ID NO: 3732697 - RNA, 17 nt, Salmonella enterica enterica serovar Typhi Ty2
agcauagauaacuaugu

SEQ ID NO: 3732698 - RNA, 17 nt, Salmonella enterica enterica serovar Typhi Ty2
agcauagcgccaucagg

SEQ ID NO: 3732699 - RNA, 23 nt, Salmonella enterica enterica serovar Typhi Ty2
agcauagucgcuccccauaaaga

SEQ ID NO: 3732700 - RNA, 16 nt, Salmonella enterica enterica serovar Typhi Ty2
agcauaucaaacugaa

SEQ ID NO: 3732701 - RNA, 19 nt, Salmonella enterica enterica serovar Typhi Ty2
agcaucaaacuuuuaaauu

SEQ ID NO: 3732702 - RNA, 22 nt, Salmonella enterica enterica serovar Typhi Ty2
agcaucaauaucugcuaccgcc

SEQ ID NO: 3732703 - RNA, 15 nt, Salmonella enterica enterica serovar Typhi Ty2
agcaucaauuugaaa

SEQ ID NO: 3732704 - RNA, 17 nt, Salmonella enterica enterica serovar Typhi Ty2
agcaucaggacaugguc

SEQ ID NO: 3732705 - RNA, 23 nt, Salmonella enterica enterica serovar Typhi Ty2
agcaucagguggaagaaacgcuu

SEQ ID NO: 3732706 - RNA, 15 nt, Salmonella enterica enterica serovar Typhi Ty2
agcaucaucugccau

SEQ ID NO: 3732707 - RNA, 14 nt, Salmonella enterica enterica serovar Typhi Ty2
agcaucaugucacc

SEQ ID NO: 3732708 - RNA, 21 nt, Salmonella enterica enterica serovar Typhi Ty2
agcauccagcucauguaguca

SEQ ID NO: 3732709 - RNA, 12 nt, Salmonella enterica enterica serovar Typhi Ty2
agcaucccacga

SEQ ID NO: 3732710 - RNA, 19 nt, Salmonella enterica enterica serovar Typhi Ty2
agcaucccgcaggcggcga

SEQ ID NO: 3732711 - RNA, 16 nt, Salmonella enterica enterica serovar Typhi Ty2
agcaucccgcuggcgc

SEQ ID NO: 3732712 - RNA, 21 nt, Salmonella enterica enterica serovar Typhi Ty2
agcauccgcaagacacgcuuc

SEQ ID NO: 3732713 - RNA, 18 nt, Salmonella enterica enterica serovar Typhi Ty2
agcauccgggauauaaaa

SEQ ID NO: 3732714 - RNA, 14 nt, Salmonella enterica enterica serovar Typhi Ty2
agcauccuccggcg

SEQ ID NO: 3732715 - RNA, 22 nt, Salmonella enterica enterica serovar Typhi Ty2
agcaucgacccuugcgaccacu

SEQ ID NO: 3732716 - RNA, 15 nt, Salmonella enterica enterica serovar Typhi Ty2
agcaucgcauuaacg

SEQ ID NO: 3732717 - RNA, 17 nt, Salmonella enterica enterica serovar Typhi Ty2
agcaucgcuaaccggcg

SEQ ID NO: 3732718 - RNA, 21 nt, Salmonella enterica enterica serovar Typhi Ty2
agcaucgcuuuuaggcugaaa

SEQ ID NO: 3732719 - RNA, 20 nt, Salmonella enterica enterica serovar Typhi Ty2
agcaucggcagcgccaguga

SEQ ID NO: 3732720 - RNA, 15 nt, Salmonella enterica enterica serovar Typhi Ty2
agcaucguuaccgcu

SEQ ID NO: 3732721 - RNA, 23 nt, Salmonella enterica enterica serovar Typhi Ty2
agcaucucaauaucguugccgcc

SEQ ID NO: 3732722 - RNA, 14 nt, Salmonella enterica enterica serovar Typhi Ty2
agcaucugcggcuu

SEQ ID NO: 3732723 - RNA, 18 nt, Salmonella enterica enterica serovar Typhi Ty2
agcaugagugauagcgcc

SEQ ID NO: 3732724 - RNA, 18 nt, Salmonella enterica enterica serovar Typhi Ty2
agcaugggcauccccaug

SEQ ID NO: 3732725 - RNA, 22 nt, Salmonella enterica enterica serovar Typhi Ty2
agcaugugaauaugaucugcac

SEQ ID NO: 3732726 - RNA, 14 nt, Salmonella enterica enterica serovar Typhi Ty2
agcauuaaaucauc

SEQ ID NO: 3732727 - RNA, 23 nt, Salmonella enterica enterica serovar Typhi Ty2
agcauuacccccgccauaaugca

SEQ ID NO: 3732728 - RNA, 16 nt, Salmonella enterica enterica serovar Typhi Ty2
agcauuaccccguggu

SEQ ID NO: 3732729 - RNA, 19 nt, Salmonella enterica enterica serovar Typhi Ty2
agcauuaccccgugguggg

SEQ ID NO: 3732730 - RNA, 12 nt, Salmonella enterica enterica serovar Typhi Ty2
agcauuagcgcc

SEQ ID NO: 3732731 - RNA, 14 nt, Salmonella enterica enterica serovar Typhi Ty2
agcauuauuuuuaa

SEQ ID NO: 3732732 - RNA, 18 nt, Salmonella enterica enterica serovar Typhi Ty2
agcauugccgucaaacgc

SEQ ID NO: 3732733 - RNA, 18 nt, Salmonella enterica enterica serovar Typhi Ty2
agcauugccguuuucaau

SEQ ID NO: 3732734 - RNA, 21 nt, Salmonella enterica enterica serovar Typhi Ty2
agcauugccguuuucaauaau

SEQ ID NO: 3732735 - RNA, 20 nt, Salmonella enterica enterica serovar Typhi Ty2
agcauugcuucgucccugca

SEQ ID NO: 3732736 - RNA, 16 nt, Salmonella enterica enterica serovar Typhi Ty2
agcauuggaaauucag

SEQ ID NO: 3732737 - RNA, 15 nt, Salmonella enterica enterica serovar Typhi Ty2
agcauugggccgaua

SEQ ID NO: 3732738 - RNA, 19 nt, Salmonella enterica enterica serovar Typhi Ty2
agcauugggccgauaaagc

SEQ ID NO: 3732739 - RNA, 21 nt, Salmonella enterica enterica serovar Typhi Ty2
agcauuguaggggcuuaucuc

SEQ ID NO: 3732740 - RNA, 15 nt, Salmonella enterica enterica serovar Typhi Ty2
agcauuguauuucag

SEQ ID NO: 3732741 - RNA, 13 nt, Salmonella enterica enterica serovar Typhi Ty2
agcauuuccagcu

SEQ ID NO: 3732742 - RNA, 19 nt, Salmonella enterica enterica serovar Typhi Ty2
agcauuuccgcagccaaca

SEQ ID NO: 3732743 - RNA, 23 nt, Salmonella enterica enterica serovar Typhi Ty2
agcauuucggcguguaacugcaa

SEQ ID NO: 3732744 - RNA, 16 nt, Salmonella enterica enterica serovar Typhi Ty2
agcauuucuucaagcg

SEQ ID NO: 3732745 - RNA, 16 nt, Salmonella enterica enterica serovar Typhi Ty2
agcauuuuucacaguu

SEQ ID NO: 3732746 - RNA, 11 nt, Salmonella enterica enterica serovar Typhi Ty2
agcauuuuucc

SEQ ID NO: 3732747 - RNA, 22 nt, Salmonella enterica enterica serovar Typhi Ty2
agccaaaaauaacgcccugcgc

SEQ ID NO: 3732748 - RNA, 14 nt, Salmonella enterica enterica serovar Typhi Ty2
agccaaacugcugu

SEQ ID NO: 3732749 - RNA, 15 nt, Salmonella enterica enterica serovar Typhi Ty2
agccaaagcgaggua

SEQ ID NO: 3732750 - RNA, 16 nt, Salmonella enterica enterica serovar Typhi Ty2
agccaacaaagaggca

SEQ ID NO: 3732751 - RNA, 18 nt, Salmonella enterica enterica serovar Typhi Ty2
agccaauaaucaaaugau

SEQ ID NO: 3732752 - RNA, 19 nt, Salmonella enterica enterica serovar Typhi Ty2
agccaaucagccccagcac

SEQ ID NO: 3732753 - RNA, 17 nt, Salmonella enterica enterica serovar Typhi Ty2
agccacaaucugauaau

SEQ ID NO: 3732754 - RNA, 23 nt, Salmonella enterica enterica serovar Typhi Ty2
agccacaaugggggcauaauacg

SEQ ID NO: 3732755 - RNA, 18 nt, Salmonella enterica enterica serovar Typhi Ty2
agccacacccauagcagc

SEQ ID NO: 3732756 - RNA, 17 nt, Salmonella enterica enterica serovar Typhi Ty2
agccacacgacgguauu

SEQ ID NO: 3732757 - RNA, 14 nt, Salmonella enterica enterica serovar Typhi Ty2
agccacagcgguua

SEQ ID NO: 3732758 - RNA, 14 nt, Salmonella enterica enterica serovar Typhi Ty2
agccacauuguaug

SEQ ID NO: 3732759 - RNA, 20 nt, Salmonella enterica enterica serovar Typhi Ty2
agccacauuguaugcaagaa

SEQ ID NO: 3732760 - RNA, 12 nt, Salmonella enterica enterica serovar Typhi Ty2
agccacccacgg

SEQ ID NO: 3732761 - RNA, 18 nt, Salmonella enterica enterica serovar Typhi Ty2
agccaccgcccagagaau

SEQ ID NO: 3732762 - RNA, 17 nt, Salmonella enterica enterica serovar Typhi Ty2
agccaccggauugccuu

SEQ ID NO: 3732763 - RNA, 18 nt, Salmonella enterica enterica serovar Typhi Ty2
agccacgcaagcagcaca

SEQ ID NO: 3732764 - RNA, 17 nt, Salmonella enterica enterica serovar Typhi Ty2
agcccugugccgcuggu

SEQ ID NO: 3732765 - RNA, 15 nt, Salmonella enterica enterica serovar Typhi Ty2
agcccuguuauucag

SEQ ID NO: 3732766 - RNA, 19 nt, Salmonella enterica enterica serovar Typhi Ty2
agcccuuaucgccccagcc

SEQ ID NO: 3732767 - RNA, 22 nt, Salmonella enterica enterica serovar Typhi Ty2
agcccuugaucggguuuuccug

SEQ ID NO: 3732768 - RNA, 13 nt, Salmonella enterica enterica serovar Typhi Ty2
agcccuuugcccu

SEQ ID NO: 3732769 - RNA, 15 nt, Salmonella enterica enterica serovar Typhi Ty2
agccgaacucuucca

SEQ ID NO: 3732770 - RNA, 20 nt, Salmonella enterica enterica serovar Typhi Ty2
agccgaaguuccccguggcc

SEQ ID NO: 3732771 - RNA, 19 nt, Salmonella enterica enterica serovar Typhi Ty2
agccgaccaucgcgccgcu

SEQ ID NO: 3732772 - RNA, 14 nt, Salmonella enterica enterica serovar Typhi Ty2
agccgaccuggcgg

SEQ ID NO: 3732773 - RNA, 21 nt, Salmonella enterica enterica serovar Typhi Ty2
agccgacgcauuucuccugau

SEQ ID NO: 3732774 - RNA, 14 nt, Salmonella enterica enterica serovar Typhi Ty2
agccgagcgguaag

SEQ ID NO: 3732775 - RNA, 14 nt, Salmonella enterica enterica serovar Typhi Ty2
agccgauaguccgg

SEQ ID NO: 3732776 - RNA, 18 nt, Salmonella enterica enterica serovar Typhi Ty2
agccgauggaaguacugg

SEQ ID NO: 3732777 - RNA, 23 nt, Salmonella enterica enterica serovar Typhi Ty2
agccgcaaucagcguuucgccgu

SEQ ID NO: 3732778 - RNA, 13 nt, Salmonella enterica enterica serovar Typhi Ty2
agccgcagaacca

SEQ ID NO: 3732779 - RNA, 23 nt, Salmonella enterica enterica serovar Typhi Ty2
agccgcagaaccauuuccucugc

SEQ ID NO: 3732780 - RNA, 17 nt, Salmonella enterica enterica serovar Typhi Ty2
agccgccacccggcuuu

SEQ ID NO: 3732781 - RNA, 12 nt, Salmonella enterica enterica serovar Typhi Ty2
agccgccaggca

SEQ ID NO: 3732782 - RNA, 22 nt, Salmonella enterica enterica serovar Typhi Ty2
agccgccaggcaaucagcagcc

SEQ ID NO: 3732783 - RNA, 16 nt, Salmonella enterica enterica serovar Typhi Ty2
agccgccauccggcac

SEQ ID NO: 3732784 - RNA, 12 nt, Salmonella enterica enterica serovar Typhi Ty2
agccgcccaucc

SEQ ID NO: 3732785 - RNA, 23 nt, Salmonella enterica enterica serovar Typhi Ty2
agccgcccgcgauaaaaauccug

SEQ ID NO: 3732786 - RNA, 12 nt, Salmonella enterica enterica serovar Typhi Ty2
agccgcccggcg

SEQ ID NO: 3732787 - RNA, 13 nt, Salmonella enterica enterica serovar Typhi Ty2
agccgcccggcgc

SEQ ID NO: 3732788 - RNA, 21 nt, Salmonella enterica enterica serovar Typhi Ty2
agccgcccggcgcgcuggagg

SEQ ID NO: 3732789 - RNA, 21 nt, Salmonella enterica enterica serovar Typhi Ty2
agccgcccugcggacaggcga

SEQ ID NO: 3732790 - RNA, 22 nt, Salmonella enterica enterica serovar Typhi Ty2
agccgccggugacggcggaaga

SEQ ID NO: 3732791 - RNA, 15 nt, Salmonella enterica enterica serovar Typhi Ty2
agccgcgcagcgcaa

SEQ ID NO: 3732792 - RNA, 20 nt, Salmonella enterica enterica serovar Typhi Ty2
agccgcgcauagcuggcgua

SEQ ID NO: 3732793 - RNA, 13 nt, Salmonella enterica enterica serovar Typhi Ty2
agccgcgccaucu

SEQ ID NO: 3732794 - RNA, 21 nt, Salmonella enterica enterica serovar Typhi Ty2
agccgcgccaucuccuccuca

SEQ ID NO: 3732795 - RNA, 20 nt, Salmonella enterica enterica serovar Typhi Ty2
agccgcgcccuaacaggcgc

SEQ ID NO: 3732796 - RNA, 14 nt, Salmonella enterica enterica serovar Typhi Ty2
agccgcgcgccgcc

SEQ ID NO: 3732797 - RNA, 18 nt, Salmonella enterica enterica serovar Typhi Ty2
agccgcgcucaagcuggg

SEQ ID NO: 3732798 - RNA, 16 nt, Salmonella enterica enterica serovar Typhi Ty2
agccgcggaccuuuug

SEQ ID NO: 3732799 - RNA, 20 nt, Salmonella enterica enterica serovar Typhi Ty2
agccgcggcgcuuucgccac

SEQ ID NO: 3732800 - RNA, 19 nt, Salmonella enterica enterica serovar Typhi Ty2
agccgcgggcgguauuaca

SEQ ID NO: 3732801 - RNA, 17 nt, Salmonella enterica enterica serovar Typhi Ty2
agccgcucaggguaauc

SEQ ID NO: 3732802 - RNA, 18 nt, Salmonella enterica enterica serovar Typhi Ty2
agccgcuguuuuucauca

SEQ ID NO: 3732803 - RNA, 16 nt, Salmonella enterica enterica serovar Typhi Ty2
agccgcuuuccgccgc

SEQ ID NO: 3732804 - RNA, 15 nt, Salmonella enterica enterica serovar Typhi Ty2
agccggaaaagcgcu

SEQ ID NO: 3732805 - RNA, 21 nt, Salmonella enterica enterica serovar Typhi Ty2
agccggaaaagcgcuggcugg

SEQ ID NO: 3732806 - RNA, 21 nt, Salmonella enterica enterica serovar Typhi Ty2
agccggaaaucaauuccgguu

SEQ ID NO: 3732807 - RNA, 21 nt, Salmonella enterica enterica serovar Typhi Ty2
agccggaauauugagaauaaa

SEQ ID NO: 3732808 - RNA, 14 nt, Salmonella enterica enterica serovar Typhi Ty2
agccggacgcccgu

SEQ ID NO: 3732809 - RNA, 13 nt, Salmonella enterica enterica serovar Typhi Ty2
agccggagguuuu

SEQ ID NO: 3732810 - RNA, 16 nt, Salmonella enterica enterica serovar Typhi Ty2
agccggauaagccgcg

SEQ ID NO: 3732811 - RNA, 19 nt, Salmonella enterica enterica serovar Typhi Ty2
agccggauguaggccugau

SEQ ID NO: 3732812 - RNA, 16 nt, Salmonella enterica enterica serovar Typhi Ty2
agccggauuuuaaauu

SEQ ID NO: 3732813 - RNA, 21 nt, Salmonella enterica enterica serovar Typhi Ty2
agccggcgauagcgccccaaa

SEQ ID NO: 3732814 - RNA, 14 nt, Salmonella enterica enterica serovar Typhi Ty2
agccggcggaaaaa

SEQ ID NO: 3732815 - RNA, 19 nt, Salmonella enterica enterica serovar Typhi Ty2
agccgggcgggaaccugcu

SEQ ID NO: 3732816 - RNA, 22 nt, Salmonella enterica enterica serovar Typhi Ty2
agccggguaauaaguugcacuc

SEQ ID NO: 3732817 - RNA, 20 nt, Salmonella enterica enterica serovar Typhi Ty2
agccgguaaucacugccgcc

SEQ ID NO: 3732818 - RNA, 22 nt, Salmonella enterica enterica serovar Typhi Ty2
agccggugaugaucaauaacgc

SEQ ID NO: 3732819 - RNA, 21 nt, Salmonella enterica enterica serovar Typhi Ty2
agccgguguuaaccagauaag

SEQ ID NO: 3732820 - RNA, 19 nt, Salmonella enterica enterica serovar Typhi Ty2
agccguaacuaugccagaa

SEQ ID NO: 3732821 - RNA, 13 nt, Salmonella enterica enterica serovar Typhi Ty2
agccguuaccgcc

SEQ ID NO: 3732822 - RNA, 18 nt, Salmonella enterica enterica serovar Typhi Ty2
agccguuacuucccccau

SEQ ID NO: 3732823 - RNA, 23 nt, Salmonella enterica enterica serovar Typhi Ty2
agccguucaccagccacugcgcc

SEQ ID NO: 3732824 - RNA, 15 nt, Salmonella enterica enterica serovar Typhi Ty2
agccguucuccagcg

SEQ ID NO: 3732825 - RNA, 18 nt, Salmonella enterica enterica serovar Typhi Ty2
agccguuuugcugucugg

SEQ ID NO: 3732826 - RNA, 19 nt, Salmonella enterica enterica serovar Typhi Ty2
agccguuuuggcagcgccc

SEQ ID NO: 3732827 - RNA, 22 nt, Salmonella enterica enterica serovar Typhi Ty2
agccuaaugacggacgcagacc

SEQ ID NO: 3732828 - RNA, 22 nt, Salmonella enterica enterica serovar Typhi Ty2
agccuaaugggccagauucuua

SEQ ID NO: 3732829 - RNA, 24 nt, Salmonella enterica enterica serovar Typhi Ty2
agccuaucgccauauacgccacgg

SEQ ID NO: 3732830 - RNA, 23 nt, Salmonella enterica enterica serovar Typhi Ty2
agccucauuuuugaguuugucau

SEQ ID NO: 3732831 - RNA, 14 nt, Salmonella enterica enterica serovar Typhi Ty2
agccucgcgcaucc

SEQ ID NO: 3732832 - RNA, 11 nt, Salmonella enterica enterica serovar Typhi Ty2
agccucuuuca

SEQ ID NO: 3732833 - RNA, 17 nt, Salmonella enterica enterica serovar Typhi Ty2
agccugaagccagcaau

SEQ ID NO: 3732834 - RNA, 18 nt, Salmonella enterica enterica serovar Typhi Ty2
agccugaagccagcaauc

SEQ ID NO: 3732835 - RNA, 17 nt, Salmonella enterica enterica serovar Typhi Ty2
agccugacgaauagcgc

SEQ ID NO: 3732836 - RNA, 17 nt, Salmonella enterica enterica serovar Typhi Ty2
agccugagcgcgaggca

SEQ ID NO: 3732837 - RNA, 15 nt, Salmonella enterica enterica serovar Typhi Ty2
agccugccagcaacc

SEQ ID NO: 3732838 - RNA, 20 nt, Salmonella enterica enterica serovar Typhi Ty2
agccugcccugcggcaggca

SEQ ID NO: 3732839 - RNA, 21 nt, Salmonella enterica enterica serovar Typhi Ty2
agccugcgcguaaauuucacu

SEQ ID NO: 3732840 - RNA, 23 nt, Salmonella enterica enterica serovar Typhi Ty2
agccugcuggucugaaucugcuc

SEQ ID NO: 3732841 - RNA, 19 nt, Salmonella enterica enterica serovar Typhi Ty2
agccuggagagcagcgcca

SEQ ID NO: 3732842 - RNA, 21 nt, Salmonella enterica enterica serovar Typhi Ty2
agccuggauagcaauuucagc

SEQ ID NO: 3732843 - RNA, 14 nt, Salmonella enterica enterica serovar Typhi Ty2
agccugggcaaggc

SEQ ID NO: 3732844 - RNA, 12 nt, Salmonella enterica enterica serovar Typhi Ty2
agccuggucacc

SEQ ID NO: 3732845 - RNA, 14 nt, Salmonella enterica enterica serovar Typhi Ty2
agccuggugcccaa

SEQ ID NO: 3732846 - RNA, 18 nt, Salmonella enterica enterica serovar Typhi Ty2
agcgcagugaccagcauc

SEQ ID NO: 3732847 - RNA, 22 nt, Salmonella enterica enterica serovar Typhi Ty2
agcgcauacgcuguccagucaa

SEQ ID NO: 3732848 - RNA, 21 nt, Salmonella enterica enterica serovar Typhi Ty2
agcgcauagcggccagauggc

SEQ ID NO: 3732849 - RNA, 17 nt, Salmonella enterica enterica serovar Typhi Ty2
agcgcauccggccagcg

SEQ ID NO: 3732850 - RNA, 16 nt, Salmonella enterica enterica serovar Typhi Ty2
agcgcaucgcucccca

SEQ ID NO: 3732851 - RNA, 16 nt, Salmonella enterica enterica serovar Typhi Ty2
agcgcauugcgcccca

SEQ ID NO: 3732852 - RNA, 21 nt, Salmonella enterica enterica serovar Typhi Ty2
agcgcauugcgccccagcaca

SEQ ID NO: 3732853 - RNA, 14 nt, Salmonella enterica enterica serovar Typhi Ty2
agcgccaaucacua

SEQ ID NO: 3732854 - RNA, 23 nt, Salmonella enterica enterica serovar Typhi Ty2
agcgccaccaaagccaggccgcc

SEQ ID NO: 3732855 - RNA, 14 nt, Salmonella enterica enterica serovar Typhi Ty2
agcgccaccacaaa

SEQ ID NO: 3732856 - RNA, 14 nt, Salmonella enterica enterica serovar Typhi Ty2
agcgccacccgaca

SEQ ID NO: 3732857 - RNA, 14 nt, Salmonella enterica enterica serovar Typhi Ty2
agcgccacgcccaa

SEQ ID NO: 3732858 - RNA, 23 nt, Salmonella enterica enterica serovar Typhi Ty2
agcgccacgcgaugcaaccccug

SEQ ID NO: 3732859 - RNA, 16 nt, Salmonella enterica enterica serovar Typhi Ty2
agcgccagacacugga

SEQ ID NO: 3732860 - RNA, 22 nt, Salmonella enterica enterica serovar Typhi Ty2
agcgccagacagauaacaccag

SEQ ID NO: 3732861 - RNA, 16 nt, Salmonella enterica enterica serovar Typhi Ty2
agcgccagauagucac

SEQ ID NO: 3732862 - RNA, 12 nt, Salmonella enterica enterica serovar Typhi Ty2
agcgccagcagc

SEQ ID NO: 3732863 - RNA, 23 nt, Salmonella enterica enterica serovar Typhi Ty2
agcgccagcagcagcgcaaugcg

SEQ ID NO: 3732864 - RNA, 13 nt, Salmonella enterica enterica serovar Typhi Ty2
agcgccagcaugg

SEQ ID NO: 3732865 - RNA, 15 nt, Salmonella enterica enterica serovar Typhi Ty2
agcgccagcgacaga

SEQ ID NO: 3732866 - RNA, 18 nt, Salmonella enterica enterica serovar Typhi Ty2
agcgccagcgccaccugc

SEQ ID NO: 3732867 - RNA, 15 nt, Salmonella enterica enterica serovar Typhi Ty2
agcgccagcggcugc

SEQ ID NO: 3732868 - RNA, 16 nt, Salmonella enterica enterica serovar Typhi Ty2
agcgccagcgguguuu

SEQ ID NO: 3732869 - RNA, 20 nt, Salmonella enterica enterica serovar Typhi Ty2
agcgccagcguugaccagcc

SEQ ID NO: 3732870 - RNA, 13 nt, Salmonella enterica enterica serovar Typhi Ty2
agcgccagcucca

SEQ ID NO: 3732871 - RNA, 15 nt, Salmonella enterica enterica serovar Typhi Ty2
agcgccagcuccaua

SEQ ID NO: 3732872 - RNA, 13 nt, Salmonella enterica enterica serovar Typhi Ty2
agcgccagugacg

SEQ ID NO: 3732873 - RNA, 14 nt, Salmonella enterica enterica serovar Typhi Ty2
agcgccaguuuuuc

SEQ ID NO: 3732874 - RNA, 20 nt, Salmonella enterica enterica serovar Typhi Ty2
agcgccaguuuuuccuguuc

SEQ ID NO: 3732875 - RNA, 17 nt, Salmonella enterica enterica serovar Typhi Ty2
agcgccauauccgcaga

SEQ ID NO: 3732876 - RNA, 20 nt, Salmonella enterica enterica serovar Typhi Ty2
agcgccauaucggcacugcu

SEQ ID NO: 3732877 - RNA, 14 nt, Salmonella enterica enterica serovar Typhi Ty2
agcgccauauugcu

SEQ ID NO: 3732878 - RNA, 13 nt, Salmonella enterica enterica serovar Typhi Ty2
agcgccaucagga

SEQ ID NO: 3732879 - RNA, 17 nt, Salmonella enterica enterica serovar Typhi Ty2
agcgccaugaagauggu

SEQ ID NO: 3732880 - RNA, 13 nt, Salmonella enterica enterica serovar Typhi Ty2
agcgccauugcua

SEQ ID NO: 3732881 - RNA, 14 nt, Salmonella enterica enterica serovar Typhi Ty2
agcgccccaguaac

SEQ ID NO: 3732882 - RNA, 15 nt, Salmonella enterica enterica serovar Typhi Ty2
agcgcccccagcaaa

SEQ ID NO: 3732883 - RNA, 22 nt, Salmonella enterica enterica serovar Typhi Ty2
agcgccccucuugcagcaagaa

SEQ ID NO: 3732884 - RNA, 13 nt, Salmonella enterica enterica serovar Typhi Ty2
agcgcccggugau

SEQ ID NO: 3732885 - RNA, 22 nt, Salmonella enterica enterica serovar Typhi Ty2
agcgcccgguucaucggcucga

SEQ ID NO: 3732886 - RNA, 13 nt, Salmonella enterica enterica serovar Typhi Ty2
agcgccgccaaga

SEQ ID NO: 3732887 - RNA, 14 nt, Salmonella enterica enterica serovar Typhi Ty2
agcgccgccaagau

SEQ ID NO: 3732888 - RNA, 23 nt, Salmonella enterica enterica serovar Typhi Ty2
agcgccgccagaaucaccucuuu

SEQ ID NO: 3732889 - RNA, 16 nt, Salmonella enterica enterica serovar Typhi Ty2
agcgccgccagauaaa

SEQ ID NO: 3732890 - RNA, 17 nt, Salmonella enterica enterica serovar Typhi Ty2
agcgccgccagauaaag

SEQ ID NO: 3732891 - RNA, 18 nt, Salmonella enterica enterica serovar Typhi Ty2
agcgccgccagauaaagc

SEQ ID NO: 3732892 - RNA, 21 nt, Salmonella enterica enterica serovar Typhi Ty2
agcgccgccagauaaagcgaa

SEQ ID NO: 3732893 - RNA, 16 nt, Salmonella enterica enterica serovar Typhi Ty2
agcgccgcgccuacca

SEQ ID NO: 3732894 - RNA, 18 nt, Salmonella enterica enterica serovar Typhi Ty2
agcgccgcgcgaucaauc

SEQ ID NO: 3732895 - RNA, 19 nt, Salmonella enterica enterica serovar Typhi Ty2
agcgccggaucgggcuucc

SEQ ID NO: 3732896 - RNA, 20 nt, Salmonella enterica enterica serovar Typhi Ty2
agcgccggaugaggacauaa

SEQ ID NO: 3732897 - RNA, 16 nt, Salmonella enterica enterica serovar Typhi Ty2
agcgccggcaaagcca

SEQ ID NO: 3732898 - RNA, 16 nt, Salmonella enterica enterica serovar Typhi Ty2
agcgccggcagcaguu

SEQ ID NO: 3732899 - RNA, 15 nt, Salmonella enterica enterica serovar Typhi Ty2
agcgccgguuucucc

SEQ ID NO: 3732900 - RNA, 16 nt, Salmonella enterica enterica serovar Typhi Ty2
agcgccgucauaccgc

SEQ ID NO: 3732901 - RNA, 19 nt, Salmonella enterica enterica serovar Typhi Ty2
agcgccgucauaccgccca

SEQ ID NO: 3732902 - RNA, 21 nt, Salmonella enterica enterica serovar Typhi Ty2
agcgccgucauggcaaacgaa

SEQ ID NO: 3732903 - RNA, 14 nt, Salmonella enterica enterica serovar Typhi Ty2
agcgccguccgaca

SEQ ID NO: 3732904 - RNA, 16 nt, Salmonella enterica enterica serovar Typhi Ty2
agcgccguuaaacugc

SEQ ID NO: 3732905 - RNA, 18 nt, Salmonella enterica enterica serovar Typhi Ty2
agcgccguuaaacugcgc

SEQ ID NO: 3732906 - RNA, 23 nt, Salmonella enterica enterica serovar Typhi Ty2
agcgccuccgcguagcccagcgc

SEQ ID NO: 3732907 - RNA, 14 nt, Salmonella enterica enterica serovar Typhi Ty2
agcgccucgcaaaa

SEQ ID NO: 3732908 - RNA, 16 nt, Salmonella enterica enterica serovar Typhi Ty2
agcgccucugauuuuu

SEQ ID NO: 3732909 - RNA, 19 nt, Salmonella enterica enterica serovar Typhi Ty2
agcgccucugauuuuucca

SEQ ID NO: 3732910 - RNA, 22 nt, Salmonella enterica enterica serovar Typhi Ty2
agcgccugcuguaaaauauccc

SEQ ID NO: 3732911 - RNA, 20 nt, Salmonella enterica enterica serovar Typhi Ty2
agcgccuguaaacguuccug

SEQ ID NO: 3732912 - RNA, 22 nt, Salmonella enterica enterica serovar Typhi Ty2
agcgccuguaaacguuccugcc

SEQ ID NO: 3732913 - RNA, 14 nt, Salmonella enterica enterica serovar Typhi Ty2
agcgccuguagcgu

SEQ ID NO: 3732914 - RNA, 20 nt, Salmonella enterica enterica serovar Typhi Ty2
agcgccugugcuuucgccac

SEQ ID NO: 3732915 - RNA, 17 nt, Salmonella enterica enterica serovar Typhi Ty2
agcgccuguucaacaug

SEQ ID NO: 3732916 - RNA, 15 nt, Salmonella enterica enterica serovar Typhi Ty2
agcgccuuugcgaau

SEQ ID NO: 3732917 - RNA, 13 nt, Salmonella enterica enterica serovar Typhi Ty2
agcgcgaaauuua

SEQ ID NO: 3732918 - RNA, 16 nt, Salmonella enterica enterica serovar Typhi Ty2
agcgcgaaugauuuua

SEQ ID NO: 3732919 - RNA, 23 nt, Salmonella enterica enterica serovar Typhi Ty2
agcgcgaccaggaaaccgguaaa

SEQ ID NO: 3732920 - RNA, 22 nt, Salmonella enterica enterica serovar Typhi Ty2
agcgcgacgggaaggaaauuca

SEQ ID NO: 3732921 - RNA, 20 nt, Salmonella enterica enterica serovar Typhi Ty2
agcgcgagagucaaggcauc

SEQ ID NO: 3732922 - RNA, 12 nt, Salmonella enterica enterica serovar Typhi Ty2
agcgcgauaaaa

SEQ ID NO: 3732923 - RNA, 16 nt, Salmonella enterica enterica serovar Typhi Ty2
agcgcgauacgcagca

SEQ ID NO: 3732924 - RNA, 20 nt, Salmonella enterica enterica serovar Typhi Ty2
agcgcgcagcugggccugcu

SEQ ID NO: 3732925 - RNA, 17 nt, Salmonella enterica enterica serovar Typhi Ty2
agcgcgccauccugagu

SEQ ID NO: 3732926 - RNA, 17 nt, Salmonella enterica enterica serovar Typhi Ty2
agcgcgccgcagcgccg

SEQ ID NO: 3732927 - RNA, 19 nt, Salmonella enterica enterica serovar Typhi Ty2
agcgcgccgccaacgccaa

SEQ ID NO: 3732928 - RNA, 21 nt, Salmonella enterica enterica serovar Typhi Ty2
agcguaauccucgacgcauca

SEQ ID NO: 3732929 - RNA, 22 nt, Salmonella enterica enterica serovar Typhi Ty2
agcguaaucggcaggccaacgg

SEQ ID NO: 3732930 - RNA, 18 nt, Salmonella enterica enterica serovar Typhi Ty2
agcguaaugcgccaggca

SEQ ID NO: 3732931 - RNA, 19 nt, Salmonella enterica enterica serovar Typhi Ty2
agcguaauuccgcaaucug

SEQ ID NO: 3732932 - RNA, 18 nt, Salmonella enterica enterica serovar Typhi Ty2
agcguacaggcggaugaa

SEQ ID NO: 3732933 - RNA, 15 nt, Salmonella enterica enterica serovar Typhi Ty2
agcguaccagcguca

SEQ ID NO: 3732934 - RNA, 16 nt, Salmonella enterica enterica serovar Typhi Ty2
agcguaccggccacaa

SEQ ID NO: 3732935 - RNA, 20 nt, Salmonella enterica enterica serovar Typhi Ty2
agcguaccgucuggcgaggc

SEQ ID NO: 3732936 - RNA, 18 nt, Salmonella enterica enterica serovar Typhi Ty2
agcguagaccgcccagga

SEQ ID NO: 3732937 - RNA, 13 nt, Salmonella enterica enterica serovar Typhi Ty2
agcguagcgccau

SEQ ID NO: 3732938 - RNA, 21 nt, Salmonella enterica enterica serovar Typhi Ty2
agcguaggguagaucacgcca

SEQ ID NO: 3732939 - RNA, 14 nt, Salmonella enterica enterica serovar Typhi Ty2
agcguaguccaggu

SEQ ID NO: 3732940 - RNA, 18 nt, Salmonella enterica enterica serovar Typhi Ty2
agcguauaauuaagcugc

SEQ ID NO: 3732941 - RNA, 14 nt, Salmonella enterica enterica serovar Typhi Ty2
agcguauccagcac

SEQ ID NO: 3732942 - RNA, 15 nt, Salmonella enterica enterica serovar Typhi Ty2
agcguaucgccggcg

SEQ ID NO: 3732943 - RNA, 15 nt, Salmonella enterica enterica serovar Typhi Ty2
agcguauugagcugg

SEQ ID NO: 3732944 - RNA, 23 nt, Salmonella enterica enterica serovar Typhi Ty2
agcgucaauaaucgcgcgcguau

SEQ ID NO: 3732945 - RNA, 12 nt, Salmonella enterica enterica serovar Typhi Ty2
agcgucagcaga

SEQ ID NO: 3732946 - RNA, 13 nt, Salmonella enterica enterica serovar Typhi Ty2
agcgucagcaugg

SEQ ID NO: 3732947 - RNA, 12 nt, Salmonella enterica enterica serovar Typhi Ty2
agcgucagccca

SEQ ID NO: 3732948 - RNA, 23 nt, Salmonella enterica enterica serovar Typhi Ty2
agcgucagcccuucuuuaugcgc

SEQ ID NO: 3732949 - RNA, 17 nt, Salmonella enterica enterica serovar Typhi Ty2
agcgucagguagcccgg

SEQ ID NO: 3732950 - RNA, 19 nt, Salmonella enterica enterica serovar Typhi Ty2
agcgucagguagcccggca

SEQ ID NO: 3732951 - RNA, 16 nt, Salmonella enterica enterica serovar Typhi Ty2
agcgucauuaaaaugc

SEQ ID NO: 3732952 - RNA, 12 nt, Salmonella enterica enterica serovar Typhi Ty2
agcguccagcag

SEQ ID NO: 3732953 - RNA, 15 nt, Salmonella enterica enterica serovar Typhi Ty2
agcguccaguccugu

SEQ ID NO: 3732954 - RNA, 18 nt, Salmonella enterica enterica serovar Typhi Ty2
agcguccgccaucgccuc

SEQ ID NO: 3732955 - RNA, 19 nt, Salmonella enterica enterica serovar Typhi Ty2
agcguccggaaaauccuca

SEQ ID NO: 3732956 - RNA, 16 nt, Salmonella enterica enterica serovar Typhi Ty2
agcguccggagcagcu

SEQ ID NO: 3732957 - RNA, 15 nt, Salmonella enterica enterica serovar Typhi Ty2
agcguccguucugau

SEQ ID NO: 3732958 - RNA, 13 nt, Salmonella enterica enterica serovar Typhi Ty2
agcgucgcgaucc

SEQ ID NO: 3732959 - RNA, 20 nt, Salmonella enterica enterica serovar Typhi Ty2
agcgucgcugauugccgcca

SEQ ID NO: 3732960 - RNA, 22 nt, Salmonella enterica enterica serovar Typhi Ty2
agcgucgggccgcgcugcgccu

SEQ ID NO: 3732961 - RNA, 17 nt, Salmonella enterica enterica serovar Typhi Ty2
agcgucggugaagaaaa

SEQ ID NO: 3732962 - RNA, 15 nt, Salmonella enterica enterica serovar Typhi Ty2
agcgucuauagauga

SEQ ID NO: 3732963 - RNA, 18 nt, Salmonella enterica enterica serovar Typhi Ty2
agcgucucagcaggcggc

SEQ ID NO: 3732964 - RNA, 15 nt, Salmonella enterica enterica serovar Typhi Ty2
agcgucugcggcuga

SEQ ID NO: 3732965 - RNA, 19 nt, Salmonella enterica enterica serovar Typhi Ty2
agcgucuguuucaacgcau

SEQ ID NO: 3732966 - RNA, 21 nt, Salmonella enterica enterica serovar Typhi Ty2
agcgucuuccuguaucccaaa

SEQ ID NO: 3732967 - RNA, 20 nt, Salmonella enterica enterica serovar Typhi Ty2
agcgugccgagcaacagaaa

SEQ ID NO: 3732968 - RNA, 23 nt, Salmonella enterica enterica serovar Typhi Ty2
agcgugccgagcaacagaaacca

SEQ ID NO: 3732969 - RNA, 18 nt, Salmonella enterica enterica serovar Typhi Ty2
agcgugccgguaaagggc

SEQ ID NO: 3732970 - RNA, 23 nt, Salmonella enterica enterica serovar Typhi Ty2
agcgugcuguugcuaaauccaua

SEQ ID NO: 3732971 - RNA, 22 nt, Salmonella enterica enterica serovar Typhi Ty2
agcgugucgcagauacgcugua

SEQ ID NO: 3732972 - RNA, 23 nt, Salmonella enterica enterica serovar Typhi Ty2
agcguuaacgacgcuccagaauc

SEQ ID NO: 3732973 - RNA, 15 nt, Salmonella enterica enterica serovar Typhi Ty2
agcguuacgcgcugc

SEQ ID NO: 3732974 - RNA, 14 nt, Salmonella enterica enterica serovar Typhi Ty2
agcguuacugcaac

SEQ ID NO: 3732975 - RNA, 23 nt, Salmonella enterica enterica serovar Typhi Ty2
agcguuacugcaacugcgcggca

SEQ ID NO: 3732976 - RNA, 13 nt, Salmonella enterica enterica serovar Typhi Ty2
agcguuagcgcca

SEQ ID NO: 3732977 - RNA, 20 nt, Salmonella enterica enterica serovar Typhi Ty2
agcguuagcgccauccggca

SEQ ID NO: 3732978 - RNA, 20 nt, Salmonella enterica enterica serovar Typhi Ty2
agcguuaucuguaauugacg

SEQ ID NO: 3732979 - RNA, 21 nt, Salmonella enterica enterica serovar Typhi Ty2
agcguucaugcuggucagcaa

SEQ ID NO: 3732980 - RNA, 21 nt, Salmonella enterica enterica serovar Typhi Ty2
agcguucauucccgccaauaa

SEQ ID NO: 3732981 - RNA, 21 nt, Salmonella enterica enterica serovar Typhi Ty2
agcguucuauuuggccugcag

SEQ ID NO: 3732982 - RNA, 17 nt, Salmonella enterica enterica serovar Typhi Ty2
agcguucuuuccaguuc

SEQ ID NO: 3732983 - RNA, 17 nt, Salmonella enterica enterica serovar Typhi Ty2
agcguugauaugcucga

SEQ ID NO: 3732984 - RNA, 19 nt, Salmonella enterica enterica serovar Typhi Ty2
agcguugcagccacguugc

SEQ ID NO: 3732985 - RNA, 19 nt, Salmonella enterica enterica serovar Typhi Ty2
agcguuuaaaaagcugcau

SEQ ID NO: 3732986 - RNA, 19 nt, Salmonella enterica enterica serovar Typhi Ty2
agcguuuauguuugcugau

SEQ ID NO: 3732987 - RNA, 22 nt, Salmonella enterica enterica serovar Typhi Ty2
agcguuuguuugucgauuuccg

SEQ ID NO: 3732988 - RNA, 21 nt, Salmonella enterica enterica serovar Typhi Ty2
agcguuuuauccguuuccgca

SEQ ID NO: 3732989 - RNA, 20 nt, Salmonella enterica enterica serovar Typhi Ty2
agcguuuugauguccagaug

SEQ ID NO: 3732990 - RNA, 18 nt, Salmonella enterica enterica serovar Typhi Ty2
agcguuuuuaccggcucg

SEQ ID NO: 3732991 - RNA, 22 nt, Salmonella enterica enterica serovar Typhi Ty2
agcuaacgacccgaaguggugg

SEQ ID NO: 3732992 - RNA, 23 nt, Salmonella enterica enterica serovar Typhi Ty2
agcuaacgacccgaagugguggg

SEQ ID NO: 3732993 - RNA, 18 nt, Salmonella enterica enterica serovar Typhi Ty2
agcuaaguuuguaaaaua

SEQ ID NO: 3732994 - RNA, 15 nt, Salmonella enterica enterica serovar Typhi Ty2
agcuaaucacccacu

SEQ ID NO: 3732995 - RNA, 16 nt, Salmonella enterica enterica serovar Typhi Ty2
agcuaauccccagcgc

SEQ ID NO: 3732996 - RNA, 22 nt, Salmonella enterica enterica serovar Typhi Ty2
agcuaaugauuaucuuuuuuag

SEQ ID NO: 3732997 - RNA, 18 nt, Salmonella enterica enterica serovar Typhi Ty2
agcuacucaggagaucgg

SEQ ID NO: 3732998 - RNA, 14 nt, Salmonella enterica enterica serovar Typhi Ty2
agcuagccaauaau

SEQ ID NO: 3732999 - RNA, 22 nt, Salmonella enterica enterica serovar Typhi Ty2
agcuagccaauaaucgaaauaa

SEQ ID NO: 3733000 - RNA, 19 nt, Salmonella enterica enterica serovar Typhi Ty2
agcuaucgcgccggacagc

SEQ ID NO: 3733001 - RNA, 18 nt, Salmonella enterica enterica serovar Typhi Ty2
agcuauguuuaagccaga

SEQ ID NO: 3733002 - RNA, 19 nt, Salmonella enterica enterica serovar Typhi Ty2
agcuauucauuauuuuuaa

SEQ ID NO: 3733003 - RNA, 17 nt, Salmonella enterica enterica serovar Typhi Ty2
agcucaaacguaaagca

SEQ ID NO: 3733004 - RNA, 17 nt, Salmonella enterica enterica serovar Typhi Ty2
agcucaccgagacugcc

SEQ ID NO: 3733005 - RNA, 15 nt, Salmonella enterica enterica serovar Typhi Ty2
agcucacgccaaaau

SEQ ID NO: 3733006 - RNA, 18 nt, Salmonella enterica enterica serovar Typhi Ty2
agcucacgcgccagcacc

SEQ ID NO: 3733007 - RNA, 19 nt, Salmonella enterica enterica serovar Typhi Ty2
agcucacgcgccagcacca

SEQ ID NO: 3733008 - RNA, 18 nt, Salmonella enterica enterica serovar Typhi Ty2
agcucagcuggauagagc

SEQ ID NO: 3733009 - RNA, 20 nt, Salmonella enterica enterica serovar Typhi Ty2
agcuucagcuggauagagua

SEQ ID NO: 3733010 - RNA, 14 nt, Salmonella enterica enterica serovar Typhi Ty2
agcuucaugcgccg

SEQ ID NO: 3733011 - RNA, 13 nt, Salmonella enterica enterica serovar Typhi Ty2
agcuucaugcugg

SEQ ID NO: 3733012 - RNA, 12 nt, Salmonella enterica enterica serovar Typhi Ty2
agcuuccagcaa

SEQ ID NO: 3733013 - RNA, 14 nt, Salmonella enterica enterica serovar Typhi Ty2
agcuuccagcaaac

SEQ ID NO: 3733014 - RNA, 23 nt, Salmonella enterica enterica serovar Typhi Ty2
agcuuccagcaaaccuuccgcca

SEQ ID NO: 3733015 - RNA, 21 nt, Salmonella enterica enterica serovar Typhi Ty2
agcuucgccgcguaaucuucg

SEQ ID NO: 3733016 - RNA, 19 nt, Salmonella enterica enterica serovar Typhi Ty2
agcuucgguccggcgcuaa

SEQ ID NO: 3733017 - RNA, 20 nt, Salmonella enterica enterica serovar Typhi Ty2
agcuucugucugcgugaaga

SEQ ID NO: 3733018 - RNA, 18 nt, Salmonella enterica enterica serovar Typhi Ty2
agcuugaaagcagucccg

SEQ ID NO: 3733019 - RNA, 15 nt, Salmonella enterica enterica serovar Typhi Ty2
agcuugcaggcaaaa

SEQ ID NO: 3733020 - RNA, 22 nt, Salmonella enterica enterica serovar Typhi Ty2
agcuugcauggccggucuuaug

SEQ ID NO: 3733021 - RNA, 15 nt, Salmonella enterica enterica serovar Typhi Ty2
agcuugcgcagagua

SEQ ID NO: 3733022 - RNA, 15 nt, Salmonella enterica enterica serovar Typhi Ty2
agcuugcgcuggugu

SEQ ID NO: 3733023 - RNA, 17 nt, Salmonella enterica enterica serovar Typhi Ty2
agcuugcgcugguguuu

SEQ ID NO: 3733024 - RNA, 23 nt, Salmonella enterica enterica serovar Typhi Ty2
agcuuuacucaacggucaaaaua

SEQ ID NO: 3733025 - RNA, 16 nt, Salmonella enterica enterica serovar Typhi Ty2
agcuuuccaccagcca

SEQ ID NO: 3733026 - RNA, 18 nt, Salmonella enterica enterica serovar Typhi Ty2
agcuuucugaauuucacg

SEQ ID NO: 3733027 - RNA, 21 nt, Salmonella enterica enterica serovar Typhi Ty2
agcuuugcguaaaaaacauca

SEQ ID NO: 3733028 - RNA, 16 nt, Salmonella enterica enterica serovar Typhi Ty2
agcuuuuccgcuggaa

SEQ ID NO: 3733029 - RNA, 15 nt, Salmonella enterica enterica serovar Typhi Ty2
agcuuuucgccggaa

SEQ ID NO: 3733030 - RNA, 19 nt, Salmonella enterica enterica serovar Typhi Ty2
agcuuuugccugcgucguu

SEQ ID NO: 3733031 - RNA, 22 nt, Salmonella enterica enterica serovar Typhi Ty2
agcuuuugcgcguuccccaaca

SEQ ID NO: 3733032 - RNA, 20 nt, Salmonella enterica enterica serovar Typhi Ty2
agcuuuugcugcgccagcca

SEQ ID NO: 3733033 - RNA, 17 nt, Salmonella enterica enterica serovar Typhi Ty2
aggaaaacgcuuuccag

SEQ ID NO: 3733034 - RNA, 20 nt, Salmonella enterica enterica serovar Typhi Ty2
aggaaacgcgccggaaggcg

SEQ ID NO: 3733035 - RNA, 20 nt, Salmonella enterica enterica serovar Typhi Ty2
aggaaagauuacuucaggcu

SEQ ID NO: 3733036 - RNA, 14 nt, Salmonella enterica enterica serovar Typhi Ty2
aggaaauauuaauu

SEQ ID NO: 3733037 - RNA, 22 nt, Salmonella enterica enterica serovar Typhi Ty2
aggaaauauuaauuaaggauga

SEQ ID NO: 3733038 - RNA, 16 nt, Salmonella enterica enterica serovar Typhi Ty2
aggaaaucuuccaguu

SEQ ID NO: 3733039 - RNA, 17 nt, Salmonella enterica enterica serovar Typhi Ty2
aggaaaugccgggcaaa

SEQ ID NO: 3733040 - RNA, 12 nt, Salmonella enterica enterica serovar Typhi Ty2
aggaaauucaga

SEQ ID NO: 3733041 - RNA, 19 nt, Salmonella enterica enterica serovar Typhi Ty2
aggaaauucagauccgagg

SEQ ID NO: 3733042 - RNA, 12 nt, Salmonella enterica enterica serovar Typhi Ty2
aggaacagugac

SEQ ID NO: 3733043 - RNA, 14 nt, Salmonella enterica enterica serovar Typhi Ty2
aggaacagugacaa

SEQ ID NO: 3733044 - RNA, 17 nt, Salmonella enterica enterica serovar Typhi Ty2
aggaacaucagccagca

SEQ ID NO: 3733045 - RNA, 14 nt, Salmonella enterica enterica serovar Typhi Ty2
aggaaccacaucca

SEQ ID NO: 3733046 - RNA, 21 nt, Salmonella enterica enterica serovar Typhi Ty2
aggaaccgguagccaggcgcg

SEQ ID NO: 3733047 - RNA, 19 nt, Salmonella enterica enterica serovar Typhi Ty2
aggaacgcgcagaccguuu

SEQ ID NO: 3733048 - RNA, 19 nt, Salmonella enterica enterica serovar Typhi Ty2
aggaacuaacuccggagcu

SEQ ID NO: 3733049 - RNA, 17 nt, Salmonella enterica enterica serovar Typhi Ty2
aggaacuguucagccag

SEQ ID NO: 3733050 - RNA, 20 nt, Salmonella enterica enterica serovar Typhi Ty2
aggaacuguucagccagcaa

SEQ ID NO: 3733051 - RNA, 18 nt, Salmonella enterica enterica serovar Typhi Ty2
aggaaggcgguaagagag

SEQ ID NO: 3733052 - RNA, 15 nt, Salmonella enterica enterica serovar Typhi Ty2
aggaaggcgugcagc

SEQ ID NO: 3733053 - RNA, 13 nt, Salmonella enterica enterica serovar Typhi Ty2
aggaagucagcuu

SEQ ID NO: 3733054 - RNA, 13 nt, Salmonella enterica enterica serovar Typhi Ty2
aggaauaacaucg

SEQ ID NO: 3733055 - RNA, 14 nt, Salmonella enterica enterica serovar Typhi Ty2
aggaauaacaucgu

SEQ ID NO: 3733056 - RNA, 21 nt, Salmonella enterica enterica serovar Typhi Ty2
aggaauaagggugagagggga

SEQ ID NO: 3733057 - RNA, 19 nt, Salmonella enterica enterica serovar Typhi Ty2
aggaauacauuaacgcugg

SEQ ID NO: 3733058 - RNA, 19 nt, Salmonella enterica enterica serovar Typhi Ty2
aggaaucauucuauugcau

SEQ ID NO: 3733059 - RNA, 22 nt, Salmonella enterica enterica serovar Typhi Ty2
aggaauuacgggcgauacaccu

SEQ ID NO: 3733060 - RNA, 17 nt, Salmonella enterica enterica serovar Typhi Ty2
aggaauuccaguccuuu

SEQ ID NO: 3733061 - RNA, 13 nt, Salmonella enterica enterica serovar Typhi Ty2
aggaauucuccac

SEQ ID NO: 3733062 - RNA, 15 nt, Salmonella enterica enterica serovar Typhi Ty2
aggaauuuaucaaca

SEQ ID NO: 3733063 - RNA, 13 nt, Salmonella enterica enterica serovar Typhi Ty2
aggaauuuuccca

SEQ ID NO: 3733064 - RNA, 18 nt, Salmonella enterica enterica serovar Typhi Ty2
aggacaaccccuacgcag

SEQ ID NO: 3733065 - RNA, 17 nt, Salmonella enterica enterica serovar Typhi Ty2
aggaccaaaacaguacu

SEQ ID NO: 3733066 - RNA, 15 nt, Salmonella enterica enterica serovar Typhi Ty2
aggacucaaucacuu

SEQ ID NO: 3733067 - RNA, 16 nt, Salmonella enterica enterica serovar Typhi Ty2
aggacucaaucacuua

SEQ ID NO: 3733068 - RNA, 14 nt, Salmonella enterica enterica serovar Typhi Ty2
aggagaaaacgggu

SEQ ID NO: 3733069 - RNA, 11 nt, Salmonella enterica enterica serovar Typhi Ty2
aggagaaaauu

SEQ ID NO: 3733070 - RNA, 14 nt, Salmonella enterica enterica serovar Typhi Ty2
aggagacgccgccc

SEQ ID NO: 3733071 - RNA, 18 nt, Salmonella enterica enterica serovar Typhi Ty2
aggagagccagaagaaua

SEQ ID NO: 3733072 - RNA, 21 nt, Salmonella enterica enterica serovar Typhi Ty2
aggagaucggcgcagguccau

SEQ ID NO: 3733073 - RNA, 17 nt, Salmonella enterica enterica serovar Typhi Ty2
aggagaugaccugccca

SEQ ID NO: 3733074 - RNA, 22 nt, Salmonella enterica enterica serovar Typhi Ty2
aggagcauagauaacuauguga

SEQ ID NO: 3733075 - RNA, 19 nt, Salmonella enterica enterica serovar Typhi Ty2
aggagcgccguggaaaaga

SEQ ID NO: 3733076 - RNA, 21 nt, Salmonella enterica enterica serovar Typhi Ty2
aggaggcgcguuuacuggcga

SEQ ID NO: 3733077 - RNA, 22 nt, Salmonella enterica enterica serovar Typhi Ty2
aggaguccaaaacgaacaggcc

SEQ ID NO: 3733078 - RNA, 22 nt, Salmonella enterica enterica serovar Typhi Ty2
aggauaaaauccugcacgccgg

SEQ ID NO: 3733079 - RNA, 17 nt, Salmonella enterica enterica serovar Typhi Ty2
aggauaaaaucgccaaa

SEQ ID NO: 3733080 - RNA, 15 nt, Salmonella enterica enterica serovar Typhi Ty2
aggauaaccuuccgg

SEQ ID NO: 3733081 - RNA, 16 nt, Salmonella enterica enterica serovar Typhi Ty2
aggauaagaauaggug

SEQ ID NO: 3733082 - RNA, 23 nt, Salmonella enterica enterica serovar Typhi Ty2
aggauaauucccccaguaguuga

SEQ ID NO: 3733083 - RNA, 17 nt, Salmonella enterica enterica serovar Typhi Ty2
aggauaguacugaccag

SEQ ID NO: 3733084 - RNA, 15 nt, Salmonella enterica enterica serovar Typhi Ty2
aggauagugauauag

SEQ ID NO: 3733085 - RNA, 15 nt, Salmonella enterica enterica serovar Typhi Ty2
aggauauaagcgcca

SEQ ID NO: 3733086 - RNA, 15 nt, Salmonella enterica enterica serovar Typhi Ty2
aggauauuuauuugc

SEQ ID NO: 3733087 - RNA, 17 nt, Salmonella enterica enterica serovar Typhi Ty2
aggauauuuauuugcau

SEQ ID NO: 3733088 - RNA, 21 nt, Salmonella enterica enterica serovar Typhi Ty2
aggauauuuugcggcuucagc

SEQ ID NO: 3733089 - RNA, 19 nt, Salmonella enterica enterica serovar Typhi Ty2
aggaucaucggccagauaa

SEQ ID NO: 3733090 - RNA, 22 nt, Salmonella enterica enterica serovar Typhi Ty2
aggaucguaacaggucacgaca

SEQ ID NO: 3733091 - RNA, 17 nt, Salmonella enterica enterica serovar Typhi Ty2
aggccuacauccggcuc

SEQ ID NO: 3733092 - RNA, 16 nt, Salmonella enterica enterica serovar Typhi Ty2
aggccuaccagccgag

SEQ ID NO: 3733093 - RNA, 13 nt, Salmonella enterica enterica serovar Typhi Ty2
aggccuauagaca

SEQ ID NO: 3733094 - RNA, 21 nt, Salmonella enterica enterica serovar Typhi Ty2
aggccucgaccaguuuuuccg

SEQ ID NO: 3733095 - RNA, 13 nt, Salmonella enterica enterica serovar Typhi Ty2
aggccucuaucuu

SEQ ID NO: 3733096 - RNA, 13 nt, Salmonella enterica enterica serovar Typhi Ty2
aggccugauaagc

SEQ ID NO: 3733097 - RNA, 18 nt, Salmonella enterica enterica serovar Typhi Ty2
aggccugauaagcacagg

SEQ ID NO: 3733098 - RNA, 20 nt, Salmonella enterica enterica serovar Typhi Ty2
aggccugauaagcacaggcc

SEQ ID NO: 3733099 - RNA, 14 nt, Salmonella enterica enterica serovar Typhi Ty2
aggccugauaagcg

SEQ ID NO: 3733100 - RNA, 20 nt, Salmonella enterica enterica serovar Typhi Ty2
aggccugauaagcgcagcgc

SEQ ID NO: 3733101 - RNA, 22 nt, Salmonella enterica enterica serovar Typhi Ty2
aggccugauaagcgcagcgcca

SEQ ID NO: 3733102 - RNA, 18 nt, Salmonella enterica enterica serovar Typhi Ty2
aggccugaugagcgcagc

SEQ ID NO: 3733103 - RNA, 20 nt, Salmonella enterica enterica serovar Typhi Ty2
aggccugcaucaacaggcga

SEQ ID NO: 3733104 - RNA, 22 nt, Salmonella enterica enterica serovar Typhi Ty2
aggccugccggguuuaaugcgc

SEQ ID NO: 3733105 - RNA, 12 nt, Salmonella enterica enterica serovar Typhi Ty2
aggccuggcugg

SEQ ID NO: 3733106 - RNA, 21 nt, Salmonella enterica enterica serovar Typhi Ty2
aggccuggcuggaugaggcgc

SEQ ID NO: 3733107 - RNA, 20 nt, Salmonella enterica enterica serovar Typhi Ty2
aggccugguaagcguagcgc

SEQ ID NO: 3733108 - RNA, 12 nt, Salmonella enterica enterica serovar Typhi Ty2
aggcgaaaacau

SEQ ID NO: 3733109 - RNA, 20 nt, Salmonella enterica enterica serovar Typhi Ty2
aggcgaaaccggccgccauc

SEQ ID NO: 3733110 - RNA, 21 nt, Salmonella enterica enterica serovar Typhi Ty2
aggcgaaacggcggaaccauu

SEQ ID NO: 3733111 - RNA, 13 nt, Salmonella enterica enterica serovar Typhi Ty2
aggcgaaccccau

SEQ ID NO: 3733112 - RNA, 16 nt, Salmonella enterica enterica serovar Typhi Ty2
aggcgaacuccagcgc

SEQ ID NO: 3733113 - RNA, 13 nt, Salmonella enterica enterica serovar Typhi Ty2
aggcgaauagcgc

SEQ ID NO: 3733114 - RNA, 13 nt, Salmonella enterica enterica serovar Typhi Ty2
aggcgaaucccca

SEQ ID NO: 3733115 - RNA, 16 nt, Salmonella enterica enterica serovar Typhi Ty2
aggcgacccauaacgg

SEQ ID NO: 3733116 - RNA, 17 nt, Salmonella enterica enterica serovar Typhi Ty2
aggcgacgaugugcaua

SEQ ID NO: 3733117 - RNA, 17 nt, Salmonella enterica enterica serovar Typhi Ty2
aggcgacgcgauagcgc

SEQ ID NO: 3733118 - RNA, 22 nt, Salmonella enterica enterica serovar Typhi Ty2
aggcgacuaccguucacggcga

SEQ ID NO: 3733119 - RNA, 17 nt, Salmonella enterica enterica serovar Typhi Ty2
aggcgacucauuacgcc

SEQ ID NO: 3733120 - RNA, 19 nt, Salmonella enterica enterica serovar Typhi Ty2
aggcgacuggcguccgcaa

SEQ ID NO: 3733121 - RNA, 21 nt, Salmonella enterica enterica serovar Typhi Ty2
aggcgagcacaccauaucuuu

SEQ ID NO: 3733122 - RNA, 20 nt, Salmonella enterica enterica serovar Typhi Ty2
aggcgauaccgguacggaac

SEQ ID NO: 3733123 - RNA, 23 nt, Salmonella enterica enterica serovar Typhi Ty2
aggcgauaccuaaucccuggcga

SEQ ID NO: 3733124 - RNA, 17 nt, Salmonella enterica enterica serovar Typhi Ty2
aggcgauucaacagggc

SEQ ID NO: 3733125 - RNA, 22 nt, Salmonella enterica enterica serovar Typhi Ty2
aggcgcaacgucgccauccggc

SEQ ID NO: 3733126 - RNA, 19 nt, Salmonella enterica enterica serovar Typhi Ty2
aggcgcagagugagcaggc

SEQ ID NO: 3733127 - RNA, 14 nt, Salmonella enterica enterica serovar Typhi Ty2
aggcgcaucagaaa

SEQ ID NO: 3733128 - RNA, 17 nt, Salmonella enterica enterica serovar Typhi Ty2
aggcgcaucagaaaaac

SEQ ID NO: 3733129 - RNA, 19 nt, Salmonella enterica enterica serovar Typhi Ty2
aggcgcaucagaaaaaccu

SEQ ID NO: 3733130 - RNA, 20 nt, Salmonella enterica enterica serovar Typhi Ty2
aggcgcauccgucaggccca

SEQ ID NO: 3733131 - RNA, 21 nt, Salmonella enterica enterica serovar Typhi Ty2
aggcgccgcucaucaccagca

SEQ ID NO: 3733132 - RNA, 23 nt, Salmonella enterica enterica serovar Typhi Ty2
aggcgccggggcagcaauaguug

SEQ ID NO: 3733133 - RNA, 18 nt, Salmonella enterica enterica serovar Typhi Ty2
aggcgcgaccucaucaaa

SEQ ID NO: 3733134 - RNA, 15 nt, Salmonella enterica enterica serovar Typhi Ty2
aggcgcgcagcugcc

SEQ ID NO: 3733135 - RNA, 18 nt, Salmonella enterica enterica serovar Typhi Ty2
aggcgcguagcuggccuu

SEQ ID NO: 3733136 - RNA, 20 nt, Salmonella enterica enterica serovar Typhi Ty2
aggcgcuauucccaggcaaa

SEQ ID NO: 3733137 - RNA, 14 nt, Salmonella enterica enterica serovar Typhi Ty2
aggcgcuugcgccg

SEQ ID NO: 3733138 - RNA, 16 nt, Salmonella enterica enterica serovar Typhi Ty2
aggcgcuugugauauc

SEQ ID NO: 3733139 - RNA, 20 nt, Salmonella enterica enterica serovar Typhi Ty2
aggcggaccgagauacgcug

SEQ ID NO: 3733140 - RNA, 18 nt, Salmonella enterica enterica serovar Typhi Ty2
aggcggagaaaugcgaca

SEQ ID NO: 3733141 - RNA, 14 nt, Salmonella enterica enterica serovar Typhi Ty2
aggcggagccgcca

SEQ ID NO: 3733142 - RNA, 23 nt, Salmonella enterica enterica serovar Typhi Ty2
aggcggaguuauacagugccagu

SEQ ID NO: 3733143 - RNA, 13 nt, Salmonella enterica enterica serovar Typhi Ty2
aggcggcaaagau

SEQ ID NO: 3733144 - RNA, 23 nt, Salmonella enterica enterica serovar Typhi Ty2
aggcggcaugauagggcgccugu

SEQ ID NO: 3733145 - RNA, 12 nt, Salmonella enterica enterica serovar Typhi Ty2
aggcggcgagcg

SEQ ID NO: 3733146 - RNA, 13 nt, Salmonella enterica enterica serovar Typhi Ty2
aggcggcgccgcg

SEQ ID NO: 3733147 - RNA, 13 nt, Salmonella enterica enterica serovar Typhi Ty2
aggcggcggugau

SEQ ID NO: 3733148 - RNA, 16 nt, Salmonella enterica enterica serovar Typhi Ty2
aggcguaaaaaggcgc

SEQ ID NO: 3733149 - RNA, 13 nt, Salmonella enterica enterica serovar Typhi Ty2
aggcguaugaaug

SEQ ID NO: 3733150 - RNA, 15 nt, Salmonella enterica enterica serovar Typhi Ty2
aggcgucaaaacagg

SEQ ID NO: 3733151 - RNA, 15 nt, Salmonella enterica enterica serovar Typhi Ty2
aggcgucccauguug

SEQ ID NO: 3733152 - RNA, 16 nt, Salmonella enterica enterica serovar Typhi Ty2
aggcgucgaacuccgc

SEQ ID NO: 3733153 - RNA, 14 nt, Salmonella enterica enterica serovar Typhi Ty2
aggcguuacagacg

SEQ ID NO: 3733154 - RNA, 18 nt, Salmonella enterica enterica serovar Typhi Ty2
aggcguuagcggcgauuc

SEQ ID NO: 3733155 - RNA, 22 nt, Salmonella enterica enterica serovar Typhi Ty2
aggcguucccgaaaugggccaa

SEQ ID NO: 3733156 - RNA, 18 nt, Salmonella enterica enterica serovar Typhi Ty2
aggcguugaacauuucau

SEQ ID NO: 3733157 - RNA, 20 nt, Salmonella enterica enterica serovar Typhi Ty2
aggcguugugcugcggcaug

SEQ ID NO: 3733158 - RNA, 21 nt, Salmonella enterica enterica serovar Typhi Ty2
aggcguuuacgcugcuauccg

SEQ ID NO: 3733159 - RNA, 18 nt, Salmonella enterica enterica serovar Typhi Ty2
aggcguuuugguccgcgc

SEQ ID NO: 3733160 - RNA, 13 nt, Salmonella enterica enterica serovar Typhi Ty2
aggcuaaauggca

SEQ ID NO: 3733161 - RNA, 22 nt, Salmonella enterica enterica serovar Typhi Ty2
aggcuaacagcuggcuugccag

SEQ ID NO: 3733162 - RNA, 14 nt, Salmonella enterica enterica serovar Typhi Ty2
aggcuacccagaca

SEQ ID NO: 3733163 - RNA, 16 nt, Salmonella enterica enterica serovar Typhi Ty2
aggcuacccagacaag

SEQ ID NO: 3733164 - RNA, 19 nt, Salmonella enterica enterica serovar Typhi Ty2
aggcuacccgcaauaccaa

SEQ ID NO: 3733165 - RNA, 18 nt, Salmonella enterica enterica serovar Typhi Ty2
aggcuaccgggcaaacau

SEQ ID NO: 3733166 - RNA, 21 nt, Salmonella enterica enterica serovar Typhi Ty2
aggcuacgguacugcccaccu

SEQ ID NO: 3733167 - RNA, 22 nt, Salmonella enterica enterica serovar Typhi Ty2
aggcuacgguacugcccaccuu

SEQ ID NO: 3733168 - RNA, 20 nt, Salmonella enterica enterica serovar Typhi Ty2
aggcuauuuuauucgccauu

SEQ ID NO: 3733169 - RNA, 14 nt, Salmonella enterica enterica serovar Typhi Ty2
aggcucaaaguuac

SEQ ID NO: 3733170 - RNA, 13 nt, Salmonella enterica enterica serovar Typhi Ty2
aggcucagcgcca

SEQ ID NO: 3733171 - RNA, 16 nt, Salmonella enterica enterica serovar Typhi Ty2
aggcucaggaaaacaa

SEQ ID NO: 3733172 - RNA, 21 nt, Salmonella enterica enterica serovar Typhi Ty2
aggcucaucagcgccauugcu

SEQ ID NO: 3733173 - RNA, 18 nt, Salmonella enterica enterica serovar Typhi Ty2
agggugcagcaaauaauc

SEQ ID NO: 3733174 - RNA, 23 nt, Salmonella enterica enterica serovar Typhi Ty2
agggugggcgcacaggccuucau

SEQ ID NO: 3733175 - RNA, 21 nt, Salmonella enterica enterica serovar Typhi Ty2
aggguuauuuccgcuggccgg

SEQ ID NO: 3733176 - RNA, 17 nt, Salmonella enterica enterica serovar Typhi Ty2
aggguugccagaggcag

SEQ ID NO: 3733177 - RNA, 22 nt, Salmonella enterica enterica serovar Typhi Ty2
aggguuuucaauuccacaggcg

SEQ ID NO: 3733178 - RNA, 23 nt, Salmonella enterica enterica serovar Typhi Ty2
aggguuuucaauuccacaggcgc

SEQ ID NO: 3733179 - RNA, 18 nt, Salmonella enterica enterica serovar Typhi Ty2
aggguuuucuaccgcagc

SEQ ID NO: 3733180 - RNA, 22 nt, Salmonella enterica enterica serovar Typhi Ty2
agguaaagaucggcuuauaaaa

SEQ ID NO: 3733181 - RNA, 14 nt, Salmonella enterica enterica serovar Typhi Ty2
agguaaauccgcca

SEQ ID NO: 3733182 - RNA, 17 nt, Salmonella enterica enterica serovar Typhi Ty2
agguaauaucauccggu

SEQ ID NO: 3733183 - RNA, 16 nt, Salmonella enterica enterica serovar Typhi Ty2
agguacagcuuagcug

SEQ ID NO: 3733184 - RNA, 13 nt, Salmonella enterica enterica serovar Typhi Ty2
agguacauugcca

SEQ ID NO: 3733185 - RNA, 20 nt, Salmonella enterica enterica serovar Typhi Ty2
agguacgcguuucacaaccu

SEQ ID NO: 3733186 - RNA, 21 nt, Salmonella enterica enterica serovar Typhi Ty2
agguacuuucccccagauugu

SEQ ID NO: 3733187 - RNA, 14 nt, Salmonella enterica enterica serovar Typhi Ty2
agguagagcuggcu

SEQ ID NO: 3733188 - RNA, 17 nt, Salmonella enterica enterica serovar Typhi Ty2
agguagcagaccgguac

SEQ ID NO: 3733189 - RNA, 19 nt, Salmonella enterica enterica serovar Typhi Ty2
agguagcccggcaggcugg

SEQ ID NO: 3733190 - RNA, 17 nt, Salmonella enterica enterica serovar Typhi Ty2
agguaguaacgggcauc

SEQ ID NO: 3733191 - RNA, 17 nt, Salmonella enterica enterica serovar Typhi Ty2
agguaguccaaauaagg

SEQ ID NO: 3733192 - RNA, 17 nt, Salmonella enterica enterica serovar Typhi Ty2
agguauaggaaaaugau

SEQ ID NO: 3733193 - RNA, 18 nt, Salmonella enterica enterica serovar Typhi Ty2
agguauccgccauauccc

SEQ ID NO: 3733194 - RNA, 16 nt, Salmonella enterica enterica serovar Typhi Ty2
agguauccuaaugcca

SEQ ID NO: 3733195 - RNA, 16 nt, Salmonella enterica enterica serovar Typhi Ty2
agguauccuccugcca

SEQ ID NO: 3733196 - RNA, 20 nt, Salmonella enterica enterica serovar Typhi Ty2
agguauccugaaccagcggc

SEQ ID NO: 3733197 - RNA, 23 nt, Salmonella enterica enterica serovar Typhi Ty2
agguaucgauacagacgccaacg

SEQ ID NO: 3733198 - RNA, 14 nt, Salmonella enterica enterica serovar Typhi Ty2
agguaugcuucagc

SEQ ID NO: 3733199 - RNA, 20 nt, Salmonella enterica enterica serovar Typhi Ty2
agguauucaccaaaaggcag

SEQ ID NO: 3733200 - RNA, 15 nt, Salmonella enterica enterica serovar Typhi Ty2
agguauugauuuuua

SEQ ID NO: 3733201 - RNA, 23 nt, Salmonella enterica enterica serovar Typhi Ty2
agguauuucgaggggcaggaagg

SEQ ID NO: 3733202 - RNA, 21 nt, Salmonella enterica enterica serovar Typhi Ty2
aggucaaccacgagagcaccg

SEQ ID NO: 3733203 - RNA, 15 nt, Salmonella enterica enterica serovar Typhi Ty2
aggucaauaagauau

SEQ ID NO: 3733204 - RNA, 15 nt, Salmonella enterica enterica serovar Typhi Ty2
aggucacaucaucgc

SEQ ID NO: 3733205 - RNA, 16 nt, Salmonella enterica enterica serovar Typhi Ty2
aggucacaucaucgcc

SEQ ID NO: 3733206 - RNA, 19 nt, Salmonella enterica enterica serovar Typhi Ty2
aggucacgccggaaaucac

SEQ ID NO: 3733207 - RNA, 20 nt, Salmonella enterica enterica serovar Typhi Ty2
aggucagauccuuuuucugc

SEQ ID NO: 3733208 - RNA, 16 nt, Salmonella enterica enterica serovar Typhi Ty2
aggucagcaguuuuuc

SEQ ID NO: 3733209 - RNA, 15 nt, Salmonella enterica enterica serovar Typhi Ty2
aggucaugguaaaac

SEQ ID NO: 3733210 - RNA, 16 nt, Salmonella enterica enterica serovar Typhi Ty2
aggucauuauucaggc

SEQ ID NO: 3733211 - RNA, 17 nt, Salmonella enterica enterica serovar Typhi Ty2
aggucauuauucaggcc

SEQ ID NO: 3733212 - RNA, 14 nt, Salmonella enterica enterica serovar Typhi Ty2
aggucauuccugcg

SEQ ID NO: 3733213 - RNA, 16 nt, Salmonella enterica enterica serovar Typhi Ty2
aggucgccaaauuuag

SEQ ID NO: 3733214 - RNA, 17 nt, Salmonella enterica enterica serovar Typhi Ty2
aggucgcgauccgcgag

SEQ ID NO: 3733215 - RNA, 21 nt, Salmonella enterica enterica serovar Typhi Ty2
aggucgcggucggccuuaacg

SEQ ID NO: 3733216 - RNA, 20 nt, Salmonella enterica enterica serovar Typhi Ty2
aggucgcuauccagcaguaa

SEQ ID NO: 3733217 - RNA, 23 nt, Salmonella enterica enterica serovar Typhi Ty2
aggucgcuauccagcaguaaaua

SEQ ID NO: 3733218 - RNA, 21 nt, Salmonella enterica enterica serovar Typhi Ty2
aggucggccaaccgccacaau

SEQ ID NO: 3733219 - RNA, 13 nt, Salmonella enterica enterica serovar Typhi Ty2
aggucggcuccug

SEQ ID NO: 3733220 - RNA, 17 nt, Salmonella enterica enterica serovar Typhi Ty2
aggucggcuccugguga

SEQ ID NO: 3733221 - RNA, 14 nt, Salmonella enterica enterica serovar Typhi Ty2
aggucggcugcccu

SEQ ID NO: 3733222 - RNA, 20 nt, Salmonella enterica enterica serovar Typhi Ty2
aggucggguaagcguagcgc

SEQ ID NO: 3733223 - RNA, 20 nt, Salmonella enterica enterica serovar Typhi Ty2
aggucggguaaggcguagcc

SEQ ID NO: 3733224 - RNA, 14 nt, Salmonella enterica enterica serovar Typhi Ty2
aggucgucuucuug

SEQ ID NO: 3733225 - RNA, 21 nt, Salmonella enterica enterica serovar Typhi Ty2
aggucuauugccuaaauaacu

SEQ ID NO: 3733226 - RNA, 15 nt, Salmonella enterica enterica serovar Typhi Ty2
aggucugacaacuau

SEQ ID NO: 3733227 - RNA, 15 nt, Salmonella enterica enterica serovar Typhi Ty2
aggucugcaccacgg

SEQ ID NO: 3733228 - RNA, 14 nt, Salmonella enterica enterica serovar Typhi Ty2
aggucuugauggcg

SEQ ID NO: 3733229 - RNA, 18 nt, Salmonella enterica enterica serovar Typhi Ty2
aggucuugccaacaaagg

SEQ ID NO: 3733230 - RNA, 20 nt, Salmonella enterica enterica serovar Typhi Ty2
aggucuugccaacaaagguu

SEQ ID NO: 3733231 - RNA, 13 nt, Salmonella enterica enterica serovar Typhi Ty2
aggugaauagcau

SEQ ID NO: 3733232 - RNA, 16 nt, Salmonella enterica enterica serovar Typhi Ty2
aggugacgaagaucgc

SEQ ID NO: 3733233 - RNA, 13 nt, Salmonella enterica enterica serovar Typhi Ty2
aggugagcucuuu

SEQ ID NO: 3733234 - RNA, 15 nt, Salmonella enterica enterica serovar Typhi Ty2
aggugagcucuuucu

SEQ ID NO: 3733235 - RNA, 14 nt, Salmonella enterica enterica serovar Typhi Ty2
aggugaucuguuca

SEQ ID NO: 3733236 - RNA, 18 nt, Salmonella enterica enterica serovar Typhi Ty2
aggugcggauaguccugc

SEQ ID NO: 3733237 - RNA, 20 nt, Salmonella enterica enterica serovar Typhi Ty2
aggugcggugcgacaaagau

SEQ ID NO: 3733238 - RNA, 12 nt, Salmonella enterica enterica serovar Typhi Ty2
aggugcugguga

SEQ ID NO: 3733239 - RNA, 16 nt, Salmonella enterica enterica serovar Typhi Ty2
aggugcuggugguggg

SEQ ID NO: 3733240 - RNA, 13 nt, Salmonella enterica enterica serovar Typhi Ty2
agguggaagaaac

SEQ ID NO: 3733241 - RNA, 15 nt, Salmonella enterica enterica serovar Typhi Ty2
agguggcaauauccu

SEQ ID NO: 3733242 - RNA, 17 nt, Salmonella enterica enterica serovar Typhi Ty2
agguguaucccuauucu

SEQ ID NO: 3733243 - RNA, 21 nt, Salmonella enterica enterica serovar Typhi Ty2
agguguuacgugggucgagaa

SEQ ID NO: 3733244 - RNA, 16 nt, Salmonella enterica enterica serovar Typhi Ty2
agguguucagguaaau

SEQ ID NO: 3733245 - RNA, 13 nt, Salmonella enterica enterica serovar Typhi Ty2
agguuaagugaca

SEQ ID NO: 3733246 - RNA, 19 nt, Salmonella enterica enterica serovar Typhi Ty2
agguuacucuuccaccauc

SEQ ID NO: 3733247 - RNA, 20 nt, Salmonella enterica enterica serovar Typhi Ty2
agguuaguaaugccuucuga

SEQ ID NO: 3733248 - RNA, 15 nt, Salmonella enterica enterica serovar Typhi Ty2
agguuauauuccgcc

SEQ ID NO: 3733249 - RNA, 16 nt, Salmonella enterica enterica serovar Typhi Ty2
agguuauccgccggag

SEQ ID NO: 3733250 - RNA, 24 nt, Salmonella enterica enterica serovar Typhi Ty2
agguuauuaaaaagccagcguaaa

SEQ ID NO: 3733251 - RNA, 16 nt, Salmonella enterica enterica serovar Typhi Ty2
agguuauucaggugga

SEQ ID NO: 3733252 - RNA, 18 nt, Salmonella enterica enterica serovar Typhi Ty2
agguucaccaccacccag

SEQ ID NO: 3733253 - RNA, 19 nt, Salmonella enterica enterica serovar Typhi Ty2
agguucagcgugcguucau

SEQ ID NO: 3733254 - RNA, 13 nt, Salmonella enterica enterica serovar Typhi Ty2
agguucccgcccu

SEQ ID NO: 3733255 - RNA, 18 nt, Salmonella enterica enterica serovar Typhi Ty2
aguauuaaggcagccauu

SEQ ID NO: 3733256 - RNA, 14 nt, Salmonella enterica enterica serovar Typhi Ty2
aguauuauuuugau

SEQ ID NO: 3733257 - RNA, 20 nt, Salmonella enterica enterica serovar Typhi Ty2
aguauuuacaaaaaagauaa

SEQ ID NO: 3733258 - RNA, 21 nt, Salmonella enterica enterica serovar Typhi Ty2
agucaaacacgaccagcgaca

SEQ ID NO: 3733259 - RNA, 16 nt, Salmonella enterica enterica serovar Typhi Ty2
agucaaauuccagcaa

SEQ ID NO: 3733260 - RNA, 18 nt, Salmonella enterica enterica serovar Typhi Ty2
agucaaauuccagcaaug

SEQ ID NO: 3733261 - RNA, 22 nt, Salmonella enterica enterica serovar Typhi Ty2
agucaacucaugccgcugcugg

SEQ ID NO: 3733262 - RNA, 23 nt, Salmonella enterica enterica serovar Typhi Ty2
agucaacucaugccgcugcuggc

SEQ ID NO: 3733263 - RNA, 18 nt, Salmonella enterica enterica serovar Typhi Ty2
agucaaggcauccagcag

SEQ ID NO: 3733264 - RNA, 17 nt, Salmonella enterica enterica serovar Typhi Ty2
agucacagauccagaca

SEQ ID NO: 3733265 - RNA, 16 nt, Salmonella enterica enterica serovar Typhi Ty2
agucacuccaggcguu

SEQ ID NO: 3733266 - RNA, 15 nt, Salmonella enterica enterica serovar Typhi Ty2
agucagacaccagcc

SEQ ID NO: 3733267 - RNA, 15 nt, Salmonella enterica enterica serovar Typhi Ty2
agucagaggaauucu

SEQ ID NO: 3733268 - RNA, 23 nt, Salmonella enterica enterica serovar Typhi Ty2
agucagcaacauggauucgcugg

SEQ ID NO: 3733269 - RNA, 13 nt, Salmonella enterica enterica serovar Typhi Ty2
agucagcguuacu

SEQ ID NO: 3733270 - RNA, 17 nt, Salmonella enterica enterica serovar Typhi Ty2
agucagcguuacuggcg

SEQ ID NO: 3733271 - RNA, 21 nt, Salmonella enterica enterica serovar Typhi Ty2
agucagcucgguggcgguauc

SEQ ID NO: 3733272 - RNA, 23 nt, Salmonella enterica enterica serovar Typhi Ty2
agucaggaucgguaaacgccccu

SEQ ID NO: 3733273 - RNA, 22 nt, Salmonella enterica enterica serovar Typhi Ty2
agucagggcgcggcgcaacuuu

SEQ ID NO: 3733274 - RNA, 23 nt, Salmonella enterica enterica serovar Typhi Ty2
agucauaauacucaauauccugc

SEQ ID NO: 3733275 - RNA, 14 nt, Salmonella enterica enterica serovar Typhi Ty2
agucauaauuaaaa

SEQ ID NO: 3733276 - RNA, 23 nt, Salmonella enterica enterica serovar Typhi Ty2
agucauaccuguuccucuuuccc

SEQ ID NO: 3733277 - RNA, 13 nt, Salmonella enterica enterica serovar Typhi Ty2
agucauccuuccc

SEQ ID NO: 3733278 - RNA, 19 nt, Salmonella enterica enterica serovar Typhi Ty2
agucaucgccuucauccgc

SEQ ID NO: 3733279 - RNA, 19 nt, Salmonella enterica enterica serovar Typhi Ty2
aguccagcagccaugccag

SEQ ID NO: 3733280 - RNA, 15 nt, Salmonella enterica enterica serovar Typhi Ty2
aguccagccauaauc

SEQ ID NO: 3733281 - RNA, 17 nt, Salmonella enterica enterica serovar Typhi Ty2
aguccauaccguuucaa

SEQ ID NO: 3733282 - RNA, 14 nt, Salmonella enterica enterica serovar Typhi Ty2
aguccauuuuccua

SEQ ID NO: 3733283 - RNA, 12 nt, Salmonella enterica enterica serovar Typhi Ty2
agucccagcguu

SEQ ID NO: 3733284 - RNA, 18 nt, Salmonella enterica enterica serovar Typhi Ty2
aguccccuuuucacccaa

SEQ ID NO: 3733285 - RNA, 14 nt, Salmonella enterica enterica serovar Typhi Ty2
aguccgacuuuuuu

SEQ ID NO: 3733286 - RNA, 19 nt, Salmonella enterica enterica serovar Typhi Ty2
aguccgccgucgucaccgc

SEQ ID NO: 3733287 - RNA, 21 nt, Salmonella enterica enterica serovar Typhi Ty2
aguccgcuuuucguccccuau

SEQ ID NO: 3733288 - RNA, 15 nt, Salmonella enterica enterica serovar Typhi Ty2
aguccggacgcccgg

SEQ ID NO: 3733289 - RNA, 14 nt, Salmonella enterica enterica serovar Typhi Ty2
aguccggauggcag

SEQ ID NO: 3733290 - RNA, 20 nt, Salmonella enterica enterica serovar Typhi Ty2
aguccgucagaauaucuuuu

SEQ ID NO: 3733291 - RNA, 21 nt, Salmonella enterica enterica serovar Typhi Ty2
aguccgucguuaaucagcgcg

SEQ ID NO: 3733292 - RNA, 15 nt, Salmonella enterica enterica serovar Typhi Ty2
aguccuaacaccugc

SEQ ID NO: 3733293 - RNA, 14 nt, Salmonella enterica enterica serovar Typhi Ty2
aguccucagcgaau

SEQ ID NO: 3733294 - RNA, 21 nt, Salmonella enterica enterica serovar Typhi Ty2
aguccucagcgaauaucucua

SEQ ID NO: 3733295 - RNA, 15 nt, Salmonella enterica enterica serovar Typhi Ty2
aguccuccggcugaa

SEQ ID NO: 3733296 - RNA, 23 nt, Salmonella enterica enterica serovar Typhi Ty2
aguccugccaccagcguaccggc

SEQ ID NO: 3733297 - RNA, 22 nt, Salmonella enterica enterica serovar Typhi Ty2
aguccugccauucgacaagcgg

SEQ ID NO: 3733298 - RNA, 22 nt, Salmonella enterica enterica serovar Typhi Ty2
aguccugccggacugauaccgc

SEQ ID NO: 3733299 - RNA, 14 nt, Salmonella enterica enterica serovar Typhi Ty2
aguccugcgucgcu

SEQ ID NO: 3733300 - RNA, 13 nt, Salmonella enterica enterica serovar Typhi Ty2
aguccuguaucuu

SEQ ID NO: 3733301 - RNA, 15 nt, Salmonella enterica enterica serovar Typhi Ty2
aguccuguaucuucg

SEQ ID NO: 3733302 - RNA, 17 nt, Salmonella enterica enterica serovar Typhi Ty2
aguccugucccugccag

SEQ ID NO: 3733303 - RNA, 17 nt, Salmonella enterica enterica serovar Typhi Ty2
aguccuucuucccccug

SEQ ID NO: 3733304 - RNA, 14 nt, Salmonella enterica enterica serovar Typhi Ty2
agucgauacgcuga

SEQ ID NO: 3733305 - RNA, 18 nt, Salmonella enterica enterica serovar Typhi Ty2
agucgcaauauaaauauc

SEQ ID NO: 3733306 - RNA, 15 nt, Salmonella enterica enterica serovar Typhi Ty2
agucgcagcggcugc

SEQ ID NO: 3733307 - RNA, 19 nt, Salmonella enterica enterica serovar Typhi Ty2
agucgcauccaguggugaa

SEQ ID NO: 3733308 - RNA, 22 nt, Salmonella enterica enterica serovar Typhi Ty2
agucgcauugugccugauggcg

SEQ ID NO: 3733309 - RNA, 17 nt, Salmonella enterica enterica serovar Typhi Ty2
agucgccagaugucggc

SEQ ID NO: 3733310 - RNA, 13 nt, Salmonella enterica enterica serovar Typhi Ty2
agucgccaggauc

SEQ ID NO: 3733311 - RNA, 12 nt, Salmonella enterica enterica serovar Typhi Ty2
agucgccaggca

SEQ ID NO: 3733312 - RNA, 14 nt, Salmonella enterica enterica serovar Typhi Ty2
agucgccaggcaag

SEQ ID NO: 3733313 - RNA, 17 nt, Salmonella enterica enterica serovar Typhi Ty2
agucgccaggcaagguu

SEQ ID NO: 3733314 - RNA, 21 nt, Salmonella enterica enterica serovar Typhi Ty2
agucgccaugaguucaauaug

SEQ ID NO: 3733315 - RNA, 20 nt, Salmonella enterica enterica serovar Typhi Ty2
agucgcgcgcgccagucauc

SEQ ID NO: 3733316 - RNA, 19 nt, Salmonella enterica enterica serovar Typhi Ty2
agucggcgaacuucgcggu

SEQ ID NO: 3733317 - RNA, 20 nt, Salmonella enterica enterica serovar Typhi Ty2
agucggggcguaaaaauuuu

SEQ ID NO: 3733318 - RNA, 13 nt, Salmonella enterica enterica serovar Typhi Ty2
agucgucauggcg

SEQ ID NO: 3733319 - RNA, 12 nt, Salmonella enterica enterica serovar Typhi Ty2
agucgucuggcg

SEQ ID NO: 3733320 - RNA, 15 nt, Salmonella enterica enterica serovar Typhi Ty2
agucguuauaauccu

SEQ ID NO: 3733321 - RNA, 16 nt, Salmonella enterica enterica serovar Typhi Ty2
agucguuauccagauc

SEQ ID NO: 3733322 - RNA, 20 nt, Salmonella enterica enterica serovar Typhi Ty2
agucguuucuauuauugauc

SEQ ID NO: 3733323 - RNA, 12 nt, Salmonella enterica enterica serovar Typhi Ty2
agucuauuuccu

SEQ ID NO: 3733324 - RNA, 23 nt, Salmonella enterica enterica serovar Typhi Ty2
agucucauugaucaguuugguau

SEQ ID NO: 3733325 - RNA, 14 nt, Salmonella enterica enterica serovar Typhi Ty2
agucucccuccugc

SEQ ID NO: 3733326 - RNA, 23 nt, Salmonella enterica enterica serovar Typhi Ty2
agucucccuccugcuccaugcug

SEQ ID NO: 3733327 - RNA, 19 nt, Salmonella enterica enterica serovar Typhi Ty2
agucuccugccaaugaaau

SEQ ID NO: 3733328 - RNA, 16 nt, Salmonella enterica enterica serovar Typhi Ty2
agucucuacuacauau

SEQ ID NO: 3733329 - RNA, 16 nt, Salmonella enterica enterica serovar Typhi Ty2
agucugaaaauaauug

SEQ ID NO: 3733330 - RNA, 17 nt, Salmonella enterica enterica serovar Typhi Ty2
agucugaccgucagccc

SEQ ID NO: 3733331 - RNA, 17 nt, Salmonella enterica enterica serovar Typhi Ty2
agucugagcgcaaacau

SEQ ID NO: 3733332 - RNA, 18 nt, Salmonella enterica enterica serovar Typhi Ty2
agucuggguuagcuguau

SEQ ID NO: 3733333 - RNA, 14 nt, Salmonella enterica enterica serovar Typhi Ty2
agucugugagaaaa

SEQ ID NO: 3733334 - RNA, 22 nt, Salmonella enterica enterica serovar Typhi Ty2
agucuuaauuugcuguuuuuug

SEQ ID NO: 3733335 - RNA, 17 nt, Salmonella enterica enterica serovar Typhi Ty2
agucuuuuguuuuucuc

SEQ ID NO: 3733336 - RNA, 15 nt, Salmonella enterica enterica serovar Typhi Ty2
agugaacacccugcc

SEQ ID NO: 3733337 - RNA, 17 nt, Salmonella enterica enterica serovar Typhi Ty2
aguucaaguuuagaaaa

SEQ ID NO: 3733338 - RNA, 21 nt, Salmonella enterica enterica serovar Typhi Ty2
aguucaccaguuuuucgccaa

SEQ ID NO: 3733339 - RNA, 19 nt, Salmonella enterica enterica serovar Typhi Ty2
aguucacgacugauagguu

SEQ ID NO: 3733340 - RNA, 21 nt, Salmonella enterica enterica serovar Typhi Ty2
aguucacgcgugguaucgcga

SEQ ID NO: 3733341 - RNA, 20 nt, Salmonella enterica enterica serovar Typhi Ty2
aguucacuccuaagagaaaa

SEQ ID NO: 3733342 - RNA, 16 nt, Salmonella enterica enterica serovar Typhi Ty2
aguucagcagcaccac

SEQ ID NO: 3733343 - RNA, 12 nt, Salmonella enterica enterica serovar Typhi Ty2
aguucagccgcc

SEQ ID NO: 3733344 - RNA, 23 nt, Salmonella enterica enterica serovar Typhi Ty2
aguucaguaugaucaugcccggc

SEQ ID NO: 3733345 - RNA, 14 nt, Salmonella enterica enterica serovar Typhi Ty2
aguucauaaaugua

SEQ ID NO: 3733346 - RNA, 20 nt, Salmonella enterica enterica serovar Typhi Ty2
aguucaucauccugcagggu

SEQ ID NO: 3733347 - RNA, 17 nt, Salmonella enterica enterica serovar Typhi Ty2
aguucauuucaggcaaa

SEQ ID NO: 3733348 - RNA, 22 nt, Salmonella enterica enterica serovar Typhi Ty2
aguuccaaucucuuuugcggcg

SEQ ID NO: 3733349 - RNA, 20 nt, Salmonella enterica enterica serovar Typhi Ty2
aguuccacauaaaguagcca

SEQ ID NO: 3733350 - RNA, 23 nt, Salmonella enterica enterica serovar Typhi Ty2
aguuccaguaagguccagggaaa

SEQ ID NO: 3733351 - RNA, 16 nt, Salmonella enterica enterica serovar Typhi Ty2
aguucccacagcuuca

SEQ ID NO: 3733352 - RNA, 17 nt, Salmonella enterica enterica serovar Typhi Ty2
aguucccagcgguggau

SEQ ID NO: 3733353 - RNA, 14 nt, Salmonella enterica enterica serovar Typhi Ty2
aguucccuacucuc

SEQ ID NO: 3733354 - RNA, 22 nt, Salmonella enterica enterica serovar Typhi Ty2
aguucccuacucucgcaugggg

SEQ ID NO: 3733355 - RNA, 12 nt, Salmonella enterica enterica serovar Typhi Ty2
aguuccggauac

SEQ ID NO: 3733356 - RNA, 11 nt, Salmonella enterica enterica serovar Typhi Ty2
aguuccuccug

SEQ ID NO: 3733357 - RNA, 12 nt, Salmonella enterica enterica serovar Typhi Ty2
aguuccuccugg

SEQ ID NO: 3733358 - RNA, 24 nt, Salmonella enterica enterica serovar Typhi Ty2
aguuccugugcggaauagccuauc

SEQ ID NO: 3733359 - RNA, 14 nt, Salmonella enterica enterica serovar Typhi Ty2
aguucgacuuaacg

SEQ ID NO: 3733360 - RNA, 12 nt, Salmonella enterica enterica serovar Typhi Ty2
aguucgccgcca

SEQ ID NO: 3733361 - RNA, 16 nt, Salmonella enterica enterica serovar Typhi Ty2
aguucgccgccaggaa

SEQ ID NO: 3733362 - RNA, 15 nt, Salmonella enterica enterica serovar Typhi Ty2
aguucgccuucuuca

SEQ ID NO: 3733363 - RNA, 19 nt, Salmonella enterica enterica serovar Typhi Ty2
aguucgccuucuucaucuu

SEQ ID NO: 3733364 - RNA, 15 nt, Salmonella enterica enterica serovar Typhi Ty2
aguucgcugaggcgu

SEQ ID NO: 3733365 - RNA, 22 nt, Salmonella enterica enterica serovar Typhi Ty2
aguucgucuuccggauaacgcg

SEQ ID NO: 3733366 - RNA, 13 nt, Salmonella enterica enterica serovar Typhi Ty2
aguucucaaugaa

SEQ ID NO: 3733367 - RNA, 17 nt, Salmonella enterica enterica serovar Typhi Ty2
aguucucaaugaacagu

SEQ ID NO: 3733368 - RNA, 12 nt, Salmonella enterica enterica serovar Typhi Ty2
aguucucuucuu

SEQ ID NO: 3733369 - RNA, 14 nt, Salmonella enterica enterica serovar Typhi Ty2
aguucuucauuuau

SEQ ID NO: 3733370 - RNA, 14 nt, Salmonella enterica enterica serovar Typhi Ty2
aguucuugcaggca

SEQ ID NO: 3733371 - RNA, 21 nt, Salmonella enterica enterica serovar Typhi Ty2
aguugacgccccauguggcca

SEQ ID NO: 3733372 - RNA, 13 nt, Salmonella enterica enterica serovar Typhi Ty2
aguugauagcgau

SEQ ID NO: 3733373 - RNA, 15 nt, Salmonella enterica enterica serovar Typhi Ty2
aguugcaagucacca

SEQ ID NO: 3733374 - RNA, 21 nt, Salmonella enterica enterica serovar Typhi Ty2
aguugcagauuacugagcagu

SEQ ID NO: 3733375 - RNA, 16 nt, Salmonella enterica enterica serovar Typhi Ty2
aguugcccauuuuccu

SEQ ID NO: 3733376 - RNA, 17 nt, Salmonella enterica enterica serovar Typhi Ty2
aguugcccauuuuccuc

SEQ ID NO: 3733377 - RNA, 15 nt, Salmonella enterica enterica serovar Typhi Ty2
aguugcgacugauaa

SEQ ID NO: 3733378 - RNA, 19 nt, Salmonella enterica enterica serovar Typhi Ty2
aguugcgacuguucaucaa

SEQ ID NO: 3733379 - RNA, 13 nt, Salmonella enterica enterica serovar Typhi Ty2
aguugcgcagggu

SEQ ID NO: 3733380 - RNA, 12 nt, Salmonella enterica enterica serovar Typhi Ty2
aguugcgucagc

SEQ ID NO: 3733381 - RNA, 16 nt, Salmonella enterica enterica serovar Typhi Ty2
aguugcuggauucucu

SEQ ID NO: 3733382 - RNA, 20 nt, Salmonella enterica enterica serovar Typhi Ty2
aguugcuucguuaccgguga

SEQ ID NO: 3733383 - RNA, 22 nt, Salmonella enterica enterica serovar Typhi Ty2
aguuggaaccaaacaccagauc

SEQ ID NO: 3733384 - RNA, 14 nt, Salmonella enterica enterica serovar Typhi Ty2
aguuggugggugau

SEQ ID NO: 3733385 - RNA, 16 nt, Salmonella enterica enterica serovar Typhi Ty2
aguugguguuucucaa

SEQ ID NO: 3733386 - RNA, 13 nt, Salmonella enterica enterica serovar Typhi Ty2
aguugguucccag

SEQ ID NO: 3733387 - RNA, 16 nt, Salmonella enterica enterica serovar Typhi Ty2
aguugguucccagcac

SEQ ID NO: 3733388 - RNA, 17 nt, Salmonella enterica enterica serovar Typhi Ty2
aguugguuguagcacag

SEQ ID NO: 3733389 - RNA, 14 nt, Salmonella enterica enterica serovar Typhi Ty2
aguuguuccagcag

SEQ ID NO: 3733390 - RNA, 18 nt, Salmonella enterica enterica serovar Typhi Ty2
aguuguuccgcgcugaug

SEQ ID NO: 3733391 - RNA, 13 nt, Salmonella enterica enterica serovar Typhi Ty2
aguuguuucaaca

SEQ ID NO: 3733392 - RNA, 18 nt, Salmonella enterica enterica serovar Typhi Ty2
aguuuaaacacucuccac

SEQ ID NO: 3733393 - RNA, 17 nt, Salmonella enterica enterica serovar Typhi Ty2
aguuuaaaucacagggg

SEQ ID NO: 3733394 - RNA, 15 nt, Salmonella enterica enterica serovar Typhi Ty2
aguuuaauucuuuga

SEQ ID NO: 3733395 - RNA, 22 nt, Salmonella enterica enterica serovar Typhi Ty2
aguuuacgagugcguucuucca

SEQ ID NO: 3733396 - RNA, 15 nt, Salmonella enterica enterica serovar Typhi Ty2
aguuuagccagcagc

SEQ ID NO: 3733397 - RNA, 16 nt, Salmonella enterica enterica serovar Typhi Ty2
aguuuagccagcagcg

SEQ ID NO: 3733398 - RNA, 15 nt, Salmonella enterica enterica serovar Typhi Ty2
aguuucagugguggc

SEQ ID NO: 3733399 - RNA, 17 nt, Salmonella enterica enterica serovar Typhi Ty2
aguuucaucagcacaaa

SEQ ID NO: 3733400 - RNA, 22 nt, Salmonella enterica enterica serovar Typhi Ty2
aguuucgacuuucauuucuuua

SEQ ID NO: 3733401 - RNA, 15 nt, Salmonella enterica enterica serovar Typhi Ty2
aguuucguuaccccg

SEQ ID NO: 3733402 - RNA, 21 nt, Salmonella enterica enterica serovar Typhi Ty2
aguuucuucggcuucaccgau

SEQ ID NO: 3733403 - RNA, 21 nt, Salmonella enterica enterica serovar Typhi Ty2
aguuucuuuuuccaaauaguu

SEQ ID NO: 3733404 - RNA, 15 nt, Salmonella enterica enterica serovar Typhi Ty2
aguuugcaauccaga

SEQ ID NO: 3733405 - RNA, 23 nt, Salmonella enterica enterica serovar Typhi Ty2
aguuugccccauuguucuuucau

SEQ ID NO: 3733406 - RNA, 16 nt, Salmonella enterica enterica serovar Typhi Ty2
aguuugcgcgauuuau

SEQ ID NO: 3733407 - RNA, 20 nt, Salmonella enterica enterica serovar Typhi Ty2
aguuugcgcgauuuauagag

SEQ ID NO: 3733408 - RNA, 17 nt, Salmonella enterica enterica serovar Typhi Ty2
aguuugcuuaagcuuug

SEQ ID NO: 3733409 - RNA, 15 nt, Salmonella enterica enterica serovar Typhi Ty2
aguuugugccgccac

SEQ ID NO: 3733410 - RNA, 10 nt, Salmonella enterica enterica serovar Typhi Ty2
aguuuuaacg

SEQ ID NO: 3733411 - RNA, 17 nt, Salmonella enterica enterica serovar Typhi Ty2
aguuuuacgguuuaucc

SEQ ID NO: 3733412 - RNA, 15 nt, Salmonella enterica enterica serovar Typhi Ty2
aguuuuacugaugcc

SEQ ID NO: 3733413 - RNA, 17 nt, Salmonella enterica enterica serovar Typhi Ty2
aguuuuacugaugccag

SEQ ID NO: 3733414 - RNA, 16 nt, Salmonella enterica enterica serovar Typhi Ty2
aguuuugcuucaugca

SEQ ID NO: 3733415 - RNA, 18 nt, Salmonella enterica enterica serovar Typhi Ty2
aguuuugucggucugaua

SEQ ID NO: 3733416 - RNA, 16 nt, Salmonella enterica enterica serovar Typhi Ty2
aguuuuuaaacaacau

SEQ ID NO: 3733417 - RNA, 22 nt, Salmonella enterica enterica serovar Typhi Ty2
aguuuuuucuuacuaauaaaua

SEQ ID NO: 3733418 - RNA, 18 nt, Salmonella enterica enterica serovar Typhi Ty2
aguuuuuugaccauucca

SEQ ID NO: 3733419 - RNA, 21 nt, Salmonella enterica enterica serovar Typhi Ty2
auaaauucuuuacgcagcaag

SEQ ID NO: 3733420 - RNA, 22 nt, Salmonella enterica enterica serovar Typhi Ty2
auaaauuuauuuuuugcuggga

SEQ ID NO: 3733421 - RNA, 19 nt, Salmonella enterica enterica serovar Typhi Ty2
auaaauuucauccaugcca

SEQ ID NO: 3733422 - RNA, 20 nt, Salmonella enterica enterica serovar Typhi Ty2
auaaauuucauccaugccaa

SEQ ID NO: 3733423 - RNA, 19 nt, Salmonella enterica enterica serovar Typhi Ty2
auaaauuugucagacauga

SEQ ID NO: 3733424 - RNA, 18 nt, Salmonella enterica enterica serovar Typhi Ty2
auaacaccgcauggcugg

SEQ ID NO: 3733425 - RNA, 22 nt, Salmonella enterica enterica serovar Typhi Ty2
auaacacggcuggcaaugcgcu

SEQ ID NO: 3733426 - RNA, 23 nt, Salmonella enterica enterica serovar Typhi Ty2
auaacagacgaaaaaaaagacgc

SEQ ID NO: 3733427 - RNA, 17 nt, Salmonella enterica enterica serovar Typhi Ty2
auaacagccagcgggcg

SEQ ID NO: 3733428 - RNA, 13 nt, Salmonella enterica enterica serovar Typhi Ty2
auaacagcgcugg

SEQ ID NO: 3733429 - RNA, 14 nt, Salmonella enterica enterica serovar Typhi Ty2
auaacaggaaucau

SEQ ID NO: 3733430 - RNA, 20 nt, Salmonella enterica enterica serovar Typhi Ty2
auaacaucguaaaucaaaug

SEQ ID NO: 3733431 - RNA, 18 nt, Salmonella enterica enterica serovar Typhi Ty2
auaacauuucagucuaau

SEQ ID NO: 3733432 - RNA, 21 nt, Salmonella enterica enterica serovar Typhi Ty2
auaaccacgaaaauuauuuuc

SEQ ID NO: 3733433 - RNA, 14 nt, Salmonella enterica enterica serovar Typhi Ty2
auaaccagaaaacc

SEQ ID NO: 3733434 - RNA, 16 nt, Salmonella enterica enterica serovar Typhi Ty2
auaaccagauggggcu

SEQ ID NO: 3733435 - RNA, 22 nt, Salmonella enterica enterica serovar Typhi Ty2
auaaccagauggggcuuccauu

SEQ ID NO: 3733436 - RNA, 14 nt, Salmonella enterica enterica serovar Typhi Ty2
auaaccaucggacg

SEQ ID NO: 3733437 - RNA, 13 nt, Salmonella enterica enterica serovar Typhi Ty2
auaacccgccugg

SEQ ID NO: 3733438 - RNA, 23 nt, Salmonella enterica enterica serovar Typhi Ty2
auaacccggauugucuuaaauau

SEQ ID NO: 3733439 - RNA, 14 nt, Salmonella enterica enterica serovar Typhi Ty2
auaaccgcccgcgg

SEQ ID NO: 3733440 - RNA, 22 nt, Salmonella enterica enterica serovar Typhi Ty2
auaaccgccgccgcgcccgcgu

SEQ ID NO: 3733441 - RNA, 19 nt, Salmonella enterica enterica serovar Typhi Ty2
auaacgaacugauggcgcu

SEQ ID NO: 3733442 - RNA, 14 nt, Salmonella enterica enterica serovar Typhi Ty2
auaacgauaaauuu

SEQ ID NO: 3733443 - RNA, 20 nt, Salmonella enterica enterica serovar Typhi Ty2
auaacgaugaugaaaaagaa

SEQ ID NO: 3733444 - RNA, 22 nt, Salmonella enterica enterica serovar Typhi Ty2
auaacgaugauuauuguuaaaa

SEQ ID NO: 3733445 - RNA, 17 nt, Salmonella enterica enterica serovar Typhi Ty2
auaacgcccugcgcgcc

SEQ ID NO: 3733446 - RNA, 19 nt, Salmonella enterica enterica serovar Typhi Ty2
auaacgcgagaagaagaau

SEQ ID NO: 3733447 - RNA, 22 nt, Salmonella enterica enterica serovar Typhi Ty2
auaacgcgauggccaaauaacc

SEQ ID NO: 3733448 - RNA, 20 nt, Salmonella enterica enterica serovar Typhi Ty2
auaacgcggcccgggagaac

SEQ ID NO: 3733449 - RNA, 19 nt, Salmonella enterica enterica serovar Typhi Ty2
auaacgcggcuaaucaggg

SEQ ID NO: 3733450 - RNA, 18 nt, Salmonella enterica enterica serovar Typhi Ty2
auaacggcgcaaagacag

SEQ ID NO: 3733451 - RNA, 21 nt, Salmonella enterica enterica serovar Typhi Ty2
auaacggguuugauugccauc

SEQ ID NO: 3733452 - RNA, 17 nt, Salmonella enterica enterica serovar Typhi Ty2
auaacguuacauuuucc

SEQ ID NO: 3733453 - RNA, 22 nt, Salmonella enterica enterica serovar Typhi Ty2
auaacguuacauuuuccaugcc

SEQ ID NO: 3733454 - RNA, 14 nt, Salmonella enterica enterica serovar Typhi Ty2
auaacguuaccgca

SEQ ID NO: 3733455 - RNA, 20 nt, Salmonella enterica enterica serovar Typhi Ty2
auaacguuaccgcagcgaau

SEQ ID NO: 3733456 - RNA, 14 nt, Salmonella enterica enterica serovar Typhi Ty2
auaacguucuuuug

SEQ ID NO: 3733457 - RNA, 15 nt, Salmonella enterica enterica serovar Typhi Ty2
auaacguuuccuuau

SEQ ID NO: 3733458 - RNA, 14 nt, Salmonella enterica enterica serovar Typhi Ty2
auaacuauaauugc

SEQ ID NO: 3733459 - RNA, 22 nt, Salmonella enterica enterica serovar Typhi Ty2
auaacuauaauugcuuuuuucc

SEQ ID NO: 3733460 - RNA, 15 nt, Salmonella enterica enterica serovar Typhi Ty2
auaacucaauagcgg

SEQ ID NO: 3733461 - RNA, 15 nt, Salmonella enterica enterica serovar Typhi Ty2
auaacugcgccaucu

SEQ ID NO: 3733462 - RNA, 20 nt, Salmonella enterica enterica serovar Typhi Ty2
auaacuuccuuugccuuucu

SEQ ID NO: 3733463 - RNA, 22 nt, Salmonella enterica enterica serovar Typhi Ty2
auaacuuuuuaagcucccgcca

SEQ ID NO: 3733464 - RNA, 16 nt, Salmonella enterica enterica serovar Typhi Ty2
auaagaaaaaacuggu

SEQ ID NO: 3733465 - RNA, 15 nt, Salmonella enterica enterica serovar Typhi Ty2
auaagaacuuuauca

SEQ ID NO: 3733466 - RNA, 13 nt, Salmonella enterica enterica serovar Typhi Ty2
auaagaaucagau

SEQ ID NO: 3733467 - RNA, 18 nt, Salmonella enterica enterica serovar Typhi Ty2
auaagaccaauacgaucg

SEQ ID NO: 3733468 - RNA, 19 nt, Salmonella enterica enterica serovar Typhi Ty2
auaagacgacgguuaaaaa

SEQ ID NO: 3733469 - RNA, 14 nt, Salmonella enterica enterica serovar Typhi Ty2
auaagacgcagggc

SEQ ID NO: 3733470 - RNA, 15 nt, Salmonella enterica enterica serovar Typhi Ty2
auaagagaaaauacc

SEQ ID NO: 3733471 - RNA, 18 nt, Salmonella enterica enterica serovar Typhi Ty2
auaagagaaaauaccgcu

SEQ ID NO: 3733472 - RNA, 18 nt, Salmonella enterica enterica serovar Typhi Ty2
auaagauuuacaacagau

SEQ ID NO: 3733473 - RNA, 20 nt, Salmonella enterica enterica serovar Typhi Ty2
auaagauuuacaacagaucg

SEQ ID NO: 3733474 - RNA, 19 nt, Salmonella enterica enterica serovar Typhi Ty2
auaagcaacugggcuugca

SEQ ID NO: 3733475 - RNA, 18 nt, Salmonella enterica enterica serovar Typhi Ty2
auaagcacaccauuucac

SEQ ID NO: 3733476 - RNA, 11 nt, Salmonella enterica enterica serovar Typhi Ty2
auaagcagaac

SEQ ID NO: 3733477 - RNA, 18 nt, Salmonella enterica enterica serovar Typhi Ty2
auaagcauagcgccauca

SEQ ID NO: 3733478 - RNA, 20 nt, Salmonella enterica enterica serovar Typhi Ty2
auaagccugagcgcgaggca

SEQ ID NO: 3733479 - RNA, 18 nt, Salmonella enterica enterica serovar Typhi Ty2
auaagcgcagcgccaucc

SEQ ID NO: 3733480 - RNA, 18 nt, Salmonella enterica enterica serovar Typhi Ty2
auaagcgcagcgucauca

SEQ ID NO: 3733481 - RNA, 19 nt, Salmonella enterica enterica serovar Typhi Ty2
auaagcgccgaguagcuga

SEQ ID NO: 3733482 - RNA, 19 nt, Salmonella enterica enterica serovar Typhi Ty2
auaagcggcagcgccaucc

SEQ ID NO: 3733483 - RNA, 21 nt, Salmonella enterica enterica serovar Typhi Ty2
auaagcuaguaaagaaauuuu

SEQ ID NO: 3733484 - RNA, 13 nt, Salmonella enterica enterica serovar Typhi Ty2
auaagcugaaugg

SEQ ID NO: 3733485 - RNA, 15 nt, Salmonella enterica enterica serovar Typhi Ty2
auaaggcagcaaugu

SEQ ID NO: 3733486 - RNA, 20 nt, Salmonella enterica enterica serovar Typhi Ty2
auaaggccacgccgccaucc

SEQ ID NO: 3733487 - RNA, 16 nt, Salmonella enterica enterica serovar Typhi Ty2
auaaggcgauaccuaa

SEQ ID NO: 3733488 - RNA, 20 nt, Salmonella enterica enterica serovar Typhi Ty2
auaaggcgcuugcgccauca

SEQ ID NO: 3733489 - RNA, 23 nt, Salmonella enterica enterica serovar Typhi Ty2
auaaggcgcuugcgccaucaucc

SEQ ID NO: 3733490 - RNA, 20 nt, Salmonella enterica enterica serovar Typhi Ty2
auaagguaaagccgccaucc

SEQ ID NO: 3733491 - RNA, 20 nt, Salmonella enterica enterica serovar Typhi Ty2
auaaggucgcuauccagcag

SEQ ID NO: 3733492 - RNA, 23 nt, Salmonella enterica enterica serovar Typhi Ty2
auaagguguuuacgccgccaucc

SEQ ID NO: 3733493 - RNA, 20 nt, Salmonella enterica enterica serovar Typhi Ty2
auaaguuagcuuuuuuaugc

SEQ ID NO: 3733494 - RNA, 22 nt, Salmonella enterica enterica serovar Typhi Ty2
auaaguuucucuucguuauuuu

SEQ ID NO: 3733495 - RNA, 14 nt, Salmonella enterica enterica serovar Typhi Ty2
auaaguuuuuucuu

SEQ ID NO: 3733496 - RNA, 14 nt, Salmonella enterica enterica serovar Typhi Ty2
auaauaaacgcgcc

SEQ ID NO: 3733497 - RNA, 12 nt, Salmonella enterica enterica serovar Typhi Ty2
auaauaagcggc

SEQ ID NO: 3733498 - RNA, 22 nt, Salmonella enterica enterica serovar Typhi Ty2
auaauaagcggccuauauuagu

SEQ ID NO: 3733499 - RNA, 23 nt, Salmonella enterica enterica serovar Typhi Ty2
auaauacaccgccauauauuuac

SEQ ID NO: 3733500 - RNA, 14 nt, Salmonella enterica enterica serovar Typhi Ty2
auacauucgcucag

SEQ ID NO: 3733501 - RNA, 14 nt, Salmonella enterica enterica serovar Typhi Ty2
auacauucucugcc

SEQ ID NO: 3733502 - RNA, 13 nt, Salmonella enterica enterica serovar Typhi Ty2
auacauucuguuu

SEQ ID NO: 3733503 - RNA, 23 nt, Salmonella enterica enterica serovar Typhi Ty2
auacauuuuguauucgcagggcu

SEQ ID NO: 3733504 - RNA, 20 nt, Salmonella enterica enterica serovar Typhi Ty2
auacauuuuuguaauaaaaa

SEQ ID NO: 3733505 - RNA, 15 nt, Salmonella enterica enterica serovar Typhi Ty2
auaccaaaaauaauu

SEQ ID NO: 3733506 - RNA, 23 nt, Salmonella enterica enterica serovar Typhi Ty2
auaccaagucucaggagugaaca

SEQ ID NO: 3733507 - RNA, 19 nt, Salmonella enterica enterica serovar Typhi Ty2
auaccaccacuucacuauc

SEQ ID NO: 3733508 - RNA, 15 nt, Salmonella enterica enterica serovar Typhi Ty2
auaccaccugccaaa

SEQ ID NO: 3733509 - RNA, 12 nt, Salmonella enterica enterica serovar Typhi Ty2
auaccaggcacu

SEQ ID NO: 3733510 - RNA, 17 nt, Salmonella enterica enterica serovar Typhi Ty2
auaccaggcacuugaga

SEQ ID NO: 3733511 - RNA, 20 nt, Salmonella enterica enterica serovar Typhi Ty2
auaccagucgacaguauaga

SEQ ID NO: 3733512 - RNA, 22 nt, Salmonella enterica enterica serovar Typhi Ty2
auaccauaaaugaaaccucaau

SEQ ID NO: 3733513 - RNA, 14 nt, Salmonella enterica enterica serovar Typhi Ty2
auaccauccccuuu

SEQ ID NO: 3733514 - RNA, 17 nt, Salmonella enterica enterica serovar Typhi Ty2
auaccaucggcugguua

SEQ ID NO: 3733515 - RNA, 18 nt, Salmonella enterica enterica serovar Typhi Ty2
auacccaccucguucaaa

SEQ ID NO: 3733516 - RNA, 18 nt, Salmonella enterica enterica serovar Typhi Ty2
auacccaguagcagacag

SEQ ID NO: 3733517 - RNA, 21 nt, Salmonella enterica enterica serovar Typhi Ty2
auacccaguagcagacagccg

SEQ ID NO: 3733518 - RNA, 19 nt, Salmonella enterica enterica serovar Typhi Ty2
auaccccgaucgauauuua

SEQ ID NO: 3733519 - RNA, 15 nt, Salmonella enterica enterica serovar Typhi Ty2
auaccccuguucaaa

SEQ ID NO: 3733520 - RNA, 17 nt, Salmonella enterica enterica serovar Typhi Ty2
auacccgacucuuuuuu

SEQ ID NO: 3733521 - RNA, 16 nt, Salmonella enterica enterica serovar Typhi Ty2
auacccgcuuaccgcg

SEQ ID NO: 3733522 - RNA, 15 nt, Salmonella enterica enterica serovar Typhi Ty2
auaccgaaauccgcu

SEQ ID NO: 3733523 - RNA, 15 nt, Salmonella enterica enterica serovar Typhi Ty2
auaccgccagcccca

SEQ ID NO: 3733524 - RNA, 19 nt, Salmonella enterica enterica serovar Typhi Ty2
auaccgccauccggcauuc

SEQ ID NO: 3733525 - RNA, 18 nt, Salmonella enterica enterica serovar Typhi Ty2
auaccgccugaugagguu

SEQ ID NO: 3733526 - RNA, 16 nt, Salmonella enterica enterica serovar Typhi Ty2
auaccgcuuuguaaaa

SEQ ID NO: 3733527 - RNA, 15 nt, Salmonella enterica enterica serovar Typhi Ty2
auaccggaggagugc

SEQ ID NO: 3733528 - RNA, 15 nt, Salmonella enterica enterica serovar Typhi Ty2
auaccggcaucacgc

SEQ ID NO: 3733529 - RNA, 16 nt, Salmonella enterica enterica serovar Typhi Ty2
auaccgguuauccaua

SEQ ID NO: 3733530 - RNA, 20 nt, Salmonella enterica enterica serovar Typhi Ty2
auaccguccagacuccuuuu

SEQ ID NO: 3733531 - RNA, 19 nt, Salmonella enterica enterica serovar Typhi Ty2
auaccgugugcagugacag

SEQ ID NO: 3733532 - RNA, 14 nt, Salmonella enterica enterica serovar Typhi Ty2
auaccuaacucuuc

SEQ ID NO: 3733533 - RNA, 14 nt, Salmonella enterica enterica serovar Typhi Ty2
auaccuaauagcga

SEQ ID NO: 3733534 - RNA, 13 nt, Salmonella enterica enterica serovar Typhi Ty2
auaccuauuuaau

SEQ ID NO: 3733535 - RNA, 17 nt, Salmonella enterica enterica serovar Typhi Ty2
auaccucaaaugcugaa

SEQ ID NO: 3733536 - RNA, 13 nt, Salmonella enterica enterica serovar Typhi Ty2
auaccucauuuca

SEQ ID NO: 3733537 - RNA, 21 nt, Salmonella enterica enterica serovar Typhi Ty2
auaccuucccgcgauaaaaac

SEQ ID NO: 3733538 - RNA, 20 nt, Salmonella enterica enterica serovar Typhi Ty2
auaccuucuucacuaaaaac

SEQ ID NO: 3733539 - RNA, 21 nt, Salmonella enterica enterica serovar Typhi Ty2
auaccuucuucacuaaaaaca

SEQ ID NO: 3733540 - RNA, 21 nt, Salmonella enterica enterica serovar Typhi Ty2
auaccuuuaaccucuuuuuca

SEQ ID NO: 3733541 - RNA, 12 nt, Salmonella enterica enterica serovar Typhi Ty2
auaccuuuucau

SEQ ID NO: 3733542 - RNA, 14 nt, Salmonella enterica enterica serovar Typhi Ty2
auacgaaauugaga

SEQ ID NO: 3733543 - RNA, 22 nt, Salmonella enterica enterica serovar Typhi Ty2
auacgauugcgcguguuaccca

SEQ ID NO: 3733544 - RNA, 15 nt, Salmonella enterica enterica serovar Typhi Ty2
auacgcauucucgcc

SEQ ID NO: 3733545 - RNA, 13 nt, Salmonella enterica enterica serovar Typhi Ty2
auacgccagcaga

SEQ ID NO: 3733546 - RNA, 23 nt, Salmonella enterica enterica serovar Typhi Ty2
auacgccagccgucaugauguuu

SEQ ID NO: 3733547 - RNA, 13 nt, Salmonella enterica enterica serovar Typhi Ty2
auacgcgauaaaa

SEQ ID NO: 3733548 - RNA, 21 nt, Salmonella enterica enterica serovar Typhi Ty2
auacgcggcacaaaguccgcc

SEQ ID NO: 3733549 - RNA, 16 nt, Salmonella enterica enterica serovar Typhi Ty2
auacgcgucagccuac

SEQ ID NO: 3733550 - RNA, 13 nt, Salmonella enterica enterica serovar Typhi Ty2
auacgcuccagcu

SEQ ID NO: 3733551 - RNA, 12 nt, Salmonella enterica enterica serovar Typhi Ty2
auacgcugaaga

SEQ ID NO: 3733552 - RNA, 13 nt, Salmonella enterica enterica serovar Typhi Ty2
auacgcugaagcu

SEQ ID NO: 3733553 - RNA, 13 nt, Salmonella enterica enterica serovar Typhi Ty2
auacgcuuucuga

SEQ ID NO: 3733554 - RNA, 22 nt, Salmonella enterica enterica serovar Typhi Ty2
auacggagaacggcacaauagc

SEQ ID NO: 3733555 - RNA, 16 nt, Salmonella enterica enterica serovar Typhi Ty2
auacggaugccgauuu

SEQ ID NO: 3733556 - RNA, 22 nt, Salmonella enterica enterica serovar Typhi Ty2
auacggccuucuuccgucaccg

SEQ ID NO: 3733557 - RNA, 19 nt, Salmonella enterica enterica serovar Typhi Ty2
auacggcggcaaugccgcc

SEQ ID NO: 3733558 - RNA, 20 nt, Salmonella enterica enterica serovar Typhi Ty2
auacggcggcaaugccgccg

SEQ ID NO: 3733559 - RNA, 16 nt, Salmonella enterica enterica serovar Typhi Ty2
auacggcuuccacugc

SEQ ID NO: 3733560 - RNA, 23 nt, Salmonella enterica enterica serovar Typhi Ty2
auacgggagagcguauccagcac

SEQ ID NO: 3733561 - RNA, 17 nt, Salmonella enterica enterica serovar Typhi Ty2
auacgguaaaucauuug

SEQ ID NO: 3733562 - RNA, 15 nt, Salmonella enterica enterica serovar Typhi Ty2
auacguaauaccuga

SEQ ID NO: 3733563 - RNA, 19 nt, Salmonella enterica enterica serovar Typhi Ty2
auacgucauaucauccagc

SEQ ID NO: 3733564 - RNA, 22 nt, Salmonella enterica enterica serovar Typhi Ty2
auacgucgugacccacacauag

SEQ ID NO: 3733565 - RNA, 14 nt, Salmonella enterica enterica serovar Typhi Ty2
auacguggcucaag

SEQ ID NO: 3733566 - RNA, 18 nt, Salmonella enterica enterica serovar Typhi Ty2
auacguguacggcgaauu

SEQ ID NO: 3733567 - RNA, 19 nt, Salmonella enterica enterica serovar Typhi Ty2
auacguuauaaauuuuuua

SEQ ID NO: 3733568 - RNA, 23 nt, Salmonella enterica enterica serovar Typhi Ty2
auacuacugguggaauaaauaua

SEQ ID NO: 3733569 - RNA, 22 nt, Salmonella enterica enterica serovar Typhi Ty2
auacuauccaacagaaggcuuc

SEQ ID NO: 3733570 - RNA, 18 nt, Salmonella enterica enterica serovar Typhi Ty2
auacucacgaauaagaau

SEQ ID NO: 3733571 - RNA, 12 nt, Salmonella enterica enterica serovar Typhi Ty2
auacucaucaua

SEQ ID NO: 3733572 - RNA, 15 nt, Salmonella enterica enterica serovar Typhi Ty2
auacuccacaguuca

SEQ ID NO: 3733573 - RNA, 22 nt, Salmonella enterica enterica serovar Typhi Ty2
auacuccauugucggcagcgag

SEQ ID NO: 3733574 - RNA, 20 nt, Salmonella enterica enterica serovar Typhi Ty2
auacuccugcaacagaagag

SEQ ID NO: 3733575 - RNA, 15 nt, Salmonella enterica enterica serovar Typhi Ty2
auacuccugccugac

SEQ ID NO: 3733576 - RNA, 14 nt, Salmonella enterica enterica serovar Typhi Ty2
auacucugcuuuuu

SEQ ID NO: 3733577 - RNA, 20 nt, Salmonella enterica enterica serovar Typhi Ty2
auacucugcuuuuucacccu

SEQ ID NO: 3733578 - RNA, 12 nt, Salmonella enterica enterica serovar Typhi Ty2
auacucuucacg

SEQ ID NO: 3733579 - RNA, 22 nt, Salmonella enterica enterica serovar Typhi Ty2
auacucuuggagagcaucaucu

SEQ ID NO: 3733580 - RNA, 11 nt, Salmonella enterica enterica serovar Typhi Ty2
auacucuuucc

SEQ ID NO: 3733581 - RNA, 17 nt, Salmonella enterica enterica serovar Typhi Ty2
auacucuuucccggcaa

SEQ ID NO: 3733582 - RNA, 14 nt, Salmonella enterica enterica serovar Typhi Ty2
auagcuguuccgca

SEQ ID NO: 3733583 - RNA, 17 nt, Salmonella enterica enterica serovar Typhi Ty2
auagcuucaaugaucca

SEQ ID NO: 3733584 - RNA, 22 nt, Salmonella enterica enterica serovar Typhi Ty2
auagcuuuucaagaauuacauc

SEQ ID NO: 3733585 - RNA, 22 nt, Salmonella enterica enterica serovar Typhi Ty2
auaggauaggcucuaaauuagc

SEQ ID NO: 3733586 - RNA, 19 nt, Salmonella enterica enterica serovar Typhi Ty2
auaggauguugcugcugcg

SEQ ID NO: 3733587 - RNA, 15 nt, Salmonella enterica enterica serovar Typhi Ty2
auaggcaauauccuc

SEQ ID NO: 3733588 - RNA, 22 nt, Salmonella enterica enterica serovar Typhi Ty2
auaggcaauauccuccggcgua

SEQ ID NO: 3733589 - RNA, 12 nt, Salmonella enterica enterica serovar Typhi Ty2
auaggccaggcu

SEQ ID NO: 3733590 - RNA, 13 nt, Salmonella enterica enterica serovar Typhi Ty2
auaggccaggcua

SEQ ID NO: 3733591 - RNA, 23 nt, Salmonella enterica enterica serovar Typhi Ty2
auaggccucgaccaguuuuuccg

SEQ ID NO: 3733592 - RNA, 12 nt, Salmonella enterica enterica serovar Typhi Ty2
auaggcgccgcc

SEQ ID NO: 3733593 - RNA, 19 nt, Salmonella enterica enterica serovar Typhi Ty2
auaggcgcgucauaaccgc

SEQ ID NO: 3733594 - RNA, 14 nt, Salmonella enterica enterica serovar Typhi Ty2
auagguacggggca

SEQ ID NO: 3733595 - RNA, 15 nt, Salmonella enterica enterica serovar Typhi Ty2
auagguacggggcau

SEQ ID NO: 3733596 - RNA, 15 nt, Salmonella enterica enterica serovar Typhi Ty2
auaggucguuccuca

SEQ ID NO: 3733597 - RNA, 19 nt, Salmonella enterica enterica serovar Typhi Ty2
auaggugacuuuccuggcu

SEQ ID NO: 3733598 - RNA, 21 nt, Salmonella enterica enterica serovar Typhi Ty2
auagguucaauaugccaggca

SEQ ID NO: 3733599 - RNA, 12 nt, Salmonella enterica enterica serovar Typhi Ty2
auagguugaaag

SEQ ID NO: 3733600 - RNA, 22 nt, Salmonella enterica enterica serovar Typhi Ty2
auagguugaauaaccauacuga

SEQ ID NO: 3733601 - RNA, 16 nt, Salmonella enterica enterica serovar Typhi Ty2
auaguaaauugacgcu

SEQ ID NO: 3733602 - RNA, 15 nt, Salmonella enterica enterica serovar Typhi Ty2
auaguaacguaugcu

SEQ ID NO: 3733603 - RNA, 17 nt, Salmonella enterica enterica serovar Typhi Ty2
auaguaacguaugcugg

SEQ ID NO: 3733604 - RNA, 18 nt, Salmonella enterica enterica serovar Typhi Ty2
auaguacccucugcacca

SEQ ID NO: 3733605 - RNA, 22 nt, Salmonella enterica enterica serovar Typhi Ty2
auaguacgauagcaauuaauaa

SEQ ID NO: 3733606 - RNA, 18 nt, Salmonella enterica enterica serovar Typhi Ty2
auaguauccauaauuuuc

SEQ ID NO: 3733607 - RNA, 16 nt, Salmonella enterica enterica serovar Typhi Ty2
auagucauaauuaaaa

SEQ ID NO: 3733608 - RNA, 19 nt, Salmonella enterica enterica serovar Typhi Ty2
auagucauugacagcaagu

SEQ ID NO: 3733609 - RNA, 16 nt, Salmonella enterica enterica serovar Typhi Ty2
auaguccacuuucugu

SEQ ID NO: 3733610 - RNA, 20 nt, Salmonella enterica enterica serovar Typhi Ty2
auagucgucuauuuccgcuu

SEQ ID NO: 3733611 - RNA, 17 nt, Salmonella enterica enterica serovar Typhi Ty2
auagucguugcgccgua

SEQ ID NO: 3733612 - RNA, 19 nt, Salmonella enterica enterica serovar Typhi Ty2
auagucuuaauuugcuguu

SEQ ID NO: 3733613 - RNA, 23 nt, Salmonella enterica enterica serovar Typhi Ty2
auagucuuguuacucaauaaaag

SEQ ID NO: 3733614 - RNA, 14 nt, Salmonella enterica enterica serovar Typhi Ty2
auagugacuucugc

SEQ ID NO: 3733615 - RNA, 21 nt, Salmonella enterica enterica serovar Typhi Ty2
auagugcgugacaaucuccuc

SEQ ID NO: 3733616 - RNA, 23 nt, Salmonella enterica enterica serovar Typhi Ty2
auaguggcgcgacgcgucaguga

SEQ ID NO: 3733617 - RNA, 17 nt, Salmonella enterica enterica serovar Typhi Ty2
auaguggcgucgccaua

SEQ ID NO: 3733618 - RNA, 22 nt, Salmonella enterica enterica serovar Typhi Ty2
auaguucaucgugaaauuauuc

SEQ ID NO: 3733619 - RNA, 21 nt, Salmonella enterica enterica serovar Typhi Ty2
auaguuucgacuuucauuucu

SEQ ID NO: 3733620 - RNA, 12 nt, Salmonella enterica enterica serovar Typhi Ty2
auaguuugcaua

SEQ ID NO: 3733621 - RNA, 16 nt, Salmonella enterica enterica serovar Typhi Ty2
auaguuuuuaauucca

SEQ ID NO: 3733622 - RNA, 17 nt, Salmonella enterica enterica serovar Typhi Ty2
auauaaaaaacauauaa

SEQ ID NO: 3733623 - RNA, 18 nt, Salmonella enterica enterica serovar Typhi Ty2
auauaaaaagccagggaa

SEQ ID NO: 3733624 - RNA, 12 nt, Salmonella enterica enterica serovar Typhi Ty2
auauaaaaauag

SEQ ID NO: 3733625 - RNA, 19 nt, Salmonella enterica enterica serovar Typhi Ty2
auauaaaccggaacauaca

SEQ ID NO: 3733626 - RNA, 18 nt, Salmonella enterica enterica serovar Typhi Ty2
auauaaccacgaaaauua

SEQ ID NO: 3733627 - RNA, 20 nt, Salmonella enterica enterica serovar Typhi Ty2
auauaagcgguauucagguu

SEQ ID NO: 3733628 - RNA, 16 nt, Salmonella enterica enterica serovar Typhi Ty2
auauaaggugucuaua

SEQ ID NO: 3733629 - RNA, 14 nt, Salmonella enterica enterica serovar Typhi Ty2
auauaaucuaccau

SEQ ID NO: 3733630 - RNA, 16 nt, Salmonella enterica enterica serovar Typhi Ty2
auauaauuuauagcca

SEQ ID NO: 3733631 - RNA, 22 nt, Salmonella enterica enterica serovar Typhi Ty2
auauaauuuuauuauauuuaaa

SEQ ID NO: 3733632 - RNA, 23 nt, Salmonella enterica enterica serovar Typhi Ty2
auauacagccuuuugagcagcau

SEQ ID NO: 3733633 - RNA, 17 nt, Salmonella enterica enterica serovar Typhi Ty2
auauacccccugcaauu

SEQ ID NO: 3733634 - RNA, 15 nt, Salmonella enterica enterica serovar Typhi Ty2
auauacgccacggcc

SEQ ID NO: 3733635 - RNA, 22 nt, Salmonella enterica enterica serovar Typhi Ty2
auauacguugcggcgcguucag

SEQ ID NO: 3733636 - RNA, 22 nt, Salmonella enterica enterica serovar Typhi Ty2
auauacuucaccauaaaucauu

SEQ ID NO: 3733637 - RNA, 23 nt, Salmonella enterica enterica serovar Typhi Ty2
auauagagcccucuguccacaca

SEQ ID NO: 3733638 - RNA, 16 nt, Salmonella enterica enterica serovar Typhi Ty2
auauagaguugugaaa

SEQ ID NO: 3733639 - RNA, 14 nt, Salmonella enterica enterica serovar Typhi Ty2
auauagcaaucaua

SEQ ID NO: 3733640 - RNA, 15 nt, Salmonella enterica enterica serovar Typhi Ty2
auauagccauuuaau

SEQ ID NO: 3733641 - RNA, 14 nt, Salmonella enterica enterica serovar Typhi Ty2
auauagccguggcu

SEQ ID NO: 3733642 - RNA, 16 nt, Salmonella enterica enterica serovar Typhi Ty2
auauagccguggcugg

SEQ ID NO: 3733643 - RNA, 16 nt, Salmonella enterica enterica serovar Typhi Ty2
auauaggggccaagcg

SEQ ID NO: 3733644 - RNA, 15 nt, Salmonella enterica enterica serovar Typhi Ty2
auauaggguuuuccg

SEQ ID NO: 3733645 - RNA, 16 nt, Salmonella enterica enterica serovar Typhi Ty2
auauaguuuauugaag

SEQ ID NO: 3733646 - RNA, 21 nt, Salmonella enterica enterica serovar Typhi Ty2
auauauccgcuauuaccagua

SEQ ID NO: 3733647 - RNA, 21 nt, Salmonella enterica enterica serovar Typhi Ty2
auauaucgcaggaugcgcugc

SEQ ID NO: 3733648 - RNA, 12 nt, Salmonella enterica enterica serovar Typhi Ty2
auauaugaaauc

SEQ ID NO: 3733649 - RNA, 20 nt, Salmonella enterica enterica serovar Typhi Ty2
auauaugaaccaagauaaga

SEQ ID NO: 3733650 - RNA, 17 nt, Salmonella enterica enterica serovar Typhi Ty2
auauauuuacugaauaa

SEQ ID NO: 3733651 - RNA, 21 nt, Salmonella enterica enterica serovar Typhi Ty2
auauauuucacuucaucauca

SEQ ID NO: 3733652 - RNA, 14 nt, Salmonella enterica enterica serovar Typhi Ty2
auaucaaugcgaaa

SEQ ID NO: 3733653 - RNA, 12 nt, Salmonella enterica enterica serovar Typhi Ty2
auaucaaugcgc

SEQ ID NO: 3733654 - RNA, 14 nt, Salmonella enterica enterica serovar Typhi Ty2
auaucaauucaaca

SEQ ID NO: 3733655 - RNA, 15 nt, Salmonella enterica enterica serovar Typhi Ty2
auaucacgcgcgcga

SEQ ID NO: 3733656 - RNA, 14 nt, Salmonella enterica enterica serovar Typhi Ty2
auaucagccccacg

SEQ ID NO: 3733657 - RNA, 21 nt, Salmonella enterica enterica serovar Typhi Ty2
auauccaccagcccaucuuuc

SEQ ID NO: 3733658 - RNA, 14 nt, Salmonella enterica enterica serovar Typhi Ty2
auauccacguugau

SEQ ID NO: 3733659 - RNA, 22 nt, Salmonella enterica enterica serovar Typhi Ty2
auauccagcucgcgcaggcgga

SEQ ID NO: 3733660 - RNA, 16 nt, Salmonella enterica enterica serovar Typhi Ty2
auauccaguugcgcca

SEQ ID NO: 3733661 - RNA, 16 nt, Salmonella enterica enterica serovar Typhi Ty2
auauccccaucccaga

SEQ ID NO: 3733662 - RNA, 15 nt, Salmonella enterica enterica serovar Typhi Ty2
auaucccgcauaccg

SEQ ID NO: 3733663 - RNA, 18 nt, Salmonella enterica enterica serovar Typhi Ty2
auaucccggcugacauaa

SEQ ID NO: 3733664 - RNA, 15 nt, Salmonella enterica enterica serovar Typhi Ty2
auauugcgccgcagc

SEQ ID NO: 3733665 - RNA, 13 nt, Salmonella enterica enterica serovar Typhi Ty2
auauugguagcau

SEQ ID NO: 3733666 - RNA, 15 nt, Salmonella enterica enterica serovar Typhi Ty2
auauuguugaaauua

SEQ ID NO: 3733667 - RNA, 17 nt, Salmonella enterica enterica serovar Typhi Ty2
auauuuaaucgcuuuua

SEQ ID NO: 3733668 - RNA, 13 nt, Salmonella enterica enterica serovar Typhi Ty2
auauuuauuuaau

SEQ ID NO: 3733669 - RNA, 18 nt, Salmonella enterica enterica serovar Typhi Ty2
auauuuauuugcauugua

SEQ ID NO: 3733670 - RNA, 20 nt, Salmonella enterica enterica serovar Typhi Ty2
auauuuauuugcauuguacu

SEQ ID NO: 3733671 - RNA, 21 nt, Salmonella enterica enterica serovar Typhi Ty2
auauuucuguaaucgauacua

SEQ ID NO: 3733672 - RNA, 18 nt, Salmonella enterica enterica serovar Typhi Ty2
auauuugcgugucaucaa

SEQ ID NO: 3733673 - RNA, 19 nt, Salmonella enterica enterica serovar Typhi Ty2
auauuuguuggaaaugcgu

SEQ ID NO: 3733674 - RNA, 11 nt, Salmonella enterica enterica serovar Typhi Ty2
auauuuuaugg

SEQ ID NO: 3733675 - RNA, 21 nt, Salmonella enterica enterica serovar Typhi Ty2
auauuuuauggaggauauaaa

SEQ ID NO: 3733676 - RNA, 12 nt, Salmonella enterica enterica serovar Typhi Ty2
auauuuucucaa

SEQ ID NO: 3733677 - RNA, 19 nt, Salmonella enterica enterica serovar Typhi Ty2
auauuuucucaauuuuaca

SEQ ID NO: 3733678 - RNA, 11 nt, Salmonella enterica enterica serovar Typhi Ty2
auauuuugcug

SEQ ID NO: 3733679 - RNA, 19 nt, Salmonella enterica enterica serovar Typhi Ty2
auauuuuguuuuaaauuca

SEQ ID NO: 3733680 - RNA, 21 nt, Salmonella enterica enterica serovar Typhi Ty2
auauuuuuaagguauugauuu

SEQ ID NO: 3733681 - RNA, 18 nt, Salmonella enterica enterica serovar Typhi Ty2
auauuuuucauucgcgcu

SEQ ID NO: 3733682 - RNA, 14 nt, Salmonella enterica enterica serovar Typhi Ty2
auauuuuuucagga

SEQ ID NO: 3733683 - RNA, 16 nt, Salmonella enterica enterica serovar Typhi Ty2
aucaaaaaaaaccaga

SEQ ID NO: 3733684 - RNA, 20 nt, Salmonella enterica enterica serovar Typhi Ty2
aucaaaacuacgccaaugaa

SEQ ID NO: 3733685 - RNA, 15 nt, Salmonella enterica enterica serovar Typhi Ty2
aucaaaagugaucau

SEQ ID NO: 3733686 - RNA, 15 nt, Salmonella enterica enterica serovar Typhi Ty2
aucaaaaucaucgcc

SEQ ID NO: 3733687 - RNA, 16 nt, Salmonella enterica enterica serovar Typhi Ty2
aucaaacauagagauc

SEQ ID NO: 3733688 - RNA, 22 nt, Salmonella enterica enterica serovar Typhi Ty2
aucaaaccauucccgucccugc

SEQ ID NO: 3733689 - RNA, 20 nt, Salmonella enterica enterica serovar Typhi Ty2
aucaaacugaaaaucaaaua

SEQ ID NO: 3733690 - RNA, 17 nt, Salmonella enterica enterica serovar Typhi Ty2
aucaaauaagacaugga

SEQ ID NO: 3733691 - RNA, 21 nt, Salmonella enterica enterica serovar Typhi Ty2
aucaaauacgcuauuuaaaaa

SEQ ID NO: 3733692 - RNA, 16 nt, Salmonella enterica enterica serovar Typhi Ty2
aucaaaugagaauaga

SEQ ID NO: 3733693 - RNA, 15 nt, Salmonella enterica enterica serovar Typhi Ty2
aucaacaaugucgcc

SEQ ID NO: 3733694 - RNA, 19 nt, Salmonella enterica enterica serovar Typhi Ty2
aucaacagcggagagacau

SEQ ID NO: 3733695 - RNA, 23 nt, Salmonella enterica enterica serovar Typhi Ty2
aucaacagcggagagacauuggu

SEQ ID NO: 3733696 - RNA, 20 nt, Salmonella enterica enterica serovar Typhi Ty2
aucaacagcgugagcugucg

SEQ ID NO: 3733697 - RNA, 20 nt, Salmonella enterica enterica serovar Typhi Ty2
aucaacaucgcaaaauuccg

SEQ ID NO: 3733698 - RNA, 16 nt, Salmonella enterica enterica serovar Typhi Ty2
aucaaccaccuucacc

SEQ ID NO: 3733699 - RNA, 16 nt, Salmonella enterica enterica serovar Typhi Ty2
aucaaccggguaaacg

SEQ ID NO: 3733700 - RNA, 15 nt, Salmonella enterica enterica serovar Typhi Ty2
aucaacgaaaucaga

SEQ ID NO: 3733701 - RNA, 22 nt, Salmonella enterica enterica serovar Typhi Ty2
aucaacgaccaugguucccgcc

SEQ ID NO: 3733702 - RNA, 14 nt, Salmonella enterica enterica serovar Typhi Ty2
aucaacgccgccag

SEQ ID NO: 3733703 - RNA, 18 nt, Salmonella enterica enterica serovar Typhi Ty2
aucaacguuguccagcgg

SEQ ID NO: 3733704 - RNA, 14 nt, Salmonella enterica enterica serovar Typhi Ty2
aucaacuccuccgg

SEQ ID NO: 3733705 - RNA, 14 nt, Salmonella enterica enterica serovar Typhi Ty2
aucaacucuccuuu

SEQ ID NO: 3733706 - RNA, 13 nt, Salmonella enterica enterica serovar Typhi Ty2
aucaacugcgcca

SEQ ID NO: 3733707 - RNA, 15 nt, Salmonella enterica enterica serovar Typhi Ty2
aucaacugcgccaca

SEQ ID NO: 3733708 - RNA, 24 nt, Salmonella enterica enterica serovar Typhi Ty2
aucaacugggugugaucgccgcga

SEQ ID NO: 3733709 - RNA, 17 nt, Salmonella enterica enterica serovar Typhi Ty2
aucaagcccagcucagg

SEQ ID NO: 3733710 - RNA, 15 nt, Salmonella enterica enterica serovar Typhi Ty2
aucaagcccauguuc

SEQ ID NO: 3733711 - RNA, 21 nt, Salmonella enterica enterica serovar Typhi Ty2
aucaagcgguagcguuaucca

SEQ ID NO: 3733712 - RNA, 20 nt, Salmonella enterica enterica serovar Typhi Ty2
aucaagcuuugcguaaaaaa

SEQ ID NO: 3733713 - RNA, 14 nt, Salmonella enterica enterica serovar Typhi Ty2
aucaaguaacgugc

SEQ ID NO: 3733714 - RNA, 14 nt, Salmonella enterica enterica serovar Typhi Ty2
aucaaguacagcuu

SEQ ID NO: 3733715 - RNA, 22 nt, Salmonella enterica enterica serovar Typhi Ty2
aucaauaaaaucaccgcggcaa

SEQ ID NO: 3733716 - RNA, 14 nt, Salmonella enterica enterica serovar Typhi Ty2
aucaauaaaauuau

SEQ ID NO: 3733717 - RNA, 17 nt, Salmonella enterica enterica serovar Typhi Ty2
aucaauaaccgccagca

SEQ ID NO: 3733718 - RNA, 19 nt, Salmonella enterica enterica serovar Typhi Ty2
aucaauaaccgccagcagu

SEQ ID NO: 3733719 - RNA, 20 nt, Salmonella enterica enterica serovar Typhi Ty2
aucaauaacgauaauuuuac

SEQ ID NO: 3733720 - RNA, 18 nt, Salmonella enterica enterica serovar Typhi Ty2
aucaauaagcgaauugcc

SEQ ID NO: 3733721 - RNA, 21 nt, Salmonella enterica enterica serovar Typhi Ty2
aucaauaagggucgcgcugua

SEQ ID NO: 3733722 - RNA, 19 nt, Salmonella enterica enterica serovar Typhi Ty2
aucaauacagagauauuaa

SEQ ID NO: 3733723 - RNA, 13 nt, Salmonella enterica enterica serovar Typhi Ty2
aucaaucaccuua

SEQ ID NO: 3733724 - RNA, 17 nt, Salmonella enterica enterica serovar Typhi Ty2
aucaaucgcuaucugac

SEQ ID NO: 3733725 - RNA, 20 nt, Salmonella enterica enterica serovar Typhi Ty2
aucaaugcccagcgcaauca

SEQ ID NO: 3733726 - RNA, 19 nt, Salmonella enterica enterica serovar Typhi Ty2
aucaauggugaauuugcug

SEQ ID NO: 3733727 - RNA, 23 nt, Salmonella enterica enterica serovar Typhi Ty2
aucaaugucugauggcgcugcgc

SEQ ID NO: 3733728 - RNA, 20 nt, Salmonella enterica enterica serovar Typhi Ty2
aucaauuucccuucaaucac

SEQ ID NO: 3733729 - RNA, 19 nt, Salmonella enterica enterica serovar Typhi Ty2
aucaauuugccuuuauuca

SEQ ID NO: 3733730 - RNA, 17 nt, Salmonella enterica enterica serovar Typhi Ty2
aucaauuuuaauaacgg

SEQ ID NO: 3733731 - RNA, 16 nt, Salmonella enterica enterica serovar Typhi Ty2
aucacaacgucauccc

SEQ ID NO: 3733732 - RNA, 19 nt, Salmonella enterica enterica serovar Typhi Ty2
aucacaacgucaucccgaa

SEQ ID NO: 3733733 - RNA, 19 nt, Salmonella enterica enterica serovar Typhi Ty2
aucacaagcuguuucuccg

SEQ ID NO: 3733734 - RNA, 14 nt, Salmonella enterica enterica serovar Typhi Ty2
aucacaaggaauga

SEQ ID NO: 3733735 - RNA, 21 nt, Salmonella enterica enterica serovar Typhi Ty2
aucacaaucagccacggcaac

SEQ ID NO: 3733736 - RNA, 22 nt, Salmonella enterica enterica serovar Typhi Ty2
aucacaccaacgcuggcccggc

SEQ ID NO: 3733737 - RNA, 12 nt, Salmonella enterica enterica serovar Typhi Ty2
aucacagacaga

SEQ ID NO: 3733738 - RNA, 16 nt, Salmonella enterica enterica serovar Typhi Ty2
aucacagggggaacau

SEQ ID NO: 3733739 - RNA, 21 nt, Salmonella enterica enterica serovar Typhi Ty2
aucacaucauuaaagcgcuca

SEQ ID NO: 3733740 - RNA, 17 nt, Salmonella enterica enterica serovar Typhi Ty2
aucacauccgccagcgc

SEQ ID NO: 3733741 - RNA, 18 nt, Salmonella enterica enterica serovar Typhi Ty2
aucacaucgcgcagcagg

SEQ ID NO: 3733742 - RNA, 14 nt, Salmonella enterica enterica serovar Typhi Ty2
aucacauugcccca

SEQ ID NO: 3733743 - RNA, 16 nt, Salmonella enterica enterica serovar Typhi Ty2
aucaccaaguagacag

SEQ ID NO: 3733744 - RNA, 20 nt, Salmonella enterica enterica serovar Typhi Ty2
aucaccagcccgaauccacu

SEQ ID NO: 3733745 - RNA, 15 nt, Salmonella enterica enterica serovar Typhi Ty2
aucaccauggcgcca

SEQ ID NO: 3733746 - RNA, 15 nt, Salmonella enterica enterica serovar Typhi Ty2
aucagccagccgcca

SEQ ID NO: 3733747 - RNA, 12 nt, Salmonella enterica enterica serovar Typhi Ty2
aucagccaggcg

SEQ ID NO: 3733748 - RNA, 13 nt, Salmonella enterica enterica serovar Typhi Ty2
aucagccauuaac

SEQ ID NO: 3733749 - RNA, 14 nt, Salmonella enterica enterica serovar Typhi Ty2
aucagccccagcac

SEQ ID NO: 3733750 - RNA, 18 nt, Salmonella enterica enterica serovar Typhi Ty2
aucagccguuacuucccc

SEQ ID NO: 3733751 - RNA, 20 nt, Salmonella enterica enterica serovar Typhi Ty2
aucagccguuacuuccccca

SEQ ID NO: 3733752 - RNA, 15 nt, Salmonella enterica enterica serovar Typhi Ty2
aucagcgaaggcaac

SEQ ID NO: 3733753 - RNA, 14 nt, Salmonella enterica enterica serovar Typhi Ty2
aucagcgagacagc

SEQ ID NO: 3733754 - RNA, 16 nt, Salmonella enterica enterica serovar Typhi Ty2
aucagcgcaauaaauu

SEQ ID NO: 3733755 - RNA, 11 nt, Salmonella enterica enterica serovar Typhi Ty2
aucagcgccac

SEQ ID NO: 3733756 - RNA, 14 nt, Salmonella enterica enterica serovar Typhi Ty2
aucagcgccaccac

SEQ ID NO: 3733757 - RNA, 14 nt, Salmonella enterica enterica serovar Typhi Ty2
aucagcgccagccc

SEQ ID NO: 3733758 - RNA, 15 nt, Salmonella enterica enterica serovar Typhi Ty2
aucagcgccagcccu

SEQ ID NO: 3733759 - RNA, 19 nt, Salmonella enterica enterica serovar Typhi Ty2
aucagcgccgucgccauca

SEQ ID NO: 3733760 - RNA, 14 nt, Salmonella enterica enterica serovar Typhi Ty2
aucagcgcgcucca

SEQ ID NO: 3733761 - RNA, 20 nt, Salmonella enterica enterica serovar Typhi Ty2
aucagcgcgcuccagaccac

SEQ ID NO: 3733762 - RNA, 22 nt, Salmonella enterica enterica serovar Typhi Ty2
aucagcgcggcgugaucaaauu

SEQ ID NO: 3733763 - RNA, 15 nt, Salmonella enterica enterica serovar Typhi Ty2
aucagcgcuaccagc

SEQ ID NO: 3733764 - RNA, 15 nt, Salmonella enterica enterica serovar Typhi Ty2
aucagcgcuccgaca

SEQ ID NO: 3733765 - RNA, 16 nt, Salmonella enterica enterica serovar Typhi Ty2
aucagcggguauugcu

SEQ ID NO: 3733766 - RNA, 19 nt, Salmonella enterica enterica serovar Typhi Ty2
aucagcugauauaacgugc

SEQ ID NO: 3733767 - RNA, 16 nt, Salmonella enterica enterica serovar Typhi Ty2
aucagcuuugcggcca

SEQ ID NO: 3733768 - RNA, 21 nt, Salmonella enterica enterica serovar Typhi Ty2
aucaggaaagagccgcgcagc

SEQ ID NO: 3733769 - RNA, 16 nt, Salmonella enterica enterica serovar Typhi Ty2
aucaggacauggucac

SEQ ID NO: 3733770 - RNA, 16 nt, Salmonella enterica enterica serovar Typhi Ty2
aucaggaugaauauga

SEQ ID NO: 3733771 - RNA, 19 nt, Salmonella enterica enterica serovar Typhi Ty2
aucaggcaauaaacaucag

SEQ ID NO: 3733772 - RNA, 12 nt, Salmonella enterica enterica serovar Typhi Ty2
aucaggcaauau

SEQ ID NO: 3733773 - RNA, 17 nt, Salmonella enterica enterica serovar Typhi Ty2
aucaggcaaugucugcc

SEQ ID NO: 3733774 - RNA, 20 nt, Salmonella enterica enterica serovar Typhi Ty2
aucaggcacacguuaaaccc

SEQ ID NO: 3733775 - RNA, 17 nt, Salmonella enterica enterica serovar Typhi Ty2
aucaggcauccugcccu

SEQ ID NO: 3733776 - RNA, 19 nt, Salmonella enterica enterica serovar Typhi Ty2
aucaggcaucugaaaugcu

SEQ ID NO: 3733777 - RNA, 19 nt, Salmonella enterica enterica serovar Typhi Ty2
aucaggcauucagcggguu

SEQ ID NO: 3733778 - RNA, 19 nt, Salmonella enterica enterica serovar Typhi Ty2
aucaggccauuaacgccgc

SEQ ID NO: 3733779 - RNA, 13 nt, Salmonella enterica enterica serovar Typhi Ty2
aucaggcccagua

SEQ ID NO: 3733780 - RNA, 19 nt, Salmonella enterica enterica serovar Typhi Ty2
aucaggccgacaaaugacg

SEQ ID NO: 3733781 - RNA, 21 nt, Salmonella enterica enterica serovar Typhi Ty2
aucaggccuacaagaauuuau

SEQ ID NO: 3733782 - RNA, 17 nt, Salmonella enterica enterica serovar Typhi Ty2
aucaggccuaccagccg

SEQ ID NO: 3733783 - RNA, 17 nt, Salmonella enterica enterica serovar Typhi Ty2
aucaggccuaccaucgc

SEQ ID NO: 3733784 - RNA, 13 nt, Salmonella enterica enterica serovar Typhi Ty2
aucaggccugccu

SEQ ID NO: 3733785 - RNA, 22 nt, Salmonella enterica enterica serovar Typhi Ty2
aucaggccugccugaucgccac

SEQ ID NO: 3733786 - RNA, 12 nt, Salmonella enterica enterica serovar Typhi Ty2
aucaggcguaga

SEQ ID NO: 3733787 - RNA, 16 nt, Salmonella enterica enterica serovar Typhi Ty2
aucaggcgugaugacu

SEQ ID NO: 3733788 - RNA, 17 nt, Salmonella enterica enterica serovar Typhi Ty2
aucaggcgugaugacuu

SEQ ID NO: 3733789 - RNA, 15 nt, Salmonella enterica enterica serovar Typhi Ty2
aucaggcguuacaga

SEQ ID NO: 3733790 - RNA, 21 nt, Salmonella enterica enterica serovar Typhi Ty2
aucaggcguuacagacgcugc

SEQ ID NO: 3733791 - RNA, 17 nt, Salmonella enterica enterica serovar Typhi Ty2
aucaggcguugaccgcu

SEQ ID NO: 3733792 - RNA, 17 nt, Salmonella enterica enterica serovar Typhi Ty2
aucaggucaugcgcgag

SEQ ID NO: 3733793 - RNA, 14 nt, Salmonella enterica enterica serovar Typhi Ty2
aucaguaacacaau

SEQ ID NO: 3733794 - RNA, 17 nt, Salmonella enterica enterica serovar Typhi Ty2
aucaguaacacaaucag

SEQ ID NO: 3733795 - RNA, 16 nt, Salmonella enterica enterica serovar Typhi Ty2
aucaguaacagaacaa

SEQ ID NO: 3733796 - RNA, 20 nt, Salmonella enterica enterica serovar Typhi Ty2
aucaguaacugacgaccggg

SEQ ID NO: 3733797 - RNA, 17 nt, Salmonella enterica enterica serovar Typhi Ty2
aucaguaauguccagau

SEQ ID NO: 3733798 - RNA, 22 nt, Salmonella enterica enterica serovar Typhi Ty2
aucaguacgaccccgccgagaa

SEQ ID NO: 3733799 - RNA, 19 nt, Salmonella enterica enterica serovar Typhi Ty2
aucaguccgggcauaaccu

SEQ ID NO: 3733800 - RNA, 14 nt, Salmonella enterica enterica serovar Typhi Ty2
aucagucgcagcgg

SEQ ID NO: 3733801 - RNA, 23 nt, Salmonella enterica enterica serovar Typhi Ty2
aucagucgcagcggcugcgccug

SEQ ID NO: 3733802 - RNA, 17 nt, Salmonella enterica enterica serovar Typhi Ty2
aucagugagaagggcag

SEQ ID NO: 3733803 - RNA, 17 nt, Salmonella enterica enterica serovar Typhi Ty2
aucagugcaucuucacu

SEQ ID NO: 3733804 - RNA, 19 nt, Salmonella enterica enterica serovar Typhi Ty2
aucagugcaucuucacugu

SEQ ID NO: 3733805 - RNA, 20 nt, Salmonella enterica enterica serovar Typhi Ty2
aucaguggcggcaaaaaaua

SEQ ID NO: 3733806 - RNA, 20 nt, Salmonella enterica enterica serovar Typhi Ty2
aucaguggggccuuuuuaau

SEQ ID NO: 3733807 - RNA, 19 nt, Salmonella enterica enterica serovar Typhi Ty2
aucaguuccaacccuugcu

SEQ ID NO: 3733808 - RNA, 12 nt, Salmonella enterica enterica serovar Typhi Ty2
aucauaaaucga

SEQ ID NO: 3733809 - RNA, 13 nt, Salmonella enterica enterica serovar Typhi Ty2
aucauaagggagc

SEQ ID NO: 3733810 - RNA, 12 nt, Salmonella enterica enterica serovar Typhi Ty2
aucauaccgcgu

SEQ ID NO: 3733811 - RNA, 20 nt, Salmonella enterica enterica serovar Typhi Ty2
aucauaccggcagcagugag

SEQ ID NO: 3733812 - RNA, 20 nt, Salmonella enterica enterica serovar Typhi Ty2
aucauaguuuuuccccauca

SEQ ID NO: 3733813 - RNA, 17 nt, Salmonella enterica enterica serovar Typhi Ty2
aucauaucaauauguuc

SEQ ID NO: 3733814 - RNA, 18 nt, Salmonella enterica enterica serovar Typhi Ty2
aucauauucgcagcucug

SEQ ID NO: 3733815 - RNA, 18 nt, Salmonella enterica enterica serovar Typhi Ty2
aucaucaccguuuuccag

SEQ ID NO: 3733816 - RNA, 15 nt, Salmonella enterica enterica serovar Typhi Ty2
aucaucagggcgaaa

SEQ ID NO: 3733817 - RNA, 23 nt, Salmonella enterica enterica serovar Typhi Ty2
aucaucaggguuauccuccagcc

SEQ ID NO: 3733818 - RNA, 16 nt, Salmonella enterica enterica serovar Typhi Ty2
aucaucauaucccggc

SEQ ID NO: 3733819 - RNA, 14 nt, Salmonella enterica enterica serovar Typhi Ty2
aucaucaucggcac

SEQ ID NO: 3733820 - RNA, 19 nt, Salmonella enterica enterica serovar Typhi Ty2
aucaucaucggcacagcca

SEQ ID NO: 3733821 - RNA, 20 nt, Salmonella enterica enterica serovar Typhi Ty2
aucaucaucggcacagccag

SEQ ID NO: 3733822 - RNA, 17 nt, Salmonella enterica enterica serovar Typhi Ty2
aucauccagucagcaau

SEQ ID NO: 3733823 - RNA, 20 nt, Salmonella enterica enterica serovar Typhi Ty2
aucauccagucagcaauuaa

SEQ ID NO: 3733824 - RNA, 20 nt, Salmonella enterica enterica serovar Typhi Ty2
aucauccccaccgcugaugg

SEQ ID NO: 3733825 - RNA, 14 nt, Salmonella enterica enterica serovar Typhi Ty2
aucauccccggcag

SEQ ID NO: 3733826 - RNA, 17 nt, Salmonella enterica enterica serovar Typhi Ty2
aucauccccggcaggcu

SEQ ID NO: 3733827 - RNA, 20 nt, Salmonella enterica enterica serovar Typhi Ty2
aucaucccgcccagcaacac

SEQ ID NO: 3733828 - RNA, 16 nt, Salmonella enterica enterica serovar Typhi Ty2
auccagauguuauaaa

SEQ ID NO: 3733829 - RNA, 19 nt, Salmonella enterica enterica serovar Typhi Ty2
auccagauguuauaaacuu

SEQ ID NO: 3733830 - RNA, 14 nt, Salmonella enterica enterica serovar Typhi Ty2
auccagcaaaauaa

SEQ ID NO: 3733831 - RNA, 11 nt, Salmonella enterica enterica serovar Typhi Ty2
auccagcacag

SEQ ID NO: 3733832 - RNA, 17 nt, Salmonella enterica enterica serovar Typhi Ty2
auccagcacgguaaacc

SEQ ID NO: 3733833 - RNA, 12 nt, Salmonella enterica enterica serovar Typhi Ty2
auccagcagcca

SEQ ID NO: 3733834 - RNA, 16 nt, Salmonella enterica enterica serovar Typhi Ty2
auccagcaguugccau

SEQ ID NO: 3733835 - RNA, 11 nt, Salmonella enterica enterica serovar Typhi Ty2
auccagcccca

SEQ ID NO: 3733836 - RNA, 23 nt, Salmonella enterica enterica serovar Typhi Ty2
auccagccccagcgccagcugcg

SEQ ID NO: 3733837 - RNA, 14 nt, Salmonella enterica enterica serovar Typhi Ty2
auccagccucuccc

SEQ ID NO: 3733838 - RNA, 22 nt, Salmonella enterica enterica serovar Typhi Ty2
auccagcgauugacgguuuguc

SEQ ID NO: 3733839 - RNA, 16 nt, Salmonella enterica enterica serovar Typhi Ty2
auccagcgcaaaggga

SEQ ID NO: 3733840 - RNA, 22 nt, Salmonella enterica enterica serovar Typhi Ty2
auccagcgccugcuguaaaaua

SEQ ID NO: 3733841 - RNA, 19 nt, Salmonella enterica enterica serovar Typhi Ty2
auccagcgcguaaauaccu

SEQ ID NO: 3733842 - RNA, 17 nt, Salmonella enterica enterica serovar Typhi Ty2
auccagcgcucaaucag

SEQ ID NO: 3733843 - RNA, 17 nt, Salmonella enterica enterica serovar Typhi Ty2
auccagcgguuacuuuu

SEQ ID NO: 3733844 - RNA, 18 nt, Salmonella enterica enterica serovar Typhi Ty2
auccagcgguuacuuuug

SEQ ID NO: 3733845 - RNA, 18 nt, Salmonella enterica enterica serovar Typhi Ty2
auccagcguagcggugua

SEQ ID NO: 3733846 - RNA, 15 nt, Salmonella enterica enterica serovar Typhi Ty2
auccagcgucacagg

SEQ ID NO: 3733847 - RNA, 14 nt, Salmonella enterica enterica serovar Typhi Ty2
auccagcgucgcca

SEQ ID NO: 3733848 - RNA, 17 nt, Salmonella enterica enterica serovar Typhi Ty2
auccagcgucgccagca

SEQ ID NO: 3733849 - RNA, 21 nt, Salmonella enterica enterica serovar Typhi Ty2
auccagcucuuucaauccuuc

SEQ ID NO: 3733850 - RNA, 20 nt, Salmonella enterica enterica serovar Typhi Ty2
auccagcuugccgucacagg

SEQ ID NO: 3733851 - RNA, 16 nt, Salmonella enterica enterica serovar Typhi Ty2
auccaggaaguaaauu

SEQ ID NO: 3733852 - RNA, 18 nt, Salmonella enterica enterica serovar Typhi Ty2
auccaggacgucuugcaa

SEQ ID NO: 3733853 - RNA, 15 nt, Salmonella enterica enterica serovar Typhi Ty2
auccaggagcauugg

SEQ ID NO: 3733854 - RNA, 11 nt, Salmonella enterica enterica serovar Typhi Ty2
auccaggugga

SEQ ID NO: 3733855 - RNA, 14 nt, Salmonella enterica enterica serovar Typhi Ty2
auccagguggaucg

SEQ ID NO: 3733856 - RNA, 19 nt, Salmonella enterica enterica serovar Typhi Ty2
auccagguggaucggaaau

SEQ ID NO: 3733857 - RNA, 9 nt, Salmonella enterica enterica serovar Typhi Ty2
auccaguaa

SEQ ID NO: 3733858 - RNA, 17 nt, Salmonella enterica enterica serovar Typhi Ty2
auccaguaauuuuuccg

SEQ ID NO: 3733859 - RNA, 15 nt, Salmonella enterica enterica serovar Typhi Ty2
auccaguugaugaug

SEQ ID NO: 3733860 - RNA, 24 nt, Salmonella enterica enterica serovar Typhi Ty2
auccaguuucuucggcuucaccga

SEQ ID NO: 3733861 - RNA, 15 nt, Salmonella enterica enterica serovar Typhi Ty2
auccaguuuuuucca

SEQ ID NO: 3733862 - RNA, 20 nt, Salmonella enterica enterica serovar Typhi Ty2
auccaguuuuuuccagcgcg

SEQ ID NO: 3733863 - RNA, 17 nt, Salmonella enterica enterica serovar Typhi Ty2
auccauaagaugaaaga

SEQ ID NO: 3733864 - RNA, 19 nt, Salmonella enterica enterica serovar Typhi Ty2
auccauacgguuguugauu

SEQ ID NO: 3733865 - RNA, 14 nt, Salmonella enterica enterica serovar Typhi Ty2
auccauauucuucg

SEQ ID NO: 3733866 - RNA, 20 nt, Salmonella enterica enterica serovar Typhi Ty2
auccaucgguucucugccau

SEQ ID NO: 3733867 - RNA, 21 nt, Salmonella enterica enterica serovar Typhi Ty2
auccauguacgcaggcgacug

SEQ ID NO: 3733868 - RNA, 16 nt, Salmonella enterica enterica serovar Typhi Ty2
auccauguugccauga

SEQ ID NO: 3733869 - RNA, 14 nt, Salmonella enterica enterica serovar Typhi Ty2
auccauuaaaaucu

SEQ ID NO: 3733870 - RNA, 17 nt, Salmonella enterica enterica serovar Typhi Ty2
aucccaccauaaagcga

SEQ ID NO: 3733871 - RNA, 15 nt, Salmonella enterica enterica serovar Typhi Ty2
aucccaccggaaaug

SEQ ID NO: 3733872 - RNA, 21 nt, Salmonella enterica enterica serovar Typhi Ty2
aucccacggagaaaagcgaaa

SEQ ID NO: 3733873 - RNA, 21 nt, Salmonella enterica enterica serovar Typhi Ty2
aucccacucuucaaccggcag

SEQ ID NO: 3733874 - RNA, 13 nt, Salmonella enterica enterica serovar Typhi Ty2
aucccagaaaaug

SEQ ID NO: 3733875 - RNA, 16 nt, Salmonella enterica enterica serovar Typhi Ty2
aucccagggcggcguc

SEQ ID NO: 3733876 - RNA, 23 nt, Salmonella enterica enterica serovar Typhi Ty2
aucccaguugaucggccagcaag

SEQ ID NO: 3733877 - RNA, 20 nt, Salmonella enterica enterica serovar Typhi Ty2
aucccauccgggccacucuc

SEQ ID NO: 3733878 - RNA, 17 nt, Salmonella enterica enterica serovar Typhi Ty2
aucccaugcaccagucc

SEQ ID NO: 3733879 - RNA, 22 nt, Salmonella enterica enterica serovar Typhi Ty2
aucccauuagggcuauuuuacu

SEQ ID NO: 3733880 - RNA, 17 nt, Salmonella enterica enterica serovar Typhi Ty2
aucccauugcguucuau

SEQ ID NO: 3733881 - RNA, 13 nt, Salmonella enterica enterica serovar Typhi Ty2
auccccaaacugc

SEQ ID NO: 3733882 - RNA, 15 nt, Salmonella enterica enterica serovar Typhi Ty2
auccccaccaccgcc

SEQ ID NO: 3733883 - RNA, 16 nt, Salmonella enterica enterica serovar Typhi Ty2
auccccaccgcugaug

SEQ ID NO: 3733884 - RNA, 17 nt, Salmonella enterica enterica serovar Typhi Ty2
auccccagucuuccugc

SEQ ID NO: 3733885 - RNA, 14 nt, Salmonella enterica enterica serovar Typhi Ty2
auccccauauucca

SEQ ID NO: 3733886 - RNA, 14 nt, Salmonella enterica enterica serovar Typhi Ty2
auccccccuuuuuu

SEQ ID NO: 3733887 - RNA, 16 nt, Salmonella enterica enterica serovar Typhi Ty2
aucccccugccacaac

SEQ ID NO: 3733888 - RNA, 13 nt, Salmonella enterica enterica serovar Typhi Ty2
aucccccuggccc

SEQ ID NO: 3733889 - RNA, 18 nt, Salmonella enterica enterica serovar Typhi Ty2
auccccgaaagccgguaa

SEQ ID NO: 3733890 - RNA, 15 nt, Salmonella enterica enterica serovar Typhi Ty2
auccccgccgggcuu

SEQ ID NO: 3733891 - RNA, 12 nt, Salmonella enterica enterica serovar Typhi Ty2
auccccgcuggc

SEQ ID NO: 3733892 - RNA, 13 nt, Salmonella enterica enterica serovar Typhi Ty2
auccccggcaggc

SEQ ID NO: 3733893 - RNA, 17 nt, Salmonella enterica enterica serovar Typhi Ty2
auccccguuuucgccgg

SEQ ID NO: 3733894 - RNA, 13 nt, Salmonella enterica enterica serovar Typhi Ty2
auccccugcuccu

SEQ ID NO: 3733895 - RNA, 14 nt, Salmonella enterica enterica serovar Typhi Ty2
auccccugcuccug

SEQ ID NO: 3733896 - RNA, 16 nt, Salmonella enterica enterica serovar Typhi Ty2
auccccuucaggaaua

SEQ ID NO: 3733897 - RNA, 18 nt, Salmonella enterica enterica serovar Typhi Ty2
aucccgaacaugccgccg

SEQ ID NO: 3733898 - RNA, 14 nt, Salmonella enterica enterica serovar Typhi Ty2
aucccgaauggcgu

SEQ ID NO: 3733899 - RNA, 22 nt, Salmonella enterica enterica serovar Typhi Ty2
aucccgacccauacucuuuccc

SEQ ID NO: 3733900 - RNA, 14 nt, Salmonella enterica enterica serovar Typhi Ty2
aucccgcaggcggc

SEQ ID NO: 3733901 - RNA, 13 nt, Salmonella enterica enterica serovar Typhi Ty2
aucccgcaucacc

SEQ ID NO: 3733902 - RNA, 14 nt, Salmonella enterica enterica serovar Typhi Ty2
aucccgccgcaucc

SEQ ID NO: 3733903 - RNA, 17 nt, Salmonella enterica enterica serovar Typhi Ty2
aucccgcgccaauaacg

SEQ ID NO: 3733904 - RNA, 22 nt, Salmonella enterica enterica serovar Typhi Ty2
aucccgggcgauaaaccagccc

SEQ ID NO: 3733905 - RNA, 14 nt, Salmonella enterica enterica serovar Typhi Ty2
aucccgucccacca

SEQ ID NO: 3733906 - RNA, 14 nt, Salmonella enterica enterica serovar Typhi Ty2
aucccuaauaaaau

SEQ ID NO: 3733907 - RNA, 22 nt, Salmonella enterica enterica serovar Typhi Ty2
aucccuccaccagcuucaugcu

SEQ ID NO: 3733908 - RNA, 14 nt, Salmonella enterica enterica serovar Typhi Ty2
aucccugcaaacua

SEQ ID NO: 3733909 - RNA, 19 nt, Salmonella enterica enterica serovar Typhi Ty2
auccgaaaugaccaccgca

SEQ ID NO: 3733910 - RNA, 13 nt, Salmonella enterica enterica serovar Typhi Ty2
auccgaagaacca

SEQ ID NO: 3733911 - RNA, 14 nt, Salmonella enterica enterica serovar Typhi Ty2
aucgacaucuucau

SEQ ID NO: 3733912 - RNA, 15 nt, Salmonella enterica enterica serovar Typhi Ty2
aucgacauuaugauc

SEQ ID NO: 3733913 - RNA, 23 nt, Salmonella enterica enterica serovar Typhi Ty2
aucgaccauacuaaugcugccca

SEQ ID NO: 3733914 - RNA, 22 nt, Salmonella enterica enterica serovar Typhi Ty2
aucgacccccaccucaaucacc

SEQ ID NO: 3733915 - RNA, 18 nt, Salmonella enterica enterica serovar Typhi Ty2
aucgaccuuuucccguaa

SEQ ID NO: 3733916 - RNA, 13 nt, Salmonella enterica enterica serovar Typhi Ty2
aucgacgaaaugg

SEQ ID NO: 3733917 - RNA, 20 nt, Salmonella enterica enterica serovar Typhi Ty2
aucgacgauaacaagccggc

SEQ ID NO: 3733918 - RNA, 14 nt, Salmonella enterica enterica serovar Typhi Ty2
aucgacggcaauau

SEQ ID NO: 3733919 - RNA, 15 nt, Salmonella enterica enterica serovar Typhi Ty2
aucgagaagccauca

SEQ ID NO: 3733920 - RNA, 14 nt, Salmonella enterica enterica serovar Typhi Ty2
aucgagagcgggug

SEQ ID NO: 3733921 - RNA, 11 nt, Salmonella enterica enterica serovar Typhi Ty2
aucgagauaag

SEQ ID NO: 3733922 - RNA, 13 nt, Salmonella enterica enterica serovar Typhi Ty2
aucgagauaagau

SEQ ID NO: 3733923 - RNA, 16 nt, Salmonella enterica enterica serovar Typhi Ty2
aucgauacuaaaacuu

SEQ ID NO: 3733924 - RNA, 20 nt, Salmonella enterica enterica serovar Typhi Ty2
aucgauauaucgcgucauca

SEQ ID NO: 3733925 - RNA, 21 nt, Salmonella enterica enterica serovar Typhi Ty2
aucgauccacuucccauucuc

SEQ ID NO: 3733926 - RNA, 22 nt, Salmonella enterica enterica serovar Typhi Ty2
aucgaugccacagcgcauucac

SEQ ID NO: 3733927 - RNA, 19 nt, Salmonella enterica enterica serovar Typhi Ty2
aucgauggcagucgcauca

SEQ ID NO: 3733928 - RNA, 21 nt, Salmonella enterica enterica serovar Typhi Ty2
aucgauuuagagcuaaucaau

SEQ ID NO: 3733929 - RNA, 17 nt, Salmonella enterica enterica serovar Typhi Ty2
aucgcagacauggcaau

SEQ ID NO: 3733930 - RNA, 21 nt, Salmonella enterica enterica serovar Typhi Ty2
aucgcagauuccgaacucaug

SEQ ID NO: 3733931 - RNA, 20 nt, Salmonella enterica enterica serovar Typhi Ty2
aucgcaggauaaagaccggc

SEQ ID NO: 3733932 - RNA, 13 nt, Salmonella enterica enterica serovar Typhi Ty2
aucgcauauugcg

SEQ ID NO: 3733933 - RNA, 13 nt, Salmonella enterica enterica serovar Typhi Ty2
aucgccaaaccag

SEQ ID NO: 3733934 - RNA, 12 nt, Salmonella enterica enterica serovar Typhi Ty2
aucgccaaagcg

SEQ ID NO: 3733935 - RNA, 20 nt, Salmonella enterica enterica serovar Typhi Ty2
aucgccaaagucauugcugc

SEQ ID NO: 3733936 - RNA, 22 nt, Salmonella enterica enterica serovar Typhi Ty2
aucgccaaagucauugcugcca

SEQ ID NO: 3733937 - RNA, 16 nt, Salmonella enterica enterica serovar Typhi Ty2
aucgccacaugcggca

SEQ ID NO: 3733938 - RNA, 19 nt, Salmonella enterica enterica serovar Typhi Ty2
aucgccacaugcggcaggc

SEQ ID NO: 3733939 - RNA, 14 nt, Salmonella enterica enterica serovar Typhi Ty2
aucgccagcgccug

SEQ ID NO: 3733940 - RNA, 20 nt, Salmonella enterica enterica serovar Typhi Ty2
aucgccaucaacuccuccgg

SEQ ID NO: 3733941 - RNA, 18 nt, Salmonella enterica enterica serovar Typhi Ty2
aucgccaucauagcccau

SEQ ID NO: 3733942 - RNA, 22 nt, Salmonella enterica enterica serovar Typhi Ty2
aucgcccacgcaaaauggccug

SEQ ID NO: 3733943 - RNA, 15 nt, Salmonella enterica enterica serovar Typhi Ty2
aucgcccaucacaug

SEQ ID NO: 3733944 - RNA, 22 nt, Salmonella enterica enterica serovar Typhi Ty2
aucgcccccaucgugauaaagg

SEQ ID NO: 3733945 - RNA, 17 nt, Salmonella enterica enterica serovar Typhi Ty2
aucgcccggccuccggu

SEQ ID NO: 3733946 - RNA, 15 nt, Salmonella enterica enterica serovar Typhi Ty2
aucgcccuccagcuc

SEQ ID NO: 3733947 - RNA, 19 nt, Salmonella enterica enterica serovar Typhi Ty2
aucgccgaaagcgaucaca

SEQ ID NO: 3733948 - RNA, 13 nt, Salmonella enterica enterica serovar Typhi Ty2
aucgccgaucaca

SEQ ID NO: 3733949 - RNA, 15 nt, Salmonella enterica enterica serovar Typhi Ty2
aucgccgaucacaaa

SEQ ID NO: 3733950 - RNA, 20 nt, Salmonella enterica enterica serovar Typhi Ty2
aucgccgcaaugaccacaaa

SEQ ID NO: 3733951 - RNA, 23 nt, Salmonella enterica enterica serovar Typhi Ty2
aucgccgcccgcaugguaaacgc

SEQ ID NO: 3733952 - RNA, 22 nt, Salmonella enterica enterica serovar Typhi Ty2
aucgccgcgccggacuccagca

SEQ ID NO: 3733953 - RNA, 22 nt, Salmonella enterica enterica serovar Typhi Ty2
aucgccggagccgccuggccug

SEQ ID NO: 3733954 - RNA, 20 nt, Salmonella enterica enterica serovar Typhi Ty2
aucgccggcgucaucggcgc

SEQ ID NO: 3733955 - RNA, 23 nt, Salmonella enterica enterica serovar Typhi Ty2
aucgccguauuucacuuuugccg

SEQ ID NO: 3733956 - RNA, 23 nt, Salmonella enterica enterica serovar Typhi Ty2
aucgccgucuucuucuucgcgca

SEQ ID NO: 3733957 - RNA, 22 nt, Salmonella enterica enterica serovar Typhi Ty2
aucgccguuaucgaggcgcugg

SEQ ID NO: 3733958 - RNA, 13 nt, Salmonella enterica enterica serovar Typhi Ty2
aucgccucaacca

SEQ ID NO: 3733959 - RNA, 18 nt, Salmonella enterica enterica serovar Typhi Ty2
aucgccuccagacuggcg

SEQ ID NO: 3733960 - RNA, 16 nt, Salmonella enterica enterica serovar Typhi Ty2
aucgccucccugccua

SEQ ID NO: 3733961 - RNA, 16 nt, Salmonella enterica enterica serovar Typhi Ty2
aucgccugaugaccgc

SEQ ID NO: 3733962 - RNA, 15 nt, Salmonella enterica enterica serovar Typhi Ty2
aucgccugcgcgccu

SEQ ID NO: 3733963 - RNA, 15 nt, Salmonella enterica enterica serovar Typhi Ty2
aucgccugcggcgua

SEQ ID NO: 3733964 - RNA, 17 nt, Salmonella enterica enterica serovar Typhi Ty2
aucgccugguaaggcaa

SEQ ID NO: 3733965 - RNA, 22 nt, Salmonella enterica enterica serovar Typhi Ty2
aucgccuggugugaacaucacg

SEQ ID NO: 3733966 - RNA, 13 nt, Salmonella enterica enterica serovar Typhi Ty2
aucgcgagaaaau

SEQ ID NO: 3733967 - RNA, 23 nt, Salmonella enterica enterica serovar Typhi Ty2
aucgcgagcacuuuuuccuccug

SEQ ID NO: 3733968 - RNA, 19 nt, Salmonella enterica enterica serovar Typhi Ty2
aucgcgauacugccgccca

SEQ ID NO: 3733969 - RNA, 21 nt, Salmonella enterica enterica serovar Typhi Ty2
aucgcgauaucaacccaguuu

SEQ ID NO: 3733970 - RNA, 20 nt, Salmonella enterica enterica serovar Typhi Ty2
aucgcgcacaugcugugcgc

SEQ ID NO: 3733971 - RNA, 17 nt, Salmonella enterica enterica serovar Typhi Ty2
aucgcgcagcaaaucag

SEQ ID NO: 3733972 - RNA, 19 nt, Salmonella enterica enterica serovar Typhi Ty2
aucgcgcagcguaaagcgu

SEQ ID NO: 3733973 - RNA, 19 nt, Salmonella enterica enterica serovar Typhi Ty2
aucgcgccggucgccagca

SEQ ID NO: 3733974 - RNA, 16 nt, Salmonella enterica enterica serovar Typhi Ty2
aucgcgcgcaaaugca

SEQ ID NO: 3733975 - RNA, 21 nt, Salmonella enterica enterica serovar Typhi Ty2
aucgcgcgcagaguguaggcc

SEQ ID NO: 3733976 - RNA, 12 nt, Salmonella enterica enterica serovar Typhi Ty2
aucgcgcggcga

SEQ ID NO: 3733977 - RNA, 15 nt, Salmonella enterica enterica serovar Typhi Ty2
aucgcgcugauauuu

SEQ ID NO: 3733978 - RNA, 22 nt, Salmonella enterica enterica serovar Typhi Ty2
aucgcggcccucuaagcgcuca

SEQ ID NO: 3733979 - RNA, 21 nt, Salmonella enterica enterica serovar Typhi Ty2
aucgcggcgcugaguuucucc

SEQ ID NO: 3733980 - RNA, 23 nt, Salmonella enterica enterica serovar Typhi Ty2
aucgcgggcaaucaaaugcgcau

SEQ ID NO: 3733981 - RNA, 15 nt, Salmonella enterica enterica serovar Typhi Ty2
aucgcggggcaacag

SEQ ID NO: 3733982 - RNA, 15 nt, Salmonella enterica enterica serovar Typhi Ty2
aucgcgguaacgccu

SEQ ID NO: 3733983 - RNA, 16 nt, Salmonella enterica enterica serovar Typhi Ty2
aucgcguacagcgcca

SEQ ID NO: 3733984 - RNA, 15 nt, Salmonella enterica enterica serovar Typhi Ty2
aucgcgucgccauca

SEQ ID NO: 3733985 - RNA, 21 nt, Salmonella enterica enterica serovar Typhi Ty2
aucgcguuacggccaaauuua

SEQ ID NO: 3733986 - RNA, 19 nt, Salmonella enterica enterica serovar Typhi Ty2
aucgcguuguaaucgccug

SEQ ID NO: 3733987 - RNA, 20 nt, Salmonella enterica enterica serovar Typhi Ty2
aucgcguuuuccagcauccu

SEQ ID NO: 3733988 - RNA, 17 nt, Salmonella enterica enterica serovar Typhi Ty2
aucgcuaaacauauacc

SEQ ID NO: 3733989 - RNA, 20 nt, Salmonella enterica enterica serovar Typhi Ty2
aucgcuaaacauauaccgca

SEQ ID NO: 3733990 - RNA, 13 nt, Salmonella enterica enterica serovar Typhi Ty2
aucgcuaaucagg

SEQ ID NO: 3733991 - RNA, 15 nt, Salmonella enterica enterica serovar Typhi Ty2
aucgcuaauuuuuaa

SEQ ID NO: 3733992 - RNA, 23 nt, Salmonella enterica enterica serovar Typhi Ty2
aucgcuaucugacagccaaacug

SEQ ID NO: 3733993 - RNA, 17 nt, Salmonella enterica enterica serovar Typhi Ty2
aucgugaggauaaucca

SEQ ID NO: 3733994 - RNA, 18 nt, Salmonella enterica enterica serovar Typhi Ty2
aucgugauaaauugcuga

SEQ ID NO: 3733995 - RNA, 23 nt, Salmonella enterica enterica serovar Typhi Ty2
aucgugccguccggcaucacaaa

SEQ ID NO: 3733996 - RNA, 23 nt, Salmonella enterica enterica serovar Typhi Ty2
aucgugcgcguaugauuuucuua

SEQ ID NO: 3733997 - RNA, 20 nt, Salmonella enterica enterica serovar Typhi Ty2
aucgugcggcgaagcaucuu

SEQ ID NO: 3733998 - RNA, 16 nt, Salmonella enterica enterica serovar Typhi Ty2
aucgugguuggcauau

SEQ ID NO: 3733999 - RNA, 19 nt, Salmonella enterica enterica serovar Typhi Ty2
aucguguuauuuucaaaaa

SEQ ID NO: 3734000 - RNA, 15 nt, Salmonella enterica enterica serovar Typhi Ty2
aucguguugcagccc

SEQ ID NO: 3734001 - RNA, 18 nt, Salmonella enterica enterica serovar Typhi Ty2
aucguuaauucauggcca

SEQ ID NO: 3734002 - RNA, 14 nt, Salmonella enterica enterica serovar Typhi Ty2
aucguuauauauac

SEQ ID NO: 3734003 - RNA, 21 nt, Salmonella enterica enterica serovar Typhi Ty2
aucguuaucauuaucgccaaa

SEQ ID NO: 3734004 - RNA, 19 nt, Salmonella enterica enterica serovar Typhi Ty2
aucguuauccagcagccac

SEQ ID NO: 3734005 - RNA, 15 nt, Salmonella enterica enterica serovar Typhi Ty2
aucguucgcggaacg

SEQ ID NO: 3734006 - RNA, 19 nt, Salmonella enterica enterica serovar Typhi Ty2
aucguucuugcacaauacu

SEQ ID NO: 3734007 - RNA, 17 nt, Salmonella enterica enterica serovar Typhi Ty2
aucguugccagcggcca

SEQ ID NO: 3734008 - RNA, 14 nt, Salmonella enterica enterica serovar Typhi Ty2
aucguugucgcaau

SEQ ID NO: 3734009 - RNA, 21 nt, Salmonella enterica enterica serovar Typhi Ty2
aucguuuacguuaucauucac

SEQ ID NO: 3734010 - RNA, 15 nt, Salmonella enterica enterica serovar Typhi Ty2
aucguuuccagcauc

SEQ ID NO: 3734011 - RNA, 12 nt, Salmonella enterica enterica serovar Typhi Ty2
aucguuuuucuu

SEQ ID NO: 3734012 - RNA, 17 nt, Salmonella enterica enterica serovar Typhi Ty2
aucuaacccgcucagac

SEQ ID NO: 3734013 - RNA, 17 nt, Salmonella enterica enterica serovar Typhi Ty2
aucuacaaacgcggaca

SEQ ID NO: 3734014 - RNA, 23 nt, Salmonella enterica enterica serovar Typhi Ty2
aucuacaaucgucuucagcaauu

SEQ ID NO: 3734015 - RNA, 20 nt, Salmonella enterica enterica serovar Typhi Ty2
aucuaccuucacgcagugcg

SEQ ID NO: 3734016 - RNA, 17 nt, Salmonella enterica enterica serovar Typhi Ty2
aucuacgcuauuuccag

SEQ ID NO: 3734017 - RNA, 19 nt, Salmonella enterica enterica serovar Typhi Ty2
aucuacgcuauuuccagaa

SEQ ID NO: 3734018 - RNA, 18 nt, Salmonella enterica enterica serovar Typhi Ty2
aucuacgguaucugcaua

SEQ ID NO: 3734019 - RNA, 19 nt, Salmonella enterica enterica serovar Typhi Ty2
aucuacuguuauugacgau

SEQ ID NO: 3734020 - RNA, 14 nt, Salmonella enterica enterica serovar Typhi Ty2
aucuacuucagcac

SEQ ID NO: 3734021 - RNA, 21 nt, Salmonella enterica enterica serovar Typhi Ty2
aucuagcggaaccuguccuga

SEQ ID NO: 3734022 - RNA, 16 nt, Salmonella enterica enterica serovar Typhi Ty2
aucuauauauucuucu

SEQ ID NO: 3734023 - RNA, 14 nt, Salmonella enterica enterica serovar Typhi Ty2
aucucaaggucugu

SEQ ID NO: 3734024 - RNA, 19 nt, Salmonella enterica enterica serovar Typhi Ty2
aucucaaggucugucagga

SEQ ID NO: 3734025 - RNA, 16 nt, Salmonella enterica enterica serovar Typhi Ty2
aucucacgcauggcgu

SEQ ID NO: 3734026 - RNA, 22 nt, Salmonella enterica enterica serovar Typhi Ty2
aucucacgcauggcguugcugc

SEQ ID NO: 3734027 - RNA, 17 nt, Salmonella enterica enterica serovar Typhi Ty2
aucucauaccaggugcc

SEQ ID NO: 3734028 - RNA, 14 nt, Salmonella enterica enterica serovar Typhi Ty2
aucucauugauggu

SEQ ID NO: 3734029 - RNA, 17 nt, Salmonella enterica enterica serovar Typhi Ty2
aucuccagaccgcugcg

SEQ ID NO: 3734030 - RNA, 19 nt, Salmonella enterica enterica serovar Typhi Ty2
aucuccagaccgcugcgga

SEQ ID NO: 3734031 - RNA, 20 nt, Salmonella enterica enterica serovar Typhi Ty2
aucuccagaccgcugcggaa

SEQ ID NO: 3734032 - RNA, 16 nt, Salmonella enterica enterica serovar Typhi Ty2
aucuccaucauuuccg

SEQ ID NO: 3734033 - RNA, 18 nt, Salmonella enterica enterica serovar Typhi Ty2
aucuccccuucagaguga

SEQ ID NO: 3734034 - RNA, 13 nt, Salmonella enterica enterica serovar Typhi Ty2
aucucccugccag

SEQ ID NO: 3734035 - RNA, 16 nt, Salmonella enterica enterica serovar Typhi Ty2
aucuccggcagcgaau

SEQ ID NO: 3734036 - RNA, 13 nt, Salmonella enterica enterica serovar Typhi Ty2
aucuccuccggcu

SEQ ID NO: 3734037 - RNA, 17 nt, Salmonella enterica enterica serovar Typhi Ty2
aucuccuccggcuucag

SEQ ID NO: 3734038 - RNA, 22 nt, Salmonella enterica enterica serovar Typhi Ty2
aucuccugcgauagcugcugac

SEQ ID NO: 3734039 - RNA, 23 nt, Salmonella enterica enterica serovar Typhi Ty2
aucucgaccuggcgcucaaucag

SEQ ID NO: 3734040 - RNA, 18 nt, Salmonella enterica enterica serovar Typhi Ty2
aucucgcacaucaugaug

SEQ ID NO: 3734041 - RNA, 22 nt, Salmonella enterica enterica serovar Typhi Ty2
aucucgcacaucaugaugaucu

SEQ ID NO: 3734042 - RNA, 12 nt, Salmonella enterica enterica serovar Typhi Ty2
aucucgccgucg

SEQ ID NO: 3734043 - RNA, 19 nt, Salmonella enterica enterica serovar Typhi Ty2
aucucgcgguugacgcugc

SEQ ID NO: 3734044 - RNA, 21 nt, Salmonella enterica enterica serovar Typhi Ty2
aucucgucaaacucuuccggg

SEQ ID NO: 3734045 - RNA, 17 nt, Salmonella enterica enterica serovar Typhi Ty2
aucucgugaucgccaaa

SEQ ID NO: 3734046 - RNA, 15 nt, Salmonella enterica enterica serovar Typhi Ty2
aucucuacuuuccug

SEQ ID NO: 3734047 - RNA, 18 nt, Salmonella enterica enterica serovar Typhi Ty2
aucucuaucggcaaacca

SEQ ID NO: 3734048 - RNA, 19 nt, Salmonella enterica enterica serovar Typhi Ty2
aucucucuggcgcauucca

SEQ ID NO: 3734049 - RNA, 19 nt, Salmonella enterica enterica serovar Typhi Ty2
aucucugucgaccaucgca

SEQ ID NO: 3734050 - RNA, 13 nt, Salmonella enterica enterica serovar Typhi Ty2
aucucuucaaaca

SEQ ID NO: 3734051 - RNA, 14 nt, Salmonella enterica enterica serovar Typhi Ty2
aucucuuccagcgu

SEQ ID NO: 3734052 - RNA, 22 nt, Salmonella enterica enterica serovar Typhi Ty2
aucucuugcauaauauccagga

SEQ ID NO: 3734053 - RNA, 14 nt, Salmonella enterica enterica serovar Typhi Ty2
aucucuuuauugcu

SEQ ID NO: 3734054 - RNA, 15 nt, Salmonella enterica enterica serovar Typhi Ty2
aucucuuucagaaua

SEQ ID NO: 3734055 - RNA, 22 nt, Salmonella enterica enterica serovar Typhi Ty2
aucucuuuuaauuuucuguaau

SEQ ID NO: 3734056 - RNA, 15 nt, Salmonella enterica enterica serovar Typhi Ty2
aucucuuuugcuuca

SEQ ID NO: 3734057 - RNA, 12 nt, Salmonella enterica enterica serovar Typhi Ty2
aucucuuuuucu

SEQ ID NO: 3734058 - RNA, 13 nt, Salmonella enterica enterica serovar Typhi Ty2
aucugaaaugcuc

SEQ ID NO: 3734059 - RNA, 14 nt, Salmonella enterica enterica serovar Typhi Ty2
aucugacagccaaa

SEQ ID NO: 3734060 - RNA, 19 nt, Salmonella enterica enterica serovar Typhi Ty2
aucugacagccaaacugcu

SEQ ID NO: 3734061 - RNA, 21 nt, Salmonella enterica enterica serovar Typhi Ty2
aucugacagccaaacugcugu

SEQ ID NO: 3734062 - RNA, 22 nt, Salmonella enterica enterica serovar Typhi Ty2
aucugacagccaaacugcugua

SEQ ID NO: 3734063 - RNA, 18 nt, Salmonella enterica enterica serovar Typhi Ty2
aucugaccaugccagcaa

SEQ ID NO: 3734064 - RNA, 16 nt, Salmonella enterica enterica serovar Typhi Ty2
aucugaguaucgcuuu

SEQ ID NO: 3734065 - RNA, 13 nt, Salmonella enterica enterica serovar Typhi Ty2
aucugauaaaaug

SEQ ID NO: 3734066 - RNA, 16 nt, Salmonella enterica enterica serovar Typhi Ty2
aucugauauaucuuca

SEQ ID NO: 3734067 - RNA, 22 nt, Salmonella enterica enterica serovar Typhi Ty2
aucugaugauggaacagacgcc

SEQ ID NO: 3734068 - RNA, 17 nt, Salmonella enterica enterica serovar Typhi Ty2
aucugcacguaccugcu

SEQ ID NO: 3734069 - RNA, 15 nt, Salmonella enterica enterica serovar Typhi Ty2
aucugcauaggcuuu

SEQ ID NO: 3734070 - RNA, 13 nt, Salmonella enterica enterica serovar Typhi Ty2
aucugccauuucu

SEQ ID NO: 3734071 - RNA, 13 nt, Salmonella enterica enterica serovar Typhi Ty2
aucugcccuuucu

SEQ ID NO: 3734072 - RNA, 15 nt, Salmonella enterica enterica serovar Typhi Ty2
aucugccgucaucga

SEQ ID NO: 3734073 - RNA, 19 nt, Salmonella enterica enterica serovar Typhi Ty2
aucugcgcaacauucugcu

SEQ ID NO: 3734074 - RNA, 21 nt, Salmonella enterica enterica serovar Typhi Ty2
aucugcgcaacauucugcuuc

SEQ ID NO: 3734075 - RNA, 14 nt, Salmonella enterica enterica serovar Typhi Ty2
aucuuucuuuuuau

SEQ ID NO: 3734076 - RNA, 16 nt, Salmonella enterica enterica serovar Typhi Ty2
aucuuugccacgucga

SEQ ID NO: 3734077 - RNA, 14 nt, Salmonella enterica enterica serovar Typhi Ty2
aucuuuguucuguu

SEQ ID NO: 3734078 - RNA, 15 nt, Salmonella enterica enterica serovar Typhi Ty2
aucuuuuaaaaucag

SEQ ID NO: 3734079 - RNA, 16 nt, Salmonella enterica enterica serovar Typhi Ty2
aucuuuuacgaaacaa

SEQ ID NO: 3734080 - RNA, 17 nt, Salmonella enterica enterica serovar Typhi Ty2
aucuuuucaaucagguu

SEQ ID NO: 3734081 - RNA, 11 nt, Salmonella enterica enterica serovar Typhi Ty2
aucuuuuuccc

SEQ ID NO: 3734082 - RNA, 10 nt, Salmonella enterica enterica serovar Typhi Ty2
augaaaaaaa

SEQ ID NO: 3734083 - RNA, 11 nt, Salmonella enterica enterica serovar Typhi Ty2
augaaaaaaac

SEQ ID NO: 3734084 - RNA, 12 nt, Salmonella enterica enterica serovar Typhi Ty2
augaaaaaaacg

SEQ ID NO: 3734085 - RNA, 17 nt, Salmonella enterica enterica serovar Typhi Ty2
augaaaaauccccgcaa

SEQ ID NO: 3734086 - RNA, 12 nt, Salmonella enterica enterica serovar Typhi Ty2
augaaaacucgg

SEQ ID NO: 3734087 - RNA, 20 nt, Salmonella enterica enterica serovar Typhi Ty2
augaaaauaauuuuuaucau

SEQ ID NO: 3734088 - RNA, 20 nt, Salmonella enterica enterica serovar Typhi Ty2
augaaacauauauauccgcu

SEQ ID NO: 3734089 - RNA, 13 nt, Salmonella enterica enterica serovar Typhi Ty2
augaaaccccaaa

SEQ ID NO: 3734090 - RNA, 23 nt, Salmonella enterica enterica serovar Typhi Ty2
augaaacgguuaaaaacagccag

SEQ ID NO: 3734091 - RNA, 14 nt, Salmonella enterica enterica serovar Typhi Ty2
augaaagaaaucac

SEQ ID NO: 3734092 - RNA, 14 nt, Salmonella enterica enterica serovar Typhi Ty2
augaaaucacccag

SEQ ID NO: 3734093 - RNA, 22 nt, Salmonella enterica enterica serovar Typhi Ty2
augaaaucgccuguuaauggua

SEQ ID NO: 3734094 - RNA, 19 nt, Salmonella enterica enterica serovar Typhi Ty2
augaaaugagaccaauaag

SEQ ID NO: 3734095 - RNA, 21 nt, Salmonella enterica enterica serovar Typhi Ty2
augaaauucuugcccgcugag

SEQ ID NO: 3734096 - RNA, 13 nt, Salmonella enterica enterica serovar Typhi Ty2
augaacaauaacg

SEQ ID NO: 3734097 - RNA, 22 nt, Salmonella enterica enterica serovar Typhi Ty2
augaacagcgauguuuuggcgu

SEQ ID NO: 3734098 - RNA, 19 nt, Salmonella enterica enterica serovar Typhi Ty2
augaacccucgaaugugaa

SEQ ID NO: 3734099 - RNA, 18 nt, Salmonella enterica enterica serovar Typhi Ty2
augaaccugaugugcuuu

SEQ ID NO: 3734100 - RNA, 22 nt, Salmonella enterica enterica serovar Typhi Ty2
augaacgacgcugauuugccaa

SEQ ID NO: 3734101 - RNA, 16 nt, Salmonella enterica enterica serovar Typhi Ty2
augaacguuaucggca

SEQ ID NO: 3734102 - RNA, 15 nt, Salmonella enterica enterica serovar Typhi Ty2
augaacucaauccau

SEQ ID NO: 3734103 - RNA, 20 nt, Salmonella enterica enterica serovar Typhi Ty2
augaacucuaugcaaaagaa

SEQ ID NO: 3734104 - RNA, 22 nt, Salmonella enterica enterica serovar Typhi Ty2
augaacucuaugcaaaagaaaa

SEQ ID NO: 3734105 - RNA, 13 nt, Salmonella enterica enterica serovar Typhi Ty2
augaacuuacacu

SEQ ID NO: 3734106 - RNA, 20 nt, Salmonella enterica enterica serovar Typhi Ty2
augaacuuacacuuaccuga

SEQ ID NO: 3734107 - RNA, 23 nt, Salmonella enterica enterica serovar Typhi Ty2
augaagacguucuaucagguauc

SEQ ID NO: 3734108 - RNA, 16 nt, Salmonella enterica enterica serovar Typhi Ty2
augaagcauaaaaaga

SEQ ID NO: 3734109 - RNA, 23 nt, Salmonella enterica enterica serovar Typhi Ty2
augaagcgaagagagaucgaccg

SEQ ID NO: 3734110 - RNA, 11 nt, Salmonella enterica enterica serovar Typhi Ty2
augaagcgcgu

SEQ ID NO: 3734111 - RNA, 19 nt, Salmonella enterica enterica serovar Typhi Ty2
augaaggagagcauuuuuu

SEQ ID NO: 3734112 - RNA, 15 nt, Salmonella enterica enterica serovar Typhi Ty2
augaauaaccucccg

SEQ ID NO: 3734113 - RNA, 22 nt, Salmonella enterica enterica serovar Typhi Ty2
augaauaaccucccgccggggc

SEQ ID NO: 3734114 - RNA, 15 nt, Salmonella enterica enterica serovar Typhi Ty2
augaauaaucucugc

SEQ ID NO: 3734115 - RNA, 23 nt, Salmonella enterica enterica serovar Typhi Ty2
augaauacgcuccagcuggcugg

SEQ ID NO: 3734116 - RNA, 20 nt, Salmonella enterica enterica serovar Typhi Ty2
augaauagccccucaauuau

SEQ ID NO: 3734117 - RNA, 14 nt, Salmonella enterica enterica serovar Typhi Ty2
augaauaucaaacc

SEQ ID NO: 3734118 - RNA, 14 nt, Salmonella enterica enterica serovar Typhi Ty2
augaaucaucagaa

SEQ ID NO: 3734119 - RNA, 20 nt, Salmonella enterica enterica serovar Typhi Ty2
augaaugacaguucccugcu

SEQ ID NO: 3734120 - RNA, 17 nt, Salmonella enterica enterica serovar Typhi Ty2
augaaugacgagcaggu

SEQ ID NO: 3734121 - RNA, 21 nt, Salmonella enterica enterica serovar Typhi Ty2
augaauuauuuucuaaaaucu

SEQ ID NO: 3734122 - RNA, 14 nt, Salmonella enterica enterica serovar Typhi Ty2
augaauuauuuuuu

SEQ ID NO: 3734123 - RNA, 16 nt, Salmonella enterica enterica serovar Typhi Ty2
augaauuauuuuuuca

SEQ ID NO: 3734124 - RNA, 21 nt, Salmonella enterica enterica serovar Typhi Ty2
augaauuuaucccgugguggg

SEQ ID NO: 3734125 - RNA, 13 nt, Salmonella enterica enterica serovar Typhi Ty2
augacaaaaauua

SEQ ID NO: 3734126 - RNA, 22 nt, Salmonella enterica enterica serovar Typhi Ty2
augacaaagccggauaucgcua

SEQ ID NO: 3734127 - RNA, 13 nt, Salmonella enterica enterica serovar Typhi Ty2
augacaacauaaa

SEQ ID NO: 3734128 - RNA, 23 nt, Salmonella enterica enterica serovar Typhi Ty2
augacaauauugccauaaauaca

SEQ ID NO: 3734129 - RNA, 22 nt, Salmonella enterica enterica serovar Typhi Ty2
augacauagcauaauaaugaau

SEQ ID NO: 3734130 - RNA, 14 nt, Salmonella enterica enterica serovar Typhi Ty2
augacauccagagg

SEQ ID NO: 3734131 - RNA, 16 nt, Salmonella enterica enterica serovar Typhi Ty2
augacaugaaagaaga

SEQ ID NO: 3734132 - RNA, 14 nt, Salmonella enterica enterica serovar Typhi Ty2
augacaugcucaug

SEQ ID NO: 3734133 - RNA, 19 nt, Salmonella enterica enterica serovar Typhi Ty2
augacaugcucaugaaggc

SEQ ID NO: 3734134 - RNA, 20 nt, Salmonella enterica enterica serovar Typhi Ty2
augaccacaccgucaacauc

SEQ ID NO: 3734135 - RNA, 13 nt, Salmonella enterica enterica serovar Typhi Ty2
augaccagaacau

SEQ ID NO: 3734136 - RNA, 13 nt, Salmonella enterica enterica serovar Typhi Ty2
augaccagcgccg

SEQ ID NO: 3734137 - RNA, 17 nt, Salmonella enterica enterica serovar Typhi Ty2
augaccauuaacgccag

SEQ ID NO: 3734138 - RNA, 20 nt, Salmonella enterica enterica serovar Typhi Ty2
augaccgaacuuacgcacaa

SEQ ID NO: 3734139 - RNA, 16 nt, Salmonella enterica enterica serovar Typhi Ty2
augaccgcgacuugga

SEQ ID NO: 3734140 - RNA, 20 nt, Salmonella enterica enterica serovar Typhi Ty2
augaccggaacggacgugcg

SEQ ID NO: 3734141 - RNA, 18 nt, Salmonella enterica enterica serovar Typhi Ty2
augaccguauuacaagua

SEQ ID NO: 3734142 - RNA, 20 nt, Salmonella enterica enterica serovar Typhi Ty2
augaccguuaguaaucggau

SEQ ID NO: 3734143 - RNA, 18 nt, Salmonella enterica enterica serovar Typhi Ty2
augaccugaauauggcca

SEQ ID NO: 3734144 - RNA, 17 nt, Salmonella enterica enterica serovar Typhi Ty2
augacgcagggcaauau

SEQ ID NO: 3734145 - RNA, 21 nt, Salmonella enterica enterica serovar Typhi Ty2
augacgcccugcgccagcaug

SEQ ID NO: 3734146 - RNA, 12 nt, Salmonella enterica enterica serovar Typhi Ty2
augacgccgucu

SEQ ID NO: 3734147 - RNA, 14 nt, Salmonella enterica enterica serovar Typhi Ty2
augacgccugccag

SEQ ID NO: 3734148 - RNA, 15 nt, Salmonella enterica enterica serovar Typhi Ty2
augacgcgcaggccg

SEQ ID NO: 3734149 - RNA, 20 nt, Salmonella enterica enterica serovar Typhi Ty2
augacgcugcgcuuauccgg

SEQ ID NO: 3734150 - RNA, 16 nt, Salmonella enterica enterica serovar Typhi Ty2
augacgcuggaaguau

SEQ ID NO: 3734151 - RNA, 17 nt, Salmonella enterica enterica serovar Typhi Ty2
augacgcuggaaguaug

SEQ ID NO: 3734152 - RNA, 21 nt, Salmonella enterica enterica serovar Typhi Ty2
augacggcaaagcccacgccc

SEQ ID NO: 3734153 - RNA, 15 nt, Salmonella enterica enterica serovar Typhi Ty2
augacggcaggggcg

SEQ ID NO: 3734154 - RNA, 23 nt, Salmonella enterica enterica serovar Typhi Ty2
augacggcagucgcuacaaccag

SEQ ID NO: 3734155 - RNA, 18 nt, Salmonella enterica enterica serovar Typhi Ty2
augacggcgcguuaucgu

SEQ ID NO: 3734156 - RNA, 23 nt, Salmonella enterica enterica serovar Typhi Ty2
augacgggaucgaaccgccgacc

SEQ ID NO: 3734157 - RNA, 18 nt, Salmonella enterica enterica serovar Typhi Ty2
augcacguuaaagccgac

SEQ ID NO: 3734158 - RNA, 18 nt, Salmonella enterica enterica serovar Typhi Ty2
augcacugcaauuucugc

SEQ ID NO: 3734159 - RNA, 14 nt, Salmonella enterica enterica serovar Typhi Ty2
augcacugcugaua

SEQ ID NO: 3734160 - RNA, 14 nt, Salmonella enterica enterica serovar Typhi Ty2
augcagaccucugc

SEQ ID NO: 3734161 - RNA, 21 nt, Salmonella enterica enterica serovar Typhi Ty2
augcagcaggucgaccaccug

SEQ ID NO: 3734162 - RNA, 21 nt, Salmonella enterica enterica serovar Typhi Ty2
augcagcaucaugucacccac

SEQ ID NO: 3734163 - RNA, 13 nt, Salmonella enterica enterica serovar Typhi Ty2
augcagccaggcc

SEQ ID NO: 3734164 - RNA, 21 nt, Salmonella enterica enterica serovar Typhi Ty2
augcagcuugcaggcaaaacg

SEQ ID NO: 3734165 - RNA, 16 nt, Salmonella enterica enterica serovar Typhi Ty2
augcaggcauaaaaaa

SEQ ID NO: 3734166 - RNA, 18 nt, Salmonella enterica enterica serovar Typhi Ty2
augcaggcauaaaaaaga

SEQ ID NO: 3734167 - RNA, 20 nt, Salmonella enterica enterica serovar Typhi Ty2
augcaggccaagcagcgcca

SEQ ID NO: 3734168 - RNA, 20 nt, Salmonella enterica enterica serovar Typhi Ty2
augcagguaguccaaauaag

SEQ ID NO: 3734169 - RNA, 15 nt, Salmonella enterica enterica serovar Typhi Ty2
augcagguucccgcc

SEQ ID NO: 3734170 - RNA, 22 nt, Salmonella enterica enterica serovar Typhi Ty2
augcagguucccgcccugcccg

SEQ ID NO: 3734171 - RNA, 13 nt, Salmonella enterica enterica serovar Typhi Ty2
augcagugcugcu

SEQ ID NO: 3734172 - RNA, 13 nt, Salmonella enterica enterica serovar Typhi Ty2
augcauaaaaaaa

SEQ ID NO: 3734173 - RNA, 14 nt, Salmonella enterica enterica serovar Typhi Ty2
augcauaaaaaaac

SEQ ID NO: 3734174 - RNA, 13 nt, Salmonella enterica enterica serovar Typhi Ty2
augcauaaucgcc

SEQ ID NO: 3734175 - RNA, 14 nt, Salmonella enterica enterica serovar Typhi Ty2
augcauaaugcagc

SEQ ID NO: 3734176 - RNA, 15 nt, Salmonella enterica enterica serovar Typhi Ty2
augcauaugcacagc

SEQ ID NO: 3734177 - RNA, 19 nt, Salmonella enterica enterica serovar Typhi Ty2
augcauaugcacagcgcua

SEQ ID NO: 3734178 - RNA, 16 nt, Salmonella enterica enterica serovar Typhi Ty2
augcaucuugaaugau

SEQ ID NO: 3734179 - RNA, 14 nt, Salmonella enterica enterica serovar Typhi Ty2
augcauggcagaua

SEQ ID NO: 3734180 - RNA, 14 nt, Salmonella enterica enterica serovar Typhi Ty2
augcauuugauuug

SEQ ID NO: 3734181 - RNA, 14 nt, Salmonella enterica enterica serovar Typhi Ty2
augccaaccaccgc

SEQ ID NO: 3734182 - RNA, 14 nt, Salmonella enterica enterica serovar Typhi Ty2
augccaagcggcau

SEQ ID NO: 3734183 - RNA, 20 nt, Salmonella enterica enterica serovar Typhi Ty2
augccaaguaauaaagagaa

SEQ ID NO: 3734184 - RNA, 14 nt, Salmonella enterica enterica serovar Typhi Ty2
augccaccagcgcc

SEQ ID NO: 3734185 - RNA, 14 nt, Salmonella enterica enterica serovar Typhi Ty2
augccacgaucccc

SEQ ID NO: 3734186 - RNA, 21 nt, Salmonella enterica enterica serovar Typhi Ty2
augccacgccccuaaggcagc

SEQ ID NO: 3734187 - RNA, 16 nt, Salmonella enterica enterica serovar Typhi Ty2
augccacggcugaggc

SEQ ID NO: 3734188 - RNA, 16 nt, Salmonella enterica enterica serovar Typhi Ty2
augccacuauagauga

SEQ ID NO: 3734189 - RNA, 16 nt, Salmonella enterica enterica serovar Typhi Ty2
augccagaagcaaauu

SEQ ID NO: 3734190 - RNA, 13 nt, Salmonella enterica enterica serovar Typhi Ty2
augccagauauuu

SEQ ID NO: 3734191 - RNA, 22 nt, Salmonella enterica enterica serovar Typhi Ty2
augccagauuuuccaggccgcc

SEQ ID NO: 3734192 - RNA, 21 nt, Salmonella enterica enterica serovar Typhi Ty2
augccauaguagaagugaagc

SEQ ID NO: 3734193 - RNA, 19 nt, Salmonella enterica enterica serovar Typhi Ty2
augccaucggccagcaggc

SEQ ID NO: 3734194 - RNA, 20 nt, Salmonella enterica enterica serovar Typhi Ty2
augccaucucuuaauguaaa

SEQ ID NO: 3734195 - RNA, 18 nt, Salmonella enterica enterica serovar Typhi Ty2
augccauguuucuuuuaa

SEQ ID NO: 3734196 - RNA, 14 nt, Salmonella enterica enterica serovar Typhi Ty2
augccauuauugca

SEQ ID NO: 3734197 - RNA, 20 nt, Salmonella enterica enterica serovar Typhi Ty2
augcccacaggcagggcgau

SEQ ID NO: 3734198 - RNA, 20 nt, Salmonella enterica enterica serovar Typhi Ty2
augcccaggcggcgggaaug

SEQ ID NO: 3734199 - RNA, 22 nt, Salmonella enterica enterica serovar Typhi Ty2
augcccgccagcgggccgguaa

SEQ ID NO: 3734200 - RNA, 17 nt, Salmonella enterica enterica serovar Typhi Ty2
augcccggaugauuauc

SEQ ID NO: 3734201 - RNA, 23 nt, Salmonella enterica enterica serovar Typhi Ty2
augcccggaugauuaucaucuau

SEQ ID NO: 3734202 - RNA, 15 nt, Salmonella enterica enterica serovar Typhi Ty2
augcccggauggcgu

SEQ ID NO: 3734203 - RNA, 19 nt, Salmonella enterica enterica serovar Typhi Ty2
augcccucuuccagcgcca

SEQ ID NO: 3734204 - RNA, 12 nt, Salmonella enterica enterica serovar Typhi Ty2
augccgaccaau

SEQ ID NO: 3734205 - RNA, 15 nt, Salmonella enterica enterica serovar Typhi Ty2
augccgaccagcguc

SEQ ID NO: 3734206 - RNA, 23 nt, Salmonella enterica enterica serovar Typhi Ty2
augccgauaauaaacgcgccaag

SEQ ID NO: 3734207 - RNA, 19 nt, Salmonella enterica enterica serovar Typhi Ty2
augccgaucaccagcgcau

SEQ ID NO: 3734208 - RNA, 10 nt, Salmonella enterica enterica serovar Typhi Ty2
augccgccgc

SEQ ID NO: 3734209 - RNA, 22 nt, Salmonella enterica enterica serovar Typhi Ty2
augccgccugccgcgccgccgc

SEQ ID NO: 3734210 - RNA, 21 nt, Salmonella enterica enterica serovar Typhi Ty2
augccgcgucaggagcgggua

SEQ ID NO: 3734211 - RNA, 13 nt, Salmonella enterica enterica serovar Typhi Ty2
augccgcugcugg

SEQ ID NO: 3734212 - RNA, 17 nt, Salmonella enterica enterica serovar Typhi Ty2
augccgggugcggcgcu

SEQ ID NO: 3734213 - RNA, 17 nt, Salmonella enterica enterica serovar Typhi Ty2
augccguagccaaguau

SEQ ID NO: 3734214 - RNA, 20 nt, Salmonella enterica enterica serovar Typhi Ty2
augccgugaggcugaagcgc

SEQ ID NO: 3734215 - RNA, 18 nt, Salmonella enterica enterica serovar Typhi Ty2
augccguuuuaacgucau

SEQ ID NO: 3734216 - RNA, 15 nt, Salmonella enterica enterica serovar Typhi Ty2
augccuaacccuuuu

SEQ ID NO: 3734217 - RNA, 14 nt, Salmonella enterica enterica serovar Typhi Ty2
augccucaccccau

SEQ ID NO: 3734218 - RNA, 22 nt, Salmonella enterica enterica serovar Typhi Ty2
augccucguuucccucauauuu

SEQ ID NO: 3734219 - RNA, 17 nt, Salmonella enterica enterica serovar Typhi Ty2
augccucuuacagggcg

SEQ ID NO: 3734220 - RNA, 15 nt, Salmonella enterica enterica serovar Typhi Ty2
augccucuuccggua

SEQ ID NO: 3734221 - RNA, 21 nt, Salmonella enterica enterica serovar Typhi Ty2
augccugcgcauccucuuucc

SEQ ID NO: 3734222 - RNA, 22 nt, Salmonella enterica enterica serovar Typhi Ty2
augccugcgccauguucauaaa

SEQ ID NO: 3734223 - RNA, 11 nt, Salmonella enterica enterica serovar Typhi Ty2
augccuggcag

SEQ ID NO: 3734224 - RNA, 17 nt, Salmonella enterica enterica serovar Typhi Ty2
augccuggggucgucag

SEQ ID NO: 3734225 - RNA, 14 nt, Salmonella enterica enterica serovar Typhi Ty2
augccugucaucau

SEQ ID NO: 3734226 - RNA, 21 nt, Salmonella enterica enterica serovar Typhi Ty2
augccuguguaucgcccugcc

SEQ ID NO: 3734227 - RNA, 21 nt, Salmonella enterica enterica serovar Typhi Ty2
augccuucauaaugaauacgc

SEQ ID NO: 3734228 - RNA, 17 nt, Salmonella enterica enterica serovar Typhi Ty2
augccuuccuguggaag

SEQ ID NO: 3734229 - RNA, 14 nt, Salmonella enterica enterica serovar Typhi Ty2
augcgaaaaguaaa

SEQ ID NO: 3734230 - RNA, 15 nt, Salmonella enterica enterica serovar Typhi Ty2
augcgaaaaguaaag

SEQ ID NO: 3734231 - RNA, 16 nt, Salmonella enterica enterica serovar Typhi Ty2
augcgacgcccaacca

SEQ ID NO: 3734232 - RNA, 15 nt, Salmonella enterica enterica serovar Typhi Ty2
augcgacugaaaauc

SEQ ID NO: 3734233 - RNA, 21 nt, Salmonella enterica enterica serovar Typhi Ty2
augcgauacguaggccugaua

SEQ ID NO: 3734234 - RNA, 19 nt, Salmonella enterica enterica serovar Typhi Ty2
augcgaucgggcaauccau

SEQ ID NO: 3734235 - RNA, 18 nt, Salmonella enterica enterica serovar Typhi Ty2
augcgaugccgcacgccu

SEQ ID NO: 3734236 - RNA, 19 nt, Salmonella enterica enterica serovar Typhi Ty2
augcgcaaaauucacacca

SEQ ID NO: 3734237 - RNA, 16 nt, Salmonella enterica enterica serovar Typhi Ty2
augcgcaugggcauaa

SEQ ID NO: 3734238 - RNA, 16 nt, Salmonella enterica enterica serovar Typhi Ty2
augcgcaugugagcau

SEQ ID NO: 3734239 - RNA, 20 nt, Salmonella enterica enterica serovar Typhi Ty2
augcuuuccagccaugccag

SEQ ID NO: 3734240 - RNA, 22 nt, Salmonella enterica enterica serovar Typhi Ty2
augcuuuccagccaugccagca

SEQ ID NO: 3734241 - RNA, 15 nt, Salmonella enterica enterica serovar Typhi Ty2
auggaaaauaauaau

SEQ ID NO: 3734242 - RNA, 21 nt, Salmonella enterica enterica serovar Typhi Ty2
auggaacucugcgacgccagg

SEQ ID NO: 3734243 - RNA, 22 nt, Salmonella enterica enterica serovar Typhi Ty2
auggaacucugcgacgccaggc

SEQ ID NO: 3734244 - RNA, 18 nt, Salmonella enterica enterica serovar Typhi Ty2
auggacaccggaagugaa

SEQ ID NO: 3734245 - RNA, 16 nt, Salmonella enterica enterica serovar Typhi Ty2
auggacagauuuccac

SEQ ID NO: 3734246 - RNA, 23 nt, Salmonella enterica enterica serovar Typhi Ty2
auggacgggauacggcgagacca

SEQ ID NO: 3734247 - RNA, 13 nt, Salmonella enterica enterica serovar Typhi Ty2
auggacuuccgca

SEQ ID NO: 3734248 - RNA, 14 nt, Salmonella enterica enterica serovar Typhi Ty2
auggaggcagugaa

SEQ ID NO: 3734249 - RNA, 18 nt, Salmonella enterica enterica serovar Typhi Ty2
auggauaacgaaaagggu

SEQ ID NO: 3734250 - RNA, 16 nt, Salmonella enterica enterica serovar Typhi Ty2
auggauagucaugaaa

SEQ ID NO: 3734251 - RNA, 23 nt, Salmonella enterica enterica serovar Typhi Ty2
auggaugagucuugcgcguccgc

SEQ ID NO: 3734252 - RNA, 21 nt, Salmonella enterica enterica serovar Typhi Ty2
auggcaaagucgaacgacuga

SEQ ID NO: 3734253 - RNA, 14 nt, Salmonella enterica enterica serovar Typhi Ty2
auggcaauugcgcc

SEQ ID NO: 3734254 - RNA, 11 nt, Salmonella enterica enterica serovar Typhi Ty2
auggcacugcg

SEQ ID NO: 3734255 - RNA, 18 nt, Salmonella enterica enterica serovar Typhi Ty2
auggcaggcauagacauc

SEQ ID NO: 3734256 - RNA, 20 nt, Salmonella enterica enterica serovar Typhi Ty2
auggcaggcauagacaucca

SEQ ID NO: 3734257 - RNA, 19 nt, Salmonella enterica enterica serovar Typhi Ty2
auggcaguauaaauaccuu

SEQ ID NO: 3734258 - RNA, 14 nt, Salmonella enterica enterica serovar Typhi Ty2
auggcauaacgcug

SEQ ID NO: 3734259 - RNA, 22 nt, Salmonella enterica enterica serovar Typhi Ty2
auggcauaacgcuguagcguuu

SEQ ID NO: 3734260 - RNA, 16 nt, Salmonella enterica enterica serovar Typhi Ty2
auggccagcaccagca

SEQ ID NO: 3734261 - RNA, 18 nt, Salmonella enterica enterica serovar Typhi Ty2
auggccagcaccagcauu

SEQ ID NO: 3734262 - RNA, 20 nt, Salmonella enterica enterica serovar Typhi Ty2
auggccagcaccagcauuag

SEQ ID NO: 3734263 - RNA, 15 nt, Salmonella enterica enterica serovar Typhi Ty2
auggcccaauguuuu

SEQ ID NO: 3734264 - RNA, 19 nt, Salmonella enterica enterica serovar Typhi Ty2
auggcccaguguacugcca

SEQ ID NO: 3734265 - RNA, 22 nt, Salmonella enterica enterica serovar Typhi Ty2
auggccggucuuaugcugccag

SEQ ID NO: 3734266 - RNA, 21 nt, Salmonella enterica enterica serovar Typhi Ty2
auggccuggcggaugaugcgu

SEQ ID NO: 3734267 - RNA, 19 nt, Salmonella enterica enterica serovar Typhi Ty2
auggcgaaagugaacguca

SEQ ID NO: 3734268 - RNA, 21 nt, Salmonella enterica enterica serovar Typhi Ty2
auggcgaauccguugaucguc

SEQ ID NO: 3734269 - RNA, 18 nt, Salmonella enterica enterica serovar Typhi Ty2
auggcgacgaucagcgcc

SEQ ID NO: 3734270 - RNA, 17 nt, Salmonella enterica enterica serovar Typhi Ty2
auggcgacgcguagcgu

SEQ ID NO: 3734271 - RNA, 22 nt, Salmonella enterica enterica serovar Typhi Ty2
auggcgaucagcgccaccacaa

SEQ ID NO: 3734272 - RNA, 18 nt, Salmonella enterica enterica serovar Typhi Ty2
auggcgcagcauacgcug

SEQ ID NO: 3734273 - RNA, 22 nt, Salmonella enterica enterica serovar Typhi Ty2
auggcgccagccauagcagcaa

SEQ ID NO: 3734274 - RNA, 19 nt, Salmonella enterica enterica serovar Typhi Ty2
auggcgcgaaaacagcugg

SEQ ID NO: 3734275 - RNA, 18 nt, Salmonella enterica enterica serovar Typhi Ty2
auggcgcgccacuucuuu

SEQ ID NO: 3734276 - RNA, 17 nt, Salmonella enterica enterica serovar Typhi Ty2
auggcgcuaagccagcc

SEQ ID NO: 3734277 - RNA, 22 nt, Salmonella enterica enterica serovar Typhi Ty2
auggcgcugucggcgcccagcu

SEQ ID NO: 3734278 - RNA, 16 nt, Salmonella enterica enterica serovar Typhi Ty2
auggcgcuuaauacgc

SEQ ID NO: 3734279 - RNA, 24 nt, Salmonella enterica enterica serovar Typhi Ty2
auggcggcgaaaugccuuauccgg

SEQ ID NO: 3734280 - RNA, 13 nt, Salmonella enterica enterica serovar Typhi Ty2
auggcggcgcaaa

SEQ ID NO: 3734281 - RNA, 20 nt, Salmonella enterica enterica serovar Typhi Ty2
auggcggcggacaugguaau

SEQ ID NO: 3734282 - RNA, 21 nt, Salmonella enterica enterica serovar Typhi Ty2
auggcggcgucgccuguccgg

SEQ ID NO: 3734283 - RNA, 19 nt, Salmonella enterica enterica serovar Typhi Ty2
auggcggcuaacgccugau

SEQ ID NO: 3734284 - RNA, 18 nt, Salmonella enterica enterica serovar Typhi Ty2
auggcgggccugugccug

SEQ ID NO: 3734285 - RNA, 22 nt, Salmonella enterica enterica serovar Typhi Ty2
auggcgggcgcagguuuuacuu

SEQ ID NO: 3734286 - RNA, 15 nt, Salmonella enterica enterica serovar Typhi Ty2
auggcgguauaacug

SEQ ID NO: 3734287 - RNA, 20 nt, Salmonella enterica enterica serovar Typhi Ty2
auggcgguauaacugccuua

SEQ ID NO: 3734288 - RNA, 20 nt, Salmonella enterica enterica serovar Typhi Ty2
auggcggucgccauauguuc

SEQ ID NO: 3734289 - RNA, 20 nt, Salmonella enterica enterica serovar Typhi Ty2
auggcggugcuuaaccggga

SEQ ID NO: 3734290 - RNA, 21 nt, Salmonella enterica enterica serovar Typhi Ty2
auggcggugcuuaaccgggau

SEQ ID NO: 3734291 - RNA, 20 nt, Salmonella enterica enterica serovar Typhi Ty2
auggcguggcgcuuuccggc

SEQ ID NO: 3734292 - RNA, 17 nt, Salmonella enterica enterica serovar Typhi Ty2
auggcugagaaucaccu

SEQ ID NO: 3734293 - RNA, 18 nt, Salmonella enterica enterica serovar Typhi Ty2
auggcugauggcgaaaau

SEQ ID NO: 3734294 - RNA, 22 nt, Salmonella enterica enterica serovar Typhi Ty2
auggcugcacccggagagaaac

SEQ ID NO: 3734295 - RNA, 12 nt, Salmonella enterica enterica serovar Typhi Ty2
auggcuggauga

SEQ ID NO: 3734296 - RNA, 18 nt, Salmonella enterica enterica serovar Typhi Ty2
auggcuuucagauuagcc

SEQ ID NO: 3734297 - RNA, 15 nt, Salmonella enterica enterica serovar Typhi Ty2
augggaaaucacagc

SEQ ID NO: 3734298 - RNA, 17 nt, Salmonella enterica enterica serovar Typhi Ty2
augggaggauacuguuu

SEQ ID NO: 3734299 - RNA, 16 nt, Salmonella enterica enterica serovar Typhi Ty2
augggauaacgcagaa

SEQ ID NO: 3734300 - RNA, 18 nt, Salmonella enterica enterica serovar Typhi Ty2
augggauacgccagcaga

SEQ ID NO: 3734301 - RNA, 20 nt, Salmonella enterica enterica serovar Typhi Ty2
augggauagugccugccguc

SEQ ID NO: 3734302 - RNA, 22 nt, Salmonella enterica enterica serovar Typhi Ty2
augggcaggagaugaccugccc

SEQ ID NO: 3734303 - RNA, 17 nt, Salmonella enterica enterica serovar Typhi Ty2
augggccauuuacgcca

SEQ ID NO: 3734304 - RNA, 18 nt, Salmonella enterica enterica serovar Typhi Ty2
augggccuacgccuggau

SEQ ID NO: 3734305 - RNA, 17 nt, Salmonella enterica enterica serovar Typhi Ty2
augggcgcacagcgcca

SEQ ID NO: 3734306 - RNA, 16 nt, Salmonella enterica enterica serovar Typhi Ty2
augggcgggauccugc

SEQ ID NO: 3734307 - RNA, 22 nt, Salmonella enterica enterica serovar Typhi Ty2
augggcgugcugacggagcugg

SEQ ID NO: 3734308 - RNA, 22 nt, Salmonella enterica enterica serovar Typhi Ty2
auggggaaauaaauauguuauu

SEQ ID NO: 3734309 - RNA, 17 nt, Salmonella enterica enterica serovar Typhi Ty2
auggggauuaucaggau

SEQ ID NO: 3734310 - RNA, 19 nt, Salmonella enterica enterica serovar Typhi Ty2
auggggauuaucaggauga

SEQ ID NO: 3734311 - RNA, 21 nt, Salmonella enterica enterica serovar Typhi Ty2
augggguaucgccaagcggua

SEQ ID NO: 3734312 - RNA, 20 nt, Salmonella enterica enterica serovar Typhi Ty2
auggguacaccacuaaacgc

SEQ ID NO: 3734313 - RNA, 20 nt, Salmonella enterica enterica serovar Typhi Ty2
auggguaggccggauaagcg

SEQ ID NO: 3734314 - RNA, 17 nt, Salmonella enterica enterica serovar Typhi Ty2
auggguuccaguugcac

SEQ ID NO: 3734315 - RNA, 20 nt, Salmonella enterica enterica serovar Typhi Ty2
augguaaaauccuuuuucau

SEQ ID NO: 3734316 - RNA, 24 nt, Salmonella enterica enterica serovar Typhi Ty2
augguaacugcggcuauauaaaau

SEQ ID NO: 3734317 - RNA, 20 nt, Salmonella enterica enterica serovar Typhi Ty2
augguacacauaugggaaga

SEQ ID NO: 3734318 - RNA, 16 nt, Salmonella enterica enterica serovar Typhi Ty2
augguacucaacauca

SEQ ID NO: 3734319 - RNA, 21 nt, Salmonella enterica enterica serovar Typhi Ty2
auggucgcauggcuaaaagaa

SEQ ID NO: 3734320 - RNA, 19 nt, Salmonella enterica enterica serovar Typhi Ty2
augugaugccgucaguuau

SEQ ID NO: 3734321 - RNA, 21 nt, Salmonella enterica enterica serovar Typhi Ty2
augugcaaucacacuacacga

SEQ ID NO: 3734322 - RNA, 18 nt, Salmonella enterica enterica serovar Typhi Ty2
augugcagcauccagcuc

SEQ ID NO: 3734323 - RNA, 17 nt, Salmonella enterica enterica serovar Typhi Ty2
augugcaucggcacagc

SEQ ID NO: 3734324 - RNA, 19 nt, Salmonella enterica enterica serovar Typhi Ty2
augugcgccagaauugccu

SEQ ID NO: 3734325 - RNA, 13 nt, Salmonella enterica enterica serovar Typhi Ty2
augugcgccagcc

SEQ ID NO: 3734326 - RNA, 14 nt, Salmonella enterica enterica serovar Typhi Ty2
augugcgccagccu

SEQ ID NO: 3734327 - RNA, 19 nt, Salmonella enterica enterica serovar Typhi Ty2
augugcuauuuucucuugc

SEQ ID NO: 3734328 - RNA, 22 nt, Salmonella enterica enterica serovar Typhi Ty2
auguggacgccauaaaccagaa

SEQ ID NO: 3734329 - RNA, 17 nt, Salmonella enterica enterica serovar Typhi Ty2
auguggcggcccguggu

SEQ ID NO: 3734330 - RNA, 20 nt, Salmonella enterica enterica serovar Typhi Ty2
augugguaaccgaacugggu

SEQ ID NO: 3734331 - RNA, 19 nt, Salmonella enterica enterica serovar Typhi Ty2
augugguugugguaaucaa

SEQ ID NO: 3734332 - RNA, 21 nt, Salmonella enterica enterica serovar Typhi Ty2
auguguaauguuuucugccag

SEQ ID NO: 3734333 - RNA, 22 nt, Salmonella enterica enterica serovar Typhi Ty2
augugucuauuuauugaagaug

SEQ ID NO: 3734334 - RNA, 17 nt, Salmonella enterica enterica serovar Typhi Ty2
auguguuucagcagccc

SEQ ID NO: 3734335 - RNA, 13 nt, Salmonella enterica enterica serovar Typhi Ty2
auguuaacgccga

SEQ ID NO: 3734336 - RNA, 17 nt, Salmonella enterica enterica serovar Typhi Ty2
auguuaacuacuuuaca

SEQ ID NO: 3734337 - RNA, 18 nt, Salmonella enterica enterica serovar Typhi Ty2
auguuaauaccagcgcca

SEQ ID NO: 3734338 - RNA, 16 nt, Salmonella enterica enterica serovar Typhi Ty2
auguuagaaucuauua

SEQ ID NO: 3734339 - RNA, 17 nt, Salmonella enterica enterica serovar Typhi Ty2
auguuagcuucacuucg

SEQ ID NO: 3734340 - RNA, 16 nt, Salmonella enterica enterica serovar Typhi Ty2
auguuaggguagaaaa

SEQ ID NO: 3734341 - RNA, 17 nt, Salmonella enterica enterica serovar Typhi Ty2
auguuaggguagaaaaa

SEQ ID NO: 3734342 - RNA, 17 nt, Salmonella enterica enterica serovar Typhi Ty2
auguucaauaucaaauu

SEQ ID NO: 3734343 - RNA, 19 nt, Salmonella enterica enterica serovar Typhi Ty2
auguucaugaaccacgcca

SEQ ID NO: 3734344 - RNA, 13 nt, Salmonella enterica enterica serovar Typhi Ty2
auguuccacaauc

SEQ ID NO: 3734345 - RNA, 19 nt, Salmonella enterica enterica serovar Typhi Ty2
auguuccgcuaccugcgag

SEQ ID NO: 3734346 - RNA, 23 nt, Salmonella enterica enterica serovar Typhi Ty2
auguuccuggacguggguuucaa

SEQ ID NO: 3734347 - RNA, 18 nt, Salmonella enterica enterica serovar Typhi Ty2
auguuccuggauagauuu

SEQ ID NO: 3734348 - RNA, 14 nt, Salmonella enterica enterica serovar Typhi Ty2
auguucuaacagau

SEQ ID NO: 3734349 - RNA, 14 nt, Salmonella enterica enterica serovar Typhi Ty2
auguugaaccguca

SEQ ID NO: 3734350 - RNA, 16 nt, Salmonella enterica enterica serovar Typhi Ty2
auguugaugucacuca

SEQ ID NO: 3734351 - RNA, 16 nt, Salmonella enterica enterica serovar Typhi Ty2
auguugccaugaucca

SEQ ID NO: 3734352 - RNA, 17 nt, Salmonella enterica enterica serovar Typhi Ty2
auguugccggauagcuc

SEQ ID NO: 3734353 - RNA, 13 nt, Salmonella enterica enterica serovar Typhi Ty2
auguugcugcauc

SEQ ID NO: 3734354 - RNA, 14 nt, Salmonella enterica enterica serovar Typhi Ty2
auguugcugcugcg

SEQ ID NO: 3734355 - RNA, 13 nt, Salmonella enterica enterica serovar Typhi Ty2
auguugguuauag

SEQ ID NO: 3734356 - RNA, 14 nt, Salmonella enterica enterica serovar Typhi Ty2
auguuuaccaucgc

SEQ ID NO: 3734357 - RNA, 15 nt, Salmonella enterica enterica serovar Typhi Ty2
auguuuccguuugua

SEQ ID NO: 3734358 - RNA, 18 nt, Salmonella enterica enterica serovar Typhi Ty2
auguuucgacaguuucuu

SEQ ID NO: 3734359 - RNA, 20 nt, Salmonella enterica enterica serovar Typhi Ty2
auguuucgacaguuucuucu

SEQ ID NO: 3734360 - RNA, 16 nt, Salmonella enterica enterica serovar Typhi Ty2
auguuugccacgccaa

SEQ ID NO: 3734361 - RNA, 15 nt, Salmonella enterica enterica serovar Typhi Ty2
auguuugcugauaag

SEQ ID NO: 3734362 - RNA, 20 nt, Salmonella enterica enterica serovar Typhi Ty2
auguuuguaggcuuccagaa

SEQ ID NO: 3734363 - RNA, 16 nt, Salmonella enterica enterica serovar Typhi Ty2
auguuuugucguucac

SEQ ID NO: 3734364 - RNA, 18 nt, Salmonella enterica enterica serovar Typhi Ty2
auguuuuuaucagcuugc

SEQ ID NO: 3734365 - RNA, 19 nt, Salmonella enterica enterica serovar Typhi Ty2
auguuuuuaucagcuugcc

SEQ ID NO: 3734366 - RNA, 15 nt, Salmonella enterica enterica serovar Typhi Ty2
auguuuuuucaucuc

SEQ ID NO: 3734367 - RNA, 15 nt, Salmonella enterica enterica serovar Typhi Ty2
auuaaaaaggccgac

SEQ ID NO: 3734368 - RNA, 12 nt, Salmonella enterica enterica serovar Typhi Ty2
auuaaaaauacc

SEQ ID NO: 3734369 - RNA, 21 nt, Salmonella enterica enterica serovar Typhi Ty2
auuaaaaauaccccaggggca

SEQ ID NO: 3734370 - RNA, 19 nt, Salmonella enterica enterica serovar Typhi Ty2
auuaaaacgagucagcguu

SEQ ID NO: 3734371 - RNA, 17 nt, Salmonella enterica enterica serovar Typhi Ty2
auuaaaauaaaugaggc

SEQ ID NO: 3734372 - RNA, 22 nt, Salmonella enterica enterica serovar Typhi Ty2
auuaaacagacaauaccagggc

SEQ ID NO: 3734373 - RNA, 17 nt, Salmonella enterica enterica serovar Typhi Ty2
auuaaagauuagcguuu

SEQ ID NO: 3734374 - RNA, 20 nt, Salmonella enterica enterica serovar Typhi Ty2
auuaaagauuagcguuuuua

SEQ ID NO: 3734375 - RNA, 21 nt, Salmonella enterica enterica serovar Typhi Ty2
auuaaagauuagcguuuuuau

SEQ ID NO: 3734376 - RNA, 11 nt, Salmonella enterica enterica serovar Typhi Ty2
auuaaagccac

SEQ ID NO: 3734377 - RNA, 22 nt, Salmonella enterica enterica serovar Typhi Ty2
auuaaauaaauaguaaauagaa

SEQ ID NO: 3734378 - RNA, 17 nt, Salmonella enterica enterica serovar Typhi Ty2
auuaaauaacggauaac

SEQ ID NO: 3734379 - RNA, 21 nt, Salmonella enterica enterica serovar Typhi Ty2
auuaaaucagauaacaaugac

SEQ ID NO: 3734380 - RNA, 20 nt, Salmonella enterica enterica serovar Typhi Ty2
auuaaauccugaaacccaua

SEQ ID NO: 3734381 - RNA, 16 nt, Salmonella enterica enterica serovar Typhi Ty2
auuaaaugcuugcuuu

SEQ ID NO: 3734382 - RNA, 12 nt, Salmonella enterica enterica serovar Typhi Ty2
auuaacaaauaa

SEQ ID NO: 3734383 - RNA, 13 nt, Salmonella enterica enterica serovar Typhi Ty2
auuaacaaauaaa

SEQ ID NO: 3734384 - RNA, 13 nt, Salmonella enterica enterica serovar Typhi Ty2
auuaacaaaucau

SEQ ID NO: 3734385 - RNA, 15 nt, Salmonella enterica enterica serovar Typhi Ty2
auuaacaagcagaua

SEQ ID NO: 3734386 - RNA, 12 nt, Salmonella enterica enterica serovar Typhi Ty2
auuaacagcgcc

SEQ ID NO: 3734387 - RNA, 23 nt, Salmonella enterica enterica serovar Typhi Ty2
auuaacagcgcgaccaggaaacc

SEQ ID NO: 3734388 - RNA, 16 nt, Salmonella enterica enterica serovar Typhi Ty2
auuaacagucuaucgc

SEQ ID NO: 3734389 - RNA, 17 nt, Salmonella enterica enterica serovar Typhi Ty2
auuaacagucuaucgcu

SEQ ID NO: 3734390 - RNA, 20 nt, Salmonella enterica enterica serovar Typhi Ty2
auuaacauuuaagaaacaau

SEQ ID NO: 3734391 - RNA, 21 nt, Salmonella enterica enterica serovar Typhi Ty2
auuaacgccgcgaggaucugc

SEQ ID NO: 3734392 - RNA, 12 nt, Salmonella enterica enterica serovar Typhi Ty2
auuaacgcgaaa

SEQ ID NO: 3734393 - RNA, 15 nt, Salmonella enterica enterica serovar Typhi Ty2
auuaacgcgaaaaua

SEQ ID NO: 3734394 - RNA, 16 nt, Salmonella enterica enterica serovar Typhi Ty2
auuaacgcgaaaauac

SEQ ID NO: 3734395 - RNA, 23 nt, Salmonella enterica enterica serovar Typhi Ty2
auuaacgcggugacuuuggccgg

SEQ ID NO: 3734396 - RNA, 12 nt, Salmonella enterica enterica serovar Typhi Ty2
auuaacucauca

SEQ ID NO: 3734397 - RNA, 23 nt, Salmonella enterica enterica serovar Typhi Ty2
auuaacuugacuuugcucuccuu

SEQ ID NO: 3734398 - RNA, 21 nt, Salmonella enterica enterica serovar Typhi Ty2
auuaagaccauacuuugcauu

SEQ ID NO: 3734399 - RNA, 18 nt, Salmonella enterica enterica serovar Typhi Ty2
auuaagcgaauccagcgc

SEQ ID NO: 3734400 - RNA, 22 nt, Salmonella enterica enterica serovar Typhi Ty2
auuaagcggauuuuuucgcuuu

SEQ ID NO: 3734401 - RNA, 16 nt, Salmonella enterica enterica serovar Typhi Ty2
auuaaguuuuuuuaaa

SEQ ID NO: 3734402 - RNA, 13 nt, Salmonella enterica enterica serovar Typhi Ty2
auuaucgccauca

SEQ ID NO: 3734403 - RNA, 14 nt, Salmonella enterica enterica serovar Typhi Ty2
auuaucgcuccgga

SEQ ID NO: 3734404 - RNA, 17 nt, Salmonella enterica enterica serovar Typhi Ty2
auuaucguuuacguuau

SEQ ID NO: 3734405 - RNA, 18 nt, Salmonella enterica enterica serovar Typhi Ty2
auuaucugauucaauuaa

SEQ ID NO: 3734406 - RNA, 23 nt, Salmonella enterica enterica serovar Typhi Ty2
auuaucugccagccgauuuuucg

SEQ ID NO: 3734407 - RNA, 13 nt, Salmonella enterica enterica serovar Typhi Ty2
auuaugccgacca

SEQ ID NO: 3734408 - RNA, 19 nt, Salmonella enterica enterica serovar Typhi Ty2
auuaugccgcacuccccag

SEQ ID NO: 3734409 - RNA, 20 nt, Salmonella enterica enterica serovar Typhi Ty2
auuaugccgcacuccccaga

SEQ ID NO: 3734410 - RNA, 16 nt, Salmonella enterica enterica serovar Typhi Ty2
auuaugccugucauca

SEQ ID NO: 3734411 - RNA, 18 nt, Salmonella enterica enterica serovar Typhi Ty2
auuaugcgaaugcuggcu

SEQ ID NO: 3734412 - RNA, 16 nt, Salmonella enterica enterica serovar Typhi Ty2
auuaugcuggccugca

SEQ ID NO: 3734413 - RNA, 16 nt, Salmonella enterica enterica serovar Typhi Ty2
auuauuaaaucaauac

SEQ ID NO: 3734414 - RNA, 13 nt, Salmonella enterica enterica serovar Typhi Ty2
auuauuacaauaa

SEQ ID NO: 3734415 - RNA, 22 nt, Salmonella enterica enterica serovar Typhi Ty2
auuauucaccuggauuccucca

SEQ ID NO: 3734416 - RNA, 16 nt, Salmonella enterica enterica serovar Typhi Ty2
auuauucaggccuccu

SEQ ID NO: 3734417 - RNA, 12 nt, Salmonella enterica enterica serovar Typhi Ty2
auuauuccccuc

SEQ ID NO: 3734418 - RNA, 21 nt, Salmonella enterica enterica serovar Typhi Ty2
auuauuccuugaucaggaaau

SEQ ID NO: 3734419 - RNA, 20 nt, Salmonella enterica enterica serovar Typhi Ty2
auuauucggcgacuggaaca

SEQ ID NO: 3734420 - RNA, 14 nt, Salmonella enterica enterica serovar Typhi Ty2
auuauucugaauuc

SEQ ID NO: 3734421 - RNA, 14 nt, Salmonella enterica enterica serovar Typhi Ty2
auuauugcacauaa

SEQ ID NO: 3734422 - RNA, 15 nt, Salmonella enterica enterica serovar Typhi Ty2
auuauugcguugcuu

SEQ ID NO: 3734423 - RNA, 22 nt, Salmonella enterica enterica serovar Typhi Ty2
auuauugcguugcuuuauaaaa

SEQ ID NO: 3734424 - RNA, 21 nt, Salmonella enterica enterica serovar Typhi Ty2
auuauuggcuuuguaaauauu

SEQ ID NO: 3734425 - RNA, 22 nt, Salmonella enterica enterica serovar Typhi Ty2
auuauugucuuuguugccuucg

SEQ ID NO: 3734426 - RNA, 14 nt, Salmonella enterica enterica serovar Typhi Ty2
auuauuuucacgcu

SEQ ID NO: 3734427 - RNA, 17 nt, Salmonella enterica enterica serovar Typhi Ty2
auuauuuucuaaaaucu

SEQ ID NO: 3734428 - RNA, 14 nt, Salmonella enterica enterica serovar Typhi Ty2
auuauuuuuaaaua

SEQ ID NO: 3734429 - RNA, 22 nt, Salmonella enterica enterica serovar Typhi Ty2
auuauuuuuaaauaacuuuuaa

SEQ ID NO: 3734430 - RNA, 17 nt, Salmonella enterica enterica serovar Typhi Ty2
auuauuuuucaaaugau

SEQ ID NO: 3734431 - RNA, 15 nt, Salmonella enterica enterica serovar Typhi Ty2
auucaaaauccgcca

SEQ ID NO: 3734432 - RNA, 20 nt, Salmonella enterica enterica serovar Typhi Ty2
auucaaauguuguuugaaaa

SEQ ID NO: 3734433 - RNA, 22 nt, Salmonella enterica enterica serovar Typhi Ty2
auucaacagggguuccggcaau

SEQ ID NO: 3734434 - RNA, 18 nt, Salmonella enterica enterica serovar Typhi Ty2
auucaaccaaugcaacgc

SEQ ID NO: 3734435 - RNA, 23 nt, Salmonella enterica enterica serovar Typhi Ty2
auucaaccagccgaucagcgcca

SEQ ID NO: 3734436 - RNA, 17 nt, Salmonella enterica enterica serovar Typhi Ty2
auucaaccaguuaauuu

SEQ ID NO: 3734437 - RNA, 15 nt, Salmonella enterica enterica serovar Typhi Ty2
auucaacgcaucaaa

SEQ ID NO: 3734438 - RNA, 11 nt, Salmonella enterica enterica serovar Typhi Ty2
auucaaucacu

SEQ ID NO: 3734439 - RNA, 21 nt, Salmonella enterica enterica serovar Typhi Ty2
auucaauuagcgccuccccua

SEQ ID NO: 3734440 - RNA, 18 nt, Salmonella enterica enterica serovar Typhi Ty2
auucaauucuggaaucaa

SEQ ID NO: 3734441 - RNA, 21 nt, Salmonella enterica enterica serovar Typhi Ty2
auucacaccaaugucauauuu

SEQ ID NO: 3734442 - RNA, 15 nt, Salmonella enterica enterica serovar Typhi Ty2
auucacaccuuuaua

SEQ ID NO: 3734443 - RNA, 18 nt, Salmonella enterica enterica serovar Typhi Ty2
auucacauauauuucugu

SEQ ID NO: 3734444 - RNA, 21 nt, Salmonella enterica enterica serovar Typhi Ty2
auucacauuauucacgcuaug

SEQ ID NO: 3734445 - RNA, 19 nt, Salmonella enterica enterica serovar Typhi Ty2
auucaccgcaugacaauau

SEQ ID NO: 3734446 - RNA, 21 nt, Salmonella enterica enterica serovar Typhi Ty2
auucaccucccugcaacagca

SEQ ID NO: 3734447 - RNA, 16 nt, Salmonella enterica enterica serovar Typhi Ty2
auucacgcagcuuauu

SEQ ID NO: 3734448 - RNA, 19 nt, Salmonella enterica enterica serovar Typhi Ty2
auucacgccaccauccgac

SEQ ID NO: 3734449 - RNA, 17 nt, Salmonella enterica enterica serovar Typhi Ty2
auucacgcgauuguuau

SEQ ID NO: 3734450 - RNA, 15 nt, Salmonella enterica enterica serovar Typhi Ty2
auucacguuccauuu

SEQ ID NO: 3734451 - RNA, 19 nt, Salmonella enterica enterica serovar Typhi Ty2
auucacuuuccgaaucagg

SEQ ID NO: 3734452 - RNA, 18 nt, Salmonella enterica enterica serovar Typhi Ty2
auucacuuucgacgacaa

SEQ ID NO: 3734453 - RNA, 21 nt, Salmonella enterica enterica serovar Typhi Ty2
auucacuuucgacgacaacgc

SEQ ID NO: 3734454 - RNA, 12 nt, Salmonella enterica enterica serovar Typhi Ty2
auucagaaaguu

SEQ ID NO: 3734455 - RNA, 13 nt, Salmonella enterica enterica serovar Typhi Ty2
auucagagcgucc

SEQ ID NO: 3734456 - RNA, 17 nt, Salmonella enterica enterica serovar Typhi Ty2
auucagagcguccacgc

SEQ ID NO: 3734457 - RNA, 17 nt, Salmonella enterica enterica serovar Typhi Ty2
auucagauccgaggcgu

SEQ ID NO: 3734458 - RNA, 15 nt, Salmonella enterica enterica serovar Typhi Ty2
auucagcaguucauu

SEQ ID NO: 3734459 - RNA, 17 nt, Salmonella enterica enterica serovar Typhi Ty2
auucaggccgccagcaa

SEQ ID NO: 3734460 - RNA, 20 nt, Salmonella enterica enterica serovar Typhi Ty2
auucagggcuuuauuuuaca

SEQ ID NO: 3734461 - RNA, 15 nt, Salmonella enterica enterica serovar Typhi Ty2
auucagggugcugau

SEQ ID NO: 3734462 - RNA, 18 nt, Salmonella enterica enterica serovar Typhi Ty2
auucagguggauuuuugc

SEQ ID NO: 3734463 - RNA, 16 nt, Salmonella enterica enterica serovar Typhi Ty2
auucaguaagagggug

SEQ ID NO: 3734464 - RNA, 14 nt, Salmonella enterica enterica serovar Typhi Ty2
auucauaaaagauc

SEQ ID NO: 3734465 - RNA, 17 nt, Salmonella enterica enterica serovar Typhi Ty2
auucauaacaccaauac

SEQ ID NO: 3734466 - RNA, 24 nt, Salmonella enterica enterica serovar Typhi Ty2
auucauagagcgcguccagacguu

SEQ ID NO: 3734467 - RNA, 14 nt, Salmonella enterica enterica serovar Typhi Ty2
auucauauuagcuc

SEQ ID NO: 3734468 - RNA, 16 nt, Salmonella enterica enterica serovar Typhi Ty2
auucauauuagcuccg

SEQ ID NO: 3734469 - RNA, 12 nt, Salmonella enterica enterica serovar Typhi Ty2
auucauauugcc

SEQ ID NO: 3734470 - RNA, 13 nt, Salmonella enterica enterica serovar Typhi Ty2
auucaucaaaaug

SEQ ID NO: 3734471 - RNA, 15 nt, Salmonella enterica enterica serovar Typhi Ty2
auucaucaaaaugca

SEQ ID NO: 3734472 - RNA, 16 nt, Salmonella enterica enterica serovar Typhi Ty2
auucaucaucuugucc

SEQ ID NO: 3734473 - RNA, 13 nt, Salmonella enterica enterica serovar Typhi Ty2
auucaucuccucu

SEQ ID NO: 3734474 - RNA, 21 nt, Salmonella enterica enterica serovar Typhi Ty2
auucaugaucuuuccuuuuuc

SEQ ID NO: 3734475 - RNA, 16 nt, Salmonella enterica enterica serovar Typhi Ty2
auucauggauaccggg

SEQ ID NO: 3734476 - RNA, 19 nt, Salmonella enterica enterica serovar Typhi Ty2
auucaugguacucaacauc

SEQ ID NO: 3734477 - RNA, 21 nt, Salmonella enterica enterica serovar Typhi Ty2
auucaugguacucaacaucau

SEQ ID NO: 3734478 - RNA, 22 nt, Salmonella enterica enterica serovar Typhi Ty2
auucauuaaaauugaacggacg

SEQ ID NO: 3734479 - RNA, 17 nt, Salmonella enterica enterica serovar Typhi Ty2
auucauuauuuuuaaau

SEQ ID NO: 3734480 - RNA, 16 nt, Salmonella enterica enterica serovar Typhi Ty2
auucauucugucagaa

SEQ ID NO: 3734481 - RNA, 14 nt, Salmonella enterica enterica serovar Typhi Ty2
auucauuucaaugu

SEQ ID NO: 3734482 - RNA, 14 nt, Salmonella enterica enterica serovar Typhi Ty2
auuccaaaauaaua

SEQ ID NO: 3734483 - RNA, 12 nt, Salmonella enterica enterica serovar Typhi Ty2
auuccaauauuu

SEQ ID NO: 3734484 - RNA, 15 nt, Salmonella enterica enterica serovar Typhi Ty2
auucugcgccagcca

SEQ ID NO: 3734485 - RNA, 16 nt, Salmonella enterica enterica serovar Typhi Ty2
auucugcgccagccag

SEQ ID NO: 3734486 - RNA, 16 nt, Salmonella enterica enterica serovar Typhi Ty2
auucugcugaugcugg

SEQ ID NO: 3734487 - RNA, 18 nt, Salmonella enterica enterica serovar Typhi Ty2
auucugcuuaccagaccg

SEQ ID NO: 3734488 - RNA, 15 nt, Salmonella enterica enterica serovar Typhi Ty2
auucugcuuccagaa

SEQ ID NO: 3734489 - RNA, 22 nt, Salmonella enterica enterica serovar Typhi Ty2
auucugcuuccagaauucguac

SEQ ID NO: 3734490 - RNA, 21 nt, Salmonella enterica enterica serovar Typhi Ty2
auucuggaaucaauuucccuu

SEQ ID NO: 3734491 - RNA, 19 nt, Salmonella enterica enterica serovar Typhi Ty2
auucugggcuuacuuucca

SEQ ID NO: 3734492 - RNA, 18 nt, Salmonella enterica enterica serovar Typhi Ty2
auucugguaguaagucag

SEQ ID NO: 3734493 - RNA, 15 nt, Salmonella enterica enterica serovar Typhi Ty2
auucugucagaaauc

SEQ ID NO: 3734494 - RNA, 22 nt, Salmonella enterica enterica serovar Typhi Ty2
auucugugaugaugcguuuguu

SEQ ID NO: 3734495 - RNA, 23 nt, Salmonella enterica enterica serovar Typhi Ty2
auucuguggggcuuaacccacga

SEQ ID NO: 3734496 - RNA, 18 nt, Salmonella enterica enterica serovar Typhi Ty2
auucuuaacccacaagaa

SEQ ID NO: 3734497 - RNA, 19 nt, Salmonella enterica enterica serovar Typhi Ty2
auucuuaacccacaagaaa

SEQ ID NO: 3734498 - RNA, 20 nt, Salmonella enterica enterica serovar Typhi Ty2
auucuuaacccacaagaaau

SEQ ID NO: 3734499 - RNA, 22 nt, Salmonella enterica enterica serovar Typhi Ty2
auucuucgccgaagugugccag

SEQ ID NO: 3734500 - RNA, 17 nt, Salmonella enterica enterica serovar Typhi Ty2
auucuugcccuauaaua

SEQ ID NO: 3734501 - RNA, 20 nt, Salmonella enterica enterica serovar Typhi Ty2
auucuuuacuaauaccugga

SEQ ID NO: 3734502 - RNA, 19 nt, Salmonella enterica enterica serovar Typhi Ty2
auucuuuuacgaucgccac

SEQ ID NO: 3734503 - RNA, 18 nt, Salmonella enterica enterica serovar Typhi Ty2
auugaaauuaaucaggca

SEQ ID NO: 3734504 - RNA, 21 nt, Salmonella enterica enterica serovar Typhi Ty2
auugaacauuuuuucagccug

SEQ ID NO: 3734505 - RNA, 21 nt, Salmonella enterica enterica serovar Typhi Ty2
auugaacgcuggcggcaggcc

SEQ ID NO: 3734506 - RNA, 22 nt, Salmonella enterica enterica serovar Typhi Ty2
auugaauaugguggucggcaau

SEQ ID NO: 3734507 - RNA, 23 nt, Salmonella enterica enterica serovar Typhi Ty2
auugaauauuugcgcaguuuaaa

SEQ ID NO: 3734508 - RNA, 22 nt, Salmonella enterica enterica serovar Typhi Ty2
auugaauucaccgcaugacaau

SEQ ID NO: 3734509 - RNA, 20 nt, Salmonella enterica enterica serovar Typhi Ty2
auugaauuugacgacaugca

SEQ ID NO: 3734510 - RNA, 14 nt, Salmonella enterica enterica serovar Typhi Ty2
auugaccaggagca

SEQ ID NO: 3734511 - RNA, 16 nt, Salmonella enterica enterica serovar Typhi Ty2
auugacccucccugcg

SEQ ID NO: 3734512 - RNA, 16 nt, Salmonella enterica enterica serovar Typhi Ty2
auugaccgcuuuuucc

SEQ ID NO: 3734513 - RNA, 18 nt, Salmonella enterica enterica serovar Typhi Ty2
auugaccguccccagcca

SEQ ID NO: 3734514 - RNA, 22 nt, Salmonella enterica enterica serovar Typhi Ty2
auugaccucacgcuuaucgcca

SEQ ID NO: 3734515 - RNA, 13 nt, Salmonella enterica enterica serovar Typhi Ty2
auugaccuucaug

SEQ ID NO: 3734516 - RNA, 16 nt, Salmonella enterica enterica serovar Typhi Ty2
auugacgguaaaguaa

SEQ ID NO: 3734517 - RNA, 17 nt, Salmonella enterica enterica serovar Typhi Ty2
auugacuggauuuuuga

SEQ ID NO: 3734518 - RNA, 15 nt, Salmonella enterica enterica serovar Typhi Ty2
auugacuuucagagc

SEQ ID NO: 3734519 - RNA, 15 nt, Salmonella enterica enterica serovar Typhi Ty2
auugagacaaauaac

SEQ ID NO: 3734520 - RNA, 21 nt, Salmonella enterica enterica serovar Typhi Ty2
auugagacaugccgccagacc

SEQ ID NO: 3734521 - RNA, 22 nt, Salmonella enterica enterica serovar Typhi Ty2
auugagacaugccgccagacca

SEQ ID NO: 3734522 - RNA, 18 nt, Salmonella enterica enterica serovar Typhi Ty2
auugagcuggauaagcug

SEQ ID NO: 3734523 - RNA, 20 nt, Salmonella enterica enterica serovar Typhi Ty2
auugaggcguuuccagugca

SEQ ID NO: 3734524 - RNA, 23 nt, Salmonella enterica enterica serovar Typhi Ty2
auugaggcguuuccagugcagcu

SEQ ID NO: 3734525 - RNA, 16 nt, Salmonella enterica enterica serovar Typhi Ty2
auugaggcuacccaga

SEQ ID NO: 3734526 - RNA, 18 nt, Salmonella enterica enterica serovar Typhi Ty2
auugaggcuacccagaca

SEQ ID NO: 3734527 - RNA, 20 nt, Salmonella enterica enterica serovar Typhi Ty2
auugagguauaggaaaauga

SEQ ID NO: 3734528 - RNA, 18 nt, Salmonella enterica enterica serovar Typhi Ty2
auugaguggacaucgcca

SEQ ID NO: 3734529 - RNA, 15 nt, Salmonella enterica enterica serovar Typhi Ty2
auugauaagcggguu

SEQ ID NO: 3734530 - RNA, 16 nt, Salmonella enterica enterica serovar Typhi Ty2
auugauaauaaccguc

SEQ ID NO: 3734531 - RNA, 20 nt, Salmonella enterica enterica serovar Typhi Ty2
auugauauagaguccagcca

SEQ ID NO: 3734532 - RNA, 18 nt, Salmonella enterica enterica serovar Typhi Ty2
auugaucacaaaaucauu

SEQ ID NO: 3734533 - RNA, 15 nt, Salmonella enterica enterica serovar Typhi Ty2
auugauggccagccc

SEQ ID NO: 3734534 - RNA, 18 nt, Salmonella enterica enterica serovar Typhi Ty2
auugauuagcuuuuuacu

SEQ ID NO: 3734535 - RNA, 12 nt, Salmonella enterica enterica serovar Typhi Ty2
auugauucugug

SEQ ID NO: 3734536 - RNA, 14 nt, Salmonella enterica enterica serovar Typhi Ty2
auugauucugugau

SEQ ID NO: 3734537 - RNA, 20 nt, Salmonella enterica enterica serovar Typhi Ty2
auugauuuccgcgcaaucgc

SEQ ID NO: 3734538 - RNA, 15 nt, Salmonella enterica enterica serovar Typhi Ty2
auugauuuuucuggu

SEQ ID NO: 3734539 - RNA, 17 nt, Salmonella enterica enterica serovar Typhi Ty2
auugcaacgaucccuaa

SEQ ID NO: 3734540 - RNA, 20 nt, Salmonella enterica enterica serovar Typhi Ty2
auugcagauaauuuugcaua

SEQ ID NO: 3734541 - RNA, 21 nt, Salmonella enterica enterica serovar Typhi Ty2
auugcagcauuacacuauguu

SEQ ID NO: 3734542 - RNA, 17 nt, Salmonella enterica enterica serovar Typhi Ty2
auugcagcgaccuggga

SEQ ID NO: 3734543 - RNA, 20 nt, Salmonella enterica enterica serovar Typhi Ty2
auugcagcgguaaacaccac

SEQ ID NO: 3734544 - RNA, 16 nt, Salmonella enterica enterica serovar Typhi Ty2
auugccacagccucag

SEQ ID NO: 3734545 - RNA, 12 nt, Salmonella enterica enterica serovar Typhi Ty2
auugccaggacu

SEQ ID NO: 3734546 - RNA, 21 nt, Salmonella enterica enterica serovar Typhi Ty2
auugccaggcguuacgcgcca

SEQ ID NO: 3734547 - RNA, 23 nt, Salmonella enterica enterica serovar Typhi Ty2
auugccaguccggaugucucagc

SEQ ID NO: 3734548 - RNA, 17 nt, Salmonella enterica enterica serovar Typhi Ty2
auugccauaaaaacaau

SEQ ID NO: 3734549 - RNA, 23 nt, Salmonella enterica enterica serovar Typhi Ty2
auugccauaaauacaauucaacu

SEQ ID NO: 3734550 - RNA, 19 nt, Salmonella enterica enterica serovar Typhi Ty2
auugccauacacgcggcga

SEQ ID NO: 3734551 - RNA, 20 nt, Salmonella enterica enterica serovar Typhi Ty2
auugccaugaugagcgccau

SEQ ID NO: 3734552 - RNA, 23 nt, Salmonella enterica enterica serovar Typhi Ty2
auugccaugcgacuaaccugauc

SEQ ID NO: 3734553 - RNA, 18 nt, Salmonella enterica enterica serovar Typhi Ty2
auugccauguuaauacca

SEQ ID NO: 3734554 - RNA, 19 nt, Salmonella enterica enterica serovar Typhi Ty2
auugccauguuaauaccag

SEQ ID NO: 3734555 - RNA, 17 nt, Salmonella enterica enterica serovar Typhi Ty2
auugcccaucgcgccau

SEQ ID NO: 3734556 - RNA, 17 nt, Salmonella enterica enterica serovar Typhi Ty2
auugccgaccauuaccc

SEQ ID NO: 3734557 - RNA, 22 nt, Salmonella enterica enterica serovar Typhi Ty2
auugccgaccgccagcagagcg

SEQ ID NO: 3734558 - RNA, 15 nt, Salmonella enterica enterica serovar Typhi Ty2
auugccgcacauguu

SEQ ID NO: 3734559 - RNA, 14 nt, Salmonella enterica enterica serovar Typhi Ty2
auugccggaaacca

SEQ ID NO: 3734560 - RNA, 19 nt, Salmonella enterica enterica serovar Typhi Ty2
auugccggauggcggcgua

SEQ ID NO: 3734561 - RNA, 24 nt, Salmonella enterica enterica serovar Typhi Ty2
auugccggauggggcauuagccgc

SEQ ID NO: 3734562 - RNA, 21 nt, Salmonella enterica enterica serovar Typhi Ty2
auugccggcgaccaugccagc

SEQ ID NO: 3734563 - RNA, 15 nt, Salmonella enterica enterica serovar Typhi Ty2
auugccuaaauaacu

SEQ ID NO: 3734564 - RNA, 16 nt, Salmonella enterica enterica serovar Typhi Ty2
auugccuaaauaacuc

SEQ ID NO: 3734565 - RNA, 20 nt, Salmonella enterica enterica serovar Typhi Ty2
auuuaugauuuuaacaucac

SEQ ID NO: 3734566 - RNA, 13 nt, Salmonella enterica enterica serovar Typhi Ty2
auuuaugccgcca

SEQ ID NO: 3734567 - RNA, 16 nt, Salmonella enterica enterica serovar Typhi Ty2
auuuaugccgccaucc

SEQ ID NO: 3734568 - RNA, 16 nt, Salmonella enterica enterica serovar Typhi Ty2
auuuaugcgcugggca

SEQ ID NO: 3734569 - RNA, 21 nt, Salmonella enterica enterica serovar Typhi Ty2
auuuauggcgucaccauuacu

SEQ ID NO: 3734570 - RNA, 16 nt, Salmonella enterica enterica serovar Typhi Ty2
auuuauuagugagugc

SEQ ID NO: 3734571 - RNA, 12 nt, Salmonella enterica enterica serovar Typhi Ty2
auuuauucuauu

SEQ ID NO: 3734572 - RNA, 21 nt, Salmonella enterica enterica serovar Typhi Ty2
auuuauuuucugaacgcugcu

SEQ ID NO: 3734573 - RNA, 23 nt, Salmonella enterica enterica serovar Typhi Ty2
auuuauuuucugaacgcugcugu

SEQ ID NO: 3734574 - RNA, 18 nt, Salmonella enterica enterica serovar Typhi Ty2
auuuauuuugaauuuuua

SEQ ID NO: 3734575 - RNA, 19 nt, Salmonella enterica enterica serovar Typhi Ty2
auuuauuuugaauuuuuau

SEQ ID NO: 3734576 - RNA, 22 nt, Salmonella enterica enterica serovar Typhi Ty2
auuuauuuuuaguaacuuacaa

SEQ ID NO: 3734577 - RNA, 23 nt, Salmonella enterica enterica serovar Typhi Ty2
auuuauuuuuugggcgcuuagaa

SEQ ID NO: 3734578 - RNA, 14 nt, Salmonella enterica enterica serovar Typhi Ty2
auuucaaaacccgc

SEQ ID NO: 3734579 - RNA, 15 nt, Salmonella enterica enterica serovar Typhi Ty2
auuucaacccggcau

SEQ ID NO: 3734580 - RNA, 22 nt, Salmonella enterica enterica serovar Typhi Ty2
auuucaauaauauguuccacaa

SEQ ID NO: 3734581 - RNA, 14 nt, Salmonella enterica enterica serovar Typhi Ty2
auuucaaucaucau

SEQ ID NO: 3734582 - RNA, 13 nt, Salmonella enterica enterica serovar Typhi Ty2
auuucaaucgcgc

SEQ ID NO: 3734583 - RNA, 14 nt, Salmonella enterica enterica serovar Typhi Ty2
auuucaauguaauu

SEQ ID NO: 3734584 - RNA, 14 nt, Salmonella enterica enterica serovar Typhi Ty2
auuucacaaauuaa

SEQ ID NO: 3734585 - RNA, 15 nt, Salmonella enterica enterica serovar Typhi Ty2
auuucacgaauaucg

SEQ ID NO: 3734586 - RNA, 14 nt, Salmonella enterica enterica serovar Typhi Ty2
auuucacgcagcac

SEQ ID NO: 3734587 - RNA, 22 nt, Salmonella enterica enterica serovar Typhi Ty2
auuucacgcuucacgucagcga

SEQ ID NO: 3734588 - RNA, 23 nt, Salmonella enterica enterica serovar Typhi Ty2
auuucacgucacguucauccugg

SEQ ID NO: 3734589 - RNA, 22 nt, Salmonella enterica enterica serovar Typhi Ty2
auuucacuggccguuuucccgg

SEQ ID NO: 3734590 - RNA, 23 nt, Salmonella enterica enterica serovar Typhi Ty2
auuucacuggccguuuucccggc

SEQ ID NO: 3734591 - RNA, 16 nt, Salmonella enterica enterica serovar Typhi Ty2
auuucacuuaucccug

SEQ ID NO: 3734592 - RNA, 14 nt, Salmonella enterica enterica serovar Typhi Ty2
auuucacuucauca

SEQ ID NO: 3734593 - RNA, 15 nt, Salmonella enterica enterica serovar Typhi Ty2
auuucacuucaucau

SEQ ID NO: 3734594 - RNA, 20 nt, Salmonella enterica enterica serovar Typhi Ty2
auuucagcgcagaauuuauu

SEQ ID NO: 3734595 - RNA, 18 nt, Salmonella enterica enterica serovar Typhi Ty2
auuucagggaaaagaagu

SEQ ID NO: 3734596 - RNA, 17 nt, Salmonella enterica enterica serovar Typhi Ty2
auuucagggcuuauuca

SEQ ID NO: 3734597 - RNA, 17 nt, Salmonella enterica enterica serovar Typhi Ty2
auuucaguacagccaaa

SEQ ID NO: 3734598 - RNA, 16 nt, Salmonella enterica enterica serovar Typhi Ty2
auuucaucgccgccgc

SEQ ID NO: 3734599 - RNA, 22 nt, Salmonella enterica enterica serovar Typhi Ty2
auuucaucguagucguagaaca

SEQ ID NO: 3734600 - RNA, 15 nt, Salmonella enterica enterica serovar Typhi Ty2
auuucaucuaucugc

SEQ ID NO: 3734601 - RNA, 18 nt, Salmonella enterica enterica serovar Typhi Ty2
auuucaugcgcagcauga

SEQ ID NO: 3734602 - RNA, 23 nt, Salmonella enterica enterica serovar Typhi Ty2
auuucaugcggugcaugaauauc

SEQ ID NO: 3734603 - RNA, 14 nt, Salmonella enterica enterica serovar Typhi Ty2
auuucauucagacc

SEQ ID NO: 3734604 - RNA, 16 nt, Salmonella enterica enterica serovar Typhi Ty2
auuuccaccuucucuu

SEQ ID NO: 3734605 - RNA, 21 nt, Salmonella enterica enterica serovar Typhi Ty2
auuuccagugccaguuaagca

SEQ ID NO: 3734606 - RNA, 14 nt, Salmonella enterica enterica serovar Typhi Ty2
auuuccauauuaac

SEQ ID NO: 3734607 - RNA, 13 nt, Salmonella enterica enterica serovar Typhi Ty2
auuuccauuuuuc

SEQ ID NO: 3734608 - RNA, 14 nt, Salmonella enterica enterica serovar Typhi Ty2
auuuccauuuuuca

SEQ ID NO: 3734609 - RNA, 14 nt, Salmonella enterica enterica serovar Typhi Ty2
auuucccuucaauc

SEQ ID NO: 3734610 - RNA, 16 nt, Salmonella enterica enterica serovar Typhi Ty2
auuuccgccauuuuuc

SEQ ID NO: 3734611 - RNA, 14 nt, Salmonella enterica enterica serovar Typhi Ty2
auuuccgccgccag

SEQ ID NO: 3734612 - RNA, 21 nt, Salmonella enterica enterica serovar Typhi Ty2
auuuccgguuccagcggccgc

SEQ ID NO: 3734613 - RNA, 20 nt, Salmonella enterica enterica serovar Typhi Ty2
auuuccuguguuacgccaau

SEQ ID NO: 3734614 - RNA, 20 nt, Salmonella enterica enterica serovar Typhi Ty2
auuucgaaacaggaaaaaca

SEQ ID NO: 3734615 - RNA, 19 nt, Salmonella enterica enterica serovar Typhi Ty2
auuucgacgauaaaaaaag

SEQ ID NO: 3734616 - RNA, 20 nt, Salmonella enterica enterica serovar Typhi Ty2
auuucgacgucaacgguaaa

SEQ ID NO: 3734617 - RNA, 13 nt, Salmonella enterica enterica serovar Typhi Ty2
auuucgaucggcc

SEQ ID NO: 3734618 - RNA, 22 nt, Salmonella enterica enterica serovar Typhi Ty2
auuucgaucuguuuaaguacgc

SEQ ID NO: 3734619 - RNA, 17 nt, Salmonella enterica enterica serovar Typhi Ty2
auuucgaugaugaccga

SEQ ID NO: 3734620 - RNA, 18 nt, Salmonella enterica enterica serovar Typhi Ty2
auuucgcaacgccgccga

SEQ ID NO: 3734621 - RNA, 17 nt, Salmonella enterica enterica serovar Typhi Ty2
auuucgccccacuggcc

SEQ ID NO: 3734622 - RNA, 21 nt, Salmonella enterica enterica serovar Typhi Ty2
auuucgccccacuggcccccu

SEQ ID NO: 3734623 - RNA, 13 nt, Salmonella enterica enterica serovar Typhi Ty2
auuucgccgccgc

SEQ ID NO: 3734624 - RNA, 19 nt, Salmonella enterica enterica serovar Typhi Ty2
auuucgccuauuuucucuu

SEQ ID NO: 3734625 - RNA, 22 nt, Salmonella enterica enterica serovar Typhi Ty2
auuucgccuuugcgacgguuuu

SEQ ID NO: 3734626 - RNA, 23 nt, Salmonella enterica enterica serovar Typhi Ty2
auuucgcgucagggcaaggcggc

SEQ ID NO: 3734627 - RNA, 22 nt, Salmonella enterica enterica serovar Typhi Ty2
auuucgcuggcggccccucuuc

SEQ ID NO: 3734628 - RNA, 13 nt, Salmonella enterica enterica serovar Typhi Ty2
auuucggcaauga

SEQ ID NO: 3734629 - RNA, 19 nt, Salmonella enterica enterica serovar Typhi Ty2
auuucggcgcuguuuuccg

SEQ ID NO: 3734630 - RNA, 15 nt, Salmonella enterica enterica serovar Typhi Ty2
auuucguagccgcgc

SEQ ID NO: 3734631 - RNA, 23 nt, Salmonella enterica enterica serovar Typhi Ty2
auuucguagccgcgcgccgccuc

SEQ ID NO: 3734632 - RNA, 14 nt, Salmonella enterica enterica serovar Typhi Ty2
auuucgucaucgcu

SEQ ID NO: 3734633 - RNA, 22 nt, Salmonella enterica enterica serovar Typhi Ty2
auuucguccggcugccacucuu

SEQ ID NO: 3734634 - RNA, 20 nt, Salmonella enterica enterica serovar Typhi Ty2
auuucgucgauguuacgacc

SEQ ID NO: 3734635 - RNA, 16 nt, Salmonella enterica enterica serovar Typhi Ty2
auuucuccugcgccag

SEQ ID NO: 3734636 - RNA, 20 nt, Salmonella enterica enterica serovar Typhi Ty2
auuucuccugcgccagccgg

SEQ ID NO: 3734637 - RNA, 15 nt, Salmonella enterica enterica serovar Typhi Ty2
auuucucgccgccgg

SEQ ID NO: 3734638 - RNA, 21 nt, Salmonella enterica enterica serovar Typhi Ty2
auuucucgcucgcccaucacu

SEQ ID NO: 3734639 - RNA, 19 nt, Salmonella enterica enterica serovar Typhi Ty2
auuucucuuuuauuauuuu

SEQ ID NO: 3734640 - RNA, 17 nt, Salmonella enterica enterica serovar Typhi Ty2
auuucugccugcuucag

SEQ ID NO: 3734641 - RNA, 17 nt, Salmonella enterica enterica serovar Typhi Ty2
auuucugcugccagcgc

SEQ ID NO: 3734642 - RNA, 23 nt, Salmonella enterica enterica serovar Typhi Ty2
auuucugcugccagcgccgccgc

SEQ ID NO: 3734643 - RNA, 20 nt, Salmonella enterica enterica serovar Typhi Ty2
auuucuugagcggcaucacu

SEQ ID NO: 3734644 - RNA, 17 nt, Salmonella enterica enterica serovar Typhi Ty2
auuucuugcaauagcgc

SEQ ID NO: 3734645 - RNA, 23 nt, Salmonella enterica enterica serovar Typhi Ty2
auuucuuuaaugcccgguauuuu

SEQ ID NO: 3734646 - RNA, 19 nt, Salmonella enterica enterica serovar Typhi Ty2
auuucuuugguuucgcggu

SEQ ID NO: 3734647 - RNA, 19 nt, Salmonella enterica enterica serovar Typhi Ty2
auuuuucgcgucaaaacuu

SEQ ID NO: 3734648 - RNA, 16 nt, Salmonella enterica enterica serovar Typhi Ty2
auuuuucgguuuucca

SEQ ID NO: 3734649 - RNA, 23 nt, Salmonella enterica enterica serovar Typhi Ty2
auuuuucucagccagauccagug

SEQ ID NO: 3734650 - RNA, 20 nt, Salmonella enterica enterica serovar Typhi Ty2
auuuuucuggcuucuuaaaa

SEQ ID NO: 3734651 - RNA, 14 nt, Salmonella enterica enterica serovar Typhi Ty2
auuuuucugguaaa

SEQ ID NO: 3734652 - RNA, 14 nt, Salmonella enterica enterica serovar Typhi Ty2
auuuuugccauuau

SEQ ID NO: 3734653 - RNA, 18 nt, Salmonella enterica enterica serovar Typhi Ty2
auuuuugcccagccuucu

SEQ ID NO: 3734654 - RNA, 16 nt, Salmonella enterica enterica serovar Typhi Ty2
auuuuuugcugggaua

SEQ ID NO: 3734655 - RNA, 13 nt, Salmonella enterica enterica serovar Typhi Ty2
auuuuuuuacauu

SEQ ID NO: 3734656 - RNA, 15 nt, Salmonella enterica enterica serovar Typhi Ty2
auuuuuuucagccuu

SEQ ID NO: 3734657 - RNA, 23 nt, Salmonella enterica enterica serovar Typhi Ty2
auuuuuuucucgauaucuucccc

SEQ ID NO: 3734658 - RNA, 15 nt, Salmonella enterica enterica serovar Typhi Ty2
auuuuuuugcuggcc

SEQ ID NO: 3734659 - RNA, 13 nt, Salmonella enterica enterica serovar Typhi Ty2
auuuuuuuugccu

SEQ ID NO: 3734660 - RNA, 13 nt, Salmonella enterica enterica serovar Typhi Ty2
caaaaaaaaaccg

SEQ ID NO: 3734661 - RNA, 22 nt, Salmonella enterica enterica serovar Typhi Ty2
caaaaaaaaucccgccagcggc

SEQ ID NO: 3734662 - RNA, 22 nt, Salmonella enterica enterica serovar Typhi Ty2
caaaaaaacuaauccucuucuc

SEQ ID NO: 3734663 - RNA, 16 nt, Salmonella enterica enterica serovar Typhi Ty2
caaaaaagcaguauau

SEQ ID NO: 3734664 - RNA, 16 nt, Salmonella enterica enterica serovar Typhi Ty2
caaaaaaucagcaauc

SEQ ID NO: 3734665 - RNA, 16 nt, Salmonella enterica enterica serovar Typhi Ty2
caaaaaaugugagcca

SEQ ID NO: 3734666 - RNA, 12 nt, Salmonella enterica enterica serovar Typhi Ty2
caaaaacgccag

SEQ ID NO: 3734667 - RNA, 23 nt, Salmonella enterica enterica serovar Typhi Ty2
caaaaacggcuuuaauaccccug

SEQ ID NO: 3734668 - RNA, 20 nt, Salmonella enterica enterica serovar Typhi Ty2
caaaaaguaguuccagcaua

SEQ ID NO: 3734669 - RNA, 12 nt, Salmonella enterica enterica serovar Typhi Ty2
caaaaauaauuc

SEQ ID NO: 3734670 - RNA, 14 nt, Salmonella enterica enterica serovar Typhi Ty2
caaaaauccuucuu

SEQ ID NO: 3734671 - RNA, 16 nt, Salmonella enterica enterica serovar Typhi Ty2
caaaaaucgucaucag

SEQ ID NO: 3734672 - RNA, 16 nt, Salmonella enterica enterica serovar Typhi Ty2
caaaacaacaaaguau

SEQ ID NO: 3734673 - RNA, 18 nt, Salmonella enterica enterica serovar Typhi Ty2
caaaacccaccagcaggg

SEQ ID NO: 3734674 - RNA, 17 nt, Salmonella enterica enterica serovar Typhi Ty2
caaaacccagaaucagu

SEQ ID NO: 3734675 - RNA, 20 nt, Salmonella enterica enterica serovar Typhi Ty2
caaaacccagaaucaguaac

SEQ ID NO: 3734676 - RNA, 17 nt, Salmonella enterica enterica serovar Typhi Ty2
caaaacgcauccagcgc

SEQ ID NO: 3734677 - RNA, 21 nt, Salmonella enterica enterica serovar Typhi Ty2
caaaacgccgguacuggagac

SEQ ID NO: 3734678 - RNA, 18 nt, Salmonella enterica enterica serovar Typhi Ty2
caaaacguagagugcuuc

SEQ ID NO: 3734679 - RNA, 21 nt, Salmonella enterica enterica serovar Typhi Ty2
caaaacgucgugaguggcggc

SEQ ID NO: 3734680 - RNA, 17 nt, Salmonella enterica enterica serovar Typhi Ty2
caaaacuacgccaauga

SEQ ID NO: 3734681 - RNA, 12 nt, Salmonella enterica enterica serovar Typhi Ty2
caaaacuauuuu

SEQ ID NO: 3734682 - RNA, 23 nt, Salmonella enterica enterica serovar Typhi Ty2
caaaacucucaccgaccugccuu

SEQ ID NO: 3734683 - RNA, 21 nt, Salmonella enterica enterica serovar Typhi Ty2
caaaacuuauuuuauuuuuau

SEQ ID NO: 3734684 - RNA, 17 nt, Salmonella enterica enterica serovar Typhi Ty2
caaaagaggcuaauuau

SEQ ID NO: 3734685 - RNA, 14 nt, Salmonella enterica enterica serovar Typhi Ty2
caaaagauugauuu

SEQ ID NO: 3734686 - RNA, 22 nt, Salmonella enterica enterica serovar Typhi Ty2
caaaagauuuaucaauuuuuaa

SEQ ID NO: 3734687 - RNA, 16 nt, Salmonella enterica enterica serovar Typhi Ty2
caaaagcaucaauuug

SEQ ID NO: 3734688 - RNA, 17 nt, Salmonella enterica enterica serovar Typhi Ty2
caaaagccuguuuacca

SEQ ID NO: 3734689 - RNA, 22 nt, Salmonella enterica enterica serovar Typhi Ty2
caaaaggccuuuuuuuuaugcg

SEQ ID NO: 3734690 - RNA, 23 nt, Salmonella enterica enterica serovar Typhi Ty2
caaaaggcuccacuucgguuugu

SEQ ID NO: 3734691 - RNA, 15 nt, Salmonella enterica enterica serovar Typhi Ty2
caaaaggcuggaaca

SEQ ID NO: 3734692 - RNA, 18 nt, Salmonella enterica enterica serovar Typhi Ty2
caaaaggcuggaacagau

SEQ ID NO: 3734693 - RNA, 21 nt, Salmonella enterica enterica serovar Typhi Ty2
caaaaggcuggaacagauguu

SEQ ID NO: 3734694 - RNA, 15 nt, Salmonella enterica enterica serovar Typhi Ty2
caaaauaagucauau

SEQ ID NO: 3734695 - RNA, 16 nt, Salmonella enterica enterica serovar Typhi Ty2
caaaauaauaaaaauc

SEQ ID NO: 3734696 - RNA, 19 nt, Salmonella enterica enterica serovar Typhi Ty2
caaaauaauacguuuauuc

SEQ ID NO: 3734697 - RNA, 14 nt, Salmonella enterica enterica serovar Typhi Ty2
caaaauagucaguu

SEQ ID NO: 3734698 - RNA, 15 nt, Salmonella enterica enterica serovar Typhi Ty2
caaaauauauaauuu

SEQ ID NO: 3734699 - RNA, 14 nt, Salmonella enterica enterica serovar Typhi Ty2
caaaaucacgcaca

SEQ ID NO: 3734700 - RNA, 17 nt, Salmonella enterica enterica serovar Typhi Ty2
caaaaucaggcaucccg

SEQ ID NO: 3734701 - RNA, 13 nt, Salmonella enterica enterica serovar Typhi Ty2
caaaaucauucgg

SEQ ID NO: 3734702 - RNA, 19 nt, Salmonella enterica enterica serovar Typhi Ty2
caaaaucccggcuggguuc

SEQ ID NO: 3734703 - RNA, 20 nt, Salmonella enterica enterica serovar Typhi Ty2
caaaaucccggcuggguuca

SEQ ID NO: 3734704 - RNA, 16 nt, Salmonella enterica enterica serovar Typhi Ty2
caaaauccgccaccgc

SEQ ID NO: 3734705 - RNA, 20 nt, Salmonella enterica enterica serovar Typhi Ty2
caaaauccuuguugauaaaa

SEQ ID NO: 3734706 - RNA, 24 nt, Salmonella enterica enterica serovar Typhi Ty2
caaaauccuuguugauaaaacgaa

SEQ ID NO: 3734707 - RNA, 19 nt, Salmonella enterica enterica serovar Typhi Ty2
caaaaucgauagcgccgca

SEQ ID NO: 3734708 - RNA, 18 nt, Salmonella enterica enterica serovar Typhi Ty2
caaaaucgcaaacgccag

SEQ ID NO: 3734709 - RNA, 20 nt, Salmonella enterica enterica serovar Typhi Ty2
caaaaucgcgcuuuauguuu

SEQ ID NO: 3734710 - RNA, 15 nt, Salmonella enterica enterica serovar Typhi Ty2
caaaaucuuuuucgc

SEQ ID NO: 3734711 - RNA, 16 nt, Salmonella enterica enterica serovar Typhi Ty2
caaaaucuuuuucgcu

SEQ ID NO: 3734712 - RNA, 20 nt, Salmonella enterica enterica serovar Typhi Ty2
caaaauuaaucgccagcagc

SEQ ID NO: 3734713 - RNA, 14 nt, Salmonella enterica enterica serovar Typhi Ty2
caaaauuuucaaua

SEQ ID NO: 3734714 - RNA, 16 nt, Salmonella enterica enterica serovar Typhi Ty2
caaacaaauaaaucca

SEQ ID NO: 3734715 - RNA, 14 nt, Salmonella enterica enterica serovar Typhi Ty2
caaacaacccggcu

SEQ ID NO: 3734716 - RNA, 18 nt, Salmonella enterica enterica serovar Typhi Ty2
caaacacaaucacgccca

SEQ ID NO: 3734717 - RNA, 13 nt, Salmonella enterica enterica serovar Typhi Ty2
caaacacagccau

SEQ ID NO: 3734718 - RNA, 13 nt, Salmonella enterica enterica serovar Typhi Ty2
caaacaccagauc

SEQ ID NO: 3734719 - RNA, 14 nt, Salmonella enterica enterica serovar Typhi Ty2
caaacaccagauca

SEQ ID NO: 3734720 - RNA, 21 nt, Salmonella enterica enterica serovar Typhi Ty2
caaacacuaccgggcagcauc

SEQ ID NO: 3734721 - RNA, 16 nt, Salmonella enterica enterica serovar Typhi Ty2
caaacauagccucaag

SEQ ID NO: 3734722 - RNA, 14 nt, Salmonella enterica enterica serovar Typhi Ty2
caaacaugcggcuu

SEQ ID NO: 3734723 - RNA, 16 nt, Salmonella enterica enterica serovar Typhi Ty2
caaacauuagcggugc

SEQ ID NO: 3734724 - RNA, 14 nt, Salmonella enterica enterica serovar Typhi Ty2
caaaccaaacugau

SEQ ID NO: 3734725 - RNA, 21 nt, Salmonella enterica enterica serovar Typhi Ty2
caaaccacagugaugacggca

SEQ ID NO: 3734726 - RNA, 12 nt, Salmonella enterica enterica serovar Typhi Ty2
caaaccacugcu

SEQ ID NO: 3734727 - RNA, 23 nt, Salmonella enterica enterica serovar Typhi Ty2
caaaccagacgcguaaccccugc

SEQ ID NO: 3734728 - RNA, 13 nt, Salmonella enterica enterica serovar Typhi Ty2
caaaccaugauaa

SEQ ID NO: 3734729 - RNA, 22 nt, Salmonella enterica enterica serovar Typhi Ty2
caaauaagguggcuaacccgcu

SEQ ID NO: 3734730 - RNA, 14 nt, Salmonella enterica enterica serovar Typhi Ty2
caaauacagaugcu

SEQ ID NO: 3734731 - RNA, 22 nt, Salmonella enterica enterica serovar Typhi Ty2
caaauacugcuuuuccggcagc

SEQ ID NO: 3734732 - RNA, 15 nt, Salmonella enterica enterica serovar Typhi Ty2
caaauagagaaaaua

SEQ ID NO: 3734733 - RNA, 20 nt, Salmonella enterica enterica serovar Typhi Ty2
caaauagagaaaauaacaau

SEQ ID NO: 3734734 - RNA, 21 nt, Salmonella enterica enterica serovar Typhi Ty2
caaauagccguuaccgccgag

SEQ ID NO: 3734735 - RNA, 16 nt, Salmonella enterica enterica serovar Typhi Ty2
caaauagcggcacaga

SEQ ID NO: 3734736 - RNA, 19 nt, Salmonella enterica enterica serovar Typhi Ty2
caaauagcguguguuuucc

SEQ ID NO: 3734737 - RNA, 14 nt, Salmonella enterica enterica serovar Typhi Ty2
caaauauuucuuug

SEQ ID NO: 3734738 - RNA, 17 nt, Salmonella enterica enterica serovar Typhi Ty2
caaaucaccacauggcc

SEQ ID NO: 3734739 - RNA, 15 nt, Salmonella enterica enterica serovar Typhi Ty2
caaaucagacgcuuc

SEQ ID NO: 3734740 - RNA, 13 nt, Salmonella enterica enterica serovar Typhi Ty2
caaaucagcagga

SEQ ID NO: 3734741 - RNA, 15 nt, Salmonella enterica enterica serovar Typhi Ty2
caaaucaggaaauaa

SEQ ID NO: 3734742 - RNA, 21 nt, Salmonella enterica enterica serovar Typhi Ty2
caaaucaggaaauaaucgagu

SEQ ID NO: 3734743 - RNA, 19 nt, Salmonella enterica enterica serovar Typhi Ty2
caaauccagcucaguuucc

SEQ ID NO: 3734744 - RNA, 21 nt, Salmonella enterica enterica serovar Typhi Ty2
caaauccgcauuucgcccucg

SEQ ID NO: 3734745 - RNA, 17 nt, Salmonella enterica enterica serovar Typhi Ty2
caaauccuccauaaaua

SEQ ID NO: 3734746 - RNA, 15 nt, Salmonella enterica enterica serovar Typhi Ty2
caaaucgacagccag

SEQ ID NO: 3734747 - RNA, 16 nt, Salmonella enterica enterica serovar Typhi Ty2
caaaucgcccaucaca

SEQ ID NO: 3734748 - RNA, 16 nt, Salmonella enterica enterica serovar Typhi Ty2
caaaucgccgauaugg

SEQ ID NO: 3734749 - RNA, 16 nt, Salmonella enterica enterica serovar Typhi Ty2
caaaucgguaaauguc

SEQ ID NO: 3734750 - RNA, 23 nt, Salmonella enterica enterica serovar Typhi Ty2
caaaucgugugcgguauagauca

SEQ ID NO: 3734751 - RNA, 14 nt, Salmonella enterica enterica serovar Typhi Ty2
caaaucguuuucua

SEQ ID NO: 3734752 - RNA, 21 nt, Salmonella enterica enterica serovar Typhi Ty2
caaaucugccgucaucgacuu

SEQ ID NO: 3734753 - RNA, 22 nt, Salmonella enterica enterica serovar Typhi Ty2
caaaucuggugauaaagcagac

SEQ ID NO: 3734754 - RNA, 21 nt, Salmonella enterica enterica serovar Typhi Ty2
caaaucuguuaucuggaugua

SEQ ID NO: 3734755 - RNA, 22 nt, Salmonella enterica enterica serovar Typhi Ty2
caaaugaaccugaugugcuuuu

SEQ ID NO: 3734756 - RNA, 19 nt, Salmonella enterica enterica serovar Typhi Ty2
caaaugaagcgacgcuggc

SEQ ID NO: 3734757 - RNA, 18 nt, Salmonella enterica enterica serovar Typhi Ty2
caaaugauaauaugcuca

SEQ ID NO: 3734758 - RNA, 22 nt, Salmonella enterica enterica serovar Typhi Ty2
caaaugcgauaaccugcuguga

SEQ ID NO: 3734759 - RNA, 15 nt, Salmonella enterica enterica serovar Typhi Ty2
caaaugggaucuuca

SEQ ID NO: 3734760 - RNA, 20 nt, Salmonella enterica enterica serovar Typhi Ty2
caaaugggaucuucaaugaa

SEQ ID NO: 3734761 - RNA, 20 nt, Salmonella enterica enterica serovar Typhi Ty2
caaauguuguuugaaaagug

SEQ ID NO: 3734762 - RNA, 17 nt, Salmonella enterica enterica serovar Typhi Ty2
caaauuaaauccugaaa

SEQ ID NO: 3734763 - RNA, 23 nt, Salmonella enterica enterica serovar Typhi Ty2
caaauuaaugugcguaaacaggc

SEQ ID NO: 3734764 - RNA, 18 nt, Salmonella enterica enterica serovar Typhi Ty2
caaauuaugauucaaucg

SEQ ID NO: 3734765 - RNA, 16 nt, Salmonella enterica enterica serovar Typhi Ty2
caaauuccagcaauga

SEQ ID NO: 3734766 - RNA, 12 nt, Salmonella enterica enterica serovar Typhi Ty2
caaauuccggca

SEQ ID NO: 3734767 - RNA, 15 nt, Salmonella enterica enterica serovar Typhi Ty2
caaauugcuguucca

SEQ ID NO: 3734768 - RNA, 17 nt, Salmonella enterica enterica serovar Typhi Ty2
caaauuuugauaaaaac

SEQ ID NO: 3734769 - RNA, 18 nt, Salmonella enterica enterica serovar Typhi Ty2
caacaaagccugcuggaa

SEQ ID NO: 3734770 - RNA, 14 nt, Salmonella enterica enterica serovar Typhi Ty2
caacaacagauaua

SEQ ID NO: 3734771 - RNA, 18 nt, Salmonella enterica enterica serovar Typhi Ty2
caacaacaggccgccgag

SEQ ID NO: 3734772 - RNA, 14 nt, Salmonella enterica enterica serovar Typhi Ty2
caacaacaguugca

SEQ ID NO: 3734773 - RNA, 19 nt, Salmonella enterica enterica serovar Typhi Ty2
caacaaccucuuuuuccgc

SEQ ID NO: 3734774 - RNA, 20 nt, Salmonella enterica enterica serovar Typhi Ty2
caacaaguccuucuuccccc

SEQ ID NO: 3734775 - RNA, 23 nt, Salmonella enterica enterica serovar Typhi Ty2
caacaaucccuuaaagccgcccu

SEQ ID NO: 3734776 - RNA, 21 nt, Salmonella enterica enterica serovar Typhi Ty2
caacaaugccacgccccuaag

SEQ ID NO: 3734777 - RNA, 15 nt, Salmonella enterica enterica serovar Typhi Ty2
caacaaugcuuucac

SEQ ID NO: 3734778 - RNA, 14 nt, Salmonella enterica enterica serovar Typhi Ty2
caacacauaagcca

SEQ ID NO: 3734779 - RNA, 14 nt, Salmonella enterica enterica serovar Typhi Ty2
caacaccaccgcuc

SEQ ID NO: 3734780 - RNA, 12 nt, Salmonella enterica enterica serovar Typhi Ty2
caacaccauccc

SEQ ID NO: 3734781 - RNA, 23 nt, Salmonella enterica enterica serovar Typhi Ty2
caacaccaucccgcucuucagua

SEQ ID NO: 3734782 - RNA, 19 nt, Salmonella enterica enterica serovar Typhi Ty2
caacaccgauccgaagaac

SEQ ID NO: 3734783 - RNA, 14 nt, Salmonella enterica enterica serovar Typhi Ty2
caacaccugcuggu

SEQ ID NO: 3734784 - RNA, 16 nt, Salmonella enterica enterica serovar Typhi Ty2
caacaccugcugguca

SEQ ID NO: 3734785 - RNA, 16 nt, Salmonella enterica enterica serovar Typhi Ty2
caacacgacaaaagca

SEQ ID NO: 3734786 - RNA, 14 nt, Salmonella enterica enterica serovar Typhi Ty2
caacacgcagaccc

SEQ ID NO: 3734787 - RNA, 17 nt, Salmonella enterica enterica serovar Typhi Ty2
caacacgccgaacaaca

SEQ ID NO: 3734788 - RNA, 24 nt, Salmonella enterica enterica serovar Typhi Ty2
caacacgccgaacaacacggcggc

SEQ ID NO: 3734789 - RNA, 19 nt, Salmonella enterica enterica serovar Typhi Ty2
caacacuuagaacgcggaa

SEQ ID NO: 3734790 - RNA, 20 nt, Salmonella enterica enterica serovar Typhi Ty2
caacacuuagaacgcggaag

SEQ ID NO: 3734791 - RNA, 15 nt, Salmonella enterica enterica serovar Typhi Ty2
caacacuuugcgcug

SEQ ID NO: 3734792 - RNA, 21 nt, Salmonella enterica enterica serovar Typhi Ty2
caacacuuugcgcugcgcauu

SEQ ID NO: 3734793 - RNA, 12 nt, Salmonella enterica enterica serovar Typhi Ty2
caacagcaaugu

SEQ ID NO: 3734794 - RNA, 14 nt, Salmonella enterica enterica serovar Typhi Ty2
caacagccgccugu

SEQ ID NO: 3734795 - RNA, 15 nt, Salmonella enterica enterica serovar Typhi Ty2
caacagcggagagac

SEQ ID NO: 3734796 - RNA, 16 nt, Salmonella enterica enterica serovar Typhi Ty2
caacagcgugagcugu

SEQ ID NO: 3734797 - RNA, 15 nt, Salmonella enterica enterica serovar Typhi Ty2
caacagcucgccaug

SEQ ID NO: 3734798 - RNA, 16 nt, Salmonella enterica enterica serovar Typhi Ty2
caacagcucgccaugc

SEQ ID NO: 3734799 - RNA, 17 nt, Salmonella enterica enterica serovar Typhi Ty2
caacagcucgccaugca

SEQ ID NO: 3734800 - RNA, 16 nt, Salmonella enterica enterica serovar Typhi Ty2
caacagcuugcgccca

SEQ ID NO: 3734801 - RNA, 16 nt, Salmonella enterica enterica serovar Typhi Ty2
caacaggaggaucgcc

SEQ ID NO: 3734802 - RNA, 24 nt, Salmonella enterica enterica serovar Typhi Ty2
caacagggcggccuccuggcuuac

SEQ ID NO: 3734803 - RNA, 14 nt, Salmonella enterica enterica serovar Typhi Ty2
caacagguaccccg

SEQ ID NO: 3734804 - RNA, 17 nt, Salmonella enterica enterica serovar Typhi Ty2
caacagguaccccgcca

SEQ ID NO: 3734805 - RNA, 21 nt, Salmonella enterica enterica serovar Typhi Ty2
caacagguaccccgccaccgc

SEQ ID NO: 3734806 - RNA, 16 nt, Salmonella enterica enterica serovar Typhi Ty2
caacagugggcuauga

SEQ ID NO: 3734807 - RNA, 20 nt, Salmonella enterica enterica serovar Typhi Ty2
caacagugugccgucaucca

SEQ ID NO: 3734808 - RNA, 17 nt, Salmonella enterica enterica serovar Typhi Ty2
caacaguugcuggagca

SEQ ID NO: 3734809 - RNA, 19 nt, Salmonella enterica enterica serovar Typhi Ty2
caacaguugcuggagcagg

SEQ ID NO: 3734810 - RNA, 16 nt, Salmonella enterica enterica serovar Typhi Ty2
caacauaaauaaacag

SEQ ID NO: 3734811 - RNA, 14 nt, Salmonella enterica enterica serovar Typhi Ty2
caacgccgccuggc

SEQ ID NO: 3734812 - RNA, 15 nt, Salmonella enterica enterica serovar Typhi Ty2
caacgccuccagcgg

SEQ ID NO: 3734813 - RNA, 14 nt, Salmonella enterica enterica serovar Typhi Ty2
caacgccuccaggc

SEQ ID NO: 3734814 - RNA, 13 nt, Salmonella enterica enterica serovar Typhi Ty2
caacgccuccugc

SEQ ID NO: 3734815 - RNA, 15 nt, Salmonella enterica enterica serovar Typhi Ty2
caacgccuccugccg

SEQ ID NO: 3734816 - RNA, 16 nt, Salmonella enterica enterica serovar Typhi Ty2
caacgccuucugcuug

SEQ ID NO: 3734817 - RNA, 17 nt, Salmonella enterica enterica serovar Typhi Ty2
caacgcgaccggauaac

SEQ ID NO: 3734818 - RNA, 17 nt, Salmonella enterica enterica serovar Typhi Ty2
caacgcgcaucaacgcc

SEQ ID NO: 3734819 - RNA, 21 nt, Salmonella enterica enterica serovar Typhi Ty2
caacgcugaauaucgucagua

SEQ ID NO: 3734820 - RNA, 15 nt, Salmonella enterica enterica serovar Typhi Ty2
caacgcuuccaccuc

SEQ ID NO: 3734821 - RNA, 16 nt, Salmonella enterica enterica serovar Typhi Ty2
caacggcacaacggcc

SEQ ID NO: 3734822 - RNA, 20 nt, Salmonella enterica enterica serovar Typhi Ty2
caacggccagcaaaaucacc

SEQ ID NO: 3734823 - RNA, 13 nt, Salmonella enterica enterica serovar Typhi Ty2
caacggcggauga

SEQ ID NO: 3734824 - RNA, 15 nt, Salmonella enterica enterica serovar Typhi Ty2
caacggcuugugagc

SEQ ID NO: 3734825 - RNA, 18 nt, Salmonella enterica enterica serovar Typhi Ty2
caacggucggucuuuuug

SEQ ID NO: 3734826 - RNA, 23 nt, Salmonella enterica enterica serovar Typhi Ty2
caacggucuuugccgagucgauc

SEQ ID NO: 3734827 - RNA, 14 nt, Salmonella enterica enterica serovar Typhi Ty2
caacgucagcaucu

SEQ ID NO: 3734828 - RNA, 12 nt, Salmonella enterica enterica serovar Typhi Ty2
caacgucauccc

SEQ ID NO: 3734829 - RNA, 15 nt, Salmonella enterica enterica serovar Typhi Ty2
caacguccgcagccg

SEQ ID NO: 3734830 - RNA, 20 nt, Salmonella enterica enterica serovar Typhi Ty2
caacgucgugccagugaugc

SEQ ID NO: 3734831 - RNA, 16 nt, Salmonella enterica enterica serovar Typhi Ty2
caacguuaacugcugc

SEQ ID NO: 3734832 - RNA, 20 nt, Salmonella enterica enterica serovar Typhi Ty2
caacguugaaaacggcguuu

SEQ ID NO: 3734833 - RNA, 15 nt, Salmonella enterica enterica serovar Typhi Ty2
caacguuucgcuauc

SEQ ID NO: 3734834 - RNA, 18 nt, Salmonella enterica enterica serovar Typhi Ty2
caacguuucuuucaucag

SEQ ID NO: 3734835 - RNA, 20 nt, Salmonella enterica enterica serovar Typhi Ty2
caacguuucuuucaucagau

SEQ ID NO: 3734836 - RNA, 22 nt, Salmonella enterica enterica serovar Typhi Ty2
caacguuucuuucaucagauca

SEQ ID NO: 3734837 - RNA, 14 nt, Salmonella enterica enterica serovar Typhi Ty2
caacuacacucuua

SEQ ID NO: 3734838 - RNA, 22 nt, Salmonella enterica enterica serovar Typhi Ty2
caacuacucguaaucuaaaauu

SEQ ID NO: 3734839 - RNA, 14 nt, Salmonella enterica enterica serovar Typhi Ty2
caacuccacaaaua

SEQ ID NO: 3734840 - RNA, 13 nt, Salmonella enterica enterica serovar Typhi Ty2
caacuccgccggc

SEQ ID NO: 3734841 - RNA, 13 nt, Salmonella enterica enterica serovar Typhi Ty2
caacucgcacuga

SEQ ID NO: 3734842 - RNA, 22 nt, Salmonella enterica enterica serovar Typhi Ty2
caacucgccgguuuuuuuacuc

SEQ ID NO: 3734843 - RNA, 19 nt, Salmonella enterica enterica serovar Typhi Ty2
caacucugugcguucgcga

SEQ ID NO: 3734844 - RNA, 20 nt, Salmonella enterica enterica serovar Typhi Ty2
caacucugugcguucgcgaa

SEQ ID NO: 3734845 - RNA, 19 nt, Salmonella enterica enterica serovar Typhi Ty2
caacugauuaaucugccga

SEQ ID NO: 3734846 - RNA, 17 nt, Salmonella enterica enterica serovar Typhi Ty2
caacugauucaaaaggu

SEQ ID NO: 3734847 - RNA, 21 nt, Salmonella enterica enterica serovar Typhi Ty2
caacugccaggcguguggcca

SEQ ID NO: 3734848 - RNA, 19 nt, Salmonella enterica enterica serovar Typhi Ty2
caacugcugcgcgugcugu

SEQ ID NO: 3734849 - RNA, 20 nt, Salmonella enterica enterica serovar Typhi Ty2
caacugcugcgcgugcugua

SEQ ID NO: 3734850 - RNA, 15 nt, Salmonella enterica enterica serovar Typhi Ty2
caacuggcgccggag

SEQ ID NO: 3734851 - RNA, 15 nt, Salmonella enterica enterica serovar Typhi Ty2
caacugggcuugcau

SEQ ID NO: 3734852 - RNA, 17 nt, Salmonella enterica enterica serovar Typhi Ty2
caacuguaccugaucca

SEQ ID NO: 3734853 - RNA, 17 nt, Salmonella enterica enterica serovar Typhi Ty2
caacuguucuucgguuu

SEQ ID NO: 3734854 - RNA, 16 nt, Salmonella enterica enterica serovar Typhi Ty2
caacuucaugaguaaa

SEQ ID NO: 3734855 - RNA, 18 nt, Salmonella enterica enterica serovar Typhi Ty2
caacuucaugaguaaaug

SEQ ID NO: 3734856 - RNA, 21 nt, Salmonella enterica enterica serovar Typhi Ty2
caacuucuaauuuuuccagca

SEQ ID NO: 3734857 - RNA, 19 nt, Salmonella enterica enterica serovar Typhi Ty2
caacuugaaguaugaaggg

SEQ ID NO: 3734858 - RNA, 20 nt, Salmonella enterica enterica serovar Typhi Ty2
caacuugaaguaugaagggu

SEQ ID NO: 3734859 - RNA, 23 nt, Salmonella enterica enterica serovar Typhi Ty2
caacuuguuuccuguucggggaa

SEQ ID NO: 3734860 - RNA, 20 nt, Salmonella enterica enterica serovar Typhi Ty2
caacuuuuucuuaagcugag

SEQ ID NO: 3734861 - RNA, 23 nt, Salmonella enterica enterica serovar Typhi Ty2
caagaaccgcuuuuccugcugcc

SEQ ID NO: 3734862 - RNA, 18 nt, Salmonella enterica enterica serovar Typhi Ty2
caagaagcguugaccgua

SEQ ID NO: 3734863 - RNA, 21 nt, Salmonella enterica enterica serovar Typhi Ty2
caagaagcguugaccguacug

SEQ ID NO: 3734864 - RNA, 18 nt, Salmonella enterica enterica serovar Typhi Ty2
caagaaguuccaccgucu

SEQ ID NO: 3734865 - RNA, 15 nt, Salmonella enterica enterica serovar Typhi Ty2
caagaauaugcagug

SEQ ID NO: 3734866 - RNA, 12 nt, Salmonella enterica enterica serovar Typhi Ty2
caagaaucaaua

SEQ ID NO: 3734867 - RNA, 19 nt, Salmonella enterica enterica serovar Typhi Ty2
caagaauuacaucaauaaa

SEQ ID NO: 3734868 - RNA, 16 nt, Salmonella enterica enterica serovar Typhi Ty2
caagaauuauuucagg

SEQ ID NO: 3734869 - RNA, 22 nt, Salmonella enterica enterica serovar Typhi Ty2
caagacacgcuuccagaugaag

SEQ ID NO: 3734870 - RNA, 17 nt, Salmonella enterica enterica serovar Typhi Ty2
caagacccgaaccugcg

SEQ ID NO: 3734871 - RNA, 21 nt, Salmonella enterica enterica serovar Typhi Ty2
caagaccgauagagacugccg

SEQ ID NO: 3734872 - RNA, 17 nt, Salmonella enterica enterica serovar Typhi Ty2
caagaccgccuaacagc

SEQ ID NO: 3734873 - RNA, 18 nt, Salmonella enterica enterica serovar Typhi Ty2
caagaccgccuaacagcg

SEQ ID NO: 3734874 - RNA, 16 nt, Salmonella enterica enterica serovar Typhi Ty2
caagaccgggcugcac

SEQ ID NO: 3734875 - RNA, 16 nt, Salmonella enterica enterica serovar Typhi Ty2
caagacgaaaaaugaa

SEQ ID NO: 3734876 - RNA, 14 nt, Salmonella enterica enterica serovar Typhi Ty2
caagagaaauaaca

SEQ ID NO: 3734877 - RNA, 19 nt, Salmonella enterica enterica serovar Typhi Ty2
caagagauucaggccgcca

SEQ ID NO: 3734878 - RNA, 15 nt, Salmonella enterica enterica serovar Typhi Ty2
caagagcagcaaccc

SEQ ID NO: 3734879 - RNA, 17 nt, Salmonella enterica enterica serovar Typhi Ty2
caagagcguccaguccu

SEQ ID NO: 3734880 - RNA, 24 nt, Salmonella enterica enterica serovar Typhi Ty2
caagagguaaugcccgauggcgcu

SEQ ID NO: 3734881 - RNA, 19 nt, Salmonella enterica enterica serovar Typhi Ty2
caagaucaaugugcucaac

SEQ ID NO: 3734882 - RNA, 20 nt, Salmonella enterica enterica serovar Typhi Ty2
caagaucacauacaaagaga

SEQ ID NO: 3734883 - RNA, 16 nt, Salmonella enterica enterica serovar Typhi Ty2
caagauccguccaugu

SEQ ID NO: 3734884 - RNA, 18 nt, Salmonella enterica enterica serovar Typhi Ty2
caagaucgcgcagcaggc

SEQ ID NO: 3734885 - RNA, 20 nt, Salmonella enterica enterica serovar Typhi Ty2
caagaucgguugaaccaucu

SEQ ID NO: 3734886 - RNA, 21 nt, Salmonella enterica enterica serovar Typhi Ty2
caagauuaagaccguauaaua

SEQ ID NO: 3734887 - RNA, 17 nt, Salmonella enterica enterica serovar Typhi Ty2
caagauuucaaaacccg

SEQ ID NO: 3734888 - RNA, 19 nt, Salmonella enterica enterica serovar Typhi Ty2
caagcaacuguagaaugcu

SEQ ID NO: 3734889 - RNA, 20 nt, Salmonella enterica enterica serovar Typhi Ty2
caagcaccuuauccggccua

SEQ ID NO: 3734890 - RNA, 15 nt, Salmonella enterica enterica serovar Typhi Ty2
caagcacugaaugcu

SEQ ID NO: 3734891 - RNA, 17 nt, Salmonella enterica enterica serovar Typhi Ty2
caagcacugaaugcuga

SEQ ID NO: 3734892 - RNA, 15 nt, Salmonella enterica enterica serovar Typhi Ty2
caagcagcauaauga

SEQ ID NO: 3734893 - RNA, 14 nt, Salmonella enterica enterica serovar Typhi Ty2
caauaccagggcga

SEQ ID NO: 3734894 - RNA, 14 nt, Salmonella enterica enterica serovar Typhi Ty2
caauacccagcgcc

SEQ ID NO: 3734895 - RNA, 19 nt, Salmonella enterica enterica serovar Typhi Ty2
caauacgcugaacuucggg

SEQ ID NO: 3734896 - RNA, 22 nt, Salmonella enterica enterica serovar Typhi Ty2
caauacuggaccccagauaaua

SEQ ID NO: 3734897 - RNA, 20 nt, Salmonella enterica enterica serovar Typhi Ty2
caauagaccugaaaucagcc

SEQ ID NO: 3734898 - RNA, 23 nt, Salmonella enterica enterica serovar Typhi Ty2
caauagaguaaugacaaaaauua

SEQ ID NO: 3734899 - RNA, 21 nt, Salmonella enterica enterica serovar Typhi Ty2
caauagagugcgauuugacau

SEQ ID NO: 3734900 - RNA, 17 nt, Salmonella enterica enterica serovar Typhi Ty2
caauagcaaucuguaac

SEQ ID NO: 3734901 - RNA, 19 nt, Salmonella enterica enterica serovar Typhi Ty2
caauagcagcuucacgcgc

SEQ ID NO: 3734902 - RNA, 18 nt, Salmonella enterica enterica serovar Typhi Ty2
caauagcgagaggcaauu

SEQ ID NO: 3734903 - RNA, 23 nt, Salmonella enterica enterica serovar Typhi Ty2
caauagcgcgucguugccuuugc

SEQ ID NO: 3734904 - RNA, 14 nt, Salmonella enterica enterica serovar Typhi Ty2
caauagcgcuaaac

SEQ ID NO: 3734905 - RNA, 15 nt, Salmonella enterica enterica serovar Typhi Ty2
caauagcgcuaaaca

SEQ ID NO: 3734906 - RNA, 19 nt, Salmonella enterica enterica serovar Typhi Ty2
caauagcuucaaugaucca

SEQ ID NO: 3734907 - RNA, 14 nt, Salmonella enterica enterica serovar Typhi Ty2
caauaguauccaua

SEQ ID NO: 3734908 - RNA, 19 nt, Salmonella enterica enterica serovar Typhi Ty2
caauaguauccauaauuuu

SEQ ID NO: 3734909 - RNA, 16 nt, Salmonella enterica enterica serovar Typhi Ty2
caauaguggacacaca

SEQ ID NO: 3734910 - RNA, 20 nt, Salmonella enterica enterica serovar Typhi Ty2
caauauaccgucaguaccag

SEQ ID NO: 3734911 - RNA, 12 nt, Salmonella enterica enterica serovar Typhi Ty2
caauauacuuau

SEQ ID NO: 3734912 - RNA, 16 nt, Salmonella enterica enterica serovar Typhi Ty2
caauauagaguccuga

SEQ ID NO: 3734913 - RNA, 14 nt, Salmonella enterica enterica serovar Typhi Ty2
caauauaugagcaa

SEQ ID NO: 3734914 - RNA, 18 nt, Salmonella enterica enterica serovar Typhi Ty2
caauaucaacgaccgucg

SEQ ID NO: 3734915 - RNA, 17 nt, Salmonella enterica enterica serovar Typhi Ty2
caauauccgccccgcug

SEQ ID NO: 3734916 - RNA, 12 nt, Salmonella enterica enterica serovar Typhi Ty2
caauauccuccg

SEQ ID NO: 3734917 - RNA, 13 nt, Salmonella enterica enterica serovar Typhi Ty2
caauauccuccgg

SEQ ID NO: 3734918 - RNA, 18 nt, Salmonella enterica enterica serovar Typhi Ty2
caauauccucgcauccuc

SEQ ID NO: 3734919 - RNA, 19 nt, Salmonella enterica enterica serovar Typhi Ty2
caauauccucgcauccucc

SEQ ID NO: 3734920 - RNA, 18 nt, Salmonella enterica enterica serovar Typhi Ty2
caauaugcgucagcgcgg

SEQ ID NO: 3734921 - RNA, 15 nt, Salmonella enterica enterica serovar Typhi Ty2
caauaugcuguuuau

SEQ ID NO: 3734922 - RNA, 16 nt, Salmonella enterica enterica serovar Typhi Ty2
caauaugcuguuuaug

SEQ ID NO: 3734923 - RNA, 21 nt, Salmonella enterica enterica serovar Typhi Ty2
caauaugcuguuuauggcgcu

SEQ ID NO: 3734924 - RNA, 22 nt, Salmonella enterica enterica serovar Typhi Ty2
caauaugguauucgugcaucag

SEQ ID NO: 3734925 - RNA, 18 nt, Salmonella enterica enterica serovar Typhi Ty2
caauaugucuuaaacagc

SEQ ID NO: 3734926 - RNA, 14 nt, Salmonella enterica enterica serovar Typhi Ty2
caauauguuccggc

SEQ ID NO: 3734927 - RNA, 15 nt, Salmonella enterica enterica serovar Typhi Ty2
caauauguuccggcg

SEQ ID NO: 3734928 - RNA, 15 nt, Salmonella enterica enterica serovar Typhi Ty2
caauauguuuaaaga

SEQ ID NO: 3734929 - RNA, 23 nt, Salmonella enterica enterica serovar Typhi Ty2
caauauguuuaaagaagaaagac

SEQ ID NO: 3734930 - RNA, 15 nt, Salmonella enterica enterica serovar Typhi Ty2
caauauuaaauaaau

SEQ ID NO: 3734931 - RNA, 14 nt, Salmonella enterica enterica serovar Typhi Ty2
caauauuaaaugac

SEQ ID NO: 3734932 - RNA, 20 nt, Salmonella enterica enterica serovar Typhi Ty2
caauauuaaugcugcguuua

SEQ ID NO: 3734933 - RNA, 20 nt, Salmonella enterica enterica serovar Typhi Ty2
caauauuacaaagcaguaaa

SEQ ID NO: 3734934 - RNA, 20 nt, Salmonella enterica enterica serovar Typhi Ty2
caauauuccgaaagaaagac

SEQ ID NO: 3734935 - RNA, 12 nt, Salmonella enterica enterica serovar Typhi Ty2
caauauuccugg

SEQ ID NO: 3734936 - RNA, 19 nt, Salmonella enterica enterica serovar Typhi Ty2
caauauugcugugcuauga

SEQ ID NO: 3734937 - RNA, 15 nt, Salmonella enterica enterica serovar Typhi Ty2
caaucacaaaauggc

SEQ ID NO: 3734938 - RNA, 19 nt, Salmonella enterica enterica serovar Typhi Ty2
caaucaccugcaucacgcc

SEQ ID NO: 3734939 - RNA, 22 nt, Salmonella enterica enterica serovar Typhi Ty2
caaucacgccgauaaugcguuu

SEQ ID NO: 3734940 - RNA, 15 nt, Salmonella enterica enterica serovar Typhi Ty2
caaucacguuauagc

SEQ ID NO: 3734941 - RNA, 19 nt, Salmonella enterica enterica serovar Typhi Ty2
caaucacugaugccacacc

SEQ ID NO: 3734942 - RNA, 13 nt, Salmonella enterica enterica serovar Typhi Ty2
caaucagcaccau

SEQ ID NO: 3734943 - RNA, 14 nt, Salmonella enterica enterica serovar Typhi Ty2
caaucagcaccauu

SEQ ID NO: 3734944 - RNA, 19 nt, Salmonella enterica enterica serovar Typhi Ty2
caaucagccccagcaccag

SEQ ID NO: 3734945 - RNA, 22 nt, Salmonella enterica enterica serovar Typhi Ty2
caaucaggcgcaaacgcgugcu

SEQ ID NO: 3734946 - RNA, 19 nt, Salmonella enterica enterica serovar Typhi Ty2
caaucaggcuugagcgaug

SEQ ID NO: 3734947 - RNA, 17 nt, Salmonella enterica enterica serovar Typhi Ty2
caaucagguauuuccug

SEQ ID NO: 3734948 - RNA, 20 nt, Salmonella enterica enterica serovar Typhi Ty2
caaucaguacgcgcgcggcg

SEQ ID NO: 3734949 - RNA, 15 nt, Salmonella enterica enterica serovar Typhi Ty2
caaucaguuccaauc

SEQ ID NO: 3734950 - RNA, 21 nt, Salmonella enterica enterica serovar Typhi Ty2
caaucauaaacgccugacgau

SEQ ID NO: 3734951 - RNA, 13 nt, Salmonella enterica enterica serovar Typhi Ty2
caaucauaauaaa

SEQ ID NO: 3734952 - RNA, 14 nt, Salmonella enterica enterica serovar Typhi Ty2
caaucaucagaaga

SEQ ID NO: 3734953 - RNA, 13 nt, Salmonella enterica enterica serovar Typhi Ty2
caaucauccugau

SEQ ID NO: 3734954 - RNA, 18 nt, Salmonella enterica enterica serovar Typhi Ty2
caauccaacgaaacucag

SEQ ID NO: 3734955 - RNA, 17 nt, Salmonella enterica enterica serovar Typhi Ty2
caauccacggguuacaa

SEQ ID NO: 3734956 - RNA, 14 nt, Salmonella enterica enterica serovar Typhi Ty2
caauccaugccggc

SEQ ID NO: 3734957 - RNA, 19 nt, Salmonella enterica enterica serovar Typhi Ty2
caauccauuaauggcgcaa

SEQ ID NO: 3734958 - RNA, 13 nt, Salmonella enterica enterica serovar Typhi Ty2
caauccuggcuuc

SEQ ID NO: 3734959 - RNA, 23 nt, Salmonella enterica enterica serovar Typhi Ty2
caauccugucgucaccagcaggu

SEQ ID NO: 3734960 - RNA, 20 nt, Salmonella enterica enterica serovar Typhi Ty2
caauccuucuaccuucaccc

SEQ ID NO: 3734961 - RNA, 19 nt, Salmonella enterica enterica serovar Typhi Ty2
caaucgacaaaacacggcu

SEQ ID NO: 3734962 - RNA, 15 nt, Salmonella enterica enterica serovar Typhi Ty2
caaucgccugcugua

SEQ ID NO: 3734963 - RNA, 17 nt, Salmonella enterica enterica serovar Typhi Ty2
caaucgcgcccgccauc

SEQ ID NO: 3734964 - RNA, 21 nt, Salmonella enterica enterica serovar Typhi Ty2
caaucgcggcgacaucgccaa

SEQ ID NO: 3734965 - RNA, 13 nt, Salmonella enterica enterica serovar Typhi Ty2
caaucgcgguaug

SEQ ID NO: 3734966 - RNA, 14 nt, Salmonella enterica enterica serovar Typhi Ty2
caaucgcguuuucc

SEQ ID NO: 3734967 - RNA, 20 nt, Salmonella enterica enterica serovar Typhi Ty2
caaucgcuuccagcgccggu

SEQ ID NO: 3734968 - RNA, 21 nt, Salmonella enterica enterica serovar Typhi Ty2
caaucggcgucuggagcgugc

SEQ ID NO: 3734969 - RNA, 18 nt, Salmonella enterica enterica serovar Typhi Ty2
caaucgucguuccgccag

SEQ ID NO: 3734970 - RNA, 19 nt, Salmonella enterica enterica serovar Typhi Ty2
caaucguuaauucauggcc

SEQ ID NO: 3734971 - RNA, 17 nt, Salmonella enterica enterica serovar Typhi Ty2
caaucguuggcguauua

SEQ ID NO: 3734972 - RNA, 12 nt, Salmonella enterica enterica serovar Typhi Ty2
caaucuacuuuu

SEQ ID NO: 3734973 - RNA, 15 nt, Salmonella enterica enterica serovar Typhi Ty2
caaucucaauaccac

SEQ ID NO: 3734974 - RNA, 15 nt, Salmonella enterica enterica serovar Typhi Ty2
caaucucacugccca

SEQ ID NO: 3734975 - RNA, 17 nt, Salmonella enterica enterica serovar Typhi Ty2
cacagccccagcaccaa

SEQ ID NO: 3734976 - RNA, 19 nt, Salmonella enterica enterica serovar Typhi Ty2
cacagccgcauuuuuucuu

SEQ ID NO: 3734977 - RNA, 13 nt, Salmonella enterica enterica serovar Typhi Ty2
cacagccuuauaa

SEQ ID NO: 3734978 - RNA, 19 nt, Salmonella enterica enterica serovar Typhi Ty2
cacagccuuauaagaacca

SEQ ID NO: 3734979 - RNA, 14 nt, Salmonella enterica enterica serovar Typhi Ty2
cacagcgcgcgaca

SEQ ID NO: 3734980 - RNA, 19 nt, Salmonella enterica enterica serovar Typhi Ty2
cacagcgcuuuaguacgcg

SEQ ID NO: 3734981 - RNA, 21 nt, Salmonella enterica enterica serovar Typhi Ty2
cacagcggacacccgcagcca

SEQ ID NO: 3734982 - RNA, 21 nt, Salmonella enterica enterica serovar Typhi Ty2
cacagcguacaauggcaggca

SEQ ID NO: 3734983 - RNA, 23 nt, Salmonella enterica enterica serovar Typhi Ty2
cacagcguaggccaggcauccgg

SEQ ID NO: 3734984 - RNA, 15 nt, Salmonella enterica enterica serovar Typhi Ty2
cacagcgucgcgcga

SEQ ID NO: 3734985 - RNA, 21 nt, Salmonella enterica enterica serovar Typhi Ty2
cacagcuugccguagcgcgcu

SEQ ID NO: 3734986 - RNA, 13 nt, Salmonella enterica enterica serovar Typhi Ty2
cacaggaaccggu

SEQ ID NO: 3734987 - RNA, 13 nt, Salmonella enterica enterica serovar Typhi Ty2
cacaggccaacau

SEQ ID NO: 3734988 - RNA, 12 nt, Salmonella enterica enterica serovar Typhi Ty2
cacaggcggcca

SEQ ID NO: 3734989 - RNA, 19 nt, Salmonella enterica enterica serovar Typhi Ty2
cacaggcggcgguucaacc

SEQ ID NO: 3734990 - RNA, 13 nt, Salmonella enterica enterica serovar Typhi Ty2
cacaggcuuauac

SEQ ID NO: 3734991 - RNA, 21 nt, Salmonella enterica enterica serovar Typhi Ty2
cacagguacaggccgccgccu

SEQ ID NO: 3734992 - RNA, 13 nt, Salmonella enterica enterica serovar Typhi Ty2
cacagguuaucgc

SEQ ID NO: 3734993 - RNA, 19 nt, Salmonella enterica enterica serovar Typhi Ty2
cacaguaaccccauacagu

SEQ ID NO: 3734994 - RNA, 19 nt, Salmonella enterica enterica serovar Typhi Ty2
cacaguaauggacagguaa

SEQ ID NO: 3734995 - RNA, 19 nt, Salmonella enterica enterica serovar Typhi Ty2
cacaguacaccugcagguu

SEQ ID NO: 3734996 - RNA, 12 nt, Salmonella enterica enterica serovar Typhi Ty2
cacaguacgccc

SEQ ID NO: 3734997 - RNA, 19 nt, Salmonella enterica enterica serovar Typhi Ty2
cacaguauuccggcaucgu

SEQ ID NO: 3734998 - RNA, 16 nt, Salmonella enterica enterica serovar Typhi Ty2
cacagucaucgcgcca

SEQ ID NO: 3734999 - RNA, 16 nt, Salmonella enterica enterica serovar Typhi Ty2
cacaguugccuucgau

SEQ ID NO: 3735000 - RNA, 15 nt, Salmonella enterica enterica serovar Typhi Ty2
cacauaacaaaacca

SEQ ID NO: 3735001 - RNA, 18 nt, Salmonella enterica enterica serovar Typhi Ty2
cacauaacaaaaccagca

SEQ ID NO: 3735002 - RNA, 12 nt, Salmonella enterica enterica serovar Typhi Ty2
cacauaacugag

SEQ ID NO: 3735003 - RNA, 17 nt, Salmonella enterica enterica serovar Typhi Ty2
cacauaagcacaccauu

SEQ ID NO: 3735004 - RNA, 17 nt, Salmonella enterica enterica serovar Typhi Ty2
cacauacagcacuuccc

SEQ ID NO: 3735005 - RNA, 23 nt, Salmonella enterica enterica serovar Typhi Ty2
cacauaucgcaauugauacauuu

SEQ ID NO: 3735006 - RNA, 17 nt, Salmonella enterica enterica serovar Typhi Ty2
cacauaucgccagccau

SEQ ID NO: 3735007 - RNA, 21 nt, Salmonella enterica enterica serovar Typhi Ty2
cacaucaaagccccauaaccg

SEQ ID NO: 3735008 - RNA, 20 nt, Salmonella enterica enterica serovar Typhi Ty2
cacaucagccaacuuuuucu

SEQ ID NO: 3735009 - RNA, 16 nt, Salmonella enterica enterica serovar Typhi Ty2
cacaucaggaaugcca

SEQ ID NO: 3735010 - RNA, 14 nt, Salmonella enterica enterica serovar Typhi Ty2
cacauccaccccgg

SEQ ID NO: 3735011 - RNA, 13 nt, Salmonella enterica enterica serovar Typhi Ty2
cacauccagcccc

SEQ ID NO: 3735012 - RNA, 15 nt, Salmonella enterica enterica serovar Typhi Ty2
cacauccgccagcgc

SEQ ID NO: 3735013 - RNA, 17 nt, Salmonella enterica enterica serovar Typhi Ty2
cacauccgccagcgccu

SEQ ID NO: 3735014 - RNA, 20 nt, Salmonella enterica enterica serovar Typhi Ty2
cacaucgacaugcagaucgc

SEQ ID NO: 3735015 - RNA, 20 nt, Salmonella enterica enterica serovar Typhi Ty2
cacaucgccauuaaaagcca

SEQ ID NO: 3735016 - RNA, 15 nt, Salmonella enterica enterica serovar Typhi Ty2
cacaucgccguucca

SEQ ID NO: 3735017 - RNA, 16 nt, Salmonella enterica enterica serovar Typhi Ty2
cacaucgugcgccauu

SEQ ID NO: 3735018 - RNA, 15 nt, Salmonella enterica enterica serovar Typhi Ty2
cacaucuacucauau

SEQ ID NO: 3735019 - RNA, 21 nt, Salmonella enterica enterica serovar Typhi Ty2
cacaucuacucauaugcggau

SEQ ID NO: 3735020 - RNA, 14 nt, Salmonella enterica enterica serovar Typhi Ty2
cacaugaccagcgc

SEQ ID NO: 3735021 - RNA, 15 nt, Salmonella enterica enterica serovar Typhi Ty2
cacaugaccagcgcc

SEQ ID NO: 3735022 - RNA, 15 nt, Salmonella enterica enterica serovar Typhi Ty2
cacaugaccugaaua

SEQ ID NO: 3735023 - RNA, 14 nt, Salmonella enterica enterica serovar Typhi Ty2
cacaugagaagggc

SEQ ID NO: 3735024 - RNA, 12 nt, Salmonella enterica enterica serovar Typhi Ty2
cacaugggcagg

SEQ ID NO: 3735025 - RNA, 21 nt, Salmonella enterica enterica serovar Typhi Ty2
cacauucagagcguccacgcc

SEQ ID NO: 3735026 - RNA, 23 nt, Salmonella enterica enterica serovar Typhi Ty2
cacauucagcagcgcccagccaa

SEQ ID NO: 3735027 - RNA, 14 nt, Salmonella enterica enterica serovar Typhi Ty2
cacauugagcgaga

SEQ ID NO: 3735028 - RNA, 12 nt, Salmonella enterica enterica serovar Typhi Ty2
cacauuggcaaa

SEQ ID NO: 3735029 - RNA, 16 nt, Salmonella enterica enterica serovar Typhi Ty2
cacauuguaugcaaga

SEQ ID NO: 3735030 - RNA, 15 nt, Salmonella enterica enterica serovar Typhi Ty2
cacauuucaaacguu

SEQ ID NO: 3735031 - RNA, 19 nt, Salmonella enterica enterica serovar Typhi Ty2
cacauuucuuuugaucguc

SEQ ID NO: 3735032 - RNA, 14 nt, Salmonella enterica enterica serovar Typhi Ty2
cacauuuucaaugc

SEQ ID NO: 3735033 - RNA, 10 nt, Salmonella enterica enterica serovar Typhi Ty2
caccaaaaac

SEQ ID NO: 3735034 - RNA, 12 nt, Salmonella enterica enterica serovar Typhi Ty2
caccaaaaagcc

SEQ ID NO: 3735035 - RNA, 17 nt, Salmonella enterica enterica serovar Typhi Ty2
caccaaaaauucuuuua

SEQ ID NO: 3735036 - RNA, 15 nt, Salmonella enterica enterica serovar Typhi Ty2
caccaaaucccccaa

SEQ ID NO: 3735037 - RNA, 21 nt, Salmonella enterica enterica serovar Typhi Ty2
caccaacggcgacgcccgcca

SEQ ID NO: 3735038 - RNA, 13 nt, Salmonella enterica enterica serovar Typhi Ty2
caccaacugcuga

SEQ ID NO: 3735039 - RNA, 16 nt, Salmonella enterica enterica serovar Typhi Ty2
caccaaguagacagag

SEQ ID NO: 3735040 - RNA, 17 nt, Salmonella enterica enterica serovar Typhi Ty2
caccaauacgugagcga

SEQ ID NO: 3735041 - RNA, 22 nt, Salmonella enterica enterica serovar Typhi Ty2
caccaauacgugagcgaaguuc

SEQ ID NO: 3735042 - RNA, 22 nt, Salmonella enterica enterica serovar Typhi Ty2
caccaaugucauauuugugagc

SEQ ID NO: 3735043 - RNA, 12 nt, Salmonella enterica enterica serovar Typhi Ty2
caccaauugcca

SEQ ID NO: 3735044 - RNA, 14 nt, Salmonella enterica enterica serovar Typhi Ty2
caccacaaaggcgc

SEQ ID NO: 3735045 - RNA, 18 nt, Salmonella enterica enterica serovar Typhi Ty2
caccaccaguacauggcu

SEQ ID NO: 3735046 - RNA, 22 nt, Salmonella enterica enterica serovar Typhi Ty2
caccacccguucgaaugagaac

SEQ ID NO: 3735047 - RNA, 16 nt, Salmonella enterica enterica serovar Typhi Ty2
caccaccgcaggcagc

SEQ ID NO: 3735048 - RNA, 13 nt, Salmonella enterica enterica serovar Typhi Ty2
caccaccgccacu

SEQ ID NO: 3735049 - RNA, 16 nt, Salmonella enterica enterica serovar Typhi Ty2
caccaccgccacuucc

SEQ ID NO: 3735050 - RNA, 18 nt, Salmonella enterica enterica serovar Typhi Ty2
caccaccgguuugucgcu

SEQ ID NO: 3735051 - RNA, 14 nt, Salmonella enterica enterica serovar Typhi Ty2
caccaccucaaacg

SEQ ID NO: 3735052 - RNA, 15 nt, Salmonella enterica enterica serovar Typhi Ty2
caccaccuccugcug

SEQ ID NO: 3735053 - RNA, 21 nt, Salmonella enterica enterica serovar Typhi Ty2
caccacgaucuugucacaaua

SEQ ID NO: 3735054 - RNA, 13 nt, Salmonella enterica enterica serovar Typhi Ty2
caccacgcacagu

SEQ ID NO: 3735055 - RNA, 15 nt, Salmonella enterica enterica serovar Typhi Ty2
caccacgccgagaaa

SEQ ID NO: 3735056 - RNA, 19 nt, Salmonella enterica enterica serovar Typhi Ty2
caccacgccuaaugaagcg

SEQ ID NO: 3735057 - RNA, 11 nt, Salmonella enterica enterica serovar Typhi Ty2
caccacgcggg

SEQ ID NO: 3735058 - RNA, 15 nt, Salmonella enterica enterica serovar Typhi Ty2
cacccgcagccagaa

SEQ ID NO: 3735059 - RNA, 12 nt, Salmonella enterica enterica serovar Typhi Ty2
cacccgccggca

SEQ ID NO: 3735060 - RNA, 16 nt, Salmonella enterica enterica serovar Typhi Ty2
cacccgcuuccagcgc

SEQ ID NO: 3735061 - RNA, 13 nt, Salmonella enterica enterica serovar Typhi Ty2
cacccuauaagcu

SEQ ID NO: 3735062 - RNA, 11 nt, Salmonella enterica enterica serovar Typhi Ty2
cacccucugcg

SEQ ID NO: 3735063 - RNA, 12 nt, Salmonella enterica enterica serovar Typhi Ty2
cacccugccccg

SEQ ID NO: 3735064 - RNA, 22 nt, Salmonella enterica enterica serovar Typhi Ty2
cacccuucuucuggcucagacc

SEQ ID NO: 3735065 - RNA, 14 nt, Salmonella enterica enterica serovar Typhi Ty2
caccgacagguuaa

SEQ ID NO: 3735066 - RNA, 15 nt, Salmonella enterica enterica serovar Typhi Ty2
caccgaccugccuug

SEQ ID NO: 3735067 - RNA, 12 nt, Salmonella enterica enterica serovar Typhi Ty2
caccgacuccuc

SEQ ID NO: 3735068 - RNA, 11 nt, Salmonella enterica enterica serovar Typhi Ty2
caccgauaaac

SEQ ID NO: 3735069 - RNA, 14 nt, Salmonella enterica enterica serovar Typhi Ty2
caccgcacgggcaa

SEQ ID NO: 3735070 - RNA, 15 nt, Salmonella enterica enterica serovar Typhi Ty2
caccgcaggcagcgg

SEQ ID NO: 3735071 - RNA, 15 nt, Salmonella enterica enterica serovar Typhi Ty2
caccgcauccgcauc

SEQ ID NO: 3735072 - RNA, 13 nt, Salmonella enterica enterica serovar Typhi Ty2
caccgcaucggca

SEQ ID NO: 3735073 - RNA, 12 nt, Salmonella enterica enterica serovar Typhi Ty2
caccgcauggcu

SEQ ID NO: 3735074 - RNA, 18 nt, Salmonella enterica enterica serovar Typhi Ty2
caccgccaaccgcccguc

SEQ ID NO: 3735075 - RNA, 18 nt, Salmonella enterica enterica serovar Typhi Ty2
caccgccaccugcccuuu

SEQ ID NO: 3735076 - RNA, 18 nt, Salmonella enterica enterica serovar Typhi Ty2
caccgccacuuccgcuac

SEQ ID NO: 3735077 - RNA, 13 nt, Salmonella enterica enterica serovar Typhi Ty2
caccgccagacgc

SEQ ID NO: 3735078 - RNA, 18 nt, Salmonella enterica enterica serovar Typhi Ty2
caccgccagacgccccaa

SEQ ID NO: 3735079 - RNA, 13 nt, Salmonella enterica enterica serovar Typhi Ty2
caccgccagagca

SEQ ID NO: 3735080 - RNA, 15 nt, Salmonella enterica enterica serovar Typhi Ty2
caccgccagagcacg

SEQ ID NO: 3735081 - RNA, 13 nt, Salmonella enterica enterica serovar Typhi Ty2
caccgccagcagu

SEQ ID NO: 3735082 - RNA, 16 nt, Salmonella enterica enterica serovar Typhi Ty2
caccgccagcgccgcg

SEQ ID NO: 3735083 - RNA, 16 nt, Salmonella enterica enterica serovar Typhi Ty2
caccgccagcgucugu

SEQ ID NO: 3735084 - RNA, 18 nt, Salmonella enterica enterica serovar Typhi Ty2
caccgccgccaccaaaaa

SEQ ID NO: 3735085 - RNA, 17 nt, Salmonella enterica enterica serovar Typhi Ty2
caccgccgcgauagacc

SEQ ID NO: 3735086 - RNA, 12 nt, Salmonella enterica enterica serovar Typhi Ty2
caccgccgggcu

SEQ ID NO: 3735087 - RNA, 20 nt, Salmonella enterica enterica serovar Typhi Ty2
caccgcgaugaccaucaaau

SEQ ID NO: 3735088 - RNA, 14 nt, Salmonella enterica enterica serovar Typhi Ty2
caccgcgaugcugc

SEQ ID NO: 3735089 - RNA, 20 nt, Salmonella enterica enterica serovar Typhi Ty2
caccgcggagaucgcucccg

SEQ ID NO: 3735090 - RNA, 22 nt, Salmonella enterica enterica serovar Typhi Ty2
caccgcggagaucgcucccgcg

SEQ ID NO: 3735091 - RNA, 18 nt, Salmonella enterica enterica serovar Typhi Ty2
caccgcggcaaccagccc

SEQ ID NO: 3735092 - RNA, 20 nt, Salmonella enterica enterica serovar Typhi Ty2
caccgcggcaaccagcccau

SEQ ID NO: 3735093 - RNA, 21 nt, Salmonella enterica enterica serovar Typhi Ty2
caccgcggcgcucgccagccc

SEQ ID NO: 3735094 - RNA, 22 nt, Salmonella enterica enterica serovar Typhi Ty2
caccgcgucguuacgcucguca

SEQ ID NO: 3735095 - RNA, 23 nt, Salmonella enterica enterica serovar Typhi Ty2
caccgcuaaucccagcgcgcgcg

SEQ ID NO: 3735096 - RNA, 20 nt, Salmonella enterica enterica serovar Typhi Ty2
caccgcuacaauccaggacg

SEQ ID NO: 3735097 - RNA, 18 nt, Salmonella enterica enterica serovar Typhi Ty2
caccgcucguucgauagc

SEQ ID NO: 3735098 - RNA, 20 nt, Salmonella enterica enterica serovar Typhi Ty2
caccgcugcgcucacgcggc

SEQ ID NO: 3735099 - RNA, 19 nt, Salmonella enterica enterica serovar Typhi Ty2
caccgcuucacauacccgc

SEQ ID NO: 3735100 - RNA, 19 nt, Salmonella enterica enterica serovar Typhi Ty2
caccgcuugccggcgcagc

SEQ ID NO: 3735101 - RNA, 20 nt, Salmonella enterica enterica serovar Typhi Ty2
caccgcuugccggcgcagcg

SEQ ID NO: 3735102 - RNA, 14 nt, Salmonella enterica enterica serovar Typhi Ty2
caccggacauccca

SEQ ID NO: 3735103 - RNA, 16 nt, Salmonella enterica enterica serovar Typhi Ty2
caccggaccgccgagu

SEQ ID NO: 3735104 - RNA, 15 nt, Salmonella enterica enterica serovar Typhi Ty2
caccggaguuaccau

SEQ ID NO: 3735105 - RNA, 14 nt, Salmonella enterica enterica serovar Typhi Ty2
caccggauacccag

SEQ ID NO: 3735106 - RNA, 14 nt, Salmonella enterica enterica serovar Typhi Ty2
caccggaugcgcag

SEQ ID NO: 3735107 - RNA, 18 nt, Salmonella enterica enterica serovar Typhi Ty2
caccggcuguauacacuu

SEQ ID NO: 3735108 - RNA, 18 nt, Salmonella enterica enterica serovar Typhi Ty2
caccgggagaaaacgcgg

SEQ ID NO: 3735109 - RNA, 21 nt, Salmonella enterica enterica serovar Typhi Ty2
caccgggagaaaacgcggccu

SEQ ID NO: 3735110 - RNA, 15 nt, Salmonella enterica enterica serovar Typhi Ty2
caccgggccaaugcc

SEQ ID NO: 3735111 - RNA, 14 nt, Salmonella enterica enterica serovar Typhi Ty2
caccgggccaccga

SEQ ID NO: 3735112 - RNA, 20 nt, Salmonella enterica enterica serovar Typhi Ty2
caccggguccagucgcgccg

SEQ ID NO: 3735113 - RNA, 18 nt, Salmonella enterica enterica serovar Typhi Ty2
caccggguuaaagcccug

SEQ ID NO: 3735114 - RNA, 22 nt, Salmonella enterica enterica serovar Typhi Ty2
caccgguacacacgcgcugacc

SEQ ID NO: 3735115 - RNA, 23 nt, Salmonella enterica enterica serovar Typhi Ty2
caccgguaucgaucacgcgcagg

SEQ ID NO: 3735116 - RNA, 22 nt, Salmonella enterica enterica serovar Typhi Ty2
caccgguuuuuccgcuucaccu

SEQ ID NO: 3735117 - RNA, 19 nt, Salmonella enterica enterica serovar Typhi Ty2
caccguaaaaggaaucaac

SEQ ID NO: 3735118 - RNA, 19 nt, Salmonella enterica enterica serovar Typhi Ty2
caccgucgcggcaucguag

SEQ ID NO: 3735119 - RNA, 16 nt, Salmonella enterica enterica serovar Typhi Ty2
caccgucuaucgugga

SEQ ID NO: 3735120 - RNA, 15 nt, Salmonella enterica enterica serovar Typhi Ty2
caccgucuccggcgc

SEQ ID NO: 3735121 - RNA, 23 nt, Salmonella enterica enterica serovar Typhi Ty2
caccguuacaaauagcggcacag

SEQ ID NO: 3735122 - RNA, 13 nt, Salmonella enterica enterica serovar Typhi Ty2
caccguuauccgg

SEQ ID NO: 3735123 - RNA, 23 nt, Salmonella enterica enterica serovar Typhi Ty2
caccguugggcgcgacgccuggg

SEQ ID NO: 3735124 - RNA, 19 nt, Salmonella enterica enterica serovar Typhi Ty2
caccguuuaaucgcccugc

SEQ ID NO: 3735125 - RNA, 20 nt, Salmonella enterica enterica serovar Typhi Ty2
caccguuuaaucgcccugcg

SEQ ID NO: 3735126 - RNA, 14 nt, Salmonella enterica enterica serovar Typhi Ty2
caccguuuuccagg

SEQ ID NO: 3735127 - RNA, 16 nt, Salmonella enterica enterica serovar Typhi Ty2
caccuaugcggauaaa

SEQ ID NO: 3735128 - RNA, 16 nt, Salmonella enterica enterica serovar Typhi Ty2
caccucacuccagacc

SEQ ID NO: 3735129 - RNA, 20 nt, Salmonella enterica enterica serovar Typhi Ty2
caccucagaauucugcgcgu

SEQ ID NO: 3735130 - RNA, 13 nt, Salmonella enterica enterica serovar Typhi Ty2
caccucagccaac

SEQ ID NO: 3735131 - RNA, 16 nt, Salmonella enterica enterica serovar Typhi Ty2
caccucagccacccac

SEQ ID NO: 3735132 - RNA, 20 nt, Salmonella enterica enterica serovar Typhi Ty2
caccucagguaaauccgcca

SEQ ID NO: 3735133 - RNA, 12 nt, Salmonella enterica enterica serovar Typhi Ty2
caccucauauuu

SEQ ID NO: 3735134 - RNA, 17 nt, Salmonella enterica enterica serovar Typhi Ty2
caccucaucacccaguc

SEQ ID NO: 3735135 - RNA, 12 nt, Salmonella enterica enterica serovar Typhi Ty2
caccuccagcgc

SEQ ID NO: 3735136 - RNA, 16 nt, Salmonella enterica enterica serovar Typhi Ty2
caccuccagcgccugu

SEQ ID NO: 3735137 - RNA, 17 nt, Salmonella enterica enterica serovar Typhi Ty2
caccucguucaaacaga

SEQ ID NO: 3735138 - RNA, 16 nt, Salmonella enterica enterica serovar Typhi Ty2
caccucuuuaugcggc

SEQ ID NO: 3735139 - RNA, 23 nt, Salmonella enterica enterica serovar Typhi Ty2
caccucuuuaugcggcgcuucca

SEQ ID NO: 3735140 - RNA, 21 nt, Salmonella enterica enterica serovar Typhi Ty2
cacgccggaaucgcgauccag

SEQ ID NO: 3735141 - RNA, 21 nt, Salmonella enterica enterica serovar Typhi Ty2
cacgccguagcugcgcgccgc

SEQ ID NO: 3735142 - RNA, 14 nt, Salmonella enterica enterica serovar Typhi Ty2
cacgccguccagca

SEQ ID NO: 3735143 - RNA, 20 nt, Salmonella enterica enterica serovar Typhi Ty2
cacgccguccagcaccaccu

SEQ ID NO: 3735144 - RNA, 20 nt, Salmonella enterica enterica serovar Typhi Ty2
cacgccgugaauuucugcug

SEQ ID NO: 3735145 - RNA, 21 nt, Salmonella enterica enterica serovar Typhi Ty2
cacgccgugaauuucugcugc

SEQ ID NO: 3735146 - RNA, 17 nt, Salmonella enterica enterica serovar Typhi Ty2
cacgccuaaugaagcgc

SEQ ID NO: 3735147 - RNA, 22 nt, Salmonella enterica enterica serovar Typhi Ty2
cacgccucuggcguacgcagau

SEQ ID NO: 3735148 - RNA, 14 nt, Salmonella enterica enterica serovar Typhi Ty2
cacgccugcuucac

SEQ ID NO: 3735149 - RNA, 14 nt, Salmonella enterica enterica serovar Typhi Ty2
cacgccuuccucca

SEQ ID NO: 3735150 - RNA, 17 nt, Salmonella enterica enterica serovar Typhi Ty2
cacgccuuccuccagca

SEQ ID NO: 3735151 - RNA, 13 nt, Salmonella enterica enterica serovar Typhi Ty2
cacgcgaauagcc

SEQ ID NO: 3735152 - RNA, 16 nt, Salmonella enterica enterica serovar Typhi Ty2
cacgcgacggcccaac

SEQ ID NO: 3735153 - RNA, 18 nt, Salmonella enterica enterica serovar Typhi Ty2
cacgcgaugagcugcgau

SEQ ID NO: 3735154 - RNA, 16 nt, Salmonella enterica enterica serovar Typhi Ty2
cacgcgccagcaccac

SEQ ID NO: 3735155 - RNA, 14 nt, Salmonella enterica enterica serovar Typhi Ty2
cacgcgccagccgu

SEQ ID NO: 3735156 - RNA, 19 nt, Salmonella enterica enterica serovar Typhi Ty2
cacgcgcgcugcgccugga

SEQ ID NO: 3735157 - RNA, 20 nt, Salmonella enterica enterica serovar Typhi Ty2
cacgcgcgcugcgccuggaa

SEQ ID NO: 3735158 - RNA, 22 nt, Salmonella enterica enterica serovar Typhi Ty2
cacgcgcgcuuuucgccagcgc

SEQ ID NO: 3735159 - RNA, 19 nt, Salmonella enterica enterica serovar Typhi Ty2
cacgcgcggcuacugccag

SEQ ID NO: 3735160 - RNA, 14 nt, Salmonella enterica enterica serovar Typhi Ty2
cacgcggcaucagg

SEQ ID NO: 3735161 - RNA, 16 nt, Salmonella enterica enterica serovar Typhi Ty2
cacgcggcaucaggca

SEQ ID NO: 3735162 - RNA, 14 nt, Salmonella enterica enterica serovar Typhi Ty2
cacgcggcgcggaa

SEQ ID NO: 3735163 - RNA, 20 nt, Salmonella enterica enterica serovar Typhi Ty2
cacgcggucgucaucggcga

SEQ ID NO: 3735164 - RNA, 19 nt, Salmonella enterica enterica serovar Typhi Ty2
cacgcguucaauauucgcg

SEQ ID NO: 3735165 - RNA, 18 nt, Salmonella enterica enterica serovar Typhi Ty2
cacgcguucgcucgguga

SEQ ID NO: 3735166 - RNA, 16 nt, Salmonella enterica enterica serovar Typhi Ty2
cacgcuaaucccgcuc

SEQ ID NO: 3735167 - RNA, 20 nt, Salmonella enterica enterica serovar Typhi Ty2
cacgcuauaaaguagccauu

SEQ ID NO: 3735168 - RNA, 22 nt, Salmonella enterica enterica serovar Typhi Ty2
cacgcucaagaugauagccauu

SEQ ID NO: 3735169 - RNA, 14 nt, Salmonella enterica enterica serovar Typhi Ty2
cacgcucacgcaga

SEQ ID NO: 3735170 - RNA, 20 nt, Salmonella enterica enterica serovar Typhi Ty2
cacgcuccugcuccugcggc

SEQ ID NO: 3735171 - RNA, 15 nt, Salmonella enterica enterica serovar Typhi Ty2
cacgcucgaguucuu

SEQ ID NO: 3735172 - RNA, 18 nt, Salmonella enterica enterica serovar Typhi Ty2
cacgcucgaguucuucac

SEQ ID NO: 3735173 - RNA, 19 nt, Salmonella enterica enterica serovar Typhi Ty2
cacgcucgcggaagcgacc

SEQ ID NO: 3735174 - RNA, 15 nt, Salmonella enterica enterica serovar Typhi Ty2
cacgcucgcuggugc

SEQ ID NO: 3735175 - RNA, 16 nt, Salmonella enterica enterica serovar Typhi Ty2
cacgcugaaaacggca

SEQ ID NO: 3735176 - RNA, 21 nt, Salmonella enterica enterica serovar Typhi Ty2
cacgcugacaggauacccggc

SEQ ID NO: 3735177 - RNA, 18 nt, Salmonella enterica enterica serovar Typhi Ty2
cacgcugaccacgccgcc

SEQ ID NO: 3735178 - RNA, 19 nt, Salmonella enterica enterica serovar Typhi Ty2
cacgcugaccacgccgccg

SEQ ID NO: 3735179 - RNA, 20 nt, Salmonella enterica enterica serovar Typhi Ty2
cacgcugaccacgccgccgc

SEQ ID NO: 3735180 - RNA, 17 nt, Salmonella enterica enterica serovar Typhi Ty2
cacgcugaccuuuuuca

SEQ ID NO: 3735181 - RNA, 16 nt, Salmonella enterica enterica serovar Typhi Ty2
cacgcugccgccgcuc

SEQ ID NO: 3735182 - RNA, 15 nt, Salmonella enterica enterica serovar Typhi Ty2
cacgcuggcaucaau

SEQ ID NO: 3735183 - RNA, 12 nt, Salmonella enterica enterica serovar Typhi Ty2
cacgcuggugcu

SEQ ID NO: 3735184 - RNA, 13 nt, Salmonella enterica enterica serovar Typhi Ty2
cacgcuguuuauu

SEQ ID NO: 3735185 - RNA, 14 nt, Salmonella enterica enterica serovar Typhi Ty2
cacgcuucgccugu

SEQ ID NO: 3735186 - RNA, 19 nt, Salmonella enterica enterica serovar Typhi Ty2
cacggaacaacggcacaca

SEQ ID NO: 3735187 - RNA, 20 nt, Salmonella enterica enterica serovar Typhi Ty2
cacggaauccccggcuucca

SEQ ID NO: 3735188 - RNA, 23 nt, Salmonella enterica enterica serovar Typhi Ty2
cacggaauccccggcuuccagcg

SEQ ID NO: 3735189 - RNA, 14 nt, Salmonella enterica enterica serovar Typhi Ty2
cacggacucgccuu

SEQ ID NO: 3735190 - RNA, 19 nt, Salmonella enterica enterica serovar Typhi Ty2
cacggagagucgcaccgcg

SEQ ID NO: 3735191 - RNA, 19 nt, Salmonella enterica enterica serovar Typhi Ty2
cacggaucaucuacccgua

SEQ ID NO: 3735192 - RNA, 17 nt, Salmonella enterica enterica serovar Typhi Ty2
cacggaugaucuucaua

SEQ ID NO: 3735193 - RNA, 15 nt, Salmonella enterica enterica serovar Typhi Ty2
cacggauggccucug

SEQ ID NO: 3735194 - RNA, 21 nt, Salmonella enterica enterica serovar Typhi Ty2
cacggcaacgccguacuccag

SEQ ID NO: 3735195 - RNA, 14 nt, Salmonella enterica enterica serovar Typhi Ty2
cacggccagcagcc

SEQ ID NO: 3735196 - RNA, 13 nt, Salmonella enterica enterica serovar Typhi Ty2
cacggcgauaaau

SEQ ID NO: 3735197 - RNA, 19 nt, Salmonella enterica enterica serovar Typhi Ty2
cacggcguacuccacuguc

SEQ ID NO: 3735198 - RNA, 22 nt, Salmonella enterica enterica serovar Typhi Ty2
cacggcguguugaaauccucua

SEQ ID NO: 3735199 - RNA, 19 nt, Salmonella enterica enterica serovar Typhi Ty2
cacggcucgaucccgaccc

SEQ ID NO: 3735200 - RNA, 13 nt, Salmonella enterica enterica serovar Typhi Ty2
cacggcucgccuu

SEQ ID NO: 3735201 - RNA, 18 nt, Salmonella enterica enterica serovar Typhi Ty2
cacgggguuggcccuccc

SEQ ID NO: 3735202 - RNA, 14 nt, Salmonella enterica enterica serovar Typhi Ty2
cacgguaaaccucu

SEQ ID NO: 3735203 - RNA, 18 nt, Salmonella enterica enterica serovar Typhi Ty2
cacggugugaucaccgcc

SEQ ID NO: 3735204 - RNA, 17 nt, Salmonella enterica enterica serovar Typhi Ty2
cacggugugccgccauc

SEQ ID NO: 3735205 - RNA, 15 nt, Salmonella enterica enterica serovar Typhi Ty2
cacgguuuuacgcug

SEQ ID NO: 3735206 - RNA, 17 nt, Salmonella enterica enterica serovar Typhi Ty2
cacguaacucggcagcg

SEQ ID NO: 3735207 - RNA, 19 nt, Salmonella enterica enterica serovar Typhi Ty2
cacguacccaaauaucaaa

SEQ ID NO: 3735208 - RNA, 18 nt, Salmonella enterica enterica serovar Typhi Ty2
cacguauaaacgccgccg

SEQ ID NO: 3735209 - RNA, 14 nt, Salmonella enterica enterica serovar Typhi Ty2
cacgucauccuccu

SEQ ID NO: 3735210 - RNA, 15 nt, Salmonella enterica enterica serovar Typhi Ty2
cacgucgauuuuccc

SEQ ID NO: 3735211 - RNA, 22 nt, Salmonella enterica enterica serovar Typhi Ty2
cacguuaaacaccucaccggcu

SEQ ID NO: 3735212 - RNA, 16 nt, Salmonella enterica enterica serovar Typhi Ty2
cacguuaccggcgguu

SEQ ID NO: 3735213 - RNA, 17 nt, Salmonella enterica enterica serovar Typhi Ty2
cacguuauaccacuggu

SEQ ID NO: 3735214 - RNA, 18 nt, Salmonella enterica enterica serovar Typhi Ty2
cacguuaucugaccuaca

SEQ ID NO: 3735215 - RNA, 19 nt, Salmonella enterica enterica serovar Typhi Ty2
cacguugagaaagggauaa

SEQ ID NO: 3735216 - RNA, 19 nt, Salmonella enterica enterica serovar Typhi Ty2
cacguugaugugcccguuc

SEQ ID NO: 3735217 - RNA, 22 nt, Salmonella enterica enterica serovar Typhi Ty2
cacguugccguaggcgacgcca

SEQ ID NO: 3735218 - RNA, 14 nt, Salmonella enterica enterica serovar Typhi Ty2
cacguugggcacgu

SEQ ID NO: 3735219 - RNA, 13 nt, Salmonella enterica enterica serovar Typhi Ty2
cacguuuuuacuc

SEQ ID NO: 3735220 - RNA, 15 nt, Salmonella enterica enterica serovar Typhi Ty2
cacuaacugaccaua

SEQ ID NO: 3735221 - RNA, 20 nt, Salmonella enterica enterica serovar Typhi Ty2
cacuaacugccgcugaccgc

SEQ ID NO: 3735222 - RNA, 19 nt, Salmonella enterica enterica serovar Typhi Ty2
cacuaauccccauuuuuuu

SEQ ID NO: 3735223 - RNA, 14 nt, Salmonella enterica enterica serovar Typhi Ty2
cacuaauuugaguc

SEQ ID NO: 3735224 - RNA, 12 nt, Salmonella enterica enterica serovar Typhi Ty2
cacuaauuugcg

SEQ ID NO: 3735225 - RNA, 20 nt, Salmonella enterica enterica serovar Typhi Ty2
cacuacacagggucgucaaa

SEQ ID NO: 3735226 - RNA, 17 nt, Salmonella enterica enterica serovar Typhi Ty2
cacuaccauuuccggcg

SEQ ID NO: 3735227 - RNA, 18 nt, Salmonella enterica enterica serovar Typhi Ty2
cacuaccauuuccggcgc

SEQ ID NO: 3735228 - RNA, 22 nt, Salmonella enterica enterica serovar Typhi Ty2
cacuaccauuuccggcgcgccu

SEQ ID NO: 3735229 - RNA, 16 nt, Salmonella enterica enterica serovar Typhi Ty2
cacuaccgccgcggau

SEQ ID NO: 3735230 - RNA, 22 nt, Salmonella enterica enterica serovar Typhi Ty2
cacuaccugauuggcuccccgc

SEQ ID NO: 3735231 - RNA, 22 nt, Salmonella enterica enterica serovar Typhi Ty2
cacuacgguccaguugcccucu

SEQ ID NO: 3735232 - RNA, 18 nt, Salmonella enterica enterica serovar Typhi Ty2
cacuacuacaccacccgu

SEQ ID NO: 3735233 - RNA, 17 nt, Salmonella enterica enterica serovar Typhi Ty2
cacuagcacuacggcaa

SEQ ID NO: 3735234 - RNA, 21 nt, Salmonella enterica enterica serovar Typhi Ty2
cacuauaaaaauaccggcauc

SEQ ID NO: 3735235 - RNA, 18 nt, Salmonella enterica enterica serovar Typhi Ty2
cacuauauguccuuuacu

SEQ ID NO: 3735236 - RNA, 14 nt, Salmonella enterica enterica serovar Typhi Ty2
cacucaaccaacca

SEQ ID NO: 3735237 - RNA, 19 nt, Salmonella enterica enterica serovar Typhi Ty2
cacucacaaaacuauuuuc

SEQ ID NO: 3735238 - RNA, 18 nt, Salmonella enterica enterica serovar Typhi Ty2
cacucagaaaauuauuuu

SEQ ID NO: 3735239 - RNA, 22 nt, Salmonella enterica enterica serovar Typhi Ty2
cacucagaaaauuauuuuaaau

SEQ ID NO: 3735240 - RNA, 12 nt, Salmonella enterica enterica serovar Typhi Ty2
cacucauccagc

SEQ ID NO: 3735241 - RNA, 14 nt, Salmonella enterica enterica serovar Typhi Ty2
cacucauccagcaa

SEQ ID NO: 3735242 - RNA, 16 nt, Salmonella enterica enterica serovar Typhi Ty2
cacucauccagcaaaa

SEQ ID NO: 3735243 - RNA, 16 nt, Salmonella enterica enterica serovar Typhi Ty2
cacuccggcugcacca

SEQ ID NO: 3735244 - RNA, 17 nt, Salmonella enterica enterica serovar Typhi Ty2
cacuccuaagagaaaac

SEQ ID NO: 3735245 - RNA, 13 nt, Salmonella enterica enterica serovar Typhi Ty2
cacucgcggauaa

SEQ ID NO: 3735246 - RNA, 21 nt, Salmonella enterica enterica serovar Typhi Ty2
cacucgcuuccuuuauugguu

SEQ ID NO: 3735247 - RNA, 19 nt, Salmonella enterica enterica serovar Typhi Ty2
cacucguaacgcauaucca

SEQ ID NO: 3735248 - RNA, 22 nt, Salmonella enterica enterica serovar Typhi Ty2
cacucguaacgcauauccagca

SEQ ID NO: 3735249 - RNA, 18 nt, Salmonella enterica enterica serovar Typhi Ty2
cacucguaggccggauaa

SEQ ID NO: 3735250 - RNA, 16 nt, Salmonella enterica enterica serovar Typhi Ty2
cacucuauucaugcau

SEQ ID NO: 3735251 - RNA, 13 nt, Salmonella enterica enterica serovar Typhi Ty2
cacucucuccagu

SEQ ID NO: 3735252 - RNA, 16 nt, Salmonella enterica enterica serovar Typhi Ty2
cacucucuuguauuac

SEQ ID NO: 3735253 - RNA, 20 nt, Salmonella enterica enterica serovar Typhi Ty2
cacucuucgggaauggggaa

SEQ ID NO: 3735254 - RNA, 22 nt, Salmonella enterica enterica serovar Typhi Ty2
cacucuuuggacggcaucagga

SEQ ID NO: 3735255 - RNA, 22 nt, Salmonella enterica enterica serovar Typhi Ty2
cacugaaaaauaauuacuaucu

SEQ ID NO: 3735256 - RNA, 14 nt, Salmonella enterica enterica serovar Typhi Ty2
cacugaagaggaga

SEQ ID NO: 3735257 - RNA, 23 nt, Salmonella enterica enterica serovar Typhi Ty2
cacugacauuuaaggcgcggccu

SEQ ID NO: 3735258 - RNA, 16 nt, Salmonella enterica enterica serovar Typhi Ty2
cacugacgaaaaccgu

SEQ ID NO: 3735259 - RNA, 15 nt, Salmonella enterica enterica serovar Typhi Ty2
cacugacuauccaca

SEQ ID NO: 3735260 - RNA, 21 nt, Salmonella enterica enterica serovar Typhi Ty2
cacugacucuuccgggcgcga

SEQ ID NO: 3735261 - RNA, 18 nt, Salmonella enterica enterica serovar Typhi Ty2
cacugauaccccagcgau

SEQ ID NO: 3735262 - RNA, 18 nt, Salmonella enterica enterica serovar Typhi Ty2
cacugauaguccaucacc

SEQ ID NO: 3735263 - RNA, 20 nt, Salmonella enterica enterica serovar Typhi Ty2
cacugauaguccaucaccuc

SEQ ID NO: 3735264 - RNA, 23 nt, Salmonella enterica enterica serovar Typhi Ty2
cacugauauaccguccagacucc

SEQ ID NO: 3735265 - RNA, 15 nt, Salmonella enterica enterica serovar Typhi Ty2
cacugaugccacacc

SEQ ID NO: 3735266 - RNA, 19 nt, Salmonella enterica enterica serovar Typhi Ty2
cacugcaauuucugcugga

SEQ ID NO: 3735267 - RNA, 16 nt, Salmonella enterica enterica serovar Typhi Ty2
cacugcaccuggucga

SEQ ID NO: 3735268 - RNA, 21 nt, Salmonella enterica enterica serovar Typhi Ty2
cacugcauaaauaucugcauu

SEQ ID NO: 3735269 - RNA, 12 nt, Salmonella enterica enterica serovar Typhi Ty2
cacugccaccgc

SEQ ID NO: 3735270 - RNA, 15 nt, Salmonella enterica enterica serovar Typhi Ty2
cacugccgccacgcc

SEQ ID NO: 3735271 - RNA, 22 nt, Salmonella enterica enterica serovar Typhi Ty2
cacugcgagggauuuccuggca

SEQ ID NO: 3735272 - RNA, 17 nt, Salmonella enterica enterica serovar Typhi Ty2
cacugcgcuuauccggc

SEQ ID NO: 3735273 - RNA, 21 nt, Salmonella enterica enterica serovar Typhi Ty2
cacugcggagguuucuuuuuc

SEQ ID NO: 3735274 - RNA, 23 nt, Salmonella enterica enterica serovar Typhi Ty2
cacugcucguuaaauccucccau

SEQ ID NO: 3735275 - RNA, 22 nt, Salmonella enterica enterica serovar Typhi Ty2
cacugcuguagcgucucaucaa

SEQ ID NO: 3735276 - RNA, 23 nt, Salmonella enterica enterica serovar Typhi Ty2
cacugcuguguccaggucaucac

SEQ ID NO: 3735277 - RNA, 16 nt, Salmonella enterica enterica serovar Typhi Ty2
cacuggaaacagccaa

SEQ ID NO: 3735278 - RNA, 17 nt, Salmonella enterica enterica serovar Typhi Ty2
cacuggaaacagccaau

SEQ ID NO: 3735279 - RNA, 21 nt, Salmonella enterica enterica serovar Typhi Ty2
cacuggaauaguuacggacau

SEQ ID NO: 3735280 - RNA, 20 nt, Salmonella enterica enterica serovar Typhi Ty2
cacuggaauucguuaccucg

SEQ ID NO: 3735281 - RNA, 21 nt, Salmonella enterica enterica serovar Typhi Ty2
cacuggagcgcauuuuacugc

SEQ ID NO: 3735282 - RNA, 21 nt, Salmonella enterica enterica serovar Typhi Ty2
cacuggaugacgcuguucaaa

SEQ ID NO: 3735283 - RNA, 14 nt, Salmonella enterica enterica serovar Typhi Ty2
cacuggcccccugu

SEQ ID NO: 3735284 - RNA, 16 nt, Salmonella enterica enterica serovar Typhi Ty2
cacuggcccccuguuc

SEQ ID NO: 3735285 - RNA, 23 nt, Salmonella enterica enterica serovar Typhi Ty2
cacuggcgagcggcaccggacau

SEQ ID NO: 3735286 - RNA, 13 nt, Salmonella enterica enterica serovar Typhi Ty2
cacuguaaaaggg

SEQ ID NO: 3735287 - RNA, 14 nt, Salmonella enterica enterica serovar Typhi Ty2
cacuguaaaaggga

SEQ ID NO: 3735288 - RNA, 22 nt, Salmonella enterica enterica serovar Typhi Ty2
cacugucaaaaauaacaggcac

SEQ ID NO: 3735289 - RNA, 16 nt, Salmonella enterica enterica serovar Typhi Ty2
cacuguggugugccug

SEQ ID NO: 3735290 - RNA, 15 nt, Salmonella enterica enterica serovar Typhi Ty2
cacuguucagaaauc

SEQ ID NO: 3735291 - RNA, 20 nt, Salmonella enterica enterica serovar Typhi Ty2
cacuguucguccauaaaggc

SEQ ID NO: 3735292 - RNA, 14 nt, Salmonella enterica enterica serovar Typhi Ty2
cacuguugcaucuu

SEQ ID NO: 3735293 - RNA, 21 nt, Salmonella enterica enterica serovar Typhi Ty2
cacuguuuaaugcuuucaaua

SEQ ID NO: 3735294 - RNA, 22 nt, Salmonella enterica enterica serovar Typhi Ty2
cacuguuugcugacaaucugcu

SEQ ID NO: 3735295 - RNA, 17 nt, Salmonella enterica enterica serovar Typhi Ty2
cacuuacggacaaaaua

SEQ ID NO: 3735296 - RNA, 16 nt, Salmonella enterica enterica serovar Typhi Ty2
cacuuacuuucuugcc

SEQ ID NO: 3735297 - RNA, 22 nt, Salmonella enterica enterica serovar Typhi Ty2
cacuuacuuucuugccacuggc

SEQ ID NO: 3735298 - RNA, 15 nt, Salmonella enterica enterica serovar Typhi Ty2
cacuuaucccugccc

SEQ ID NO: 3735299 - RNA, 16 nt, Salmonella enterica enterica serovar Typhi Ty2
cacuuaucccugcccc

SEQ ID NO: 3735300 - RNA, 11 nt, Salmonella enterica enterica serovar Typhi Ty2
cacuuaugguc

SEQ ID NO: 3735301 - RNA, 19 nt, Salmonella enterica enterica serovar Typhi Ty2
cacuucaauguuagcauua

SEQ ID NO: 3735302 - RNA, 21 nt, Salmonella enterica enterica serovar Typhi Ty2
cacuucaauguuagcauuauu

SEQ ID NO: 3735303 - RNA, 22 nt, Salmonella enterica enterica serovar Typhi Ty2
cagacgcuucauugguuaauuc

SEQ ID NO: 3735304 - RNA, 18 nt, Salmonella enterica enterica serovar Typhi Ty2
cagacggcaagcaaccgu

SEQ ID NO: 3735305 - RNA, 16 nt, Salmonella enterica enterica serovar Typhi Ty2
cagacggcgaaucaau

SEQ ID NO: 3735306 - RNA, 21 nt, Salmonella enterica enterica serovar Typhi Ty2
cagacggcuccagcgccagcu

SEQ ID NO: 3735307 - RNA, 13 nt, Salmonella enterica enterica serovar Typhi Ty2
cagacggcugggc

SEQ ID NO: 3735308 - RNA, 13 nt, Salmonella enterica enterica serovar Typhi Ty2
cagacguagcgcc

SEQ ID NO: 3735309 - RNA, 18 nt, Salmonella enterica enterica serovar Typhi Ty2
cagacuaaaaagcgcguc

SEQ ID NO: 3735310 - RNA, 21 nt, Salmonella enterica enterica serovar Typhi Ty2
cagacuaaccguucaucuauc

SEQ ID NO: 3735311 - RNA, 22 nt, Salmonella enterica enterica serovar Typhi Ty2
cagacuauccguccucuuuccc

SEQ ID NO: 3735312 - RNA, 15 nt, Salmonella enterica enterica serovar Typhi Ty2
cagacucagccaggu

SEQ ID NO: 3735313 - RNA, 19 nt, Salmonella enterica enterica serovar Typhi Ty2
cagacucgcuucacgcgga

SEQ ID NO: 3735314 - RNA, 19 nt, Salmonella enterica enterica serovar Typhi Ty2
cagacugaauaaaggguuu

SEQ ID NO: 3735315 - RNA, 15 nt, Salmonella enterica enterica serovar Typhi Ty2
cagacugcgccacgu

SEQ ID NO: 3735316 - RNA, 16 nt, Salmonella enterica enterica serovar Typhi Ty2
cagacugguauagccu

SEQ ID NO: 3735317 - RNA, 20 nt, Salmonella enterica enterica serovar Typhi Ty2
cagacugguauagccuuuuu

SEQ ID NO: 3735318 - RNA, 18 nt, Salmonella enterica enterica serovar Typhi Ty2
cagacuguaaaucugccg

SEQ ID NO: 3735319 - RNA, 12 nt, Salmonella enterica enterica serovar Typhi Ty2
cagacuuuccag

SEQ ID NO: 3735320 - RNA, 18 nt, Salmonella enterica enterica serovar Typhi Ty2
cagacuuuggauaaagcc

SEQ ID NO: 3735321 - RNA, 15 nt, Salmonella enterica enterica serovar Typhi Ty2
cagagauaauuuucc

SEQ ID NO: 3735322 - RNA, 19 nt, Salmonella enterica enterica serovar Typhi Ty2
cagagauccacauugguuu

SEQ ID NO: 3735323 - RNA, 21 nt, Salmonella enterica enterica serovar Typhi Ty2
cagagcaacgagaacccacuu

SEQ ID NO: 3735324 - RNA, 21 nt, Salmonella enterica enterica serovar Typhi Ty2
cagagcagucguugcgccugu

SEQ ID NO: 3735325 - RNA, 18 nt, Salmonella enterica enterica serovar Typhi Ty2
cagagcaucaauggugaa

SEQ ID NO: 3735326 - RNA, 21 nt, Salmonella enterica enterica serovar Typhi Ty2
cagagcaucuaccgcauacug

SEQ ID NO: 3735327 - RNA, 19 nt, Salmonella enterica enterica serovar Typhi Ty2
cagagccaaacacuucccc

SEQ ID NO: 3735328 - RNA, 21 nt, Salmonella enterica enterica serovar Typhi Ty2
cagagcgacauggcccauuuc

SEQ ID NO: 3735329 - RNA, 22 nt, Salmonella enterica enterica serovar Typhi Ty2
cagagcgcgcuggcaagcgcca

SEQ ID NO: 3735330 - RNA, 16 nt, Salmonella enterica enterica serovar Typhi Ty2
cagagcggggaaacuc

SEQ ID NO: 3735331 - RNA, 22 nt, Salmonella enterica enterica serovar Typhi Ty2
cagagcggggaaacucuuuucc

SEQ ID NO: 3735332 - RNA, 17 nt, Salmonella enterica enterica serovar Typhi Ty2
cagagcguccacgccau

SEQ ID NO: 3735333 - RNA, 17 nt, Salmonella enterica enterica serovar Typhi Ty2
cagagcucgucaaaaau

SEQ ID NO: 3735334 - RNA, 12 nt, Salmonella enterica enterica serovar Typhi Ty2
cagaggaaaacg

SEQ ID NO: 3735335 - RNA, 15 nt, Salmonella enterica enterica serovar Typhi Ty2
cagaggaaugaaaac

SEQ ID NO: 3735336 - RNA, 15 nt, Salmonella enterica enterica serovar Typhi Ty2
cagaggacauuaaag

SEQ ID NO: 3735337 - RNA, 20 nt, Salmonella enterica enterica serovar Typhi Ty2
cagaggaucuggacgccaau

SEQ ID NO: 3735338 - RNA, 15 nt, Salmonella enterica enterica serovar Typhi Ty2
cagaggccugaaugc

SEQ ID NO: 3735339 - RNA, 18 nt, Salmonella enterica enterica serovar Typhi Ty2
cagagguaagauguucua

SEQ ID NO: 3735340 - RNA, 19 nt, Salmonella enterica enterica serovar Typhi Ty2
cagaggucucagguucgaa

SEQ ID NO: 3735341 - RNA, 21 nt, Salmonella enterica enterica serovar Typhi Ty2
cagaguaacccgauacccuga

SEQ ID NO: 3735342 - RNA, 22 nt, Salmonella enterica enterica serovar Typhi Ty2
cagaguaacccgauacccugag

SEQ ID NO: 3735343 - RNA, 13 nt, Salmonella enterica enterica serovar Typhi Ty2
cagaguccagcgg

SEQ ID NO: 3735344 - RNA, 20 nt, Salmonella enterica enterica serovar Typhi Ty2
cagaguccggcgccugaaua

SEQ ID NO: 3735345 - RNA, 18 nt, Salmonella enterica enterica serovar Typhi Ty2
cagagucgaaagaaacgc

SEQ ID NO: 3735346 - RNA, 22 nt, Salmonella enterica enterica serovar Typhi Ty2
cagagugagauagcggcgcgcu

SEQ ID NO: 3735347 - RNA, 12 nt, Salmonella enterica enterica serovar Typhi Ty2
cagauaaaccac

SEQ ID NO: 3735348 - RNA, 21 nt, Salmonella enterica enterica serovar Typhi Ty2
cagauaaagcuucugcgccuu

SEQ ID NO: 3735349 - RNA, 18 nt, Salmonella enterica enterica serovar Typhi Ty2
cagauaacaccagcgauc

SEQ ID NO: 3735350 - RNA, 23 nt, Salmonella enterica enterica serovar Typhi Ty2
cagauaacaccagcgauccagau

SEQ ID NO: 3735351 - RNA, 23 nt, Salmonella enterica enterica serovar Typhi Ty2
cagauaaccgucggcgccggcgu

SEQ ID NO: 3735352 - RNA, 21 nt, Salmonella enterica enterica serovar Typhi Ty2
cagauaacugagcuugagcca

SEQ ID NO: 3735353 - RNA, 20 nt, Salmonella enterica enterica serovar Typhi Ty2
cagauaagcgacucuguauu

SEQ ID NO: 3735354 - RNA, 17 nt, Salmonella enterica enterica serovar Typhi Ty2
cagauaauagcugcggc

SEQ ID NO: 3735355 - RNA, 18 nt, Salmonella enterica enterica serovar Typhi Ty2
cagauaauagcugcggcu

SEQ ID NO: 3735356 - RNA, 14 nt, Salmonella enterica enterica serovar Typhi Ty2
cagauaauccagcg

SEQ ID NO: 3735357 - RNA, 16 nt, Salmonella enterica enterica serovar Typhi Ty2
cagauaauccagcguc

SEQ ID NO: 3735358 - RNA, 22 nt, Salmonella enterica enterica serovar Typhi Ty2
cagauaaugaucaacgcggcga

SEQ ID NO: 3735359 - RNA, 19 nt, Salmonella enterica enterica serovar Typhi Ty2
cagauaaugccgcuggcgu

SEQ ID NO: 3735360 - RNA, 15 nt, Salmonella enterica enterica serovar Typhi Ty2
cagauacauggcuau

SEQ ID NO: 3735361 - RNA, 21 nt, Salmonella enterica enterica serovar Typhi Ty2
cagauacgccuuuacgucgcc

SEQ ID NO: 3735362 - RNA, 15 nt, Salmonella enterica enterica serovar Typhi Ty2
cagauacgcgccggc

SEQ ID NO: 3735363 - RNA, 16 nt, Salmonella enterica enterica serovar Typhi Ty2
cagauacggcgcgucg

SEQ ID NO: 3735364 - RNA, 17 nt, Salmonella enterica enterica serovar Typhi Ty2
cagauacggcgcgucgg

SEQ ID NO: 3735365 - RNA, 13 nt, Salmonella enterica enterica serovar Typhi Ty2
cagauagcccgcc

SEQ ID NO: 3735366 - RNA, 18 nt, Salmonella enterica enterica serovar Typhi Ty2
cagauagcccgccagcac

SEQ ID NO: 3735367 - RNA, 21 nt, Salmonella enterica enterica serovar Typhi Ty2
cagauagcccgccagcaccag

SEQ ID NO: 3735368 - RNA, 17 nt, Salmonella enterica enterica serovar Typhi Ty2
cagauagcccugagccc

SEQ ID NO: 3735369 - RNA, 18 nt, Salmonella enterica enterica serovar Typhi Ty2
cagauagcgaucgccgcu

SEQ ID NO: 3735370 - RNA, 17 nt, Salmonella enterica enterica serovar Typhi Ty2
cagauagcgcugcgcca

SEQ ID NO: 3735371 - RNA, 19 nt, Salmonella enterica enterica serovar Typhi Ty2
cagauagcgcugcgccaga

SEQ ID NO: 3735372 - RNA, 17 nt, Salmonella enterica enterica serovar Typhi Ty2
cagauagcguaaccggu

SEQ ID NO: 3735373 - RNA, 13 nt, Salmonella enterica enterica serovar Typhi Ty2
cagauaucgcgua

SEQ ID NO: 3735374 - RNA, 15 nt, Salmonella enterica enterica serovar Typhi Ty2
cagauaugcgggcuc

SEQ ID NO: 3735375 - RNA, 16 nt, Salmonella enterica enterica serovar Typhi Ty2
cagauauuccagcgac

SEQ ID NO: 3735376 - RNA, 21 nt, Salmonella enterica enterica serovar Typhi Ty2
cagauauugcggaucagcaaa

SEQ ID NO: 3735377 - RNA, 23 nt, Salmonella enterica enterica serovar Typhi Ty2
cagauauuuucggcauacucuuu

SEQ ID NO: 3735378 - RNA, 15 nt, Salmonella enterica enterica serovar Typhi Ty2
cagaucaaaaaucug

SEQ ID NO: 3735379 - RNA, 17 nt, Salmonella enterica enterica serovar Typhi Ty2
cagaucaggucugagau

SEQ ID NO: 3735380 - RNA, 16 nt, Salmonella enterica enterica serovar Typhi Ty2
cagauccaucgccugc

SEQ ID NO: 3735381 - RNA, 21 nt, Salmonella enterica enterica serovar Typhi Ty2
cagauccaucgccugcggcgu

SEQ ID NO: 3735382 - RNA, 16 nt, Salmonella enterica enterica serovar Typhi Ty2
cagaucccagguaacc

SEQ ID NO: 3735383 - RNA, 19 nt, Salmonella enterica enterica serovar Typhi Ty2
cagaucccagguaaccgcu

SEQ ID NO: 3735384 - RNA, 14 nt, Salmonella enterica enterica serovar Typhi Ty2
cagauccuuuuucu

SEQ ID NO: 3735385 - RNA, 15 nt, Salmonella enterica enterica serovar Typhi Ty2
cagcacacuacacag

SEQ ID NO: 3735386 - RNA, 19 nt, Salmonella enterica enterica serovar Typhi Ty2
cagcacauucagcagcgcc

SEQ ID NO: 3735387 - RNA, 13 nt, Salmonella enterica enterica serovar Typhi Ty2
cagcaccagcauu

SEQ ID NO: 3735388 - RNA, 15 nt, Salmonella enterica enterica serovar Typhi Ty2
cagcaccagcauuag

SEQ ID NO: 3735389 - RNA, 18 nt, Salmonella enterica enterica serovar Typhi Ty2
cagcaccagcauuagcgc

SEQ ID NO: 3735390 - RNA, 12 nt, Salmonella enterica enterica serovar Typhi Ty2
cagcaccaggau

SEQ ID NO: 3735391 - RNA, 21 nt, Salmonella enterica enterica serovar Typhi Ty2
cagcaccaguugcgucagcgu

SEQ ID NO: 3735392 - RNA, 15 nt, Salmonella enterica enterica serovar Typhi Ty2
cagcaccaucaugca

SEQ ID NO: 3735393 - RNA, 17 nt, Salmonella enterica enterica serovar Typhi Ty2
cagcaccaucaugcaag

SEQ ID NO: 3735394 - RNA, 12 nt, Salmonella enterica enterica serovar Typhi Ty2
cagcaccgccgc

SEQ ID NO: 3735395 - RNA, 15 nt, Salmonella enterica enterica serovar Typhi Ty2
cagcaccgcuggcga

SEQ ID NO: 3735396 - RNA, 21 nt, Salmonella enterica enterica serovar Typhi Ty2
cagcaccucgcugcugcuuuu

SEQ ID NO: 3735397 - RNA, 16 nt, Salmonella enterica enterica serovar Typhi Ty2
cagcaccugaauaaug

SEQ ID NO: 3735398 - RNA, 15 nt, Salmonella enterica enterica serovar Typhi Ty2
cagcacgacagagau

SEQ ID NO: 3735399 - RNA, 19 nt, Salmonella enterica enterica serovar Typhi Ty2
cagcacgacagagaucagg

SEQ ID NO: 3735400 - RNA, 16 nt, Salmonella enterica enterica serovar Typhi Ty2
cagcacgaugcauaug

SEQ ID NO: 3735401 - RNA, 18 nt, Salmonella enterica enterica serovar Typhi Ty2
cagcacgccggaaagaau

SEQ ID NO: 3735402 - RNA, 15 nt, Salmonella enterica enterica serovar Typhi Ty2
cagcacgcucaaaua

SEQ ID NO: 3735403 - RNA, 17 nt, Salmonella enterica enterica serovar Typhi Ty2
cagcacgcuuacccagc

SEQ ID NO: 3735404 - RNA, 19 nt, Salmonella enterica enterica serovar Typhi Ty2
cagcacgcuuacccagcau

SEQ ID NO: 3735405 - RNA, 13 nt, Salmonella enterica enterica serovar Typhi Ty2
cagcacuaacagc

SEQ ID NO: 3735406 - RNA, 14 nt, Salmonella enterica enterica serovar Typhi Ty2
cagcacuaacagca

SEQ ID NO: 3735407 - RNA, 19 nt, Salmonella enterica enterica serovar Typhi Ty2
cagcacuuccggaucgcua

SEQ ID NO: 3735408 - RNA, 17 nt, Salmonella enterica enterica serovar Typhi Ty2
cagcacuucgcugauac

SEQ ID NO: 3735409 - RNA, 15 nt, Salmonella enterica enterica serovar Typhi Ty2
cagcagaaaaccggu

SEQ ID NO: 3735410 - RNA, 17 nt, Salmonella enterica enterica serovar Typhi Ty2
cagcagacaaccgacgc

SEQ ID NO: 3735411 - RNA, 14 nt, Salmonella enterica enterica serovar Typhi Ty2
cagcagacagguga

SEQ ID NO: 3735412 - RNA, 14 nt, Salmonella enterica enterica serovar Typhi Ty2
cagcagaccggcaa

SEQ ID NO: 3735413 - RNA, 23 nt, Salmonella enterica enterica serovar Typhi Ty2
cagcagaccggcaaaaauuugcg

SEQ ID NO: 3735414 - RNA, 14 nt, Salmonella enterica enterica serovar Typhi Ty2
cagcagauguggcg

SEQ ID NO: 3735415 - RNA, 18 nt, Salmonella enterica enterica serovar Typhi Ty2
cagcagauguggcggccc

SEQ ID NO: 3735416 - RNA, 19 nt, Salmonella enterica enterica serovar Typhi Ty2
cagcagcaaaccgauaauc

SEQ ID NO: 3735417 - RNA, 18 nt, Salmonella enterica enterica serovar Typhi Ty2
cagcagcagagccggaac

SEQ ID NO: 3735418 - RNA, 14 nt, Salmonella enterica enterica serovar Typhi Ty2
cagcagcagcaccg

SEQ ID NO: 3735419 - RNA, 23 nt, Salmonella enterica enterica serovar Typhi Ty2
cagcagcaggcuggagagcaacg

SEQ ID NO: 3735420 - RNA, 18 nt, Salmonella enterica enterica serovar Typhi Ty2
cagcagccaugccagcgc

SEQ ID NO: 3735421 - RNA, 19 nt, Salmonella enterica enterica serovar Typhi Ty2
cagcagcccgucuuuuucc

SEQ ID NO: 3735422 - RNA, 17 nt, Salmonella enterica enterica serovar Typhi Ty2
cagcagccgggccagac

SEQ ID NO: 3735423 - RNA, 19 nt, Salmonella enterica enterica serovar Typhi Ty2
cagcagccgguauccagcg

SEQ ID NO: 3735424 - RNA, 13 nt, Salmonella enterica enterica serovar Typhi Ty2
cagcagcgacgca

SEQ ID NO: 3735425 - RNA, 15 nt, Salmonella enterica enterica serovar Typhi Ty2
cagcagcgacgcauu

SEQ ID NO: 3735426 - RNA, 14 nt, Salmonella enterica enterica serovar Typhi Ty2
cagcagcgagguga

SEQ ID NO: 3735427 - RNA, 14 nt, Salmonella enterica enterica serovar Typhi Ty2
cagcagcgcauagg

SEQ ID NO: 3735428 - RNA, 22 nt, Salmonella enterica enterica serovar Typhi Ty2
cagcagcgcgaucgccccgacc

SEQ ID NO: 3735429 - RNA, 16 nt, Salmonella enterica enterica serovar Typhi Ty2
cagcagcgcuuucuuc

SEQ ID NO: 3735430 - RNA, 20 nt, Salmonella enterica enterica serovar Typhi Ty2
cagcagcgcuuucuucuuca

SEQ ID NO: 3735431 - RNA, 22 nt, Salmonella enterica enterica serovar Typhi Ty2
cagcagcuucagcaucaucucc

SEQ ID NO: 3735432 - RNA, 15 nt, Salmonella enterica enterica serovar Typhi Ty2
cagcaggcagacgcg

SEQ ID NO: 3735433 - RNA, 12 nt, Salmonella enterica enterica serovar Typhi Ty2
cagcaggcuuug

SEQ ID NO: 3735434 - RNA, 18 nt, Salmonella enterica enterica serovar Typhi Ty2
cagcaggcuuugcugcug

SEQ ID NO: 3735435 - RNA, 20 nt, Salmonella enterica enterica serovar Typhi Ty2
cagcaggucgaccaccugcu

SEQ ID NO: 3735436 - RNA, 20 nt, Salmonella enterica enterica serovar Typhi Ty2
cagcaggucgcacuccucug

SEQ ID NO: 3735437 - RNA, 16 nt, Salmonella enterica enterica serovar Typhi Ty2
cagcagucucuacuac

SEQ ID NO: 3735438 - RNA, 17 nt, Salmonella enterica enterica serovar Typhi Ty2
cagcagugagcuuugca

SEQ ID NO: 3735439 - RNA, 18 nt, Salmonella enterica enterica serovar Typhi Ty2
cagcaguggcucagucag

SEQ ID NO: 3735440 - RNA, 17 nt, Salmonella enterica enterica serovar Typhi Ty2
cagcaguuccccgccgc

SEQ ID NO: 3735441 - RNA, 14 nt, Salmonella enterica enterica serovar Typhi Ty2
cagcaguucuacgc

SEQ ID NO: 3735442 - RNA, 18 nt, Salmonella enterica enterica serovar Typhi Ty2
cagcaguuuuucaaucuu

SEQ ID NO: 3735443 - RNA, 19 nt, Salmonella enterica enterica serovar Typhi Ty2
cagcauaauaaagcagcgg

SEQ ID NO: 3735444 - RNA, 23 nt, Salmonella enterica enterica serovar Typhi Ty2
cagcauaauauccugcaccgccu

SEQ ID NO: 3735445 - RNA, 23 nt, Salmonella enterica enterica serovar Typhi Ty2
cagcauaauauucauaacgccga

SEQ ID NO: 3735446 - RNA, 12 nt, Salmonella enterica enterica serovar Typhi Ty2
cagcauaccgcc

SEQ ID NO: 3735447 - RNA, 17 nt, Salmonella enterica enterica serovar Typhi Ty2
cagcauacgucugcgcu

SEQ ID NO: 3735448 - RNA, 21 nt, Salmonella enterica enterica serovar Typhi Ty2
cagcauacugaugucguugua

SEQ ID NO: 3735449 - RNA, 14 nt, Salmonella enterica enterica serovar Typhi Ty2
cagcauauccagcg

SEQ ID NO: 3735450 - RNA, 15 nt, Salmonella enterica enterica serovar Typhi Ty2
cagcauauccagcgc

SEQ ID NO: 3735451 - RNA, 19 nt, Salmonella enterica enterica serovar Typhi Ty2
cagcauauccagcgccugc

SEQ ID NO: 3735452 - RNA, 23 nt, Salmonella enterica enterica serovar Typhi Ty2
cagcauaucgauagcaucgguca

SEQ ID NO: 3735453 - RNA, 18 nt, Salmonella enterica enterica serovar Typhi Ty2
cagcaucaaccaccaaaa

SEQ ID NO: 3735454 - RNA, 12 nt, Salmonella enterica enterica serovar Typhi Ty2
cagcaucaucuc

SEQ ID NO: 3735455 - RNA, 20 nt, Salmonella enterica enterica serovar Typhi Ty2
cagcaucaucucccaggccg

SEQ ID NO: 3735456 - RNA, 22 nt, Salmonella enterica enterica serovar Typhi Ty2
cagcaucaucucccaggccgcc

SEQ ID NO: 3735457 - RNA, 18 nt, Salmonella enterica enterica serovar Typhi Ty2
cagcaucccacgaaugcc

SEQ ID NO: 3735458 - RNA, 13 nt, Salmonella enterica enterica serovar Typhi Ty2
cagcaucccgcug

SEQ ID NO: 3735459 - RNA, 13 nt, Salmonella enterica enterica serovar Typhi Ty2
cagcaucccggca

SEQ ID NO: 3735460 - RNA, 15 nt, Salmonella enterica enterica serovar Typhi Ty2
cagcaucccggcaaa

SEQ ID NO: 3735461 - RNA, 23 nt, Salmonella enterica enterica serovar Typhi Ty2
cagcaucccguuaugguuaucaa

SEQ ID NO: 3735462 - RNA, 14 nt, Salmonella enterica enterica serovar Typhi Ty2
cagcaucgaccagg

SEQ ID NO: 3735463 - RNA, 16 nt, Salmonella enterica enterica serovar Typhi Ty2
cagcaucgaccaggau

SEQ ID NO: 3735464 - RNA, 15 nt, Salmonella enterica enterica serovar Typhi Ty2
cagcaucgccaucaa

SEQ ID NO: 3735465 - RNA, 19 nt, Salmonella enterica enterica serovar Typhi Ty2
cagcaucgccaucaacucc

SEQ ID NO: 3735466 - RNA, 16 nt, Salmonella enterica enterica serovar Typhi Ty2
cagcaucggcagcgcc

SEQ ID NO: 3735467 - RNA, 15 nt, Salmonella enterica enterica serovar Typhi Ty2
cagcccugugccgcu

SEQ ID NO: 3735468 - RNA, 23 nt, Salmonella enterica enterica serovar Typhi Ty2
cagcccuuucaggaauuuaucaa

SEQ ID NO: 3735469 - RNA, 13 nt, Salmonella enterica enterica serovar Typhi Ty2
cagccgacgcauu

SEQ ID NO: 3735470 - RNA, 20 nt, Salmonella enterica enterica serovar Typhi Ty2
cagccgacuauuccgcaaac

SEQ ID NO: 3735471 - RNA, 21 nt, Salmonella enterica enterica serovar Typhi Ty2
cagccgagcgguaagagccag

SEQ ID NO: 3735472 - RNA, 22 nt, Salmonella enterica enterica serovar Typhi Ty2
cagccgagcgguaagagccaga

SEQ ID NO: 3735473 - RNA, 16 nt, Salmonella enterica enterica serovar Typhi Ty2
cagccgauaacucuuc

SEQ ID NO: 3735474 - RNA, 24 nt, Salmonella enterica enterica serovar Typhi Ty2
cagccgaucaacgggguuagcguu

SEQ ID NO: 3735475 - RNA, 14 nt, Salmonella enterica enterica serovar Typhi Ty2
cagccgaucagcgc

SEQ ID NO: 3735476 - RNA, 17 nt, Salmonella enterica enterica serovar Typhi Ty2
cagccgaucagcgccau

SEQ ID NO: 3735477 - RNA, 14 nt, Salmonella enterica enterica serovar Typhi Ty2
cagccgaucaggcc

SEQ ID NO: 3735478 - RNA, 17 nt, Salmonella enterica enterica serovar Typhi Ty2
cagccgaucaucacgaa

SEQ ID NO: 3735479 - RNA, 20 nt, Salmonella enterica enterica serovar Typhi Ty2
cagccgaucuauuucauaau

SEQ ID NO: 3735480 - RNA, 17 nt, Salmonella enterica enterica serovar Typhi Ty2
cagccgauuucauacca

SEQ ID NO: 3735481 - RNA, 17 nt, Salmonella enterica enterica serovar Typhi Ty2
cagccgauuuuucggca

SEQ ID NO: 3735482 - RNA, 12 nt, Salmonella enterica enterica serovar Typhi Ty2
cagccgcaucuu

SEQ ID NO: 3735483 - RNA, 23 nt, Salmonella enterica enterica serovar Typhi Ty2
cagccgcauuuuucauggugaac

SEQ ID NO: 3735484 - RNA, 14 nt, Salmonella enterica enterica serovar Typhi Ty2
cagccgcauuuuuu

SEQ ID NO: 3735485 - RNA, 17 nt, Salmonella enterica enterica serovar Typhi Ty2
cagccgccaccacaaag

SEQ ID NO: 3735486 - RNA, 12 nt, Salmonella enterica enterica serovar Typhi Ty2
cagccgccaggc

SEQ ID NO: 3735487 - RNA, 13 nt, Salmonella enterica enterica serovar Typhi Ty2
cagccgccauggc

SEQ ID NO: 3735488 - RNA, 13 nt, Salmonella enterica enterica serovar Typhi Ty2
cagccgcccgcga

SEQ ID NO: 3735489 - RNA, 21 nt, Salmonella enterica enterica serovar Typhi Ty2
cagccgcggcgcuuucgccac

SEQ ID NO: 3735490 - RNA, 14 nt, Salmonella enterica enterica serovar Typhi Ty2
cagccgcucugcug

SEQ ID NO: 3735491 - RNA, 22 nt, Salmonella enterica enterica serovar Typhi Ty2
cagccgcuuuccgccgccgcca

SEQ ID NO: 3735492 - RNA, 23 nt, Salmonella enterica enterica serovar Typhi Ty2
cagccggaaaagcgcuggcuggc

SEQ ID NO: 3735493 - RNA, 18 nt, Salmonella enterica enterica serovar Typhi Ty2
cagccggauagacaugac

SEQ ID NO: 3735494 - RNA, 16 nt, Salmonella enterica enterica serovar Typhi Ty2
cagccggauuuuaaau

SEQ ID NO: 3735495 - RNA, 18 nt, Salmonella enterica enterica serovar Typhi Ty2
cagccgggccgcaaccgc

SEQ ID NO: 3735496 - RNA, 17 nt, Salmonella enterica enterica serovar Typhi Ty2
cagccgguauccagcgc

SEQ ID NO: 3735497 - RNA, 21 nt, Salmonella enterica enterica serovar Typhi Ty2
cagccguaccacccgggaaaa

SEQ ID NO: 3735498 - RNA, 23 nt, Salmonella enterica enterica serovar Typhi Ty2
cagccgucaaacaucgcgcucca

SEQ ID NO: 3735499 - RNA, 21 nt, Salmonella enterica enterica serovar Typhi Ty2
cagccgucgugauagccauac

SEQ ID NO: 3735500 - RNA, 14 nt, Salmonella enterica enterica serovar Typhi Ty2
cagccgugagcaga

SEQ ID NO: 3735501 - RNA, 17 nt, Salmonella enterica enterica serovar Typhi Ty2
cagccguuacuuccccc

SEQ ID NO: 3735502 - RNA, 17 nt, Salmonella enterica enterica serovar Typhi Ty2
cagccuaaaaaaccggc

SEQ ID NO: 3735503 - RNA, 13 nt, Salmonella enterica enterica serovar Typhi Ty2
cagccuaccgcuu

SEQ ID NO: 3735504 - RNA, 16 nt, Salmonella enterica enterica serovar Typhi Ty2
cagccuaccugccgcc

SEQ ID NO: 3735505 - RNA, 15 nt, Salmonella enterica enterica serovar Typhi Ty2
cagccugccgucuuu

SEQ ID NO: 3735506 - RNA, 13 nt, Salmonella enterica enterica serovar Typhi Ty2
cagccugcugguc

SEQ ID NO: 3735507 - RNA, 21 nt, Salmonella enterica enterica serovar Typhi Ty2
cagccugcuggucugaaucug

SEQ ID NO: 3735508 - RNA, 23 nt, Salmonella enterica enterica serovar Typhi Ty2
cagccugcuggucugaaucugcu

SEQ ID NO: 3735509 - RNA, 20 nt, Salmonella enterica enterica serovar Typhi Ty2
cagccuuaaucaacugcgcc

SEQ ID NO: 3735510 - RNA, 17 nt, Salmonella enterica enterica serovar Typhi Ty2
cagccuuauaagaacca

SEQ ID NO: 3735511 - RNA, 11 nt, Salmonella enterica enterica serovar Typhi Ty2
cagccuuauag

SEQ ID NO: 3735512 - RNA, 19 nt, Salmonella enterica enterica serovar Typhi Ty2
cagccuuccuggucugcca

SEQ ID NO: 3735513 - RNA, 18 nt, Salmonella enterica enterica serovar Typhi Ty2
cagccuuuucauauggaa

SEQ ID NO: 3735514 - RNA, 19 nt, Salmonella enterica enterica serovar Typhi Ty2
cagcgaaacugcgcgccgg

SEQ ID NO: 3735515 - RNA, 16 nt, Salmonella enterica enterica serovar Typhi Ty2
cagcgaaagcugccuu

SEQ ID NO: 3735516 - RNA, 17 nt, Salmonella enterica enterica serovar Typhi Ty2
cagcgaaagcugccuuu

SEQ ID NO: 3735517 - RNA, 15 nt, Salmonella enterica enterica serovar Typhi Ty2
cagcgaaaugacggc

SEQ ID NO: 3735518 - RNA, 21 nt, Salmonella enterica enterica serovar Typhi Ty2
cagcgaaaugacggccaccag

SEQ ID NO: 3735519 - RNA, 23 nt, Salmonella enterica enterica serovar Typhi Ty2
cagcgaaaugacggccaccagcg

SEQ ID NO: 3735520 - RNA, 17 nt, Salmonella enterica enterica serovar Typhi Ty2
cagcgaaaugcgaaucc

SEQ ID NO: 3735521 - RNA, 23 nt, Salmonella enterica enterica serovar Typhi Ty2
cagcgaacaguguaaacgccaga

SEQ ID NO: 3735522 - RNA, 15 nt, Salmonella enterica enterica serovar Typhi Ty2
cagcgaaccuuccau

SEQ ID NO: 3735523 - RNA, 19 nt, Salmonella enterica enterica serovar Typhi Ty2
cagcgaacucccgggcgcu

SEQ ID NO: 3735524 - RNA, 23 nt, Salmonella enterica enterica serovar Typhi Ty2
cagcgaauccgugcguaaaauau

SEQ ID NO: 3735525 - RNA, 14 nt, Salmonella enterica enterica serovar Typhi Ty2
cagcgaauuccggc

SEQ ID NO: 3735526 - RNA, 21 nt, Salmonella enterica enterica serovar Typhi Ty2
cagcgaauuccggccaucaga

SEQ ID NO: 3735527 - RNA, 17 nt, Salmonella enterica enterica serovar Typhi Ty2
cagcgacauccucuuca

SEQ ID NO: 3735528 - RNA, 17 nt, Salmonella enterica enterica serovar Typhi Ty2
cagcgaccacgccaccg

SEQ ID NO: 3735529 - RNA, 23 nt, Salmonella enterica enterica serovar Typhi Ty2
cagcgacgaugaaauaaacgacc

SEQ ID NO: 3735530 - RNA, 15 nt, Salmonella enterica enterica serovar Typhi Ty2
cagcgacgcauugag

SEQ ID NO: 3735531 - RNA, 17 nt, Salmonella enterica enterica serovar Typhi Ty2
cagcgacgccagauuau

SEQ ID NO: 3735532 - RNA, 23 nt, Salmonella enterica enterica serovar Typhi Ty2
cagcgacgccagauuaucggcca

SEQ ID NO: 3735533 - RNA, 15 nt, Salmonella enterica enterica serovar Typhi Ty2
cagcgacgcccagug

SEQ ID NO: 3735534 - RNA, 22 nt, Salmonella enterica enterica serovar Typhi Ty2
cagcgacucauucagcaacugc

SEQ ID NO: 3735535 - RNA, 15 nt, Salmonella enterica enterica serovar Typhi Ty2
cagcgagaagucggc

SEQ ID NO: 3735536 - RNA, 15 nt, Salmonella enterica enterica serovar Typhi Ty2
cagcgagauggcuuu

SEQ ID NO: 3735537 - RNA, 22 nt, Salmonella enterica enterica serovar Typhi Ty2
cagcgaggugauaaucagcgcu

SEQ ID NO: 3735538 - RNA, 14 nt, Salmonella enterica enterica serovar Typhi Ty2
cagcgauagucguu

SEQ ID NO: 3735539 - RNA, 15 nt, Salmonella enterica enterica serovar Typhi Ty2
cagcgauauuacuuu

SEQ ID NO: 3735540 - RNA, 19 nt, Salmonella enterica enterica serovar Typhi Ty2
cagcgauauuucuccgccc

SEQ ID NO: 3735541 - RNA, 15 nt, Salmonella enterica enterica serovar Typhi Ty2
cagcgaucaggcguc

SEQ ID NO: 3735542 - RNA, 18 nt, Salmonella enterica enterica serovar Typhi Ty2
cagcgaugagcgccagca

SEQ ID NO: 3735543 - RNA, 19 nt, Salmonella enterica enterica serovar Typhi Ty2
cagcgaugagcgccagcaa

SEQ ID NO: 3735544 - RNA, 17 nt, Salmonella enterica enterica serovar Typhi Ty2
cagcgauuacgccagac

SEQ ID NO: 3735545 - RNA, 13 nt, Salmonella enterica enterica serovar Typhi Ty2
cagcgauuauuuc

SEQ ID NO: 3735546 - RNA, 20 nt, Salmonella enterica enterica serovar Typhi Ty2
cagcgauuccgucaggaacg

SEQ ID NO: 3735547 - RNA, 14 nt, Salmonella enterica enterica serovar Typhi Ty2
cagcgauugcgcca

SEQ ID NO: 3735548 - RNA, 16 nt, Salmonella enterica enterica serovar Typhi Ty2
cagcgauugcgccaga

SEQ ID NO: 3735549 - RNA, 15 nt, Salmonella enterica enterica serovar Typhi Ty2
cagcgcuacccgcug

SEQ ID NO: 3735550 - RNA, 16 nt, Salmonella enterica enterica serovar Typhi Ty2
cagcgcuacccgcuga

SEQ ID NO: 3735551 - RNA, 15 nt, Salmonella enterica enterica serovar Typhi Ty2
cagcgcuauccggcc

SEQ ID NO: 3735552 - RNA, 15 nt, Salmonella enterica enterica serovar Typhi Ty2
cagcgcuccaccaac

SEQ ID NO: 3735553 - RNA, 18 nt, Salmonella enterica enterica serovar Typhi Ty2
cagcgcuccaccaaccag

SEQ ID NO: 3735554 - RNA, 16 nt, Salmonella enterica enterica serovar Typhi Ty2
cagcgcuccacgcguc

SEQ ID NO: 3735555 - RNA, 20 nt, Salmonella enterica enterica serovar Typhi Ty2
cagcgcugcauuugcugccg

SEQ ID NO: 3735556 - RNA, 12 nt, Salmonella enterica enterica serovar Typhi Ty2
cagcgcugcugu

SEQ ID NO: 3735557 - RNA, 22 nt, Salmonella enterica enterica serovar Typhi Ty2
cagcgcugcuguaacagacgca

SEQ ID NO: 3735558 - RNA, 16 nt, Salmonella enterica enterica serovar Typhi Ty2
cagcgcuguccagaua

SEQ ID NO: 3735559 - RNA, 20 nt, Salmonella enterica enterica serovar Typhi Ty2
cagcgcuugccgcagcgcag

SEQ ID NO: 3735560 - RNA, 15 nt, Salmonella enterica enterica serovar Typhi Ty2
cagcgcuuucaccgc

SEQ ID NO: 3735561 - RNA, 15 nt, Salmonella enterica enterica serovar Typhi Ty2
cagcgcuuugccgcu

SEQ ID NO: 3735562 - RNA, 22 nt, Salmonella enterica enterica serovar Typhi Ty2
cagcgcuuugccgcugcugccu

SEQ ID NO: 3735563 - RNA, 16 nt, Salmonella enterica enterica serovar Typhi Ty2
cagcgcuuuugccgcg

SEQ ID NO: 3735564 - RNA, 20 nt, Salmonella enterica enterica serovar Typhi Ty2
cagcggaaagugaaggccag

SEQ ID NO: 3735565 - RNA, 13 nt, Salmonella enterica enterica serovar Typhi Ty2
cagcggaaucccc

SEQ ID NO: 3735566 - RNA, 15 nt, Salmonella enterica enterica serovar Typhi Ty2
cagcggaauucccac

SEQ ID NO: 3735567 - RNA, 17 nt, Salmonella enterica enterica serovar Typhi Ty2
cagcggacggcuaauau

SEQ ID NO: 3735568 - RNA, 19 nt, Salmonella enterica enterica serovar Typhi Ty2
cagcggauuacgcgccugc

SEQ ID NO: 3735569 - RNA, 23 nt, Salmonella enterica enterica serovar Typhi Ty2
cagcggcaaaggcauggcaggua

SEQ ID NO: 3735570 - RNA, 17 nt, Salmonella enterica enterica serovar Typhi Ty2
cagcggcaacucgugca

SEQ ID NO: 3735571 - RNA, 16 nt, Salmonella enterica enterica serovar Typhi Ty2
cagcggcagcucugcc

SEQ ID NO: 3735572 - RNA, 21 nt, Salmonella enterica enterica serovar Typhi Ty2
cagcggcaggauccccauccc

SEQ ID NO: 3735573 - RNA, 15 nt, Salmonella enterica enterica serovar Typhi Ty2
cagcggcaguaaauu

SEQ ID NO: 3735574 - RNA, 13 nt, Salmonella enterica enterica serovar Typhi Ty2
cagcggccaugac

SEQ ID NO: 3735575 - RNA, 17 nt, Salmonella enterica enterica serovar Typhi Ty2
cagcggccauugaaguc

SEQ ID NO: 3735576 - RNA, 21 nt, Salmonella enterica enterica serovar Typhi Ty2
cagcggcgauuuauagagcag

SEQ ID NO: 3735577 - RNA, 13 nt, Salmonella enterica enterica serovar Typhi Ty2
cagcggcgcaggg

SEQ ID NO: 3735578 - RNA, 19 nt, Salmonella enterica enterica serovar Typhi Ty2
cagcggcgccaucaccauc

SEQ ID NO: 3735579 - RNA, 13 nt, Salmonella enterica enterica serovar Typhi Ty2
cagcggcgcgcca

SEQ ID NO: 3735580 - RNA, 14 nt, Salmonella enterica enterica serovar Typhi Ty2
cagcggcgcgcggu

SEQ ID NO: 3735581 - RNA, 13 nt, Salmonella enterica enterica serovar Typhi Ty2
cagcggcggaaug

SEQ ID NO: 3735582 - RNA, 13 nt, Salmonella enterica enterica serovar Typhi Ty2
cagcggcggcagu

SEQ ID NO: 3735583 - RNA, 19 nt, Salmonella enterica enterica serovar Typhi Ty2
cagcggcgguuauccgcca

SEQ ID NO: 3735584 - RNA, 21 nt, Salmonella enterica enterica serovar Typhi Ty2
cagcggcguaucuuccagcgu

SEQ ID NO: 3735585 - RNA, 11 nt, Salmonella enterica enterica serovar Typhi Ty2
cagcggcguug

SEQ ID NO: 3735586 - RNA, 17 nt, Salmonella enterica enterica serovar Typhi Ty2
cagcgggccgcugaugu

SEQ ID NO: 3735587 - RNA, 21 nt, Salmonella enterica enterica serovar Typhi Ty2
cagcgggcuaugcugaagcag

SEQ ID NO: 3735588 - RNA, 14 nt, Salmonella enterica enterica serovar Typhi Ty2
cagcggucaucaau

SEQ ID NO: 3735589 - RNA, 22 nt, Salmonella enterica enterica serovar Typhi Ty2
cagcgguccaauaaacgccagg

SEQ ID NO: 3735590 - RNA, 23 nt, Salmonella enterica enterica serovar Typhi Ty2
cagcgguuacuuuugaacauaaa

SEQ ID NO: 3735591 - RNA, 15 nt, Salmonella enterica enterica serovar Typhi Ty2
cagcgguuugccggu

SEQ ID NO: 3735592 - RNA, 22 nt, Salmonella enterica enterica serovar Typhi Ty2
cagcguaaucggcaggccaacg

SEQ ID NO: 3735593 - RNA, 22 nt, Salmonella enterica enterica serovar Typhi Ty2
cagcguaaugcgccaggcagca

SEQ ID NO: 3735594 - RNA, 21 nt, Salmonella enterica enterica serovar Typhi Ty2
cagcguaauuguugccccgcu

SEQ ID NO: 3735595 - RNA, 15 nt, Salmonella enterica enterica serovar Typhi Ty2
cagcguacaauggca

SEQ ID NO: 3735596 - RNA, 20 nt, Salmonella enterica enterica serovar Typhi Ty2
cagcguacaggcggaaauca

SEQ ID NO: 3735597 - RNA, 15 nt, Salmonella enterica enterica serovar Typhi Ty2
cagcguaccgauaau

SEQ ID NO: 3735598 - RNA, 21 nt, Salmonella enterica enterica serovar Typhi Ty2
cagcguaccugcggcaauggc

SEQ ID NO: 3735599 - RNA, 18 nt, Salmonella enterica enterica serovar Typhi Ty2
cagcguauuaagccaacg

SEQ ID NO: 3735600 - RNA, 16 nt, Salmonella enterica enterica serovar Typhi Ty2
cagcguauugagcugg

SEQ ID NO: 3735601 - RNA, 18 nt, Salmonella enterica enterica serovar Typhi Ty2
cagcgucagcagaguguc

SEQ ID NO: 3735602 - RNA, 20 nt, Salmonella enterica enterica serovar Typhi Ty2
cagcgucaggaacgcggcgc

SEQ ID NO: 3735603 - RNA, 15 nt, Salmonella enterica enterica serovar Typhi Ty2
cagcgucaucagauc

SEQ ID NO: 3735604 - RNA, 13 nt, Salmonella enterica enterica serovar Typhi Ty2
cagcgucauuaaa

SEQ ID NO: 3735605 - RNA, 13 nt, Salmonella enterica enterica serovar Typhi Ty2
cagcgucccggcg

SEQ ID NO: 3735606 - RNA, 16 nt, Salmonella enterica enterica serovar Typhi Ty2
cagcgucccggcgucu

SEQ ID NO: 3735607 - RNA, 22 nt, Salmonella enterica enterica serovar Typhi Ty2
cagcguccgccaucgccucgau

SEQ ID NO: 3735608 - RNA, 14 nt, Salmonella enterica enterica serovar Typhi Ty2
cagcguccggaaaa

SEQ ID NO: 3735609 - RNA, 14 nt, Salmonella enterica enterica serovar Typhi Ty2
cagcguccggagca

SEQ ID NO: 3735610 - RNA, 16 nt, Salmonella enterica enterica serovar Typhi Ty2
cagcgucggauggcga

SEQ ID NO: 3735611 - RNA, 17 nt, Salmonella enterica enterica serovar Typhi Ty2
cagcgucuauagaugau

SEQ ID NO: 3735612 - RNA, 16 nt, Salmonella enterica enterica serovar Typhi Ty2
cagcgucucagcaggc

SEQ ID NO: 3735613 - RNA, 22 nt, Salmonella enterica enterica serovar Typhi Ty2
cagcgucugccccaaacgcuca

SEQ ID NO: 3735614 - RNA, 18 nt, Salmonella enterica enterica serovar Typhi Ty2
cagcgucuguuucaacgc

SEQ ID NO: 3735615 - RNA, 21 nt, Salmonella enterica enterica serovar Typhi Ty2
cagcgugaaacgcccuuccca

SEQ ID NO: 3735616 - RNA, 22 nt, Salmonella enterica enterica serovar Typhi Ty2
cagcgugaaacgcccuucccag

SEQ ID NO: 3735617 - RNA, 17 nt, Salmonella enterica enterica serovar Typhi Ty2
cagcgugaagcugccgu

SEQ ID NO: 3735618 - RNA, 23 nt, Salmonella enterica enterica serovar Typhi Ty2
cagcgugaguuaugacggggaac

SEQ ID NO: 3735619 - RNA, 22 nt, Salmonella enterica enterica serovar Typhi Ty2
cagcguggugacgguugagagg

SEQ ID NO: 3735620 - RNA, 16 nt, Salmonella enterica enterica serovar Typhi Ty2
cagcguguaaucgccg

SEQ ID NO: 3735621 - RNA, 20 nt, Salmonella enterica enterica serovar Typhi Ty2
cagcguguucaugcgcggcg

SEQ ID NO: 3735622 - RNA, 14 nt, Salmonella enterica enterica serovar Typhi Ty2
cagcguugaccagc

SEQ ID NO: 3735623 - RNA, 15 nt, Salmonella enterica enterica serovar Typhi Ty2
cagcguuucaugaau

SEQ ID NO: 3735624 - RNA, 13 nt, Salmonella enterica enterica serovar Typhi Ty2
cagcguuuccagc

SEQ ID NO: 3735625 - RNA, 15 nt, Salmonella enterica enterica serovar Typhi Ty2
cagcguuuugcgcuc

SEQ ID NO: 3735626 - RNA, 19 nt, Salmonella enterica enterica serovar Typhi Ty2
cagcuaaaaccguagauuu

SEQ ID NO: 3735627 - RNA, 17 nt, Salmonella enterica enterica serovar Typhi Ty2
cagcuacuucaggcugu

SEQ ID NO: 3735628 - RNA, 22 nt, Salmonella enterica enterica serovar Typhi Ty2
cagcuauuagcguuuuuaccgg

SEQ ID NO: 3735629 - RNA, 19 nt, Salmonella enterica enterica serovar Typhi Ty2
cagcuauuuuucaccauaa

SEQ ID NO: 3735630 - RNA, 19 nt, Salmonella enterica enterica serovar Typhi Ty2
cagcucaaccgcgcggcgu

SEQ ID NO: 3735631 - RNA, 21 nt, Salmonella enterica enterica serovar Typhi Ty2
caggagcauuggaaauucagg

SEQ ID NO: 3735632 - RNA, 14 nt, Salmonella enterica enterica serovar Typhi Ty2
caggaggccugaau

SEQ ID NO: 3735633 - RNA, 15 nt, Salmonella enterica enterica serovar Typhi Ty2
caggagugaacacgu

SEQ ID NO: 3735634 - RNA, 19 nt, Salmonella enterica enterica serovar Typhi Ty2
caggaguuagcauguggga

SEQ ID NO: 3735635 - RNA, 15 nt, Salmonella enterica enterica serovar Typhi Ty2
caggauaaaauccug

SEQ ID NO: 3735636 - RNA, 18 nt, Salmonella enterica enterica serovar Typhi Ty2
caggauaaaauccugcac

SEQ ID NO: 3735637 - RNA, 15 nt, Salmonella enterica enterica serovar Typhi Ty2
caggauaauaaugau

SEQ ID NO: 3735638 - RNA, 20 nt, Salmonella enterica enterica serovar Typhi Ty2
caggauaauaucgcuggcca

SEQ ID NO: 3735639 - RNA, 22 nt, Salmonella enterica enterica serovar Typhi Ty2
caggauaguacugaccagacag

SEQ ID NO: 3735640 - RNA, 19 nt, Salmonella enterica enterica serovar Typhi Ty2
caggauauacuucaucagg

SEQ ID NO: 3735641 - RNA, 19 nt, Salmonella enterica enterica serovar Typhi Ty2
caggaucaaaaucgcgccc

SEQ ID NO: 3735642 - RNA, 16 nt, Salmonella enterica enterica serovar Typhi Ty2
caggaucaauucugau

SEQ ID NO: 3735643 - RNA, 15 nt, Salmonella enterica enterica serovar Typhi Ty2
caggaucagauauuc

SEQ ID NO: 3735644 - RNA, 21 nt, Salmonella enterica enterica serovar Typhi Ty2
caggaucagauauuccagcga

SEQ ID NO: 3735645 - RNA, 22 nt, Salmonella enterica enterica serovar Typhi Ty2
caggaucgguaaacgccccuuc

SEQ ID NO: 3735646 - RNA, 23 nt, Salmonella enterica enterica serovar Typhi Ty2
caggaucgguaaacgccccuucg

SEQ ID NO: 3735647 - RNA, 14 nt, Salmonella enterica enterica serovar Typhi Ty2
caggaucuuuuuca

SEQ ID NO: 3735648 - RNA, 16 nt, Salmonella enterica enterica serovar Typhi Ty2
caggaugauguucauc

SEQ ID NO: 3735649 - RNA, 16 nt, Salmonella enterica enterica serovar Typhi Ty2
caggaugccaaccacc

SEQ ID NO: 3735650 - RNA, 11 nt, Salmonella enterica enterica serovar Typhi Ty2
caggaugcuga

SEQ ID NO: 3735651 - RNA, 20 nt, Salmonella enterica enterica serovar Typhi Ty2
caggauggccagcaccagca

SEQ ID NO: 3735652 - RNA, 19 nt, Salmonella enterica enterica serovar Typhi Ty2
caggaugugaggcagauau

SEQ ID NO: 3735653 - RNA, 20 nt, Salmonella enterica enterica serovar Typhi Ty2
caggauuauuacacacaguc

SEQ ID NO: 3735654 - RNA, 17 nt, Salmonella enterica enterica serovar Typhi Ty2
caggauuuacugagcgc

SEQ ID NO: 3735655 - RNA, 16 nt, Salmonella enterica enterica serovar Typhi Ty2
caggcaaaaaucggcc

SEQ ID NO: 3735656 - RNA, 12 nt, Salmonella enterica enterica serovar Typhi Ty2
caggcaaaccag

SEQ ID NO: 3735657 - RNA, 14 nt, Salmonella enterica enterica serovar Typhi Ty2
caggcaaaccagca

SEQ ID NO: 3735658 - RNA, 15 nt, Salmonella enterica enterica serovar Typhi Ty2
caggcaaaccagcac

SEQ ID NO: 3735659 - RNA, 16 nt, Salmonella enterica enterica serovar Typhi Ty2
caggcaaagcucaacg

SEQ ID NO: 3735660 - RNA, 22 nt, Salmonella enterica enterica serovar Typhi Ty2
caggcaaaucaacauuauuaaa

SEQ ID NO: 3735661 - RNA, 17 nt, Salmonella enterica enterica serovar Typhi Ty2
caggcaaaucuggugau

SEQ ID NO: 3735662 - RNA, 22 nt, Salmonella enterica enterica serovar Typhi Ty2
caggcaagacacagcgucgcgc

SEQ ID NO: 3735663 - RNA, 17 nt, Salmonella enterica enterica serovar Typhi Ty2
caggcaagacgcaugac

SEQ ID NO: 3735664 - RNA, 17 nt, Salmonella enterica enterica serovar Typhi Ty2
caggcaaguuuaauucc

SEQ ID NO: 3735665 - RNA, 18 nt, Salmonella enterica enterica serovar Typhi Ty2
caggcacagaagcgccug

SEQ ID NO: 3735666 - RNA, 19 nt, Salmonella enterica enterica serovar Typhi Ty2
caggcacagaagcgccugu

SEQ ID NO: 3735667 - RNA, 16 nt, Salmonella enterica enterica serovar Typhi Ty2
caggcacgccugugcu

SEQ ID NO: 3735668 - RNA, 15 nt, Salmonella enterica enterica serovar Typhi Ty2
caggcacgugcauaa

SEQ ID NO: 3735669 - RNA, 21 nt, Salmonella enterica enterica serovar Typhi Ty2
caggcacugaauuuacgccgu

SEQ ID NO: 3735670 - RNA, 14 nt, Salmonella enterica enterica serovar Typhi Ty2
caggcacuugagaa

SEQ ID NO: 3735671 - RNA, 15 nt, Salmonella enterica enterica serovar Typhi Ty2
caggcagaaauaacu

SEQ ID NO: 3735672 - RNA, 13 nt, Salmonella enterica enterica serovar Typhi Ty2
caggcagaacgcu

SEQ ID NO: 3735673 - RNA, 15 nt, Salmonella enterica enterica serovar Typhi Ty2
caggcagccacaaug

SEQ ID NO: 3735674 - RNA, 21 nt, Salmonella enterica enterica serovar Typhi Ty2
caggcaggcccgcgcuuuaau

SEQ ID NO: 3735675 - RNA, 17 nt, Salmonella enterica enterica serovar Typhi Ty2
caggcaguuugcgaaaa

SEQ ID NO: 3735676 - RNA, 18 nt, Salmonella enterica enterica serovar Typhi Ty2
caggcauaaaaaagagga

SEQ ID NO: 3735677 - RNA, 21 nt, Salmonella enterica enterica serovar Typhi Ty2
caggcauaauggaacugccug

SEQ ID NO: 3735678 - RNA, 15 nt, Salmonella enterica enterica serovar Typhi Ty2
caggcauacagaugc

SEQ ID NO: 3735679 - RNA, 21 nt, Salmonella enterica enterica serovar Typhi Ty2
caggcauagaguaucgccugu

SEQ ID NO: 3735680 - RNA, 19 nt, Salmonella enterica enterica serovar Typhi Ty2
caggcauccgugaccugcu

SEQ ID NO: 3735681 - RNA, 16 nt, Salmonella enterica enterica serovar Typhi Ty2
caggcauccugcccug

SEQ ID NO: 3735682 - RNA, 18 nt, Salmonella enterica enterica serovar Typhi Ty2
caggcaucgacgccagcg

SEQ ID NO: 3735683 - RNA, 18 nt, Salmonella enterica enterica serovar Typhi Ty2
caggcaucuuccagcguc

SEQ ID NO: 3735684 - RNA, 20 nt, Salmonella enterica enterica serovar Typhi Ty2
caggcaucuuccagcgucgg

SEQ ID NO: 3735685 - RNA, 15 nt, Salmonella enterica enterica serovar Typhi Ty2
caggcauggcagcag

SEQ ID NO: 3735686 - RNA, 17 nt, Salmonella enterica enterica serovar Typhi Ty2
caggcauggcagcaggg

SEQ ID NO: 3735687 - RNA, 12 nt, Salmonella enterica enterica serovar Typhi Ty2
caggcauggcca

SEQ ID NO: 3735688 - RNA, 20 nt, Salmonella enterica enterica serovar Typhi Ty2
caggcauguugcgcaaucac

SEQ ID NO: 3735689 - RNA, 14 nt, Salmonella enterica enterica serovar Typhi Ty2
caggcauuaaaaaa

SEQ ID NO: 3735690 - RNA, 15 nt, Salmonella enterica enterica serovar Typhi Ty2
caggcauuaaaaaaa

SEQ ID NO: 3735691 - RNA, 15 nt, Salmonella enterica enterica serovar Typhi Ty2
caggcauuuuauuac

SEQ ID NO: 3735692 - RNA, 17 nt, Salmonella enterica enterica serovar Typhi Ty2
caggcauuuuauuaccu

SEQ ID NO: 3735693 - RNA, 18 nt, Salmonella enterica enterica serovar Typhi Ty2
caggccaaacagcggcuc

SEQ ID NO: 3735694 - RNA, 14 nt, Salmonella enterica enterica serovar Typhi Ty2
caggccaacauagc

SEQ ID NO: 3735695 - RNA, 20 nt, Salmonella enterica enterica serovar Typhi Ty2
caggccaacguaguuauugu

SEQ ID NO: 3735696 - RNA, 16 nt, Salmonella enterica enterica serovar Typhi Ty2
caggccaagcagcgcc

SEQ ID NO: 3735697 - RNA, 23 nt, Salmonella enterica enterica serovar Typhi Ty2
caggccaagcgccuguucaacau

SEQ ID NO: 3735698 - RNA, 18 nt, Salmonella enterica enterica serovar Typhi Ty2
caggccaauuccgccaua

SEQ ID NO: 3735699 - RNA, 23 nt, Salmonella enterica enterica serovar Typhi Ty2
caggccagauauugccgaccauu

SEQ ID NO: 3735700 - RNA, 15 nt, Salmonella enterica enterica serovar Typhi Ty2
caggccaucauaccg

SEQ ID NO: 3735701 - RNA, 19 nt, Salmonella enterica enterica serovar Typhi Ty2
caggccaucauugauacug

SEQ ID NO: 3735702 - RNA, 16 nt, Salmonella enterica enterica serovar Typhi Ty2
caggccaugcgccgcg

SEQ ID NO: 3735703 - RNA, 21 nt, Salmonella enterica enterica serovar Typhi Ty2
caggccaugcgccgcgucagc

SEQ ID NO: 3735704 - RNA, 20 nt, Salmonella enterica enterica serovar Typhi Ty2
caggccauuuuuucgaugau

SEQ ID NO: 3735705 - RNA, 12 nt, Salmonella enterica enterica serovar Typhi Ty2
caggcccagccg

SEQ ID NO: 3735706 - RNA, 13 nt, Salmonella enterica enterica serovar Typhi Ty2
caggcccagccgc

SEQ ID NO: 3735707 - RNA, 13 nt, Salmonella enterica enterica serovar Typhi Ty2
caggccgccaccg

SEQ ID NO: 3735708 - RNA, 14 nt, Salmonella enterica enterica serovar Typhi Ty2
caggccgccaccgc

SEQ ID NO: 3735709 - RNA, 19 nt, Salmonella enterica enterica serovar Typhi Ty2
caggccgccgcaaaagccg

SEQ ID NO: 3735710 - RNA, 14 nt, Salmonella enterica enterica serovar Typhi Ty2
caggccgcgccgcu

SEQ ID NO: 3735711 - RNA, 15 nt, Salmonella enterica enterica serovar Typhi Ty2
caggccgcgccgcug

SEQ ID NO: 3735712 - RNA, 13 nt, Salmonella enterica enterica serovar Typhi Ty2
caggccggauaag

SEQ ID NO: 3735713 - RNA, 14 nt, Salmonella enterica enterica serovar Typhi Ty2
cagggacuuauuaa

SEQ ID NO: 3735714 - RNA, 20 nt, Salmonella enterica enterica serovar Typhi Ty2
cagggagacggccacccauc

SEQ ID NO: 3735715 - RNA, 17 nt, Salmonella enterica enterica serovar Typhi Ty2
cagggauauacaaauau

SEQ ID NO: 3735716 - RNA, 18 nt, Salmonella enterica enterica serovar Typhi Ty2
cagggcagcgagcaccga

SEQ ID NO: 3735717 - RNA, 15 nt, Salmonella enterica enterica serovar Typhi Ty2
cagggcaucaugaug

SEQ ID NO: 3735718 - RNA, 16 nt, Salmonella enterica enterica serovar Typhi Ty2
cagggcaucccguccc

SEQ ID NO: 3735719 - RNA, 20 nt, Salmonella enterica enterica serovar Typhi Ty2
cagggcaucccgucccacca

SEQ ID NO: 3735720 - RNA, 18 nt, Salmonella enterica enterica serovar Typhi Ty2
cagggccgcgagaacuuc

SEQ ID NO: 3735721 - RNA, 23 nt, Salmonella enterica enterica serovar Typhi Ty2
cagggcgaacauuccgcccaaga

SEQ ID NO: 3735722 - RNA, 14 nt, Salmonella enterica enterica serovar Typhi Ty2
cagggcgauuuccg

SEQ ID NO: 3735723 - RNA, 13 nt, Salmonella enterica enterica serovar Typhi Ty2
cagggcggaagca

SEQ ID NO: 3735724 - RNA, 14 nt, Salmonella enterica enterica serovar Typhi Ty2
cagggcggcgcgcu

SEQ ID NO: 3735725 - RNA, 21 nt, Salmonella enterica enterica serovar Typhi Ty2
cagggcgggauccccugcucc

SEQ ID NO: 3735726 - RNA, 17 nt, Salmonella enterica enterica serovar Typhi Ty2
cagggcgugacgcgcca

SEQ ID NO: 3735727 - RNA, 19 nt, Salmonella enterica enterica serovar Typhi Ty2
cagggcugaaucggcaccu

SEQ ID NO: 3735728 - RNA, 19 nt, Salmonella enterica enterica serovar Typhi Ty2
cagggcugcuggccuucca

SEQ ID NO: 3735729 - RNA, 21 nt, Salmonella enterica enterica serovar Typhi Ty2
cagggcugcuggugcgccugu

SEQ ID NO: 3735730 - RNA, 15 nt, Salmonella enterica enterica serovar Typhi Ty2
cagggcuuuuuucuc

SEQ ID NO: 3735731 - RNA, 22 nt, Salmonella enterica enterica serovar Typhi Ty2
cagggcuuuuuucucgcgcuga

SEQ ID NO: 3735732 - RNA, 20 nt, Salmonella enterica enterica serovar Typhi Ty2
caggggaugauuuucaggca

SEQ ID NO: 3735733 - RNA, 17 nt, Salmonella enterica enterica serovar Typhi Ty2
caggggauuagacuucc

SEQ ID NO: 3735734 - RNA, 21 nt, Salmonella enterica enterica serovar Typhi Ty2
caggggcuauugaaaaagccg

SEQ ID NO: 3735735 - RNA, 19 nt, Salmonella enterica enterica serovar Typhi Ty2
caggggcucuaaaaaggaa

SEQ ID NO: 3735736 - RNA, 24 nt, Salmonella enterica enterica serovar Typhi Ty2
cagggggauagcgacggggcgcag

SEQ ID NO: 3735737 - RNA, 17 nt, Salmonella enterica enterica serovar Typhi Ty2
cagggguguuacgccau

SEQ ID NO: 3735738 - RNA, 17 nt, Salmonella enterica enterica serovar Typhi Ty2
caggguaaucaccauua

SEQ ID NO: 3735739 - RNA, 17 nt, Salmonella enterica enterica serovar Typhi Ty2
caggguaucaucgcuua

SEQ ID NO: 3735740 - RNA, 19 nt, Salmonella enterica enterica serovar Typhi Ty2
caggguaucauuaugggca

SEQ ID NO: 3735741 - RNA, 23 nt, Salmonella enterica enterica serovar Typhi Ty2
caggguaucauuaugggcagcac

SEQ ID NO: 3735742 - RNA, 16 nt, Salmonella enterica enterica serovar Typhi Ty2
caggguaucuaacccg

SEQ ID NO: 3735743 - RNA, 14 nt, Salmonella enterica enterica serovar Typhi Ty2
cagggucaggaacu

SEQ ID NO: 3735744 - RNA, 21 nt, Salmonella enterica enterica serovar Typhi Ty2
cagggucgcggcauuaaaugc

SEQ ID NO: 3735745 - RNA, 23 nt, Salmonella enterica enterica serovar Typhi Ty2
cagggucuuauuucuccugcgcc

SEQ ID NO: 3735746 - RNA, 21 nt, Salmonella enterica enterica serovar Typhi Ty2
cagggugaagaguauuauuuu

SEQ ID NO: 3735747 - RNA, 16 nt, Salmonella enterica enterica serovar Typhi Ty2
cagggugaugguguca

SEQ ID NO: 3735748 - RNA, 12 nt, Salmonella enterica enterica serovar Typhi Ty2
caggguggcgcu

SEQ ID NO: 3735749 - RNA, 23 nt, Salmonella enterica enterica serovar Typhi Ty2
caggguuauuuccgcuggccggu

SEQ ID NO: 3735750 - RNA, 16 nt, Salmonella enterica enterica serovar Typhi Ty2
caggguucacugccag

SEQ ID NO: 3735751 - RNA, 14 nt, Salmonella enterica enterica serovar Typhi Ty2
caggguugcguucg

SEQ ID NO: 3735752 - RNA, 13 nt, Salmonella enterica enterica serovar Typhi Ty2
caggguuugccag

SEQ ID NO: 3735753 - RNA, 21 nt, Salmonella enterica enterica serovar Typhi Ty2
caggguuugccagcaccagca

SEQ ID NO: 3735754 - RNA, 16 nt, Salmonella enterica enterica serovar Typhi Ty2
caggguuuuacgcugg

SEQ ID NO: 3735755 - RNA, 18 nt, Salmonella enterica enterica serovar Typhi Ty2
cagguaaaaccagauacg

SEQ ID NO: 3735756 - RNA, 23 nt, Salmonella enterica enterica serovar Typhi Ty2
cagguaaaaccagauacgcaucg

SEQ ID NO: 3735757 - RNA, 18 nt, Salmonella enterica enterica serovar Typhi Ty2
cagguaaaccggucaggu

SEQ ID NO: 3735758 - RNA, 22 nt, Salmonella enterica enterica serovar Typhi Ty2
cagguaacauaucgacauaagu

SEQ ID NO: 3735759 - RNA, 20 nt, Salmonella enterica enterica serovar Typhi Ty2
cagguaacgacuacuuccag

SEQ ID NO: 3735760 - RNA, 19 nt, Salmonella enterica enterica serovar Typhi Ty2
cagguaauacaggguuugu

SEQ ID NO: 3735761 - RNA, 15 nt, Salmonella enterica enterica serovar Typhi Ty2
cagguaaucaucacc

SEQ ID NO: 3735762 - RNA, 15 nt, Salmonella enterica enterica serovar Typhi Ty2
cagguaaugacuuuu

SEQ ID NO: 3735763 - RNA, 16 nt, Salmonella enterica enterica serovar Typhi Ty2
cagguacagguaauga

SEQ ID NO: 3735764 - RNA, 21 nt, Salmonella enterica enterica serovar Typhi Ty2
cagguaccccagccauauuuc

SEQ ID NO: 3735765 - RNA, 15 nt, Salmonella enterica enterica serovar Typhi Ty2
cagguaccccgccac

SEQ ID NO: 3735766 - RNA, 14 nt, Salmonella enterica enterica serovar Typhi Ty2
cagguagcagaccg

SEQ ID NO: 3735767 - RNA, 19 nt, Salmonella enterica enterica serovar Typhi Ty2
cagguagcgccuuuacugg

SEQ ID NO: 3735768 - RNA, 23 nt, Salmonella enterica enterica serovar Typhi Ty2
cagguauuaaauacagagucgcu

SEQ ID NO: 3735769 - RNA, 16 nt, Salmonella enterica enterica serovar Typhi Ty2
cagguauuaauccugc

SEQ ID NO: 3735770 - RNA, 16 nt, Salmonella enterica enterica serovar Typhi Ty2
cagguauucaccaaaa

SEQ ID NO: 3735771 - RNA, 20 nt, Salmonella enterica enterica serovar Typhi Ty2
cagguauuuagccacgccgu

SEQ ID NO: 3735772 - RNA, 22 nt, Salmonella enterica enterica serovar Typhi Ty2
cagguauuuagccacgccgucc

SEQ ID NO: 3735773 - RNA, 24 nt, Salmonella enterica enterica serovar Typhi Ty2
cagguauuucgaggggcaggaagg

SEQ ID NO: 3735774 - RNA, 21 nt, Salmonella enterica enterica serovar Typhi Ty2
caggucaaaauuaaucgccag

SEQ ID NO: 3735775 - RNA, 19 nt, Salmonella enterica enterica serovar Typhi Ty2
caggucaucaccuccagca

SEQ ID NO: 3735776 - RNA, 23 nt, Salmonella enterica enterica serovar Typhi Ty2
caggucaucaccuccagcacgcg

SEQ ID NO: 3735777 - RNA, 21 nt, Salmonella enterica enterica serovar Typhi Ty2
caggucauucaggacgguggu

SEQ ID NO: 3735778 - RNA, 15 nt, Salmonella enterica enterica serovar Typhi Ty2
caggucgaugauuuu

SEQ ID NO: 3735779 - RNA, 21 nt, Salmonella enterica enterica serovar Typhi Ty2
caggucgcacuccucugucga

SEQ ID NO: 3735780 - RNA, 20 nt, Salmonella enterica enterica serovar Typhi Ty2
caggucgccagaagccgucg

SEQ ID NO: 3735781 - RNA, 20 nt, Salmonella enterica enterica serovar Typhi Ty2
caggucgccagcgggauaaa

SEQ ID NO: 3735782 - RNA, 16 nt, Salmonella enterica enterica serovar Typhi Ty2
caggucggccaaccgc

SEQ ID NO: 3735783 - RNA, 21 nt, Salmonella enterica enterica serovar Typhi Ty2
caggucuauugccuaaauaac

SEQ ID NO: 3735784 - RNA, 14 nt, Salmonella enterica enterica serovar Typhi Ty2
caggucugagauaa

SEQ ID NO: 3735785 - RNA, 14 nt, Salmonella enterica enterica serovar Typhi Ty2
caggugaacauuac

SEQ ID NO: 3735786 - RNA, 13 nt, Salmonella enterica enterica serovar Typhi Ty2
caggugaccaggc

SEQ ID NO: 3735787 - RNA, 15 nt, Salmonella enterica enterica serovar Typhi Ty2
caggugacgaagauc

SEQ ID NO: 3735788 - RNA, 17 nt, Salmonella enterica enterica serovar Typhi Ty2
caggugaucuguucaaa

SEQ ID NO: 3735789 - RNA, 16 nt, Salmonella enterica enterica serovar Typhi Ty2
caggugcggacugggc

SEQ ID NO: 3735790 - RNA, 15 nt, Salmonella enterica enterica serovar Typhi Ty2
caggugcggcugggc

SEQ ID NO: 3735791 - RNA, 17 nt, Salmonella enterica enterica serovar Typhi Ty2
caggugcggcugggcga

SEQ ID NO: 3735792 - RNA, 16 nt, Salmonella enterica enterica serovar Typhi Ty2
caggugcuuaucugag

SEQ ID NO: 3735793 - RNA, 20 nt, Salmonella enterica enterica serovar Typhi Ty2
cagguggaucccccuggccc

SEQ ID NO: 3735794 - RNA, 13 nt, Salmonella enterica enterica serovar Typhi Ty2
caguacggcgcac

SEQ ID NO: 3735795 - RNA, 19 nt, Salmonella enterica enterica serovar Typhi Ty2
caguacguaacggaaaagc

SEQ ID NO: 3735796 - RNA, 17 nt, Salmonella enterica enterica serovar Typhi Ty2
caguacuuucuuuugau

SEQ ID NO: 3735797 - RNA, 19 nt, Salmonella enterica enterica serovar Typhi Ty2
caguagaucgacauaagag

SEQ ID NO: 3735798 - RNA, 20 nt, Salmonella enterica enterica serovar Typhi Ty2
caguagaucgacauaagagu

SEQ ID NO: 3735799 - RNA, 16 nt, Salmonella enterica enterica serovar Typhi Ty2
caguagcagacagccg

SEQ ID NO: 3735800 - RNA, 18 nt, Salmonella enterica enterica serovar Typhi Ty2
caguagcagacagccgau

SEQ ID NO: 3735801 - RNA, 16 nt, Salmonella enterica enterica serovar Typhi Ty2
caguagcgcgacgcca

SEQ ID NO: 3735802 - RNA, 22 nt, Salmonella enterica enterica serovar Typhi Ty2
caguagcgcgacgccaaaccug

SEQ ID NO: 3735803 - RNA, 20 nt, Salmonella enterica enterica serovar Typhi Ty2
caguagucgcgccauuccgc

SEQ ID NO: 3735804 - RNA, 17 nt, Salmonella enterica enterica serovar Typhi Ty2
caguaugaugaccuggu

SEQ ID NO: 3735805 - RNA, 16 nt, Salmonella enterica enterica serovar Typhi Ty2
caguauugccgaugcc

SEQ ID NO: 3735806 - RNA, 20 nt, Salmonella enterica enterica serovar Typhi Ty2
caguauugccgaugccugcg

SEQ ID NO: 3735807 - RNA, 23 nt, Salmonella enterica enterica serovar Typhi Ty2
cagucaacgaggugaauaaaucc

SEQ ID NO: 3735808 - RNA, 12 nt, Salmonella enterica enterica serovar Typhi Ty2
cagucacagauc

SEQ ID NO: 3735809 - RNA, 16 nt, Salmonella enterica enterica serovar Typhi Ty2
cagucagaggaauucu

SEQ ID NO: 3735810 - RNA, 17 nt, Salmonella enterica enterica serovar Typhi Ty2
cagucagcaauuaacaa

SEQ ID NO: 3735811 - RNA, 18 nt, Salmonella enterica enterica serovar Typhi Ty2
cagucagcaauuaacaaa

SEQ ID NO: 3735812 - RNA, 16 nt, Salmonella enterica enterica serovar Typhi Ty2
cagucagcgcgagcgu

SEQ ID NO: 3735813 - RNA, 11 nt, Salmonella enterica enterica serovar Typhi Ty2
cagucagcucc

SEQ ID NO: 3735814 - RNA, 13 nt, Salmonella enterica enterica serovar Typhi Ty2
cagucaucgcgcc

SEQ ID NO: 3735815 - RNA, 17 nt, Salmonella enterica enterica serovar Typhi Ty2
cagucaucgcgccaaac

SEQ ID NO: 3735816 - RNA, 15 nt, Salmonella enterica enterica serovar Typhi Ty2
cagucauggcuuuua

SEQ ID NO: 3735817 - RNA, 17 nt, Salmonella enterica enterica serovar Typhi Ty2
cagucauuugcagguua

SEQ ID NO: 3735818 - RNA, 12 nt, Salmonella enterica enterica serovar Typhi Ty2
caguccagaugc

SEQ ID NO: 3735819 - RNA, 23 nt, Salmonella enterica enterica serovar Typhi Ty2
caguccagcgcggguucuuucca

SEQ ID NO: 3735820 - RNA, 19 nt, Salmonella enterica enterica serovar Typhi Ty2
cagucccaaugcggaaacc

SEQ ID NO: 3735821 - RNA, 22 nt, Salmonella enterica enterica serovar Typhi Ty2
cagucccaaugcggaaaccagu

SEQ ID NO: 3735822 - RNA, 21 nt, Salmonella enterica enterica serovar Typhi Ty2
caguccccagcguaccacgcc

SEQ ID NO: 3735823 - RNA, 14 nt, Salmonella enterica enterica serovar Typhi Ty2
caguccccuuuuca

SEQ ID NO: 3735824 - RNA, 20 nt, Salmonella enterica enterica serovar Typhi Ty2
cagucccugaagaaaaggaa

SEQ ID NO: 3735825 - RNA, 24 nt, Salmonella enterica enterica serovar Typhi Ty2
cagucccugaagaaaaggaaugcc

SEQ ID NO: 3735826 - RNA, 15 nt, Salmonella enterica enterica serovar Typhi Ty2
caguccgcccgccuc

SEQ ID NO: 3735827 - RNA, 19 nt, Salmonella enterica enterica serovar Typhi Ty2
caguccgcgcgcuuuuuug

SEQ ID NO: 3735828 - RNA, 17 nt, Salmonella enterica enterica serovar Typhi Ty2
caguccgggcauaaccu

SEQ ID NO: 3735829 - RNA, 16 nt, Salmonella enterica enterica serovar Typhi Ty2
caguccuccggcugaa

SEQ ID NO: 3735830 - RNA, 14 nt, Salmonella enterica enterica serovar Typhi Ty2
caguccucgcccac

SEQ ID NO: 3735831 - RNA, 14 nt, Salmonella enterica enterica serovar Typhi Ty2
caguccugucccug

SEQ ID NO: 3735832 - RNA, 16 nt, Salmonella enterica enterica serovar Typhi Ty2
caguccuuucgacgca

SEQ ID NO: 3735833 - RNA, 23 nt, Salmonella enterica enterica serovar Typhi Ty2
cagucgaacauccuugcacgcca

SEQ ID NO: 3735834 - RNA, 16 nt, Salmonella enterica enterica serovar Typhi Ty2
cagucgcagagcccag

SEQ ID NO: 3735835 - RNA, 13 nt, Salmonella enterica enterica serovar Typhi Ty2
cagucgcagccac

SEQ ID NO: 3735836 - RNA, 20 nt, Salmonella enterica enterica serovar Typhi Ty2
cagucgcgccgugcccagca

SEQ ID NO: 3735837 - RNA, 23 nt, Salmonella enterica enterica serovar Typhi Ty2
cagucgcucuaucgccuggagcu

SEQ ID NO: 3735838 - RNA, 19 nt, Salmonella enterica enterica serovar Typhi Ty2
cagucgggaucgccagauc

SEQ ID NO: 3735839 - RNA, 20 nt, Salmonella enterica enterica serovar Typhi Ty2
cagucgucauggcguaaauc

SEQ ID NO: 3735840 - RNA, 17 nt, Salmonella enterica enterica serovar Typhi Ty2
cagucguggcggauucu

SEQ ID NO: 3735841 - RNA, 16 nt, Salmonella enterica enterica serovar Typhi Ty2
cagucguugcgccugu

SEQ ID NO: 3735842 - RNA, 16 nt, Salmonella enterica enterica serovar Typhi Ty2
cagucuaauuuauuaa

SEQ ID NO: 3735843 - RNA, 20 nt, Salmonella enterica enterica serovar Typhi Ty2
cagucuaauuuauuaacccu

SEQ ID NO: 3735844 - RNA, 21 nt, Salmonella enterica enterica serovar Typhi Ty2
cagucucaaaggccugcauca

SEQ ID NO: 3735845 - RNA, 13 nt, Salmonella enterica enterica serovar Typhi Ty2
cagucugcccggc

SEQ ID NO: 3735846 - RNA, 21 nt, Salmonella enterica enterica serovar Typhi Ty2
cagucuggcggcagccgacag

SEQ ID NO: 3735847 - RNA, 22 nt, Salmonella enterica enterica serovar Typhi Ty2
cagucuggguuagcuguaucca

SEQ ID NO: 3735848 - RNA, 15 nt, Salmonella enterica enterica serovar Typhi Ty2
cagugaaaagcugga

SEQ ID NO: 3735849 - RNA, 18 nt, Salmonella enterica enterica serovar Typhi Ty2
cagugaaaccggcgcgcc

SEQ ID NO: 3735850 - RNA, 19 nt, Salmonella enterica enterica serovar Typhi Ty2
cagugaaaccggcgcgccu

SEQ ID NO: 3735851 - RNA, 19 nt, Salmonella enterica enterica serovar Typhi Ty2
cagugaaacgggugagguc

SEQ ID NO: 3735852 - RNA, 13 nt, Salmonella enterica enterica serovar Typhi Ty2
cagugaaauaaau

SEQ ID NO: 3735853 - RNA, 15 nt, Salmonella enterica enterica serovar Typhi Ty2
cagugaaauccucua

SEQ ID NO: 3735854 - RNA, 14 nt, Salmonella enterica enterica serovar Typhi Ty2
cagugaacacccug

SEQ ID NO: 3735855 - RNA, 17 nt, Salmonella enterica enterica serovar Typhi Ty2
cagugaacacccugccc

SEQ ID NO: 3735856 - RNA, 22 nt, Salmonella enterica enterica serovar Typhi Ty2
cagugaauauccccugacagag

SEQ ID NO: 3735857 - RNA, 21 nt, Salmonella enterica enterica serovar Typhi Ty2
cagugacaaacucacguuccc

SEQ ID NO: 3735858 - RNA, 15 nt, Salmonella enterica enterica serovar Typhi Ty2
cagugacauuuaucu

SEQ ID NO: 3735859 - RNA, 16 nt, Salmonella enterica enterica serovar Typhi Ty2
cagugacccgccgcca

SEQ ID NO: 3735860 - RNA, 16 nt, Salmonella enterica enterica serovar Typhi Ty2
cagugacgccaguucc

SEQ ID NO: 3735861 - RNA, 20 nt, Salmonella enterica enterica serovar Typhi Ty2
cagugagcuuugcacgcugu

SEQ ID NO: 3735862 - RNA, 20 nt, Salmonella enterica enterica serovar Typhi Ty2
cagugauccaucgguucucu

SEQ ID NO: 3735863 - RNA, 21 nt, Salmonella enterica enterica serovar Typhi Ty2
cagugaugaaucgcuauugag

SEQ ID NO: 3735864 - RNA, 24 nt, Salmonella enterica enterica serovar Typhi Ty2
cagugauuacaaaaugugcaauca

SEQ ID NO: 3735865 - RNA, 17 nt, Salmonella enterica enterica serovar Typhi Ty2
cagugauuaugcucccg

SEQ ID NO: 3735866 - RNA, 22 nt, Salmonella enterica enterica serovar Typhi Ty2
cagugauuuacuccaaaaauaa

SEQ ID NO: 3735867 - RNA, 19 nt, Salmonella enterica enterica serovar Typhi Ty2
cagugcaggauuuguauca

SEQ ID NO: 3735868 - RNA, 23 nt, Salmonella enterica enterica serovar Typhi Ty2
cagugcaguauugcaccaggaag

SEQ ID NO: 3735869 - RNA, 17 nt, Salmonella enterica enterica serovar Typhi Ty2
cagugccugguggcgac

SEQ ID NO: 3735870 - RNA, 16 nt, Salmonella enterica enterica serovar Typhi Ty2
cagugcgauaccggcc

SEQ ID NO: 3735871 - RNA, 23 nt, Salmonella enterica enterica serovar Typhi Ty2
cagugcgaugggcuucagauguu

SEQ ID NO: 3735872 - RNA, 22 nt, Salmonella enterica enterica serovar Typhi Ty2
cagugcgcauacuaccgcugcg

SEQ ID NO: 3735873 - RNA, 18 nt, Salmonella enterica enterica serovar Typhi Ty2
cagugcuaaaauuauaca

SEQ ID NO: 3735874 - RNA, 14 nt, Salmonella enterica enterica serovar Typhi Ty2
caguggaaaacagc

SEQ ID NO: 3735875 - RNA, 18 nt, Salmonella enterica enterica serovar Typhi Ty2
caguggagaggccaccag

SEQ ID NO: 3735876 - RNA, 15 nt, Salmonella enterica enterica serovar Typhi Ty2
cauaaaugcugauga

SEQ ID NO: 3735877 - RNA, 22 nt, Salmonella enterica enterica serovar Typhi Ty2
cauaaaugcugucgcccauuga

SEQ ID NO: 3735878 - RNA, 15 nt, Salmonella enterica enterica serovar Typhi Ty2
cauaaauugcagcga

SEQ ID NO: 3735879 - RNA, 17 nt, Salmonella enterica enterica serovar Typhi Ty2
cauaaauugcagcgacc

SEQ ID NO: 3735880 - RNA, 23 nt, Salmonella enterica enterica serovar Typhi Ty2
cauaaauuggcucagaauuuaaa

SEQ ID NO: 3735881 - RNA, 15 nt, Salmonella enterica enterica serovar Typhi Ty2
cauaacaaaaccagc

SEQ ID NO: 3735882 - RNA, 14 nt, Salmonella enterica enterica serovar Typhi Ty2
cauaacaacuauuu

SEQ ID NO: 3735883 - RNA, 21 nt, Salmonella enterica enterica serovar Typhi Ty2
cauaacaacuauuuuuccggc

SEQ ID NO: 3735884 - RNA, 15 nt, Salmonella enterica enterica serovar Typhi Ty2
cauaacaccaauacg

SEQ ID NO: 3735885 - RNA, 22 nt, Salmonella enterica enterica serovar Typhi Ty2
cauaaccaaacgcgcauuuuau

SEQ ID NO: 3735886 - RNA, 16 nt, Salmonella enterica enterica serovar Typhi Ty2
cauaaccgcagucucc

SEQ ID NO: 3735887 - RNA, 16 nt, Salmonella enterica enterica serovar Typhi Ty2
cauaaccgugcggcgg

SEQ ID NO: 3735888 - RNA, 17 nt, Salmonella enterica enterica serovar Typhi Ty2
cauaacgaccaaacaag

SEQ ID NO: 3735889 - RNA, 15 nt, Salmonella enterica enterica serovar Typhi Ty2
cauaacgccgaugcc

SEQ ID NO: 3735890 - RNA, 16 nt, Salmonella enterica enterica serovar Typhi Ty2
cauaacgccuuauucg

SEQ ID NO: 3735891 - RNA, 17 nt, Salmonella enterica enterica serovar Typhi Ty2
cauaacgcuguaccggc

SEQ ID NO: 3735892 - RNA, 20 nt, Salmonella enterica enterica serovar Typhi Ty2
cauaacgcuuuguacagaca

SEQ ID NO: 3735893 - RNA, 18 nt, Salmonella enterica enterica serovar Typhi Ty2
cauaacggccuuuuuccg

SEQ ID NO: 3735894 - RNA, 23 nt, Salmonella enterica enterica serovar Typhi Ty2
cauaacgggguauaacucagcgg

SEQ ID NO: 3735895 - RNA, 18 nt, Salmonella enterica enterica serovar Typhi Ty2
cauaacguuuccuuauau

SEQ ID NO: 3735896 - RNA, 20 nt, Salmonella enterica enterica serovar Typhi Ty2
cauaagagauggaaugagca

SEQ ID NO: 3735897 - RNA, 22 nt, Salmonella enterica enterica serovar Typhi Ty2
cauaagcaaacagugggaagca

SEQ ID NO: 3735898 - RNA, 23 nt, Salmonella enterica enterica serovar Typhi Ty2
cauaagcaaauccucgucaaggu

SEQ ID NO: 3735899 - RNA, 18 nt, Salmonella enterica enterica serovar Typhi Ty2
cauaagcacaccauuuca

SEQ ID NO: 3735900 - RNA, 14 nt, Salmonella enterica enterica serovar Typhi Ty2
cauaagcgcggcgg

SEQ ID NO: 3735901 - RNA, 21 nt, Salmonella enterica enterica serovar Typhi Ty2
cauaagcuuaggauaagaaua

SEQ ID NO: 3735902 - RNA, 19 nt, Salmonella enterica enterica serovar Typhi Ty2
cauaaggguaagcaauaug

SEQ ID NO: 3735903 - RNA, 22 nt, Salmonella enterica enterica serovar Typhi Ty2
cauaagugauacaugcuacagg

SEQ ID NO: 3735904 - RNA, 17 nt, Salmonella enterica enterica serovar Typhi Ty2
cauaauaaacugcaucc

SEQ ID NO: 3735905 - RNA, 20 nt, Salmonella enterica enterica serovar Typhi Ty2
cauaauaaacugcauccccu

SEQ ID NO: 3735906 - RNA, 17 nt, Salmonella enterica enterica serovar Typhi Ty2
cauaauaagcgcucagg

SEQ ID NO: 3735907 - RNA, 23 nt, Salmonella enterica enterica serovar Typhi Ty2
cauaauaagcgcucaggcagcca

SEQ ID NO: 3735908 - RNA, 14 nt, Salmonella enterica enterica serovar Typhi Ty2
cauaauaaugaaua

SEQ ID NO: 3735909 - RNA, 16 nt, Salmonella enterica enterica serovar Typhi Ty2
cauaauaaugacuaau

SEQ ID NO: 3735910 - RNA, 14 nt, Salmonella enterica enterica serovar Typhi Ty2
cauaauauccugca

SEQ ID NO: 3735911 - RNA, 19 nt, Salmonella enterica enterica serovar Typhi Ty2
cauaaucgacaguggcuuu

SEQ ID NO: 3735912 - RNA, 18 nt, Salmonella enterica enterica serovar Typhi Ty2
cauaaucgccgacuaauu

SEQ ID NO: 3735913 - RNA, 23 nt, Salmonella enterica enterica serovar Typhi Ty2
cauaaucgccgacuaauuauuuu

SEQ ID NO: 3735914 - RNA, 17 nt, Salmonella enterica enterica serovar Typhi Ty2
cauaaucgcuuuuuccu

SEQ ID NO: 3735915 - RNA, 20 nt, Salmonella enterica enterica serovar Typhi Ty2
cauaaucggccaggauggcc

SEQ ID NO: 3735916 - RNA, 22 nt, Salmonella enterica enterica serovar Typhi Ty2
cauaaucugugauugaauucac

SEQ ID NO: 3735917 - RNA, 16 nt, Salmonella enterica enterica serovar Typhi Ty2
cauaaugaauacgcuc

SEQ ID NO: 3735918 - RNA, 12 nt, Salmonella enterica enterica serovar Typhi Ty2
cauaaugaaucc

SEQ ID NO: 3735919 - RNA, 21 nt, Salmonella enterica enterica serovar Typhi Ty2
cauaaugauggggucacaggu

SEQ ID NO: 3735920 - RNA, 22 nt, Salmonella enterica enterica serovar Typhi Ty2
cauaaugauggggucacagguu

SEQ ID NO: 3735921 - RNA, 19 nt, Salmonella enterica enterica serovar Typhi Ty2
cauaauggaacugccuggc

SEQ ID NO: 3735922 - RNA, 14 nt, Salmonella enterica enterica serovar Typhi Ty2
cauaauggcccagu

SEQ ID NO: 3735923 - RNA, 23 nt, Salmonella enterica enterica serovar Typhi Ty2
cauaauggcgacgccuucaguca

SEQ ID NO: 3735924 - RNA, 20 nt, Salmonella enterica enterica serovar Typhi Ty2
cauaauugcugcccgccgcc

SEQ ID NO: 3735925 - RNA, 17 nt, Salmonella enterica enterica serovar Typhi Ty2
cauaauuguucagcuac

SEQ ID NO: 3735926 - RNA, 14 nt, Salmonella enterica enterica serovar Typhi Ty2
cauaauuuccggcg

SEQ ID NO: 3735927 - RNA, 15 nt, Salmonella enterica enterica serovar Typhi Ty2
cauaauuuuugccuu

SEQ ID NO: 3735928 - RNA, 16 nt, Salmonella enterica enterica serovar Typhi Ty2
cauaauuuuugccuuu

SEQ ID NO: 3735929 - RNA, 16 nt, Salmonella enterica enterica serovar Typhi Ty2
cauacaaagagaaaau

SEQ ID NO: 3735930 - RNA, 16 nt, Salmonella enterica enterica serovar Typhi Ty2
cauacaccuuugcccg

SEQ ID NO: 3735931 - RNA, 24 nt, Salmonella enterica enterica serovar Typhi Ty2
cauacacgccgggcacgcugacca

SEQ ID NO: 3735932 - RNA, 13 nt, Salmonella enterica enterica serovar Typhi Ty2
cauacacgcggcg

SEQ ID NO: 3735933 - RNA, 19 nt, Salmonella enterica enterica serovar Typhi Ty2
cauacacguaauacaugag

SEQ ID NO: 3735934 - RNA, 19 nt, Salmonella enterica enterica serovar Typhi Ty2
cauacacugcauaaauauc

SEQ ID NO: 3735935 - RNA, 14 nt, Salmonella enterica enterica serovar Typhi Ty2
cauacagcacuucc

SEQ ID NO: 3735936 - RNA, 15 nt, Salmonella enterica enterica serovar Typhi Ty2
cauacagguuuuaau

SEQ ID NO: 3735937 - RNA, 19 nt, Salmonella enterica enterica serovar Typhi Ty2
cauacauccaucacuccuu

SEQ ID NO: 3735938 - RNA, 18 nt, Salmonella enterica enterica serovar Typhi Ty2
cauacauuucgucaucgc

SEQ ID NO: 3735939 - RNA, 20 nt, Salmonella enterica enterica serovar Typhi Ty2
cauacauuuuuguaauaaaa

SEQ ID NO: 3735940 - RNA, 20 nt, Salmonella enterica enterica serovar Typhi Ty2
cauaccacaacagaaucgcg

SEQ ID NO: 3735941 - RNA, 17 nt, Salmonella enterica enterica serovar Typhi Ty2
cauaccacgcagcggca

SEQ ID NO: 3735942 - RNA, 12 nt, Salmonella enterica enterica serovar Typhi Ty2
cauaccagcgaa

SEQ ID NO: 3735943 - RNA, 15 nt, Salmonella enterica enterica serovar Typhi Ty2
cauaccagcgaaaug

SEQ ID NO: 3735944 - RNA, 14 nt, Salmonella enterica enterica serovar Typhi Ty2
cauacccagguuug

SEQ ID NO: 3735945 - RNA, 17 nt, Salmonella enterica enterica serovar Typhi Ty2
cauacccaguagcagac

SEQ ID NO: 3735946 - RNA, 17 nt, Salmonella enterica enterica serovar Typhi Ty2
cauaccccacgccauaa

SEQ ID NO: 3735947 - RNA, 19 nt, Salmonella enterica enterica serovar Typhi Ty2
cauacccuauuuacagagc

SEQ ID NO: 3735948 - RNA, 13 nt, Salmonella enterica enterica serovar Typhi Ty2
cauacccuuccag

SEQ ID NO: 3735949 - RNA, 15 nt, Salmonella enterica enterica serovar Typhi Ty2
cauaccgaacagaaa

SEQ ID NO: 3735950 - RNA, 15 nt, Salmonella enterica enterica serovar Typhi Ty2
cauaccgccaaucaa

SEQ ID NO: 3735951 - RNA, 17 nt, Salmonella enterica enterica serovar Typhi Ty2
cauaccgcuuaacagcg

SEQ ID NO: 3735952 - RNA, 15 nt, Salmonella enterica enterica serovar Typhi Ty2
cauaccggagccugg

SEQ ID NO: 3735953 - RNA, 19 nt, Salmonella enterica enterica serovar Typhi Ty2
cauaccggugcgccccagc

SEQ ID NO: 3735954 - RNA, 21 nt, Salmonella enterica enterica serovar Typhi Ty2
cauaccggugcgccccagcau

SEQ ID NO: 3735955 - RNA, 19 nt, Salmonella enterica enterica serovar Typhi Ty2
cauaccgguguagcuggca

SEQ ID NO: 3735956 - RNA, 14 nt, Salmonella enterica enterica serovar Typhi Ty2
cauaccgucaccac

SEQ ID NO: 3735957 - RNA, 18 nt, Salmonella enterica enterica serovar Typhi Ty2
cauaccgugagcuacagc

SEQ ID NO: 3735958 - RNA, 17 nt, Salmonella enterica enterica serovar Typhi Ty2
cauauccgacagauagu

SEQ ID NO: 3735959 - RNA, 12 nt, Salmonella enterica enterica serovar Typhi Ty2
cauaucgaauga

SEQ ID NO: 3735960 - RNA, 12 nt, Salmonella enterica enterica serovar Typhi Ty2
cauaucgacggu

SEQ ID NO: 3735961 - RNA, 20 nt, Salmonella enterica enterica serovar Typhi Ty2
cauaucgcagaccauccaug

SEQ ID NO: 3735962 - RNA, 16 nt, Salmonella enterica enterica serovar Typhi Ty2
cauaucgccgccacau

SEQ ID NO: 3735963 - RNA, 15 nt, Salmonella enterica enterica serovar Typhi Ty2
cauaucgcuaaacca

SEQ ID NO: 3735964 - RNA, 16 nt, Salmonella enterica enterica serovar Typhi Ty2
cauaucgcuaaaccaa

SEQ ID NO: 3735965 - RNA, 23 nt, Salmonella enterica enterica serovar Typhi Ty2
cauaucgucaucggucaguuugc

SEQ ID NO: 3735966 - RNA, 14 nt, Salmonella enterica enterica serovar Typhi Ty2
cauaucuauauuuu

SEQ ID NO: 3735967 - RNA, 22 nt, Salmonella enterica enterica serovar Typhi Ty2
cauaucuauauuuuuauaucug

SEQ ID NO: 3735968 - RNA, 15 nt, Salmonella enterica enterica serovar Typhi Ty2
cauaucugcgccgcc

SEQ ID NO: 3735969 - RNA, 21 nt, Salmonella enterica enterica serovar Typhi Ty2
cauaucuggauacccccuauc

SEQ ID NO: 3735970 - RNA, 14 nt, Salmonella enterica enterica serovar Typhi Ty2
cauaucuuccaggc

SEQ ID NO: 3735971 - RNA, 14 nt, Salmonella enterica enterica serovar Typhi Ty2
cauauuauuauaua

SEQ ID NO: 3735972 - RNA, 22 nt, Salmonella enterica enterica serovar Typhi Ty2
cauauucaguuuuacgccauag

SEQ ID NO: 3735973 - RNA, 20 nt, Salmonella enterica enterica serovar Typhi Ty2
cauauucauaucgaagccca

SEQ ID NO: 3735974 - RNA, 13 nt, Salmonella enterica enterica serovar Typhi Ty2
cauauucaugguu

SEQ ID NO: 3735975 - RNA, 15 nt, Salmonella enterica enterica serovar Typhi Ty2
cauauucgccaccgc

SEQ ID NO: 3735976 - RNA, 16 nt, Salmonella enterica enterica serovar Typhi Ty2
cauauucgucuucauc

SEQ ID NO: 3735977 - RNA, 13 nt, Salmonella enterica enterica serovar Typhi Ty2
cauauugcgcuuc

SEQ ID NO: 3735978 - RNA, 16 nt, Salmonella enterica enterica serovar Typhi Ty2
cauauuguguuuuuua

SEQ ID NO: 3735979 - RNA, 19 nt, Salmonella enterica enterica serovar Typhi Ty2
cauauuuucaacggcauca

SEQ ID NO: 3735980 - RNA, 21 nt, Salmonella enterica enterica serovar Typhi Ty2
cauauuuucaacggcaucaau

SEQ ID NO: 3735981 - RNA, 16 nt, Salmonella enterica enterica serovar Typhi Ty2
cauauuuuuucaggaa

SEQ ID NO: 3735982 - RNA, 14 nt, Salmonella enterica enterica serovar Typhi Ty2
caucaaaaaaaaua

SEQ ID NO: 3735983 - RNA, 21 nt, Salmonella enterica enterica serovar Typhi Ty2
caucaaaaucaucgccacgau

SEQ ID NO: 3735984 - RNA, 14 nt, Salmonella enterica enterica serovar Typhi Ty2
caucaaacagcggc

SEQ ID NO: 3735985 - RNA, 19 nt, Salmonella enterica enterica serovar Typhi Ty2
caucaaacgcagcaaacgc

SEQ ID NO: 3735986 - RNA, 16 nt, Salmonella enterica enterica serovar Typhi Ty2
caucaaacuuuuaaau

SEQ ID NO: 3735987 - RNA, 19 nt, Salmonella enterica enterica serovar Typhi Ty2
caucaaagaaauacccuuc

SEQ ID NO: 3735988 - RNA, 13 nt, Salmonella enterica enterica serovar Typhi Ty2
caucaaagccacc

SEQ ID NO: 3735989 - RNA, 17 nt, Salmonella enterica enterica serovar Typhi Ty2
caucaaaguuauuuacc

SEQ ID NO: 3735990 - RNA, 14 nt, Salmonella enterica enterica serovar Typhi Ty2
caucaacguaaaua

SEQ ID NO: 3735991 - RNA, 23 nt, Salmonella enterica enterica serovar Typhi Ty2
caucaacguaaauagagaaauca

SEQ ID NO: 3735992 - RNA, 21 nt, Salmonella enterica enterica serovar Typhi Ty2
caucaagcccacacaucacaa

SEQ ID NO: 3735993 - RNA, 17 nt, Salmonella enterica enterica serovar Typhi Ty2
caucaauaaaaucaccg

SEQ ID NO: 3735994 - RNA, 22 nt, Salmonella enterica enterica serovar Typhi Ty2
caucaauaccugucggcaaauc

SEQ ID NO: 3735995 - RNA, 11 nt, Salmonella enterica enterica serovar Typhi Ty2
caucaauagca

SEQ ID NO: 3735996 - RNA, 19 nt, Salmonella enterica enterica serovar Typhi Ty2
caucaaucaccuuacgcuc

SEQ ID NO: 3735997 - RNA, 20 nt, Salmonella enterica enterica serovar Typhi Ty2
caucaaucgcuaucugacag

SEQ ID NO: 3735998 - RNA, 15 nt, Salmonella enterica enterica serovar Typhi Ty2
caucaaugcccagcg

SEQ ID NO: 3735999 - RNA, 22 nt, Salmonella enterica enterica serovar Typhi Ty2
caucaaugcccagcgcaaucac

SEQ ID NO: 3736000 - RNA, 19 nt, Salmonella enterica enterica serovar Typhi Ty2
caucaauggcgauuuuuag

SEQ ID NO: 3736001 - RNA, 23 nt, Salmonella enterica enterica serovar Typhi Ty2
caucaauggcgucaaacagcuua

SEQ ID NO: 3736002 - RNA, 20 nt, Salmonella enterica enterica serovar Typhi Ty2
caucaauucuuuaauuugug

SEQ ID NO: 3736003 - RNA, 16 nt, Salmonella enterica enterica serovar Typhi Ty2
caucacagccacacug

SEQ ID NO: 3736004 - RNA, 19 nt, Salmonella enterica enterica serovar Typhi Ty2
caucacagccacacugcug

SEQ ID NO: 3736005 - RNA, 17 nt, Salmonella enterica enterica serovar Typhi Ty2
caucacaucaaagcccc

SEQ ID NO: 3736006 - RNA, 20 nt, Salmonella enterica enterica serovar Typhi Ty2
caucacaucguaaaucagcg

SEQ ID NO: 3736007 - RNA, 21 nt, Salmonella enterica enterica serovar Typhi Ty2
caucacaugcgggagcaaaau

SEQ ID NO: 3736008 - RNA, 19 nt, Salmonella enterica enterica serovar Typhi Ty2
caucacauguagcgcggca

SEQ ID NO: 3736009 - RNA, 23 nt, Salmonella enterica enterica serovar Typhi Ty2
caucaccaucguugccagcggcc

SEQ ID NO: 3736010 - RNA, 13 nt, Salmonella enterica enterica serovar Typhi Ty2
caucaccggcccc

SEQ ID NO: 3736011 - RNA, 21 nt, Salmonella enterica enterica serovar Typhi Ty2
caucaccgucuucaggucauu

SEQ ID NO: 3736012 - RNA, 21 nt, Salmonella enterica enterica serovar Typhi Ty2
caucaccuccagcacgcgcug

SEQ ID NO: 3736013 - RNA, 19 nt, Salmonella enterica enterica serovar Typhi Ty2
caucaccugaugucccauc

SEQ ID NO: 3736014 - RNA, 14 nt, Salmonella enterica enterica serovar Typhi Ty2
caucacgaaauaac

SEQ ID NO: 3736015 - RNA, 19 nt, Salmonella enterica enterica serovar Typhi Ty2
caucacggcagcaccgcug

SEQ ID NO: 3736016 - RNA, 19 nt, Salmonella enterica enterica serovar Typhi Ty2
caucacguucgcgcauacc

SEQ ID NO: 3736017 - RNA, 14 nt, Salmonella enterica enterica serovar Typhi Ty2
caucacucauaaug

SEQ ID NO: 3736018 - RNA, 13 nt, Salmonella enterica enterica serovar Typhi Ty2
caucacuuccauc

SEQ ID NO: 3736019 - RNA, 16 nt, Salmonella enterica enterica serovar Typhi Ty2
caucacuuccuguauc

SEQ ID NO: 3736020 - RNA, 21 nt, Salmonella enterica enterica serovar Typhi Ty2
caucacuuuaugaccauacug

SEQ ID NO: 3736021 - RNA, 21 nt, Salmonella enterica enterica serovar Typhi Ty2
caucagaaaaaagccaagcac

SEQ ID NO: 3736022 - RNA, 16 nt, Salmonella enterica enterica serovar Typhi Ty2
caucagaagugccagu

SEQ ID NO: 3736023 - RNA, 20 nt, Salmonella enterica enterica serovar Typhi Ty2
caucagaagugccaguaacu

SEQ ID NO: 3736024 - RNA, 17 nt, Salmonella enterica enterica serovar Typhi Ty2
caucagaaugcugguca

SEQ ID NO: 3736025 - RNA, 16 nt, Salmonella enterica enterica serovar Typhi Ty2
caucagaccgauaaau

SEQ ID NO: 3736026 - RNA, 22 nt, Salmonella enterica enterica serovar Typhi Ty2
caucagacuacuuuuacccuuc

SEQ ID NO: 3736027 - RNA, 18 nt, Salmonella enterica enterica serovar Typhi Ty2
caucagacuguuacgcug

SEQ ID NO: 3736028 - RNA, 20 nt, Salmonella enterica enterica serovar Typhi Ty2
caucagauuuaggaucguaa

SEQ ID NO: 3736029 - RNA, 19 nt, Salmonella enterica enterica serovar Typhi Ty2
caucagcaaaauaccggca

SEQ ID NO: 3736030 - RNA, 23 nt, Salmonella enterica enterica serovar Typhi Ty2
caucagcaauuucucgcccgcca

SEQ ID NO: 3736031 - RNA, 14 nt, Salmonella enterica enterica serovar Typhi Ty2
caucagcacaaaau

SEQ ID NO: 3736032 - RNA, 18 nt, Salmonella enterica enterica serovar Typhi Ty2
caucagcacaaaauccca

SEQ ID NO: 3736033 - RNA, 15 nt, Salmonella enterica enterica serovar Typhi Ty2
caucagccagcagcu

SEQ ID NO: 3736034 - RNA, 16 nt, Salmonella enterica enterica serovar Typhi Ty2
caucagccagcagcuc

SEQ ID NO: 3736035 - RNA, 12 nt, Salmonella enterica enterica serovar Typhi Ty2
caucagccaggc

SEQ ID NO: 3736036 - RNA, 22 nt, Salmonella enterica enterica serovar Typhi Ty2
caucagcccuaucgcugcgcug

SEQ ID NO: 3736037 - RNA, 20 nt, Salmonella enterica enterica serovar Typhi Ty2
caucagccguuacuuccccc

SEQ ID NO: 3736038 - RNA, 21 nt, Salmonella enterica enterica serovar Typhi Ty2
caucagccguuacuuccccca

SEQ ID NO: 3736039 - RNA, 12 nt, Salmonella enterica enterica serovar Typhi Ty2
caucagcgccag

SEQ ID NO: 3736040 - RNA, 16 nt, Salmonella enterica enterica serovar Typhi Ty2
cauccggcaaacucag

SEQ ID NO: 3736041 - RNA, 16 nt, Salmonella enterica enterica serovar Typhi Ty2
cauccggcaaucagac

SEQ ID NO: 3736042 - RNA, 16 nt, Salmonella enterica enterica serovar Typhi Ty2
cauccggcacggucaa

SEQ ID NO: 3736043 - RNA, 15 nt, Salmonella enterica enterica serovar Typhi Ty2
cauccggcauuuuuu

SEQ ID NO: 3736044 - RNA, 13 nt, Salmonella enterica enterica serovar Typhi Ty2
cauccggccagcg

SEQ ID NO: 3736045 - RNA, 22 nt, Salmonella enterica enterica serovar Typhi Ty2
cauccggccuggcgcaacguuu

SEQ ID NO: 3736046 - RNA, 14 nt, Salmonella enterica enterica serovar Typhi Ty2
cauccggccuguuc

SEQ ID NO: 3736047 - RNA, 22 nt, Salmonella enterica enterica serovar Typhi Ty2
cauccggcgauggugcggcgca

SEQ ID NO: 3736048 - RNA, 20 nt, Salmonella enterica enterica serovar Typhi Ty2
cauccgggaguuucaugcca

SEQ ID NO: 3736049 - RNA, 21 nt, Salmonella enterica enterica serovar Typhi Ty2
cauccgggaguuucaugccau

SEQ ID NO: 3736050 - RNA, 15 nt, Salmonella enterica enterica serovar Typhi Ty2
cauccgguuuuaaau

SEQ ID NO: 3736051 - RNA, 20 nt, Salmonella enterica enterica serovar Typhi Ty2
cauccgucaaaaugaucaga

SEQ ID NO: 3736052 - RNA, 15 nt, Salmonella enterica enterica serovar Typhi Ty2
cauccgucuggcgau

SEQ ID NO: 3736053 - RNA, 15 nt, Salmonella enterica enterica serovar Typhi Ty2
cauccgugaccugcu

SEQ ID NO: 3736054 - RNA, 23 nt, Salmonella enterica enterica serovar Typhi Ty2
cauccucaaccaccaccgauaaa

SEQ ID NO: 3736055 - RNA, 18 nt, Salmonella enterica enterica serovar Typhi Ty2
cauccucaauguuaacua

SEQ ID NO: 3736056 - RNA, 14 nt, Salmonella enterica enterica serovar Typhi Ty2
cauccucacgcaac

SEQ ID NO: 3736057 - RNA, 21 nt, Salmonella enterica enterica serovar Typhi Ty2
cauccuccggcgacugaaugc

SEQ ID NO: 3736058 - RNA, 14 nt, Salmonella enterica enterica serovar Typhi Ty2
cauccucgccauaa

SEQ ID NO: 3736059 - RNA, 13 nt, Salmonella enterica enterica serovar Typhi Ty2
cauccucuccuga

SEQ ID NO: 3736060 - RNA, 21 nt, Salmonella enterica enterica serovar Typhi Ty2
cauccucuuggguuauuucga

SEQ ID NO: 3736061 - RNA, 13 nt, Salmonella enterica enterica serovar Typhi Ty2
cauccucuuuccg

SEQ ID NO: 3736062 - RNA, 17 nt, Salmonella enterica enterica serovar Typhi Ty2
cauccugacauuacccg

SEQ ID NO: 3736063 - RNA, 20 nt, Salmonella enterica enterica serovar Typhi Ty2
cauccugauuauuacaauaa

SEQ ID NO: 3736064 - RNA, 16 nt, Salmonella enterica enterica serovar Typhi Ty2
cauccugauuuuacug

SEQ ID NO: 3736065 - RNA, 18 nt, Salmonella enterica enterica serovar Typhi Ty2
cauccugauuuuacugac

SEQ ID NO: 3736066 - RNA, 19 nt, Salmonella enterica enterica serovar Typhi Ty2
cauccugcaacucaaaaua

SEQ ID NO: 3736067 - RNA, 17 nt, Salmonella enterica enterica serovar Typhi Ty2
cauccugccgcaccagu

SEQ ID NO: 3736068 - RNA, 21 nt, Salmonella enterica enterica serovar Typhi Ty2
cauccugcgccauugcgggag

SEQ ID NO: 3736069 - RNA, 14 nt, Salmonella enterica enterica serovar Typhi Ty2
cauccugcggcagu

SEQ ID NO: 3736070 - RNA, 18 nt, Salmonella enterica enterica serovar Typhi Ty2
cauccugcggguucaucg

SEQ ID NO: 3736071 - RNA, 21 nt, Salmonella enterica enterica serovar Typhi Ty2
cauccugcggguucaucgcca

SEQ ID NO: 3736072 - RNA, 16 nt, Salmonella enterica enterica serovar Typhi Ty2
cauccuguaccaccac

SEQ ID NO: 3736073 - RNA, 19 nt, Salmonella enterica enterica serovar Typhi Ty2
cauccuguuuuuucagcgc

SEQ ID NO: 3736074 - RNA, 23 nt, Salmonella enterica enterica serovar Typhi Ty2
cauccuguuuuuucagcgcgccg

SEQ ID NO: 3736075 - RNA, 23 nt, Salmonella enterica enterica serovar Typhi Ty2
cauccuuuacaauuucgcaaaca

SEQ ID NO: 3736076 - RNA, 23 nt, Salmonella enterica enterica serovar Typhi Ty2
caucgaauaaagacacugcugcu

SEQ ID NO: 3736077 - RNA, 21 nt, Salmonella enterica enterica serovar Typhi Ty2
caucgaaugucgauguucugu

SEQ ID NO: 3736078 - RNA, 19 nt, Salmonella enterica enterica serovar Typhi Ty2
caucgacaaaggcaagauc

SEQ ID NO: 3736079 - RNA, 21 nt, Salmonella enterica enterica serovar Typhi Ty2
caucgacaagcuaauccccag

SEQ ID NO: 3736080 - RNA, 14 nt, Salmonella enterica enterica serovar Typhi Ty2
caucgacagcgcca

SEQ ID NO: 3736081 - RNA, 12 nt, Salmonella enterica enterica serovar Typhi Ty2
caucgacgccag

SEQ ID NO: 3736082 - RNA, 17 nt, Salmonella enterica enterica serovar Typhi Ty2
caucgacuucaagguuc

SEQ ID NO: 3736083 - RNA, 18 nt, Salmonella enterica enterica serovar Typhi Ty2
caucgacuucgaagguuc

SEQ ID NO: 3736084 - RNA, 14 nt, Salmonella enterica enterica serovar Typhi Ty2
caucgauggcgcca

SEQ ID NO: 3736085 - RNA, 17 nt, Salmonella enterica enterica serovar Typhi Ty2
caucgauuuccugauga

SEQ ID NO: 3736086 - RNA, 18 nt, Salmonella enterica enterica serovar Typhi Ty2
caucgauuuccugaugac

SEQ ID NO: 3736087 - RNA, 16 nt, Salmonella enterica enterica serovar Typhi Ty2
caucgcaaugccacca

SEQ ID NO: 3736088 - RNA, 20 nt, Salmonella enterica enterica serovar Typhi Ty2
caucgcaaugccaccacacg

SEQ ID NO: 3736089 - RNA, 17 nt, Salmonella enterica enterica serovar Typhi Ty2
caucgcagauuccgaac

SEQ ID NO: 3736090 - RNA, 16 nt, Salmonella enterica enterica serovar Typhi Ty2
caucgccacgauagac

SEQ ID NO: 3736091 - RNA, 15 nt, Salmonella enterica enterica serovar Typhi Ty2
caucgccagauaaau

SEQ ID NO: 3736092 - RNA, 13 nt, Salmonella enterica enterica serovar Typhi Ty2
caucgccagccau

SEQ ID NO: 3736093 - RNA, 13 nt, Salmonella enterica enterica serovar Typhi Ty2
caucgccagcuuc

SEQ ID NO: 3736094 - RNA, 16 nt, Salmonella enterica enterica serovar Typhi Ty2
caucgccagcuucgcu

SEQ ID NO: 3736095 - RNA, 18 nt, Salmonella enterica enterica serovar Typhi Ty2
caucgccauuaaaagcca

SEQ ID NO: 3736096 - RNA, 12 nt, Salmonella enterica enterica serovar Typhi Ty2
caucgcccaggu

SEQ ID NO: 3736097 - RNA, 15 nt, Salmonella enterica enterica serovar Typhi Ty2
caucgcccgcuccca

SEQ ID NO: 3736098 - RNA, 17 nt, Salmonella enterica enterica serovar Typhi Ty2
caucgccgauuccugcu

SEQ ID NO: 3736099 - RNA, 19 nt, Salmonella enterica enterica serovar Typhi Ty2
caucgccgcccaguggcaa

SEQ ID NO: 3736100 - RNA, 14 nt, Salmonella enterica enterica serovar Typhi Ty2
caucgccgccgagu

SEQ ID NO: 3736101 - RNA, 14 nt, Salmonella enterica enterica serovar Typhi Ty2
caucgccgccucgc

SEQ ID NO: 3736102 - RNA, 16 nt, Salmonella enterica enterica serovar Typhi Ty2
caucgccgcgaauaaa

SEQ ID NO: 3736103 - RNA, 14 nt, Salmonella enterica enterica serovar Typhi Ty2
caucgccgcgccgu

SEQ ID NO: 3736104 - RNA, 15 nt, Salmonella enterica enterica serovar Typhi Ty2
caucgccgcggcgcu

SEQ ID NO: 3736105 - RNA, 18 nt, Salmonella enterica enterica serovar Typhi Ty2
caucgccgcggcgcuggc

SEQ ID NO: 3736106 - RNA, 20 nt, Salmonella enterica enterica serovar Typhi Ty2
caucgccggagccgccuggc

SEQ ID NO: 3736107 - RNA, 20 nt, Salmonella enterica enterica serovar Typhi Ty2
caucgcgaauuucaaucgcc

SEQ ID NO: 3736108 - RNA, 13 nt, Salmonella enterica enterica serovar Typhi Ty2
caucgcgcagcag

SEQ ID NO: 3736109 - RNA, 16 nt, Salmonella enterica enterica serovar Typhi Ty2
caucgcgccgcuggcg

SEQ ID NO: 3736110 - RNA, 15 nt, Salmonella enterica enterica serovar Typhi Ty2
caucgcgccuccccu

SEQ ID NO: 3736111 - RNA, 22 nt, Salmonella enterica enterica serovar Typhi Ty2
caucgcgcugauauuuuuacug

SEQ ID NO: 3736112 - RNA, 14 nt, Salmonella enterica enterica serovar Typhi Ty2
caucgcgcuuaacu

SEQ ID NO: 3736113 - RNA, 16 nt, Salmonella enterica enterica serovar Typhi Ty2
caucgcggccagcaug

SEQ ID NO: 3736114 - RNA, 21 nt, Salmonella enterica enterica serovar Typhi Ty2
caucgcggccagcaugguuaa

SEQ ID NO: 3736115 - RNA, 20 nt, Salmonella enterica enterica serovar Typhi Ty2
caucgcggucagcggcgcgc

SEQ ID NO: 3736116 - RNA, 22 nt, Salmonella enterica enterica serovar Typhi Ty2
caucgcuaaguugaacgguaaa

SEQ ID NO: 3736117 - RNA, 14 nt, Salmonella enterica enterica serovar Typhi Ty2
caucgcuccccaac

SEQ ID NO: 3736118 - RNA, 12 nt, Salmonella enterica enterica serovar Typhi Ty2
caucgcuccggc

SEQ ID NO: 3736119 - RNA, 13 nt, Salmonella enterica enterica serovar Typhi Ty2
caucgcucgcgcc

SEQ ID NO: 3736120 - RNA, 20 nt, Salmonella enterica enterica serovar Typhi Ty2
caucgcucgcgccacgcaga

SEQ ID NO: 3736121 - RNA, 14 nt, Salmonella enterica enterica serovar Typhi Ty2
caucgcuggcgcgc

SEQ ID NO: 3736122 - RNA, 13 nt, Salmonella enterica enterica serovar Typhi Ty2
caucuuuuuucac

SEQ ID NO: 3736123 - RNA, 13 nt, Salmonella enterica enterica serovar Typhi Ty2
caugaaaaaaacg

SEQ ID NO: 3736124 - RNA, 19 nt, Salmonella enterica enterica serovar Typhi Ty2
caugaaaaauauaaaaagc

SEQ ID NO: 3736125 - RNA, 18 nt, Salmonella enterica enterica serovar Typhi Ty2
caugaaacucgacacacu

SEQ ID NO: 3736126 - RNA, 20 nt, Salmonella enterica enterica serovar Typhi Ty2
caugaagcgauuuauccacc

SEQ ID NO: 3736127 - RNA, 18 nt, Salmonella enterica enterica serovar Typhi Ty2
caugaaucaucacaauua

SEQ ID NO: 3736128 - RNA, 18 nt, Salmonella enterica enterica serovar Typhi Ty2
caugaaugccccagcgcu

SEQ ID NO: 3736129 - RNA, 21 nt, Salmonella enterica enterica serovar Typhi Ty2
caugaaugccccagcgcugcu

SEQ ID NO: 3736130 - RNA, 20 nt, Salmonella enterica enterica serovar Typhi Ty2
caugaauuacagcucauaaa

SEQ ID NO: 3736131 - RNA, 17 nt, Salmonella enterica enterica serovar Typhi Ty2
caugacaauaacggccu

SEQ ID NO: 3736132 - RNA, 15 nt, Salmonella enterica enterica serovar Typhi Ty2
caugacaucagaagu

SEQ ID NO: 3736133 - RNA, 13 nt, Salmonella enterica enterica serovar Typhi Ty2
caugacauccaug

SEQ ID NO: 3736134 - RNA, 18 nt, Salmonella enterica enterica serovar Typhi Ty2
caugaccauccacgggcu

SEQ ID NO: 3736135 - RNA, 14 nt, Salmonella enterica enterica serovar Typhi Ty2
caugaccauucaca

SEQ ID NO: 3736136 - RNA, 15 nt, Salmonella enterica enterica serovar Typhi Ty2
caugacccagagcga

SEQ ID NO: 3736137 - RNA, 21 nt, Salmonella enterica enterica serovar Typhi Ty2
caugacgccaagcugcagaau

SEQ ID NO: 3736138 - RNA, 23 nt, Salmonella enterica enterica serovar Typhi Ty2
caugacguuuugggaaaaccagu

SEQ ID NO: 3736139 - RNA, 14 nt, Salmonella enterica enterica serovar Typhi Ty2
caugacucuuguuu

SEQ ID NO: 3736140 - RNA, 17 nt, Salmonella enterica enterica serovar Typhi Ty2
caugaguaaugaccaca

SEQ ID NO: 3736141 - RNA, 23 nt, Salmonella enterica enterica serovar Typhi Ty2
caugagucgcgcgcgccagucau

SEQ ID NO: 3736142 - RNA, 17 nt, Salmonella enterica enterica serovar Typhi Ty2
caugauacguggcucaa

SEQ ID NO: 3736143 - RNA, 16 nt, Salmonella enterica enterica serovar Typhi Ty2
caugauagggcagcag

SEQ ID NO: 3736144 - RNA, 14 nt, Salmonella enterica enterica serovar Typhi Ty2
caugauauucuguc

SEQ ID NO: 3736145 - RNA, 22 nt, Salmonella enterica enterica serovar Typhi Ty2
caugauccguucgaucagcugg

SEQ ID NO: 3736146 - RNA, 14 nt, Salmonella enterica enterica serovar Typhi Ty2
caugaucgccgcca

SEQ ID NO: 3736147 - RNA, 16 nt, Salmonella enterica enterica serovar Typhi Ty2
caugaucgccgccauc

SEQ ID NO: 3736148 - RNA, 22 nt, Salmonella enterica enterica serovar Typhi Ty2
caugaucuuaccucuccugaau

SEQ ID NO: 3736149 - RNA, 23 nt, Salmonella enterica enterica serovar Typhi Ty2
caugaucuuuccuuuuucaggca

SEQ ID NO: 3736150 - RNA, 15 nt, Salmonella enterica enterica serovar Typhi Ty2
caugaugagcgccau

SEQ ID NO: 3736151 - RNA, 13 nt, Salmonella enterica enterica serovar Typhi Ty2
caugaugccaaau

SEQ ID NO: 3736152 - RNA, 19 nt, Salmonella enterica enterica serovar Typhi Ty2
caugaugccacgagaaauc

SEQ ID NO: 3736153 - RNA, 23 nt, Salmonella enterica enterica serovar Typhi Ty2
caugaugccacgagaaauccaca

SEQ ID NO: 3736154 - RNA, 22 nt, Salmonella enterica enterica serovar Typhi Ty2
caugaugggcgcacagcgccau

SEQ ID NO: 3736155 - RNA, 15 nt, Salmonella enterica enterica serovar Typhi Ty2
caugcaauuugaggu

SEQ ID NO: 3736156 - RNA, 20 nt, Salmonella enterica enterica serovar Typhi Ty2
caugcaccagucccagcccc

SEQ ID NO: 3736157 - RNA, 20 nt, Salmonella enterica enterica serovar Typhi Ty2
caugcagccauagcgcgccg

SEQ ID NO: 3736158 - RNA, 17 nt, Salmonella enterica enterica serovar Typhi Ty2
caugcagcucaagcgcc

SEQ ID NO: 3736159 - RNA, 14 nt, Salmonella enterica enterica serovar Typhi Ty2
caugcaucaauggc

SEQ ID NO: 3736160 - RNA, 14 nt, Salmonella enterica enterica serovar Typhi Ty2
caugccaaaccaga

SEQ ID NO: 3736161 - RNA, 22 nt, Salmonella enterica enterica serovar Typhi Ty2
caugccacaacagaagcggccu

SEQ ID NO: 3736162 - RNA, 21 nt, Salmonella enterica enterica serovar Typhi Ty2
caugccagaagcaaauucagg

SEQ ID NO: 3736163 - RNA, 18 nt, Salmonella enterica enterica serovar Typhi Ty2
caugccauacuccugccu

SEQ ID NO: 3736164 - RNA, 18 nt, Salmonella enterica enterica serovar Typhi Ty2
caugccaucauuaauuua

SEQ ID NO: 3736165 - RNA, 18 nt, Salmonella enterica enterica serovar Typhi Ty2
caugcccaguucaaucaa

SEQ ID NO: 3736166 - RNA, 18 nt, Salmonella enterica enterica serovar Typhi Ty2
caugccccucgacaggag

SEQ ID NO: 3736167 - RNA, 20 nt, Salmonella enterica enterica serovar Typhi Ty2
caugcccggauggcgucuga

SEQ ID NO: 3736168 - RNA, 17 nt, Salmonella enterica enterica serovar Typhi Ty2
caugcccggugauauug

SEQ ID NO: 3736169 - RNA, 18 nt, Salmonella enterica enterica serovar Typhi Ty2
caugccgaccagggcauc

SEQ ID NO: 3736170 - RNA, 14 nt, Salmonella enterica enterica serovar Typhi Ty2
caugccgcccaggc

SEQ ID NO: 3736171 - RNA, 21 nt, Salmonella enterica enterica serovar Typhi Ty2
caugccgccugccgcgccgcc

SEQ ID NO: 3736172 - RNA, 22 nt, Salmonella enterica enterica serovar Typhi Ty2
caugccggcuggcaauuugaua

SEQ ID NO: 3736173 - RNA, 18 nt, Salmonella enterica enterica serovar Typhi Ty2
caugccggcuuuccgcac

SEQ ID NO: 3736174 - RNA, 18 nt, Salmonella enterica enterica serovar Typhi Ty2
caugccuucuuugccuuu

SEQ ID NO: 3736175 - RNA, 18 nt, Salmonella enterica enterica serovar Typhi Ty2
caugcgacgugucgcgua

SEQ ID NO: 3736176 - RNA, 21 nt, Salmonella enterica enterica serovar Typhi Ty2
caugcgaucgggcaauccauu

SEQ ID NO: 3736177 - RNA, 18 nt, Salmonella enterica enterica serovar Typhi Ty2
caugcgcagaaacugauc

SEQ ID NO: 3736178 - RNA, 21 nt, Salmonella enterica enterica serovar Typhi Ty2
caugcgcggcggguugaugau

SEQ ID NO: 3736179 - RNA, 17 nt, Salmonella enterica enterica serovar Typhi Ty2
caugcggaaucacgcau

SEQ ID NO: 3736180 - RNA, 15 nt, Salmonella enterica enterica serovar Typhi Ty2
caugcggcgccauca

SEQ ID NO: 3736181 - RNA, 17 nt, Salmonella enterica enterica serovar Typhi Ty2
caugcgggauggccgcc

SEQ ID NO: 3736182 - RNA, 19 nt, Salmonella enterica enterica serovar Typhi Ty2
caugcggugcaugaauauc

SEQ ID NO: 3736183 - RNA, 15 nt, Salmonella enterica enterica serovar Typhi Ty2
caugcguuagauaua

SEQ ID NO: 3736184 - RNA, 21 nt, Salmonella enterica enterica serovar Typhi Ty2
caugcuaaaacagauaacgaa

SEQ ID NO: 3736185 - RNA, 19 nt, Salmonella enterica enterica serovar Typhi Ty2
caugcuacaggcaaguuua

SEQ ID NO: 3736186 - RNA, 21 nt, Salmonella enterica enterica serovar Typhi Ty2
caugcuacaggcaaguuuaau

SEQ ID NO: 3736187 - RNA, 15 nt, Salmonella enterica enterica serovar Typhi Ty2
caugcuauucagcag

SEQ ID NO: 3736188 - RNA, 19 nt, Salmonella enterica enterica serovar Typhi Ty2
caugcuauucagcaguuca

SEQ ID NO: 3736189 - RNA, 15 nt, Salmonella enterica enterica serovar Typhi Ty2
caugcucauccaacu

SEQ ID NO: 3736190 - RNA, 16 nt, Salmonella enterica enterica serovar Typhi Ty2
caugcucaugaaggca

SEQ ID NO: 3736191 - RNA, 21 nt, Salmonella enterica enterica serovar Typhi Ty2
caugcugaccgaaccgcugua

SEQ ID NO: 3736192 - RNA, 18 nt, Salmonella enterica enterica serovar Typhi Ty2
caugcugaugacuaaugg

SEQ ID NO: 3736193 - RNA, 23 nt, Salmonella enterica enterica serovar Typhi Ty2
caugcugaugacuaauggcauuu

SEQ ID NO: 3736194 - RNA, 21 nt, Salmonella enterica enterica serovar Typhi Ty2
caugcugcaccgcaucaaacu

SEQ ID NO: 3736195 - RNA, 16 nt, Salmonella enterica enterica serovar Typhi Ty2
caugcugccauuuuau

SEQ ID NO: 3736196 - RNA, 21 nt, Salmonella enterica enterica serovar Typhi Ty2
caugcuggauaccgaauuccg

SEQ ID NO: 3736197 - RNA, 19 nt, Salmonella enterica enterica serovar Typhi Ty2
cauggaacauccucuccug

SEQ ID NO: 3736198 - RNA, 20 nt, Salmonella enterica enterica serovar Typhi Ty2
cauggaguuccaguucaucu

SEQ ID NO: 3736199 - RNA, 20 nt, Salmonella enterica enterica serovar Typhi Ty2
cauggauagucaugaaaucu

SEQ ID NO: 3736200 - RNA, 23 nt, Salmonella enterica enterica serovar Typhi Ty2
cauggcaaaacuaaacccggccu

SEQ ID NO: 3736201 - RNA, 21 nt, Salmonella enterica enterica serovar Typhi Ty2
cauggcaaaagacauccccgc

SEQ ID NO: 3736202 - RNA, 17 nt, Salmonella enterica enterica serovar Typhi Ty2
cauggcagccccggcau

SEQ ID NO: 3736203 - RNA, 13 nt, Salmonella enterica enterica serovar Typhi Ty2
cauuaucaccauu

SEQ ID NO: 3736204 - RNA, 23 nt, Salmonella enterica enterica serovar Typhi Ty2
cauuaugaucgguuuuuuuagaa

SEQ ID NO: 3736205 - RNA, 14 nt, Salmonella enterica enterica serovar Typhi Ty2
cauuaugaugaguu

SEQ ID NO: 3736206 - RNA, 17 nt, Salmonella enterica enterica serovar Typhi Ty2
cauuauguuuugaacau

SEQ ID NO: 3736207 - RNA, 20 nt, Salmonella enterica enterica serovar Typhi Ty2
cauuauuaaauuaacaccca

SEQ ID NO: 3736208 - RNA, 13 nt, Salmonella enterica enterica serovar Typhi Ty2
cauuauuccccuc

SEQ ID NO: 3736209 - RNA, 17 nt, Salmonella enterica enterica serovar Typhi Ty2
cauuauugaucucuuca

SEQ ID NO: 3736210 - RNA, 15 nt, Salmonella enterica enterica serovar Typhi Ty2
cauuauugcaucaau

SEQ ID NO: 3736211 - RNA, 21 nt, Salmonella enterica enterica serovar Typhi Ty2
cauuauugcgaaauagcgcgg

SEQ ID NO: 3736212 - RNA, 20 nt, Salmonella enterica enterica serovar Typhi Ty2
cauuauuuuagugaaaaaau

SEQ ID NO: 3736213 - RNA, 15 nt, Salmonella enterica enterica serovar Typhi Ty2
cauuauuuuuaaaua

SEQ ID NO: 3736214 - RNA, 17 nt, Salmonella enterica enterica serovar Typhi Ty2
cauuauuuuuaaauaac

SEQ ID NO: 3736215 - RNA, 18 nt, Salmonella enterica enterica serovar Typhi Ty2
cauuauuuuuaaauaacu

SEQ ID NO: 3736216 - RNA, 15 nt, Salmonella enterica enterica serovar Typhi Ty2
cauucacgccaccau

SEQ ID NO: 3736217 - RNA, 17 nt, Salmonella enterica enterica serovar Typhi Ty2
cauucagcaacugcgua

SEQ ID NO: 3736218 - RNA, 20 nt, Salmonella enterica enterica serovar Typhi Ty2
cauucagcggcugcgccugc

SEQ ID NO: 3736219 - RNA, 19 nt, Salmonella enterica enterica serovar Typhi Ty2
cauucaggcaggcgaaacc

SEQ ID NO: 3736220 - RNA, 17 nt, Salmonella enterica enterica serovar Typhi Ty2
cauucaggccucugcuu

SEQ ID NO: 3736221 - RNA, 17 nt, Salmonella enterica enterica serovar Typhi Ty2
cauucagggaaucagcg

SEQ ID NO: 3736222 - RNA, 22 nt, Salmonella enterica enterica serovar Typhi Ty2
cauucaguacgcuuuggcaggc

SEQ ID NO: 3736223 - RNA, 19 nt, Salmonella enterica enterica serovar Typhi Ty2
cauucagugaauuaugacc

SEQ ID NO: 3736224 - RNA, 20 nt, Salmonella enterica enterica serovar Typhi Ty2
cauucauaagcaaacagugg

SEQ ID NO: 3736225 - RNA, 12 nt, Salmonella enterica enterica serovar Typhi Ty2
cauuccagaccc

SEQ ID NO: 3736226 - RNA, 12 nt, Salmonella enterica enterica serovar Typhi Ty2
cauuccagaccu

SEQ ID NO: 3736227 - RNA, 20 nt, Salmonella enterica enterica serovar Typhi Ty2
cauuccagcguaugauagcg

SEQ ID NO: 3736228 - RNA, 20 nt, Salmonella enterica enterica serovar Typhi Ty2
cauuccaggugucacucauc

SEQ ID NO: 3736229 - RNA, 18 nt, Salmonella enterica enterica serovar Typhi Ty2
cauuccauuuuucgaucu

SEQ ID NO: 3736230 - RNA, 17 nt, Salmonella enterica enterica serovar Typhi Ty2
cauucccagccgagcgg

SEQ ID NO: 3736231 - RNA, 14 nt, Salmonella enterica enterica serovar Typhi Ty2
cauucccagcgccc

SEQ ID NO: 3736232 - RNA, 16 nt, Salmonella enterica enterica serovar Typhi Ty2
cauucccgccaauaac

SEQ ID NO: 3736233 - RNA, 18 nt, Salmonella enterica enterica serovar Typhi Ty2
cauucccgccaauaacca

SEQ ID NO: 3736234 - RNA, 16 nt, Salmonella enterica enterica serovar Typhi Ty2
cauucgaauccuccug

SEQ ID NO: 3736235 - RNA, 17 nt, Salmonella enterica enterica serovar Typhi Ty2
cauucgauaaccgccga

SEQ ID NO: 3736236 - RNA, 22 nt, Salmonella enterica enterica serovar Typhi Ty2
cauucgccaccaggcucaaauu

SEQ ID NO: 3736237 - RNA, 15 nt, Salmonella enterica enterica serovar Typhi Ty2
cauucgccagcggau

SEQ ID NO: 3736238 - RNA, 13 nt, Salmonella enterica enterica serovar Typhi Ty2
cauucgccccagc

SEQ ID NO: 3736239 - RNA, 15 nt, Salmonella enterica enterica serovar Typhi Ty2
cauucgccccagcau

SEQ ID NO: 3736240 - RNA, 18 nt, Salmonella enterica enterica serovar Typhi Ty2
cauucgcccgcaauguuu

SEQ ID NO: 3736241 - RNA, 16 nt, Salmonella enterica enterica serovar Typhi Ty2
cauucgcgucauacuu

SEQ ID NO: 3736242 - RNA, 16 nt, Salmonella enterica enterica serovar Typhi Ty2
cauucgcucaggacag

SEQ ID NO: 3736243 - RNA, 14 nt, Salmonella enterica enterica serovar Typhi Ty2
cauucgcuccucag

SEQ ID NO: 3736244 - RNA, 17 nt, Salmonella enterica enterica serovar Typhi Ty2
cauucgcuccucagcgc

SEQ ID NO: 3736245 - RNA, 16 nt, Salmonella enterica enterica serovar Typhi Ty2
cauucgcuugcccggc

SEQ ID NO: 3736246 - RNA, 21 nt, Salmonella enterica enterica serovar Typhi Ty2
cauucgcuugcccggccguua

SEQ ID NO: 3736247 - RNA, 17 nt, Salmonella enterica enterica serovar Typhi Ty2
cauucggcguaucggaa

SEQ ID NO: 3736248 - RNA, 23 nt, Salmonella enterica enterica serovar Typhi Ty2
cauucgggacaaacccccagcca

SEQ ID NO: 3736249 - RNA, 14 nt, Salmonella enterica enterica serovar Typhi Ty2
cauucgucaaauuc

SEQ ID NO: 3736250 - RNA, 20 nt, Salmonella enterica enterica serovar Typhi Ty2
cauucucuucuaccacgcug

SEQ ID NO: 3736251 - RNA, 15 nt, Salmonella enterica enterica serovar Typhi Ty2
cauucucuugccugc

SEQ ID NO: 3736252 - RNA, 20 nt, Salmonella enterica enterica serovar Typhi Ty2
cauucucuuucugcgccgca

SEQ ID NO: 3736253 - RNA, 15 nt, Salmonella enterica enterica serovar Typhi Ty2
cauucugcugaugcu

SEQ ID NO: 3736254 - RNA, 20 nt, Salmonella enterica enterica serovar Typhi Ty2
cauucugggaggugaaggau

SEQ ID NO: 3736255 - RNA, 13 nt, Salmonella enterica enterica serovar Typhi Ty2
cauucuugccgca

SEQ ID NO: 3736256 - RNA, 23 nt, Salmonella enterica enterica serovar Typhi Ty2
cauucuuugcuuuguaaagcgcc

SEQ ID NO: 3736257 - RNA, 23 nt, Salmonella enterica enterica serovar Typhi Ty2
cauucuuuugcccgguggcgcug

SEQ ID NO: 3736258 - RNA, 15 nt, Salmonella enterica enterica serovar Typhi Ty2
cauugaacgcgcgcu

SEQ ID NO: 3736259 - RNA, 16 nt, Salmonella enterica enterica serovar Typhi Ty2
cauugacuacugugac

SEQ ID NO: 3736260 - RNA, 21 nt, Salmonella enterica enterica serovar Typhi Ty2
cauugacuuaucgcgcuggca

SEQ ID NO: 3736261 - RNA, 18 nt, Salmonella enterica enterica serovar Typhi Ty2
cauugaggcuacccagac

SEQ ID NO: 3736262 - RNA, 16 nt, Salmonella enterica enterica serovar Typhi Ty2
cauugaguaaauaaau

SEQ ID NO: 3736263 - RNA, 16 nt, Salmonella enterica enterica serovar Typhi Ty2
cauugauaaagcgcuc

SEQ ID NO: 3736264 - RNA, 22 nt, Salmonella enterica enterica serovar Typhi Ty2
cauugauauagaguccagccau

SEQ ID NO: 3736265 - RNA, 19 nt, Salmonella enterica enterica serovar Typhi Ty2
cauugaugaugaagcugca

SEQ ID NO: 3736266 - RNA, 21 nt, Salmonella enterica enterica serovar Typhi Ty2
cauugaugaugaagcugcagg

SEQ ID NO: 3736267 - RNA, 20 nt, Salmonella enterica enterica serovar Typhi Ty2
cauugaugcaggcgccuggg

SEQ ID NO: 3736268 - RNA, 19 nt, Salmonella enterica enterica serovar Typhi Ty2
cauugaugccugcccaucu

SEQ ID NO: 3736269 - RNA, 16 nt, Salmonella enterica enterica serovar Typhi Ty2
cauugcagcauuacac

SEQ ID NO: 3736270 - RNA, 11 nt, Salmonella enterica enterica serovar Typhi Ty2
cauugcagcgg

SEQ ID NO: 3736271 - RNA, 17 nt, Salmonella enterica enterica serovar Typhi Ty2
cauugcaggcuuuuuca

SEQ ID NO: 3736272 - RNA, 13 nt, Salmonella enterica enterica serovar Typhi Ty2
cauugccacccau

SEQ ID NO: 3736273 - RNA, 23 nt, Salmonella enterica enterica serovar Typhi Ty2
cauugccaugcgacuaaccugau

SEQ ID NO: 3736274 - RNA, 12 nt, Salmonella enterica enterica serovar Typhi Ty2
cauugcccggcg

SEQ ID NO: 3736275 - RNA, 14 nt, Salmonella enterica enterica serovar Typhi Ty2
cauugccgcgccga

SEQ ID NO: 3736276 - RNA, 14 nt, Salmonella enterica enterica serovar Typhi Ty2
cauugccguaaauu

SEQ ID NO: 3736277 - RNA, 17 nt, Salmonella enterica enterica serovar Typhi Ty2
cauugccguuaacugcu

SEQ ID NO: 3736278 - RNA, 20 nt, Salmonella enterica enterica serovar Typhi Ty2
cauugccguuaacugcugcu

SEQ ID NO: 3736279 - RNA, 15 nt, Salmonella enterica enterica serovar Typhi Ty2
cauugccuuccaggc

SEQ ID NO: 3736280 - RNA, 22 nt, Salmonella enterica enterica serovar Typhi Ty2
cauugcgagaaaaaacucagga

SEQ ID NO: 3736281 - RNA, 16 nt, Salmonella enterica enterica serovar Typhi Ty2
cauugcgcgccgacag

SEQ ID NO: 3736282 - RNA, 16 nt, Salmonella enterica enterica serovar Typhi Ty2
cauugcgcuauuacuc

SEQ ID NO: 3736283 - RNA, 18 nt, Salmonella enterica enterica serovar Typhi Ty2
cauugcguaaugagcguc

SEQ ID NO: 3736284 - RNA, 19 nt, Salmonella enterica enterica serovar Typhi Ty2
cauugcuaggaacagugac

SEQ ID NO: 3736285 - RNA, 18 nt, Salmonella enterica enterica serovar Typhi Ty2
cauuuuucgaucuucucc

SEQ ID NO: 3736286 - RNA, 12 nt, Salmonella enterica enterica serovar Typhi Ty2
cauuuuucucag

SEQ ID NO: 3736287 - RNA, 19 nt, Salmonella enterica enterica serovar Typhi Ty2
cauuuuucucaggacgcca

SEQ ID NO: 3736288 - RNA, 21 nt, Salmonella enterica enterica serovar Typhi Ty2
cauuuuuugacaacaaaaaga

SEQ ID NO: 3736289 - RNA, 16 nt, Salmonella enterica enterica serovar Typhi Ty2
cauuuuuuucagccuu

SEQ ID NO: 3736290 - RNA, 22 nt, Salmonella enterica enterica serovar Typhi Ty2
ccaaaaaccguagcguugccaa

SEQ ID NO: 3736291 - RNA, 11 nt, Salmonella enterica enterica serovar Typhi Ty2
ccaaaaagaaa

SEQ ID NO: 3736292 - RNA, 14 nt, Salmonella enterica enterica serovar Typhi Ty2
ccaaaaauaaaagg

SEQ ID NO: 3736293 - RNA, 16 nt, Salmonella enterica enterica serovar Typhi Ty2
ccaaaacccaccagca

SEQ ID NO: 3736294 - RNA, 21 nt, Salmonella enterica enterica serovar Typhi Ty2
ccaaaagguuagguuaaauag

SEQ ID NO: 3736295 - RNA, 19 nt, Salmonella enterica enterica serovar Typhi Ty2
ccaaaauaauaaaaaucgg

SEQ ID NO: 3736296 - RNA, 20 nt, Salmonella enterica enterica serovar Typhi Ty2
ccaaaauccagggaaaccau

SEQ ID NO: 3736297 - RNA, 21 nt, Salmonella enterica enterica serovar Typhi Ty2
ccaaaauucacgcuucucugg

SEQ ID NO: 3736298 - RNA, 13 nt, Salmonella enterica enterica serovar Typhi Ty2
ccaaaccagaccc

SEQ ID NO: 3736299 - RNA, 22 nt, Salmonella enterica enterica serovar Typhi Ty2
ccaaaccagacucaccccuucu

SEQ ID NO: 3736300 - RNA, 20 nt, Salmonella enterica enterica serovar Typhi Ty2
ccaaaccugagcauauaaau

SEQ ID NO: 3736301 - RNA, 16 nt, Salmonella enterica enterica serovar Typhi Ty2
ccaaaccugccacagg

SEQ ID NO: 3736302 - RNA, 16 nt, Salmonella enterica enterica serovar Typhi Ty2
ccaaacgaauuuaaau

SEQ ID NO: 3736303 - RNA, 17 nt, Salmonella enterica enterica serovar Typhi Ty2
ccaaacgaauuuaaaua

SEQ ID NO: 3736304 - RNA, 23 nt, Salmonella enterica enterica serovar Typhi Ty2
ccaaacgaugaccauaaaugaaa

SEQ ID NO: 3736305 - RNA, 19 nt, Salmonella enterica enterica serovar Typhi Ty2
ccaaacgcggucaggguga

SEQ ID NO: 3736306 - RNA, 12 nt, Salmonella enterica enterica serovar Typhi Ty2
ccaaacggcagc

SEQ ID NO: 3736307 - RNA, 13 nt, Salmonella enterica enterica serovar Typhi Ty2
ccaaacuccucac

SEQ ID NO: 3736308 - RNA, 18 nt, Salmonella enterica enterica serovar Typhi Ty2
ccaaacucugaaaaaauu

SEQ ID NO: 3736309 - RNA, 12 nt, Salmonella enterica enterica serovar Typhi Ty2
ccaaacugcgga

SEQ ID NO: 3736310 - RNA, 19 nt, Salmonella enterica enterica serovar Typhi Ty2
ccaaacugcggaauuuuau

SEQ ID NO: 3736311 - RNA, 16 nt, Salmonella enterica enterica serovar Typhi Ty2
ccaaacuuacgcagcu

SEQ ID NO: 3736312 - RNA, 15 nt, Salmonella enterica enterica serovar Typhi Ty2
ccaaagaaacgcuga

SEQ ID NO: 3736313 - RNA, 21 nt, Salmonella enterica enterica serovar Typhi Ty2
ccaaagagcugaauguauaua

SEQ ID NO: 3736314 - RNA, 19 nt, Salmonella enterica enterica serovar Typhi Ty2
ccaaagcaaucgccagcgc

SEQ ID NO: 3736315 - RNA, 23 nt, Salmonella enterica enterica serovar Typhi Ty2
ccaaagcaccauucuucaacaau

SEQ ID NO: 3736316 - RNA, 19 nt, Salmonella enterica enterica serovar Typhi Ty2
ccaaagcagcggaaaauau

SEQ ID NO: 3736317 - RNA, 18 nt, Salmonella enterica enterica serovar Typhi Ty2
ccaaagcccgcaaacaga

SEQ ID NO: 3736318 - RNA, 22 nt, Salmonella enterica enterica serovar Typhi Ty2
ccaaagcgcccgauaauaucac

SEQ ID NO: 3736319 - RNA, 16 nt, Salmonella enterica enterica serovar Typhi Ty2
ccaaagggagcagacu

SEQ ID NO: 3736320 - RNA, 15 nt, Salmonella enterica enterica serovar Typhi Ty2
ccaaaguccaacugu

SEQ ID NO: 3736321 - RNA, 17 nt, Salmonella enterica enterica serovar Typhi Ty2
ccaaaguuaaucagcgc

SEQ ID NO: 3736322 - RNA, 14 nt, Salmonella enterica enterica serovar Typhi Ty2
ccaaaguuuuuaaa

SEQ ID NO: 3736323 - RNA, 13 nt, Salmonella enterica enterica serovar Typhi Ty2
ccaaauagcgcca

SEQ ID NO: 3736324 - RNA, 22 nt, Salmonella enterica enterica serovar Typhi Ty2
ccaaauaggcgaggaaaacauu

SEQ ID NO: 3736325 - RNA, 15 nt, Salmonella enterica enterica serovar Typhi Ty2
ccaaaucaauagaau

SEQ ID NO: 3736326 - RNA, 18 nt, Salmonella enterica enterica serovar Typhi Ty2
ccaaaucaugccgccaaa

SEQ ID NO: 3736327 - RNA, 20 nt, Salmonella enterica enterica serovar Typhi Ty2
ccaaaucucccccggcacca

SEQ ID NO: 3736328 - RNA, 18 nt, Salmonella enterica enterica serovar Typhi Ty2
ccaaaucuguucugucca

SEQ ID NO: 3736329 - RNA, 13 nt, Salmonella enterica enterica serovar Typhi Ty2
ccaaaugcccagc

SEQ ID NO: 3736330 - RNA, 17 nt, Salmonella enterica enterica serovar Typhi Ty2
ccaacaacaggccgccg

SEQ ID NO: 3736331 - RNA, 14 nt, Salmonella enterica enterica serovar Typhi Ty2
ccaacaacccauuc

SEQ ID NO: 3736332 - RNA, 19 nt, Salmonella enterica enterica serovar Typhi Ty2
ccaacaaucagaagaaaua

SEQ ID NO: 3736333 - RNA, 15 nt, Salmonella enterica enterica serovar Typhi Ty2
ccaacaaugccacgc

SEQ ID NO: 3736334 - RNA, 20 nt, Salmonella enterica enterica serovar Typhi Ty2
ccaacaaugccacgccccua

SEQ ID NO: 3736335 - RNA, 12 nt, Salmonella enterica enterica serovar Typhi Ty2
ccaacaccagcc

SEQ ID NO: 3736336 - RNA, 18 nt, Salmonella enterica enterica serovar Typhi Ty2
ccaacagcaauguuucaa

SEQ ID NO: 3736337 - RNA, 12 nt, Salmonella enterica enterica serovar Typhi Ty2
ccaacagcgcaa

SEQ ID NO: 3736338 - RNA, 13 nt, Salmonella enterica enterica serovar Typhi Ty2
ccaacagcugggu

SEQ ID NO: 3736339 - RNA, 13 nt, Salmonella enterica enterica serovar Typhi Ty2
ccaacaggaacau

SEQ ID NO: 3736340 - RNA, 22 nt, Salmonella enterica enterica serovar Typhi Ty2
ccaacaggaacaucguguccug

SEQ ID NO: 3736341 - RNA, 17 nt, Salmonella enterica enterica serovar Typhi Ty2
ccaacagguuaaucagc

SEQ ID NO: 3736342 - RNA, 12 nt, Salmonella enterica enterica serovar Typhi Ty2
ccaacagucaug

SEQ ID NO: 3736343 - RNA, 21 nt, Salmonella enterica enterica serovar Typhi Ty2
ccaacauacaugccugcgcca

SEQ ID NO: 3736344 - RNA, 21 nt, Salmonella enterica enterica serovar Typhi Ty2
ccaacauagcuaaauaaaaau

SEQ ID NO: 3736345 - RNA, 23 nt, Salmonella enterica enterica serovar Typhi Ty2
ccaacauagcuaaauaaaaauaa

SEQ ID NO: 3736346 - RNA, 16 nt, Salmonella enterica enterica serovar Typhi Ty2
ccaaccaggcaaacca

SEQ ID NO: 3736347 - RNA, 19 nt, Salmonella enterica enterica serovar Typhi Ty2
ccaaccaucggcacacuuu

SEQ ID NO: 3736348 - RNA, 18 nt, Salmonella enterica enterica serovar Typhi Ty2
ccaacccacgcgccacgu

SEQ ID NO: 3736349 - RNA, 15 nt, Salmonella enterica enterica serovar Typhi Ty2
ccaaccgaacaauau

SEQ ID NO: 3736350 - RNA, 11 nt, Salmonella enterica enterica serovar Typhi Ty2
ccaaccgccag

SEQ ID NO: 3736351 - RNA, 14 nt, Salmonella enterica enterica serovar Typhi Ty2
ccaaccgccagcca

SEQ ID NO: 3736352 - RNA, 21 nt, Salmonella enterica enterica serovar Typhi Ty2
ccaaccggccccaucgccgua

SEQ ID NO: 3736353 - RNA, 15 nt, Salmonella enterica enterica serovar Typhi Ty2
ccaaccgugcuucac

SEQ ID NO: 3736354 - RNA, 17 nt, Salmonella enterica enterica serovar Typhi Ty2
ccaacgaaacucagcgg

SEQ ID NO: 3736355 - RNA, 16 nt, Salmonella enterica enterica serovar Typhi Ty2
ccaacgccagcagcgc

SEQ ID NO: 3736356 - RNA, 19 nt, Salmonella enterica enterica serovar Typhi Ty2
ccaacgcuucacaaccuga

SEQ ID NO: 3736357 - RNA, 16 nt, Salmonella enterica enterica serovar Typhi Ty2
ccaacggcgacgcccg

SEQ ID NO: 3736358 - RNA, 22 nt, Salmonella enterica enterica serovar Typhi Ty2
ccaacggcgacgcccgccaucu

SEQ ID NO: 3736359 - RNA, 20 nt, Salmonella enterica enterica serovar Typhi Ty2
ccaacgucaauguaauucac

SEQ ID NO: 3736360 - RNA, 15 nt, Salmonella enterica enterica serovar Typhi Ty2
ccaacugccaaacca

SEQ ID NO: 3736361 - RNA, 21 nt, Salmonella enterica enterica serovar Typhi Ty2
ccaacuguauuuugaaaacac

SEQ ID NO: 3736362 - RNA, 17 nt, Salmonella enterica enterica serovar Typhi Ty2
ccaacugucgccauccu

SEQ ID NO: 3736363 - RNA, 12 nt, Salmonella enterica enterica serovar Typhi Ty2
ccaagaaugaaa

SEQ ID NO: 3736364 - RNA, 21 nt, Salmonella enterica enterica serovar Typhi Ty2
ccaagauaagaaguaaacaga

SEQ ID NO: 3736365 - RNA, 17 nt, Salmonella enterica enterica serovar Typhi Ty2
ccaagauccagcgguaa

SEQ ID NO: 3736366 - RNA, 21 nt, Salmonella enterica enterica serovar Typhi Ty2
ccaagaucgccaagcugugau

SEQ ID NO: 3736367 - RNA, 15 nt, Salmonella enterica enterica serovar Typhi Ty2
ccacauugaccccau

SEQ ID NO: 3736368 - RNA, 12 nt, Salmonella enterica enterica serovar Typhi Ty2
ccaccaaagcca

SEQ ID NO: 3736369 - RNA, 17 nt, Salmonella enterica enterica serovar Typhi Ty2
ccaccaaagccaggccg

SEQ ID NO: 3736370 - RNA, 19 nt, Salmonella enterica enterica serovar Typhi Ty2
ccaccaaagccaggccgcc

SEQ ID NO: 3736371 - RNA, 12 nt, Salmonella enterica enterica serovar Typhi Ty2
ccaccacaaagc

SEQ ID NO: 3736372 - RNA, 14 nt, Salmonella enterica enterica serovar Typhi Ty2
ccaccaccagcauc

SEQ ID NO: 3736373 - RNA, 21 nt, Salmonella enterica enterica serovar Typhi Ty2
ccaccacccagugccaccagc

SEQ ID NO: 3736374 - RNA, 13 nt, Salmonella enterica enterica serovar Typhi Ty2
ccaccaccgccac

SEQ ID NO: 3736375 - RNA, 14 nt, Salmonella enterica enterica serovar Typhi Ty2
ccaccaccuccugc

SEQ ID NO: 3736376 - RNA, 13 nt, Salmonella enterica enterica serovar Typhi Ty2
ccaccacgcagcc

SEQ ID NO: 3736377 - RNA, 12 nt, Salmonella enterica enterica serovar Typhi Ty2
ccaccagaaccu

SEQ ID NO: 3736378 - RNA, 23 nt, Salmonella enterica enterica serovar Typhi Ty2
ccaccagcccaucuuucgccagc

SEQ ID NO: 3736379 - RNA, 15 nt, Salmonella enterica enterica serovar Typhi Ty2
ccaccagccgauaac

SEQ ID NO: 3736380 - RNA, 23 nt, Salmonella enterica enterica serovar Typhi Ty2
ccaccagccgauaacucuucauc

SEQ ID NO: 3736381 - RNA, 13 nt, Salmonella enterica enterica serovar Typhi Ty2
ccaccagcgccag

SEQ ID NO: 3736382 - RNA, 18 nt, Salmonella enterica enterica serovar Typhi Ty2
ccaccagcgccagcggcu

SEQ ID NO: 3736383 - RNA, 19 nt, Salmonella enterica enterica serovar Typhi Ty2
ccaccagcgccaggccauu

SEQ ID NO: 3736384 - RNA, 12 nt, Salmonella enterica enterica serovar Typhi Ty2
ccaccagcguac

SEQ ID NO: 3736385 - RNA, 21 nt, Salmonella enterica enterica serovar Typhi Ty2
ccaccaggaaugcggccaucc

SEQ ID NO: 3736386 - RNA, 15 nt, Salmonella enterica enterica serovar Typhi Ty2
ccaccagguucagca

SEQ ID NO: 3736387 - RNA, 20 nt, Salmonella enterica enterica serovar Typhi Ty2
ccaccaguaaccgccacagc

SEQ ID NO: 3736388 - RNA, 19 nt, Salmonella enterica enterica serovar Typhi Ty2
ccaccauaggccagcguca

SEQ ID NO: 3736389 - RNA, 22 nt, Salmonella enterica enterica serovar Typhi Ty2
ccaccauaucgcagaccaucca

SEQ ID NO: 3736390 - RNA, 20 nt, Salmonella enterica enterica serovar Typhi Ty2
ccaccaucacuuccauccau

SEQ ID NO: 3736391 - RNA, 13 nt, Salmonella enterica enterica serovar Typhi Ty2
ccaccauccgcgc

SEQ ID NO: 3736392 - RNA, 18 nt, Salmonella enterica enterica serovar Typhi Ty2
ccaccaucgucgccagac

SEQ ID NO: 3736393 - RNA, 16 nt, Salmonella enterica enterica serovar Typhi Ty2
ccaccaugcugguugg

SEQ ID NO: 3736394 - RNA, 23 nt, Salmonella enterica enterica serovar Typhi Ty2
ccacccauuuauguuugcccagc

SEQ ID NO: 3736395 - RNA, 19 nt, Salmonella enterica enterica serovar Typhi Ty2
ccacccgcgcgcuuuccac

SEQ ID NO: 3736396 - RNA, 15 nt, Salmonella enterica enterica serovar Typhi Ty2
ccacccgggaagccc

SEQ ID NO: 3736397 - RNA, 15 nt, Salmonella enterica enterica serovar Typhi Ty2
ccacccgguuuacca

SEQ ID NO: 3736398 - RNA, 16 nt, Salmonella enterica enterica serovar Typhi Ty2
ccaccgccaaccgccc

SEQ ID NO: 3736399 - RNA, 18 nt, Salmonella enterica enterica serovar Typhi Ty2
ccaccgccgccaccaaaa

SEQ ID NO: 3736400 - RNA, 12 nt, Salmonella enterica enterica serovar Typhi Ty2
ccaccgccgcug

SEQ ID NO: 3736401 - RNA, 16 nt, Salmonella enterica enterica serovar Typhi Ty2
ccaccgcgcgcuuaau

SEQ ID NO: 3736402 - RNA, 15 nt, Salmonella enterica enterica serovar Typhi Ty2
ccaccgcuccgcgca

SEQ ID NO: 3736403 - RNA, 23 nt, Salmonella enterica enterica serovar Typhi Ty2
ccaccggaccuaauagccagccc

SEQ ID NO: 3736404 - RNA, 16 nt, Salmonella enterica enterica serovar Typhi Ty2
ccaccgguauccgcau

SEQ ID NO: 3736405 - RNA, 21 nt, Salmonella enterica enterica serovar Typhi Ty2
ccaccguaugugcgccgugca

SEQ ID NO: 3736406 - RNA, 22 nt, Salmonella enterica enterica serovar Typhi Ty2
ccaccguaugugcgccgugcag

SEQ ID NO: 3736407 - RNA, 17 nt, Salmonella enterica enterica serovar Typhi Ty2
ccaccguuuaaucgccc

SEQ ID NO: 3736408 - RNA, 21 nt, Salmonella enterica enterica serovar Typhi Ty2
ccaccguuuaaucgcccugcg

SEQ ID NO: 3736409 - RNA, 18 nt, Salmonella enterica enterica serovar Typhi Ty2
ccaccucaagguagcgug

SEQ ID NO: 3736410 - RNA, 14 nt, Salmonella enterica enterica serovar Typhi Ty2
ccaccucaaucacc

SEQ ID NO: 3736411 - RNA, 16 nt, Salmonella enterica enterica serovar Typhi Ty2
ccaccucguucaaaca

SEQ ID NO: 3736412 - RNA, 15 nt, Salmonella enterica enterica serovar Typhi Ty2
ccaccugaucgccaa

SEQ ID NO: 3736413 - RNA, 16 nt, Salmonella enterica enterica serovar Typhi Ty2
ccaccugaucgccaac

SEQ ID NO: 3736414 - RNA, 16 nt, Salmonella enterica enterica serovar Typhi Ty2
ccaccugcacggcguc

SEQ ID NO: 3736415 - RNA, 13 nt, Salmonella enterica enterica serovar Typhi Ty2
ccaccugcgcguu

SEQ ID NO: 3736416 - RNA, 18 nt, Salmonella enterica enterica serovar Typhi Ty2
ccaccuggcccugcauca

SEQ ID NO: 3736417 - RNA, 18 nt, Salmonella enterica enterica serovar Typhi Ty2
ccaccuguucgccuucgu

SEQ ID NO: 3736418 - RNA, 19 nt, Salmonella enterica enterica serovar Typhi Ty2
ccaccuguuucgccaggcc

SEQ ID NO: 3736419 - RNA, 18 nt, Salmonella enterica enterica serovar Typhi Ty2
ccaccuuaaacuugccgu

SEQ ID NO: 3736420 - RNA, 19 nt, Salmonella enterica enterica serovar Typhi Ty2
ccaccuucucuuuaugcgu

SEQ ID NO: 3736421 - RNA, 23 nt, Salmonella enterica enterica serovar Typhi Ty2
ccaccuuugaaaaucacaucgcc

SEQ ID NO: 3736422 - RNA, 16 nt, Salmonella enterica enterica serovar Typhi Ty2
ccacgaaagucuguuc

SEQ ID NO: 3736423 - RNA, 17 nt, Salmonella enterica enterica serovar Typhi Ty2
ccacgaacgauauaaaa

SEQ ID NO: 3736424 - RNA, 22 nt, Salmonella enterica enterica serovar Typhi Ty2
ccacgaacgauauaaaaaccga

SEQ ID NO: 3736425 - RNA, 14 nt, Salmonella enterica enterica serovar Typhi Ty2
ccacgacauccgga

SEQ ID NO: 3736426 - RNA, 18 nt, Salmonella enterica enterica serovar Typhi Ty2
ccacgaccuacaccguau

SEQ ID NO: 3736427 - RNA, 16 nt, Salmonella enterica enterica serovar Typhi Ty2
ccacgauacgccccug

SEQ ID NO: 3736428 - RNA, 17 nt, Salmonella enterica enterica serovar Typhi Ty2
ccacgauagacagcacc

SEQ ID NO: 3736429 - RNA, 17 nt, Salmonella enterica enterica serovar Typhi Ty2
ccacgcaaucucuuccg

SEQ ID NO: 3736430 - RNA, 18 nt, Salmonella enterica enterica serovar Typhi Ty2
ccacgcacgccggccccg

SEQ ID NO: 3736431 - RNA, 17 nt, Salmonella enterica enterica serovar Typhi Ty2
ccacgcaggcgaccucg

SEQ ID NO: 3736432 - RNA, 22 nt, Salmonella enterica enterica serovar Typhi Ty2
ccacgccaaccaucggcacacu

SEQ ID NO: 3736433 - RNA, 15 nt, Salmonella enterica enterica serovar Typhi Ty2
ccacgccaccgccgc

SEQ ID NO: 3736434 - RNA, 20 nt, Salmonella enterica enterica serovar Typhi Ty2
ccacgccaccgggccgucag

SEQ ID NO: 3736435 - RNA, 15 nt, Salmonella enterica enterica serovar Typhi Ty2
ccacgccagcagcuc

SEQ ID NO: 3736436 - RNA, 15 nt, Salmonella enterica enterica serovar Typhi Ty2
ccacgccaucgcggc

SEQ ID NO: 3736437 - RNA, 13 nt, Salmonella enterica enterica serovar Typhi Ty2
ccacgcccagcua

SEQ ID NO: 3736438 - RNA, 19 nt, Salmonella enterica enterica serovar Typhi Ty2
ccacgcccuucacgccgaa

SEQ ID NO: 3736439 - RNA, 20 nt, Salmonella enterica enterica serovar Typhi Ty2
ccacgccgaccaccagcuug

SEQ ID NO: 3736440 - RNA, 20 nt, Salmonella enterica enterica serovar Typhi Ty2
ccacgccgagaaacaccaga

SEQ ID NO: 3736441 - RNA, 14 nt, Salmonella enterica enterica serovar Typhi Ty2
ccacgccgcaagga

SEQ ID NO: 3736442 - RNA, 14 nt, Salmonella enterica enterica serovar Typhi Ty2
ccacgccgccgcgu

SEQ ID NO: 3736443 - RNA, 17 nt, Salmonella enterica enterica serovar Typhi Ty2
ccacgccgcuaucgacc

SEQ ID NO: 3736444 - RNA, 18 nt, Salmonella enterica enterica serovar Typhi Ty2
ccacgccgcuaucgacca

SEQ ID NO: 3736445 - RNA, 15 nt, Salmonella enterica enterica serovar Typhi Ty2
ccacgccguccggag

SEQ ID NO: 3736446 - RNA, 22 nt, Salmonella enterica enterica serovar Typhi Ty2
ccacgccuaaacugauagacaa

SEQ ID NO: 3736447 - RNA, 14 nt, Salmonella enterica enterica serovar Typhi Ty2
ccacgcgacgccag

SEQ ID NO: 3736448 - RNA, 15 nt, Salmonella enterica enterica serovar Typhi Ty2
ccacgcgacgccagc

SEQ ID NO: 3736449 - RNA, 20 nt, Salmonella enterica enterica serovar Typhi Ty2
ccagacagauaacaccagcg

SEQ ID NO: 3736450 - RNA, 17 nt, Salmonella enterica enterica serovar Typhi Ty2
ccagacaggacgccagc

SEQ ID NO: 3736451 - RNA, 19 nt, Salmonella enterica enterica serovar Typhi Ty2
ccagacaggacgccagcgc

SEQ ID NO: 3736452 - RNA, 22 nt, Salmonella enterica enterica serovar Typhi Ty2
ccagacaucacguucgcgcaua

SEQ ID NO: 3736453 - RNA, 17 nt, Salmonella enterica enterica serovar Typhi Ty2
ccagacaugcacauggu

SEQ ID NO: 3736454 - RNA, 14 nt, Salmonella enterica enterica serovar Typhi Ty2
ccagaccaauagag

SEQ ID NO: 3736455 - RNA, 21 nt, Salmonella enterica enterica serovar Typhi Ty2
ccagaccacuaacccggcgac

SEQ ID NO: 3736456 - RNA, 19 nt, Salmonella enterica enterica serovar Typhi Ty2
ccagaccauucaaccagcc

SEQ ID NO: 3736457 - RNA, 23 nt, Salmonella enterica enterica serovar Typhi Ty2
ccagaccccaguaauccggcaac

SEQ ID NO: 3736458 - RNA, 19 nt, Salmonella enterica enterica serovar Typhi Ty2
ccagacccgauaguguaaa

SEQ ID NO: 3736459 - RNA, 19 nt, Salmonella enterica enterica serovar Typhi Ty2
ccagaccggcaucucaucu

SEQ ID NO: 3736460 - RNA, 12 nt, Salmonella enterica enterica serovar Typhi Ty2
ccagaccgugcg

SEQ ID NO: 3736461 - RNA, 13 nt, Salmonella enterica enterica serovar Typhi Ty2
ccagacgccagcc

SEQ ID NO: 3736462 - RNA, 20 nt, Salmonella enterica enterica serovar Typhi Ty2
ccagacgccauaucgccgcc

SEQ ID NO: 3736463 - RNA, 14 nt, Salmonella enterica enterica serovar Typhi Ty2
ccagacgcgcagca

SEQ ID NO: 3736464 - RNA, 17 nt, Salmonella enterica enterica serovar Typhi Ty2
ccagacgcguaaccccu

SEQ ID NO: 3736465 - RNA, 20 nt, Salmonella enterica enterica serovar Typhi Ty2
ccagacgcugauagccacgg

SEQ ID NO: 3736466 - RNA, 22 nt, Salmonella enterica enterica serovar Typhi Ty2
ccagacggcggcgaauagcgaa

SEQ ID NO: 3736467 - RNA, 22 nt, Salmonella enterica enterica serovar Typhi Ty2
ccagacgguaagcguucgcaua

SEQ ID NO: 3736468 - RNA, 22 nt, Salmonella enterica enterica serovar Typhi Ty2
ccagacguuggauaacagcgcg

SEQ ID NO: 3736469 - RNA, 15 nt, Salmonella enterica enterica serovar Typhi Ty2
ccagacuaaaacgug

SEQ ID NO: 3736470 - RNA, 13 nt, Salmonella enterica enterica serovar Typhi Ty2
ccagacuaaucca

SEQ ID NO: 3736471 - RNA, 16 nt, Salmonella enterica enterica serovar Typhi Ty2
ccagacugugauggcg

SEQ ID NO: 3736472 - RNA, 14 nt, Salmonella enterica enterica serovar Typhi Ty2
ccagacuuuccagc

SEQ ID NO: 3736473 - RNA, 17 nt, Salmonella enterica enterica serovar Typhi Ty2
ccagagagaugccgccg

SEQ ID NO: 3736474 - RNA, 21 nt, Salmonella enterica enterica serovar Typhi Ty2
ccagagagcguuucuacgcca

SEQ ID NO: 3736475 - RNA, 17 nt, Salmonella enterica enterica serovar Typhi Ty2
ccagagcgcgcuggcaa

SEQ ID NO: 3736476 - RNA, 18 nt, Salmonella enterica enterica serovar Typhi Ty2
ccagagcgcggccuuugc

SEQ ID NO: 3736477 - RNA, 20 nt, Salmonella enterica enterica serovar Typhi Ty2
ccagaggaucuggacgccaa

SEQ ID NO: 3736478 - RNA, 17 nt, Salmonella enterica enterica serovar Typhi Ty2
ccagaguccggcgccug

SEQ ID NO: 3736479 - RNA, 16 nt, Salmonella enterica enterica serovar Typhi Ty2
ccagauaaagcagcga

SEQ ID NO: 3736480 - RNA, 12 nt, Salmonella enterica enterica serovar Typhi Ty2
ccagauaauagc

SEQ ID NO: 3736481 - RNA, 20 nt, Salmonella enterica enterica serovar Typhi Ty2
ccagauaaucaaacgcgccg

SEQ ID NO: 3736482 - RNA, 18 nt, Salmonella enterica enterica serovar Typhi Ty2
ccagauaauuaugccugu

SEQ ID NO: 3736483 - RNA, 13 nt, Salmonella enterica enterica serovar Typhi Ty2
ccagauacauggc

SEQ ID NO: 3736484 - RNA, 15 nt, Salmonella enterica enterica serovar Typhi Ty2
ccagauacgccgcgc

SEQ ID NO: 3736485 - RNA, 14 nt, Salmonella enterica enterica serovar Typhi Ty2
ccagauagcgcugc

SEQ ID NO: 3736486 - RNA, 21 nt, Salmonella enterica enterica serovar Typhi Ty2
ccagauagcgcugcgccagau

SEQ ID NO: 3736487 - RNA, 17 nt, Salmonella enterica enterica serovar Typhi Ty2
ccagauagcgucuucag

SEQ ID NO: 3736488 - RNA, 19 nt, Salmonella enterica enterica serovar Typhi Ty2
ccagauagggccaggcgcg

SEQ ID NO: 3736489 - RNA, 15 nt, Salmonella enterica enterica serovar Typhi Ty2
ccagauaucccgcca

SEQ ID NO: 3736490 - RNA, 13 nt, Salmonella enterica enterica serovar Typhi Ty2
ccagauauggcaa

SEQ ID NO: 3736491 - RNA, 19 nt, Salmonella enterica enterica serovar Typhi Ty2
ccagaucgauauccgugcg

SEQ ID NO: 3736492 - RNA, 13 nt, Salmonella enterica enterica serovar Typhi Ty2
ccagaucggcaua

SEQ ID NO: 3736493 - RNA, 22 nt, Salmonella enterica enterica serovar Typhi Ty2
ccagaucguagccauguuccuc

SEQ ID NO: 3736494 - RNA, 15 nt, Salmonella enterica enterica serovar Typhi Ty2
ccagaugaaacugca

SEQ ID NO: 3736495 - RNA, 15 nt, Salmonella enterica enterica serovar Typhi Ty2
ccagaugaagcgcau

SEQ ID NO: 3736496 - RNA, 16 nt, Salmonella enterica enterica serovar Typhi Ty2
ccagaugcgaaacguc

SEQ ID NO: 3736497 - RNA, 22 nt, Salmonella enterica enterica serovar Typhi Ty2
ccagaugcgaaacguccccugc

SEQ ID NO: 3736498 - RNA, 12 nt, Salmonella enterica enterica serovar Typhi Ty2
ccagaugcgcca

SEQ ID NO: 3736499 - RNA, 14 nt, Salmonella enterica enterica serovar Typhi Ty2
ccagaugcugggcg

SEQ ID NO: 3736500 - RNA, 18 nt, Salmonella enterica enterica serovar Typhi Ty2
ccagaugcugggcguguc

SEQ ID NO: 3736501 - RNA, 23 nt, Salmonella enterica enterica serovar Typhi Ty2
ccagaugcuuaaugcucugcugu

SEQ ID NO: 3736502 - RNA, 17 nt, Salmonella enterica enterica serovar Typhi Ty2
ccagauggcaagauuaa

SEQ ID NO: 3736503 - RNA, 21 nt, Salmonella enterica enterica serovar Typhi Ty2
ccagauggggcuuccauugca

SEQ ID NO: 3736504 - RNA, 16 nt, Salmonella enterica enterica serovar Typhi Ty2
ccagaugucgcggaua

SEQ ID NO: 3736505 - RNA, 20 nt, Salmonella enterica enterica serovar Typhi Ty2
ccagauguuauaaacuucaa

SEQ ID NO: 3736506 - RNA, 19 nt, Salmonella enterica enterica serovar Typhi Ty2
ccagauuaucggccagcgc

SEQ ID NO: 3736507 - RNA, 22 nt, Salmonella enterica enterica serovar Typhi Ty2
ccagauuaucggccagcgccag

SEQ ID NO: 3736508 - RNA, 23 nt, Salmonella enterica enterica serovar Typhi Ty2
ccagauucuuaguccucagcgaa

SEQ ID NO: 3736509 - RNA, 20 nt, Salmonella enterica enterica serovar Typhi Ty2
ccagauugucgcaaaccacc

SEQ ID NO: 3736510 - RNA, 18 nt, Salmonella enterica enterica serovar Typhi Ty2
ccagauuuuucucacaca

SEQ ID NO: 3736511 - RNA, 13 nt, Salmonella enterica enterica serovar Typhi Ty2
ccagcaaaauaau

SEQ ID NO: 3736512 - RNA, 14 nt, Salmonella enterica enterica serovar Typhi Ty2
ccagcaaaccggca

SEQ ID NO: 3736513 - RNA, 23 nt, Salmonella enterica enterica serovar Typhi Ty2
ccagcaaaccuuccgccaggcgg

SEQ ID NO: 3736514 - RNA, 12 nt, Salmonella enterica enterica serovar Typhi Ty2
ccagcaaaucgc

SEQ ID NO: 3736515 - RNA, 22 nt, Salmonella enterica enterica serovar Typhi Ty2
ccagcaaaucgcccaucacaug

SEQ ID NO: 3736516 - RNA, 14 nt, Salmonella enterica enterica serovar Typhi Ty2
ccagcaacacagcc

SEQ ID NO: 3736517 - RNA, 15 nt, Salmonella enterica enterica serovar Typhi Ty2
ccagcaacagcguac

SEQ ID NO: 3736518 - RNA, 19 nt, Salmonella enterica enterica serovar Typhi Ty2
ccagcaacagguaccccgc

SEQ ID NO: 3736519 - RNA, 20 nt, Salmonella enterica enterica serovar Typhi Ty2
ccagcaacagugggcuauga

SEQ ID NO: 3736520 - RNA, 17 nt, Salmonella enterica enterica serovar Typhi Ty2
ccagcaacccaccugcc

SEQ ID NO: 3736521 - RNA, 15 nt, Salmonella enterica enterica serovar Typhi Ty2
ccagcaagcggcgau

SEQ ID NO: 3736522 - RNA, 19 nt, Salmonella enterica enterica serovar Typhi Ty2
ccagcaagcggcgauugau

SEQ ID NO: 3736523 - RNA, 12 nt, Salmonella enterica enterica serovar Typhi Ty2
ccagcaaggcaa

SEQ ID NO: 3736524 - RNA, 23 nt, Salmonella enterica enterica serovar Typhi Ty2
ccagcaaguauuggcugccgaca

SEQ ID NO: 3736525 - RNA, 15 nt, Salmonella enterica enterica serovar Typhi Ty2
ccagcaauaacaccg

SEQ ID NO: 3736526 - RNA, 16 nt, Salmonella enterica enterica serovar Typhi Ty2
ccagcaaugauuuuau

SEQ ID NO: 3736527 - RNA, 16 nt, Salmonella enterica enterica serovar Typhi Ty2
ccagcaaugccgccgc

SEQ ID NO: 3736528 - RNA, 20 nt, Salmonella enterica enterica serovar Typhi Ty2
ccagcacacgcaucccgcca

SEQ ID NO: 3736529 - RNA, 12 nt, Salmonella enterica enterica serovar Typhi Ty2
ccagcacagccc

SEQ ID NO: 3736530 - RNA, 15 nt, Salmonella enterica enterica serovar Typhi Ty2
ccagcacagcccagu

SEQ ID NO: 3736531 - RNA, 16 nt, Salmonella enterica enterica serovar Typhi Ty2
ccagcaccaucuuuuc

SEQ ID NO: 3736532 - RNA, 14 nt, Salmonella enterica enterica serovar Typhi Ty2
ccagcacuaacagc

SEQ ID NO: 3736533 - RNA, 19 nt, Salmonella enterica enterica serovar Typhi Ty2
ccagcacuaacagcagcag

SEQ ID NO: 3736534 - RNA, 17 nt, Salmonella enterica enterica serovar Typhi Ty2
ccagcagacgcugcuuc

SEQ ID NO: 3736535 - RNA, 20 nt, Salmonella enterica enterica serovar Typhi Ty2
ccagcagacgcugcuucacg

SEQ ID NO: 3736536 - RNA, 19 nt, Salmonella enterica enterica serovar Typhi Ty2
ccagcagaugcaguucacc

SEQ ID NO: 3736537 - RNA, 20 nt, Salmonella enterica enterica serovar Typhi Ty2
ccagcagauuuuuauccguc

SEQ ID NO: 3736538 - RNA, 9 nt, Salmonella enterica enterica serovar Typhi Ty2
ccagcagca

SEQ ID NO: 3736539 - RNA, 17 nt, Salmonella enterica enterica serovar Typhi Ty2
ccagcagcagcaccggc

SEQ ID NO: 3736540 - RNA, 13 nt, Salmonella enterica enterica serovar Typhi Ty2
ccagcagcagccg

SEQ ID NO: 3736541 - RNA, 15 nt, Salmonella enterica enterica serovar Typhi Ty2
ccagcagcauaaaac

SEQ ID NO: 3736542 - RNA, 21 nt, Salmonella enterica enterica serovar Typhi Ty2
ccagcagcauaaaaccgccgc

SEQ ID NO: 3736543 - RNA, 15 nt, Salmonella enterica enterica serovar Typhi Ty2
ccagcagccacagga

SEQ ID NO: 3736544 - RNA, 17 nt, Salmonella enterica enterica serovar Typhi Ty2
ccagcagcgcaccugcc

SEQ ID NO: 3736545 - RNA, 11 nt, Salmonella enterica enterica serovar Typhi Ty2
ccagcagcgcc

SEQ ID NO: 3736546 - RNA, 12 nt, Salmonella enterica enterica serovar Typhi Ty2
ccagcagcgcca

SEQ ID NO: 3736547 - RNA, 17 nt, Salmonella enterica enterica serovar Typhi Ty2
ccagcagcgccagcgaa

SEQ ID NO: 3736548 - RNA, 22 nt, Salmonella enterica enterica serovar Typhi Ty2
ccagcagcgccaguuuuucccg

SEQ ID NO: 3736549 - RNA, 18 nt, Salmonella enterica enterica serovar Typhi Ty2
ccagcagcgcgaucgccc

SEQ ID NO: 3736550 - RNA, 22 nt, Salmonella enterica enterica serovar Typhi Ty2
ccagcagcucgccgaccggcgc

SEQ ID NO: 3736551 - RNA, 22 nt, Salmonella enterica enterica serovar Typhi Ty2
ccagcaggugcggacugggcug

SEQ ID NO: 3736552 - RNA, 14 nt, Salmonella enterica enterica serovar Typhi Ty2
ccagcaguugccuu

SEQ ID NO: 3736553 - RNA, 17 nt, Salmonella enterica enterica serovar Typhi Ty2
ccagcauaccgcccaac

SEQ ID NO: 3736554 - RNA, 14 nt, Salmonella enterica enterica serovar Typhi Ty2
ccagcauacgucug

SEQ ID NO: 3736555 - RNA, 22 nt, Salmonella enterica enterica serovar Typhi Ty2
ccagcauaugcacacgcagcug

SEQ ID NO: 3736556 - RNA, 20 nt, Salmonella enterica enterica serovar Typhi Ty2
ccagcauauuaacagugagu

SEQ ID NO: 3736557 - RNA, 19 nt, Salmonella enterica enterica serovar Typhi Ty2
ccagcauauuuuccggcgu

SEQ ID NO: 3736558 - RNA, 13 nt, Salmonella enterica enterica serovar Typhi Ty2
ccagcaucacgug

SEQ ID NO: 3736559 - RNA, 19 nt, Salmonella enterica enterica serovar Typhi Ty2
ccagcaucagaauaaugcu

SEQ ID NO: 3736560 - RNA, 14 nt, Salmonella enterica enterica serovar Typhi Ty2
ccagcaucaggugg

SEQ ID NO: 3736561 - RNA, 12 nt, Salmonella enterica enterica serovar Typhi Ty2
ccagcaucgacc

SEQ ID NO: 3736562 - RNA, 16 nt, Salmonella enterica enterica serovar Typhi Ty2
ccagcaucgcccgggc

SEQ ID NO: 3736563 - RNA, 18 nt, Salmonella enterica enterica serovar Typhi Ty2
ccagcaucggcagcgcca

SEQ ID NO: 3736564 - RNA, 19 nt, Salmonella enterica enterica serovar Typhi Ty2
ccagcaucggcagcgccag

SEQ ID NO: 3736565 - RNA, 16 nt, Salmonella enterica enterica serovar Typhi Ty2
ccagcaugagccagcc

SEQ ID NO: 3736566 - RNA, 17 nt, Salmonella enterica enterica serovar Typhi Ty2
ccagcaugagccagccc

SEQ ID NO: 3736567 - RNA, 21 nt, Salmonella enterica enterica serovar Typhi Ty2
ccagcaugaucauacugccgc

SEQ ID NO: 3736568 - RNA, 14 nt, Salmonella enterica enterica serovar Typhi Ty2
ccagcaugcccgcc

SEQ ID NO: 3736569 - RNA, 15 nt, Salmonella enterica enterica serovar Typhi Ty2
ccagcaugcccgcca

SEQ ID NO: 3736570 - RNA, 17 nt, Salmonella enterica enterica serovar Typhi Ty2
ccagcaugcccgccagc

SEQ ID NO: 3736571 - RNA, 22 nt, Salmonella enterica enterica serovar Typhi Ty2
ccagcauggcgucggcgacuuu

SEQ ID NO: 3736572 - RNA, 17 nt, Salmonella enterica enterica serovar Typhi Ty2
ccagcauuaacccggcc

SEQ ID NO: 3736573 - RNA, 15 nt, Salmonella enterica enterica serovar Typhi Ty2
ccagcauuagcgcca

SEQ ID NO: 3736574 - RNA, 17 nt, Salmonella enterica enterica serovar Typhi Ty2
ccagcauuagcgccacc

SEQ ID NO: 3736575 - RNA, 21 nt, Salmonella enterica enterica serovar Typhi Ty2
ccagcauugggccgauaaagc

SEQ ID NO: 3736576 - RNA, 18 nt, Salmonella enterica enterica serovar Typhi Ty2
ccagcauuucaaucgcgc

SEQ ID NO: 3736577 - RNA, 19 nt, Salmonella enterica enterica serovar Typhi Ty2
ccagcauuucaaucgcgcc

SEQ ID NO: 3736578 - RNA, 11 nt, Salmonella enterica enterica serovar Typhi Ty2
ccagcauuucu

SEQ ID NO: 3736579 - RNA, 12 nt, Salmonella enterica enterica serovar Typhi Ty2
ccagccaaacaa

SEQ ID NO: 3736580 - RNA, 18 nt, Salmonella enterica enterica serovar Typhi Ty2
ccagccacaagagcagca

SEQ ID NO: 3736581 - RNA, 15 nt, Salmonella enterica enterica serovar Typhi Ty2
ccagccacacgacgg

SEQ ID NO: 3736582 - RNA, 15 nt, Salmonella enterica enterica serovar Typhi Ty2
ccagccacuccuuac

SEQ ID NO: 3736583 - RNA, 14 nt, Salmonella enterica enterica serovar Typhi Ty2
ccagccacugcgcc

SEQ ID NO: 3736584 - RNA, 15 nt, Salmonella enterica enterica serovar Typhi Ty2
ccagccacugcgcca

SEQ ID NO: 3736585 - RNA, 15 nt, Salmonella enterica enterica serovar Typhi Ty2
ccagccagacgccag

SEQ ID NO: 3736586 - RNA, 17 nt, Salmonella enterica enterica serovar Typhi Ty2
ccagccagcgacgcaug

SEQ ID NO: 3736587 - RNA, 18 nt, Salmonella enterica enterica serovar Typhi Ty2
ccagccagcgccaccaaa

SEQ ID NO: 3736588 - RNA, 14 nt, Salmonella enterica enterica serovar Typhi Ty2
ccagccaggcgauu

SEQ ID NO: 3736589 - RNA, 22 nt, Salmonella enterica enterica serovar Typhi Ty2
ccagccauaaugcaaucaguuc

SEQ ID NO: 3736590 - RNA, 15 nt, Salmonella enterica enterica serovar Typhi Ty2
ccagccauagcagca

SEQ ID NO: 3736591 - RNA, 15 nt, Salmonella enterica enterica serovar Typhi Ty2
ccagccauccccaua

SEQ ID NO: 3736592 - RNA, 14 nt, Salmonella enterica enterica serovar Typhi Ty2
ccagccaugccagc

SEQ ID NO: 3736593 - RNA, 20 nt, Salmonella enterica enterica serovar Typhi Ty2
ccagccauggcccaaaaggu

SEQ ID NO: 3736594 - RNA, 14 nt, Salmonella enterica enterica serovar Typhi Ty2
ccagccccaccguc

SEQ ID NO: 3736595 - RNA, 18 nt, Salmonella enterica enterica serovar Typhi Ty2
ccagccccgaugucgcca

SEQ ID NO: 3736596 - RNA, 21 nt, Salmonella enterica enterica serovar Typhi Ty2
ccagccccuucgcuguccauu

SEQ ID NO: 3736597 - RNA, 15 nt, Salmonella enterica enterica serovar Typhi Ty2
ccagcccgccgcccu

SEQ ID NO: 3736598 - RNA, 23 nt, Salmonella enterica enterica serovar Typhi Ty2
ccagcccggaaauaaacgccagu

SEQ ID NO: 3736599 - RNA, 16 nt, Salmonella enterica enterica serovar Typhi Ty2
ccagcccuaaaaauag

SEQ ID NO: 3736600 - RNA, 12 nt, Salmonella enterica enterica serovar Typhi Ty2
ccagccgcccgc

SEQ ID NO: 3736601 - RNA, 21 nt, Salmonella enterica enterica serovar Typhi Ty2
ccagccgcgccaucuccuccu

SEQ ID NO: 3736602 - RNA, 13 nt, Salmonella enterica enterica serovar Typhi Ty2
ccagccgcugccu

SEQ ID NO: 3736603 - RNA, 18 nt, Salmonella enterica enterica serovar Typhi Ty2
ccagccgcuuuccgccgc

SEQ ID NO: 3736604 - RNA, 20 nt, Salmonella enterica enterica serovar Typhi Ty2
ccagccguugugcugguuga

SEQ ID NO: 3736605 - RNA, 16 nt, Salmonella enterica enterica serovar Typhi Ty2
ccagccuaucgccaua

SEQ ID NO: 3736606 - RNA, 13 nt, Salmonella enterica enterica serovar Typhi Ty2
ccagccucuccca

SEQ ID NO: 3736607 - RNA, 18 nt, Salmonella enterica enterica serovar Typhi Ty2
ccagccuuccuggucugc

SEQ ID NO: 3736608 - RNA, 15 nt, Salmonella enterica enterica serovar Typhi Ty2
ccagcgaaaaccagc

SEQ ID NO: 3736609 - RNA, 15 nt, Salmonella enterica enterica serovar Typhi Ty2
ccagcgaaccuucca

SEQ ID NO: 3736610 - RNA, 14 nt, Salmonella enterica enterica serovar Typhi Ty2
ccagcgaauaauga

SEQ ID NO: 3736611 - RNA, 16 nt, Salmonella enterica enterica serovar Typhi Ty2
ccagcgacaucccaga

SEQ ID NO: 3736612 - RNA, 14 nt, Salmonella enterica enterica serovar Typhi Ty2
ccagcgacggccag

SEQ ID NO: 3736613 - RNA, 14 nt, Salmonella enterica enterica serovar Typhi Ty2
ccagcgacggcgua

SEQ ID NO: 3736614 - RNA, 13 nt, Salmonella enterica enterica serovar Typhi Ty2
ccagcucugccgg

SEQ ID NO: 3736615 - RNA, 12 nt, Salmonella enterica enterica serovar Typhi Ty2
ccagcucuucuu

SEQ ID NO: 3736616 - RNA, 21 nt, Salmonella enterica enterica serovar Typhi Ty2
ccagcucuuuaggcaggaaau

SEQ ID NO: 3736617 - RNA, 23 nt, Salmonella enterica enterica serovar Typhi Ty2
ccagcucuuucaacuuccgcguu

SEQ ID NO: 3736618 - RNA, 14 nt, Salmonella enterica enterica serovar Typhi Ty2
ccagcucuuucaau

SEQ ID NO: 3736619 - RNA, 19 nt, Salmonella enterica enterica serovar Typhi Ty2
ccagcugaaacagaauaaa

SEQ ID NO: 3736620 - RNA, 17 nt, Salmonella enterica enterica serovar Typhi Ty2
ccagcugacgacgccag

SEQ ID NO: 3736621 - RNA, 18 nt, Salmonella enterica enterica serovar Typhi Ty2
ccagcugacgacgccagc

SEQ ID NO: 3736622 - RNA, 21 nt, Salmonella enterica enterica serovar Typhi Ty2
ccagcugacgacgccagcccu

SEQ ID NO: 3736623 - RNA, 17 nt, Salmonella enterica enterica serovar Typhi Ty2
ccagcugcgacagcgaa

SEQ ID NO: 3736624 - RNA, 20 nt, Salmonella enterica enterica serovar Typhi Ty2
ccagcugcgcgcuauuccag

SEQ ID NO: 3736625 - RNA, 23 nt, Salmonella enterica enterica serovar Typhi Ty2
ccagcugguuaaccaccucauua

SEQ ID NO: 3736626 - RNA, 13 nt, Salmonella enterica enterica serovar Typhi Ty2
ccagcuuaucuga

SEQ ID NO: 3736627 - RNA, 23 nt, Salmonella enterica enterica serovar Typhi Ty2
ccagcuuaucugaccaugccagc

SEQ ID NO: 3736628 - RNA, 18 nt, Salmonella enterica enterica serovar Typhi Ty2
ccagcuugccgucacagg

SEQ ID NO: 3736629 - RNA, 14 nt, Salmonella enterica enterica serovar Typhi Ty2
ccaggaacuaacuc

SEQ ID NO: 3736630 - RNA, 19 nt, Salmonella enterica enterica serovar Typhi Ty2
ccaggaagaguaucucucu

SEQ ID NO: 3736631 - RNA, 17 nt, Salmonella enterica enterica serovar Typhi Ty2
ccaggaauuuucccaua

SEQ ID NO: 3736632 - RNA, 23 nt, Salmonella enterica enterica serovar Typhi Ty2
ccaggacaacgccgguacgcagc

SEQ ID NO: 3736633 - RNA, 15 nt, Salmonella enterica enterica serovar Typhi Ty2
ccaggagcaaaccga

SEQ ID NO: 3736634 - RNA, 16 nt, Salmonella enterica enterica serovar Typhi Ty2
ccaggauaguacugac

SEQ ID NO: 3736635 - RNA, 13 nt, Salmonella enterica enterica serovar Typhi Ty2
ccaggaucgccgc

SEQ ID NO: 3736636 - RNA, 15 nt, Salmonella enterica enterica serovar Typhi Ty2
ccaggaucgccgccg

SEQ ID NO: 3736637 - RNA, 15 nt, Salmonella enterica enterica serovar Typhi Ty2
ccaggcaaaaauagg

SEQ ID NO: 3736638 - RNA, 14 nt, Salmonella enterica enterica serovar Typhi Ty2
ccaggcaaaacagu

SEQ ID NO: 3736639 - RNA, 21 nt, Salmonella enterica enterica serovar Typhi Ty2
ccaggcaaagauccaccagau

SEQ ID NO: 3736640 - RNA, 13 nt, Salmonella enterica enterica serovar Typhi Ty2
ccaggcaaagccc

SEQ ID NO: 3736641 - RNA, 18 nt, Salmonella enterica enterica serovar Typhi Ty2
ccaggcaaagccccaguc

SEQ ID NO: 3736642 - RNA, 17 nt, Salmonella enterica enterica serovar Typhi Ty2
ccaggcaaucagcagcc

SEQ ID NO: 3736643 - RNA, 16 nt, Salmonella enterica enterica serovar Typhi Ty2
ccaggcacuugagaaa

SEQ ID NO: 3736644 - RNA, 23 nt, Salmonella enterica enterica serovar Typhi Ty2
ccaggcacuugagaaauuauuuu

SEQ ID NO: 3736645 - RNA, 19 nt, Salmonella enterica enterica serovar Typhi Ty2
ccaggcagauccaaauggc

SEQ ID NO: 3736646 - RNA, 20 nt, Salmonella enterica enterica serovar Typhi Ty2
ccaggcagcaccucaauaug

SEQ ID NO: 3736647 - RNA, 13 nt, Salmonella enterica enterica serovar Typhi Ty2
ccaggcauagaaa

SEQ ID NO: 3736648 - RNA, 21 nt, Salmonella enterica enterica serovar Typhi Ty2
ccaggcauagaaaaagaacug

SEQ ID NO: 3736649 - RNA, 18 nt, Salmonella enterica enterica serovar Typhi Ty2
ccaggcauguuaugaaua

SEQ ID NO: 3736650 - RNA, 19 nt, Salmonella enterica enterica serovar Typhi Ty2
ccaggcauuuuauuaccug

SEQ ID NO: 3736651 - RNA, 18 nt, Salmonella enterica enterica serovar Typhi Ty2
ccaggccaauuccgccau

SEQ ID NO: 3736652 - RNA, 11 nt, Salmonella enterica enterica serovar Typhi Ty2
ccaggccagcg

SEQ ID NO: 3736653 - RNA, 15 nt, Salmonella enterica enterica serovar Typhi Ty2
ccaggccgccaccgc

SEQ ID NO: 3736654 - RNA, 18 nt, Salmonella enterica enterica serovar Typhi Ty2
ccaggccgccaccgccuc

SEQ ID NO: 3736655 - RNA, 18 nt, Salmonella enterica enterica serovar Typhi Ty2
ccaggccggcauaaugau

SEQ ID NO: 3736656 - RNA, 23 nt, Salmonella enterica enterica serovar Typhi Ty2
ccaggccgguuguuuacacggca

SEQ ID NO: 3736657 - RNA, 17 nt, Salmonella enterica enterica serovar Typhi Ty2
ccaggccgucggcgcca

SEQ ID NO: 3736658 - RNA, 21 nt, Salmonella enterica enterica serovar Typhi Ty2
ccaggccgucggcgccagcca

SEQ ID NO: 3736659 - RNA, 17 nt, Salmonella enterica enterica serovar Typhi Ty2
ccaggcgaccagaugca

SEQ ID NO: 3736660 - RNA, 14 nt, Salmonella enterica enterica serovar Typhi Ty2
ccaggcgcgcaccg

SEQ ID NO: 3736661 - RNA, 20 nt, Salmonella enterica enterica serovar Typhi Ty2
ccaggcgcuauucccaggca

SEQ ID NO: 3736662 - RNA, 20 nt, Salmonella enterica enterica serovar Typhi Ty2
ccaggcggauaaaacagaaa

SEQ ID NO: 3736663 - RNA, 22 nt, Salmonella enterica enterica serovar Typhi Ty2
ccaggcggcuuuuucaucaucg

SEQ ID NO: 3736664 - RNA, 20 nt, Salmonella enterica enterica serovar Typhi Ty2
ccaggcggguagucccagga

SEQ ID NO: 3736665 - RNA, 20 nt, Salmonella enterica enterica serovar Typhi Ty2
ccaggcguaagaucccaggg

SEQ ID NO: 3736666 - RNA, 15 nt, Salmonella enterica enterica serovar Typhi Ty2
ccaggcguccaguug

SEQ ID NO: 3736667 - RNA, 17 nt, Salmonella enterica enterica serovar Typhi Ty2
ccaggcguuuaugagau

SEQ ID NO: 3736668 - RNA, 17 nt, Salmonella enterica enterica serovar Typhi Ty2
ccaggcuauccaacaga

SEQ ID NO: 3736669 - RNA, 14 nt, Salmonella enterica enterica serovar Typhi Ty2
ccaggcuauccagc

SEQ ID NO: 3736670 - RNA, 18 nt, Salmonella enterica enterica serovar Typhi Ty2
ccaggcuauccagcucac

SEQ ID NO: 3736671 - RNA, 15 nt, Salmonella enterica enterica serovar Typhi Ty2
ccaggcuucaucgga

SEQ ID NO: 3736672 - RNA, 21 nt, Salmonella enterica enterica serovar Typhi Ty2
ccaggcuuuaaauucagcacc

SEQ ID NO: 3736673 - RNA, 21 nt, Salmonella enterica enterica serovar Typhi Ty2
ccaggcuuuaguuuccgguaa

SEQ ID NO: 3736674 - RNA, 20 nt, Salmonella enterica enterica serovar Typhi Ty2
ccagggauugauggccagcc

SEQ ID NO: 3736675 - RNA, 13 nt, Salmonella enterica enterica serovar Typhi Ty2
ccagggcaggcag

SEQ ID NO: 3736676 - RNA, 19 nt, Salmonella enterica enterica serovar Typhi Ty2
ccagggcaggcagugaacu

SEQ ID NO: 3736677 - RNA, 14 nt, Salmonella enterica enterica serovar Typhi Ty2
ccagggcaucaaua

SEQ ID NO: 3736678 - RNA, 20 nt, Salmonella enterica enterica serovar Typhi Ty2
ccagggcaugauuaaagcca

SEQ ID NO: 3736679 - RNA, 20 nt, Salmonella enterica enterica serovar Typhi Ty2
ccagggcgggauccccugcu

SEQ ID NO: 3736680 - RNA, 18 nt, Salmonella enterica enterica serovar Typhi Ty2
ccagggcugcuggccuuc

SEQ ID NO: 3736681 - RNA, 18 nt, Salmonella enterica enterica serovar Typhi Ty2
ccagggggauccuuauuc

SEQ ID NO: 3736682 - RNA, 21 nt, Salmonella enterica enterica serovar Typhi Ty2
ccagggugcaaagaaacguuc

SEQ ID NO: 3736683 - RNA, 17 nt, Salmonella enterica enterica serovar Typhi Ty2
ccaggguucgcuggcca

SEQ ID NO: 3736684 - RNA, 21 nt, Salmonella enterica enterica serovar Typhi Ty2
ccaggguuuagccccagaccg

SEQ ID NO: 3736685 - RNA, 16 nt, Salmonella enterica enterica serovar Typhi Ty2
ccagguauacagacaa

SEQ ID NO: 3736686 - RNA, 16 nt, Salmonella enterica enterica serovar Typhi Ty2
ccaggucgcccagcca

SEQ ID NO: 3736687 - RNA, 23 nt, Salmonella enterica enterica serovar Typhi Ty2
ccaggucggcuuuuuuuuaugcc

SEQ ID NO: 3736688 - RNA, 16 nt, Salmonella enterica enterica serovar Typhi Ty2
ccaggucugcgcguuu

SEQ ID NO: 3736689 - RNA, 18 nt, Salmonella enterica enterica serovar Typhi Ty2
ccaggugacuuugcccuu

SEQ ID NO: 3736690 - RNA, 20 nt, Salmonella enterica enterica serovar Typhi Ty2
ccaggugacuuugcccuuuu

SEQ ID NO: 3736691 - RNA, 14 nt, Salmonella enterica enterica serovar Typhi Ty2
ccaggugccgaggu

SEQ ID NO: 3736692 - RNA, 21 nt, Salmonella enterica enterica serovar Typhi Ty2
ccaggugcguggcccgcacug

SEQ ID NO: 3736693 - RNA, 18 nt, Salmonella enterica enterica serovar Typhi Ty2
ccaggugucguuaaugcu

SEQ ID NO: 3736694 - RNA, 15 nt, Salmonella enterica enterica serovar Typhi Ty2
ccagguuaauccuua

SEQ ID NO: 3736695 - RNA, 15 nt, Salmonella enterica enterica serovar Typhi Ty2
ccagguuagcagcca

SEQ ID NO: 3736696 - RNA, 13 nt, Salmonella enterica enterica serovar Typhi Ty2
ccaguuuuuucca

SEQ ID NO: 3736697 - RNA, 12 nt, Salmonella enterica enterica serovar Typhi Ty2
ccauaaaaugau

SEQ ID NO: 3736698 - RNA, 13 nt, Salmonella enterica enterica serovar Typhi Ty2
ccauaaacaaaac

SEQ ID NO: 3736699 - RNA, 14 nt, Salmonella enterica enterica serovar Typhi Ty2
ccauaaaucauuac

SEQ ID NO: 3736700 - RNA, 12 nt, Salmonella enterica enterica serovar Typhi Ty2
ccauaaaugaaa

SEQ ID NO: 3736701 - RNA, 18 nt, Salmonella enterica enterica serovar Typhi Ty2
ccauaauaaugacuaauu

SEQ ID NO: 3736702 - RNA, 17 nt, Salmonella enterica enterica serovar Typhi Ty2
ccauaaucgauauaauu

SEQ ID NO: 3736703 - RNA, 17 nt, Salmonella enterica enterica serovar Typhi Ty2
ccauaaugauccacacc

SEQ ID NO: 3736704 - RNA, 21 nt, Salmonella enterica enterica serovar Typhi Ty2
ccauaaugaucguaugcagcc

SEQ ID NO: 3736705 - RNA, 23 nt, Salmonella enterica enterica serovar Typhi Ty2
ccauaauuaccggcacaccggcc

SEQ ID NO: 3736706 - RNA, 23 nt, Salmonella enterica enterica serovar Typhi Ty2
ccauaauuuauccuccgaacagg

SEQ ID NO: 3736707 - RNA, 22 nt, Salmonella enterica enterica serovar Typhi Ty2
ccauaauuugauauuuaaucgc

SEQ ID NO: 3736708 - RNA, 13 nt, Salmonella enterica enterica serovar Typhi Ty2
ccauaauuuuccc

SEQ ID NO: 3736709 - RNA, 18 nt, Salmonella enterica enterica serovar Typhi Ty2
ccauacagcccauaccac

SEQ ID NO: 3736710 - RNA, 21 nt, Salmonella enterica enterica serovar Typhi Ty2
ccauacauugaguaaauaaau

SEQ ID NO: 3736711 - RNA, 15 nt, Salmonella enterica enterica serovar Typhi Ty2
ccauacccggcuccc

SEQ ID NO: 3736712 - RNA, 19 nt, Salmonella enterica enterica serovar Typhi Ty2
ccauaccggacuccaggca

SEQ ID NO: 3736713 - RNA, 19 nt, Salmonella enterica enterica serovar Typhi Ty2
ccauaccuaaugcccgcuu

SEQ ID NO: 3736714 - RNA, 20 nt, Salmonella enterica enterica serovar Typhi Ty2
ccauaccuaaugcccgcuug

SEQ ID NO: 3736715 - RNA, 19 nt, Salmonella enterica enterica serovar Typhi Ty2
ccauacgcccacgcggcgu

SEQ ID NO: 3736716 - RNA, 19 nt, Salmonella enterica enterica serovar Typhi Ty2
ccauacguuuuuauuaucu

SEQ ID NO: 3736717 - RNA, 13 nt, Salmonella enterica enterica serovar Typhi Ty2
ccauacuuugcau

SEQ ID NO: 3736718 - RNA, 18 nt, Salmonella enterica enterica serovar Typhi Ty2
ccauagaaaucagcaggu

SEQ ID NO: 3736719 - RNA, 21 nt, Salmonella enterica enterica serovar Typhi Ty2
ccauagccaacacauaagcca

SEQ ID NO: 3736720 - RNA, 18 nt, Salmonella enterica enterica serovar Typhi Ty2
ccauagcccacuauuuuu

SEQ ID NO: 3736721 - RNA, 20 nt, Salmonella enterica enterica serovar Typhi Ty2
ccauagcgcuaugcgcucca

SEQ ID NO: 3736722 - RNA, 21 nt, Salmonella enterica enterica serovar Typhi Ty2
ccauagcguuuaaaaagcugc

SEQ ID NO: 3736723 - RNA, 23 nt, Salmonella enterica enterica serovar Typhi Ty2
ccauagcguuuaaaaagcugcau

SEQ ID NO: 3736724 - RNA, 14 nt, Salmonella enterica enterica serovar Typhi Ty2
ccauaggccagcgu

SEQ ID NO: 3736725 - RNA, 19 nt, Salmonella enterica enterica serovar Typhi Ty2
ccauauaacagaauaagcc

SEQ ID NO: 3736726 - RNA, 13 nt, Salmonella enterica enterica serovar Typhi Ty2
ccauauacucuuu

SEQ ID NO: 3736727 - RNA, 20 nt, Salmonella enterica enterica serovar Typhi Ty2
ccauauagacauacaggaau

SEQ ID NO: 3736728 - RNA, 13 nt, Salmonella enterica enterica serovar Typhi Ty2
ccauauaucugaa

SEQ ID NO: 3736729 - RNA, 14 nt, Salmonella enterica enterica serovar Typhi Ty2
ccauauaugaaauc

SEQ ID NO: 3736730 - RNA, 13 nt, Salmonella enterica enterica serovar Typhi Ty2
ccauaucaaucaa

SEQ ID NO: 3736731 - RNA, 14 nt, Salmonella enterica enterica serovar Typhi Ty2
ccauaucgccgcca

SEQ ID NO: 3736732 - RNA, 14 nt, Salmonella enterica enterica serovar Typhi Ty2
ccauauucacgcag

SEQ ID NO: 3736733 - RNA, 19 nt, Salmonella enterica enterica serovar Typhi Ty2
ccauauuguucaguuucaa

SEQ ID NO: 3736734 - RNA, 17 nt, Salmonella enterica enterica serovar Typhi Ty2
ccauauuuuuccagcgc

SEQ ID NO: 3736735 - RNA, 15 nt, Salmonella enterica enterica serovar Typhi Ty2
ccaucaaaaaaaaua

SEQ ID NO: 3736736 - RNA, 15 nt, Salmonella enterica enterica serovar Typhi Ty2
ccaucaacagcguga

SEQ ID NO: 3736737 - RNA, 17 nt, Salmonella enterica enterica serovar Typhi Ty2
ccaucaacaucaucgga

SEQ ID NO: 3736738 - RNA, 19 nt, Salmonella enterica enterica serovar Typhi Ty2
ccaucaacuucucgcaggc

SEQ ID NO: 3736739 - RNA, 19 nt, Salmonella enterica enterica serovar Typhi Ty2
ccaucaauaagcgaauugc

SEQ ID NO: 3736740 - RNA, 15 nt, Salmonella enterica enterica serovar Typhi Ty2
ccaucaaucaccuua

SEQ ID NO: 3736741 - RNA, 16 nt, Salmonella enterica enterica serovar Typhi Ty2
ccaucaauccaacgaa

SEQ ID NO: 3736742 - RNA, 21 nt, Salmonella enterica enterica serovar Typhi Ty2
ccaucaauccaacgaaacuca

SEQ ID NO: 3736743 - RNA, 18 nt, Salmonella enterica enterica serovar Typhi Ty2
ccaucacuuccauccaug

SEQ ID NO: 3736744 - RNA, 21 nt, Salmonella enterica enterica serovar Typhi Ty2
ccaucagaaugcuggucacgg

SEQ ID NO: 3736745 - RNA, 13 nt, Salmonella enterica enterica serovar Typhi Ty2
ccaucagcaaaau

SEQ ID NO: 3736746 - RNA, 13 nt, Salmonella enterica enterica serovar Typhi Ty2
ccaucagcaccuu

SEQ ID NO: 3736747 - RNA, 23 nt, Salmonella enterica enterica serovar Typhi Ty2
ccaucagccgcgcuaucaaaaug

SEQ ID NO: 3736748 - RNA, 13 nt, Salmonella enterica enterica serovar Typhi Ty2
ccaucagcgccag

SEQ ID NO: 3736749 - RNA, 17 nt, Salmonella enterica enterica serovar Typhi Ty2
ccaucagcgccagcccu

SEQ ID NO: 3736750 - RNA, 21 nt, Salmonella enterica enterica serovar Typhi Ty2
ccaucagcgcgggauaacgca

SEQ ID NO: 3736751 - RNA, 16 nt, Salmonella enterica enterica serovar Typhi Ty2
ccaucaggcaauaugu

SEQ ID NO: 3736752 - RNA, 16 nt, Salmonella enterica enterica serovar Typhi Ty2
ccaucaggcacaaugc

SEQ ID NO: 3736753 - RNA, 15 nt, Salmonella enterica enterica serovar Typhi Ty2
ccaucaggcauaaac

SEQ ID NO: 3736754 - RNA, 21 nt, Salmonella enterica enterica serovar Typhi Ty2
ccaucaggcaucugaaaugcu

SEQ ID NO: 3736755 - RNA, 18 nt, Salmonella enterica enterica serovar Typhi Ty2
ccaucaggcuuugcgcca

SEQ ID NO: 3736756 - RNA, 15 nt, Salmonella enterica enterica serovar Typhi Ty2
ccaucagggaaaaau

SEQ ID NO: 3736757 - RNA, 18 nt, Salmonella enterica enterica serovar Typhi Ty2
ccaucaguccccagcgua

SEQ ID NO: 3736758 - RNA, 13 nt, Salmonella enterica enterica serovar Typhi Ty2
ccaucauaaagcc

SEQ ID NO: 3736759 - RNA, 14 nt, Salmonella enterica enterica serovar Typhi Ty2
ccaucauagcccau

SEQ ID NO: 3736760 - RNA, 15 nt, Salmonella enterica enterica serovar Typhi Ty2
ccaucauagcccaua

SEQ ID NO: 3736761 - RNA, 23 nt, Salmonella enterica enterica serovar Typhi Ty2
ccaucaucaucggcacagccagu

SEQ ID NO: 3736762 - RNA, 17 nt, Salmonella enterica enterica serovar Typhi Ty2
ccaucaugcccacaggc

SEQ ID NO: 3736763 - RNA, 15 nt, Salmonella enterica enterica serovar Typhi Ty2
ccaucaugcgccagg

SEQ ID NO: 3736764 - RNA, 16 nt, Salmonella enterica enterica serovar Typhi Ty2
ccaucauggcuuucag

SEQ ID NO: 3736765 - RNA, 22 nt, Salmonella enterica enterica serovar Typhi Ty2
ccaucauggcuuucagauuagc

SEQ ID NO: 3736766 - RNA, 21 nt, Salmonella enterica enterica serovar Typhi Ty2
ccaucauguugaaauauuuga

SEQ ID NO: 3736767 - RNA, 13 nt, Salmonella enterica enterica serovar Typhi Ty2
ccaucauuaccaa

SEQ ID NO: 3736768 - RNA, 15 nt, Salmonella enterica enterica serovar Typhi Ty2
ccaucauucaacgca

SEQ ID NO: 3736769 - RNA, 13 nt, Salmonella enterica enterica serovar Typhi Ty2
ccauccaccagaa

SEQ ID NO: 3736770 - RNA, 19 nt, Salmonella enterica enterica serovar Typhi Ty2
ccauccagacaugcacaug

SEQ ID NO: 3736771 - RNA, 21 nt, Salmonella enterica enterica serovar Typhi Ty2
ccauccauauugagcgguagc

SEQ ID NO: 3736772 - RNA, 17 nt, Salmonella enterica enterica serovar Typhi Ty2
ccaucccagguuauuca

SEQ ID NO: 3736773 - RNA, 22 nt, Salmonella enterica enterica serovar Typhi Ty2
ccaucccagguuauucaggugg

SEQ ID NO: 3736774 - RNA, 13 nt, Salmonella enterica enterica serovar Typhi Ty2
ccaucccggcgua

SEQ ID NO: 3736775 - RNA, 15 nt, Salmonella enterica enterica serovar Typhi Ty2
ccauccggcaaaauu

SEQ ID NO: 3736776 - RNA, 18 nt, Salmonella enterica enterica serovar Typhi Ty2
ccauccggcaauuaaccg

SEQ ID NO: 3736777 - RNA, 23 nt, Salmonella enterica enterica serovar Typhi Ty2
ccauccggcacggucaaucauca

SEQ ID NO: 3736778 - RNA, 17 nt, Salmonella enterica enterica serovar Typhi Ty2
ccauucccgauaaugac

SEQ ID NO: 3736779 - RNA, 20 nt, Salmonella enterica enterica serovar Typhi Ty2
ccauucccgauaaugaccga

SEQ ID NO: 3736780 - RNA, 15 nt, Salmonella enterica enterica serovar Typhi Ty2
ccauucccgccgcaa

SEQ ID NO: 3736781 - RNA, 14 nt, Salmonella enterica enterica serovar Typhi Ty2
ccauucccguaaaa

SEQ ID NO: 3736782 - RNA, 18 nt, Salmonella enterica enterica serovar Typhi Ty2
ccauucccguaaaagaag

SEQ ID NO: 3736783 - RNA, 15 nt, Salmonella enterica enterica serovar Typhi Ty2
ccauucgcccaguca

SEQ ID NO: 3736784 - RNA, 13 nt, Salmonella enterica enterica serovar Typhi Ty2
ccauucuucaaca

SEQ ID NO: 3736785 - RNA, 13 nt, Salmonella enterica enterica serovar Typhi Ty2
ccauugccagaua

SEQ ID NO: 3736786 - RNA, 20 nt, Salmonella enterica enterica serovar Typhi Ty2
ccauugccgcgacaaaaagc

SEQ ID NO: 3736787 - RNA, 14 nt, Salmonella enterica enterica serovar Typhi Ty2
ccauugcguauuuc

SEQ ID NO: 3736788 - RNA, 16 nt, Salmonella enterica enterica serovar Typhi Ty2
ccauugcuaggaacag

SEQ ID NO: 3736789 - RNA, 20 nt, Salmonella enterica enterica serovar Typhi Ty2
ccauugcuaggaacagugac

SEQ ID NO: 3736790 - RNA, 18 nt, Salmonella enterica enterica serovar Typhi Ty2
ccauugcugaggaucacc

SEQ ID NO: 3736791 - RNA, 16 nt, Salmonella enterica enterica serovar Typhi Ty2
ccauugcugucgacaa

SEQ ID NO: 3736792 - RNA, 16 nt, Salmonella enterica enterica serovar Typhi Ty2
ccauugcuuuuuugau

SEQ ID NO: 3736793 - RNA, 14 nt, Salmonella enterica enterica serovar Typhi Ty2
ccauuggccagaua

SEQ ID NO: 3736794 - RNA, 21 nt, Salmonella enterica enterica serovar Typhi Ty2
ccauuggcuauuuuuugcugg

SEQ ID NO: 3736795 - RNA, 21 nt, Salmonella enterica enterica serovar Typhi Ty2
ccauugggggguuagugcugu

SEQ ID NO: 3736796 - RNA, 22 nt, Salmonella enterica enterica serovar Typhi Ty2
ccauuuauguuugcccagcuca

SEQ ID NO: 3736797 - RNA, 18 nt, Salmonella enterica enterica serovar Typhi Ty2
ccauuuccggcgcgccua

SEQ ID NO: 3736798 - RNA, 21 nt, Salmonella enterica enterica serovar Typhi Ty2
ccauuucgccuauuuucucuu

SEQ ID NO: 3736799 - RNA, 16 nt, Salmonella enterica enterica serovar Typhi Ty2
ccauuuggcuuaaaua

SEQ ID NO: 3736800 - RNA, 15 nt, Salmonella enterica enterica serovar Typhi Ty2
ccauuuuaaauacac

SEQ ID NO: 3736801 - RNA, 23 nt, Salmonella enterica enterica serovar Typhi Ty2
ccauuuuagggccgggcagugcu

SEQ ID NO: 3736802 - RNA, 23 nt, Salmonella enterica enterica serovar Typhi Ty2
ccauuuuccuauggacauuggcc

SEQ ID NO: 3736803 - RNA, 23 nt, Salmonella enterica enterica serovar Typhi Ty2
ccauuuuggacuugggcagugcu

SEQ ID NO: 3736804 - RNA, 11 nt, Salmonella enterica enterica serovar Typhi Ty2
ccauuuuucag

SEQ ID NO: 3736805 - RNA, 22 nt, Salmonella enterica enterica serovar Typhi Ty2
ccauuuuuuuguccgucauuua

SEQ ID NO: 3736806 - RNA, 12 nt, Salmonella enterica enterica serovar Typhi Ty2
cccaaaagguag

SEQ ID NO: 3736807 - RNA, 19 nt, Salmonella enterica enterica serovar Typhi Ty2
cccaaacgucguaaaaccu

SEQ ID NO: 3736808 - RNA, 23 nt, Salmonella enterica enterica serovar Typhi Ty2
cccaaaggaaagguccggcccgc

SEQ ID NO: 3736809 - RNA, 18 nt, Salmonella enterica enterica serovar Typhi Ty2
cccaaauaaaagccgccg

SEQ ID NO: 3736810 - RNA, 20 nt, Salmonella enterica enterica serovar Typhi Ty2
cccaaauuaauuuauugacg

SEQ ID NO: 3736811 - RNA, 16 nt, Salmonella enterica enterica serovar Typhi Ty2
cccaacaucaguucag

SEQ ID NO: 3736812 - RNA, 15 nt, Salmonella enterica enterica serovar Typhi Ty2
cccaacaugguugcu

SEQ ID NO: 3736813 - RNA, 12 nt, Salmonella enterica enterica serovar Typhi Ty2
cccaaccagccc

SEQ ID NO: 3736814 - RNA, 12 nt, Salmonella enterica enterica serovar Typhi Ty2
cccaaccagugg

SEQ ID NO: 3736815 - RNA, 17 nt, Salmonella enterica enterica serovar Typhi Ty2
cccaaccgaaacguaug

SEQ ID NO: 3736816 - RNA, 16 nt, Salmonella enterica enterica serovar Typhi Ty2
cccaaccgagcagcuu

SEQ ID NO: 3736817 - RNA, 23 nt, Salmonella enterica enterica serovar Typhi Ty2
cccaaccgccagccauugaugca

SEQ ID NO: 3736818 - RNA, 17 nt, Salmonella enterica enterica serovar Typhi Ty2
cccaacgacagcacuac

SEQ ID NO: 3736819 - RNA, 15 nt, Salmonella enterica enterica serovar Typhi Ty2
cccaacgaccauaaa

SEQ ID NO: 3736820 - RNA, 20 nt, Salmonella enterica enterica serovar Typhi Ty2
cccaacggaugcgccauccc

SEQ ID NO: 3736821 - RNA, 15 nt, Salmonella enterica enterica serovar Typhi Ty2
cccaacugagcgcca

SEQ ID NO: 3736822 - RNA, 14 nt, Salmonella enterica enterica serovar Typhi Ty2
cccaagaacaugac

SEQ ID NO: 3736823 - RNA, 22 nt, Salmonella enterica enterica serovar Typhi Ty2
cccaaucuugcguaccacguua

SEQ ID NO: 3736824 - RNA, 15 nt, Salmonella enterica enterica serovar Typhi Ty2
cccaaugcccccauc

SEQ ID NO: 3736825 - RNA, 15 nt, Salmonella enterica enterica serovar Typhi Ty2
cccacaaccgacgca

SEQ ID NO: 3736826 - RNA, 18 nt, Salmonella enterica enterica serovar Typhi Ty2
cccacaaucccgccagac

SEQ ID NO: 3736827 - RNA, 14 nt, Salmonella enterica enterica serovar Typhi Ty2
cccacacaucacaa

SEQ ID NO: 3736828 - RNA, 14 nt, Salmonella enterica enterica serovar Typhi Ty2
cccacaccacagcc

SEQ ID NO: 3736829 - RNA, 18 nt, Salmonella enterica enterica serovar Typhi Ty2
cccacagucgucuggcgc

SEQ ID NO: 3736830 - RNA, 15 nt, Salmonella enterica enterica serovar Typhi Ty2
cccacaucaccugug

SEQ ID NO: 3736831 - RNA, 15 nt, Salmonella enterica enterica serovar Typhi Ty2
cccaccaccgccacu

SEQ ID NO: 3736832 - RNA, 15 nt, Salmonella enterica enterica serovar Typhi Ty2
cccaccacgcagcca

SEQ ID NO: 3736833 - RNA, 15 nt, Salmonella enterica enterica serovar Typhi Ty2
cccaccagcgccagg

SEQ ID NO: 3736834 - RNA, 20 nt, Salmonella enterica enterica serovar Typhi Ty2
cccaccauaaagcgaauaau

SEQ ID NO: 3736835 - RNA, 13 nt, Salmonella enterica enterica serovar Typhi Ty2
cccaccgacacaa

SEQ ID NO: 3736836 - RNA, 17 nt, Salmonella enterica enterica serovar Typhi Ty2
cccaccgccaaccgccc

SEQ ID NO: 3736837 - RNA, 17 nt, Salmonella enterica enterica serovar Typhi Ty2
cccacgauacgccccug

SEQ ID NO: 3736838 - RNA, 21 nt, Salmonella enterica enterica serovar Typhi Ty2
cccacgauacgccccugcugg

SEQ ID NO: 3736839 - RNA, 18 nt, Salmonella enterica enterica serovar Typhi Ty2
cccacgcauaguccugcc

SEQ ID NO: 3736840 - RNA, 23 nt, Salmonella enterica enterica serovar Typhi Ty2
cccacgccagcagcucgccgacc

SEQ ID NO: 3736841 - RNA, 24 nt, Salmonella enterica enterica serovar Typhi Ty2
cccacgccagcagcucgccgaccg

SEQ ID NO: 3736842 - RNA, 14 nt, Salmonella enterica enterica serovar Typhi Ty2
cccacgcccgccau

SEQ ID NO: 3736843 - RNA, 15 nt, Salmonella enterica enterica serovar Typhi Ty2
cccacgcccgccauc

SEQ ID NO: 3736844 - RNA, 19 nt, Salmonella enterica enterica serovar Typhi Ty2
cccacggagaaaagcgaaa

SEQ ID NO: 3736845 - RNA, 19 nt, Salmonella enterica enterica serovar Typhi Ty2
cccacggaugaucuucaua

SEQ ID NO: 3736846 - RNA, 13 nt, Salmonella enterica enterica serovar Typhi Ty2
cccacuaacugcc

SEQ ID NO: 3736847 - RNA, 15 nt, Salmonella enterica enterica serovar Typhi Ty2
cccacuauuuuucau

SEQ ID NO: 3736848 - RNA, 15 nt, Salmonella enterica enterica serovar Typhi Ty2
cccacugauaaaauu

SEQ ID NO: 3736849 - RNA, 13 nt, Salmonella enterica enterica serovar Typhi Ty2
cccacuguucaau

SEQ ID NO: 3736850 - RNA, 16 nt, Salmonella enterica enterica serovar Typhi Ty2
cccacuucgccgguuc

SEQ ID NO: 3736851 - RNA, 18 nt, Salmonella enterica enterica serovar Typhi Ty2
cccacuuguagcgagcgc

SEQ ID NO: 3736852 - RNA, 16 nt, Salmonella enterica enterica serovar Typhi Ty2
cccacuuucagcuccg

SEQ ID NO: 3736853 - RNA, 19 nt, Salmonella enterica enterica serovar Typhi Ty2
cccagaaaauuaacgacaa

SEQ ID NO: 3736854 - RNA, 15 nt, Salmonella enterica enterica serovar Typhi Ty2
cccagaaagaucagc

SEQ ID NO: 3736855 - RNA, 13 nt, Salmonella enterica enterica serovar Typhi Ty2
cccagaaucaccc

SEQ ID NO: 3736856 - RNA, 14 nt, Salmonella enterica enterica serovar Typhi Ty2
cccagaaucacccc

SEQ ID NO: 3736857 - RNA, 18 nt, Salmonella enterica enterica serovar Typhi Ty2
cccagaaucccgccuugc

SEQ ID NO: 3736858 - RNA, 15 nt, Salmonella enterica enterica serovar Typhi Ty2
cccagaauccgcgca

SEQ ID NO: 3736859 - RNA, 16 nt, Salmonella enterica enterica serovar Typhi Ty2
cccagaauccgcgcau

SEQ ID NO: 3736860 - RNA, 20 nt, Salmonella enterica enterica serovar Typhi Ty2
cccaugcgggauggccgccg

SEQ ID NO: 3736861 - RNA, 21 nt, Salmonella enterica enterica serovar Typhi Ty2
cccaugcgggauggccgccga

SEQ ID NO: 3736862 - RNA, 15 nt, Salmonella enterica enterica serovar Typhi Ty2
cccauggccccaugu

SEQ ID NO: 3736863 - RNA, 22 nt, Salmonella enterica enterica serovar Typhi Ty2
cccauguucaugaaccacgcca

SEQ ID NO: 3736864 - RNA, 20 nt, Salmonella enterica enterica serovar Typhi Ty2
cccauguugagcgcuugcug

SEQ ID NO: 3736865 - RNA, 14 nt, Salmonella enterica enterica serovar Typhi Ty2
cccauguugcgccg

SEQ ID NO: 3736866 - RNA, 14 nt, Salmonella enterica enterica serovar Typhi Ty2
cccauuaaacuggc

SEQ ID NO: 3736867 - RNA, 15 nt, Salmonella enterica enterica serovar Typhi Ty2
cccauuaauaucagc

SEQ ID NO: 3736868 - RNA, 17 nt, Salmonella enterica enterica serovar Typhi Ty2
cccauuaauaucagccc

SEQ ID NO: 3736869 - RNA, 13 nt, Salmonella enterica enterica serovar Typhi Ty2
cccauuauugauc

SEQ ID NO: 3736870 - RNA, 16 nt, Salmonella enterica enterica serovar Typhi Ty2
cccauuccgccugccg

SEQ ID NO: 3736871 - RNA, 15 nt, Salmonella enterica enterica serovar Typhi Ty2
cccauucugcugaug

SEQ ID NO: 3736872 - RNA, 19 nt, Salmonella enterica enterica serovar Typhi Ty2
cccauugaaaucgccucau

SEQ ID NO: 3736873 - RNA, 15 nt, Salmonella enterica enterica serovar Typhi Ty2
cccauugucaucagu

SEQ ID NO: 3736874 - RNA, 21 nt, Salmonella enterica enterica serovar Typhi Ty2
cccauugucaucaguaugagc

SEQ ID NO: 3736875 - RNA, 23 nt, Salmonella enterica enterica serovar Typhi Ty2
cccauuguucuuucauuuuaccu

SEQ ID NO: 3736876 - RNA, 22 nt, Salmonella enterica enterica serovar Typhi Ty2
cccauuugcggguggugugcgu

SEQ ID NO: 3736877 - RNA, 13 nt, Salmonella enterica enterica serovar Typhi Ty2
cccauuuuauccu

SEQ ID NO: 3736878 - RNA, 19 nt, Salmonella enterica enterica serovar Typhi Ty2
cccauuuuauccucuucaa

SEQ ID NO: 3736879 - RNA, 13 nt, Salmonella enterica enterica serovar Typhi Ty2
cccauuuuccgcu

SEQ ID NO: 3736880 - RNA, 15 nt, Salmonella enterica enterica serovar Typhi Ty2
ccccaaacgcucaua

SEQ ID NO: 3736881 - RNA, 22 nt, Salmonella enterica enterica serovar Typhi Ty2
ccccaacgcgcuaucguugcgc

SEQ ID NO: 3736882 - RNA, 17 nt, Salmonella enterica enterica serovar Typhi Ty2
ccccaaucuugcguacc

SEQ ID NO: 3736883 - RNA, 16 nt, Salmonella enterica enterica serovar Typhi Ty2
ccccaaugauccacag

SEQ ID NO: 3736884 - RNA, 17 nt, Salmonella enterica enterica serovar Typhi Ty2
ccccaauugcugcuauu

SEQ ID NO: 3736885 - RNA, 16 nt, Salmonella enterica enterica serovar Typhi Ty2
ccccaccgacacaaau

SEQ ID NO: 3736886 - RNA, 13 nt, Salmonella enterica enterica serovar Typhi Ty2
ccccaccgccaga

SEQ ID NO: 3736887 - RNA, 23 nt, Salmonella enterica enterica serovar Typhi Ty2
ccccacgauacgccccugcuggc

SEQ ID NO: 3736888 - RNA, 13 nt, Salmonella enterica enterica serovar Typhi Ty2
ccccacgcccgcc

SEQ ID NO: 3736889 - RNA, 12 nt, Salmonella enterica enterica serovar Typhi Ty2
ccccagaaaauu

SEQ ID NO: 3736890 - RNA, 20 nt, Salmonella enterica enterica serovar Typhi Ty2
ccccagaugccguagccaag

SEQ ID NO: 3736891 - RNA, 12 nt, Salmonella enterica enterica serovar Typhi Ty2
ccccagccagag

SEQ ID NO: 3736892 - RNA, 17 nt, Salmonella enterica enterica serovar Typhi Ty2
ccccagcguaccacgcc

SEQ ID NO: 3736893 - RNA, 13 nt, Salmonella enterica enterica serovar Typhi Ty2
ccccagcugcggc

SEQ ID NO: 3736894 - RNA, 15 nt, Salmonella enterica enterica serovar Typhi Ty2
ccccaggccgguugu

SEQ ID NO: 3736895 - RNA, 13 nt, Salmonella enterica enterica serovar Typhi Ty2
ccccagucuuccu

SEQ ID NO: 3736896 - RNA, 17 nt, Salmonella enterica enterica serovar Typhi Ty2
ccccaguugguuguagc

SEQ ID NO: 3736897 - RNA, 15 nt, Salmonella enterica enterica serovar Typhi Ty2
ccccauacaguaguu

SEQ ID NO: 3736898 - RNA, 12 nt, Salmonella enterica enterica serovar Typhi Ty2
ccccauacgcgc

SEQ ID NO: 3736899 - RNA, 19 nt, Salmonella enterica enterica serovar Typhi Ty2
ccccauauugaucgggauu

SEQ ID NO: 3736900 - RNA, 18 nt, Salmonella enterica enterica serovar Typhi Ty2
ccccaucaugcgccaggu

SEQ ID NO: 3736901 - RNA, 13 nt, Salmonella enterica enterica serovar Typhi Ty2
ccccaucccagac

SEQ ID NO: 3736902 - RNA, 13 nt, Salmonella enterica enterica serovar Typhi Ty2
ccccaucuccaga

SEQ ID NO: 3736903 - RNA, 14 nt, Salmonella enterica enterica serovar Typhi Ty2
ccccauuaaacugg

SEQ ID NO: 3736904 - RNA, 14 nt, Salmonella enterica enterica serovar Typhi Ty2
ccccauucugcuga

SEQ ID NO: 3736905 - RNA, 20 nt, Salmonella enterica enterica serovar Typhi Ty2
cccccagaaugccgcccauc

SEQ ID NO: 3736906 - RNA, 19 nt, Salmonella enterica enterica serovar Typhi Ty2
ccccccgcacagcacauag

SEQ ID NO: 3736907 - RNA, 13 nt, Salmonella enterica enterica serovar Typhi Ty2
ccccccuaccgga

SEQ ID NO: 3736908 - RNA, 21 nt, Salmonella enterica enterica serovar Typhi Ty2
cccccgcacagcacauagaag

SEQ ID NO: 3736909 - RNA, 13 nt, Salmonella enterica enterica serovar Typhi Ty2
cccccucggcagc

SEQ ID NO: 3736910 - RNA, 15 nt, Salmonella enterica enterica serovar Typhi Ty2
cccccuuugacaacc

SEQ ID NO: 3736911 - RNA, 14 nt, Salmonella enterica enterica serovar Typhi Ty2
ccccgaaagccggu

SEQ ID NO: 3736912 - RNA, 22 nt, Salmonella enterica enterica serovar Typhi Ty2
ccccgacaaaaccguucugagc

SEQ ID NO: 3736913 - RNA, 17 nt, Salmonella enterica enterica serovar Typhi Ty2
ccccgacauucccaguc

SEQ ID NO: 3736914 - RNA, 19 nt, Salmonella enterica enterica serovar Typhi Ty2
ccccgaguaacaccgcggc

SEQ ID NO: 3736915 - RNA, 20 nt, Salmonella enterica enterica serovar Typhi Ty2
ccccgaugucgccacgccgc

SEQ ID NO: 3736916 - RNA, 22 nt, Salmonella enterica enterica serovar Typhi Ty2
ccccgaugucgccacgccgccc

SEQ ID NO: 3736917 - RNA, 15 nt, Salmonella enterica enterica serovar Typhi Ty2
ccccgcaacggcgcu

SEQ ID NO: 3736918 - RNA, 16 nt, Salmonella enterica enterica serovar Typhi Ty2
ccccgcaauugcgcgg

SEQ ID NO: 3736919 - RNA, 15 nt, Salmonella enterica enterica serovar Typhi Ty2
ccccgccaccgccgc

SEQ ID NO: 3736920 - RNA, 16 nt, Salmonella enterica enterica serovar Typhi Ty2
ccccgccaccgccgcu

SEQ ID NO: 3736921 - RNA, 20 nt, Salmonella enterica enterica serovar Typhi Ty2
ccccgccauaaugcacaaua

SEQ ID NO: 3736922 - RNA, 12 nt, Salmonella enterica enterica serovar Typhi Ty2
ccccgccgccau

SEQ ID NO: 3736923 - RNA, 14 nt, Salmonella enterica enterica serovar Typhi Ty2
ccccgcuggcgcgg

SEQ ID NO: 3736924 - RNA, 11 nt, Salmonella enterica enterica serovar Typhi Ty2
ccccggccucg

SEQ ID NO: 3736925 - RNA, 20 nt, Salmonella enterica enterica serovar Typhi Ty2
ccccggcgagugccugcugg

SEQ ID NO: 3736926 - RNA, 23 nt, Salmonella enterica enterica serovar Typhi Ty2
ccccggcgggguuuuuuuaugcg

SEQ ID NO: 3736927 - RNA, 13 nt, Salmonella enterica enterica serovar Typhi Ty2
ccccggcuuccag

SEQ ID NO: 3736928 - RNA, 13 nt, Salmonella enterica enterica serovar Typhi Ty2
ccccggcuugcgg

SEQ ID NO: 3736929 - RNA, 20 nt, Salmonella enterica enterica serovar Typhi Ty2
ccccggcuuuaugaugguga

SEQ ID NO: 3736930 - RNA, 17 nt, Salmonella enterica enterica serovar Typhi Ty2
ccccggcuuuauuacuu

SEQ ID NO: 3736931 - RNA, 22 nt, Salmonella enterica enterica serovar Typhi Ty2
ccccgggcgaccacccgcgacc

SEQ ID NO: 3736932 - RNA, 22 nt, Salmonella enterica enterica serovar Typhi Ty2
ccccggucaacgcgccgccaac

SEQ ID NO: 3736933 - RNA, 16 nt, Salmonella enterica enterica serovar Typhi Ty2
ccccggugagcgccgc

SEQ ID NO: 3736934 - RNA, 20 nt, Salmonella enterica enterica serovar Typhi Ty2
ccccggugcuuucuccugcg

SEQ ID NO: 3736935 - RNA, 12 nt, Salmonella enterica enterica serovar Typhi Ty2
ccccgucagucg

SEQ ID NO: 3736936 - RNA, 14 nt, Salmonella enterica enterica serovar Typhi Ty2
ccccgucauauuac

SEQ ID NO: 3736937 - RNA, 14 nt, Salmonella enterica enterica serovar Typhi Ty2
ccccguucgacaac

SEQ ID NO: 3736938 - RNA, 20 nt, Salmonella enterica enterica serovar Typhi Ty2
ccccguugagaauggcggga

SEQ ID NO: 3736939 - RNA, 18 nt, Salmonella enterica enterica serovar Typhi Ty2
ccccguugcucauguuau

SEQ ID NO: 3736940 - RNA, 16 nt, Salmonella enterica enterica serovar Typhi Ty2
ccccguuuuccacgcg

SEQ ID NO: 3736941 - RNA, 16 nt, Salmonella enterica enterica serovar Typhi Ty2
ccccuaccgaggcagg

SEQ ID NO: 3736942 - RNA, 14 nt, Salmonella enterica enterica serovar Typhi Ty2
ccccuaucuggugc

SEQ ID NO: 3736943 - RNA, 22 nt, Salmonella enterica enterica serovar Typhi Ty2
cccggcagcuuuaaucuaccag

SEQ ID NO: 3736944 - RNA, 13 nt, Salmonella enterica enterica serovar Typhi Ty2
cccggcaggcugg

SEQ ID NO: 3736945 - RNA, 12 nt, Salmonella enterica enterica serovar Typhi Ty2
cccggcccgccg

SEQ ID NO: 3736946 - RNA, 21 nt, Salmonella enterica enterica serovar Typhi Ty2
cccggccguuaccguggcggc

SEQ ID NO: 3736947 - RNA, 15 nt, Salmonella enterica enterica serovar Typhi Ty2
cccggcgaccgguga

SEQ ID NO: 3736948 - RNA, 15 nt, Salmonella enterica enterica serovar Typhi Ty2
cccggcgagugccug

SEQ ID NO: 3736949 - RNA, 22 nt, Salmonella enterica enterica serovar Typhi Ty2
cccggcgcacuuccucucccac

SEQ ID NO: 3736950 - RNA, 12 nt, Salmonella enterica enterica serovar Typhi Ty2
cccggcgcgcca

SEQ ID NO: 3736951 - RNA, 21 nt, Salmonella enterica enterica serovar Typhi Ty2
cccggcggcgcgaugccugcc

SEQ ID NO: 3736952 - RNA, 21 nt, Salmonella enterica enterica serovar Typhi Ty2
cccggcggguauggcaaugcc

SEQ ID NO: 3736953 - RNA, 15 nt, Salmonella enterica enterica serovar Typhi Ty2
cccggcguagcgcgc

SEQ ID NO: 3736954 - RNA, 17 nt, Salmonella enterica enterica serovar Typhi Ty2
cccggcucauuaccgac

SEQ ID NO: 3736955 - RNA, 22 nt, Salmonella enterica enterica serovar Typhi Ty2
cccggcugccauuaucaccauu

SEQ ID NO: 3736956 - RNA, 17 nt, Salmonella enterica enterica serovar Typhi Ty2
cccggcuuaaauuuuua

SEQ ID NO: 3736957 - RNA, 19 nt, Salmonella enterica enterica serovar Typhi Ty2
cccggcuuuaugaugguga

SEQ ID NO: 3736958 - RNA, 20 nt, Salmonella enterica enterica serovar Typhi Ty2
cccggcuuuuugccgggcgu

SEQ ID NO: 3736959 - RNA, 17 nt, Salmonella enterica enterica serovar Typhi Ty2
cccggguaaugcugcag

SEQ ID NO: 3736960 - RNA, 14 nt, Salmonella enterica enterica serovar Typhi Ty2
cccgggugcgcagc

SEQ ID NO: 3736961 - RNA, 15 nt, Salmonella enterica enterica serovar Typhi Ty2
cccgguaaacgucga

SEQ ID NO: 3736962 - RNA, 18 nt, Salmonella enterica enterica serovar Typhi Ty2
cccgguacacuucagcca

SEQ ID NO: 3736963 - RNA, 17 nt, Salmonella enterica enterica serovar Typhi Ty2
cccgguagccacaccca

SEQ ID NO: 3736964 - RNA, 16 nt, Salmonella enterica enterica serovar Typhi Ty2
cccggucauccagcgg

SEQ ID NO: 3736965 - RNA, 14 nt, Salmonella enterica enterica serovar Typhi Ty2
cccggucgcgccag

SEQ ID NO: 3736966 - RNA, 13 nt, Salmonella enterica enterica serovar Typhi Ty2
cccggugcucaau

SEQ ID NO: 3736967 - RNA, 18 nt, Salmonella enterica enterica serovar Typhi Ty2
cccgguggcgccacgcca

SEQ ID NO: 3736968 - RNA, 21 nt, Salmonella enterica enterica serovar Typhi Ty2
cccgguggcgccacgccaccg

SEQ ID NO: 3736969 - RNA, 17 nt, Salmonella enterica enterica serovar Typhi Ty2
cccgguggcgcugcgcu

SEQ ID NO: 3736970 - RNA, 13 nt, Salmonella enterica enterica serovar Typhi Ty2
cccgguuuaccau

SEQ ID NO: 3736971 - RNA, 18 nt, Salmonella enterica enterica serovar Typhi Ty2
cccguaaugcccaggcgg

SEQ ID NO: 3736972 - RNA, 16 nt, Salmonella enterica enterica serovar Typhi Ty2
cccguaucacugauau

SEQ ID NO: 3736973 - RNA, 21 nt, Salmonella enterica enterica serovar Typhi Ty2
cccgucaucuucuaccuggaa

SEQ ID NO: 3736974 - RNA, 23 nt, Salmonella enterica enterica serovar Typhi Ty2
cccgucaugcuucaccucagcaa

SEQ ID NO: 3736975 - RNA, 20 nt, Salmonella enterica enterica serovar Typhi Ty2
cccgucgccuguuucugcgc

SEQ ID NO: 3736976 - RNA, 18 nt, Salmonella enterica enterica serovar Typhi Ty2
cccgucgcgcccacgcgc

SEQ ID NO: 3736977 - RNA, 14 nt, Salmonella enterica enterica serovar Typhi Ty2
cccgucucuuuauc

SEQ ID NO: 3736978 - RNA, 22 nt, Salmonella enterica enterica serovar Typhi Ty2
cccgucugggagccgcugcuca

SEQ ID NO: 3736979 - RNA, 19 nt, Salmonella enterica enterica serovar Typhi Ty2
cccgugcgcgucgccugaa

SEQ ID NO: 3736980 - RNA, 14 nt, Salmonella enterica enterica serovar Typhi Ty2
cccguuaaauacca

SEQ ID NO: 3736981 - RNA, 18 nt, Salmonella enterica enterica serovar Typhi Ty2
cccguuccucguccugau

SEQ ID NO: 3736982 - RNA, 16 nt, Salmonella enterica enterica serovar Typhi Ty2
cccguuucagccccuu

SEQ ID NO: 3736983 - RNA, 20 nt, Salmonella enterica enterica serovar Typhi Ty2
cccguuucagccccuugcug

SEQ ID NO: 3736984 - RNA, 21 nt, Salmonella enterica enterica serovar Typhi Ty2
cccguuucagccccuugcuga

SEQ ID NO: 3736985 - RNA, 15 nt, Salmonella enterica enterica serovar Typhi Ty2
cccguuuuuuccagc

SEQ ID NO: 3736986 - RNA, 15 nt, Salmonella enterica enterica serovar Typhi Ty2
cccuacugcuuagcu

SEQ ID NO: 3736987 - RNA, 11 nt, Salmonella enterica enterica serovar Typhi Ty2
cccuauccgcg

SEQ ID NO: 3736988 - RNA, 15 nt, Salmonella enterica enterica serovar Typhi Ty2
cccuauuagcacgcc

SEQ ID NO: 3736989 - RNA, 14 nt, Salmonella enterica enterica serovar Typhi Ty2
cccuauuguuccag

SEQ ID NO: 3736990 - RNA, 22 nt, Salmonella enterica enterica serovar Typhi Ty2
cccucaaacaggcugucugcca

SEQ ID NO: 3736991 - RNA, 20 nt, Salmonella enterica enterica serovar Typhi Ty2
cccucaacgcccugcuccca

SEQ ID NO: 3736992 - RNA, 21 nt, Salmonella enterica enterica serovar Typhi Ty2
cccucaacgcccugcucccac

SEQ ID NO: 3736993 - RNA, 22 nt, Salmonella enterica enterica serovar Typhi Ty2
cccucaacgcccugcucccaca

SEQ ID NO: 3736994 - RNA, 17 nt, Salmonella enterica enterica serovar Typhi Ty2
cccucaagacgguuauu

SEQ ID NO: 3736995 - RNA, 18 nt, Salmonella enterica enterica serovar Typhi Ty2
cccucaauaucuuugccu

SEQ ID NO: 3736996 - RNA, 16 nt, Salmonella enterica enterica serovar Typhi Ty2
cccucaccucccccgc

SEQ ID NO: 3736997 - RNA, 22 nt, Salmonella enterica enterica serovar Typhi Ty2
cccuccgcggauuguuuuacuu

SEQ ID NO: 3736998 - RNA, 13 nt, Salmonella enterica enterica serovar Typhi Ty2
cccuccggccagc

SEQ ID NO: 3736999 - RNA, 15 nt, Salmonella enterica enterica serovar Typhi Ty2
cccuccggccagcgc

SEQ ID NO: 3737000 - RNA, 17 nt, Salmonella enterica enterica serovar Typhi Ty2
cccuccggccagcgcca

SEQ ID NO: 3737001 - RNA, 17 nt, Salmonella enterica enterica serovar Typhi Ty2
cccucgacaggaguaua

SEQ ID NO: 3737002 - RNA, 13 nt, Salmonella enterica enterica serovar Typhi Ty2
cccucgccagcaa

SEQ ID NO: 3737003 - RNA, 19 nt, Salmonella enterica enterica serovar Typhi Ty2
cccucugagcugguguaau

SEQ ID NO: 3737004 - RNA, 16 nt, Salmonella enterica enterica serovar Typhi Ty2
cccucugauuggcugu

SEQ ID NO: 3737005 - RNA, 21 nt, Salmonella enterica enterica serovar Typhi Ty2
cccucuucuucuuccgucagc

SEQ ID NO: 3737006 - RNA, 16 nt, Salmonella enterica enterica serovar Typhi Ty2
cccucuuuuagcaaua

SEQ ID NO: 3737007 - RNA, 23 nt, Salmonella enterica enterica serovar Typhi Ty2
cccugaaauaacagacuccgucu

SEQ ID NO: 3737008 - RNA, 14 nt, Salmonella enterica enterica serovar Typhi Ty2
cccugaauauuaga

SEQ ID NO: 3737009 - RNA, 18 nt, Salmonella enterica enterica serovar Typhi Ty2
cccugaauuucaauaauc

SEQ ID NO: 3737010 - RNA, 19 nt, Salmonella enterica enterica serovar Typhi Ty2
cccugacaauacugcacgc

SEQ ID NO: 3737011 - RNA, 19 nt, Salmonella enterica enterica serovar Typhi Ty2
cccugaccuuccauccaca

SEQ ID NO: 3737012 - RNA, 16 nt, Salmonella enterica enterica serovar Typhi Ty2
cccugagcccacagcg

SEQ ID NO: 3737013 - RNA, 15 nt, Salmonella enterica enterica serovar Typhi Ty2
cccugagucuugccu

SEQ ID NO: 3737014 - RNA, 22 nt, Salmonella enterica enterica serovar Typhi Ty2
cccugaugcguauccagcgcgg

SEQ ID NO: 3737015 - RNA, 14 nt, Salmonella enterica enterica serovar Typhi Ty2
cccugauggcgcgc

SEQ ID NO: 3737016 - RNA, 14 nt, Salmonella enterica enterica serovar Typhi Ty2
cccugcaacgccug

SEQ ID NO: 3737017 - RNA, 15 nt, Salmonella enterica enterica serovar Typhi Ty2
cccugcaacgccugc

SEQ ID NO: 3737018 - RNA, 17 nt, Salmonella enterica enterica serovar Typhi Ty2
cccugccacaaccgccc

SEQ ID NO: 3737019 - RNA, 23 nt, Salmonella enterica enterica serovar Typhi Ty2
cccugccacaacggcaauuuuua

SEQ ID NO: 3737020 - RNA, 13 nt, Salmonella enterica enterica serovar Typhi Ty2
cccugccagcgua

SEQ ID NO: 3737021 - RNA, 18 nt, Salmonella enterica enterica serovar Typhi Ty2
cccugccauucccagccg

SEQ ID NO: 3737022 - RNA, 14 nt, Salmonella enterica enterica serovar Typhi Ty2
cccugcccgccagg

SEQ ID NO: 3737023 - RNA, 15 nt, Salmonella enterica enterica serovar Typhi Ty2
cccugccggcggcag

SEQ ID NO: 3737024 - RNA, 20 nt, Salmonella enterica enterica serovar Typhi Ty2
cccugccgucucaaccagca

SEQ ID NO: 3737025 - RNA, 13 nt, Salmonella enterica enterica serovar Typhi Ty2
ccgacgccagcca

SEQ ID NO: 3737026 - RNA, 14 nt, Salmonella enterica enterica serovar Typhi Ty2
ccgacgcucaaccg

SEQ ID NO: 3737027 - RNA, 15 nt, Salmonella enterica enterica serovar Typhi Ty2
ccgacgcucaaccgg

SEQ ID NO: 3737028 - RNA, 18 nt, Salmonella enterica enterica serovar Typhi Ty2
ccgacgguuauugcgcug

SEQ ID NO: 3737029 - RNA, 13 nt, Salmonella enterica enterica serovar Typhi Ty2
ccgacguaguuca

SEQ ID NO: 3737030 - RNA, 14 nt, Salmonella enterica enterica serovar Typhi Ty2
ccgacuaauuauuu

SEQ ID NO: 3737031 - RNA, 16 nt, Salmonella enterica enterica serovar Typhi Ty2
ccgacuaccggcacca

SEQ ID NO: 3737032 - RNA, 12 nt, Salmonella enterica enterica serovar Typhi Ty2
ccgacucgcgca

SEQ ID NO: 3737033 - RNA, 14 nt, Salmonella enterica enterica serovar Typhi Ty2
ccgacuuuucgccc

SEQ ID NO: 3737034 - RNA, 19 nt, Salmonella enterica enterica serovar Typhi Ty2
ccgacuuuuuugccuuuca

SEQ ID NO: 3737035 - RNA, 22 nt, Salmonella enterica enterica serovar Typhi Ty2
ccgacuuuuuugccuuucagau

SEQ ID NO: 3737036 - RNA, 19 nt, Salmonella enterica enterica serovar Typhi Ty2
ccgagcaacagaaaccaua

SEQ ID NO: 3737037 - RNA, 14 nt, Salmonella enterica enterica serovar Typhi Ty2
ccgagcauccgcgc

SEQ ID NO: 3737038 - RNA, 19 nt, Salmonella enterica enterica serovar Typhi Ty2
ccgagcauuuccgcagcca

SEQ ID NO: 3737039 - RNA, 22 nt, Salmonella enterica enterica serovar Typhi Ty2
ccgagccagaacgagaggagga

SEQ ID NO: 3737040 - RNA, 23 nt, Salmonella enterica enterica serovar Typhi Ty2
ccgagccgcccuucacaaccauc

SEQ ID NO: 3737041 - RNA, 17 nt, Salmonella enterica enterica serovar Typhi Ty2
ccgagccggguuauagc

SEQ ID NO: 3737042 - RNA, 21 nt, Salmonella enterica enterica serovar Typhi Ty2
ccgagcgaaggggcgggcagc

SEQ ID NO: 3737043 - RNA, 11 nt, Salmonella enterica enterica serovar Typhi Ty2
ccgagcgcugg

SEQ ID NO: 3737044 - RNA, 12 nt, Salmonella enterica enterica serovar Typhi Ty2
ccgaggcgaaac

SEQ ID NO: 3737045 - RNA, 17 nt, Salmonella enterica enterica serovar Typhi Ty2
ccgaggcuaagccagaa

SEQ ID NO: 3737046 - RNA, 19 nt, Salmonella enterica enterica serovar Typhi Ty2
ccgaggcuuaauacggcaa

SEQ ID NO: 3737047 - RNA, 21 nt, Salmonella enterica enterica serovar Typhi Ty2
ccgaggguggacaugauaagc

SEQ ID NO: 3737048 - RNA, 15 nt, Salmonella enterica enterica serovar Typhi Ty2
ccgagguucaccagc

SEQ ID NO: 3737049 - RNA, 17 nt, Salmonella enterica enterica serovar Typhi Ty2
ccgagguuuucauccac

SEQ ID NO: 3737050 - RNA, 14 nt, Salmonella enterica enterica serovar Typhi Ty2
ccgaguaacaccgc

SEQ ID NO: 3737051 - RNA, 19 nt, Salmonella enterica enterica serovar Typhi Ty2
ccgagucgaucgucgggau

SEQ ID NO: 3737052 - RNA, 22 nt, Salmonella enterica enterica serovar Typhi Ty2
ccgagugcuuauguaggccuga

SEQ ID NO: 3737053 - RNA, 17 nt, Salmonella enterica enterica serovar Typhi Ty2
ccgaguggaaucagcca

SEQ ID NO: 3737054 - RNA, 20 nt, Salmonella enterica enterica serovar Typhi Ty2
ccgaguggaaucagccagga

SEQ ID NO: 3737055 - RNA, 15 nt, Salmonella enterica enterica serovar Typhi Ty2
ccgagugucgcccgc

SEQ ID NO: 3737056 - RNA, 16 nt, Salmonella enterica enterica serovar Typhi Ty2
ccgaguuucugguaga

SEQ ID NO: 3737057 - RNA, 22 nt, Salmonella enterica enterica serovar Typhi Ty2
ccgauaaagcgaccgaucauca

SEQ ID NO: 3737058 - RNA, 18 nt, Salmonella enterica enterica serovar Typhi Ty2
ccgauaaauucugucuca

SEQ ID NO: 3737059 - RNA, 15 nt, Salmonella enterica enterica serovar Typhi Ty2
ccgauaacgcggccc

SEQ ID NO: 3737060 - RNA, 17 nt, Salmonella enterica enterica serovar Typhi Ty2
ccgauaagcaagcgcca

SEQ ID NO: 3737061 - RNA, 18 nt, Salmonella enterica enterica serovar Typhi Ty2
ccgauaagcaagcgccau

SEQ ID NO: 3737062 - RNA, 18 nt, Salmonella enterica enterica serovar Typhi Ty2
ccgauaaucaccagcccg

SEQ ID NO: 3737063 - RNA, 21 nt, Salmonella enterica enterica serovar Typhi Ty2
ccgauacaggacugacugcug

SEQ ID NO: 3737064 - RNA, 23 nt, Salmonella enterica enterica serovar Typhi Ty2
ccgauagcgaaacugauauuaga

SEQ ID NO: 3737065 - RNA, 15 nt, Salmonella enterica enterica serovar Typhi Ty2
ccgauagcgccgcgc

SEQ ID NO: 3737066 - RNA, 19 nt, Salmonella enterica enterica serovar Typhi Ty2
ccgauagcgccgcgcuauc

SEQ ID NO: 3737067 - RNA, 17 nt, Salmonella enterica enterica serovar Typhi Ty2
ccgauagcggcgcagac

SEQ ID NO: 3737068 - RNA, 17 nt, Salmonella enterica enterica serovar Typhi Ty2
ccgauagcuaucacaca

SEQ ID NO: 3737069 - RNA, 18 nt, Salmonella enterica enterica serovar Typhi Ty2
ccgauagcuaucacacau

SEQ ID NO: 3737070 - RNA, 21 nt, Salmonella enterica enterica serovar Typhi Ty2
ccgauauauugccggccugau

SEQ ID NO: 3737071 - RNA, 22 nt, Salmonella enterica enterica serovar Typhi Ty2
ccgaucacggcgaaucgccugu

SEQ ID NO: 3737072 - RNA, 12 nt, Salmonella enterica enterica serovar Typhi Ty2
ccgaucacggcu

SEQ ID NO: 3737073 - RNA, 23 nt, Salmonella enterica enterica serovar Typhi Ty2
ccgaucagcaccacgcccggauc

SEQ ID NO: 3737074 - RNA, 17 nt, Salmonella enterica enterica serovar Typhi Ty2
ccgaucaggccgcagac

SEQ ID NO: 3737075 - RNA, 22 nt, Salmonella enterica enterica serovar Typhi Ty2
ccgaucaucccgcccagcaaca

SEQ ID NO: 3737076 - RNA, 22 nt, Salmonella enterica enterica serovar Typhi Ty2
ccgaucuacgcuauuuccagaa

SEQ ID NO: 3737077 - RNA, 19 nt, Salmonella enterica enterica serovar Typhi Ty2
ccgaucucaugcaacuggc

SEQ ID NO: 3737078 - RNA, 15 nt, Salmonella enterica enterica serovar Typhi Ty2
ccgaugaacgacgcu

SEQ ID NO: 3737079 - RNA, 21 nt, Salmonella enterica enterica serovar Typhi Ty2
ccgaugagaaguagcccauau

SEQ ID NO: 3737080 - RNA, 18 nt, Salmonella enterica enterica serovar Typhi Ty2
ccgaugccgacggcgcuu

SEQ ID NO: 3737081 - RNA, 12 nt, Salmonella enterica enterica serovar Typhi Ty2
ccgaugccgccg

SEQ ID NO: 3737082 - RNA, 21 nt, Salmonella enterica enterica serovar Typhi Ty2
ccgaugcucagggcauccgcc

SEQ ID NO: 3737083 - RNA, 17 nt, Salmonella enterica enterica serovar Typhi Ty2
ccgauggcgcugcguuu

SEQ ID NO: 3737084 - RNA, 20 nt, Salmonella enterica enterica serovar Typhi Ty2
ccgaugucgccacgccgccc

SEQ ID NO: 3737085 - RNA, 23 nt, Salmonella enterica enterica serovar Typhi Ty2
ccgaugucgcuucgcuuaucugg

SEQ ID NO: 3737086 - RNA, 13 nt, Salmonella enterica enterica serovar Typhi Ty2
ccgauucccaguc

SEQ ID NO: 3737087 - RNA, 23 nt, Salmonella enterica enterica serovar Typhi Ty2
ccgauuuugucggaauuuccggg

SEQ ID NO: 3737088 - RNA, 22 nt, Salmonella enterica enterica serovar Typhi Ty2
ccgauuuuuuaucucgccgucg

SEQ ID NO: 3737089 - RNA, 13 nt, Salmonella enterica enterica serovar Typhi Ty2
ccgcaaaaaauac

SEQ ID NO: 3737090 - RNA, 12 nt, Salmonella enterica enterica serovar Typhi Ty2
ccgcaaaaccuu

SEQ ID NO: 3737091 - RNA, 21 nt, Salmonella enterica enterica serovar Typhi Ty2
ccgcaaaaccuucauaaauac

SEQ ID NO: 3737092 - RNA, 16 nt, Salmonella enterica enterica serovar Typhi Ty2
ccgcaaacagcacgcc

SEQ ID NO: 3737093 - RNA, 15 nt, Salmonella enterica enterica serovar Typhi Ty2
ccgcaaacgccgaag

SEQ ID NO: 3737094 - RNA, 18 nt, Salmonella enterica enterica serovar Typhi Ty2
ccgcaaacgccugcuccg

SEQ ID NO: 3737095 - RNA, 21 nt, Salmonella enterica enterica serovar Typhi Ty2
ccgcaaacggaauagcgccuu

SEQ ID NO: 3737096 - RNA, 20 nt, Salmonella enterica enterica serovar Typhi Ty2
ccgcaaaggaccaacaccag

SEQ ID NO: 3737097 - RNA, 21 nt, Salmonella enterica enterica serovar Typhi Ty2
ccgcaaauucgucgccgccaa

SEQ ID NO: 3737098 - RNA, 12 nt, Salmonella enterica enterica serovar Typhi Ty2
ccgcaacgccag

SEQ ID NO: 3737099 - RNA, 17 nt, Salmonella enterica enterica serovar Typhi Ty2
ccgcaacgccgauaagg

SEQ ID NO: 3737100 - RNA, 18 nt, Salmonella enterica enterica serovar Typhi Ty2
ccgcaacggcuugugagc

SEQ ID NO: 3737101 - RNA, 16 nt, Salmonella enterica enterica serovar Typhi Ty2
ccgcaauaacgccgau

SEQ ID NO: 3737102 - RNA, 14 nt, Salmonella enterica enterica serovar Typhi Ty2
ccgcaauccuggcu

SEQ ID NO: 3737103 - RNA, 17 nt, Salmonella enterica enterica serovar Typhi Ty2
ccgcaaugaccacaaau

SEQ ID NO: 3737104 - RNA, 18 nt, Salmonella enterica enterica serovar Typhi Ty2
ccgcaaugaccacaaauu

SEQ ID NO: 3737105 - RNA, 18 nt, Salmonella enterica enterica serovar Typhi Ty2
ccgcaauugguaauuaaa

SEQ ID NO: 3737106 - RNA, 16 nt, Salmonella enterica enterica serovar Typhi Ty2
ccgcacacagcagaaa

SEQ ID NO: 3737107 - RNA, 22 nt, Salmonella enterica enterica serovar Typhi Ty2
ccgccauccggcaaacucagcg

SEQ ID NO: 3737108 - RNA, 15 nt, Salmonella enterica enterica serovar Typhi Ty2
ccgccauccggccug

SEQ ID NO: 3737109 - RNA, 12 nt, Salmonella enterica enterica serovar Typhi Ty2
ccgccaucgcau

SEQ ID NO: 3737110 - RNA, 21 nt, Salmonella enterica enterica serovar Typhi Ty2
ccgccaucgcaucgaggcugg

SEQ ID NO: 3737111 - RNA, 14 nt, Salmonella enterica enterica serovar Typhi Ty2
ccgccaucgccucg

SEQ ID NO: 3737112 - RNA, 16 nt, Salmonella enterica enterica serovar Typhi Ty2
ccgccaucgcugggau

SEQ ID NO: 3737113 - RNA, 16 nt, Salmonella enterica enterica serovar Typhi Ty2
ccgccaucguccagcc

SEQ ID NO: 3737114 - RNA, 20 nt, Salmonella enterica enterica serovar Typhi Ty2
ccgccaucucacgcauggcg

SEQ ID NO: 3737115 - RNA, 20 nt, Salmonella enterica enterica serovar Typhi Ty2
ccgccaucucauucgccagc

SEQ ID NO: 3737116 - RNA, 17 nt, Salmonella enterica enterica serovar Typhi Ty2
ccgccaucuccggcagc

SEQ ID NO: 3737117 - RNA, 22 nt, Salmonella enterica enterica serovar Typhi Ty2
ccgccaucuuuacccugagccu

SEQ ID NO: 3737118 - RNA, 12 nt, Salmonella enterica enterica serovar Typhi Ty2
ccgccaugaaaa

SEQ ID NO: 3737119 - RNA, 20 nt, Salmonella enterica enterica serovar Typhi Ty2
ccgccauucgcuuccgccgg

SEQ ID NO: 3737120 - RNA, 18 nt, Salmonella enterica enterica serovar Typhi Ty2
ccgccauugccaguaccg

SEQ ID NO: 3737121 - RNA, 19 nt, Salmonella enterica enterica serovar Typhi Ty2
ccgccauugccaguaccga

SEQ ID NO: 3737122 - RNA, 17 nt, Salmonella enterica enterica serovar Typhi Ty2
ccgcccaacagggcggc

SEQ ID NO: 3737123 - RNA, 15 nt, Salmonella enterica enterica serovar Typhi Ty2
ccgcccaaccagccc

SEQ ID NO: 3737124 - RNA, 20 nt, Salmonella enterica enterica serovar Typhi Ty2
ccgcccagaaagaucagcag

SEQ ID NO: 3737125 - RNA, 22 nt, Salmonella enterica enterica serovar Typhi Ty2
ccgcccagaaagaucagcagaa

SEQ ID NO: 3737126 - RNA, 17 nt, Salmonella enterica enterica serovar Typhi Ty2
ccgcccagaacggcagc

SEQ ID NO: 3737127 - RNA, 17 nt, Salmonella enterica enterica serovar Typhi Ty2
ccgcccagagaauauug

SEQ ID NO: 3737128 - RNA, 23 nt, Salmonella enterica enterica serovar Typhi Ty2
ccgcccagauguugauacagaaa

SEQ ID NO: 3737129 - RNA, 14 nt, Salmonella enterica enterica serovar Typhi Ty2
ccgcccccuccagu

SEQ ID NO: 3737130 - RNA, 12 nt, Salmonella enterica enterica serovar Typhi Ty2
ccgccccgcugg

SEQ ID NO: 3737131 - RNA, 16 nt, Salmonella enterica enterica serovar Typhi Ty2
ccgcccggacccgcuu

SEQ ID NO: 3737132 - RNA, 14 nt, Salmonella enterica enterica serovar Typhi Ty2
ccgcccggcgcgcu

SEQ ID NO: 3737133 - RNA, 18 nt, Salmonella enterica enterica serovar Typhi Ty2
ccgcccuguccuccaugg

SEQ ID NO: 3737134 - RNA, 23 nt, Salmonella enterica enterica serovar Typhi Ty2
ccgcccuucacaaccaucgucug

SEQ ID NO: 3737135 - RNA, 20 nt, Salmonella enterica enterica serovar Typhi Ty2
ccgccgaacagacggcggcu

SEQ ID NO: 3737136 - RNA, 15 nt, Salmonella enterica enterica serovar Typhi Ty2
ccgccgacaccggcc

SEQ ID NO: 3737137 - RNA, 20 nt, Salmonella enterica enterica serovar Typhi Ty2
ccgccgagcauuuccgcagc

SEQ ID NO: 3737138 - RNA, 18 nt, Salmonella enterica enterica serovar Typhi Ty2
ccgccgagggcauugaug

SEQ ID NO: 3737139 - RNA, 18 nt, Salmonella enterica enterica serovar Typhi Ty2
ccgccgcaauuccugacu

SEQ ID NO: 3737140 - RNA, 14 nt, Salmonella enterica enterica serovar Typhi Ty2
ccgccgcacaggcg

SEQ ID NO: 3737141 - RNA, 14 nt, Salmonella enterica enterica serovar Typhi Ty2
ccgccgcagcagau

SEQ ID NO: 3737142 - RNA, 19 nt, Salmonella enterica enterica serovar Typhi Ty2
ccgccgccagcaccgccgc

SEQ ID NO: 3737143 - RNA, 15 nt, Salmonella enterica enterica serovar Typhi Ty2
ccgccgccaucacca

SEQ ID NO: 3737144 - RNA, 15 nt, Salmonella enterica enterica serovar Typhi Ty2
ccgccgcccagaugu

SEQ ID NO: 3737145 - RNA, 14 nt, Salmonella enterica enterica serovar Typhi Ty2
ccgccgcccguccg

SEQ ID NO: 3737146 - RNA, 16 nt, Salmonella enterica enterica serovar Typhi Ty2
ccgccgccgggccgcc

SEQ ID NO: 3737147 - RNA, 13 nt, Salmonella enterica enterica serovar Typhi Ty2
ccgccgccugcca

SEQ ID NO: 3737148 - RNA, 13 nt, Salmonella enterica enterica serovar Typhi Ty2
ccgccgcgaaaac

SEQ ID NO: 3737149 - RNA, 14 nt, Salmonella enterica enterica serovar Typhi Ty2
ccgccgcgagcagc

SEQ ID NO: 3737150 - RNA, 16 nt, Salmonella enterica enterica serovar Typhi Ty2
ccgccgcgcggcccca

SEQ ID NO: 3737151 - RNA, 15 nt, Salmonella enterica enterica serovar Typhi Ty2
ccgccgcgcgucagc

SEQ ID NO: 3737152 - RNA, 20 nt, Salmonella enterica enterica serovar Typhi Ty2
ccgccgcguccuaccgccgc

SEQ ID NO: 3737153 - RNA, 15 nt, Salmonella enterica enterica serovar Typhi Ty2
ccgccgcuggcgggc

SEQ ID NO: 3737154 - RNA, 18 nt, Salmonella enterica enterica serovar Typhi Ty2
ccgccgcuggucaacacg

SEQ ID NO: 3737155 - RNA, 23 nt, Salmonella enterica enterica serovar Typhi Ty2
ccgccgcuuuuuucagcggcagc

SEQ ID NO: 3737156 - RNA, 14 nt, Salmonella enterica enterica serovar Typhi Ty2
ccgccggcagcagc

SEQ ID NO: 3737157 - RNA, 15 nt, Salmonella enterica enterica serovar Typhi Ty2
ccgccgggcaacacg

SEQ ID NO: 3737158 - RNA, 17 nt, Salmonella enterica enterica serovar Typhi Ty2
ccgccgggcgucacccg

SEQ ID NO: 3737159 - RNA, 23 nt, Salmonella enterica enterica serovar Typhi Ty2
ccgccggggcucccacucuucca

SEQ ID NO: 3737160 - RNA, 19 nt, Salmonella enterica enterica serovar Typhi Ty2
ccgccgguuuauccccgcu

SEQ ID NO: 3737161 - RNA, 14 nt, Salmonella enterica enterica serovar Typhi Ty2
ccgccgucaggcua

SEQ ID NO: 3737162 - RNA, 12 nt, Salmonella enterica enterica serovar Typhi Ty2
ccgccguccugg

SEQ ID NO: 3737163 - RNA, 19 nt, Salmonella enterica enterica serovar Typhi Ty2
ccgccgucggcaauaaacu

SEQ ID NO: 3737164 - RNA, 19 nt, Salmonella enterica enterica serovar Typhi Ty2
ccgccgucgucaccgccgc

SEQ ID NO: 3737165 - RNA, 14 nt, Salmonella enterica enterica serovar Typhi Ty2
ccgccgugauaaau

SEQ ID NO: 3737166 - RNA, 15 nt, Salmonella enterica enterica serovar Typhi Ty2
ccgccgugcucacua

SEQ ID NO: 3737167 - RNA, 16 nt, Salmonella enterica enterica serovar Typhi Ty2
ccgccuaacagcgccg

SEQ ID NO: 3737168 - RNA, 12 nt, Salmonella enterica enterica serovar Typhi Ty2
ccgccuccagca

SEQ ID NO: 3737169 - RNA, 14 nt, Salmonella enterica enterica serovar Typhi Ty2
ccgccuccaggccg

SEQ ID NO: 3737170 - RNA, 11 nt, Salmonella enterica enterica serovar Typhi Ty2
ccgccuccggg

SEQ ID NO: 3737171 - RNA, 20 nt, Salmonella enterica enterica serovar Typhi Ty2
ccgccucgcgauccgccagc

SEQ ID NO: 3737172 - RNA, 14 nt, Salmonella enterica enterica serovar Typhi Ty2
ccgccugaaucgcc

SEQ ID NO: 3737173 - RNA, 16 nt, Salmonella enterica enterica serovar Typhi Ty2
ccgccugaaucgccgc

SEQ ID NO: 3737174 - RNA, 15 nt, Salmonella enterica enterica serovar Typhi Ty2
ccgccugccgcgccg

SEQ ID NO: 3737175 - RNA, 12 nt, Salmonella enterica enterica serovar Typhi Ty2
ccgccugcugug

SEQ ID NO: 3737176 - RNA, 20 nt, Salmonella enterica enterica serovar Typhi Ty2
ccgccuguacuuccgguauc

SEQ ID NO: 3737177 - RNA, 15 nt, Salmonella enterica enterica serovar Typhi Ty2
ccgccuuaccgcggu

SEQ ID NO: 3737178 - RNA, 17 nt, Salmonella enterica enterica serovar Typhi Ty2
ccgccuuaucaggccug

SEQ ID NO: 3737179 - RNA, 17 nt, Salmonella enterica enterica serovar Typhi Ty2
ccgccuucagcgcgccc

SEQ ID NO: 3737180 - RNA, 19 nt, Salmonella enterica enterica serovar Typhi Ty2
ccgccuugcccguauugaa

SEQ ID NO: 3737181 - RNA, 18 nt, Salmonella enterica enterica serovar Typhi Ty2
ccgccuugcggcgccagg

SEQ ID NO: 3737182 - RNA, 18 nt, Salmonella enterica enterica serovar Typhi Ty2
ccgccuuuaagcaccgcu

SEQ ID NO: 3737183 - RNA, 17 nt, Salmonella enterica enterica serovar Typhi Ty2
ccgcgaaccggaccagc

SEQ ID NO: 3737184 - RNA, 23 nt, Salmonella enterica enterica serovar Typhi Ty2
ccgcgacaaaaagcgcgccgaaa

SEQ ID NO: 3737185 - RNA, 16 nt, Salmonella enterica enterica serovar Typhi Ty2
ccgcgacagucgcaga

SEQ ID NO: 3737186 - RNA, 20 nt, Salmonella enterica enterica serovar Typhi Ty2
ccgcgacagucgcagagccc

SEQ ID NO: 3737187 - RNA, 15 nt, Salmonella enterica enterica serovar Typhi Ty2
ccgcgacuuuggcuu

SEQ ID NO: 3737188 - RNA, 18 nt, Salmonella enterica enterica serovar Typhi Ty2
ccgcgagagucgccagga

SEQ ID NO: 3737189 - RNA, 15 nt, Salmonella enterica enterica serovar Typhi Ty2
ccgcuggcgcgggga

SEQ ID NO: 3737190 - RNA, 22 nt, Salmonella enterica enterica serovar Typhi Ty2
ccgcuggcgcggggaacacucu

SEQ ID NO: 3737191 - RNA, 12 nt, Salmonella enterica enterica serovar Typhi Ty2
ccgcuggcgucu

SEQ ID NO: 3737192 - RNA, 18 nt, Salmonella enterica enterica serovar Typhi Ty2
ccgcugguugccuuccug

SEQ ID NO: 3737193 - RNA, 20 nt, Salmonella enterica enterica serovar Typhi Ty2
ccgcugguugccuuccugau

SEQ ID NO: 3737194 - RNA, 21 nt, Salmonella enterica enterica serovar Typhi Ty2
ccgcugucgccagaauguuau

SEQ ID NO: 3737195 - RNA, 19 nt, Salmonella enterica enterica serovar Typhi Ty2
ccgcuguuacugucggcga

SEQ ID NO: 3737196 - RNA, 14 nt, Salmonella enterica enterica serovar Typhi Ty2
ccgcuguuaugcac

SEQ ID NO: 3737197 - RNA, 21 nt, Salmonella enterica enterica serovar Typhi Ty2
ccgcuuauuugccuaacgggc

SEQ ID NO: 3737198 - RNA, 17 nt, Salmonella enterica enterica serovar Typhi Ty2
ccgcuucauuggcgucu

SEQ ID NO: 3737199 - RNA, 23 nt, Salmonella enterica enterica serovar Typhi Ty2
ccgcuucauuggcgucugcuggc

SEQ ID NO: 3737200 - RNA, 12 nt, Salmonella enterica enterica serovar Typhi Ty2
ccgcuuccagcg

SEQ ID NO: 3737201 - RNA, 17 nt, Salmonella enterica enterica serovar Typhi Ty2
ccgcuuccagcgcgucg

SEQ ID NO: 3737202 - RNA, 14 nt, Salmonella enterica enterica serovar Typhi Ty2
ccgcuucgccacuc

SEQ ID NO: 3737203 - RNA, 13 nt, Salmonella enterica enterica serovar Typhi Ty2
ccgcuucuuccau

SEQ ID NO: 3737204 - RNA, 15 nt, Salmonella enterica enterica serovar Typhi Ty2
ccgcuuuaagcgcug

SEQ ID NO: 3737205 - RNA, 16 nt, Salmonella enterica enterica serovar Typhi Ty2
ccgcuuuaucauacca

SEQ ID NO: 3737206 - RNA, 13 nt, Salmonella enterica enterica serovar Typhi Ty2
ccgcuuugauuug

SEQ ID NO: 3737207 - RNA, 16 nt, Salmonella enterica enterica serovar Typhi Ty2
ccgcuuugcgaacagc

SEQ ID NO: 3737208 - RNA, 12 nt, Salmonella enterica enterica serovar Typhi Ty2
ccgcuuuuccug

SEQ ID NO: 3737209 - RNA, 21 nt, Salmonella enterica enterica serovar Typhi Ty2
ccgcuuuugccgcgacuuccg

SEQ ID NO: 3737210 - RNA, 21 nt, Salmonella enterica enterica serovar Typhi Ty2
ccgcuuuugguuuuucaacca

SEQ ID NO: 3737211 - RNA, 16 nt, Salmonella enterica enterica serovar Typhi Ty2
ccgcuuuuuccagcau

SEQ ID NO: 3737212 - RNA, 18 nt, Salmonella enterica enterica serovar Typhi Ty2
ccgcuuuuuccgccgucg

SEQ ID NO: 3737213 - RNA, 17 nt, Salmonella enterica enterica serovar Typhi Ty2
ccggaaaagcgcuggcu

SEQ ID NO: 3737214 - RNA, 20 nt, Salmonella enterica enterica serovar Typhi Ty2
ccggaaaagcgcuggcuggc

SEQ ID NO: 3737215 - RNA, 22 nt, Salmonella enterica enterica serovar Typhi Ty2
ccggaaagaauaaucgccgccg

SEQ ID NO: 3737216 - RNA, 22 nt, Salmonella enterica enterica serovar Typhi Ty2
ccggaaaggauauaagcgccau

SEQ ID NO: 3737217 - RNA, 17 nt, Salmonella enterica enterica serovar Typhi Ty2
ccggaaaucgcggcgau

SEQ ID NO: 3737218 - RNA, 13 nt, Salmonella enterica enterica serovar Typhi Ty2
ccggaaaucugca

SEQ ID NO: 3737219 - RNA, 20 nt, Salmonella enterica enterica serovar Typhi Ty2
ccggaaauggguaucuucau

SEQ ID NO: 3737220 - RNA, 19 nt, Salmonella enterica enterica serovar Typhi Ty2
ccggaaauuugcagcgcug

SEQ ID NO: 3737221 - RNA, 15 nt, Salmonella enterica enterica serovar Typhi Ty2
ccggaacaaaagaaa

SEQ ID NO: 3737222 - RNA, 17 nt, Salmonella enterica enterica serovar Typhi Ty2
ccggaacaaaagaaagc

SEQ ID NO: 3737223 - RNA, 18 nt, Salmonella enterica enterica serovar Typhi Ty2
ccggaacaaaagaaagca

SEQ ID NO: 3737224 - RNA, 21 nt, Salmonella enterica enterica serovar Typhi Ty2
ccggaacauacacguaauaca

SEQ ID NO: 3737225 - RNA, 17 nt, Salmonella enterica enterica serovar Typhi Ty2
ccggaaccuguccuuua

SEQ ID NO: 3737226 - RNA, 18 nt, Salmonella enterica enterica serovar Typhi Ty2
ccggaacggacgugcgcu

SEQ ID NO: 3737227 - RNA, 17 nt, Salmonella enterica enterica serovar Typhi Ty2
ccggaacgggcaugacu

SEQ ID NO: 3737228 - RNA, 19 nt, Salmonella enterica enterica serovar Typhi Ty2
ccggaaucgccugcgucgc

SEQ ID NO: 3737229 - RNA, 16 nt, Salmonella enterica enterica serovar Typhi Ty2
ccggacaaggcgcgcc

SEQ ID NO: 3737230 - RNA, 14 nt, Salmonella enterica enterica serovar Typhi Ty2
ccggacaaggcggu

SEQ ID NO: 3737231 - RNA, 21 nt, Salmonella enterica enterica serovar Typhi Ty2
ccggacaaggcgguacgccgc

SEQ ID NO: 3737232 - RNA, 14 nt, Salmonella enterica enterica serovar Typhi Ty2
ccggacaucauccc

SEQ ID NO: 3737233 - RNA, 22 nt, Salmonella enterica enterica serovar Typhi Ty2
ccggaccuaauagccagcccca

SEQ ID NO: 3737234 - RNA, 11 nt, Salmonella enterica enterica serovar Typhi Ty2
ccggaccugcg

SEQ ID NO: 3737235 - RNA, 14 nt, Salmonella enterica enterica serovar Typhi Ty2
ccggacgcaccagc

SEQ ID NO: 3737236 - RNA, 13 nt, Salmonella enterica enterica serovar Typhi Ty2
ccggacgccacca

SEQ ID NO: 3737237 - RNA, 14 nt, Salmonella enterica enterica serovar Typhi Ty2
ccggacgcccgucc

SEQ ID NO: 3737238 - RNA, 17 nt, Salmonella enterica enterica serovar Typhi Ty2
ccggacgccguccaggc

SEQ ID NO: 3737239 - RNA, 20 nt, Salmonella enterica enterica serovar Typhi Ty2
ccggacuccaggcaacguug

SEQ ID NO: 3737240 - RNA, 15 nt, Salmonella enterica enterica serovar Typhi Ty2
ccggagaccggcgaa

SEQ ID NO: 3737241 - RNA, 18 nt, Salmonella enterica enterica serovar Typhi Ty2
ccggagagcuugauaaau

SEQ ID NO: 3737242 - RNA, 23 nt, Salmonella enterica enterica serovar Typhi Ty2
ccggagaucugucgccgauaauc

SEQ ID NO: 3737243 - RNA, 18 nt, Salmonella enterica enterica serovar Typhi Ty2
ccggagauuuaucuucuc

SEQ ID NO: 3737244 - RNA, 17 nt, Salmonella enterica enterica serovar Typhi Ty2
ccggagccggucggcgc

SEQ ID NO: 3737245 - RNA, 23 nt, Salmonella enterica enterica serovar Typhi Ty2
ccggaggcagaggucucagguuc

SEQ ID NO: 3737246 - RNA, 21 nt, Salmonella enterica enterica serovar Typhi Ty2
ccggagggcgaacuggcgguc

SEQ ID NO: 3737247 - RNA, 15 nt, Salmonella enterica enterica serovar Typhi Ty2
ccggagguuuuucug

SEQ ID NO: 3737248 - RNA, 19 nt, Salmonella enterica enterica serovar Typhi Ty2
ccggauaacgcgcuggaug

SEQ ID NO: 3737249 - RNA, 19 nt, Salmonella enterica enterica serovar Typhi Ty2
ccggauaagcggcagcgcc

SEQ ID NO: 3737250 - RNA, 21 nt, Salmonella enterica enterica serovar Typhi Ty2
ccggauaagcggcagcgccau

SEQ ID NO: 3737251 - RNA, 20 nt, Salmonella enterica enterica serovar Typhi Ty2
ccggauaagcgugagcgcau

SEQ ID NO: 3737252 - RNA, 22 nt, Salmonella enterica enterica serovar Typhi Ty2
ccggauaagcgugcgccauccg

SEQ ID NO: 3737253 - RNA, 23 nt, Salmonella enterica enterica serovar Typhi Ty2
ccggauaaggcauuucgccgcca

SEQ ID NO: 3737254 - RNA, 22 nt, Salmonella enterica enterica serovar Typhi Ty2
ccggauaaggcgcuugcgccau

SEQ ID NO: 3737255 - RNA, 21 nt, Salmonella enterica enterica serovar Typhi Ty2
ccggauaaggcgcuugcgccg

SEQ ID NO: 3737256 - RNA, 22 nt, Salmonella enterica enterica serovar Typhi Ty2
ccggauaaggcgcuugcgccgc

SEQ ID NO: 3737257 - RNA, 23 nt, Salmonella enterica enterica serovar Typhi Ty2
ccggauaaggcgcuugcgccgcc

SEQ ID NO: 3737258 - RNA, 22 nt, Salmonella enterica enterica serovar Typhi Ty2
ccggauaaggcggagccgccau

SEQ ID NO: 3737259 - RNA, 18 nt, Salmonella enterica enterica serovar Typhi Ty2
ccggauaauccagacaaa

SEQ ID NO: 3737260 - RNA, 21 nt, Salmonella enterica enterica serovar Typhi Ty2
ccggauacucgacgcacucca

SEQ ID NO: 3737261 - RNA, 19 nt, Salmonella enterica enterica serovar Typhi Ty2
ccggauagcguagcgccau

SEQ ID NO: 3737262 - RNA, 23 nt, Salmonella enterica enterica serovar Typhi Ty2
ccggaucaauaaacagcuccgca

SEQ ID NO: 3737263 - RNA, 13 nt, Salmonella enterica enterica serovar Typhi Ty2
ccggaucaucuuu

SEQ ID NO: 3737264 - RNA, 19 nt, Salmonella enterica enterica serovar Typhi Ty2
ccggaucgaucccggcaaa

SEQ ID NO: 3737265 - RNA, 13 nt, Salmonella enterica enterica serovar Typhi Ty2
ccggaucgcguuu

SEQ ID NO: 3737266 - RNA, 18 nt, Salmonella enterica enterica serovar Typhi Ty2
ccggaucgcuaauuuuua

SEQ ID NO: 3737267 - RNA, 18 nt, Salmonella enterica enterica serovar Typhi Ty2
ccggaugacgcuucgcuu

SEQ ID NO: 3737268 - RNA, 22 nt, Salmonella enterica enterica serovar Typhi Ty2
ccggaugaggcgcagccgccau

SEQ ID NO: 3737269 - RNA, 16 nt, Salmonella enterica enterica serovar Typhi Ty2
ccggaugcaccaucuc

SEQ ID NO: 3737270 - RNA, 13 nt, Salmonella enterica enterica serovar Typhi Ty2
ccggcgcgguauu

SEQ ID NO: 3737271 - RNA, 15 nt, Salmonella enterica enterica serovar Typhi Ty2
ccggcgcguaauucc

SEQ ID NO: 3737272 - RNA, 19 nt, Salmonella enterica enterica serovar Typhi Ty2
ccggcgcguuaauaccgug

SEQ ID NO: 3737273 - RNA, 19 nt, Salmonella enterica enterica serovar Typhi Ty2
ccggcgcguuuuggcagac

SEQ ID NO: 3737274 - RNA, 15 nt, Salmonella enterica enterica serovar Typhi Ty2
ccggcgcuaaccagc

SEQ ID NO: 3737275 - RNA, 18 nt, Salmonella enterica enterica serovar Typhi Ty2
ccggcgcuaaccagcgcu

SEQ ID NO: 3737276 - RNA, 20 nt, Salmonella enterica enterica serovar Typhi Ty2
ccggcgcugcgcggcgugca

SEQ ID NO: 3737277 - RNA, 20 nt, Salmonella enterica enterica serovar Typhi Ty2
ccggcggaaaaaagcagcau

SEQ ID NO: 3737278 - RNA, 14 nt, Salmonella enterica enterica serovar Typhi Ty2
ccggcggaauagcu

SEQ ID NO: 3737279 - RNA, 14 nt, Salmonella enterica enterica serovar Typhi Ty2
ccggcggccuacca

SEQ ID NO: 3737280 - RNA, 23 nt, Salmonella enterica enterica serovar Typhi Ty2
ccggcgggguuuuuuuaugcguu

SEQ ID NO: 3737281 - RNA, 20 nt, Salmonella enterica enterica serovar Typhi Ty2
ccggcggucaugcuggcgau

SEQ ID NO: 3737282 - RNA, 23 nt, Salmonella enterica enterica serovar Typhi Ty2
ccggcggucgauuuugccuucaa

SEQ ID NO: 3737283 - RNA, 17 nt, Salmonella enterica enterica serovar Typhi Ty2
ccggcguaauugcgccu

SEQ ID NO: 3737284 - RNA, 18 nt, Salmonella enterica enterica serovar Typhi Ty2
ccggcgucgaucagcgcg

SEQ ID NO: 3737285 - RNA, 13 nt, Salmonella enterica enterica serovar Typhi Ty2
ccggcgugauaaa

SEQ ID NO: 3737286 - RNA, 18 nt, Salmonella enterica enterica serovar Typhi Ty2
ccggcguucucccgggcc

SEQ ID NO: 3737287 - RNA, 13 nt, Salmonella enterica enterica serovar Typhi Ty2
ccggcguugaaau

SEQ ID NO: 3737288 - RNA, 22 nt, Salmonella enterica enterica serovar Typhi Ty2
ccggcguuucguuuagcgccug

SEQ ID NO: 3737289 - RNA, 19 nt, Salmonella enterica enterica serovar Typhi Ty2
ccggcguuuuuagugacag

SEQ ID NO: 3737290 - RNA, 19 nt, Salmonella enterica enterica serovar Typhi Ty2
ccggcuaaaugacgcgcga

SEQ ID NO: 3737291 - RNA, 21 nt, Salmonella enterica enterica serovar Typhi Ty2
ccggcuaugccggaggauauu

SEQ ID NO: 3737292 - RNA, 18 nt, Salmonella enterica enterica serovar Typhi Ty2
ccggcucgccuugcgguu

SEQ ID NO: 3737293 - RNA, 22 nt, Salmonella enterica enterica serovar Typhi Ty2
ccggcugcauauacucacugaa

SEQ ID NO: 3737294 - RNA, 15 nt, Salmonella enterica enterica serovar Typhi Ty2
ccggcugccauuauc

SEQ ID NO: 3737295 - RNA, 21 nt, Salmonella enterica enterica serovar Typhi Ty2
ccggcugcgucgcuucuuguu

SEQ ID NO: 3737296 - RNA, 15 nt, Salmonella enterica enterica serovar Typhi Ty2
ccggcuggcuauagu

SEQ ID NO: 3737297 - RNA, 20 nt, Salmonella enterica enterica serovar Typhi Ty2
ccggcugguuaaucacuuuu

SEQ ID NO: 3737298 - RNA, 16 nt, Salmonella enterica enterica serovar Typhi Ty2
ccggcuuaccggcuau

SEQ ID NO: 3737299 - RNA, 18 nt, Salmonella enterica enterica serovar Typhi Ty2
ccggcuuaggcaggggau

SEQ ID NO: 3737300 - RNA, 13 nt, Salmonella enterica enterica serovar Typhi Ty2
ccggcuuauccgg

SEQ ID NO: 3737301 - RNA, 11 nt, Salmonella enterica enterica serovar Typhi Ty2
ccggcuucagc

SEQ ID NO: 3737302 - RNA, 12 nt, Salmonella enterica enterica serovar Typhi Ty2
ccggcuucagca

SEQ ID NO: 3737303 - RNA, 16 nt, Salmonella enterica enterica serovar Typhi Ty2
ccggcuuccagcggcg

SEQ ID NO: 3737304 - RNA, 17 nt, Salmonella enterica enterica serovar Typhi Ty2
ccggcuucuccaccaua

SEQ ID NO: 3737305 - RNA, 19 nt, Salmonella enterica enterica serovar Typhi Ty2
ccggcuucuccaccauauc

SEQ ID NO: 3737306 - RNA, 22 nt, Salmonella enterica enterica serovar Typhi Ty2
ccggcuuuaugauggugagagc

SEQ ID NO: 3737307 - RNA, 20 nt, Salmonella enterica enterica serovar Typhi Ty2
ccgggaaaucuucuacuuca

SEQ ID NO: 3737308 - RNA, 21 nt, Salmonella enterica enterica serovar Typhi Ty2
ccgggaaauggcaauggcggc

SEQ ID NO: 3737309 - RNA, 18 nt, Salmonella enterica enterica serovar Typhi Ty2
ccgggaaaugucuggcgc

SEQ ID NO: 3737310 - RNA, 13 nt, Salmonella enterica enterica serovar Typhi Ty2
ccgggaacuggca

SEQ ID NO: 3737311 - RNA, 23 nt, Salmonella enterica enterica serovar Typhi Ty2
ccgggacuuuaaacgucaugcug

SEQ ID NO: 3737312 - RNA, 15 nt, Salmonella enterica enterica serovar Typhi Ty2
ccgggauaaucaggu

SEQ ID NO: 3737313 - RNA, 14 nt, Salmonella enterica enterica serovar Typhi Ty2
ccgggauucaggga

SEQ ID NO: 3737314 - RNA, 21 nt, Salmonella enterica enterica serovar Typhi Ty2
ccgggcagacaucgccgugcu

SEQ ID NO: 3737315 - RNA, 22 nt, Salmonella enterica enterica serovar Typhi Ty2
ccgggcagcaucucgauuacag

SEQ ID NO: 3737316 - RNA, 16 nt, Salmonella enterica enterica serovar Typhi Ty2
ccgggcauaaaaaaag

SEQ ID NO: 3737317 - RNA, 11 nt, Salmonella enterica enterica serovar Typhi Ty2
ccgggcaucug

SEQ ID NO: 3737318 - RNA, 17 nt, Salmonella enterica enterica serovar Typhi Ty2
ccgggccaaugccgccu

SEQ ID NO: 3737319 - RNA, 12 nt, Salmonella enterica enterica serovar Typhi Ty2
ccgggccacucu

SEQ ID NO: 3737320 - RNA, 20 nt, Salmonella enterica enterica serovar Typhi Ty2
ccgggccaucuuuuuucacu

SEQ ID NO: 3737321 - RNA, 19 nt, Salmonella enterica enterica serovar Typhi Ty2
ccgggccgcuagcugcagc

SEQ ID NO: 3737322 - RNA, 16 nt, Salmonella enterica enterica serovar Typhi Ty2
ccgggccgugacacau

SEQ ID NO: 3737323 - RNA, 16 nt, Salmonella enterica enterica serovar Typhi Ty2
ccgggccugagcgcgc

SEQ ID NO: 3737324 - RNA, 16 nt, Salmonella enterica enterica serovar Typhi Ty2
ccgggccugccagguu

SEQ ID NO: 3737325 - RNA, 17 nt, Salmonella enterica enterica serovar Typhi Ty2
ccgggcgacacgcgcgc

SEQ ID NO: 3737326 - RNA, 18 nt, Salmonella enterica enterica serovar Typhi Ty2
ccgggcgacacgcgcgcu

SEQ ID NO: 3737327 - RNA, 13 nt, Salmonella enterica enterica serovar Typhi Ty2
ccgggcgaccacc

SEQ ID NO: 3737328 - RNA, 22 nt, Salmonella enterica enterica serovar Typhi Ty2
ccgggcgcaccaguuccccaua

SEQ ID NO: 3737329 - RNA, 16 nt, Salmonella enterica enterica serovar Typhi Ty2
ccgggcgcuuaccuaa

SEQ ID NO: 3737330 - RNA, 17 nt, Salmonella enterica enterica serovar Typhi Ty2
ccgggcggcgcagcgcg

SEQ ID NO: 3737331 - RNA, 16 nt, Salmonella enterica enterica serovar Typhi Ty2
ccgggcgucacccgcc

SEQ ID NO: 3737332 - RNA, 23 nt, Salmonella enterica enterica serovar Typhi Ty2
ccgggcucauuuuauccaacagc

SEQ ID NO: 3737333 - RNA, 18 nt, Salmonella enterica enterica serovar Typhi Ty2
ccgggcuggcaaacaggc

SEQ ID NO: 3737334 - RNA, 16 nt, Salmonella enterica enterica serovar Typhi Ty2
ccggggaagcgcgcgc

SEQ ID NO: 3737335 - RNA, 17 nt, Salmonella enterica enterica serovar Typhi Ty2
ccggggaagcgcgcgca

SEQ ID NO: 3737336 - RNA, 18 nt, Salmonella enterica enterica serovar Typhi Ty2
ccggggaucguucugcug

SEQ ID NO: 3737337 - RNA, 14 nt, Salmonella enterica enterica serovar Typhi Ty2
ccggggcgcgccgc

SEQ ID NO: 3737338 - RNA, 14 nt, Salmonella enterica enterica serovar Typhi Ty2
ccggggcuggcggc

SEQ ID NO: 3737339 - RNA, 17 nt, Salmonella enterica enterica serovar Typhi Ty2
ccggggcuggcggcgau

SEQ ID NO: 3737340 - RNA, 20 nt, Salmonella enterica enterica serovar Typhi Ty2
ccggggcuggcggcgauggc

SEQ ID NO: 3737341 - RNA, 20 nt, Salmonella enterica enterica serovar Typhi Ty2
ccgggguucgaauccccgcc

SEQ ID NO: 3737342 - RNA, 17 nt, Salmonella enterica enterica serovar Typhi Ty2
ccggguaaacgcagcgu

SEQ ID NO: 3737343 - RNA, 14 nt, Salmonella enterica enterica serovar Typhi Ty2
ccggguaaacgcca

SEQ ID NO: 3737344 - RNA, 15 nt, Salmonella enterica enterica serovar Typhi Ty2
ccggguaaacgccau

SEQ ID NO: 3737345 - RNA, 14 nt, Salmonella enterica enterica serovar Typhi Ty2
ccggguaauaaguu

SEQ ID NO: 3737346 - RNA, 21 nt, Salmonella enterica enterica serovar Typhi Ty2
ccggguaaugcugcagggccg

SEQ ID NO: 3737347 - RNA, 13 nt, Salmonella enterica enterica serovar Typhi Ty2
ccggguaggacau

SEQ ID NO: 3737348 - RNA, 23 nt, Salmonella enterica enterica serovar Typhi Ty2
ccggguaggacauagccgccacc

SEQ ID NO: 3737349 - RNA, 18 nt, Salmonella enterica enterica serovar Typhi Ty2
ccggguaucugggcggca

SEQ ID NO: 3737350 - RNA, 18 nt, Salmonella enterica enterica serovar Typhi Ty2
ccgggucagcccccaguu

SEQ ID NO: 3737351 - RNA, 22 nt, Salmonella enterica enterica serovar Typhi Ty2
ccgggucagcgggguucagacc

SEQ ID NO: 3737352 - RNA, 23 nt, Salmonella enterica enterica serovar Typhi Ty2
ccgucagggucuuauuucuccug

SEQ ID NO: 3737353 - RNA, 18 nt, Salmonella enterica enterica serovar Typhi Ty2
ccgucaguaccagcgaga

SEQ ID NO: 3737354 - RNA, 23 nt, Salmonella enterica enterica serovar Typhi Ty2
ccgucaguaccagcgagauaacc

SEQ ID NO: 3737355 - RNA, 20 nt, Salmonella enterica enterica serovar Typhi Ty2
ccgucauaaaaucaaucugc

SEQ ID NO: 3737356 - RNA, 18 nt, Salmonella enterica enterica serovar Typhi Ty2
ccgucauaaucgcgauac

SEQ ID NO: 3737357 - RNA, 16 nt, Salmonella enterica enterica serovar Typhi Ty2
ccgucauccagcagca

SEQ ID NO: 3737358 - RNA, 18 nt, Salmonella enterica enterica serovar Typhi Ty2
ccgucauccagcagcaga

SEQ ID NO: 3737359 - RNA, 17 nt, Salmonella enterica enterica serovar Typhi Ty2
ccgucauccugcaacuc

SEQ ID NO: 3737360 - RNA, 16 nt, Salmonella enterica enterica serovar Typhi Ty2
ccgucaucgacuucaa

SEQ ID NO: 3737361 - RNA, 17 nt, Salmonella enterica enterica serovar Typhi Ty2
ccgucaucgacuucgaa

SEQ ID NO: 3737362 - RNA, 16 nt, Salmonella enterica enterica serovar Typhi Ty2
ccgucaugcuucaccu

SEQ ID NO: 3737363 - RNA, 13 nt, Salmonella enterica enterica serovar Typhi Ty2
ccgucauggugau

SEQ ID NO: 3737364 - RNA, 20 nt, Salmonella enterica enterica serovar Typhi Ty2
ccguccauuucaaugcauac

SEQ ID NO: 3737365 - RNA, 23 nt, Salmonella enterica enterica serovar Typhi Ty2
ccgucccagcggaugucggucau

SEQ ID NO: 3737366 - RNA, 19 nt, Salmonella enterica enterica serovar Typhi Ty2
ccguccccagcccaucggu

SEQ ID NO: 3737367 - RNA, 18 nt, Salmonella enterica enterica serovar Typhi Ty2
ccguccggcuuuuuucac

SEQ ID NO: 3737368 - RNA, 21 nt, Salmonella enterica enterica serovar Typhi Ty2
ccgucgagaaaccgcucgccg

SEQ ID NO: 3737369 - RNA, 17 nt, Salmonella enterica enterica serovar Typhi Ty2
ccgucgauaaaauccuc

SEQ ID NO: 3737370 - RNA, 15 nt, Salmonella enterica enterica serovar Typhi Ty2
ccgucgaugauggcg

SEQ ID NO: 3737371 - RNA, 17 nt, Salmonella enterica enterica serovar Typhi Ty2
ccgucgaugauggcggc

SEQ ID NO: 3737372 - RNA, 19 nt, Salmonella enterica enterica serovar Typhi Ty2
ccgucgccaggccagaugg

SEQ ID NO: 3737373 - RNA, 23 nt, Salmonella enterica enterica serovar Typhi Ty2
ccgucgcgcccacgcgcggcauc

SEQ ID NO: 3737374 - RNA, 13 nt, Salmonella enterica enterica serovar Typhi Ty2
ccgucgcgcuuac

SEQ ID NO: 3737375 - RNA, 16 nt, Salmonella enterica enterica serovar Typhi Ty2
ccgucggcgccagcca

SEQ ID NO: 3737376 - RNA, 17 nt, Salmonella enterica enterica serovar Typhi Ty2
ccgucggcgccagccac

SEQ ID NO: 3737377 - RNA, 16 nt, Salmonella enterica enterica serovar Typhi Ty2
ccgucggcgucugcgc

SEQ ID NO: 3737378 - RNA, 17 nt, Salmonella enterica enterica serovar Typhi Ty2
ccgucguagccaccauc

SEQ ID NO: 3737379 - RNA, 19 nt, Salmonella enterica enterica serovar Typhi Ty2
ccgucgucaccgccgcgcu

SEQ ID NO: 3737380 - RNA, 21 nt, Salmonella enterica enterica serovar Typhi Ty2
ccgucgugacuaauagccaaa

SEQ ID NO: 3737381 - RNA, 16 nt, Salmonella enterica enterica serovar Typhi Ty2
ccgucgugccugcggu

SEQ ID NO: 3737382 - RNA, 22 nt, Salmonella enterica enterica serovar Typhi Ty2
ccgucgugccuuucaggcgcgg

SEQ ID NO: 3737383 - RNA, 18 nt, Salmonella enterica enterica serovar Typhi Ty2
ccgucguuaacaucauca

SEQ ID NO: 3737384 - RNA, 17 nt, Salmonella enterica enterica serovar Typhi Ty2
ccgucguuaaucagcgc

SEQ ID NO: 3737385 - RNA, 19 nt, Salmonella enterica enterica serovar Typhi Ty2
ccgucguuaaucagcgcgg

SEQ ID NO: 3737386 - RNA, 16 nt, Salmonella enterica enterica serovar Typhi Ty2
ccgucguuacccuccu

SEQ ID NO: 3737387 - RNA, 15 nt, Salmonella enterica enterica serovar Typhi Ty2
ccgucucaaccagca

SEQ ID NO: 3737388 - RNA, 22 nt, Salmonella enterica enterica serovar Typhi Ty2
ccgucuccuccuugugggcagc

SEQ ID NO: 3737389 - RNA, 20 nt, Salmonella enterica enterica serovar Typhi Ty2
ccgucucuuuaucuaacugc

SEQ ID NO: 3737390 - RNA, 17 nt, Salmonella enterica enterica serovar Typhi Ty2
ccgucucuuuuugcagc

SEQ ID NO: 3737391 - RNA, 14 nt, Salmonella enterica enterica serovar Typhi Ty2
ccgucugcaaaauu

SEQ ID NO: 3737392 - RNA, 18 nt, Salmonella enterica enterica serovar Typhi Ty2
ccgucuggcgugccgggc

SEQ ID NO: 3737393 - RNA, 18 nt, Salmonella enterica enterica serovar Typhi Ty2
ccgucuuacgaucccacg

SEQ ID NO: 3737394 - RNA, 14 nt, Salmonella enterica enterica serovar Typhi Ty2
ccgucuucagguca

SEQ ID NO: 3737395 - RNA, 22 nt, Salmonella enterica enterica serovar Typhi Ty2
ccgugaauaaugaccagcgccc

SEQ ID NO: 3737396 - RNA, 23 nt, Salmonella enterica enterica serovar Typhi Ty2
ccgugaaugcccggcggcgcgau

SEQ ID NO: 3737397 - RNA, 18 nt, Salmonella enterica enterica serovar Typhi Ty2
ccgugaauguccugcggc

SEQ ID NO: 3737398 - RNA, 16 nt, Salmonella enterica enterica serovar Typhi Ty2
ccgugaccgcguuauc

SEQ ID NO: 3737399 - RNA, 14 nt, Salmonella enterica enterica serovar Typhi Ty2
ccgugaccugcuga

SEQ ID NO: 3737400 - RNA, 14 nt, Salmonella enterica enterica serovar Typhi Ty2
ccgugacgccaggc

SEQ ID NO: 3737401 - RNA, 18 nt, Salmonella enterica enterica serovar Typhi Ty2
ccgugagaaucgaucagc

SEQ ID NO: 3737402 - RNA, 23 nt, Salmonella enterica enterica serovar Typhi Ty2
ccgugaugcggacgcugacgcca

SEQ ID NO: 3737403 - RNA, 21 nt, Salmonella enterica enterica serovar Typhi Ty2
ccgugcaaaaucacgcggcgc

SEQ ID NO: 3737404 - RNA, 23 nt, Salmonella enterica enterica serovar Typhi Ty2
ccgugcaguuuugcuucaugcac

SEQ ID NO: 3737405 - RNA, 17 nt, Salmonella enterica enterica serovar Typhi Ty2
ccgugccggauggcggc

SEQ ID NO: 3737406 - RNA, 16 nt, Salmonella enterica enterica serovar Typhi Ty2
ccgugccguguaaggc

SEQ ID NO: 3737407 - RNA, 14 nt, Salmonella enterica enterica serovar Typhi Ty2
ccgugccugcuccg

SEQ ID NO: 3737408 - RNA, 20 nt, Salmonella enterica enterica serovar Typhi Ty2
ccguggaaaagagcgucguu

SEQ ID NO: 3737409 - RNA, 16 nt, Salmonella enterica enterica serovar Typhi Ty2
ccguggccaaaaaauc

SEQ ID NO: 3737410 - RNA, 16 nt, Salmonella enterica enterica serovar Typhi Ty2
ccguggguggcaaggc

SEQ ID NO: 3737411 - RNA, 17 nt, Salmonella enterica enterica serovar Typhi Ty2
ccguggugggguucccg

SEQ ID NO: 3737412 - RNA, 14 nt, Salmonella enterica enterica serovar Typhi Ty2
ccguguccaaacug

SEQ ID NO: 3737413 - RNA, 18 nt, Salmonella enterica enterica serovar Typhi Ty2
ccguguucaugcagccau

SEQ ID NO: 3737414 - RNA, 19 nt, Salmonella enterica enterica serovar Typhi Ty2
ccguguugugugccgcgcu

SEQ ID NO: 3737415 - RNA, 22 nt, Salmonella enterica enterica serovar Typhi Ty2
ccguguuuuuuacaggcauccg

SEQ ID NO: 3737416 - RNA, 23 nt, Salmonella enterica enterica serovar Typhi Ty2
ccguuaaacugcgcgauaucugc

SEQ ID NO: 3737417 - RNA, 13 nt, Salmonella enterica enterica serovar Typhi Ty2
ccguuaagcccug

SEQ ID NO: 3737418 - RNA, 20 nt, Salmonella enterica enterica serovar Typhi Ty2
ccguuaauggaggcagugaa

SEQ ID NO: 3737419 - RNA, 13 nt, Salmonella enterica enterica serovar Typhi Ty2
ccguuaccagcau

SEQ ID NO: 3737420 - RNA, 14 nt, Salmonella enterica enterica serovar Typhi Ty2
ccguuacuuccccc

SEQ ID NO: 3737421 - RNA, 15 nt, Salmonella enterica enterica serovar Typhi Ty2
ccguuacuuccccca

SEQ ID NO: 3737422 - RNA, 21 nt, Salmonella enterica enterica serovar Typhi Ty2
ccguuaugaaucgcgugcgcu

SEQ ID NO: 3737423 - RNA, 14 nt, Salmonella enterica enterica serovar Typhi Ty2
ccguucacggcgau

SEQ ID NO: 3737424 - RNA, 17 nt, Salmonella enterica enterica serovar Typhi Ty2
ccguucaucggcauaca

SEQ ID NO: 3737425 - RNA, 19 nt, Salmonella enterica enterica serovar Typhi Ty2
ccguucaucgguaauauua

SEQ ID NO: 3737426 - RNA, 23 nt, Salmonella enterica enterica serovar Typhi Ty2
ccguucaucuaucgccagcgcgu

SEQ ID NO: 3737427 - RNA, 20 nt, Salmonella enterica enterica serovar Typhi Ty2
ccguucauucgccccagcau

SEQ ID NO: 3737428 - RNA, 15 nt, Salmonella enterica enterica serovar Typhi Ty2
ccguuccaccgccaa

SEQ ID NO: 3737429 - RNA, 17 nt, Salmonella enterica enterica serovar Typhi Ty2
ccguucugaccugcgca

SEQ ID NO: 3737430 - RNA, 18 nt, Salmonella enterica enterica serovar Typhi Ty2
ccguucugugcgccgcug

SEQ ID NO: 3737431 - RNA, 15 nt, Salmonella enterica enterica serovar Typhi Ty2
ccguugaccagcuga

SEQ ID NO: 3737432 - RNA, 19 nt, Salmonella enterica enterica serovar Typhi Ty2
ccguugccgggugcgcguc

SEQ ID NO: 3737433 - RNA, 17 nt, Salmonella enterica enterica serovar Typhi Ty2
ccguugcgcccaucauc

SEQ ID NO: 3737434 - RNA, 18 nt, Salmonella enterica enterica serovar Typhi Ty2
ccucaucccggcuuaaau

SEQ ID NO: 3737435 - RNA, 18 nt, Salmonella enterica enterica serovar Typhi Ty2
ccucaucccguagcguca

SEQ ID NO: 3737436 - RNA, 23 nt, Salmonella enterica enterica serovar Typhi Ty2
ccucaucgcuaccuucuucccau

SEQ ID NO: 3737437 - RNA, 15 nt, Salmonella enterica enterica serovar Typhi Ty2
ccucaucggcaaaca

SEQ ID NO: 3737438 - RNA, 22 nt, Salmonella enterica enterica serovar Typhi Ty2
ccucauuacuggaucgcuccau

SEQ ID NO: 3737439 - RNA, 16 nt, Salmonella enterica enterica serovar Typhi Ty2
ccucauuaguucaagu

SEQ ID NO: 3737440 - RNA, 20 nt, Salmonella enterica enterica serovar Typhi Ty2
ccucauucagcggcugcgcc

SEQ ID NO: 3737441 - RNA, 20 nt, Salmonella enterica enterica serovar Typhi Ty2
ccucauuuuguugcuccagc

SEQ ID NO: 3737442 - RNA, 21 nt, Salmonella enterica enterica serovar Typhi Ty2
ccucauuuuguugcuccagca

SEQ ID NO: 3737443 - RNA, 13 nt, Salmonella enterica enterica serovar Typhi Ty2
ccuccaauucagg

SEQ ID NO: 3737444 - RNA, 22 nt, Salmonella enterica enterica serovar Typhi Ty2
ccuccacgcccagcgccgagaa

SEQ ID NO: 3737445 - RNA, 20 nt, Salmonella enterica enterica serovar Typhi Ty2
ccuccagccauaaugcaauc

SEQ ID NO: 3737446 - RNA, 17 nt, Salmonella enterica enterica serovar Typhi Ty2
ccuccagcuccgcguau

SEQ ID NO: 3737447 - RNA, 20 nt, Salmonella enterica enterica serovar Typhi Ty2
ccuccaguaauucccggcag

SEQ ID NO: 3737448 - RNA, 14 nt, Salmonella enterica enterica serovar Typhi Ty2
ccuccauacacugc

SEQ ID NO: 3737449 - RNA, 14 nt, Salmonella enterica enterica serovar Typhi Ty2
ccuccauccaggua

SEQ ID NO: 3737450 - RNA, 13 nt, Salmonella enterica enterica serovar Typhi Ty2
ccuccaucgccag

SEQ ID NO: 3737451 - RNA, 13 nt, Salmonella enterica enterica serovar Typhi Ty2
ccucccaguuccc

SEQ ID NO: 3737452 - RNA, 13 nt, Salmonella enterica enterica serovar Typhi Ty2
ccuccccaggcgc

SEQ ID NO: 3737453 - RNA, 18 nt, Salmonella enterica enterica serovar Typhi Ty2
ccuccccaggcgcuauuc

SEQ ID NO: 3737454 - RNA, 23 nt, Salmonella enterica enterica serovar Typhi Ty2
ccucccggugcgggaggaauaaa

SEQ ID NO: 3737455 - RNA, 22 nt, Salmonella enterica enterica serovar Typhi Ty2
ccucccguuucagugacgcguu

SEQ ID NO: 3737456 - RNA, 17 nt, Salmonella enterica enterica serovar Typhi Ty2
ccuccgccgaucagcac

SEQ ID NO: 3737457 - RNA, 17 nt, Salmonella enterica enterica serovar Typhi Ty2
ccuccgcgcagcaacag

SEQ ID NO: 3737458 - RNA, 17 nt, Salmonella enterica enterica serovar Typhi Ty2
ccuccgcguaccucagc

SEQ ID NO: 3737459 - RNA, 19 nt, Salmonella enterica enterica serovar Typhi Ty2
ccuccgcguaccucagcau

SEQ ID NO: 3737460 - RNA, 23 nt, Salmonella enterica enterica serovar Typhi Ty2
ccuccgcguagcccagcgccgca

SEQ ID NO: 3737461 - RNA, 19 nt, Salmonella enterica enterica serovar Typhi Ty2
ccuccgcuuccugcgccag

SEQ ID NO: 3737462 - RNA, 18 nt, Salmonella enterica enterica serovar Typhi Ty2
ccuccggaucgacagcaa

SEQ ID NO: 3737463 - RNA, 17 nt, Salmonella enterica enterica serovar Typhi Ty2
ccuccggaugacgccgc

SEQ ID NO: 3737464 - RNA, 13 nt, Salmonella enterica enterica serovar Typhi Ty2
ccuccggcacaca

SEQ ID NO: 3737465 - RNA, 22 nt, Salmonella enterica enterica serovar Typhi Ty2
ccuccggcagaaaugaccacgu

SEQ ID NO: 3737466 - RNA, 16 nt, Salmonella enterica enterica serovar Typhi Ty2
ccuccggccagcgcca

SEQ ID NO: 3737467 - RNA, 17 nt, Salmonella enterica enterica serovar Typhi Ty2
ccuccggccagcgccag

SEQ ID NO: 3737468 - RNA, 18 nt, Salmonella enterica enterica serovar Typhi Ty2
ccuccggcgagcgaugcu

SEQ ID NO: 3737469 - RNA, 13 nt, Salmonella enterica enterica serovar Typhi Ty2
ccuccggcuucag

SEQ ID NO: 3737470 - RNA, 19 nt, Salmonella enterica enterica serovar Typhi Ty2
ccuccggugaagguaauuu

SEQ ID NO: 3737471 - RNA, 17 nt, Salmonella enterica enterica serovar Typhi Ty2
ccuccucauucagcggc

SEQ ID NO: 3737472 - RNA, 15 nt, Salmonella enterica enterica serovar Typhi Ty2
ccuccuggcguuauc

SEQ ID NO: 3737473 - RNA, 16 nt, Salmonella enterica enterica serovar Typhi Ty2
ccuccuuguaagggag

SEQ ID NO: 3737474 - RNA, 20 nt, Salmonella enterica enterica serovar Typhi Ty2
ccuccuuguaagggaggugc

SEQ ID NO: 3737475 - RNA, 14 nt, Salmonella enterica enterica serovar Typhi Ty2
ccuccuuuccugug

SEQ ID NO: 3737476 - RNA, 14 nt, Salmonella enterica enterica serovar Typhi Ty2
ccucgaaguauuac

SEQ ID NO: 3737477 - RNA, 19 nt, Salmonella enterica enterica serovar Typhi Ty2
ccucgacaauuucaccuuu

SEQ ID NO: 3737478 - RNA, 16 nt, Salmonella enterica enterica serovar Typhi Ty2
ccucgaccaguuuuuc

SEQ ID NO: 3737479 - RNA, 13 nt, Salmonella enterica enterica serovar Typhi Ty2
ccucgaccccuuc

SEQ ID NO: 3737480 - RNA, 21 nt, Salmonella enterica enterica serovar Typhi Ty2
ccucgauggcauuguccuuua

SEQ ID NO: 3737481 - RNA, 19 nt, Salmonella enterica enterica serovar Typhi Ty2
ccucgcauccuccauccag

SEQ ID NO: 3737482 - RNA, 16 nt, Salmonella enterica enterica serovar Typhi Ty2
ccucgccaaagcagcg

SEQ ID NO: 3737483 - RNA, 20 nt, Salmonella enterica enterica serovar Typhi Ty2
ccucgcgcauccgggccgcu

SEQ ID NO: 3737484 - RNA, 16 nt, Salmonella enterica enterica serovar Typhi Ty2
ccucgcgcggcgguuc

SEQ ID NO: 3737485 - RNA, 17 nt, Salmonella enterica enterica serovar Typhi Ty2
ccucgcguagcgccaac

SEQ ID NO: 3737486 - RNA, 15 nt, Salmonella enterica enterica serovar Typhi Ty2
ccucgcuaaugcccg

SEQ ID NO: 3737487 - RNA, 22 nt, Salmonella enterica enterica serovar Typhi Ty2
ccucgcuacuggcaaaugaagc

SEQ ID NO: 3737488 - RNA, 23 nt, Salmonella enterica enterica serovar Typhi Ty2
ccucgcucucuuucaccagcgcc

SEQ ID NO: 3737489 - RNA, 17 nt, Salmonella enterica enterica serovar Typhi Ty2
ccucgcuuaaaccacca

SEQ ID NO: 3737490 - RNA, 17 nt, Salmonella enterica enterica serovar Typhi Ty2
ccucguaucugucccag

SEQ ID NO: 3737491 - RNA, 13 nt, Salmonella enterica enterica serovar Typhi Ty2
ccucgucuugauu

SEQ ID NO: 3737492 - RNA, 19 nt, Salmonella enterica enterica serovar Typhi Ty2
ccucguucggcgcaccugu

SEQ ID NO: 3737493 - RNA, 17 nt, Salmonella enterica enterica serovar Typhi Ty2
ccucguugauguuuuua

SEQ ID NO: 3737494 - RNA, 15 nt, Salmonella enterica enterica serovar Typhi Ty2
ccucuaccuacacau

SEQ ID NO: 3737495 - RNA, 22 nt, Salmonella enterica enterica serovar Typhi Ty2
ccucuauaguaaauugacgcuu

SEQ ID NO: 3737496 - RNA, 13 nt, Salmonella enterica enterica serovar Typhi Ty2
ccucuaucuucuc

SEQ ID NO: 3737497 - RNA, 18 nt, Salmonella enterica enterica serovar Typhi Ty2
ccucuaucuuuucaauca

SEQ ID NO: 3737498 - RNA, 22 nt, Salmonella enterica enterica serovar Typhi Ty2
ccucucccacugcgaacgcauc

SEQ ID NO: 3737499 - RNA, 22 nt, Salmonella enterica enterica serovar Typhi Ty2
ccucucccgaacugucugaauc

SEQ ID NO: 3737500 - RNA, 19 nt, Salmonella enterica enterica serovar Typhi Ty2
ccucugauuggcuguuagu

SEQ ID NO: 3737501 - RNA, 16 nt, Salmonella enterica enterica serovar Typhi Ty2
ccucugcaccagaacu

SEQ ID NO: 3737502 - RNA, 20 nt, Salmonella enterica enterica serovar Typhi Ty2
ccucugcaccagaacucccu

SEQ ID NO: 3737503 - RNA, 13 nt, Salmonella enterica enterica serovar Typhi Ty2
ccucuuaucaggc

SEQ ID NO: 3737504 - RNA, 23 nt, Salmonella enterica enterica serovar Typhi Ty2
ccucuucauagcguuuuuucauc

SEQ ID NO: 3737505 - RNA, 13 nt, Salmonella enterica enterica serovar Typhi Ty2
ccucuuccgccag

SEQ ID NO: 3737506 - RNA, 18 nt, Salmonella enterica enterica serovar Typhi Ty2
ccucuuccgccaggucgc

SEQ ID NO: 3737507 - RNA, 22 nt, Salmonella enterica enterica serovar Typhi Ty2
ccucuuccucgauaucuucaua

SEQ ID NO: 3737508 - RNA, 20 nt, Salmonella enterica enterica serovar Typhi Ty2
ccucuucuuuuaauugccag

SEQ ID NO: 3737509 - RNA, 13 nt, Salmonella enterica enterica serovar Typhi Ty2
ccucuugugcgac

SEQ ID NO: 3737510 - RNA, 17 nt, Salmonella enterica enterica serovar Typhi Ty2
ccucuuucaugcggucu

SEQ ID NO: 3737511 - RNA, 12 nt, Salmonella enterica enterica serovar Typhi Ty2
ccucuuuccguu

SEQ ID NO: 3737512 - RNA, 14 nt, Salmonella enterica enterica serovar Typhi Ty2
ccucuuucgccauu

SEQ ID NO: 3737513 - RNA, 15 nt, Salmonella enterica enterica serovar Typhi Ty2
ccucuuucugauaac

SEQ ID NO: 3737514 - RNA, 21 nt, Salmonella enterica enterica serovar Typhi Ty2
ccucuuuugucguccccugga

SEQ ID NO: 3737515 - RNA, 12 nt, Salmonella enterica enterica serovar Typhi Ty2
ccugaaacgcgg

SEQ ID NO: 3737516 - RNA, 22 nt, Salmonella enterica enterica serovar Typhi Ty2
ccugcaacuccugggcaaaaua

SEQ ID NO: 3737517 - RNA, 23 nt, Salmonella enterica enterica serovar Typhi Ty2
ccugcacguuacccgccagucgg

SEQ ID NO: 3737518 - RNA, 13 nt, Salmonella enterica enterica serovar Typhi Ty2
ccugcacuuccag

SEQ ID NO: 3737519 - RNA, 22 nt, Salmonella enterica enterica serovar Typhi Ty2
ccugcacuuccagccacggcgu

SEQ ID NO: 3737520 - RNA, 17 nt, Salmonella enterica enterica serovar Typhi Ty2
ccugcaggcgagugcua

SEQ ID NO: 3737521 - RNA, 17 nt, Salmonella enterica enterica serovar Typhi Ty2
ccugcagggaauaagcg

SEQ ID NO: 3737522 - RNA, 20 nt, Salmonella enterica enterica serovar Typhi Ty2
ccugcagggaauaagcgccc

SEQ ID NO: 3737523 - RNA, 22 nt, Salmonella enterica enterica serovar Typhi Ty2
ccugcagggaauaagcgcccau

SEQ ID NO: 3737524 - RNA, 15 nt, Salmonella enterica enterica serovar Typhi Ty2
ccugcaggguaauua

SEQ ID NO: 3737525 - RNA, 19 nt, Salmonella enterica enterica serovar Typhi Ty2
ccugcaggguuugcgcaga

SEQ ID NO: 3737526 - RNA, 16 nt, Salmonella enterica enterica serovar Typhi Ty2
ccugcaguauuucaga

SEQ ID NO: 3737527 - RNA, 22 nt, Salmonella enterica enterica serovar Typhi Ty2
ccugcauaauugcugacagcau

SEQ ID NO: 3737528 - RNA, 23 nt, Salmonella enterica enterica serovar Typhi Ty2
ccugcauauauccuaacuuauua

SEQ ID NO: 3737529 - RNA, 14 nt, Salmonella enterica enterica serovar Typhi Ty2
ccugcaucaacagg

SEQ ID NO: 3737530 - RNA, 12 nt, Salmonella enterica enterica serovar Typhi Ty2
ccugcaucacgc

SEQ ID NO: 3737531 - RNA, 20 nt, Salmonella enterica enterica serovar Typhi Ty2
ccugcaucacgcccggcggu

SEQ ID NO: 3737532 - RNA, 19 nt, Salmonella enterica enterica serovar Typhi Ty2
ccugcaucgauuccccacc

SEQ ID NO: 3737533 - RNA, 20 nt, Salmonella enterica enterica serovar Typhi Ty2
ccugcauuaacggcaacagu

SEQ ID NO: 3737534 - RNA, 14 nt, Salmonella enterica enterica serovar Typhi Ty2
ccugcauuauccac

SEQ ID NO: 3737535 - RNA, 22 nt, Salmonella enterica enterica serovar Typhi Ty2
ccugccacaacggcaauuuuua

SEQ ID NO: 3737536 - RNA, 16 nt, Salmonella enterica enterica serovar Typhi Ty2
ccugccacaggccaac

SEQ ID NO: 3737537 - RNA, 14 nt, Salmonella enterica enterica serovar Typhi Ty2
ccugccaccagcgu

SEQ ID NO: 3737538 - RNA, 21 nt, Salmonella enterica enterica serovar Typhi Ty2
ccugccagcaacccaccugcc

SEQ ID NO: 3737539 - RNA, 18 nt, Salmonella enterica enterica serovar Typhi Ty2
ccugccagcauuaacccg

SEQ ID NO: 3737540 - RNA, 16 nt, Salmonella enterica enterica serovar Typhi Ty2
ccugccaggccggacu

SEQ ID NO: 3737541 - RNA, 16 nt, Salmonella enterica enterica serovar Typhi Ty2
ccugccaguccgcccg

SEQ ID NO: 3737542 - RNA, 21 nt, Salmonella enterica enterica serovar Typhi Ty2
ccugccauucacgcuggguga

SEQ ID NO: 3737543 - RNA, 20 nt, Salmonella enterica enterica serovar Typhi Ty2
ccugccauucccagccgagc

SEQ ID NO: 3737544 - RNA, 19 nt, Salmonella enterica enterica serovar Typhi Ty2
ccugcccacuuugccauga

SEQ ID NO: 3737545 - RNA, 15 nt, Salmonella enterica enterica serovar Typhi Ty2
ccugccccgcucgaa

SEQ ID NO: 3737546 - RNA, 21 nt, Salmonella enterica enterica serovar Typhi Ty2
ccugccccgcucgaaaccauc

SEQ ID NO: 3737547 - RNA, 12 nt, Salmonella enterica enterica serovar Typhi Ty2
ccugcccuuuca

SEQ ID NO: 3737548 - RNA, 15 nt, Salmonella enterica enterica serovar Typhi Ty2
ccugcccuuucuuca

SEQ ID NO: 3737549 - RNA, 15 nt, Salmonella enterica enterica serovar Typhi Ty2
ccugccgcgccgccg

SEQ ID NO: 3737550 - RNA, 17 nt, Salmonella enterica enterica serovar Typhi Ty2
ccugccggaaaaugcgc

SEQ ID NO: 3737551 - RNA, 22 nt, Salmonella enterica enterica serovar Typhi Ty2
ccugccggauuuuacauagcag

SEQ ID NO: 3737552 - RNA, 15 nt, Salmonella enterica enterica serovar Typhi Ty2
ccugccggcggcaga

SEQ ID NO: 3737553 - RNA, 20 nt, Salmonella enterica enterica serovar Typhi Ty2
ccugccgucgcggcuuucag

SEQ ID NO: 3737554 - RNA, 13 nt, Salmonella enterica enterica serovar Typhi Ty2
ccugccucaacau

SEQ ID NO: 3737555 - RNA, 23 nt, Salmonella enterica enterica serovar Typhi Ty2
ccugccugaagcgcaguguuaau

SEQ ID NO: 3737556 - RNA, 10 nt, Salmonella enterica enterica serovar Typhi Ty2
ccugccuguu

SEQ ID NO: 3737557 - RNA, 18 nt, Salmonella enterica enterica serovar Typhi Ty2
ccugccuuucccauccgc

SEQ ID NO: 3737558 - RNA, 21 nt, Salmonella enterica enterica serovar Typhi Ty2
ccugccuuugucacccgcuuu

SEQ ID NO: 3737559 - RNA, 21 nt, Salmonella enterica enterica serovar Typhi Ty2
ccugcgaaaagcgugcgccuu

SEQ ID NO: 3737560 - RNA, 14 nt, Salmonella enterica enterica serovar Typhi Ty2
ccugcgaucaucau

SEQ ID NO: 3737561 - RNA, 22 nt, Salmonella enterica enterica serovar Typhi Ty2
ccugcgaucugugucguccagg

SEQ ID NO: 3737562 - RNA, 20 nt, Salmonella enterica enterica serovar Typhi Ty2
ccugcgccaggauaucgccc

SEQ ID NO: 3737563 - RNA, 14 nt, Salmonella enterica enterica serovar Typhi Ty2
ccugcgcgccugac

SEQ ID NO: 3737564 - RNA, 14 nt, Salmonella enterica enterica serovar Typhi Ty2
ccugcgcguaaauu

SEQ ID NO: 3737565 - RNA, 17 nt, Salmonella enterica enterica serovar Typhi Ty2
ccugcgcugauuuucuc

SEQ ID NO: 3737566 - RNA, 15 nt, Salmonella enterica enterica serovar Typhi Ty2
ccugcgcuuugacau

SEQ ID NO: 3737567 - RNA, 23 nt, Salmonella enterica enterica serovar Typhi Ty2
ccugcgcuuuggguuaaugccag

SEQ ID NO: 3737568 - RNA, 15 nt, Salmonella enterica enterica serovar Typhi Ty2
ccugcggaaccgccc

SEQ ID NO: 3737569 - RNA, 23 nt, Salmonella enterica enterica serovar Typhi Ty2
ccugcggacgcagcucauacccu

SEQ ID NO: 3737570 - RNA, 20 nt, Salmonella enterica enterica serovar Typhi Ty2
ccugcggccaugaucgccgc

SEQ ID NO: 3737571 - RNA, 23 nt, Salmonella enterica enterica serovar Typhi Ty2
ccugcggccaugaucgccgccau

SEQ ID NO: 3737572 - RNA, 13 nt, Salmonella enterica enterica serovar Typhi Ty2
ccugcggccccag

SEQ ID NO: 3737573 - RNA, 15 nt, Salmonella enterica enterica serovar Typhi Ty2
ccugcggccucgccu

SEQ ID NO: 3737574 - RNA, 17 nt, Salmonella enterica enterica serovar Typhi Ty2
ccugcggcgcgcccggc

SEQ ID NO: 3737575 - RNA, 16 nt, Salmonella enterica enterica serovar Typhi Ty2
ccugcggcguggaaaa

SEQ ID NO: 3737576 - RNA, 14 nt, Salmonella enterica enterica serovar Typhi Ty2
ccugcggcugauug

SEQ ID NO: 3737577 - RNA, 18 nt, Salmonella enterica enterica serovar Typhi Ty2
ccugcggguucaucgcca

SEQ ID NO: 3737578 - RNA, 20 nt, Salmonella enterica enterica serovar Typhi Ty2
ccugcgguaaucgccgcgac

SEQ ID NO: 3737579 - RNA, 15 nt, Salmonella enterica enterica serovar Typhi Ty2
ccugcgguagcgccg

SEQ ID NO: 3737580 - RNA, 18 nt, Salmonella enterica enterica serovar Typhi Ty2
ccugcgguuucuaccacc

SEQ ID NO: 3737581 - RNA, 22 nt, Salmonella enterica enterica serovar Typhi Ty2
ccugcgguuucuaccacccagc

SEQ ID NO: 3737582 - RNA, 14 nt, Salmonella enterica enterica serovar Typhi Ty2
ccugcgucacagac

SEQ ID NO: 3737583 - RNA, 23 nt, Salmonella enterica enterica serovar Typhi Ty2
ccugcgugccguugaccagcuga

SEQ ID NO: 3737584 - RNA, 16 nt, Salmonella enterica enterica serovar Typhi Ty2
ccugcguuugcggauc

SEQ ID NO: 3737585 - RNA, 14 nt, Salmonella enterica enterica serovar Typhi Ty2
ccugcucaaucgca

SEQ ID NO: 3737586 - RNA, 17 nt, Salmonella enterica enterica serovar Typhi Ty2
ccugcucuggacguuga

SEQ ID NO: 3737587 - RNA, 21 nt, Salmonella enterica enterica serovar Typhi Ty2
ccugcugacuacgguugccuu

SEQ ID NO: 3737588 - RNA, 23 nt, Salmonella enterica enterica serovar Typhi Ty2
ccugcugcaacauugcaggucug

SEQ ID NO: 3737589 - RNA, 18 nt, Salmonella enterica enterica serovar Typhi Ty2
ccugcugccagccgccgc

SEQ ID NO: 3737590 - RNA, 18 nt, Salmonella enterica enterica serovar Typhi Ty2
ccugcugccaucgcuucu

SEQ ID NO: 3737591 - RNA, 13 nt, Salmonella enterica enterica serovar Typhi Ty2
ccugcugcgccag

SEQ ID NO: 3737592 - RNA, 18 nt, Salmonella enterica enterica serovar Typhi Ty2
ccugcugcggauaacguu

SEQ ID NO: 3737593 - RNA, 16 nt, Salmonella enterica enterica serovar Typhi Ty2
ccugcuggcaaaacgc

SEQ ID NO: 3737594 - RNA, 16 nt, Salmonella enterica enterica serovar Typhi Ty2
ccugcuggcgcaugau

SEQ ID NO: 3737595 - RNA, 21 nt, Salmonella enterica enterica serovar Typhi Ty2
ccugcuggucugaaucugcuc

SEQ ID NO: 3737596 - RNA, 15 nt, Salmonella enterica enterica serovar Typhi Ty2
ccugcuguaaccccu

SEQ ID NO: 3737597 - RNA, 16 nt, Salmonella enterica enterica serovar Typhi Ty2
ccugcuguaaccccug

SEQ ID NO: 3737598 - RNA, 14 nt, Salmonella enterica enterica serovar Typhi Ty2
ccugugcuuugauu

SEQ ID NO: 3737599 - RNA, 20 nt, Salmonella enterica enterica serovar Typhi Ty2
ccuguggcuguugguuuauu

SEQ ID NO: 3737600 - RNA, 18 nt, Salmonella enterica enterica serovar Typhi Ty2
ccuguguaaugaaagaaa

SEQ ID NO: 3737601 - RNA, 19 nt, Salmonella enterica enterica serovar Typhi Ty2
ccugugucggcagaugaug

SEQ ID NO: 3737602 - RNA, 16 nt, Salmonella enterica enterica serovar Typhi Ty2
ccuguuauucaauucu

SEQ ID NO: 3737603 - RNA, 14 nt, Salmonella enterica enterica serovar Typhi Ty2
ccuguuauucaggg

SEQ ID NO: 3737604 - RNA, 16 nt, Salmonella enterica enterica serovar Typhi Ty2
ccuguucaaaagccug

SEQ ID NO: 3737605 - RNA, 12 nt, Salmonella enterica enterica serovar Typhi Ty2
ccuguucaagug

SEQ ID NO: 3737606 - RNA, 21 nt, Salmonella enterica enterica serovar Typhi Ty2
ccuguucaaguggcaaucgac

SEQ ID NO: 3737607 - RNA, 14 nt, Salmonella enterica enterica serovar Typhi Ty2
ccuguucaucggcu

SEQ ID NO: 3737608 - RNA, 15 nt, Salmonella enterica enterica serovar Typhi Ty2
ccuguucaugccaga

SEQ ID NO: 3737609 - RNA, 14 nt, Salmonella enterica enterica serovar Typhi Ty2
ccuguucgcuuauu

SEQ ID NO: 3737610 - RNA, 22 nt, Salmonella enterica enterica serovar Typhi Ty2
ccuguugcgggccagcagccag

SEQ ID NO: 3737611 - RNA, 13 nt, Salmonella enterica enterica serovar Typhi Ty2
ccuguuuauauuc

SEQ ID NO: 3737612 - RNA, 22 nt, Salmonella enterica enterica serovar Typhi Ty2
ccuguuucgccaggccgcggcu

SEQ ID NO: 3737613 - RNA, 15 nt, Salmonella enterica enterica serovar Typhi Ty2
ccuguuucgcccgcu

SEQ ID NO: 3737614 - RNA, 24 nt, Salmonella enterica enterica serovar Typhi Ty2
ccuguuucuuaccacgccgcgacu

SEQ ID NO: 3737615 - RNA, 15 nt, Salmonella enterica enterica serovar Typhi Ty2
ccuuaaugucaucau

SEQ ID NO: 3737616 - RNA, 24 nt, Salmonella enterica enterica serovar Typhi Ty2
ccuuaauuugugauugcagauaau

SEQ ID NO: 3737617 - RNA, 14 nt, Salmonella enterica enterica serovar Typhi Ty2
ccuuacaggcgcau

SEQ ID NO: 3737618 - RNA, 18 nt, Salmonella enterica enterica serovar Typhi Ty2
ccuuacaggcgcaucaga

SEQ ID NO: 3737619 - RNA, 17 nt, Salmonella enterica enterica serovar Typhi Ty2
ccuuacccggccugcgu

SEQ ID NO: 3737620 - RNA, 18 nt, Salmonella enterica enterica serovar Typhi Ty2
ccuuaggccgucagacau

SEQ ID NO: 3737621 - RNA, 17 nt, Salmonella enterica enterica serovar Typhi Ty2
ccuuauauuccgcgcau

SEQ ID NO: 3737622 - RNA, 17 nt, Salmonella enterica enterica serovar Typhi Ty2
ccuuauccggcguguaa

SEQ ID NO: 3737623 - RNA, 22 nt, Salmonella enterica enterica serovar Typhi Ty2
ccuuaucgagugucaauaagcc

SEQ ID NO: 3737624 - RNA, 18 nt, Salmonella enterica enterica serovar Typhi Ty2
ccuuaucggagucuuauc

SEQ ID NO: 3737625 - RNA, 22 nt, Salmonella enterica enterica serovar Typhi Ty2
ccuuaugggucacauccagaca

SEQ ID NO: 3737626 - RNA, 14 nt, Salmonella enterica enterica serovar Typhi Ty2
ccuuaugucauuca

SEQ ID NO: 3737627 - RNA, 18 nt, Salmonella enterica enterica serovar Typhi Ty2
ccuuauucccauuccugc

SEQ ID NO: 3737628 - RNA, 17 nt, Salmonella enterica enterica serovar Typhi Ty2
ccuucaaauauauugaa

SEQ ID NO: 3737629 - RNA, 20 nt, Salmonella enterica enterica serovar Typhi Ty2
ccuucaaauauauugaaaag

SEQ ID NO: 3737630 - RNA, 22 nt, Salmonella enterica enterica serovar Typhi Ty2
ccuucaacccagcagcagauaa

SEQ ID NO: 3737631 - RNA, 20 nt, Salmonella enterica enterica serovar Typhi Ty2
ccuucaauaucaacgaccgu

SEQ ID NO: 3737632 - RNA, 22 nt, Salmonella enterica enterica serovar Typhi Ty2
ccuucaaucacaaaauggcuga

SEQ ID NO: 3737633 - RNA, 22 nt, Salmonella enterica enterica serovar Typhi Ty2
ccuucaaucacgcccgcagcaa

SEQ ID NO: 3737634 - RNA, 16 nt, Salmonella enterica enterica serovar Typhi Ty2
ccuucacccccaucgc

SEQ ID NO: 3737635 - RNA, 14 nt, Salmonella enterica enterica serovar Typhi Ty2
ccuucacgccgcca

SEQ ID NO: 3737636 - RNA, 15 nt, Salmonella enterica enterica serovar Typhi Ty2
ccuucacgccgccaa

SEQ ID NO: 3737637 - RNA, 16 nt, Salmonella enterica enterica serovar Typhi Ty2
ccuucacggucaaacg

SEQ ID NO: 3737638 - RNA, 20 nt, Salmonella enterica enterica serovar Typhi Ty2
ccuucagaaaauuauuuuca

SEQ ID NO: 3737639 - RNA, 22 nt, Salmonella enterica enterica serovar Typhi Ty2
ccuucagauucaaacugauaag

SEQ ID NO: 3737640 - RNA, 13 nt, Salmonella enterica enterica serovar Typhi Ty2
ccuucaggcauca

SEQ ID NO: 3737641 - RNA, 22 nt, Salmonella enterica enterica serovar Typhi Ty2
ccuucagugauaaagcacagcc

SEQ ID NO: 3737642 - RNA, 23 nt, Salmonella enterica enterica serovar Typhi Ty2
ccuucauaaugaauacgcuccag

SEQ ID NO: 3737643 - RNA, 15 nt, Salmonella enterica enterica serovar Typhi Ty2
ccuucauacugcgga

SEQ ID NO: 3737644 - RNA, 21 nt, Salmonella enterica enterica serovar Typhi Ty2
ccuucauuguccucggcaaca

SEQ ID NO: 3737645 - RNA, 15 nt, Salmonella enterica enterica serovar Typhi Ty2
ccuuccagaaauaaa

SEQ ID NO: 3737646 - RNA, 18 nt, Salmonella enterica enterica serovar Typhi Ty2
ccuuccaguaguaaaccg

SEQ ID NO: 3737647 - RNA, 13 nt, Salmonella enterica enterica serovar Typhi Ty2
ccuuccaucgcau

SEQ ID NO: 3737648 - RNA, 15 nt, Salmonella enterica enterica serovar Typhi Ty2
ccuuccccggcagcc

SEQ ID NO: 3737649 - RNA, 23 nt, Salmonella enterica enterica serovar Typhi Ty2
ccuuccccggcagccucaggccu

SEQ ID NO: 3737650 - RNA, 19 nt, Salmonella enterica enterica serovar Typhi Ty2
ccuuccgcaagcucaccau

SEQ ID NO: 3737651 - RNA, 19 nt, Salmonella enterica enterica serovar Typhi Ty2
ccuuccucauuuuugccca

SEQ ID NO: 3737652 - RNA, 20 nt, Salmonella enterica enterica serovar Typhi Ty2
ccuuccucgucggcaagaau

SEQ ID NO: 3737653 - RNA, 16 nt, Salmonella enterica enterica serovar Typhi Ty2
ccuuccuggucugcca

SEQ ID NO: 3737654 - RNA, 15 nt, Salmonella enterica enterica serovar Typhi Ty2
ccuucgacaaucagc

SEQ ID NO: 3737655 - RNA, 24 nt, Salmonella enterica enterica serovar Typhi Ty2
ccuucgauaguccauuuuccuaug

SEQ ID NO: 3737656 - RNA, 17 nt, Salmonella enterica enterica serovar Typhi Ty2
ccuucgaugaucaugcg

SEQ ID NO: 3737657 - RNA, 17 nt, Salmonella enterica enterica serovar Typhi Ty2
ccuucgcauagccggau

SEQ ID NO: 3737658 - RNA, 14 nt, Salmonella enterica enterica serovar Typhi Ty2
ccuucgcccggcgc

SEQ ID NO: 3737659 - RNA, 13 nt, Salmonella enterica enterica serovar Typhi Ty2
ccuucgccgccca

SEQ ID NO: 3737660 - RNA, 14 nt, Salmonella enterica enterica serovar Typhi Ty2
ccuucgccgccgcu

SEQ ID NO: 3737661 - RNA, 19 nt, Salmonella enterica enterica serovar Typhi Ty2
ccuucgccggguugagcga

SEQ ID NO: 3737662 - RNA, 13 nt, Salmonella enterica enterica serovar Typhi Ty2
ccuucgccuucac

SEQ ID NO: 3737663 - RNA, 14 nt, Salmonella enterica enterica serovar Typhi Ty2
ccuucgccuucacg

SEQ ID NO: 3737664 - RNA, 19 nt, Salmonella enterica enterica serovar Typhi Ty2
ccuucgcggugaucccagg

SEQ ID NO: 3737665 - RNA, 18 nt, Salmonella enterica enterica serovar Typhi Ty2
ccuucgggcgauuuuugc

SEQ ID NO: 3737666 - RNA, 21 nt, Salmonella enterica enterica serovar Typhi Ty2
ccuucggugaaaucacgaccg

SEQ ID NO: 3737667 - RNA, 17 nt, Salmonella enterica enterica serovar Typhi Ty2
ccuucgguuuuauauuc

SEQ ID NO: 3737668 - RNA, 18 nt, Salmonella enterica enterica serovar Typhi Ty2
ccuucguuauaaggccug

SEQ ID NO: 3737669 - RNA, 22 nt, Salmonella enterica enterica serovar Typhi Ty2
ccuucuaauuccaggaugacca

SEQ ID NO: 3737670 - RNA, 16 nt, Salmonella enterica enterica serovar Typhi Ty2
ccuucuccgguaauca

SEQ ID NO: 3737671 - RNA, 11 nt, Salmonella enterica enterica serovar Typhi Ty2
ccuucuccuuc

SEQ ID NO: 3737672 - RNA, 17 nt, Salmonella enterica enterica serovar Typhi Ty2
ccuucuccuucgccaaa

SEQ ID NO: 3737673 - RNA, 22 nt, Salmonella enterica enterica serovar Typhi Ty2
ccuucucuccuagaaacccauu

SEQ ID NO: 3737674 - RNA, 17 nt, Salmonella enterica enterica serovar Typhi Ty2
ccuucucuuuaugcguc

SEQ ID NO: 3737675 - RNA, 21 nt, Salmonella enterica enterica serovar Typhi Ty2
ccuucugcgcccgccugcugu

SEQ ID NO: 3737676 - RNA, 19 nt, Salmonella enterica enterica serovar Typhi Ty2
ccuucugguagccagacau

SEQ ID NO: 3737677 - RNA, 21 nt, Salmonella enterica enterica serovar Typhi Ty2
ccuucuguaagcaauuaauau

SEQ ID NO: 3737678 - RNA, 15 nt, Salmonella enterica enterica serovar Typhi Ty2
ccuucuucacccacu

SEQ ID NO: 3737679 - RNA, 18 nt, Salmonella enterica enterica serovar Typhi Ty2
ccuucuucaucuucaccu

SEQ ID NO: 3737680 - RNA, 14 nt, Salmonella enterica enterica serovar Typhi Ty2
cgaaauugccgccc

SEQ ID NO: 3737681 - RNA, 18 nt, Salmonella enterica enterica serovar Typhi Ty2
cgaaauuggaguuaucau

SEQ ID NO: 3737682 - RNA, 18 nt, Salmonella enterica enterica serovar Typhi Ty2
cgaaauuggccaucaggu

SEQ ID NO: 3737683 - RNA, 17 nt, Salmonella enterica enterica serovar Typhi Ty2
cgaaauuuucuucuucg

SEQ ID NO: 3737684 - RNA, 21 nt, Salmonella enterica enterica serovar Typhi Ty2
cgaacagaaaaaaugcaccgc

SEQ ID NO: 3737685 - RNA, 13 nt, Salmonella enterica enterica serovar Typhi Ty2
cgaacagcccgcu

SEQ ID NO: 3737686 - RNA, 13 nt, Salmonella enterica enterica serovar Typhi Ty2
cgaacagcgcucc

SEQ ID NO: 3737687 - RNA, 18 nt, Salmonella enterica enterica serovar Typhi Ty2
cgaacaggcucagcgcca

SEQ ID NO: 3737688 - RNA, 19 nt, Salmonella enterica enterica serovar Typhi Ty2
cgaacauccuugcacgcca

SEQ ID NO: 3737689 - RNA, 22 nt, Salmonella enterica enterica serovar Typhi Ty2
cgaacauccuugcacgccaaaa

SEQ ID NO: 3737690 - RNA, 14 nt, Salmonella enterica enterica serovar Typhi Ty2
cgaacaugccgccg

SEQ ID NO: 3737691 - RNA, 17 nt, Salmonella enterica enterica serovar Typhi Ty2
cgaacaugcggauaucg

SEQ ID NO: 3737692 - RNA, 12 nt, Salmonella enterica enterica serovar Typhi Ty2
cgaacauuggaa

SEQ ID NO: 3737693 - RNA, 17 nt, Salmonella enterica enterica serovar Typhi Ty2
cgaacauuucagcgcca

SEQ ID NO: 3737694 - RNA, 13 nt, Salmonella enterica enterica serovar Typhi Ty2
cgaaccaccagcc

SEQ ID NO: 3737695 - RNA, 21 nt, Salmonella enterica enterica serovar Typhi Ty2
cgaaccacggcuucagcggcg

SEQ ID NO: 3737696 - RNA, 15 nt, Salmonella enterica enterica serovar Typhi Ty2
cgaaccguggccucc

SEQ ID NO: 3737697 - RNA, 21 nt, Salmonella enterica enterica serovar Typhi Ty2
cgaaccguggccuccggcaga

SEQ ID NO: 3737698 - RNA, 19 nt, Salmonella enterica enterica serovar Typhi Ty2
cgaaccuuaagcgcgaaau

SEQ ID NO: 3737699 - RNA, 19 nt, Salmonella enterica enterica serovar Typhi Ty2
cgaacgcccggugaucggu

SEQ ID NO: 3737700 - RNA, 20 nt, Salmonella enterica enterica serovar Typhi Ty2
cgaacgccgacaucacgcaa

SEQ ID NO: 3737701 - RNA, 15 nt, Salmonella enterica enterica serovar Typhi Ty2
cgaacgcuaugcgcc

SEQ ID NO: 3737702 - RNA, 15 nt, Salmonella enterica enterica serovar Typhi Ty2
cgaacgcuccacugc

SEQ ID NO: 3737703 - RNA, 23 nt, Salmonella enterica enterica serovar Typhi Ty2
cgaacggcuuuccagcagccaga

SEQ ID NO: 3737704 - RNA, 16 nt, Salmonella enterica enterica serovar Typhi Ty2
cgaacguuggcugggu

SEQ ID NO: 3737705 - RNA, 23 nt, Salmonella enterica enterica serovar Typhi Ty2
cgaacuacugauuccugccagac

SEQ ID NO: 3737706 - RNA, 16 nt, Salmonella enterica enterica serovar Typhi Ty2
cgaacucaugccguag

SEQ ID NO: 3737707 - RNA, 14 nt, Salmonella enterica enterica serovar Typhi Ty2
cgaacuccagcgcg

SEQ ID NO: 3737708 - RNA, 13 nt, Salmonella enterica enterica serovar Typhi Ty2
cgaacugauggcg

SEQ ID NO: 3737709 - RNA, 15 nt, Salmonella enterica enterica serovar Typhi Ty2
cgaacugauggcgcu

SEQ ID NO: 3737710 - RNA, 22 nt, Salmonella enterica enterica serovar Typhi Ty2
cgaacugauggcgcuaagccag

SEQ ID NO: 3737711 - RNA, 23 nt, Salmonella enterica enterica serovar Typhi Ty2
cgaacuuacgacgcgccaccauc

SEQ ID NO: 3737712 - RNA, 16 nt, Salmonella enterica enterica serovar Typhi Ty2
cgaacuucauccacgc

SEQ ID NO: 3737713 - RNA, 19 nt, Salmonella enterica enterica serovar Typhi Ty2
cgaacuucauccacgccga

SEQ ID NO: 3737714 - RNA, 21 nt, Salmonella enterica enterica serovar Typhi Ty2
cgaagaacauaaacagcguga

SEQ ID NO: 3737715 - RNA, 19 nt, Salmonella enterica enterica serovar Typhi Ty2
cgaagagcauaugcgcugc

SEQ ID NO: 3737716 - RNA, 17 nt, Salmonella enterica enterica serovar Typhi Ty2
cgaagaggaugaaaagu

SEQ ID NO: 3737717 - RNA, 21 nt, Salmonella enterica enterica serovar Typhi Ty2
cgaagaucgcguacagcgcca

SEQ ID NO: 3737718 - RNA, 19 nt, Salmonella enterica enterica serovar Typhi Ty2
cgaagaucguuauccagca

SEQ ID NO: 3737719 - RNA, 23 nt, Salmonella enterica enterica serovar Typhi Ty2
cgaagaucguuauccagcagcca

SEQ ID NO: 3737720 - RNA, 16 nt, Salmonella enterica enterica serovar Typhi Ty2
cgaagcgaauagcgua

SEQ ID NO: 3737721 - RNA, 14 nt, Salmonella enterica enterica serovar Typhi Ty2
cgaagcgcggcagu

SEQ ID NO: 3737722 - RNA, 15 nt, Salmonella enterica enterica serovar Typhi Ty2
cgaaggaagauagcg

SEQ ID NO: 3737723 - RNA, 17 nt, Salmonella enterica enterica serovar Typhi Ty2
cgaaggcgcuuugcgag

SEQ ID NO: 3737724 - RNA, 21 nt, Salmonella enterica enterica serovar Typhi Ty2
cgaaggcuacugcgucgcgcg

SEQ ID NO: 3737725 - RNA, 18 nt, Salmonella enterica enterica serovar Typhi Ty2
cgaagggggccgggaaag

SEQ ID NO: 3737726 - RNA, 23 nt, Salmonella enterica enterica serovar Typhi Ty2
cgaaggguagggauagcaucuuc

SEQ ID NO: 3737727 - RNA, 16 nt, Salmonella enterica enterica serovar Typhi Ty2
cgaagggugaggagcu

SEQ ID NO: 3737728 - RNA, 18 nt, Salmonella enterica enterica serovar Typhi Ty2
cgaaggucagauccuuuu

SEQ ID NO: 3737729 - RNA, 22 nt, Salmonella enterica enterica serovar Typhi Ty2
cgaaguagcugaaaaucaaauc

SEQ ID NO: 3737730 - RNA, 14 nt, Salmonella enterica enterica serovar Typhi Ty2
cgaagucgccaccc

SEQ ID NO: 3737731 - RNA, 16 nt, Salmonella enterica enterica serovar Typhi Ty2
cgaauaaggaauggua

SEQ ID NO: 3737732 - RNA, 19 nt, Salmonella enterica enterica serovar Typhi Ty2
cgaauaccgugcacgcugc

SEQ ID NO: 3737733 - RNA, 17 nt, Salmonella enterica enterica serovar Typhi Ty2
cgaauacuguuccaggc

SEQ ID NO: 3737734 - RNA, 21 nt, Salmonella enterica enterica serovar Typhi Ty2
cgaauagaguaauacauccau

SEQ ID NO: 3737735 - RNA, 18 nt, Salmonella enterica enterica serovar Typhi Ty2
cgaauagugauaccaguc

SEQ ID NO: 3737736 - RNA, 19 nt, Salmonella enterica enterica serovar Typhi Ty2
cgaauauucauuuccagca

SEQ ID NO: 3737737 - RNA, 16 nt, Salmonella enterica enterica serovar Typhi Ty2
cgaaucacauccgcca

SEQ ID NO: 3737738 - RNA, 17 nt, Salmonella enterica enterica serovar Typhi Ty2
cgaaucauguuuuucuc

SEQ ID NO: 3737739 - RNA, 13 nt, Salmonella enterica enterica serovar Typhi Ty2
cgaauccagcagg

SEQ ID NO: 3737740 - RNA, 16 nt, Salmonella enterica enterica serovar Typhi Ty2
cgaauccagcgccgaa

SEQ ID NO: 3737741 - RNA, 14 nt, Salmonella enterica enterica serovar Typhi Ty2
cgaauccgccauag

SEQ ID NO: 3737742 - RNA, 13 nt, Salmonella enterica enterica serovar Typhi Ty2
cgaauccuccugu

SEQ ID NO: 3737743 - RNA, 16 nt, Salmonella enterica enterica serovar Typhi Ty2
cgaauccuccuguuga

SEQ ID NO: 3737744 - RNA, 17 nt, Salmonella enterica enterica serovar Typhi Ty2
cgaaucgccgcuuuuuc

SEQ ID NO: 3737745 - RNA, 15 nt, Salmonella enterica enterica serovar Typhi Ty2
cgaaucuaccagauc

SEQ ID NO: 3737746 - RNA, 16 nt, Salmonella enterica enterica serovar Typhi Ty2
cgaaugccugcauaua

SEQ ID NO: 3737747 - RNA, 17 nt, Salmonella enterica enterica serovar Typhi Ty2
cgaaugcuggcugaaau

SEQ ID NO: 3737748 - RNA, 19 nt, Salmonella enterica enterica serovar Typhi Ty2
cgaauggccuccagcagca

SEQ ID NO: 3737749 - RNA, 20 nt, Salmonella enterica enterica serovar Typhi Ty2
cgaaugugcaccuuaaccgu

SEQ ID NO: 3737750 - RNA, 16 nt, Salmonella enterica enterica serovar Typhi Ty2
cgaaugugcuuaucac

SEQ ID NO: 3737751 - RNA, 16 nt, Salmonella enterica enterica serovar Typhi Ty2
cgaauuccgccugcug

SEQ ID NO: 3737752 - RNA, 22 nt, Salmonella enterica enterica serovar Typhi Ty2
cgaauuccuuuuuccgccaccu

SEQ ID NO: 3737753 - RNA, 18 nt, Salmonella enterica enterica serovar Typhi Ty2
cgaauuuacugugaucca

SEQ ID NO: 3737754 - RNA, 16 nt, Salmonella enterica enterica serovar Typhi Ty2
cgaauuucacgcagca

SEQ ID NO: 3737755 - RNA, 12 nt, Salmonella enterica enterica serovar Typhi Ty2
cgaauuuccagc

SEQ ID NO: 3737756 - RNA, 18 nt, Salmonella enterica enterica serovar Typhi Ty2
cgaauuugaaaaaaacau

SEQ ID NO: 3737757 - RNA, 17 nt, Salmonella enterica enterica serovar Typhi Ty2
cgaauuugccccagaua

SEQ ID NO: 3737758 - RNA, 20 nt, Salmonella enterica enterica serovar Typhi Ty2
cgacaaaaccguucugagcg

SEQ ID NO: 3737759 - RNA, 23 nt, Salmonella enterica enterica serovar Typhi Ty2
cgacaaaacuuuuggugcccauc

SEQ ID NO: 3737760 - RNA, 15 nt, Salmonella enterica enterica serovar Typhi Ty2
cgacaaaagccagau

SEQ ID NO: 3737761 - RNA, 13 nt, Salmonella enterica enterica serovar Typhi Ty2
cgacaaagccgac

SEQ ID NO: 3737762 - RNA, 11 nt, Salmonella enterica enterica serovar Typhi Ty2
cgaccgccaua

SEQ ID NO: 3737763 - RNA, 17 nt, Salmonella enterica enterica serovar Typhi Ty2
cgaccgccugcaucacc

SEQ ID NO: 3737764 - RNA, 14 nt, Salmonella enterica enterica serovar Typhi Ty2
cgaccggauugguc

SEQ ID NO: 3737765 - RNA, 21 nt, Salmonella enterica enterica serovar Typhi Ty2
cgaccggauuggucugauuca

SEQ ID NO: 3737766 - RNA, 23 nt, Salmonella enterica enterica serovar Typhi Ty2
cgaccggcaaaaagaaucgccag

SEQ ID NO: 3737767 - RNA, 13 nt, Salmonella enterica enterica serovar Typhi Ty2
cgaccggcagccg

SEQ ID NO: 3737768 - RNA, 15 nt, Salmonella enterica enterica serovar Typhi Ty2
cgaccggcagcguca

SEQ ID NO: 3737769 - RNA, 16 nt, Salmonella enterica enterica serovar Typhi Ty2
cgaccggcgucaucau

SEQ ID NO: 3737770 - RNA, 22 nt, Salmonella enterica enterica serovar Typhi Ty2
cgaccggcucgcuguucgccag

SEQ ID NO: 3737771 - RNA, 18 nt, Salmonella enterica enterica serovar Typhi Ty2
cgaccgguccaccggggg

SEQ ID NO: 3737772 - RNA, 15 nt, Salmonella enterica enterica serovar Typhi Ty2
cgaccgucagcagca

SEQ ID NO: 3737773 - RNA, 20 nt, Salmonella enterica enterica serovar Typhi Ty2
cgaccgugauuuuuaccgcc

SEQ ID NO: 3737774 - RNA, 22 nt, Salmonella enterica enterica serovar Typhi Ty2
cgaccgugauuuuuaccgccgg

SEQ ID NO: 3737775 - RNA, 19 nt, Salmonella enterica enterica serovar Typhi Ty2
cgaccucuucguucauccg

SEQ ID NO: 3737776 - RNA, 17 nt, Salmonella enterica enterica serovar Typhi Ty2
cgaccugcauauuuuuc

SEQ ID NO: 3737777 - RNA, 16 nt, Salmonella enterica enterica serovar Typhi Ty2
cgaccuggcgcucaau

SEQ ID NO: 3737778 - RNA, 19 nt, Salmonella enterica enterica serovar Typhi Ty2
cgaccuggcggucggcuuu

SEQ ID NO: 3737779 - RNA, 14 nt, Salmonella enterica enterica serovar Typhi Ty2
cgaccuucacgccg

SEQ ID NO: 3737780 - RNA, 11 nt, Salmonella enterica enterica serovar Typhi Ty2
cgaccuucucc

SEQ ID NO: 3737781 - RNA, 15 nt, Salmonella enterica enterica serovar Typhi Ty2
cgacgaaucagcgau

SEQ ID NO: 3737782 - RNA, 16 nt, Salmonella enterica enterica serovar Typhi Ty2
cgacgaauggcggcgu

SEQ ID NO: 3737783 - RNA, 18 nt, Salmonella enterica enterica serovar Typhi Ty2
cgacgaauggcggcguuu

SEQ ID NO: 3737784 - RNA, 16 nt, Salmonella enterica enterica serovar Typhi Ty2
cgacgaccggcagcgu

SEQ ID NO: 3737785 - RNA, 13 nt, Salmonella enterica enterica serovar Typhi Ty2
cgacgacuucacc

SEQ ID NO: 3737786 - RNA, 20 nt, Salmonella enterica enterica serovar Typhi Ty2
cgacgagguuuccggcggga

SEQ ID NO: 3737787 - RNA, 22 nt, Salmonella enterica enterica serovar Typhi Ty2
cgacgagguuuccggcgggagc

SEQ ID NO: 3737788 - RNA, 15 nt, Salmonella enterica enterica serovar Typhi Ty2
cgacgauaaacagau

SEQ ID NO: 3737789 - RNA, 15 nt, Salmonella enterica enterica serovar Typhi Ty2
cgacgaucagcgcca

SEQ ID NO: 3737790 - RNA, 19 nt, Salmonella enterica enterica serovar Typhi Ty2
cgacgaucagcgccacgca

SEQ ID NO: 3737791 - RNA, 17 nt, Salmonella enterica enterica serovar Typhi Ty2
cgacgcacuccagaugc

SEQ ID NO: 3737792 - RNA, 17 nt, Salmonella enterica enterica serovar Typhi Ty2
cgacgcagacaauaaac

SEQ ID NO: 3737793 - RNA, 23 nt, Salmonella enterica enterica serovar Typhi Ty2
cgacgcauugagacaugccgcca

SEQ ID NO: 3737794 - RNA, 14 nt, Salmonella enterica enterica serovar Typhi Ty2
cgacgccaaaccug

SEQ ID NO: 3737795 - RNA, 13 nt, Salmonella enterica enterica serovar Typhi Ty2
cgacgccaaccgc

SEQ ID NO: 3737796 - RNA, 16 nt, Salmonella enterica enterica serovar Typhi Ty2
cgacgccaaucggcgu

SEQ ID NO: 3737797 - RNA, 13 nt, Salmonella enterica enterica serovar Typhi Ty2
cgacgccagccag

SEQ ID NO: 3737798 - RNA, 18 nt, Salmonella enterica enterica serovar Typhi Ty2
cgacgccgucucuuuuug

SEQ ID NO: 3737799 - RNA, 12 nt, Salmonella enterica enterica serovar Typhi Ty2
cgacgccugcau

SEQ ID NO: 3737800 - RNA, 17 nt, Salmonella enterica enterica serovar Typhi Ty2
cgacgccuuuaccaccc

SEQ ID NO: 3737801 - RNA, 15 nt, Salmonella enterica enterica serovar Typhi Ty2
cgacgcgcggcguca

SEQ ID NO: 3737802 - RNA, 17 nt, Salmonella enterica enterica serovar Typhi Ty2
cgacgcggcuccggcuu

SEQ ID NO: 3737803 - RNA, 12 nt, Salmonella enterica enterica serovar Typhi Ty2
cgacgcucauua

SEQ ID NO: 3737804 - RNA, 16 nt, Salmonella enterica enterica serovar Typhi Ty2
cgacgcuuaucagccc

SEQ ID NO: 3737805 - RNA, 23 nt, Salmonella enterica enterica serovar Typhi Ty2
cgacggagauuaacagcgcgacc

SEQ ID NO: 3737806 - RNA, 18 nt, Salmonella enterica enterica serovar Typhi Ty2
cgacggccaguugcgcag

SEQ ID NO: 3737807 - RNA, 14 nt, Salmonella enterica enterica serovar Typhi Ty2
cgacggccauaaac

SEQ ID NO: 3737808 - RNA, 17 nt, Salmonella enterica enterica serovar Typhi Ty2
cgacggcgaccggcaaa

SEQ ID NO: 3737809 - RNA, 14 nt, Salmonella enterica enterica serovar Typhi Ty2
cgacggcgcagaca

SEQ ID NO: 3737810 - RNA, 19 nt, Salmonella enterica enterica serovar Typhi Ty2
cgacgguaauaccaaccgc

SEQ ID NO: 3737811 - RNA, 20 nt, Salmonella enterica enterica serovar Typhi Ty2
cgacggugaugacccgcagc

SEQ ID NO: 3737812 - RNA, 21 nt, Salmonella enterica enterica serovar Typhi Ty2
cgacguaacgguguuucaucu

SEQ ID NO: 3737813 - RNA, 21 nt, Salmonella enterica enterica serovar Typhi Ty2
cgacguaacugucuuauccgg

SEQ ID NO: 3737814 - RNA, 22 nt, Salmonella enterica enterica serovar Typhi Ty2
cgacguaacugucuuauccggc

SEQ ID NO: 3737815 - RNA, 12 nt, Salmonella enterica enterica serovar Typhi Ty2
cgacgucaacgg

SEQ ID NO: 3737816 - RNA, 14 nt, Salmonella enterica enterica serovar Typhi Ty2
cgacgucaacggua

SEQ ID NO: 3737817 - RNA, 13 nt, Salmonella enterica enterica serovar Typhi Ty2
cgacgucaauaaa

SEQ ID NO: 3737818 - RNA, 13 nt, Salmonella enterica enterica serovar Typhi Ty2
cgacgucccguca

SEQ ID NO: 3737819 - RNA, 15 nt, Salmonella enterica enterica serovar Typhi Ty2
cgacgugacgcgcca

SEQ ID NO: 3737820 - RNA, 15 nt, Salmonella enterica enterica serovar Typhi Ty2
cgacgugucgcguaa

SEQ ID NO: 3737821 - RNA, 20 nt, Salmonella enterica enterica serovar Typhi Ty2
cgacguucagcauauccagc

SEQ ID NO: 3737822 - RNA, 22 nt, Salmonella enterica enterica serovar Typhi Ty2
cgacguucagcauauccagcgc

SEQ ID NO: 3737823 - RNA, 14 nt, Salmonella enterica enterica serovar Typhi Ty2
cgacguucaugccg

SEQ ID NO: 3737824 - RNA, 13 nt, Salmonella enterica enterica serovar Typhi Ty2
cgacguugcgccu

SEQ ID NO: 3737825 - RNA, 20 nt, Salmonella enterica enterica serovar Typhi Ty2
cgacguuguucgcuucuucu

SEQ ID NO: 3737826 - RNA, 21 nt, Salmonella enterica enterica serovar Typhi Ty2
cgacguuugcguaaagcuguu

SEQ ID NO: 3737827 - RNA, 14 nt, Salmonella enterica enterica serovar Typhi Ty2
cgacuacgguaaac

SEQ ID NO: 3737828 - RNA, 21 nt, Salmonella enterica enterica serovar Typhi Ty2
cgacuauuccgcaaacgccgu

SEQ ID NO: 3737829 - RNA, 16 nt, Salmonella enterica enterica serovar Typhi Ty2
cgacucacgcagcgcu

SEQ ID NO: 3737830 - RNA, 14 nt, Salmonella enterica enterica serovar Typhi Ty2
cgacucacgcgcgc

SEQ ID NO: 3737831 - RNA, 14 nt, Salmonella enterica enterica serovar Typhi Ty2
cgacucauucagca

SEQ ID NO: 3737832 - RNA, 19 nt, Salmonella enterica enterica serovar Typhi Ty2
cgacuccaauaauggagau

SEQ ID NO: 3737833 - RNA, 13 nt, Salmonella enterica enterica serovar Typhi Ty2
cgacuccagaaua

SEQ ID NO: 3737834 - RNA, 12 nt, Salmonella enterica enterica serovar Typhi Ty2
cgacucccaggc

SEQ ID NO: 3737835 - RNA, 19 nt, Salmonella enterica enterica serovar Typhi Ty2
cgacucccaggcgcgcagc

SEQ ID NO: 3737836 - RNA, 15 nt, Salmonella enterica enterica serovar Typhi Ty2
cgacuccggauagag

SEQ ID NO: 3737837 - RNA, 17 nt, Salmonella enterica enterica serovar Typhi Ty2
cgacucggcgaucacca

SEQ ID NO: 3737838 - RNA, 13 nt, Salmonella enterica enterica serovar Typhi Ty2
cgacucucccggc

SEQ ID NO: 3737839 - RNA, 23 nt, Salmonella enterica enterica serovar Typhi Ty2
cgacucuguauuuaauaccuggu

SEQ ID NO: 3737840 - RNA, 15 nt, Salmonella enterica enterica serovar Typhi Ty2
cgacucuuuuuucag

SEQ ID NO: 3737841 - RNA, 12 nt, Salmonella enterica enterica serovar Typhi Ty2
cgacugaacaua

SEQ ID NO: 3737842 - RNA, 16 nt, Salmonella enterica enterica serovar Typhi Ty2
cgacugaccagacaga

SEQ ID NO: 3737843 - RNA, 21 nt, Salmonella enterica enterica serovar Typhi Ty2
cgacugccaccgucgcggcau

SEQ ID NO: 3737844 - RNA, 22 nt, Salmonella enterica enterica serovar Typhi Ty2
cgacugcggucguauuuaccgc

SEQ ID NO: 3737845 - RNA, 16 nt, Salmonella enterica enterica serovar Typhi Ty2
cgauaaauaccguaau

SEQ ID NO: 3737846 - RNA, 13 nt, Salmonella enterica enterica serovar Typhi Ty2
cgauaaauccucc

SEQ ID NO: 3737847 - RNA, 15 nt, Salmonella enterica enterica serovar Typhi Ty2
cgauaaauuucacgu

SEQ ID NO: 3737848 - RNA, 15 nt, Salmonella enterica enterica serovar Typhi Ty2
cgauaacacggcugg

SEQ ID NO: 3737849 - RNA, 20 nt, Salmonella enterica enterica serovar Typhi Ty2
cgauaacacggcuggcaaug

SEQ ID NO: 3737850 - RNA, 14 nt, Salmonella enterica enterica serovar Typhi Ty2
cgauaaccaccagc

SEQ ID NO: 3737851 - RNA, 14 nt, Salmonella enterica enterica serovar Typhi Ty2
cgauaaccagcgcg

SEQ ID NO: 3737852 - RNA, 15 nt, Salmonella enterica enterica serovar Typhi Ty2
cgauaaccaggucac

SEQ ID NO: 3737853 - RNA, 19 nt, Salmonella enterica enterica serovar Typhi Ty2
cgauaaccaugcucagcgg

SEQ ID NO: 3737854 - RNA, 21 nt, Salmonella enterica enterica serovar Typhi Ty2
cgauaaccaugcucagcggcg

SEQ ID NO: 3737855 - RNA, 12 nt, Salmonella enterica enterica serovar Typhi Ty2
cgauaaccgaug

SEQ ID NO: 3737856 - RNA, 13 nt, Salmonella enterica enterica serovar Typhi Ty2
cgauaaccgccga

SEQ ID NO: 3737857 - RNA, 18 nt, Salmonella enterica enterica serovar Typhi Ty2
cgauaaccucucaccgcc

SEQ ID NO: 3737858 - RNA, 19 nt, Salmonella enterica enterica serovar Typhi Ty2
cgauaaccuguaaauaaua

SEQ ID NO: 3737859 - RNA, 22 nt, Salmonella enterica enterica serovar Typhi Ty2
cgauaaccuucuucguuaugaa

SEQ ID NO: 3737860 - RNA, 17 nt, Salmonella enterica enterica serovar Typhi Ty2
cgauaacgaccagauac

SEQ ID NO: 3737861 - RNA, 19 nt, Salmonella enterica enterica serovar Typhi Ty2
cgauaacguuaccgcagcg

SEQ ID NO: 3737862 - RNA, 16 nt, Salmonella enterica enterica serovar Typhi Ty2
cgauaagcaagcgcca

SEQ ID NO: 3737863 - RNA, 18 nt, Salmonella enterica enterica serovar Typhi Ty2
cgauaagcuuccgccaug

SEQ ID NO: 3737864 - RNA, 14 nt, Salmonella enterica enterica serovar Typhi Ty2
cgauaauacgcgcg

SEQ ID NO: 3737865 - RNA, 22 nt, Salmonella enterica enterica serovar Typhi Ty2
cgauaauacgcgcgauuacgcg

SEQ ID NO: 3737866 - RNA, 21 nt, Salmonella enterica enterica serovar Typhi Ty2
cgauaauauccgacgccuguu

SEQ ID NO: 3737867 - RNA, 14 nt, Salmonella enterica enterica serovar Typhi Ty2
cgauaaucaccagc

SEQ ID NO: 3737868 - RNA, 15 nt, Salmonella enterica enterica serovar Typhi Ty2
cgauaaucaccagcc

SEQ ID NO: 3737869 - RNA, 13 nt, Salmonella enterica enterica serovar Typhi Ty2
cgauaaucggcga

SEQ ID NO: 3737870 - RNA, 21 nt, Salmonella enterica enterica serovar Typhi Ty2
cgauaaugaagcauaaaaaga

SEQ ID NO: 3737871 - RNA, 22 nt, Salmonella enterica enterica serovar Typhi Ty2
cgauaauuuuaccuucgcguuu

SEQ ID NO: 3737872 - RNA, 14 nt, Salmonella enterica enterica serovar Typhi Ty2
cgauaccaguaaua

SEQ ID NO: 3737873 - RNA, 17 nt, Salmonella enterica enterica serovar Typhi Ty2
cgauaccaguaauacgc

SEQ ID NO: 3737874 - RNA, 15 nt, Salmonella enterica enterica serovar Typhi Ty2
cgauacccaccagcg

SEQ ID NO: 3737875 - RNA, 19 nt, Salmonella enterica enterica serovar Typhi Ty2
cgauacccgcccagaucag

SEQ ID NO: 3737876 - RNA, 13 nt, Salmonella enterica enterica serovar Typhi Ty2
cgauacccgcgau

SEQ ID NO: 3737877 - RNA, 22 nt, Salmonella enterica enterica serovar Typhi Ty2
cgauaccgaaacgcauacgcag

SEQ ID NO: 3737878 - RNA, 21 nt, Salmonella enterica enterica serovar Typhi Ty2
cgauacgacugacuucaucaa

SEQ ID NO: 3737879 - RNA, 14 nt, Salmonella enterica enterica serovar Typhi Ty2
cgauacggauagcg

SEQ ID NO: 3737880 - RNA, 13 nt, Salmonella enterica enterica serovar Typhi Ty2
cgauacuaaaacu

SEQ ID NO: 3737881 - RNA, 21 nt, Salmonella enterica enterica serovar Typhi Ty2
cgauacuaaaacuuuaacacu

SEQ ID NO: 3737882 - RNA, 22 nt, Salmonella enterica enterica serovar Typhi Ty2
cgauacucacgacuuucaccag

SEQ ID NO: 3737883 - RNA, 22 nt, Salmonella enterica enterica serovar Typhi Ty2
cgauacuccauugucggcagcg

SEQ ID NO: 3737884 - RNA, 18 nt, Salmonella enterica enterica serovar Typhi Ty2
cgauagacguugagcuca

SEQ ID NO: 3737885 - RNA, 16 nt, Salmonella enterica enterica serovar Typhi Ty2
cgauagagaguuccuc

SEQ ID NO: 3737886 - RNA, 18 nt, Salmonella enterica enterica serovar Typhi Ty2
cgauagagaguuccuccu

SEQ ID NO: 3737887 - RNA, 19 nt, Salmonella enterica enterica serovar Typhi Ty2
cgauagagaguuccuccug

SEQ ID NO: 3737888 - RNA, 20 nt, Salmonella enterica enterica serovar Typhi Ty2
cgauagagaguuccuccugg

SEQ ID NO: 3737889 - RNA, 16 nt, Salmonella enterica enterica serovar Typhi Ty2
cgauagcaucggucaa

SEQ ID NO: 3737890 - RNA, 14 nt, Salmonella enterica enterica serovar Typhi Ty2
cgauagcauuuuua

SEQ ID NO: 3737891 - RNA, 20 nt, Salmonella enterica enterica serovar Typhi Ty2
cgauagcauuuuuacucagc

SEQ ID NO: 3737892 - RNA, 15 nt, Salmonella enterica enterica serovar Typhi Ty2
cgauagcgccccaaa

SEQ ID NO: 3737893 - RNA, 12 nt, Salmonella enterica enterica serovar Typhi Ty2
cgauagcgccgg

SEQ ID NO: 3737894 - RNA, 19 nt, Salmonella enterica enterica serovar Typhi Ty2
cgauagcuaucacacauau

SEQ ID NO: 3737895 - RNA, 19 nt, Salmonella enterica enterica serovar Typhi Ty2
cgauaguguaaacgcgcca

SEQ ID NO: 3737896 - RNA, 17 nt, Salmonella enterica enterica serovar Typhi Ty2
cgauauaauuuuauuau

SEQ ID NO: 3737897 - RNA, 19 nt, Salmonella enterica enterica serovar Typhi Ty2
cgauauaauuuuauuauau

SEQ ID NO: 3737898 - RNA, 23 nt, Salmonella enterica enterica serovar Typhi Ty2
cgauauaccacccgcuaugaaga

SEQ ID NO: 3737899 - RNA, 13 nt, Salmonella enterica enterica serovar Typhi Ty2
cgauauagcgcau

SEQ ID NO: 3737900 - RNA, 21 nt, Salmonella enterica enterica serovar Typhi Ty2
cgauauagcgcauagcggcca

SEQ ID NO: 3737901 - RNA, 17 nt, Salmonella enterica enterica serovar Typhi Ty2
cgauauagcgcugaagu

SEQ ID NO: 3737902 - RNA, 22 nt, Salmonella enterica enterica serovar Typhi Ty2
cgauauauuuuccguccaccug

SEQ ID NO: 3737903 - RNA, 16 nt, Salmonella enterica enterica serovar Typhi Ty2
cgauaucacggaauuu

SEQ ID NO: 3737904 - RNA, 16 nt, Salmonella enterica enterica serovar Typhi Ty2
cgauaucauucucuac

SEQ ID NO: 3737905 - RNA, 17 nt, Salmonella enterica enterica serovar Typhi Ty2
cgauauccgugccgccg

SEQ ID NO: 3737906 - RNA, 13 nt, Salmonella enterica enterica serovar Typhi Ty2
cgauaucgauaau

SEQ ID NO: 3737907 - RNA, 16 nt, Salmonella enterica enterica serovar Typhi Ty2
cgauaucgauaaucaa

SEQ ID NO: 3737908 - RNA, 23 nt, Salmonella enterica enterica serovar Typhi Ty2
cgauaucgucauuaacgggaaac

SEQ ID NO: 3737909 - RNA, 23 nt, Salmonella enterica enterica serovar Typhi Ty2
cgauaugaauaauuucggcggcg

SEQ ID NO: 3737910 - RNA, 20 nt, Salmonella enterica enterica serovar Typhi Ty2
cgauaugugucaugcgguua

SEQ ID NO: 3737911 - RNA, 18 nt, Salmonella enterica enterica serovar Typhi Ty2
cgauauuacuccagcgua

SEQ ID NO: 3737912 - RNA, 21 nt, Salmonella enterica enterica serovar Typhi Ty2
cgauauucgggcgcaugucag

SEQ ID NO: 3737913 - RNA, 23 nt, Salmonella enterica enterica serovar Typhi Ty2
cgauauuucgccuaucaugcugc

SEQ ID NO: 3737914 - RNA, 12 nt, Salmonella enterica enterica serovar Typhi Ty2
cgaucaaucacg

SEQ ID NO: 3737915 - RNA, 12 nt, Salmonella enterica enterica serovar Typhi Ty2
cgaucaccacgc

SEQ ID NO: 3737916 - RNA, 15 nt, Salmonella enterica enterica serovar Typhi Ty2
cgaucacuaccgcca

SEQ ID NO: 3737917 - RNA, 16 nt, Salmonella enterica enterica serovar Typhi Ty2
cgaucagauugaucau

SEQ ID NO: 3737918 - RNA, 12 nt, Salmonella enterica enterica serovar Typhi Ty2
cgaucagcgcca

SEQ ID NO: 3737919 - RNA, 19 nt, Salmonella enterica enterica serovar Typhi Ty2
cgaucagcgccaccacaaa

SEQ ID NO: 3737920 - RNA, 13 nt, Salmonella enterica enterica serovar Typhi Ty2
cgaucagcgcgua

SEQ ID NO: 3737921 - RNA, 18 nt, Salmonella enterica enterica serovar Typhi Ty2
cgaucagcgcguagaugu

SEQ ID NO: 3737922 - RNA, 18 nt, Salmonella enterica enterica serovar Typhi Ty2
cgaucaguggcgccgcaa

SEQ ID NO: 3737923 - RNA, 14 nt, Salmonella enterica enterica serovar Typhi Ty2
cgaucaucauuccg

SEQ ID NO: 3737924 - RNA, 19 nt, Salmonella enterica enterica serovar Typhi Ty2
cgaucaucccgcccagcaa

SEQ ID NO: 3737925 - RNA, 20 nt, Salmonella enterica enterica serovar Typhi Ty2
cgaucaucccgcccagcaac

SEQ ID NO: 3737926 - RNA, 15 nt, Salmonella enterica enterica serovar Typhi Ty2
cgaucaugccgccca

SEQ ID NO: 3737927 - RNA, 18 nt, Salmonella enterica enterica serovar Typhi Ty2
cgauuucauuggucuuca

SEQ ID NO: 3737928 - RNA, 12 nt, Salmonella enterica enterica serovar Typhi Ty2
cgauuuccccug

SEQ ID NO: 3737929 - RNA, 12 nt, Salmonella enterica enterica serovar Typhi Ty2
cgauuugccccg

SEQ ID NO: 3737930 - RNA, 15 nt, Salmonella enterica enterica serovar Typhi Ty2
cgauuugcgcucgcg

SEQ ID NO: 3737931 - RNA, 18 nt, Salmonella enterica enterica serovar Typhi Ty2
cgauuuucuccggaagca

SEQ ID NO: 3737932 - RNA, 22 nt, Salmonella enterica enterica serovar Typhi Ty2
cgauuuugacaaugaugguuaa

SEQ ID NO: 3737933 - RNA, 17 nt, Salmonella enterica enterica serovar Typhi Ty2
cgauuuugguagcgcug

SEQ ID NO: 3737934 - RNA, 15 nt, Salmonella enterica enterica serovar Typhi Ty2
cgauuuuuaggccaa

SEQ ID NO: 3737935 - RNA, 21 nt, Salmonella enterica enterica serovar Typhi Ty2
cgauuuuuucgacauuaccca

SEQ ID NO: 3737936 - RNA, 15 nt, Salmonella enterica enterica serovar Typhi Ty2
cgcaaaagcgcgccc

SEQ ID NO: 3737937 - RNA, 20 nt, Salmonella enterica enterica serovar Typhi Ty2
cgcaaaaucgcaaacgccag

SEQ ID NO: 3737938 - RNA, 16 nt, Salmonella enterica enterica serovar Typhi Ty2
cgcaaaauucacacca

SEQ ID NO: 3737939 - RNA, 18 nt, Salmonella enterica enterica serovar Typhi Ty2
cgcaaaauuccggcugau

SEQ ID NO: 3737940 - RNA, 17 nt, Salmonella enterica enterica serovar Typhi Ty2
cgcaaacagcacgcccu

SEQ ID NO: 3737941 - RNA, 13 nt, Salmonella enterica enterica serovar Typhi Ty2
cgcaaacaguuca

SEQ ID NO: 3737942 - RNA, 12 nt, Salmonella enterica enterica serovar Typhi Ty2
cgcaaaccgcuu

SEQ ID NO: 3737943 - RNA, 13 nt, Salmonella enterica enterica serovar Typhi Ty2
cgcaaacgccgaa

SEQ ID NO: 3737944 - RNA, 16 nt, Salmonella enterica enterica serovar Typhi Ty2
cgcaaacgccgugaac

SEQ ID NO: 3737945 - RNA, 21 nt, Salmonella enterica enterica serovar Typhi Ty2
cgcaaacgccgugaacgccaa

SEQ ID NO: 3737946 - RNA, 18 nt, Salmonella enterica enterica serovar Typhi Ty2
cgcaaacgccugcuccgu

SEQ ID NO: 3737947 - RNA, 16 nt, Salmonella enterica enterica serovar Typhi Ty2
cgcaaacugcgcgccc

SEQ ID NO: 3737948 - RNA, 23 nt, Salmonella enterica enterica serovar Typhi Ty2
cgcaaacugcgcgcccgccuccg

SEQ ID NO: 3737949 - RNA, 22 nt, Salmonella enterica enterica serovar Typhi Ty2
cgcaaagacaggugaccaggcu

SEQ ID NO: 3737950 - RNA, 19 nt, Salmonella enterica enterica serovar Typhi Ty2
cgcaaagcaauguaaaacu

SEQ ID NO: 3737951 - RNA, 18 nt, Salmonella enterica enterica serovar Typhi Ty2
cgcaaagcccaucagcgc

SEQ ID NO: 3737952 - RNA, 16 nt, Salmonella enterica enterica serovar Typhi Ty2
cgcaaaucaccgucga

SEQ ID NO: 3737953 - RNA, 19 nt, Salmonella enterica enterica serovar Typhi Ty2
cgcaaauucaucgccgccg

SEQ ID NO: 3737954 - RNA, 13 nt, Salmonella enterica enterica serovar Typhi Ty2
cgcaaauucugua

SEQ ID NO: 3737955 - RNA, 21 nt, Salmonella enterica enterica serovar Typhi Ty2
cgcaacauucugcuuccagaa

SEQ ID NO: 3737956 - RNA, 14 nt, Salmonella enterica enterica serovar Typhi Ty2
cgcaaccacggcgc

SEQ ID NO: 3737957 - RNA, 14 nt, Salmonella enterica enterica serovar Typhi Ty2
cgcaacgcgcauca

SEQ ID NO: 3737958 - RNA, 17 nt, Salmonella enterica enterica serovar Typhi Ty2
cgcaacgcgcaucaacg

SEQ ID NO: 3737959 - RNA, 18 nt, Salmonella enterica enterica serovar Typhi Ty2
cgcaacgcuaggcaaccu

SEQ ID NO: 3737960 - RNA, 22 nt, Salmonella enterica enterica serovar Typhi Ty2
cgcaacgcuuccaccucuucug

SEQ ID NO: 3737961 - RNA, 18 nt, Salmonella enterica enterica serovar Typhi Ty2
cgcaacggucggucuuuu

SEQ ID NO: 3737962 - RNA, 15 nt, Salmonella enterica enterica serovar Typhi Ty2
cgcaacgucagcgau

SEQ ID NO: 3737963 - RNA, 16 nt, Salmonella enterica enterica serovar Typhi Ty2
cgcaacgucagcgauc

SEQ ID NO: 3737964 - RNA, 15 nt, Salmonella enterica enterica serovar Typhi Ty2
cgcaacgucaguacg

SEQ ID NO: 3737965 - RNA, 23 nt, Salmonella enterica enterica serovar Typhi Ty2
cgcaacguguaggcccgguaagc

SEQ ID NO: 3737966 - RNA, 23 nt, Salmonella enterica enterica serovar Typhi Ty2
cgcaacguuucuuucaucagauc

SEQ ID NO: 3737967 - RNA, 12 nt, Salmonella enterica enterica serovar Typhi Ty2
cgcaagcagcac

SEQ ID NO: 3737968 - RNA, 20 nt, Salmonella enterica enterica serovar Typhi Ty2
cgcaagcggcaaucgccuca

SEQ ID NO: 3737969 - RNA, 22 nt, Salmonella enterica enterica serovar Typhi Ty2
cgcaagcucaccaucuucauga

SEQ ID NO: 3737970 - RNA, 19 nt, Salmonella enterica enterica serovar Typhi Ty2
cgcaaggaaauauuaauua

SEQ ID NO: 3737971 - RNA, 22 nt, Salmonella enterica enterica serovar Typhi Ty2
cgcaaggcggcguuuuuuuauc

SEQ ID NO: 3737972 - RNA, 16 nt, Salmonella enterica enterica serovar Typhi Ty2
cgcaauaacgccgaua

SEQ ID NO: 3737973 - RNA, 21 nt, Salmonella enterica enterica serovar Typhi Ty2
cgcaauaaguucaaacucauu

SEQ ID NO: 3737974 - RNA, 19 nt, Salmonella enterica enterica serovar Typhi Ty2
cgcaauacagcccgccagc

SEQ ID NO: 3737975 - RNA, 20 nt, Salmonella enterica enterica serovar Typhi Ty2
cgcaauacagcccgccagca

SEQ ID NO: 3737976 - RNA, 23 nt, Salmonella enterica enterica serovar Typhi Ty2
cgcaauacguuugguaccgcugg

SEQ ID NO: 3737977 - RNA, 16 nt, Salmonella enterica enterica serovar Typhi Ty2
cgcaauagaguaauga

SEQ ID NO: 3737978 - RNA, 14 nt, Salmonella enterica enterica serovar Typhi Ty2
cgcaaucacauaca

SEQ ID NO: 3737979 - RNA, 22 nt, Salmonella enterica enterica serovar Typhi Ty2
cgcaaucacauacagcacuucc

SEQ ID NO: 3737980 - RNA, 19 nt, Salmonella enterica enterica serovar Typhi Ty2
cgcaaucucgcaagauucc

SEQ ID NO: 3737981 - RNA, 17 nt, Salmonella enterica enterica serovar Typhi Ty2
cgcaaucugcucgacgc

SEQ ID NO: 3737982 - RNA, 18 nt, Salmonella enterica enterica serovar Typhi Ty2
cgcaaucugcucgacgcg

SEQ ID NO: 3737983 - RNA, 17 nt, Salmonella enterica enterica serovar Typhi Ty2
cgcaaucuuugccgcaa

SEQ ID NO: 3737984 - RNA, 16 nt, Salmonella enterica enterica serovar Typhi Ty2
cgcaaugccaccacac

SEQ ID NO: 3737985 - RNA, 17 nt, Salmonella enterica enterica serovar Typhi Ty2
cgcaaugcugacgacau

SEQ ID NO: 3737986 - RNA, 13 nt, Salmonella enterica enterica serovar Typhi Ty2
cgcaauuaauuua

SEQ ID NO: 3737987 - RNA, 13 nt, Salmonella enterica enterica serovar Typhi Ty2
cgcaauucuucua

SEQ ID NO: 3737988 - RNA, 12 nt, Salmonella enterica enterica serovar Typhi Ty2
cgcacaaacgcu

SEQ ID NO: 3737989 - RNA, 15 nt, Salmonella enterica enterica serovar Typhi Ty2
cgcacaccagcgcau

SEQ ID NO: 3737990 - RNA, 23 nt, Salmonella enterica enterica serovar Typhi Ty2
cgcacagaaucgcuguggcauua

SEQ ID NO: 3737991 - RNA, 23 nt, Salmonella enterica enterica serovar Typhi Ty2
cgcacagcagacaaccgacgcau

SEQ ID NO: 3737992 - RNA, 20 nt, Salmonella enterica enterica serovar Typhi Ty2
cgcacagggugaaaucacgc

SEQ ID NO: 3737993 - RNA, 16 nt, Salmonella enterica enterica serovar Typhi Ty2
cgcacauaaucaccgc

SEQ ID NO: 3737994 - RNA, 22 nt, Salmonella enterica enterica serovar Typhi Ty2
cgcacauggaacucugcgacgc

SEQ ID NO: 3737995 - RNA, 12 nt, Salmonella enterica enterica serovar Typhi Ty2
cgcaccagccag

SEQ ID NO: 3737996 - RNA, 17 nt, Salmonella enterica enterica serovar Typhi Ty2
cgcaccaguuccccaua

SEQ ID NO: 3737997 - RNA, 20 nt, Salmonella enterica enterica serovar Typhi Ty2
cgcaccgucgagaaaccgcu

SEQ ID NO: 3737998 - RNA, 19 nt, Salmonella enterica enterica serovar Typhi Ty2
cgcacgccagauaaaucag

SEQ ID NO: 3737999 - RNA, 14 nt, Salmonella enterica enterica serovar Typhi Ty2
cgcacgccagcggu

SEQ ID NO: 3738000 - RNA, 16 nt, Salmonella enterica enterica serovar Typhi Ty2
cgcacgccugcggccc

SEQ ID NO: 3738001 - RNA, 17 nt, Salmonella enterica enterica serovar Typhi Ty2
cgcacgccugggcgaua

SEQ ID NO: 3738002 - RNA, 21 nt, Salmonella enterica enterica serovar Typhi Ty2
cgcacgcgucaucggcgcgcu

SEQ ID NO: 3738003 - RNA, 12 nt, Salmonella enterica enterica serovar Typhi Ty2
cgcacggcguua

SEQ ID NO: 3738004 - RNA, 21 nt, Salmonella enterica enterica serovar Typhi Ty2
cgcacuacggcaaacgcuggu

SEQ ID NO: 3738005 - RNA, 17 nt, Salmonella enterica enterica serovar Typhi Ty2
cgcacugauagccgcca

SEQ ID NO: 3738006 - RNA, 19 nt, Salmonella enterica enterica serovar Typhi Ty2
cgcacugauagccgccagu

SEQ ID NO: 3738007 - RNA, 12 nt, Salmonella enterica enterica serovar Typhi Ty2
cgcacugccuga

SEQ ID NO: 3738008 - RNA, 15 nt, Salmonella enterica enterica serovar Typhi Ty2
cgcacuggcgccugc

SEQ ID NO: 3738009 - RNA, 14 nt, Salmonella enterica enterica serovar Typhi Ty2
cgcauccagcgcaa

SEQ ID NO: 3738010 - RNA, 14 nt, Salmonella enterica enterica serovar Typhi Ty2
cgcauccagggagu

SEQ ID NO: 3738011 - RNA, 16 nt, Salmonella enterica enterica serovar Typhi Ty2
cgcauccaguuguuua

SEQ ID NO: 3738012 - RNA, 16 nt, Salmonella enterica enterica serovar Typhi Ty2
cgcauccgcggcgcuu

SEQ ID NO: 3738013 - RNA, 19 nt, Salmonella enterica enterica serovar Typhi Ty2
cgcauccggaaucgccguu

SEQ ID NO: 3738014 - RNA, 20 nt, Salmonella enterica enterica serovar Typhi Ty2
cgcauccggccagcgacugg

SEQ ID NO: 3738015 - RNA, 16 nt, Salmonella enterica enterica serovar Typhi Ty2
cgcauccgucaaaaug

SEQ ID NO: 3738016 - RNA, 21 nt, Salmonella enterica enterica serovar Typhi Ty2
cgcaucgccgcggcgcuggcc

SEQ ID NO: 3738017 - RNA, 19 nt, Salmonella enterica enterica serovar Typhi Ty2
cgcaucggcccuguauaca

SEQ ID NO: 3738018 - RNA, 18 nt, Salmonella enterica enterica serovar Typhi Ty2
cgcaucgggucgcgcgcc

SEQ ID NO: 3738019 - RNA, 22 nt, Salmonella enterica enterica serovar Typhi Ty2
cgcaucguggccgauauugccu

SEQ ID NO: 3738020 - RNA, 16 nt, Salmonella enterica enterica serovar Typhi Ty2
cgcaucugacaucaga

SEQ ID NO: 3738021 - RNA, 16 nt, Salmonella enterica enterica serovar Typhi Ty2
cgcaucugggcugaga

SEQ ID NO: 3738022 - RNA, 21 nt, Salmonella enterica enterica serovar Typhi Ty2
cgcaucugggcugagaaaaau

SEQ ID NO: 3738023 - RNA, 15 nt, Salmonella enterica enterica serovar Typhi Ty2
cgcaugacccaggca

SEQ ID NO: 3738024 - RNA, 19 nt, Salmonella enterica enterica serovar Typhi Ty2
cgcaugacuacgaaucgcg

SEQ ID NO: 3738025 - RNA, 15 nt, Salmonella enterica enterica serovar Typhi Ty2
cgcauggcagggcga

SEQ ID NO: 3738026 - RNA, 15 nt, Salmonella enterica enterica serovar Typhi Ty2
cgcaugggcauaauc

SEQ ID NO: 3738027 - RNA, 21 nt, Salmonella enterica enterica serovar Typhi Ty2
cgcauguuucgcuucaauucg

SEQ ID NO: 3738028 - RNA, 13 nt, Salmonella enterica enterica serovar Typhi Ty2
cgcauguuugccu

SEQ ID NO: 3738029 - RNA, 17 nt, Salmonella enterica enterica serovar Typhi Ty2
cgcauuccagacccgau

SEQ ID NO: 3738030 - RNA, 19 nt, Salmonella enterica enterica serovar Typhi Ty2
cgcauucucugucgccgcc

SEQ ID NO: 3738031 - RNA, 20 nt, Salmonella enterica enterica serovar Typhi Ty2
cgcauucucugucgccgccc

SEQ ID NO: 3738032 - RNA, 18 nt, Salmonella enterica enterica serovar Typhi Ty2
cgcauucuugccgcaucu

SEQ ID NO: 3738033 - RNA, 16 nt, Salmonella enterica enterica serovar Typhi Ty2
cgcauucuuuuuucuc

SEQ ID NO: 3738034 - RNA, 14 nt, Salmonella enterica enterica serovar Typhi Ty2
cgcauugccggcga

SEQ ID NO: 3738035 - RNA, 18 nt, Salmonella enterica enterica serovar Typhi Ty2
cgcauugcgccccagcac

SEQ ID NO: 3738036 - RNA, 19 nt, Salmonella enterica enterica serovar Typhi Ty2
cgcauugcgccccagcaca

SEQ ID NO: 3738037 - RNA, 20 nt, Salmonella enterica enterica serovar Typhi Ty2
cgcauugcgcuauuacucuu

SEQ ID NO: 3738038 - RNA, 17 nt, Salmonella enterica enterica serovar Typhi Ty2
cgcauuucaagcaggcg

SEQ ID NO: 3738039 - RNA, 15 nt, Salmonella enterica enterica serovar Typhi Ty2
cgcauuugcuuucau

SEQ ID NO: 3738040 - RNA, 19 nt, Salmonella enterica enterica serovar Typhi Ty2
cgcauuuuucuucacgccg

SEQ ID NO: 3738041 - RNA, 19 nt, Salmonella enterica enterica serovar Typhi Ty2
cgcauuuuuucuucaguuc

SEQ ID NO: 3738042 - RNA, 16 nt, Salmonella enterica enterica serovar Typhi Ty2
cgccaaaagaggcagc

SEQ ID NO: 3738043 - RNA, 21 nt, Salmonella enterica enterica serovar Typhi Ty2
cgccaaaagaggcagcaaagc

SEQ ID NO: 3738044 - RNA, 14 nt, Salmonella enterica enterica serovar Typhi Ty2
cgccaaaccacacc

SEQ ID NO: 3738045 - RNA, 15 nt, Salmonella enterica enterica serovar Typhi Ty2
cgccaaaccagaccc

SEQ ID NO: 3738046 - RNA, 16 nt, Salmonella enterica enterica serovar Typhi Ty2
cgccaaaccagacccg

SEQ ID NO: 3738047 - RNA, 12 nt, Salmonella enterica enterica serovar Typhi Ty2
cgccaaacccga

SEQ ID NO: 3738048 - RNA, 22 nt, Salmonella enterica enterica serovar Typhi Ty2
cgccaaaccugccacaggccaa

SEQ ID NO: 3738049 - RNA, 14 nt, Salmonella enterica enterica serovar Typhi Ty2
cgccaaacgggcaa

SEQ ID NO: 3738050 - RNA, 18 nt, Salmonella enterica enterica serovar Typhi Ty2
cgccaaagaaacgcugau

SEQ ID NO: 3738051 - RNA, 23 nt, Salmonella enterica enterica serovar Typhi Ty2
cgccaaagcaaucgccagcgccu

SEQ ID NO: 3738052 - RNA, 20 nt, Salmonella enterica enterica serovar Typhi Ty2
cgccaaagggauaagaaaga

SEQ ID NO: 3738053 - RNA, 17 nt, Salmonella enterica enterica serovar Typhi Ty2
cgccaaaguuaaucagc

SEQ ID NO: 3738054 - RNA, 20 nt, Salmonella enterica enterica serovar Typhi Ty2
cgccaaccgugagcgcgccg

SEQ ID NO: 3738055 - RNA, 23 nt, Salmonella enterica enterica serovar Typhi Ty2
cgccaaccucccaaccaguauga

SEQ ID NO: 3738056 - RNA, 15 nt, Salmonella enterica enterica serovar Typhi Ty2
cgccaaccugcuggu

SEQ ID NO: 3738057 - RNA, 12 nt, Salmonella enterica enterica serovar Typhi Ty2
cgccaacgccaa

SEQ ID NO: 3738058 - RNA, 17 nt, Salmonella enterica enterica serovar Typhi Ty2
cgccaacgccagcagcg

SEQ ID NO: 3738059 - RNA, 21 nt, Salmonella enterica enterica serovar Typhi Ty2
cgccaacuuuuugcgcaauac

SEQ ID NO: 3738060 - RNA, 13 nt, Salmonella enterica enterica serovar Typhi Ty2
cgccaagcgcgga

SEQ ID NO: 3738061 - RNA, 20 nt, Salmonella enterica enterica serovar Typhi Ty2
cgccaagcgcggcagcagcu

SEQ ID NO: 3738062 - RNA, 13 nt, Salmonella enterica enterica serovar Typhi Ty2
cgccaagcggcaa

SEQ ID NO: 3738063 - RNA, 16 nt, Salmonella enterica enterica serovar Typhi Ty2
cgccaaguucggugac

SEQ ID NO: 3738064 - RNA, 15 nt, Salmonella enterica enterica serovar Typhi Ty2
cgccaauaccgccgu

SEQ ID NO: 3738065 - RNA, 14 nt, Salmonella enterica enterica serovar Typhi Ty2
cgccaauauccauu

SEQ ID NO: 3738066 - RNA, 20 nt, Salmonella enterica enterica serovar Typhi Ty2
cgccaaucaacgccgccagg

SEQ ID NO: 3738067 - RNA, 18 nt, Salmonella enterica enterica serovar Typhi Ty2
cgccaaucaccgccagca

SEQ ID NO: 3738068 - RNA, 23 nt, Salmonella enterica enterica serovar Typhi Ty2
cgccaaucacuauuugugcggca

SEQ ID NO: 3738069 - RNA, 12 nt, Salmonella enterica enterica serovar Typhi Ty2
cgccaaucagca

SEQ ID NO: 3738070 - RNA, 12 nt, Salmonella enterica enterica serovar Typhi Ty2
cgccaaucggcg

SEQ ID NO: 3738071 - RNA, 17 nt, Salmonella enterica enterica serovar Typhi Ty2
cgccaauggccgccccc

SEQ ID NO: 3738072 - RNA, 16 nt, Salmonella enterica enterica serovar Typhi Ty2
cgccaauuaaauaucc

SEQ ID NO: 3738073 - RNA, 15 nt, Salmonella enterica enterica serovar Typhi Ty2
cgccaauugaugaac

SEQ ID NO: 3738074 - RNA, 18 nt, Salmonella enterica enterica serovar Typhi Ty2
cgccacaauauccgcccc

SEQ ID NO: 3738075 - RNA, 20 nt, Salmonella enterica enterica serovar Typhi Ty2
cgccacaauauccgccccgc

SEQ ID NO: 3738076 - RNA, 23 nt, Salmonella enterica enterica serovar Typhi Ty2
cgccacaccgagacagagaaccu

SEQ ID NO: 3738077 - RNA, 20 nt, Salmonella enterica enterica serovar Typhi Ty2
cgccacaccggauaccgguu

SEQ ID NO: 3738078 - RNA, 14 nt, Salmonella enterica enterica serovar Typhi Ty2
cgccacauucaauu

SEQ ID NO: 3738079 - RNA, 17 nt, Salmonella enterica enterica serovar Typhi Ty2
cgccacauugcgcgccg

SEQ ID NO: 3738080 - RNA, 16 nt, Salmonella enterica enterica serovar Typhi Ty2
cgccaccaaagccagg

SEQ ID NO: 3738081 - RNA, 12 nt, Salmonella enterica enterica serovar Typhi Ty2
cgccaccacaaa

SEQ ID NO: 3738082 - RNA, 16 nt, Salmonella enterica enterica serovar Typhi Ty2
cgccaccacucggcga

SEQ ID NO: 3738083 - RNA, 21 nt, Salmonella enterica enterica serovar Typhi Ty2
cgccaccagauagucaucacc

SEQ ID NO: 3738084 - RNA, 14 nt, Salmonella enterica enterica serovar Typhi Ty2
cgccaccagcgcag

SEQ ID NO: 3738085 - RNA, 16 nt, Salmonella enterica enterica serovar Typhi Ty2
cgccaccauccgacaa

SEQ ID NO: 3738086 - RNA, 17 nt, Salmonella enterica enterica serovar Typhi Ty2
cgccaccauccggcgcu

SEQ ID NO: 3738087 - RNA, 21 nt, Salmonella enterica enterica serovar Typhi Ty2
cgccaccaucgucgccagacc

SEQ ID NO: 3738088 - RNA, 17 nt, Salmonella enterica enterica serovar Typhi Ty2
cgccaccauguugcgca

SEQ ID NO: 3738089 - RNA, 12 nt, Salmonella enterica enterica serovar Typhi Ty2
cgccacccggcu

SEQ ID NO: 3738090 - RNA, 13 nt, Salmonella enterica enterica serovar Typhi Ty2
cgccacccggcuu

SEQ ID NO: 3738091 - RNA, 12 nt, Salmonella enterica enterica serovar Typhi Ty2
cgccagccggaa

SEQ ID NO: 3738092 - RNA, 20 nt, Salmonella enterica enterica serovar Typhi Ty2
cgccagcgacgguaauacca

SEQ ID NO: 3738093 - RNA, 14 nt, Salmonella enterica enterica serovar Typhi Ty2
cgccagcgccaccu

SEQ ID NO: 3738094 - RNA, 16 nt, Salmonella enterica enterica serovar Typhi Ty2
cgccagcgccagcagc

SEQ ID NO: 3738095 - RNA, 15 nt, Salmonella enterica enterica serovar Typhi Ty2
cgccagcgccucuuc

SEQ ID NO: 3738096 - RNA, 17 nt, Salmonella enterica enterica serovar Typhi Ty2
cgccagcggccagcgua

SEQ ID NO: 3738097 - RNA, 22 nt, Salmonella enterica enterica serovar Typhi Ty2
cgccagcggccagcguaccugc

SEQ ID NO: 3738098 - RNA, 12 nt, Salmonella enterica enterica serovar Typhi Ty2
cgccagcggcgc

SEQ ID NO: 3738099 - RNA, 13 nt, Salmonella enterica enterica serovar Typhi Ty2
cgccagcggcgcc

SEQ ID NO: 3738100 - RNA, 14 nt, Salmonella enterica enterica serovar Typhi Ty2
cgccagcggcugcu

SEQ ID NO: 3738101 - RNA, 17 nt, Salmonella enterica enterica serovar Typhi Ty2
cgccagcgggccgguaa

SEQ ID NO: 3738102 - RNA, 18 nt, Salmonella enterica enterica serovar Typhi Ty2
cgccagcgguguuugcca

SEQ ID NO: 3738103 - RNA, 18 nt, Salmonella enterica enterica serovar Typhi Ty2
cgccagcgucucagcagg

SEQ ID NO: 3738104 - RNA, 20 nt, Salmonella enterica enterica serovar Typhi Ty2
cgccagcgugcgcagcgcgu

SEQ ID NO: 3738105 - RNA, 14 nt, Salmonella enterica enterica serovar Typhi Ty2
cgccagcguugacc

SEQ ID NO: 3738106 - RNA, 18 nt, Salmonella enterica enterica serovar Typhi Ty2
cgccagcuaauuuuacuu

SEQ ID NO: 3738107 - RNA, 15 nt, Salmonella enterica enterica serovar Typhi Ty2
cgccagcucaacgcc

SEQ ID NO: 3738108 - RNA, 21 nt, Salmonella enterica enterica serovar Typhi Ty2
cgccagcucaugcgcggcggg

SEQ ID NO: 3738109 - RNA, 23 nt, Salmonella enterica enterica serovar Typhi Ty2
cgccagcuccauagaaaucagca

SEQ ID NO: 3738110 - RNA, 15 nt, Salmonella enterica enterica serovar Typhi Ty2
cgccagcugcgcgcu

SEQ ID NO: 3738111 - RNA, 16 nt, Salmonella enterica enterica serovar Typhi Ty2
cgccagcugcgcgcua

SEQ ID NO: 3738112 - RNA, 20 nt, Salmonella enterica enterica serovar Typhi Ty2
cgccaggaaccgcggucggc

SEQ ID NO: 3738113 - RNA, 21 nt, Salmonella enterica enterica serovar Typhi Ty2
cgccaggaaccgcggucggca

SEQ ID NO: 3738114 - RNA, 15 nt, Salmonella enterica enterica serovar Typhi Ty2
cgccaggcaaucagc

SEQ ID NO: 3738115 - RNA, 19 nt, Salmonella enterica enterica serovar Typhi Ty2
cgccaggcauguuaugaau

SEQ ID NO: 3738116 - RNA, 15 nt, Salmonella enterica enterica serovar Typhi Ty2
cgccaggccagaugg

SEQ ID NO: 3738117 - RNA, 20 nt, Salmonella enterica enterica serovar Typhi Ty2
cgccaggccagauggcuuua

SEQ ID NO: 3738118 - RNA, 15 nt, Salmonella enterica enterica serovar Typhi Ty2
cgccaggcgcugcgu

SEQ ID NO: 3738119 - RNA, 19 nt, Salmonella enterica enterica serovar Typhi Ty2
cgccaggcggguggugagc

SEQ ID NO: 3738120 - RNA, 12 nt, Salmonella enterica enterica serovar Typhi Ty2
cgccagggcggc

SEQ ID NO: 3738121 - RNA, 22 nt, Salmonella enterica enterica serovar Typhi Ty2
cgccagggcgggauccccugcu

SEQ ID NO: 3738122 - RNA, 21 nt, Salmonella enterica enterica serovar Typhi Ty2
cgccaggucucauagcgcccc

SEQ ID NO: 3738123 - RNA, 22 nt, Salmonella enterica enterica serovar Typhi Ty2
cgccaggucucauagcgcccca

SEQ ID NO: 3738124 - RNA, 16 nt, Salmonella enterica enterica serovar Typhi Ty2
cgccaguaaucggcgc

SEQ ID NO: 3738125 - RNA, 23 nt, Salmonella enterica enterica serovar Typhi Ty2
cgccaguaauuuuucucccagca

SEQ ID NO: 3738126 - RNA, 19 nt, Salmonella enterica enterica serovar Typhi Ty2
cgccaguaggaauauacca

SEQ ID NO: 3738127 - RNA, 18 nt, Salmonella enterica enterica serovar Typhi Ty2
cgccagucaucgccgcua

SEQ ID NO: 3738128 - RNA, 18 nt, Salmonella enterica enterica serovar Typhi Ty2
cgccagugaauccaccac

SEQ ID NO: 3738129 - RNA, 14 nt, Salmonella enterica enterica serovar Typhi Ty2
cgccagugcgcaua

SEQ ID NO: 3738130 - RNA, 22 nt, Salmonella enterica enterica serovar Typhi Ty2
cgccaguucauucgccaccagg

SEQ ID NO: 3738131 - RNA, 16 nt, Salmonella enterica enterica serovar Typhi Ty2
cgccaguucccacagc

SEQ ID NO: 3738132 - RNA, 14 nt, Salmonella enterica enterica serovar Typhi Ty2
cgccaguuuacgcg

SEQ ID NO: 3738133 - RNA, 20 nt, Salmonella enterica enterica serovar Typhi Ty2
cgccaguuugcgauccagua

SEQ ID NO: 3738134 - RNA, 19 nt, Salmonella enterica enterica serovar Typhi Ty2
cgccaguuugguuaauucc

SEQ ID NO: 3738135 - RNA, 23 nt, Salmonella enterica enterica serovar Typhi Ty2
cgccaguuuuugcgccauugccg

SEQ ID NO: 3738136 - RNA, 22 nt, Salmonella enterica enterica serovar Typhi Ty2
cgccauaaaaaacaccugucug

SEQ ID NO: 3738137 - RNA, 22 nt, Salmonella enterica enterica serovar Typhi Ty2
cgccauaaaaagcguacaaaaa

SEQ ID NO: 3738138 - RNA, 21 nt, Salmonella enterica enterica serovar Typhi Ty2
cgccauaaaucagauccacgc

SEQ ID NO: 3738139 - RNA, 22 nt, Salmonella enterica enterica serovar Typhi Ty2
cgccauaagaauguccccauau

SEQ ID NO: 3738140 - RNA, 21 nt, Salmonella enterica enterica serovar Typhi Ty2
cgccauaauacuuaauucaua

SEQ ID NO: 3738141 - RNA, 18 nt, Salmonella enterica enterica serovar Typhi Ty2
cgccauaauuguucagcu

SEQ ID NO: 3738142 - RNA, 20 nt, Salmonella enterica enterica serovar Typhi Ty2
cgccauacaacguaccguug

SEQ ID NO: 3738143 - RNA, 19 nt, Salmonella enterica enterica serovar Typhi Ty2
cgccauagaaauagccccg

SEQ ID NO: 3738144 - RNA, 15 nt, Salmonella enterica enterica serovar Typhi Ty2
cgccauagcaucgac

SEQ ID NO: 3738145 - RNA, 20 nt, Salmonella enterica enterica serovar Typhi Ty2
cgccauaguccauuacgcag

SEQ ID NO: 3738146 - RNA, 14 nt, Salmonella enterica enterica serovar Typhi Ty2
cgccauauacgcca

SEQ ID NO: 3738147 - RNA, 20 nt, Salmonella enterica enterica serovar Typhi Ty2
cgccauauaggcauguuccu

SEQ ID NO: 3738148 - RNA, 15 nt, Salmonella enterica enterica serovar Typhi Ty2
cgccauauccaagcc

SEQ ID NO: 3738149 - RNA, 17 nt, Salmonella enterica enterica serovar Typhi Ty2
cgccauauccccgccau

SEQ ID NO: 3738150 - RNA, 15 nt, Salmonella enterica enterica serovar Typhi Ty2
cgccauauccgcaga

SEQ ID NO: 3738151 - RNA, 13 nt, Salmonella enterica enterica serovar Typhi Ty2
cgccauaucggca

SEQ ID NO: 3738152 - RNA, 18 nt, Salmonella enterica enterica serovar Typhi Ty2
cgccaucaaacgcagcaa

SEQ ID NO: 3738153 - RNA, 15 nt, Salmonella enterica enterica serovar Typhi Ty2
cgccaucaacgacca

SEQ ID NO: 3738154 - RNA, 18 nt, Salmonella enterica enterica serovar Typhi Ty2
cgccaucaacuccuccgg

SEQ ID NO: 3738155 - RNA, 20 nt, Salmonella enterica enterica serovar Typhi Ty2
cgccaucaauuuugcgccua

SEQ ID NO: 3738156 - RNA, 12 nt, Salmonella enterica enterica serovar Typhi Ty2
cgccaucaccag

SEQ ID NO: 3738157 - RNA, 17 nt, Salmonella enterica enterica serovar Typhi Ty2
cgccaucagcaaaauac

SEQ ID NO: 3738158 - RNA, 17 nt, Salmonella enterica enterica serovar Typhi Ty2
cgccaucagccgcgcua

SEQ ID NO: 3738159 - RNA, 17 nt, Salmonella enterica enterica serovar Typhi Ty2
cgccaucaggcauaaac

SEQ ID NO: 3738160 - RNA, 14 nt, Salmonella enterica enterica serovar Typhi Ty2
cgccaucaggcaug

SEQ ID NO: 3738161 - RNA, 15 nt, Salmonella enterica enterica serovar Typhi Ty2
cgccaucaggcaugc

SEQ ID NO: 3738162 - RNA, 20 nt, Salmonella enterica enterica serovar Typhi Ty2
cgccaucaggcaugccaaac

SEQ ID NO: 3738163 - RNA, 21 nt, Salmonella enterica enterica serovar Typhi Ty2
cgccaucaggcaugccaaacc

SEQ ID NO: 3738164 - RNA, 19 nt, Salmonella enterica enterica serovar Typhi Ty2
cgccaucaggcuggguaac

SEQ ID NO: 3738165 - RNA, 17 nt, Salmonella enterica enterica serovar Typhi Ty2
cgccauccaccaggcau

SEQ ID NO: 3738166 - RNA, 13 nt, Salmonella enterica enterica serovar Typhi Ty2
cgccauccggcaa

SEQ ID NO: 3738167 - RNA, 14 nt, Salmonella enterica enterica serovar Typhi Ty2
cgccauccggcaac

SEQ ID NO: 3738168 - RNA, 14 nt, Salmonella enterica enterica serovar Typhi Ty2
cgccauccggcaau

SEQ ID NO: 3738169 - RNA, 19 nt, Salmonella enterica enterica serovar Typhi Ty2
cgccauccggcacggucaa

SEQ ID NO: 3738170 - RNA, 13 nt, Salmonella enterica enterica serovar Typhi Ty2
cgccauccggcau

SEQ ID NO: 3738171 - RNA, 17 nt, Salmonella enterica enterica serovar Typhi Ty2
cgccauccggcauuacc

SEQ ID NO: 3738172 - RNA, 15 nt, Salmonella enterica enterica serovar Typhi Ty2
cgccauccggcauuu

SEQ ID NO: 3738173 - RNA, 23 nt, Salmonella enterica enterica serovar Typhi Ty2
cgcccgccagaucggacaucggc

SEQ ID NO: 3738174 - RNA, 15 nt, Salmonella enterica enterica serovar Typhi Ty2
cgcccgccaucgccc

SEQ ID NO: 3738175 - RNA, 13 nt, Salmonella enterica enterica serovar Typhi Ty2
cgcccgccgccag

SEQ ID NO: 3738176 - RNA, 13 nt, Salmonella enterica enterica serovar Typhi Ty2
cgcccgccgccug

SEQ ID NO: 3738177 - RNA, 13 nt, Salmonella enterica enterica serovar Typhi Ty2
cgcccgccgcgaa

SEQ ID NO: 3738178 - RNA, 16 nt, Salmonella enterica enterica serovar Typhi Ty2
cgcccgccucgcugau

SEQ ID NO: 3738179 - RNA, 15 nt, Salmonella enterica enterica serovar Typhi Ty2
cgcccgcucagggag

SEQ ID NO: 3738180 - RNA, 18 nt, Salmonella enterica enterica serovar Typhi Ty2
cgcccgcucgcgauccuc

SEQ ID NO: 3738181 - RNA, 11 nt, Salmonella enterica enterica serovar Typhi Ty2
cgcccgcuuca

SEQ ID NO: 3738182 - RNA, 20 nt, Salmonella enterica enterica serovar Typhi Ty2
cgcccgcuucaucugaggau

SEQ ID NO: 3738183 - RNA, 23 nt, Salmonella enterica enterica serovar Typhi Ty2
cgcccggagggguuuucgccagc

SEQ ID NO: 3738184 - RNA, 17 nt, Salmonella enterica enterica serovar Typhi Ty2
cgcccggaucacggccu

SEQ ID NO: 3738185 - RNA, 18 nt, Salmonella enterica enterica serovar Typhi Ty2
cgcccggaucacggccuu

SEQ ID NO: 3738186 - RNA, 14 nt, Salmonella enterica enterica serovar Typhi Ty2
cgcccggcgccagc

SEQ ID NO: 3738187 - RNA, 13 nt, Salmonella enterica enterica serovar Typhi Ty2
cgcccggcgggua

SEQ ID NO: 3738188 - RNA, 18 nt, Salmonella enterica enterica serovar Typhi Ty2
cgcccguaccgcggcgcu

SEQ ID NO: 3738189 - RNA, 13 nt, Salmonella enterica enterica serovar Typhi Ty2
cgcccguccgcua

SEQ ID NO: 3738190 - RNA, 19 nt, Salmonella enterica enterica serovar Typhi Ty2
cgcccgugacgccaggcag

SEQ ID NO: 3738191 - RNA, 13 nt, Salmonella enterica enterica serovar Typhi Ty2
cgcccguuuccgc

SEQ ID NO: 3738192 - RNA, 22 nt, Salmonella enterica enterica serovar Typhi Ty2
cgcccucaagacgguuauuuuu

SEQ ID NO: 3738193 - RNA, 13 nt, Salmonella enterica enterica serovar Typhi Ty2
cgcccucgccagc

SEQ ID NO: 3738194 - RNA, 15 nt, Salmonella enterica enterica serovar Typhi Ty2
cgcccucgccagcaa

SEQ ID NO: 3738195 - RNA, 16 nt, Salmonella enterica enterica serovar Typhi Ty2
cgcccugaagggcggc

SEQ ID NO: 3738196 - RNA, 13 nt, Salmonella enterica enterica serovar Typhi Ty2
cgcccugacgccg

SEQ ID NO: 3738197 - RNA, 14 nt, Salmonella enterica enterica serovar Typhi Ty2
cgcccugacgccgc

SEQ ID NO: 3738198 - RNA, 23 nt, Salmonella enterica enterica serovar Typhi Ty2
cgcccugaggaguauuauccauu

SEQ ID NO: 3738199 - RNA, 20 nt, Salmonella enterica enterica serovar Typhi Ty2
cgcccugccauucccagccg

SEQ ID NO: 3738200 - RNA, 21 nt, Salmonella enterica enterica serovar Typhi Ty2
cgcccugccauucccagccga

SEQ ID NO: 3738201 - RNA, 21 nt, Salmonella enterica enterica serovar Typhi Ty2
cgcccugcgccagcauggcgu

SEQ ID NO: 3738202 - RNA, 14 nt, Salmonella enterica enterica serovar Typhi Ty2
cgcccugcgcgccu

SEQ ID NO: 3738203 - RNA, 15 nt, Salmonella enterica enterica serovar Typhi Ty2
cgcccugcgcgccuu

SEQ ID NO: 3738204 - RNA, 12 nt, Salmonella enterica enterica serovar Typhi Ty2
cgcccugcggaa

SEQ ID NO: 3738205 - RNA, 15 nt, Salmonella enterica enterica serovar Typhi Ty2
cgcccugcggacagg

SEQ ID NO: 3738206 - RNA, 14 nt, Salmonella enterica enterica serovar Typhi Ty2
cgcccugcgguagc

SEQ ID NO: 3738207 - RNA, 19 nt, Salmonella enterica enterica serovar Typhi Ty2
cgcccugcgguagcgccga

SEQ ID NO: 3738208 - RNA, 16 nt, Salmonella enterica enterica serovar Typhi Ty2
cgcccugcgucgcgcu

SEQ ID NO: 3738209 - RNA, 21 nt, Salmonella enterica enterica serovar Typhi Ty2
cgcccugcgucgcgcuuucaa

SEQ ID NO: 3738210 - RNA, 13 nt, Salmonella enterica enterica serovar Typhi Ty2
cgcccugcuccca

SEQ ID NO: 3738211 - RNA, 18 nt, Salmonella enterica enterica serovar Typhi Ty2
cgcccugcucccacagcu

SEQ ID NO: 3738212 - RNA, 23 nt, Salmonella enterica enterica serovar Typhi Ty2
cgcccuggcgggaaacagguacu

SEQ ID NO: 3738213 - RNA, 21 nt, Salmonella enterica enterica serovar Typhi Ty2
cgcccuguauacaggcauggc

SEQ ID NO: 3738214 - RNA, 15 nt, Salmonella enterica enterica serovar Typhi Ty2
cgcccuuccgucagc

SEQ ID NO: 3738215 - RNA, 23 nt, Salmonella enterica enterica serovar Typhi Ty2
cgcccuuuuaguucaaccugcgc

SEQ ID NO: 3738216 - RNA, 13 nt, Salmonella enterica enterica serovar Typhi Ty2
cgccgaacacgca

SEQ ID NO: 3738217 - RNA, 21 nt, Salmonella enterica enterica serovar Typhi Ty2
cgccgaagccagcgcagucaa

SEQ ID NO: 3738218 - RNA, 15 nt, Salmonella enterica enterica serovar Typhi Ty2
cgccgaagcggcagu

SEQ ID NO: 3738219 - RNA, 12 nt, Salmonella enterica enterica serovar Typhi Ty2
cgccgaagugug

SEQ ID NO: 3738220 - RNA, 23 nt, Salmonella enterica enterica serovar Typhi Ty2
cgccgaauagaguaauacaucca

SEQ ID NO: 3738221 - RNA, 21 nt, Salmonella enterica enterica serovar Typhi Ty2
cgccgacauaagugcaggcug

SEQ ID NO: 3738222 - RNA, 16 nt, Salmonella enterica enterica serovar Typhi Ty2
cgccgacaugguuaac

SEQ ID NO: 3738223 - RNA, 23 nt, Salmonella enterica enterica serovar Typhi Ty2
cgccgacaugguuaaccaccagc

SEQ ID NO: 3738224 - RNA, 17 nt, Salmonella enterica enterica serovar Typhi Ty2
cgccgacauucccugcg

SEQ ID NO: 3738225 - RNA, 20 nt, Salmonella enterica enterica serovar Typhi Ty2
cgccgacauucccugcgcau

SEQ ID NO: 3738226 - RNA, 13 nt, Salmonella enterica enterica serovar Typhi Ty2
cgccgaccaccag

SEQ ID NO: 3738227 - RNA, 14 nt, Salmonella enterica enterica serovar Typhi Ty2
cgccgaccaccagc

SEQ ID NO: 3738228 - RNA, 15 nt, Salmonella enterica enterica serovar Typhi Ty2
cgccgaccauccaga

SEQ ID NO: 3738229 - RNA, 19 nt, Salmonella enterica enterica serovar Typhi Ty2
cgccgacccccuccuugua

SEQ ID NO: 3738230 - RNA, 17 nt, Salmonella enterica enterica serovar Typhi Ty2
cgccgacgaccggcagc

SEQ ID NO: 3738231 - RNA, 17 nt, Salmonella enterica enterica serovar Typhi Ty2
cgccgacgcauccgcca

SEQ ID NO: 3738232 - RNA, 17 nt, Salmonella enterica enterica serovar Typhi Ty2
cgccgacucacgcagcg

SEQ ID NO: 3738233 - RNA, 14 nt, Salmonella enterica enterica serovar Typhi Ty2
cgccgagcauuucc

SEQ ID NO: 3738234 - RNA, 16 nt, Salmonella enterica enterica serovar Typhi Ty2
cgccgaguaauuugaa

SEQ ID NO: 3738235 - RNA, 19 nt, Salmonella enterica enterica serovar Typhi Ty2
cgccgagugcuugcauuuu

SEQ ID NO: 3738236 - RNA, 22 nt, Salmonella enterica enterica serovar Typhi Ty2
cgccgauaaauccuccggcgcg

SEQ ID NO: 3738237 - RNA, 21 nt, Salmonella enterica enterica serovar Typhi Ty2
cgccgauaaccagcgcgccgc

SEQ ID NO: 3738238 - RNA, 14 nt, Salmonella enterica enterica serovar Typhi Ty2
cgccgauacugccc

SEQ ID NO: 3738239 - RNA, 15 nt, Salmonella enterica enterica serovar Typhi Ty2
cgccgaucagcacca

SEQ ID NO: 3738240 - RNA, 23 nt, Salmonella enterica enterica serovar Typhi Ty2
cgccgaucaucccgcccagcaac

SEQ ID NO: 3738241 - RNA, 15 nt, Salmonella enterica enterica serovar Typhi Ty2
cgccgaucggcguuu

SEQ ID NO: 3738242 - RNA, 14 nt, Salmonella enterica enterica serovar Typhi Ty2
cgccgaugccgccg

SEQ ID NO: 3738243 - RNA, 21 nt, Salmonella enterica enterica serovar Typhi Ty2
cgccgauuaaugcuccaauaa

SEQ ID NO: 3738244 - RNA, 22 nt, Salmonella enterica enterica serovar Typhi Ty2
cgccgauugagggggaggcggc

SEQ ID NO: 3738245 - RNA, 17 nt, Salmonella enterica enterica serovar Typhi Ty2
cgccgcaaaccagacca

SEQ ID NO: 3738246 - RNA, 19 nt, Salmonella enterica enterica serovar Typhi Ty2
cgccgcaaacgccgagccg

SEQ ID NO: 3738247 - RNA, 22 nt, Salmonella enterica enterica serovar Typhi Ty2
cgccgcaaaggaucaucggcca

SEQ ID NO: 3738248 - RNA, 18 nt, Salmonella enterica enterica serovar Typhi Ty2
cgccgcaaugccgccugc

SEQ ID NO: 3738249 - RNA, 17 nt, Salmonella enterica enterica serovar Typhi Ty2
cgccgcacacagcagaa

SEQ ID NO: 3738250 - RNA, 16 nt, Salmonella enterica enterica serovar Typhi Ty2
cgccgcagcuccaugu

SEQ ID NO: 3738251 - RNA, 21 nt, Salmonella enterica enterica serovar Typhi Ty2
cgccgcauugguaaagccggu

SEQ ID NO: 3738252 - RNA, 21 nt, Salmonella enterica enterica serovar Typhi Ty2
cgccgccaaacugcgcgccgc

SEQ ID NO: 3738253 - RNA, 21 nt, Salmonella enterica enterica serovar Typhi Ty2
cgccgccaagauuaagaccgu

SEQ ID NO: 3738254 - RNA, 14 nt, Salmonella enterica enterica serovar Typhi Ty2
cgccgccacauugc

SEQ ID NO: 3738255 - RNA, 20 nt, Salmonella enterica enterica serovar Typhi Ty2
cgccgucaggcuugccgcgc

SEQ ID NO: 3738256 - RNA, 14 nt, Salmonella enterica enterica serovar Typhi Ty2
cgccgucauaaaac

SEQ ID NO: 3738257 - RNA, 12 nt, Salmonella enterica enterica serovar Typhi Ty2
cgccgucauccg

SEQ ID NO: 3738258 - RNA, 19 nt, Salmonella enterica enterica serovar Typhi Ty2
cgccguccauuucaaugca

SEQ ID NO: 3738259 - RNA, 21 nt, Salmonella enterica enterica serovar Typhi Ty2
cgccgucgaugauggcggcua

SEQ ID NO: 3738260 - RNA, 18 nt, Salmonella enterica enterica serovar Typhi Ty2
cgccgucgccaucaccag

SEQ ID NO: 3738261 - RNA, 17 nt, Salmonella enterica enterica serovar Typhi Ty2
cgccgucguucagccag

SEQ ID NO: 3738262 - RNA, 16 nt, Salmonella enterica enterica serovar Typhi Ty2
cgccgugcacuucugc

SEQ ID NO: 3738263 - RNA, 20 nt, Salmonella enterica enterica serovar Typhi Ty2
cgccgugcacuucugcggua

SEQ ID NO: 3738264 - RNA, 16 nt, Salmonella enterica enterica serovar Typhi Ty2
cgccgugucuggcgaa

SEQ ID NO: 3738265 - RNA, 17 nt, Salmonella enterica enterica serovar Typhi Ty2
cgccguguucuuaccca

SEQ ID NO: 3738266 - RNA, 21 nt, Salmonella enterica enterica serovar Typhi Ty2
cgccguguugugugccgcgcu

SEQ ID NO: 3738267 - RNA, 20 nt, Salmonella enterica enterica serovar Typhi Ty2
cgccguuaaaccguuaugaa

SEQ ID NO: 3738268 - RNA, 16 nt, Salmonella enterica enterica serovar Typhi Ty2
cgccguuaccagcauc

SEQ ID NO: 3738269 - RNA, 14 nt, Salmonella enterica enterica serovar Typhi Ty2
cgccguuggcguaa

SEQ ID NO: 3738270 - RNA, 15 nt, Salmonella enterica enterica serovar Typhi Ty2
cgccguuuguuuauu

SEQ ID NO: 3738271 - RNA, 21 nt, Salmonella enterica enterica serovar Typhi Ty2
cgccuaacagcgccgcgccga

SEQ ID NO: 3738272 - RNA, 12 nt, Salmonella enterica enterica serovar Typhi Ty2
cgccuaccagca

SEQ ID NO: 3738273 - RNA, 14 nt, Salmonella enterica enterica serovar Typhi Ty2
cgccuaccgcuucc

SEQ ID NO: 3738274 - RNA, 21 nt, Salmonella enterica enterica serovar Typhi Ty2
cgccuaggccagugccaagca

SEQ ID NO: 3738275 - RNA, 12 nt, Salmonella enterica enterica serovar Typhi Ty2
cgccuauuguuc

SEQ ID NO: 3738276 - RNA, 19 nt, Salmonella enterica enterica serovar Typhi Ty2
cgccucaauugccgccagc

SEQ ID NO: 3738277 - RNA, 15 nt, Salmonella enterica enterica serovar Typhi Ty2
cgccucaucugcuuc

SEQ ID NO: 3738278 - RNA, 21 nt, Salmonella enterica enterica serovar Typhi Ty2
cgccucauugauaccuaaacg

SEQ ID NO: 3738279 - RNA, 22 nt, Salmonella enterica enterica serovar Typhi Ty2
cgccuccaccguuugcagccag

SEQ ID NO: 3738280 - RNA, 18 nt, Salmonella enterica enterica serovar Typhi Ty2
cgccuccaggccggauaa

SEQ ID NO: 3738281 - RNA, 18 nt, Salmonella enterica enterica serovar Typhi Ty2
cgccuccccugccggcgg

SEQ ID NO: 3738282 - RNA, 16 nt, Salmonella enterica enterica serovar Typhi Ty2
cgccuccgacaacaag

SEQ ID NO: 3738283 - RNA, 20 nt, Salmonella enterica enterica serovar Typhi Ty2
cgccuccguaugaccgccgc

SEQ ID NO: 3738284 - RNA, 12 nt, Salmonella enterica enterica serovar Typhi Ty2
cgccuccugccg

SEQ ID NO: 3738285 - RNA, 18 nt, Salmonella enterica enterica serovar Typhi Ty2
cgccucgcgauccgccag

SEQ ID NO: 3738286 - RNA, 19 nt, Salmonella enterica enterica serovar Typhi Ty2
cgccucgcgauccgccagc

SEQ ID NO: 3738287 - RNA, 14 nt, Salmonella enterica enterica serovar Typhi Ty2
cgccucgcucucuu

SEQ ID NO: 3738288 - RNA, 21 nt, Salmonella enterica enterica serovar Typhi Ty2
cgccucguaucugucccagcc

SEQ ID NO: 3738289 - RNA, 21 nt, Salmonella enterica enterica serovar Typhi Ty2
cgccugaaaggcacgcuccug

SEQ ID NO: 3738290 - RNA, 17 nt, Salmonella enterica enterica serovar Typhi Ty2
cgccugaagauacgcca

SEQ ID NO: 3738291 - RNA, 18 nt, Salmonella enterica enterica serovar Typhi Ty2
cgccugaauaaucggcgu

SEQ ID NO: 3738292 - RNA, 23 nt, Salmonella enterica enterica serovar Typhi Ty2
cgccugacgaaagucauccagua

SEQ ID NO: 3738293 - RNA, 17 nt, Salmonella enterica enterica serovar Typhi Ty2
cgccugacgcggacgcc

SEQ ID NO: 3738294 - RNA, 24 nt, Salmonella enterica enterica serovar Typhi Ty2
cgccugacgcggacgccaccacag

SEQ ID NO: 3738295 - RNA, 16 nt, Salmonella enterica enterica serovar Typhi Ty2
cgccugauccggccua

SEQ ID NO: 3738296 - RNA, 15 nt, Salmonella enterica enterica serovar Typhi Ty2
cgccugaucgcgcag

SEQ ID NO: 3738297 - RNA, 16 nt, Salmonella enterica enterica serovar Typhi Ty2
cgccugaucuuucugg

SEQ ID NO: 3738298 - RNA, 16 nt, Salmonella enterica enterica serovar Typhi Ty2
cgccugauuuaaugaa

SEQ ID NO: 3738299 - RNA, 14 nt, Salmonella enterica enterica serovar Typhi Ty2
cgccugcauaaugc

SEQ ID NO: 3738300 - RNA, 20 nt, Salmonella enterica enterica serovar Typhi Ty2
cgccugccaacauggggagc

SEQ ID NO: 3738301 - RNA, 13 nt, Salmonella enterica enterica serovar Typhi Ty2
cgccugccagcgc

SEQ ID NO: 3738302 - RNA, 14 nt, Salmonella enterica enterica serovar Typhi Ty2
cgccugccgcaugu

SEQ ID NO: 3738303 - RNA, 14 nt, Salmonella enterica enterica serovar Typhi Ty2
cgccugcgcgccug

SEQ ID NO: 3738304 - RNA, 22 nt, Salmonella enterica enterica serovar Typhi Ty2
cgccugcgcucauauacccugc

SEQ ID NO: 3738305 - RNA, 21 nt, Salmonella enterica enterica serovar Typhi Ty2
cgccugcggaaucuccggcga

SEQ ID NO: 3738306 - RNA, 12 nt, Salmonella enterica enterica serovar Typhi Ty2
cgccugcuccgu

SEQ ID NO: 3738307 - RNA, 15 nt, Salmonella enterica enterica serovar Typhi Ty2
cgccugcugccagcc

SEQ ID NO: 3738308 - RNA, 20 nt, Salmonella enterica enterica serovar Typhi Ty2
cgccugcugccagccgccgc

SEQ ID NO: 3738309 - RNA, 17 nt, Salmonella enterica enterica serovar Typhi Ty2
cgccugcuguugggcag

SEQ ID NO: 3738310 - RNA, 19 nt, Salmonella enterica enterica serovar Typhi Ty2
cgccuggcaguucagucgg

SEQ ID NO: 3738311 - RNA, 21 nt, Salmonella enterica enterica serovar Typhi Ty2
cgccuggcuugcggguuuuga

SEQ ID NO: 3738312 - RNA, 17 nt, Salmonella enterica enterica serovar Typhi Ty2
cgccuguaaacguuccu

SEQ ID NO: 3738313 - RNA, 22 nt, Salmonella enterica enterica serovar Typhi Ty2
cgccuguaaggcucucuuacca

SEQ ID NO: 3738314 - RNA, 23 nt, Salmonella enterica enterica serovar Typhi Ty2
cgccuguaaugucuggugcagca

SEQ ID NO: 3738315 - RNA, 14 nt, Salmonella enterica enterica serovar Typhi Ty2
cgccuguccggccu

SEQ ID NO: 3738316 - RNA, 15 nt, Salmonella enterica enterica serovar Typhi Ty2
cgccugugcuggcga

SEQ ID NO: 3738317 - RNA, 22 nt, Salmonella enterica enterica serovar Typhi Ty2
cgccugugcuuucgccaccagc

SEQ ID NO: 3738318 - RNA, 14 nt, Salmonella enterica enterica serovar Typhi Ty2
cgccuguuaauggu

SEQ ID NO: 3738319 - RNA, 23 nt, Salmonella enterica enterica serovar Typhi Ty2
cgccuguuagggcgcggcuggua

SEQ ID NO: 3738320 - RNA, 18 nt, Salmonella enterica enterica serovar Typhi Ty2
cgccuguugcugacgauu

SEQ ID NO: 3738321 - RNA, 20 nt, Salmonella enterica enterica serovar Typhi Ty2
cgccuuaagaauguccaucu

SEQ ID NO: 3738322 - RNA, 15 nt, Salmonella enterica enterica serovar Typhi Ty2
cgccuuaccgcggua

SEQ ID NO: 3738323 - RNA, 15 nt, Salmonella enterica enterica serovar Typhi Ty2
cgccuuauccggccu

SEQ ID NO: 3738324 - RNA, 20 nt, Salmonella enterica enterica serovar Typhi Ty2
cgccuuauccggccuacaaa

SEQ ID NO: 3738325 - RNA, 23 nt, Salmonella enterica enterica serovar Typhi Ty2
cgccuucacacugcgccgccagc

SEQ ID NO: 3738326 - RNA, 12 nt, Salmonella enterica enterica serovar Typhi Ty2
cgccuuccaguu

SEQ ID NO: 3738327 - RNA, 12 nt, Salmonella enterica enterica serovar Typhi Ty2
cgccuuccggcc

SEQ ID NO: 3738328 - RNA, 21 nt, Salmonella enterica enterica serovar Typhi Ty2
cgccuuccggccacuccgcca

SEQ ID NO: 3738329 - RNA, 14 nt, Salmonella enterica enterica serovar Typhi Ty2
cgccuuccuccagc

SEQ ID NO: 3738330 - RNA, 15 nt, Salmonella enterica enterica serovar Typhi Ty2
cgccuuccuccagca

SEQ ID NO: 3738331 - RNA, 22 nt, Salmonella enterica enterica serovar Typhi Ty2
cgccuucgaaccggguauugaa

SEQ ID NO: 3738332 - RNA, 17 nt, Salmonella enterica enterica serovar Typhi Ty2
cgccuucgacuuccgca

SEQ ID NO: 3738333 - RNA, 21 nt, Salmonella enterica enterica serovar Typhi Ty2
cgccuucgauuaguccgucgg

SEQ ID NO: 3738334 - RNA, 20 nt, Salmonella enterica enterica serovar Typhi Ty2
cgccuucgcggugaucccag

SEQ ID NO: 3738335 - RNA, 15 nt, Salmonella enterica enterica serovar Typhi Ty2
cgccuucggccugaa

SEQ ID NO: 3738336 - RNA, 18 nt, Salmonella enterica enterica serovar Typhi Ty2
cgccuucguuauaaggcc

SEQ ID NO: 3738337 - RNA, 23 nt, Salmonella enterica enterica serovar Typhi Ty2
cgcgcaaccgcaucacgcgaagc

SEQ ID NO: 3738338 - RNA, 19 nt, Salmonella enterica enterica serovar Typhi Ty2
cgcgcaaucauuaccggac

SEQ ID NO: 3738339 - RNA, 21 nt, Salmonella enterica enterica serovar Typhi Ty2
cgcgcacaacgugcaaaacag

SEQ ID NO: 3738340 - RNA, 19 nt, Salmonella enterica enterica serovar Typhi Ty2
cgcgcacagggugaaauca

SEQ ID NO: 3738341 - RNA, 22 nt, Salmonella enterica enterica serovar Typhi Ty2
cgcgcaccauaauauaaggauc

SEQ ID NO: 3738342 - RNA, 17 nt, Salmonella enterica enterica serovar Typhi Ty2
cgcgcaccuucucuccu

SEQ ID NO: 3738343 - RNA, 14 nt, Salmonella enterica enterica serovar Typhi Ty2
cgcgcacgcgcgcg

SEQ ID NO: 3738344 - RNA, 16 nt, Salmonella enterica enterica serovar Typhi Ty2
cgcgcagaaucacuuc

SEQ ID NO: 3738345 - RNA, 21 nt, Salmonella enterica enterica serovar Typhi Ty2
cgcgcagaaucacuucauccg

SEQ ID NO: 3738346 - RNA, 13 nt, Salmonella enterica enterica serovar Typhi Ty2
cgcgcagcaggcc

SEQ ID NO: 3738347 - RNA, 14 nt, Salmonella enterica enterica serovar Typhi Ty2
cgcgcagcaggcca

SEQ ID NO: 3738348 - RNA, 20 nt, Salmonella enterica enterica serovar Typhi Ty2
cgcgcagcgauauagcgcau

SEQ ID NO: 3738349 - RNA, 15 nt, Salmonella enterica enterica serovar Typhi Ty2
cgcgcagcugggccu

SEQ ID NO: 3738350 - RNA, 17 nt, Salmonella enterica enterica serovar Typhi Ty2
cgcgcaggcgccgauaa

SEQ ID NO: 3738351 - RNA, 13 nt, Salmonella enterica enterica serovar Typhi Ty2
cgcgcagugcagc

SEQ ID NO: 3738352 - RNA, 18 nt, Salmonella enterica enterica serovar Typhi Ty2
cgcgcaguucaauauuca

SEQ ID NO: 3738353 - RNA, 19 nt, Salmonella enterica enterica serovar Typhi Ty2
cgcgcauagcuggcguagc

SEQ ID NO: 3738354 - RNA, 13 nt, Salmonella enterica enterica serovar Typhi Ty2
cgcgcauccgggc

SEQ ID NO: 3738355 - RNA, 22 nt, Salmonella enterica enterica serovar Typhi Ty2
cgcgcaucuucacuguuaucgc

SEQ ID NO: 3738356 - RNA, 18 nt, Salmonella enterica enterica serovar Typhi Ty2
cgcgcauggcagggcgau

SEQ ID NO: 3738357 - RNA, 16 nt, Salmonella enterica enterica serovar Typhi Ty2
cgcgcauugaccagga

SEQ ID NO: 3738358 - RNA, 17 nt, Salmonella enterica enterica serovar Typhi Ty2
cgcgccaaacggcagcu

SEQ ID NO: 3738359 - RNA, 18 nt, Salmonella enterica enterica serovar Typhi Ty2
cgcgccaaaguuaaucag

SEQ ID NO: 3738360 - RNA, 22 nt, Salmonella enterica enterica serovar Typhi Ty2
cgcgccaaaguuaaucagcgcc

SEQ ID NO: 3738361 - RNA, 17 nt, Salmonella enterica enterica serovar Typhi Ty2
cgcgccaaugcgaaaau

SEQ ID NO: 3738362 - RNA, 13 nt, Salmonella enterica enterica serovar Typhi Ty2
cgcgccacgccau

SEQ ID NO: 3738363 - RNA, 17 nt, Salmonella enterica enterica serovar Typhi Ty2
cgcgccacgucggauaa

SEQ ID NO: 3738364 - RNA, 13 nt, Salmonella enterica enterica serovar Typhi Ty2
cgcgccacuucca

SEQ ID NO: 3738365 - RNA, 15 nt, Salmonella enterica enterica serovar Typhi Ty2
cgcgccagacgccau

SEQ ID NO: 3738366 - RNA, 23 nt, Salmonella enterica enterica serovar Typhi Ty2
cgcgccagaugcuuaaacugcgc

SEQ ID NO: 3738367 - RNA, 12 nt, Salmonella enterica enterica serovar Typhi Ty2
cgcgccagccaa

SEQ ID NO: 3738368 - RNA, 12 nt, Salmonella enterica enterica serovar Typhi Ty2
cgcgccagcgac

SEQ ID NO: 3738369 - RNA, 19 nt, Salmonella enterica enterica serovar Typhi Ty2
cgcgccaggucucauagcg

SEQ ID NO: 3738370 - RNA, 22 nt, Salmonella enterica enterica serovar Typhi Ty2
cgcgccaguuuggugaugcgau

SEQ ID NO: 3738371 - RNA, 20 nt, Salmonella enterica enterica serovar Typhi Ty2
cgcgccauacuuacugcugu

SEQ ID NO: 3738372 - RNA, 21 nt, Salmonella enterica enterica serovar Typhi Ty2
cgcgccauccggcauuaccgc

SEQ ID NO: 3738373 - RNA, 21 nt, Salmonella enterica enterica serovar Typhi Ty2
cgcgccaucuuucacccauug

SEQ ID NO: 3738374 - RNA, 14 nt, Salmonella enterica enterica serovar Typhi Ty2
cgcgccauuuagcg

SEQ ID NO: 3738375 - RNA, 18 nt, Salmonella enterica enterica serovar Typhi Ty2
cgcgccauuugccagaua

SEQ ID NO: 3738376 - RNA, 15 nt, Salmonella enterica enterica serovar Typhi Ty2
cgcgcccaccgauga

SEQ ID NO: 3738377 - RNA, 14 nt, Salmonella enterica enterica serovar Typhi Ty2
cgcgcccgacgcgc

SEQ ID NO: 3738378 - RNA, 14 nt, Salmonella enterica enterica serovar Typhi Ty2
cgcgcccgccgcca

SEQ ID NO: 3738379 - RNA, 16 nt, Salmonella enterica enterica serovar Typhi Ty2
cgcgcccuccuccagc

SEQ ID NO: 3738380 - RNA, 14 nt, Salmonella enterica enterica serovar Typhi Ty2
cgcgccgcagcgcc

SEQ ID NO: 3738381 - RNA, 14 nt, Salmonella enterica enterica serovar Typhi Ty2
cgcgccgcaucuuc

SEQ ID NO: 3738382 - RNA, 13 nt, Salmonella enterica enterica serovar Typhi Ty2
cgcgccgccaacg

SEQ ID NO: 3738383 - RNA, 22 nt, Salmonella enterica enterica serovar Typhi Ty2
cgcgccgccaacgccaacauag

SEQ ID NO: 3738384 - RNA, 13 nt, Salmonella enterica enterica serovar Typhi Ty2
cgcgccgccgccu

SEQ ID NO: 3738385 - RNA, 12 nt, Salmonella enterica enterica serovar Typhi Ty2
cgcgccgccucu

SEQ ID NO: 3738386 - RNA, 18 nt, Salmonella enterica enterica serovar Typhi Ty2
cgcgccgcugcuuagcag

SEQ ID NO: 3738387 - RNA, 21 nt, Salmonella enterica enterica serovar Typhi Ty2
cgcgccgcuggcgaccagccu

SEQ ID NO: 3738388 - RNA, 17 nt, Salmonella enterica enterica serovar Typhi Ty2
cgcgccggucgccagca

SEQ ID NO: 3738389 - RNA, 15 nt, Salmonella enterica enterica serovar Typhi Ty2
cgcgccgugcccagc

SEQ ID NO: 3738390 - RNA, 11 nt, Salmonella enterica enterica serovar Typhi Ty2
cgcgccguucg

SEQ ID NO: 3738391 - RNA, 16 nt, Salmonella enterica enterica serovar Typhi Ty2
cgcgccuaccagcgcu

SEQ ID NO: 3738392 - RNA, 14 nt, Salmonella enterica enterica serovar Typhi Ty2
cgcgccuaccgcca

SEQ ID NO: 3738393 - RNA, 16 nt, Salmonella enterica enterica serovar Typhi Ty2
cgcgccuccccugccg

SEQ ID NO: 3738394 - RNA, 16 nt, Salmonella enterica enterica serovar Typhi Ty2
cgcgccugacgcggac

SEQ ID NO: 3738395 - RNA, 12 nt, Salmonella enterica enterica serovar Typhi Ty2
cgcgccugccaa

SEQ ID NO: 3738396 - RNA, 19 nt, Salmonella enterica enterica serovar Typhi Ty2
cgcgccuggaucugcgcau

SEQ ID NO: 3738397 - RNA, 20 nt, Salmonella enterica enterica serovar Typhi Ty2
cgcgcgaaacgcacccgcgc

SEQ ID NO: 3738398 - RNA, 12 nt, Salmonella enterica enterica serovar Typhi Ty2
cgcgcgaaggcg

SEQ ID NO: 3738399 - RNA, 11 nt, Salmonella enterica enterica serovar Typhi Ty2
cgcgcgaccca

SEQ ID NO: 3738400 - RNA, 19 nt, Salmonella enterica enterica serovar Typhi Ty2
cgcgcgacuuaucuuccac

SEQ ID NO: 3738401 - RNA, 14 nt, Salmonella enterica enterica serovar Typhi Ty2
cgcgcgaugcugcu

SEQ ID NO: 3738402 - RNA, 22 nt, Salmonella enterica enterica serovar Typhi Ty2
cgcgcgaugguaggccugauaa

SEQ ID NO: 3738403 - RNA, 17 nt, Salmonella enterica enterica serovar Typhi Ty2
cgcgcgcaggcccaccg

SEQ ID NO: 3738404 - RNA, 17 nt, Salmonella enterica enterica serovar Typhi Ty2
cgcgcgcagguucgucu

SEQ ID NO: 3738405 - RNA, 21 nt, Salmonella enterica enterica serovar Typhi Ty2
cgcgcgccagucaucgccgcu

SEQ ID NO: 3738406 - RNA, 12 nt, Salmonella enterica enterica serovar Typhi Ty2
cgcgcgccgccu

SEQ ID NO: 3738407 - RNA, 13 nt, Salmonella enterica enterica serovar Typhi Ty2
cgcgcgccgccuc

SEQ ID NO: 3738408 - RNA, 19 nt, Salmonella enterica enterica serovar Typhi Ty2
cgcgcgccgcuuccggcag

SEQ ID NO: 3738409 - RNA, 21 nt, Salmonella enterica enterica serovar Typhi Ty2
cgcgcgccgcuuccggcaggu

SEQ ID NO: 3738410 - RNA, 19 nt, Salmonella enterica enterica serovar Typhi Ty2
cgcgcgcuuucaccgccuc

SEQ ID NO: 3738411 - RNA, 17 nt, Salmonella enterica enterica serovar Typhi Ty2
cgcgcggauucuccagg

SEQ ID NO: 3738412 - RNA, 15 nt, Salmonella enterica enterica serovar Typhi Ty2
cgcgcggcaggccuu

SEQ ID NO: 3738413 - RNA, 14 nt, Salmonella enterica enterica serovar Typhi Ty2
cgcgcggugaaagu

SEQ ID NO: 3738414 - RNA, 23 nt, Salmonella enterica enterica serovar Typhi Ty2
cgcgcguacugcccguggcggag

SEQ ID NO: 3738415 - RNA, 13 nt, Salmonella enterica enterica serovar Typhi Ty2
cgcgcguauccgc

SEQ ID NO: 3738416 - RNA, 22 nt, Salmonella enterica enterica serovar Typhi Ty2
cgcgcguccacggcgggacgcu

SEQ ID NO: 3738417 - RNA, 18 nt, Salmonella enterica enterica serovar Typhi Ty2
cgcgcguucauccaccgc

SEQ ID NO: 3738418 - RNA, 22 nt, Salmonella enterica enterica serovar Typhi Ty2
cgcgcguuccaucacuuccugu

SEQ ID NO: 3738419 - RNA, 21 nt, Salmonella enterica enterica serovar Typhi Ty2
cgcgguauuucgcaacgccgc

SEQ ID NO: 3738420 - RNA, 12 nt, Salmonella enterica enterica serovar Typhi Ty2
cgcggucagcgg

SEQ ID NO: 3738421 - RNA, 19 nt, Salmonella enterica enterica serovar Typhi Ty2
cgcggucagcggcgcgccg

SEQ ID NO: 3738422 - RNA, 17 nt, Salmonella enterica enterica serovar Typhi Ty2
cgcggucauugagccgc

SEQ ID NO: 3738423 - RNA, 12 nt, Salmonella enterica enterica serovar Typhi Ty2
cgcggucggcag

SEQ ID NO: 3738424 - RNA, 16 nt, Salmonella enterica enterica serovar Typhi Ty2
cgcggucggcaggcgg

SEQ ID NO: 3738425 - RNA, 22 nt, Salmonella enterica enterica serovar Typhi Ty2
cgcggucgggauauaugcaaaa

SEQ ID NO: 3738426 - RNA, 23 nt, Salmonella enterica enterica serovar Typhi Ty2
cgcggugacuuuggccggcuucu

SEQ ID NO: 3738427 - RNA, 21 nt, Salmonella enterica enterica serovar Typhi Ty2
cgcgguucuguuccgcuaucu

SEQ ID NO: 3738428 - RNA, 15 nt, Salmonella enterica enterica serovar Typhi Ty2
cgcgguugucggcgc

SEQ ID NO: 3738429 - RNA, 12 nt, Salmonella enterica enterica serovar Typhi Ty2
cgcgguuuaucc

SEQ ID NO: 3738430 - RNA, 17 nt, Salmonella enterica enterica serovar Typhi Ty2
cgcguaaacuuccgcca

SEQ ID NO: 3738431 - RNA, 19 nt, Salmonella enterica enterica serovar Typhi Ty2
cgcguaaacuuccgccagc

SEQ ID NO: 3738432 - RNA, 20 nt, Salmonella enterica enterica serovar Typhi Ty2
cgcguaaauccacauuccag

SEQ ID NO: 3738433 - RNA, 15 nt, Salmonella enterica enterica serovar Typhi Ty2
cgcguacagcgccau

SEQ ID NO: 3738434 - RNA, 17 nt, Salmonella enterica enterica serovar Typhi Ty2
cgcguacagcgccauga

SEQ ID NO: 3738435 - RNA, 12 nt, Salmonella enterica enterica serovar Typhi Ty2
cgcguaccagcg

SEQ ID NO: 3738436 - RNA, 13 nt, Salmonella enterica enterica serovar Typhi Ty2
cgcguaccagcgc

SEQ ID NO: 3738437 - RNA, 17 nt, Salmonella enterica enterica serovar Typhi Ty2
cgcguacccggcuuaca

SEQ ID NO: 3738438 - RNA, 20 nt, Salmonella enterica enterica serovar Typhi Ty2
cgcguacuuucgccaguuca

SEQ ID NO: 3738439 - RNA, 18 nt, Salmonella enterica enterica serovar Typhi Ty2
cgcguagcccacagguag

SEQ ID NO: 3738440 - RNA, 16 nt, Salmonella enterica enterica serovar Typhi Ty2
cgcguagcccagcgcc

SEQ ID NO: 3738441 - RNA, 15 nt, Salmonella enterica enterica serovar Typhi Ty2
cgcguauaacgccgc

SEQ ID NO: 3738442 - RNA, 17 nt, Salmonella enterica enterica serovar Typhi Ty2
cgcguauaacgccgccc

SEQ ID NO: 3738443 - RNA, 17 nt, Salmonella enterica enterica serovar Typhi Ty2
cgcgucaaauagagaaa

SEQ ID NO: 3738444 - RNA, 13 nt, Salmonella enterica enterica serovar Typhi Ty2
cgcgucaacgcca

SEQ ID NO: 3738445 - RNA, 17 nt, Salmonella enterica enterica serovar Typhi Ty2
cgcgucacaacagccgg

SEQ ID NO: 3738446 - RNA, 14 nt, Salmonella enterica enterica serovar Typhi Ty2
cgcgucacaagcuc

SEQ ID NO: 3738447 - RNA, 17 nt, Salmonella enterica enterica serovar Typhi Ty2
cgcgucacgaccggcga

SEQ ID NO: 3738448 - RNA, 18 nt, Salmonella enterica enterica serovar Typhi Ty2
cgcgucacgaccggcgaa

SEQ ID NO: 3738449 - RNA, 18 nt, Salmonella enterica enterica serovar Typhi Ty2
cgcgucagcgccuccgcg

SEQ ID NO: 3738450 - RNA, 11 nt, Salmonella enterica enterica serovar Typhi Ty2
cgcgucagggc

SEQ ID NO: 3738451 - RNA, 15 nt, Salmonella enterica enterica serovar Typhi Ty2
cgcgucagggcgaua

SEQ ID NO: 3738452 - RNA, 16 nt, Salmonella enterica enterica serovar Typhi Ty2
cgcgucagggcgauaa

SEQ ID NO: 3738453 - RNA, 17 nt, Salmonella enterica enterica serovar Typhi Ty2
cgcgucaucggcgcgcu

SEQ ID NO: 3738454 - RNA, 15 nt, Salmonella enterica enterica serovar Typhi Ty2
cgcguccauuacucu

SEQ ID NO: 3738455 - RNA, 13 nt, Salmonella enterica enterica serovar Typhi Ty2
cgcgucccucucc

SEQ ID NO: 3738456 - RNA, 14 nt, Salmonella enterica enterica serovar Typhi Ty2
cgcgucccucucca

SEQ ID NO: 3738457 - RNA, 12 nt, Salmonella enterica enterica serovar Typhi Ty2
cgcgucgccauc

SEQ ID NO: 3738458 - RNA, 21 nt, Salmonella enterica enterica serovar Typhi Ty2
cgcgucggccggcaccagcca

SEQ ID NO: 3738459 - RNA, 21 nt, Salmonella enterica enterica serovar Typhi Ty2
cgcgucugaaugacgccgucu

SEQ ID NO: 3738460 - RNA, 19 nt, Salmonella enterica enterica serovar Typhi Ty2
cgcgucuguguuuauccgg

SEQ ID NO: 3738461 - RNA, 17 nt, Salmonella enterica enterica serovar Typhi Ty2
cgcgucuucaucagcca

SEQ ID NO: 3738462 - RNA, 21 nt, Salmonella enterica enterica serovar Typhi Ty2
cgcgucuucaucagccagcau

SEQ ID NO: 3738463 - RNA, 21 nt, Salmonella enterica enterica serovar Typhi Ty2
cgcgugacgacuaccgccgau

SEQ ID NO: 3738464 - RNA, 14 nt, Salmonella enterica enterica serovar Typhi Ty2
cgcgugacgcagua

SEQ ID NO: 3738465 - RNA, 18 nt, Salmonella enterica enterica serovar Typhi Ty2
cgcgugacgcaguaauac

SEQ ID NO: 3738466 - RNA, 16 nt, Salmonella enterica enterica serovar Typhi Ty2
cgcgugagaucguuau

SEQ ID NO: 3738467 - RNA, 15 nt, Salmonella enterica enterica serovar Typhi Ty2
cgcgugguaucgcga

SEQ ID NO: 3738468 - RNA, 17 nt, Salmonella enterica enterica serovar Typhi Ty2
cgcguucagcaucggga

SEQ ID NO: 3738469 - RNA, 15 nt, Salmonella enterica enterica serovar Typhi Ty2
cgcguuguaaucgcc

SEQ ID NO: 3738470 - RNA, 20 nt, Salmonella enterica enterica serovar Typhi Ty2
cgcguuuaaauaaaaauucc

SEQ ID NO: 3738471 - RNA, 14 nt, Salmonella enterica enterica serovar Typhi Ty2
cgcguuuagcgcca

SEQ ID NO: 3738472 - RNA, 18 nt, Salmonella enterica enterica serovar Typhi Ty2
cgcguuuaucgcauacgg

SEQ ID NO: 3738473 - RNA, 14 nt, Salmonella enterica enterica serovar Typhi Ty2
cgcguuuuccacca

SEQ ID NO: 3738474 - RNA, 16 nt, Salmonella enterica enterica serovar Typhi Ty2
cgcguuuuccauuuua

SEQ ID NO: 3738475 - RNA, 13 nt, Salmonella enterica enterica serovar Typhi Ty2
cgcuaaaccggcg

SEQ ID NO: 3738476 - RNA, 13 nt, Salmonella enterica enterica serovar Typhi Ty2
cgcuaaagcgcug

SEQ ID NO: 3738477 - RNA, 14 nt, Salmonella enterica enterica serovar Typhi Ty2
cgcuaaagcgcugg

SEQ ID NO: 3738478 - RNA, 15 nt, Salmonella enterica enterica serovar Typhi Ty2
cgcuaaaugcauagc

SEQ ID NO: 3738479 - RNA, 22 nt, Salmonella enterica enterica serovar Typhi Ty2
cgcuaaccagcgcuucgccugc

SEQ ID NO: 3738480 - RNA, 15 nt, Salmonella enterica enterica serovar Typhi Ty2
cgcuaagccagccaa

SEQ ID NO: 3738481 - RNA, 21 nt, Salmonella enterica enterica serovar Typhi Ty2
cgcuaaucccgcucgccaggu

SEQ ID NO: 3738482 - RNA, 21 nt, Salmonella enterica enterica serovar Typhi Ty2
cgcuaaugcccggcgcggcau

SEQ ID NO: 3738483 - RNA, 23 nt, Salmonella enterica enterica serovar Typhi Ty2
cgcuaauguacgccuaaaaauga

SEQ ID NO: 3738484 - RNA, 17 nt, Salmonella enterica enterica serovar Typhi Ty2
cgcuaauuuucagggug

SEQ ID NO: 3738485 - RNA, 17 nt, Salmonella enterica enterica serovar Typhi Ty2
cgcuaauuuuuaaauga

SEQ ID NO: 3738486 - RNA, 15 nt, Salmonella enterica enterica serovar Typhi Ty2
cgcuacaauccagga

SEQ ID NO: 3738487 - RNA, 12 nt, Salmonella enterica enterica serovar Typhi Ty2
cgcuacgcgucg

SEQ ID NO: 3738488 - RNA, 16 nt, Salmonella enterica enterica serovar Typhi Ty2
cgcuacgcuuaucagg

SEQ ID NO: 3738489 - RNA, 15 nt, Salmonella enterica enterica serovar Typhi Ty2
cgcuacggcguuuca

SEQ ID NO: 3738490 - RNA, 16 nt, Salmonella enterica enterica serovar Typhi Ty2
cgcuacguuuaucugg

SEQ ID NO: 3738491 - RNA, 22 nt, Salmonella enterica enterica serovar Typhi Ty2
cgcuacugugggccguuccgca

SEQ ID NO: 3738492 - RNA, 14 nt, Salmonella enterica enterica serovar Typhi Ty2
cgcuagccgcaucc

SEQ ID NO: 3738493 - RNA, 15 nt, Salmonella enterica enterica serovar Typhi Ty2
cgcuagcuggcaggg

SEQ ID NO: 3738494 - RNA, 16 nt, Salmonella enterica enterica serovar Typhi Ty2
cgcuagggcaucagac

SEQ ID NO: 3738495 - RNA, 14 nt, Salmonella enterica enterica serovar Typhi Ty2
cgcuagugccgcca

SEQ ID NO: 3738496 - RNA, 14 nt, Salmonella enterica enterica serovar Typhi Ty2
cgcuauauuccagc

SEQ ID NO: 3738497 - RNA, 21 nt, Salmonella enterica enterica serovar Typhi Ty2
cgcuaucaacgccuccaggcu

SEQ ID NO: 3738498 - RNA, 19 nt, Salmonella enterica enterica serovar Typhi Ty2
cgcuaucaccgccgcccgu

SEQ ID NO: 3738499 - RNA, 12 nt, Salmonella enterica enterica serovar Typhi Ty2
cgcuauccagca

SEQ ID NO: 3738500 - RNA, 14 nt, Salmonella enterica enterica serovar Typhi Ty2
cgcuauccagcagu

SEQ ID NO: 3738501 - RNA, 15 nt, Salmonella enterica enterica serovar Typhi Ty2
cgcuauccggcgcgc

SEQ ID NO: 3738502 - RNA, 20 nt, Salmonella enterica enterica serovar Typhi Ty2
cgcugucggucagauucaga

SEQ ID NO: 3738503 - RNA, 19 nt, Salmonella enterica enterica serovar Typhi Ty2
cgcugugauccauguugcc

SEQ ID NO: 3738504 - RNA, 21 nt, Salmonella enterica enterica serovar Typhi Ty2
cgcugugcuaucaggccuaca

SEQ ID NO: 3738505 - RNA, 17 nt, Salmonella enterica enterica serovar Typhi Ty2
cgcugugguuuauccgc

SEQ ID NO: 3738506 - RNA, 15 nt, Salmonella enterica enterica serovar Typhi Ty2
cgcuguucuugcugc

SEQ ID NO: 3738507 - RNA, 16 nt, Salmonella enterica enterica serovar Typhi Ty2
cgcuguuuauccacag

SEQ ID NO: 3738508 - RNA, 13 nt, Salmonella enterica enterica serovar Typhi Ty2
cgcuguuucucga

SEQ ID NO: 3738509 - RNA, 17 nt, Salmonella enterica enterica serovar Typhi Ty2
cgcuuaacuccggcgac

SEQ ID NO: 3738510 - RNA, 21 nt, Salmonella enterica enterica serovar Typhi Ty2
cgcuuaauaauaagcggccua

SEQ ID NO: 3738511 - RNA, 23 nt, Salmonella enterica enterica serovar Typhi Ty2
cgcuuaaucaguugcaggaaggu

SEQ ID NO: 3738512 - RNA, 22 nt, Salmonella enterica enterica serovar Typhi Ty2
cgcuuaaucuugaguuuggccu

SEQ ID NO: 3738513 - RNA, 20 nt, Salmonella enterica enterica serovar Typhi Ty2
cgcuuaauggcgucaaucaa

SEQ ID NO: 3738514 - RNA, 18 nt, Salmonella enterica enterica serovar Typhi Ty2
cgcuuacaauuuaucugc

SEQ ID NO: 3738515 - RNA, 22 nt, Salmonella enterica enterica serovar Typhi Ty2
cgcuuacacacccggccuauca

SEQ ID NO: 3738516 - RNA, 15 nt, Salmonella enterica enterica serovar Typhi Ty2
cgcuuacaucgccau

SEQ ID NO: 3738517 - RNA, 21 nt, Salmonella enterica enterica serovar Typhi Ty2
cgcuuaccacuuugcgcuccu

SEQ ID NO: 3738518 - RNA, 13 nt, Salmonella enterica enterica serovar Typhi Ty2
cgcuuacccagca

SEQ ID NO: 3738519 - RNA, 14 nt, Salmonella enterica enterica serovar Typhi Ty2
cgcuuaccgggccu

SEQ ID NO: 3738520 - RNA, 19 nt, Salmonella enterica enterica serovar Typhi Ty2
cgcuuacgaagaucgucga

SEQ ID NO: 3738521 - RNA, 14 nt, Salmonella enterica enterica serovar Typhi Ty2
cgcuuacgcggcgc

SEQ ID NO: 3738522 - RNA, 19 nt, Salmonella enterica enterica serovar Typhi Ty2
cgcuuacucagccagauac

SEQ ID NO: 3738523 - RNA, 17 nt, Salmonella enterica enterica serovar Typhi Ty2
cgcuuagcuucccgcau

SEQ ID NO: 3738524 - RNA, 14 nt, Salmonella enterica enterica serovar Typhi Ty2
cgcuuaucaggccu

SEQ ID NO: 3738525 - RNA, 18 nt, Salmonella enterica enterica serovar Typhi Ty2
cgcuuaucaggccuacaa

SEQ ID NO: 3738526 - RNA, 19 nt, Salmonella enterica enterica serovar Typhi Ty2
cgcuuaucaggccuacaac

SEQ ID NO: 3738527 - RNA, 21 nt, Salmonella enterica enterica serovar Typhi Ty2
cgcuuaucaggccuacauccg

SEQ ID NO: 3738528 - RNA, 17 nt, Salmonella enterica enterica serovar Typhi Ty2
cgcuuaucaggccuacg

SEQ ID NO: 3738529 - RNA, 18 nt, Salmonella enterica enterica serovar Typhi Ty2
cgcuuauccggccuacag

SEQ ID NO: 3738530 - RNA, 19 nt, Salmonella enterica enterica serovar Typhi Ty2
cgcuuauuccuccgccgau

SEQ ID NO: 3738531 - RNA, 14 nt, Salmonella enterica enterica serovar Typhi Ty2
cgcuucacauaccc

SEQ ID NO: 3738532 - RNA, 22 nt, Salmonella enterica enterica serovar Typhi Ty2
cgcuucaccuuucgccgccaga

SEQ ID NO: 3738533 - RNA, 23 nt, Salmonella enterica enterica serovar Typhi Ty2
cgcuucacgcgcggcuacugcca

SEQ ID NO: 3738534 - RNA, 19 nt, Salmonella enterica enterica serovar Typhi Ty2
cgcuucacgucagcgacca

SEQ ID NO: 3738535 - RNA, 12 nt, Salmonella enterica enterica serovar Typhi Ty2
cgcuuccagaau

SEQ ID NO: 3738536 - RNA, 14 nt, Salmonella enterica enterica serovar Typhi Ty2
cgcuuccagcgcau

SEQ ID NO: 3738537 - RNA, 11 nt, Salmonella enterica enterica serovar Typhi Ty2
cgcuuccuggg

SEQ ID NO: 3738538 - RNA, 20 nt, Salmonella enterica enterica serovar Typhi Ty2
cgcuucgcuuaucaggccua

SEQ ID NO: 3738539 - RNA, 20 nt, Salmonella enterica enterica serovar Typhi Ty2
cgcuucgcuuauccggccua

SEQ ID NO: 3738540 - RNA, 20 nt, Salmonella enterica enterica serovar Typhi Ty2
cgcuucgcuuaucuggccua

SEQ ID NO: 3738541 - RNA, 19 nt, Salmonella enterica enterica serovar Typhi Ty2
cgcuucgcuugcccggccu

SEQ ID NO: 3738542 - RNA, 20 nt, Salmonella enterica enterica serovar Typhi Ty2
cgcuucgcuugcccggccua

SEQ ID NO: 3738543 - RNA, 16 nt, Salmonella enterica enterica serovar Typhi Ty2
cgcuucguuccgcgau

SEQ ID NO: 3738544 - RNA, 18 nt, Salmonella enterica enterica serovar Typhi Ty2
cgcuucuaacgaaacaga

SEQ ID NO: 3738545 - RNA, 16 nt, Salmonella enterica enterica serovar Typhi Ty2
cgcuucuacagccacc

SEQ ID NO: 3738546 - RNA, 18 nt, Salmonella enterica enterica serovar Typhi Ty2
cgcuucugauuauugaca

SEQ ID NO: 3738547 - RNA, 14 nt, Salmonella enterica enterica serovar Typhi Ty2
cgcuucugccgcca

SEQ ID NO: 3738548 - RNA, 12 nt, Salmonella enterica enterica serovar Typhi Ty2
cgcuucuucaug

SEQ ID NO: 3738549 - RNA, 20 nt, Salmonella enterica enterica serovar Typhi Ty2
cgcuucuuugaaauugauca

SEQ ID NO: 3738550 - RNA, 17 nt, Salmonella enterica enterica serovar Typhi Ty2
cgcuugauacgccaucu

SEQ ID NO: 3738551 - RNA, 13 nt, Salmonella enterica enterica serovar Typhi Ty2
cgcuugcauggca

SEQ ID NO: 3738552 - RNA, 13 nt, Salmonella enterica enterica serovar Typhi Ty2
cgcuugcgccgcc

SEQ ID NO: 3738553 - RNA, 14 nt, Salmonella enterica enterica serovar Typhi Ty2
cgcuugcgccgcca

SEQ ID NO: 3738554 - RNA, 15 nt, Salmonella enterica enterica serovar Typhi Ty2
cgcuugcgccgccau

SEQ ID NO: 3738555 - RNA, 14 nt, Salmonella enterica enterica serovar Typhi Ty2
cgcuugcuccgcag

SEQ ID NO: 3738556 - RNA, 23 nt, Salmonella enterica enterica serovar Typhi Ty2
cgcuuggugcguaccucauggua

SEQ ID NO: 3738557 - RNA, 16 nt, Salmonella enterica enterica serovar Typhi Ty2
cgcuugugccugcugc

SEQ ID NO: 3738558 - RNA, 21 nt, Salmonella enterica enterica serovar Typhi Ty2
cgcuuuacccgggccaucuuu

SEQ ID NO: 3738559 - RNA, 15 nt, Salmonella enterica enterica serovar Typhi Ty2
cgcuuuaccgccuuc

SEQ ID NO: 3738560 - RNA, 17 nt, Salmonella enterica enterica serovar Typhi Ty2
cgcuuuaccgccuuccu

SEQ ID NO: 3738561 - RNA, 21 nt, Salmonella enterica enterica serovar Typhi Ty2
cgcuuuaggguaucauuucca

SEQ ID NO: 3738562 - RNA, 17 nt, Salmonella enterica enterica serovar Typhi Ty2
cgcuuucaccaucgcga

SEQ ID NO: 3738563 - RNA, 16 nt, Salmonella enterica enterica serovar Typhi Ty2
cgcuuucaccgccuca

SEQ ID NO: 3738564 - RNA, 23 nt, Salmonella enterica enterica serovar Typhi Ty2
cgcuuucaccgccucaucggcgu

SEQ ID NO: 3738565 - RNA, 16 nt, Salmonella enterica enterica serovar Typhi Ty2
cgcuuucaguaauaau

SEQ ID NO: 3738566 - RNA, 18 nt, Salmonella enterica enterica serovar Typhi Ty2
cgcuuuccaguugcggca

SEQ ID NO: 3738567 - RNA, 22 nt, Salmonella enterica enterica serovar Typhi Ty2
cgcuuuccggcgcuuccugcag

SEQ ID NO: 3738568 - RNA, 23 nt, Salmonella enterica enterica serovar Typhi Ty2
cgcuuuccggggugaauuuuuug

SEQ ID NO: 3738569 - RNA, 20 nt, Salmonella enterica enterica serovar Typhi Ty2
cgcuuucgccacgcucacuu

SEQ ID NO: 3738570 - RNA, 20 nt, Salmonella enterica enterica serovar Typhi Ty2
cgcuuucgucguccacucuu

SEQ ID NO: 3738571 - RNA, 22 nt, Salmonella enterica enterica serovar Typhi Ty2
cgcuuugaggaucaauuuuucg

SEQ ID NO: 3738572 - RNA, 21 nt, Salmonella enterica enterica serovar Typhi Ty2
cgcuuugauguccggcgcguu

SEQ ID NO: 3738573 - RNA, 15 nt, Salmonella enterica enterica serovar Typhi Ty2
cgcuuugccgccauc

SEQ ID NO: 3738574 - RNA, 20 nt, Salmonella enterica enterica serovar Typhi Ty2
cgcuuugcuuauccggccua

SEQ ID NO: 3738575 - RNA, 15 nt, Salmonella enterica enterica serovar Typhi Ty2
cgcuuuggaggucau

SEQ ID NO: 3738576 - RNA, 22 nt, Salmonella enterica enterica serovar Typhi Ty2
cgcuuugucgaacuuacgacgc

SEQ ID NO: 3738577 - RNA, 14 nt, Salmonella enterica enterica serovar Typhi Ty2
cgcuuuguuuucca

SEQ ID NO: 3738578 - RNA, 19 nt, Salmonella enterica enterica serovar Typhi Ty2
cgcuuuuaauugcgcauca

SEQ ID NO: 3738579 - RNA, 13 nt, Salmonella enterica enterica serovar Typhi Ty2
cgcuuuucuggcu

SEQ ID NO: 3738580 - RNA, 20 nt, Salmonella enterica enterica serovar Typhi Ty2
cgcuuuugccgcgacuuccg

SEQ ID NO: 3738581 - RNA, 17 nt, Salmonella enterica enterica serovar Typhi Ty2
cgcuuuugguuuuucaa

SEQ ID NO: 3738582 - RNA, 20 nt, Salmonella enterica enterica serovar Typhi Ty2
cgcuuuugguuuuucaacca

SEQ ID NO: 3738583 - RNA, 18 nt, Salmonella enterica enterica serovar Typhi Ty2
cgcuuuuugcgccagcgc

SEQ ID NO: 3738584 - RNA, 22 nt, Salmonella enterica enterica serovar Typhi Ty2
cggagaacgguucauccagcag

SEQ ID NO: 3738585 - RNA, 17 nt, Salmonella enterica enterica serovar Typhi Ty2
cggagaagacgccgccg

SEQ ID NO: 3738586 - RNA, 20 nt, Salmonella enterica enterica serovar Typhi Ty2
cggagaagacgccgccgcau

SEQ ID NO: 3738587 - RNA, 15 nt, Salmonella enterica enterica serovar Typhi Ty2
cggagagacauuggu

SEQ ID NO: 3738588 - RNA, 17 nt, Salmonella enterica enterica serovar Typhi Ty2
cggagagagcaacuggc

SEQ ID NO: 3738589 - RNA, 21 nt, Salmonella enterica enterica serovar Typhi Ty2
cggagagagcaacuggcaaua

SEQ ID NO: 3738590 - RNA, 18 nt, Salmonella enterica enterica serovar Typhi Ty2
cggagagcggauaauccg

SEQ ID NO: 3738591 - RNA, 21 nt, Salmonella enterica enterica serovar Typhi Ty2
cggagaguucauaacgcacaa

SEQ ID NO: 3738592 - RNA, 15 nt, Salmonella enterica enterica serovar Typhi Ty2
cggagaucuccagau

SEQ ID NO: 3738593 - RNA, 23 nt, Salmonella enterica enterica serovar Typhi Ty2
cggagaugaucguuuccagcauc

SEQ ID NO: 3738594 - RNA, 18 nt, Salmonella enterica enterica serovar Typhi Ty2
cggagauuucauccucuu

SEQ ID NO: 3738595 - RNA, 14 nt, Salmonella enterica enterica serovar Typhi Ty2
cggagcaaaaaaug

SEQ ID NO: 3738596 - RNA, 17 nt, Salmonella enterica enterica serovar Typhi Ty2
cggagcggcguccgcca

SEQ ID NO: 3738597 - RNA, 18 nt, Salmonella enterica enterica serovar Typhi Ty2
cggagcggcguccgccag

SEQ ID NO: 3738598 - RNA, 15 nt, Salmonella enterica enterica serovar Typhi Ty2
cggagcuggcacgcg

SEQ ID NO: 3738599 - RNA, 22 nt, Salmonella enterica enterica serovar Typhi Ty2
cggaggauauuuauuauuucca

SEQ ID NO: 3738600 - RNA, 14 nt, Salmonella enterica enterica serovar Typhi Ty2
cggaggcacugccu

SEQ ID NO: 3738601 - RNA, 19 nt, Salmonella enterica enterica serovar Typhi Ty2
cggaggccagauucaccac

SEQ ID NO: 3738602 - RNA, 14 nt, Salmonella enterica enterica serovar Typhi Ty2
cggaguccagcaac

SEQ ID NO: 3738603 - RNA, 15 nt, Salmonella enterica enterica serovar Typhi Ty2
cggagucuuauccga

SEQ ID NO: 3738604 - RNA, 15 nt, Salmonella enterica enterica serovar Typhi Ty2
cggauaaaauuauuu

SEQ ID NO: 3738605 - RNA, 23 nt, Salmonella enterica enterica serovar Typhi Ty2
cggauaaacgcgucuucaucagc

SEQ ID NO: 3738606 - RNA, 22 nt, Salmonella enterica enterica serovar Typhi Ty2
cggauaaauagugacgccgcca

SEQ ID NO: 3738607 - RNA, 18 nt, Salmonella enterica enterica serovar Typhi Ty2
cggauaagcgcagcgcca

SEQ ID NO: 3738608 - RNA, 17 nt, Salmonella enterica enterica serovar Typhi Ty2
cggauaagcggcagcgc

SEQ ID NO: 3738609 - RNA, 11 nt, Salmonella enterica enterica serovar Typhi Ty2
cggauaagcgu

SEQ ID NO: 3738610 - RNA, 18 nt, Salmonella enterica enterica serovar Typhi Ty2
cggauaagcguagcgcca

SEQ ID NO: 3738611 - RNA, 19 nt, Salmonella enterica enterica serovar Typhi Ty2
cggauaagcgugagcgcau

SEQ ID NO: 3738612 - RNA, 22 nt, Salmonella enterica enterica serovar Typhi Ty2
cggauaaggccacgccgccauc

SEQ ID NO: 3738613 - RNA, 18 nt, Salmonella enterica enterica serovar Typhi Ty2
cggauaaggcgcagccgc

SEQ ID NO: 3738614 - RNA, 20 nt, Salmonella enterica enterica serovar Typhi Ty2
cggauaaggcggagccgcca

SEQ ID NO: 3738615 - RNA, 20 nt, Salmonella enterica enterica serovar Typhi Ty2
cggauaaggcguuuacgcug

SEQ ID NO: 3738616 - RNA, 23 nt, Salmonella enterica enterica serovar Typhi Ty2
cggauaagguguuuacgccgcca

SEQ ID NO: 3738617 - RNA, 21 nt, Salmonella enterica enterica serovar Typhi Ty2
cggauacaagguauccgccau

SEQ ID NO: 3738618 - RNA, 22 nt, Salmonella enterica enterica serovar Typhi Ty2
cggauacaagguauccgccaua

SEQ ID NO: 3738619 - RNA, 19 nt, Salmonella enterica enterica serovar Typhi Ty2
cggauaccggcgcagcauc

SEQ ID NO: 3738620 - RNA, 18 nt, Salmonella enterica enterica serovar Typhi Ty2
cggauagcggcuucgcca

SEQ ID NO: 3738621 - RNA, 22 nt, Salmonella enterica enterica serovar Typhi Ty2
cggauagcggcuucgccagauc

SEQ ID NO: 3738622 - RNA, 16 nt, Salmonella enterica enterica serovar Typhi Ty2
cggauagcguagcgcc

SEQ ID NO: 3738623 - RNA, 18 nt, Salmonella enterica enterica serovar Typhi Ty2
cggauagucauaauuaaa

SEQ ID NO: 3738624 - RNA, 14 nt, Salmonella enterica enterica serovar Typhi Ty2
cggauaucagacag

SEQ ID NO: 3738625 - RNA, 16 nt, Salmonella enterica enterica serovar Typhi Ty2
cggauaugcagcagcc

SEQ ID NO: 3738626 - RNA, 23 nt, Salmonella enterica enterica serovar Typhi Ty2
cggauaugcgucuuaaugguggu

SEQ ID NO: 3738627 - RNA, 17 nt, Salmonella enterica enterica serovar Typhi Ty2
cggaucaugguugaaaa

SEQ ID NO: 3738628 - RNA, 19 nt, Salmonella enterica enterica serovar Typhi Ty2
cggaucgaucucgauauuc

SEQ ID NO: 3738629 - RNA, 20 nt, Salmonella enterica enterica serovar Typhi Ty2
cggaucgaucucgauauuca

SEQ ID NO: 3738630 - RNA, 19 nt, Salmonella enterica enterica serovar Typhi Ty2
cggaucgcaagauccugau

SEQ ID NO: 3738631 - RNA, 19 nt, Salmonella enterica enterica serovar Typhi Ty2
cggaucgccgauaaagugg

SEQ ID NO: 3738632 - RNA, 12 nt, Salmonella enterica enterica serovar Typhi Ty2
cggaucgcguuu

SEQ ID NO: 3738633 - RNA, 17 nt, Salmonella enterica enterica serovar Typhi Ty2
cggaucggccauaucca

SEQ ID NO: 3738634 - RNA, 11 nt, Salmonella enterica enterica serovar Typhi Ty2
cggaucgggcu

SEQ ID NO: 3738635 - RNA, 17 nt, Salmonella enterica enterica serovar Typhi Ty2
cggaucggucuggcgca

SEQ ID NO: 3738636 - RNA, 21 nt, Salmonella enterica enterica serovar Typhi Ty2
cggaugaaacaguccggcgaa

SEQ ID NO: 3738637 - RNA, 13 nt, Salmonella enterica enterica serovar Typhi Ty2
cggaugaccagaa

SEQ ID NO: 3738638 - RNA, 15 nt, Salmonella enterica enterica serovar Typhi Ty2
cggaugacgccgcuu

SEQ ID NO: 3738639 - RNA, 17 nt, Salmonella enterica enterica serovar Typhi Ty2
cggaugaucuucauaaa

SEQ ID NO: 3738640 - RNA, 19 nt, Salmonella enterica enterica serovar Typhi Ty2
cggaugauggccuggcgga

SEQ ID NO: 3738641 - RNA, 18 nt, Salmonella enterica enterica serovar Typhi Ty2
cggaugccauauucaacg

SEQ ID NO: 3738642 - RNA, 17 nt, Salmonella enterica enterica serovar Typhi Ty2
cggaugcgccaucccau

SEQ ID NO: 3738643 - RNA, 17 nt, Salmonella enterica enterica serovar Typhi Ty2
cggaugcggcuagcgcc

SEQ ID NO: 3738644 - RNA, 22 nt, Salmonella enterica enterica serovar Typhi Ty2
cggauggaauuuugcaccauca

SEQ ID NO: 3738645 - RNA, 20 nt, Salmonella enterica enterica serovar Typhi Ty2
cggauggcaguacagggcga

SEQ ID NO: 3738646 - RNA, 17 nt, Salmonella enterica enterica serovar Typhi Ty2
cggauggccugcucaau

SEQ ID NO: 3738647 - RNA, 19 nt, Salmonella enterica enterica serovar Typhi Ty2
cggauggcgcugccgcuua

SEQ ID NO: 3738648 - RNA, 18 nt, Salmonella enterica enterica serovar Typhi Ty2
cggauggcggcuaacgcc

SEQ ID NO: 3738649 - RNA, 18 nt, Salmonella enterica enterica serovar Typhi Ty2
cggaugguggcguaaaua

SEQ ID NO: 3738650 - RNA, 17 nt, Salmonella enterica enterica serovar Typhi Ty2
cggauuaacaagcagau

SEQ ID NO: 3738651 - RNA, 24 nt, Salmonella enterica enterica serovar Typhi Ty2
cggauuacgaauaccguaagacca

SEQ ID NO: 3738652 - RNA, 18 nt, Salmonella enterica enterica serovar Typhi Ty2
cggauuagcgacagcgcu

SEQ ID NO: 3738653 - RNA, 16 nt, Salmonella enterica enterica serovar Typhi Ty2
cggauuaucguccggc

SEQ ID NO: 3738654 - RNA, 19 nt, Salmonella enterica enterica serovar Typhi Ty2
cggauuaucguccggcauc

SEQ ID NO: 3738655 - RNA, 15 nt, Salmonella enterica enterica serovar Typhi Ty2
cggauuaugcgcuuu

SEQ ID NO: 3738656 - RNA, 16 nt, Salmonella enterica enterica serovar Typhi Ty2
cggauucaauauugaa

SEQ ID NO: 3738657 - RNA, 18 nt, Salmonella enterica enterica serovar Typhi Ty2
cggauugccgcgcucaau

SEQ ID NO: 3738658 - RNA, 24 nt, Salmonella enterica enterica serovar Typhi Ty2
cggauugccuucucugucgagcau

SEQ ID NO: 3738659 - RNA, 17 nt, Salmonella enterica enterica serovar Typhi Ty2
cggauuggucugauuca

SEQ ID NO: 3738660 - RNA, 17 nt, Salmonella enterica enterica serovar Typhi Ty2
cggauugugaaauucga

SEQ ID NO: 3738661 - RNA, 21 nt, Salmonella enterica enterica serovar Typhi Ty2
cggauuguuguucauggucag

SEQ ID NO: 3738662 - RNA, 12 nt, Salmonella enterica enterica serovar Typhi Ty2
cggauuugcugc

SEQ ID NO: 3738663 - RNA, 20 nt, Salmonella enterica enterica serovar Typhi Ty2
cggcaaaaaauauagccauu

SEQ ID NO: 3738664 - RNA, 15 nt, Salmonella enterica enterica serovar Typhi Ty2
cggcaaaaacgccgg

SEQ ID NO: 3738665 - RNA, 17 nt, Salmonella enterica enterica serovar Typhi Ty2
cggcagugcggugguau

SEQ ID NO: 3738666 - RNA, 20 nt, Salmonella enterica enterica serovar Typhi Ty2
cggcauacaccgccagcguc

SEQ ID NO: 3738667 - RNA, 16 nt, Salmonella enterica enterica serovar Typhi Ty2
cggcauacugucgcgc

SEQ ID NO: 3738668 - RNA, 19 nt, Salmonella enterica enterica serovar Typhi Ty2
cggcauacuuucgcgcggc

SEQ ID NO: 3738669 - RNA, 11 nt, Salmonella enterica enterica serovar Typhi Ty2
cggcauagcug

SEQ ID NO: 3738670 - RNA, 22 nt, Salmonella enterica enterica serovar Typhi Ty2
cggcaucaagcauaaaccggcg

SEQ ID NO: 3738671 - RNA, 16 nt, Salmonella enterica enterica serovar Typhi Ty2
cggcaucacaggcuua

SEQ ID NO: 3738672 - RNA, 22 nt, Salmonella enterica enterica serovar Typhi Ty2
cggcaucacaggcuuauaccga

SEQ ID NO: 3738673 - RNA, 23 nt, Salmonella enterica enterica serovar Typhi Ty2
cggcaucagcaggauagcgacca

SEQ ID NO: 3738674 - RNA, 14 nt, Salmonella enterica enterica serovar Typhi Ty2
cggcaucaggaaaa

SEQ ID NO: 3738675 - RNA, 22 nt, Salmonella enterica enterica serovar Typhi Ty2
cggcaucaucuaccuucacgca

SEQ ID NO: 3738676 - RNA, 15 nt, Salmonella enterica enterica serovar Typhi Ty2
cggcauccagcgcuc

SEQ ID NO: 3738677 - RNA, 17 nt, Salmonella enterica enterica serovar Typhi Ty2
cggcaucccaggcgucc

SEQ ID NO: 3738678 - RNA, 15 nt, Salmonella enterica enterica serovar Typhi Ty2
cggcaucggcagcgu

SEQ ID NO: 3738679 - RNA, 17 nt, Salmonella enterica enterica serovar Typhi Ty2
cggcaucggcagcguca

SEQ ID NO: 3738680 - RNA, 23 nt, Salmonella enterica enterica serovar Typhi Ty2
cggcaucgugaaacucacugaau

SEQ ID NO: 3738681 - RNA, 15 nt, Salmonella enterica enterica serovar Typhi Ty2
cggcaucucuucguu

SEQ ID NO: 3738682 - RNA, 20 nt, Salmonella enterica enterica serovar Typhi Ty2
cggcaucuuuaaccgccugc

SEQ ID NO: 3738683 - RNA, 22 nt, Salmonella enterica enterica serovar Typhi Ty2
cggcaucuuuaaccgccugcuc

SEQ ID NO: 3738684 - RNA, 20 nt, Salmonella enterica enterica serovar Typhi Ty2
cggcaugauagggcgccugu

SEQ ID NO: 3738685 - RNA, 21 nt, Salmonella enterica enterica serovar Typhi Ty2
cggcaugcaucucuucaaaca

SEQ ID NO: 3738686 - RNA, 17 nt, Salmonella enterica enterica serovar Typhi Ty2
cggcauggaugcaugag

SEQ ID NO: 3738687 - RNA, 20 nt, Salmonella enterica enterica serovar Typhi Ty2
cggcauggguaaagcccauc

SEQ ID NO: 3738688 - RNA, 16 nt, Salmonella enterica enterica serovar Typhi Ty2
cggcaugucgccagcc

SEQ ID NO: 3738689 - RNA, 18 nt, Salmonella enterica enterica serovar Typhi Ty2
cggcaugucgccagccag

SEQ ID NO: 3738690 - RNA, 16 nt, Salmonella enterica enterica serovar Typhi Ty2
cggcauuaauuucuug

SEQ ID NO: 3738691 - RNA, 17 nt, Salmonella enterica enterica serovar Typhi Ty2
cggcauuagcaugggcu

SEQ ID NO: 3738692 - RNA, 23 nt, Salmonella enterica enterica serovar Typhi Ty2
cggcauuaugcaggcgucgggca

SEQ ID NO: 3738693 - RNA, 17 nt, Salmonella enterica enterica serovar Typhi Ty2
cggcauucacgucgcgc

SEQ ID NO: 3738694 - RNA, 20 nt, Salmonella enterica enterica serovar Typhi Ty2
cggcauucacgucgcgcgcc

SEQ ID NO: 3738695 - RNA, 21 nt, Salmonella enterica enterica serovar Typhi Ty2
cggcauuucaccgucaauaac

SEQ ID NO: 3738696 - RNA, 14 nt, Salmonella enterica enterica serovar Typhi Ty2
cggccaaagcgcga

SEQ ID NO: 3738697 - RNA, 19 nt, Salmonella enterica enterica serovar Typhi Ty2
cggccaaagcgcgacugga

SEQ ID NO: 3738698 - RNA, 16 nt, Salmonella enterica enterica serovar Typhi Ty2
cggccaaccccggcaa

SEQ ID NO: 3738699 - RNA, 22 nt, Salmonella enterica enterica serovar Typhi Ty2
cggccaauccugcacccgccuu

SEQ ID NO: 3738700 - RNA, 14 nt, Salmonella enterica enterica serovar Typhi Ty2
cggccacaaaacag

SEQ ID NO: 3738701 - RNA, 13 nt, Salmonella enterica enterica serovar Typhi Ty2
cggccacagccau

SEQ ID NO: 3738702 - RNA, 15 nt, Salmonella enterica enterica serovar Typhi Ty2
cggccacagccaucc

SEQ ID NO: 3738703 - RNA, 17 nt, Salmonella enterica enterica serovar Typhi Ty2
cggccacagcgccagac

SEQ ID NO: 3738704 - RNA, 15 nt, Salmonella enterica enterica serovar Typhi Ty2
cggccacaggcgucg

SEQ ID NO: 3738705 - RNA, 14 nt, Salmonella enterica enterica serovar Typhi Ty2
cggccaccacauac

SEQ ID NO: 3738706 - RNA, 21 nt, Salmonella enterica enterica serovar Typhi Ty2
cggccaccauuacgcccccuc

SEQ ID NO: 3738707 - RNA, 18 nt, Salmonella enterica enterica serovar Typhi Ty2
cggccacccauccccaua

SEQ ID NO: 3738708 - RNA, 23 nt, Salmonella enterica enterica serovar Typhi Ty2
cggccacccauccccauauucca

SEQ ID NO: 3738709 - RNA, 14 nt, Salmonella enterica enterica serovar Typhi Ty2
cggccacgagcugu

SEQ ID NO: 3738710 - RNA, 20 nt, Salmonella enterica enterica serovar Typhi Ty2
cggccacgcgcgucaggacg

SEQ ID NO: 3738711 - RNA, 15 nt, Salmonella enterica enterica serovar Typhi Ty2
cggccacgguguggc

SEQ ID NO: 3738712 - RNA, 21 nt, Salmonella enterica enterica serovar Typhi Ty2
cggccacgguguggcccagcg

SEQ ID NO: 3738713 - RNA, 14 nt, Salmonella enterica enterica serovar Typhi Ty2
cggccacuauuucg

SEQ ID NO: 3738714 - RNA, 17 nt, Salmonella enterica enterica serovar Typhi Ty2
cggccacuccgccacaa

SEQ ID NO: 3738715 - RNA, 23 nt, Salmonella enterica enterica serovar Typhi Ty2
cggccagacaauacuuaaaccug

SEQ ID NO: 3738716 - RNA, 18 nt, Salmonella enterica enterica serovar Typhi Ty2
cggccagauaacgcgcau

SEQ ID NO: 3738717 - RNA, 13 nt, Salmonella enterica enterica serovar Typhi Ty2
cggccagcaaaau

SEQ ID NO: 3738718 - RNA, 14 nt, Salmonella enterica enterica serovar Typhi Ty2
cggccagcagccau

SEQ ID NO: 3738719 - RNA, 12 nt, Salmonella enterica enterica serovar Typhi Ty2
cggccagcauau

SEQ ID NO: 3738720 - RNA, 20 nt, Salmonella enterica enterica serovar Typhi Ty2
cggccagcgaaaaccagcgc

SEQ ID NO: 3738721 - RNA, 19 nt, Salmonella enterica enterica serovar Typhi Ty2
cggccagcgagucgccgcu

SEQ ID NO: 3738722 - RNA, 14 nt, Salmonella enterica enterica serovar Typhi Ty2
cggccagcgcaggc

SEQ ID NO: 3738723 - RNA, 20 nt, Salmonella enterica enterica serovar Typhi Ty2
cggccaggcaaagauccacc

SEQ ID NO: 3738724 - RNA, 17 nt, Salmonella enterica enterica serovar Typhi Ty2
cggccaguagcgggggc

SEQ ID NO: 3738725 - RNA, 18 nt, Salmonella enterica enterica serovar Typhi Ty2
cggccaguagcgggggcc

SEQ ID NO: 3738726 - RNA, 20 nt, Salmonella enterica enterica serovar Typhi Ty2
cggccagucgcucuaacuga

SEQ ID NO: 3738727 - RNA, 19 nt, Salmonella enterica enterica serovar Typhi Ty2
cggccaguguacauagcuu

SEQ ID NO: 3738728 - RNA, 23 nt, Salmonella enterica enterica serovar Typhi Ty2
cggccaugacucaaacagauagc

SEQ ID NO: 3738729 - RNA, 22 nt, Salmonella enterica enterica serovar Typhi Ty2
cggccauggagagugagccacg

SEQ ID NO: 3738730 - RNA, 16 nt, Salmonella enterica enterica serovar Typhi Ty2
cggccauuaacacaca

SEQ ID NO: 3738731 - RNA, 18 nt, Salmonella enterica enterica serovar Typhi Ty2
cggccauugccgcgccga

SEQ ID NO: 3738732 - RNA, 20 nt, Salmonella enterica enterica serovar Typhi Ty2
cggcccaaacgaugaccaua

SEQ ID NO: 3738733 - RNA, 22 nt, Salmonella enterica enterica serovar Typhi Ty2
cggcccaggcaucgacgccagc

SEQ ID NO: 3738734 - RNA, 18 nt, Salmonella enterica enterica serovar Typhi Ty2
cggcccauaaacagguca

SEQ ID NO: 3738735 - RNA, 23 nt, Salmonella enterica enterica serovar Typhi Ty2
cggcccauaucaaucaacgguuc

SEQ ID NO: 3738736 - RNA, 15 nt, Salmonella enterica enterica serovar Typhi Ty2
cggccccagccugga

SEQ ID NO: 3738737 - RNA, 22 nt, Salmonella enterica enterica serovar Typhi Ty2
cggccccucgucuucgaccgcc

SEQ ID NO: 3738738 - RNA, 14 nt, Salmonella enterica enterica serovar Typhi Ty2
cggcccgcauugaa

SEQ ID NO: 3738739 - RNA, 17 nt, Salmonella enterica enterica serovar Typhi Ty2
cggcccgcuaucaccgc

SEQ ID NO: 3738740 - RNA, 19 nt, Salmonella enterica enterica serovar Typhi Ty2
cggcccgcuaucaccgccc

SEQ ID NO: 3738741 - RNA, 23 nt, Salmonella enterica enterica serovar Typhi Ty2
cggcccgcuucauuggcgucugc

SEQ ID NO: 3738742 - RNA, 18 nt, Salmonella enterica enterica serovar Typhi Ty2
cggcccgugccagcuauc

SEQ ID NO: 3738743 - RNA, 15 nt, Salmonella enterica enterica serovar Typhi Ty2
cggccgguuucacca

SEQ ID NO: 3738744 - RNA, 16 nt, Salmonella enterica enterica serovar Typhi Ty2
cggccuacaacucagc

SEQ ID NO: 3738745 - RNA, 13 nt, Salmonella enterica enterica serovar Typhi Ty2
cggccucccagcu

SEQ ID NO: 3738746 - RNA, 14 nt, Salmonella enterica enterica serovar Typhi Ty2
cggccuccgcuucc

SEQ ID NO: 3738747 - RNA, 20 nt, Salmonella enterica enterica serovar Typhi Ty2
cggcgcgucuucccggcgcu

SEQ ID NO: 3738748 - RNA, 16 nt, Salmonella enterica enterica serovar Typhi Ty2
cggcgcguucgccaaa

SEQ ID NO: 3738749 - RNA, 18 nt, Salmonella enterica enterica serovar Typhi Ty2
cggcgcguugccgccgag

SEQ ID NO: 3738750 - RNA, 19 nt, Salmonella enterica enterica serovar Typhi Ty2
cggcgcguuuuggcagaca

SEQ ID NO: 3738751 - RNA, 14 nt, Salmonella enterica enterica serovar Typhi Ty2
cggcgcuaaccagc

SEQ ID NO: 3738752 - RNA, 14 nt, Salmonella enterica enterica serovar Typhi Ty2
cggcgcucgccagc

SEQ ID NO: 3738753 - RNA, 22 nt, Salmonella enterica enterica serovar Typhi Ty2
cggcgcugcgcggcgugcagau

SEQ ID NO: 3738754 - RNA, 15 nt, Salmonella enterica enterica serovar Typhi Ty2
cggcgcuggcgcgcu

SEQ ID NO: 3738755 - RNA, 22 nt, Salmonella enterica enterica serovar Typhi Ty2
cggcgcugucacuccggcugca

SEQ ID NO: 3738756 - RNA, 16 nt, Salmonella enterica enterica serovar Typhi Ty2
cggcgcuuccugcagu

SEQ ID NO: 3738757 - RNA, 19 nt, Salmonella enterica enterica serovar Typhi Ty2
cggcgcuuccugcagugga

SEQ ID NO: 3738758 - RNA, 15 nt, Salmonella enterica enterica serovar Typhi Ty2
cggcgcuucgcagcg

SEQ ID NO: 3738759 - RNA, 19 nt, Salmonella enterica enterica serovar Typhi Ty2
cggcggaaaauagccagaa

SEQ ID NO: 3738760 - RNA, 22 nt, Salmonella enterica enterica serovar Typhi Ty2
cggcggaaaauagccagaaugc

SEQ ID NO: 3738761 - RNA, 23 nt, Salmonella enterica enterica serovar Typhi Ty2
cggcggaaccauuuuccccagaa

SEQ ID NO: 3738762 - RNA, 16 nt, Salmonella enterica enterica serovar Typhi Ty2
cggcggaaugcugguu

SEQ ID NO: 3738763 - RNA, 21 nt, Salmonella enterica enterica serovar Typhi Ty2
cggcggagacagaacaggaug

SEQ ID NO: 3738764 - RNA, 19 nt, Salmonella enterica enterica serovar Typhi Ty2
cggcggauuguucagguac

SEQ ID NO: 3738765 - RNA, 13 nt, Salmonella enterica enterica serovar Typhi Ty2
cggcggcaguccc

SEQ ID NO: 3738766 - RNA, 22 nt, Salmonella enterica enterica serovar Typhi Ty2
cggcggcagucccaaugcggaa

SEQ ID NO: 3738767 - RNA, 20 nt, Salmonella enterica enterica serovar Typhi Ty2
cggcggccaaccccggcaaa

SEQ ID NO: 3738768 - RNA, 23 nt, Salmonella enterica enterica serovar Typhi Ty2
cggcggccuaugacuauaucagc

SEQ ID NO: 3738769 - RNA, 13 nt, Salmonella enterica enterica serovar Typhi Ty2
cggcggcgcgaug

SEQ ID NO: 3738770 - RNA, 14 nt, Salmonella enterica enterica serovar Typhi Ty2
cggcggcguacagc

SEQ ID NO: 3738771 - RNA, 11 nt, Salmonella enterica enterica serovar Typhi Ty2
cggcggcguuu

SEQ ID NO: 3738772 - RNA, 16 nt, Salmonella enterica enterica serovar Typhi Ty2
cggcgggagcucuacc

SEQ ID NO: 3738773 - RNA, 18 nt, Salmonella enterica enterica serovar Typhi Ty2
cggcgggaucuccagaag

SEQ ID NO: 3738774 - RNA, 17 nt, Salmonella enterica enterica serovar Typhi Ty2
cggcggguauggcaaug

SEQ ID NO: 3738775 - RNA, 13 nt, Salmonella enterica enterica serovar Typhi Ty2
cggcggucgccgc

SEQ ID NO: 3738776 - RNA, 13 nt, Salmonella enterica enterica serovar Typhi Ty2
cggcggucugcgc

SEQ ID NO: 3738777 - RNA, 20 nt, Salmonella enterica enterica serovar Typhi Ty2
cggcguaacggcugacgccc

SEQ ID NO: 3738778 - RNA, 16 nt, Salmonella enterica enterica serovar Typhi Ty2
cggcguaccagaaugc

SEQ ID NO: 3738779 - RNA, 15 nt, Salmonella enterica enterica serovar Typhi Ty2
cggcguaccgcgcgc

SEQ ID NO: 3738780 - RNA, 21 nt, Salmonella enterica enterica serovar Typhi Ty2
cggcguagccgccgagcgccg

SEQ ID NO: 3738781 - RNA, 20 nt, Salmonella enterica enterica serovar Typhi Ty2
cggcguagcgcguucagggu

SEQ ID NO: 3738782 - RNA, 15 nt, Salmonella enterica enterica serovar Typhi Ty2
cggcguagcucgccc

SEQ ID NO: 3738783 - RNA, 14 nt, Salmonella enterica enterica serovar Typhi Ty2
cggcgucaacucag

SEQ ID NO: 3738784 - RNA, 21 nt, Salmonella enterica enterica serovar Typhi Ty2
cggcgucacguucgucgccgg

SEQ ID NO: 3738785 - RNA, 23 nt, Salmonella enterica enterica serovar Typhi Ty2
cggcgucaucauugcgccaagac

SEQ ID NO: 3738786 - RNA, 12 nt, Salmonella enterica enterica serovar Typhi Ty2
cggcgucauccc

SEQ ID NO: 3738787 - RNA, 15 nt, Salmonella enterica enterica serovar Typhi Ty2
cggcgucaucggcgc

SEQ ID NO: 3738788 - RNA, 14 nt, Salmonella enterica enterica serovar Typhi Ty2
cggcguccgccagc

SEQ ID NO: 3738789 - RNA, 20 nt, Salmonella enterica enterica serovar Typhi Ty2
cggcguccggcacgcgcagc

SEQ ID NO: 3738790 - RNA, 15 nt, Salmonella enterica enterica serovar Typhi Ty2
cggcgucgccugucc

SEQ ID NO: 3738791 - RNA, 23 nt, Salmonella enterica enterica serovar Typhi Ty2
cggcgucgucaucgcgcgcaggc

SEQ ID NO: 3738792 - RNA, 14 nt, Salmonella enterica enterica serovar Typhi Ty2
cggcgucugaugaa

SEQ ID NO: 3738793 - RNA, 22 nt, Salmonella enterica enterica serovar Typhi Ty2
cggcgucuucauccucgccaua

SEQ ID NO: 3738794 - RNA, 14 nt, Salmonella enterica enterica serovar Typhi Ty2
cggcgugaaagcgc

SEQ ID NO: 3738795 - RNA, 22 nt, Salmonella enterica enterica serovar Typhi Ty2
cggcgugaaagcgcuugauaau

SEQ ID NO: 3738796 - RNA, 16 nt, Salmonella enterica enterica serovar Typhi Ty2
cggcguggaaccgccg

SEQ ID NO: 3738797 - RNA, 17 nt, Salmonella enterica enterica serovar Typhi Ty2
cggcguggagcauucca

SEQ ID NO: 3738798 - RNA, 19 nt, Salmonella enterica enterica serovar Typhi Ty2
cggcguguaaacagaugcu

SEQ ID NO: 3738799 - RNA, 21 nt, Salmonella enterica enterica serovar Typhi Ty2
cggcguguagccaaucagccc

SEQ ID NO: 3738800 - RNA, 16 nt, Salmonella enterica enterica serovar Typhi Ty2
cggcguguuucaucuc

SEQ ID NO: 3738801 - RNA, 13 nt, Salmonella enterica enterica serovar Typhi Ty2
cggcguuacuccg

SEQ ID NO: 3738802 - RNA, 18 nt, Salmonella enterica enterica serovar Typhi Ty2
cggcguuacuccgcggua

SEQ ID NO: 3738803 - RNA, 22 nt, Salmonella enterica enterica serovar Typhi Ty2
cggcguuauacgccugccuggu

SEQ ID NO: 3738804 - RNA, 14 nt, Salmonella enterica enterica serovar Typhi Ty2
cggcguuccgcaca

SEQ ID NO: 3738805 - RNA, 21 nt, Salmonella enterica enterica serovar Typhi Ty2
cggcguucucccgggccgcgu

SEQ ID NO: 3738806 - RNA, 12 nt, Salmonella enterica enterica serovar Typhi Ty2
cggcguucugcg

SEQ ID NO: 3738807 - RNA, 19 nt, Salmonella enterica enterica serovar Typhi Ty2
cggcguuggcgauuuccag

SEQ ID NO: 3738808 - RNA, 23 nt, Salmonella enterica enterica serovar Typhi Ty2
cggcguuucaagcaguuccagca

SEQ ID NO: 3738809 - RNA, 17 nt, Salmonella enterica enterica serovar Typhi Ty2
cggcguuuuaauauccu

SEQ ID NO: 3738810 - RNA, 22 nt, Salmonella enterica enterica serovar Typhi Ty2
cggcguuuuaauauccuggcga

SEQ ID NO: 3738811 - RNA, 19 nt, Salmonella enterica enterica serovar Typhi Ty2
cggcuaaacugcgaugcgc

SEQ ID NO: 3738812 - RNA, 14 nt, Salmonella enterica enterica serovar Typhi Ty2
cggcuaacgccuga

SEQ ID NO: 3738813 - RNA, 16 nt, Salmonella enterica enterica serovar Typhi Ty2
cggcuaacgccugauc

SEQ ID NO: 3738814 - RNA, 17 nt, Salmonella enterica enterica serovar Typhi Ty2
cggcuaaucaccaccuc

SEQ ID NO: 3738815 - RNA, 16 nt, Salmonella enterica enterica serovar Typhi Ty2
cggcuaccgaaggcgc

SEQ ID NO: 3738816 - RNA, 19 nt, Salmonella enterica enterica serovar Typhi Ty2
cggcuaccgccguaucacu

SEQ ID NO: 3738817 - RNA, 13 nt, Salmonella enterica enterica serovar Typhi Ty2
cggcuaccgccug

SEQ ID NO: 3738818 - RNA, 15 nt, Salmonella enterica enterica serovar Typhi Ty2
cggcuacgccuuacc

SEQ ID NO: 3738819 - RNA, 20 nt, Salmonella enterica enterica serovar Typhi Ty2
cggcuacgccuuauccggcc

SEQ ID NO: 3738820 - RNA, 22 nt, Salmonella enterica enterica serovar Typhi Ty2
cggcuacugccagcgucgcuga

SEQ ID NO: 3738821 - RNA, 19 nt, Salmonella enterica enterica serovar Typhi Ty2
cggcuaucagccgccggug

SEQ ID NO: 3738822 - RNA, 20 nt, Salmonella enterica enterica serovar Typhi Ty2
cggcuauuccucgaucgccu

SEQ ID NO: 3738823 - RNA, 19 nt, Salmonella enterica enterica serovar Typhi Ty2
cggcucaaacggccugcgc

SEQ ID NO: 3738824 - RNA, 22 nt, Salmonella enterica enterica serovar Typhi Ty2
cggcucaaacggccugcgcugg

SEQ ID NO: 3738825 - RNA, 13 nt, Salmonella enterica enterica serovar Typhi Ty2
cggcucauccagc

SEQ ID NO: 3738826 - RNA, 17 nt, Salmonella enterica enterica serovar Typhi Ty2
cggcucauccagcaaca

SEQ ID NO: 3738827 - RNA, 14 nt, Salmonella enterica enterica serovar Typhi Ty2
cggcuccaauauuu

SEQ ID NO: 3738828 - RNA, 16 nt, Salmonella enterica enterica serovar Typhi Ty2
cggcuccaauauuuca

SEQ ID NO: 3738829 - RNA, 22 nt, Salmonella enterica enterica serovar Typhi Ty2
cgggcaggcuuccacgcacgcc

SEQ ID NO: 3738830 - RNA, 18 nt, Salmonella enterica enterica serovar Typhi Ty2
cgggcauacucuccucca

SEQ ID NO: 3738831 - RNA, 15 nt, Salmonella enterica enterica serovar Typhi Ty2
cgggcauuguuaauc

SEQ ID NO: 3738832 - RNA, 15 nt, Salmonella enterica enterica serovar Typhi Ty2
cgggccauucgccau

SEQ ID NO: 3738833 - RNA, 20 nt, Salmonella enterica enterica serovar Typhi Ty2
cgggccguagugcuucucuu

SEQ ID NO: 3738834 - RNA, 19 nt, Salmonella enterica enterica serovar Typhi Ty2
cgggccguccggcaaaccc

SEQ ID NO: 3738835 - RNA, 17 nt, Salmonella enterica enterica serovar Typhi Ty2
cgggccugagcgcgcag

SEQ ID NO: 3738836 - RNA, 18 nt, Salmonella enterica enterica serovar Typhi Ty2
cgggccugagcgcgcagc

SEQ ID NO: 3738837 - RNA, 13 nt, Salmonella enterica enterica serovar Typhi Ty2
cgggccugccagg

SEQ ID NO: 3738838 - RNA, 14 nt, Salmonella enterica enterica serovar Typhi Ty2
cgggccugccaggu

SEQ ID NO: 3738839 - RNA, 16 nt, Salmonella enterica enterica serovar Typhi Ty2
cgggccugugccugac

SEQ ID NO: 3738840 - RNA, 17 nt, Salmonella enterica enterica serovar Typhi Ty2
cgggccugugccugaca

SEQ ID NO: 3738841 - RNA, 16 nt, Salmonella enterica enterica serovar Typhi Ty2
cgggcgaccgucgggc

SEQ ID NO: 3738842 - RNA, 14 nt, Salmonella enterica enterica serovar Typhi Ty2
cgggcgaggccucg

SEQ ID NO: 3738843 - RNA, 15 nt, Salmonella enterica enterica serovar Typhi Ty2
cgggcgauaaaccag

SEQ ID NO: 3738844 - RNA, 23 nt, Salmonella enterica enterica serovar Typhi Ty2
cgggcgauaaccucucaccgccu

SEQ ID NO: 3738845 - RNA, 18 nt, Salmonella enterica enterica serovar Typhi Ty2
cgggcgauacaccuucac

SEQ ID NO: 3738846 - RNA, 12 nt, Salmonella enterica enterica serovar Typhi Ty2
cgggcgccacgu

SEQ ID NO: 3738847 - RNA, 17 nt, Salmonella enterica enterica serovar Typhi Ty2
cgggcgcguuaaugcau

SEQ ID NO: 3738848 - RNA, 19 nt, Salmonella enterica enterica serovar Typhi Ty2
cgggcgcuaaacccaacgu

SEQ ID NO: 3738849 - RNA, 20 nt, Salmonella enterica enterica serovar Typhi Ty2
cgggcggcgcagcgcgcgac

SEQ ID NO: 3738850 - RNA, 17 nt, Salmonella enterica enterica serovar Typhi Ty2
cgggcgguauuauccgc

SEQ ID NO: 3738851 - RNA, 19 nt, Salmonella enterica enterica serovar Typhi Ty2
cgggcuaaaugcccacggc

SEQ ID NO: 3738852 - RNA, 13 nt, Salmonella enterica enterica serovar Typhi Ty2
cgggcucacgcug

SEQ ID NO: 3738853 - RNA, 15 nt, Salmonella enterica enterica serovar Typhi Ty2
cgggcugcacgccau

SEQ ID NO: 3738854 - RNA, 20 nt, Salmonella enterica enterica serovar Typhi Ty2
cgggcugccccagacgcccu

SEQ ID NO: 3738855 - RNA, 13 nt, Salmonella enterica enterica serovar Typhi Ty2
cgggcuucaggau

SEQ ID NO: 3738856 - RNA, 23 nt, Salmonella enterica enterica serovar Typhi Ty2
cgggcuuccaguacgcugacgaa

SEQ ID NO: 3738857 - RNA, 23 nt, Salmonella enterica enterica serovar Typhi Ty2
cgggcuuuguugucuauaaagcg

SEQ ID NO: 3738858 - RNA, 23 nt, Salmonella enterica enterica serovar Typhi Ty2
cggggaaaauauuagcggcggca

SEQ ID NO: 3738859 - RNA, 16 nt, Salmonella enterica enterica serovar Typhi Ty2
cggggaacacggacag

SEQ ID NO: 3738860 - RNA, 23 nt, Salmonella enterica enterica serovar Typhi Ty2
cggggaacacggacagcaacccg

SEQ ID NO: 3738861 - RNA, 15 nt, Salmonella enterica enterica serovar Typhi Ty2
cggggaagcgcgcgc

SEQ ID NO: 3738862 - RNA, 18 nt, Salmonella enterica enterica serovar Typhi Ty2
cggggauaaucagcagcg

SEQ ID NO: 3738863 - RNA, 16 nt, Salmonella enterica enterica serovar Typhi Ty2
cggggaucgguuuauc

SEQ ID NO: 3738864 - RNA, 17 nt, Salmonella enterica enterica serovar Typhi Ty2
cggggaucgguuuaucc

SEQ ID NO: 3738865 - RNA, 19 nt, Salmonella enterica enterica serovar Typhi Ty2
cggggaucguucugcugau

SEQ ID NO: 3738866 - RNA, 15 nt, Salmonella enterica enterica serovar Typhi Ty2
cggggauggcggauu

SEQ ID NO: 3738867 - RNA, 20 nt, Salmonella enterica enterica serovar Typhi Ty2
cggggauuuuuuugcccggu

SEQ ID NO: 3738868 - RNA, 18 nt, Salmonella enterica enterica serovar Typhi Ty2
cggggcguuaaucaccgg

SEQ ID NO: 3738869 - RNA, 22 nt, Salmonella enterica enterica serovar Typhi Ty2
cggggcguuaaucaccggcgcg

SEQ ID NO: 3738870 - RNA, 22 nt, Salmonella enterica enterica serovar Typhi Ty2
cggggcucccacucuuccagca

SEQ ID NO: 3738871 - RNA, 16 nt, Salmonella enterica enterica serovar Typhi Ty2
cgggggcgaucagcag

SEQ ID NO: 3738872 - RNA, 20 nt, Salmonella enterica enterica serovar Typhi Ty2
cgggggcgaucagcagguca

SEQ ID NO: 3738873 - RNA, 16 nt, Salmonella enterica enterica serovar Typhi Ty2
cggggguuauucagcg

SEQ ID NO: 3738874 - RNA, 17 nt, Salmonella enterica enterica serovar Typhi Ty2
cggggucuuccagcaga

SEQ ID NO: 3738875 - RNA, 21 nt, Salmonella enterica enterica serovar Typhi Ty2
cggggucuuccagcagaucca

SEQ ID NO: 3738876 - RNA, 21 nt, Salmonella enterica enterica serovar Typhi Ty2
cgggguuagcguuucaaccgc

SEQ ID NO: 3738877 - RNA, 18 nt, Salmonella enterica enterica serovar Typhi Ty2
cgggguucgggcagcgcu

SEQ ID NO: 3738878 - RNA, 22 nt, Salmonella enterica enterica serovar Typhi Ty2
cggguaaacaaacacagccauc

SEQ ID NO: 3738879 - RNA, 23 nt, Salmonella enterica enterica serovar Typhi Ty2
cggguaaacgucccugccacagu

SEQ ID NO: 3738880 - RNA, 23 nt, Salmonella enterica enterica serovar Typhi Ty2
cggguaaaugcgcgcggcuaccg

SEQ ID NO: 3738881 - RNA, 13 nt, Salmonella enterica enterica serovar Typhi Ty2
cggguaacgucga

SEQ ID NO: 3738882 - RNA, 14 nt, Salmonella enterica enterica serovar Typhi Ty2
cggguaaggcaucg

SEQ ID NO: 3738883 - RNA, 15 nt, Salmonella enterica enterica serovar Typhi Ty2
cggguagagcuuuuc

SEQ ID NO: 3738884 - RNA, 15 nt, Salmonella enterica enterica serovar Typhi Ty2
cggguagucaucgcc

SEQ ID NO: 3738885 - RNA, 23 nt, Salmonella enterica enterica serovar Typhi Ty2
cggguagucaucgccuucauccg

SEQ ID NO: 3738886 - RNA, 20 nt, Salmonella enterica enterica serovar Typhi Ty2
cggguauggcaaugcccccu

SEQ ID NO: 3738887 - RNA, 17 nt, Salmonella enterica enterica serovar Typhi Ty2
cgggucagauucagcau

SEQ ID NO: 3738888 - RNA, 19 nt, Salmonella enterica enterica serovar Typhi Ty2
cgggucagcgucugcccca

SEQ ID NO: 3738889 - RNA, 15 nt, Salmonella enterica enterica serovar Typhi Ty2
cggguccugaucggc

SEQ ID NO: 3738890 - RNA, 16 nt, Salmonella enterica enterica serovar Typhi Ty2
cgggugagacgcagcc

SEQ ID NO: 3738891 - RNA, 14 nt, Salmonella enterica enterica serovar Typhi Ty2
cgggugcgcagcaa

SEQ ID NO: 3738892 - RNA, 21 nt, Salmonella enterica enterica serovar Typhi Ty2
cggguuaaaucgcgcaaauau

SEQ ID NO: 3738893 - RNA, 14 nt, Salmonella enterica enterica serovar Typhi Ty2
cggguuaggcaagc

SEQ ID NO: 3738894 - RNA, 22 nt, Salmonella enterica enterica serovar Typhi Ty2
cggguucagcgacaggcugucg

SEQ ID NO: 3738895 - RNA, 13 nt, Salmonella enterica enterica serovar Typhi Ty2
cggguucaucgcc

SEQ ID NO: 3738896 - RNA, 13 nt, Salmonella enterica enterica serovar Typhi Ty2
cggguuccugcau

SEQ ID NO: 3738897 - RNA, 22 nt, Salmonella enterica enterica serovar Typhi Ty2
cggguugcacauuguugcaggg

SEQ ID NO: 3738898 - RNA, 23 nt, Salmonella enterica enterica serovar Typhi Ty2
cggguugcacauuguugcaggga

SEQ ID NO: 3738899 - RNA, 20 nt, Salmonella enterica enterica serovar Typhi Ty2
cggguuuggucagguaagcu

SEQ ID NO: 3738900 - RNA, 12 nt, Salmonella enterica enterica serovar Typhi Ty2
cggguuuuccug

SEQ ID NO: 3738901 - RNA, 19 nt, Salmonella enterica enterica serovar Typhi Ty2
cggguuuuuuuugcgcuua

SEQ ID NO: 3738902 - RNA, 13 nt, Salmonella enterica enterica serovar Typhi Ty2
cgguaaacaccac

SEQ ID NO: 3738903 - RNA, 15 nt, Salmonella enterica enterica serovar Typhi Ty2
cgguaaaccaggcca

SEQ ID NO: 3738904 - RNA, 17 nt, Salmonella enterica enterica serovar Typhi Ty2
cgguaaaccaggccagc

SEQ ID NO: 3738905 - RNA, 14 nt, Salmonella enterica enterica serovar Typhi Ty2
cgguaaaccucuuu

SEQ ID NO: 3738906 - RNA, 21 nt, Salmonella enterica enterica serovar Typhi Ty2
cgguaaaccuguuuguuuauu

SEQ ID NO: 3738907 - RNA, 13 nt, Salmonella enterica enterica serovar Typhi Ty2
cgguaaacgucga

SEQ ID NO: 3738908 - RNA, 18 nt, Salmonella enterica enterica serovar Typhi Ty2
cgguaaacgugccacagu

SEQ ID NO: 3738909 - RNA, 19 nt, Salmonella enterica enterica serovar Typhi Ty2
cgguaaacgugcuggaugg

SEQ ID NO: 3738910 - RNA, 17 nt, Salmonella enterica enterica serovar Typhi Ty2
cgguaaagcagugcagu

SEQ ID NO: 3738911 - RNA, 17 nt, Salmonella enterica enterica serovar Typhi Ty2
cggugagaaacgcgcca

SEQ ID NO: 3738912 - RNA, 14 nt, Salmonella enterica enterica serovar Typhi Ty2
cggugagcgccgcg

SEQ ID NO: 3738913 - RNA, 13 nt, Salmonella enterica enterica serovar Typhi Ty2
cggugaucccagg

SEQ ID NO: 3738914 - RNA, 22 nt, Salmonella enterica enterica serovar Typhi Ty2
cggugaugcgccugucuccagc

SEQ ID NO: 3738915 - RNA, 18 nt, Salmonella enterica enterica serovar Typhi Ty2
cggugccaaauguauacu

SEQ ID NO: 3738916 - RNA, 19 nt, Salmonella enterica enterica serovar Typhi Ty2
cggugccauuccagccggu

SEQ ID NO: 3738917 - RNA, 23 nt, Salmonella enterica enterica serovar Typhi Ty2
cggugccguuaauuuucacgcac

SEQ ID NO: 3738918 - RNA, 15 nt, Salmonella enterica enterica serovar Typhi Ty2
cggugccugccgccu

SEQ ID NO: 3738919 - RNA, 22 nt, Salmonella enterica enterica serovar Typhi Ty2
cggugcgagaaaaagcaauaau

SEQ ID NO: 3738920 - RNA, 15 nt, Salmonella enterica enterica serovar Typhi Ty2
cggugcgauucagcg

SEQ ID NO: 3738921 - RNA, 17 nt, Salmonella enterica enterica serovar Typhi Ty2
cggugcgauucagcgca

SEQ ID NO: 3738922 - RNA, 18 nt, Salmonella enterica enterica serovar Typhi Ty2
cggugcgccccagcauga

SEQ ID NO: 3738923 - RNA, 17 nt, Salmonella enterica enterica serovar Typhi Ty2
cggugcggcaagcgcgc

SEQ ID NO: 3738924 - RNA, 16 nt, Salmonella enterica enterica serovar Typhi Ty2
cggugcggucacaggc

SEQ ID NO: 3738925 - RNA, 16 nt, Salmonella enterica enterica serovar Typhi Ty2
cggugcucaauaaaag

SEQ ID NO: 3738926 - RNA, 22 nt, Salmonella enterica enterica serovar Typhi Ty2
cggugcugaauauuaucggcgu

SEQ ID NO: 3738927 - RNA, 17 nt, Salmonella enterica enterica serovar Typhi Ty2
cggugcuguagcugccc

SEQ ID NO: 3738928 - RNA, 20 nt, Salmonella enterica enterica serovar Typhi Ty2
cggugcuguagcugcccgga

SEQ ID NO: 3738929 - RNA, 13 nt, Salmonella enterica enterica serovar Typhi Ty2
cgguggcgcugcg

SEQ ID NO: 3738930 - RNA, 20 nt, Salmonella enterica enterica serovar Typhi Ty2
cgguggcgcugucgcuuacc

SEQ ID NO: 3738931 - RNA, 18 nt, Salmonella enterica enterica serovar Typhi Ty2
cgguggguagcggcaauu

SEQ ID NO: 3738932 - RNA, 14 nt, Salmonella enterica enterica serovar Typhi Ty2
cgguguacagcgcg

SEQ ID NO: 3738933 - RNA, 18 nt, Salmonella enterica enterica serovar Typhi Ty2
cgguguaccccgccugac

SEQ ID NO: 3738934 - RNA, 17 nt, Salmonella enterica enterica serovar Typhi Ty2
cgguguagaccgcaucg

SEQ ID NO: 3738935 - RNA, 14 nt, Salmonella enterica enterica serovar Typhi Ty2
cggugucagacacc

SEQ ID NO: 3738936 - RNA, 16 nt, Salmonella enterica enterica serovar Typhi Ty2
cgguguggcccagcgc

SEQ ID NO: 3738937 - RNA, 19 nt, Salmonella enterica enterica serovar Typhi Ty2
cgguguuuagacacauuga

SEQ ID NO: 3738938 - RNA, 23 nt, Salmonella enterica enterica serovar Typhi Ty2
cgguuaaugaaaucgucgccaac

SEQ ID NO: 3738939 - RNA, 19 nt, Salmonella enterica enterica serovar Typhi Ty2
cgguuagcucaacgcaucg

SEQ ID NO: 3738940 - RNA, 14 nt, Salmonella enterica enterica serovar Typhi Ty2
cgguuauaaccgga

SEQ ID NO: 3738941 - RNA, 16 nt, Salmonella enterica enterica serovar Typhi Ty2
cgguuauaccgccauc

SEQ ID NO: 3738942 - RNA, 19 nt, Salmonella enterica enterica serovar Typhi Ty2
cgguuaugcauugcugauc

SEQ ID NO: 3738943 - RNA, 13 nt, Salmonella enterica enterica serovar Typhi Ty2
cgguuaugccugc

SEQ ID NO: 3738944 - RNA, 20 nt, Salmonella enterica enterica serovar Typhi Ty2
cgguuaugccugccagcauu

SEQ ID NO: 3738945 - RNA, 15 nt, Salmonella enterica enterica serovar Typhi Ty2
cgguuaugcgauuuc

SEQ ID NO: 3738946 - RNA, 14 nt, Salmonella enterica enterica serovar Typhi Ty2
cgguucaaucacgc

SEQ ID NO: 3738947 - RNA, 20 nt, Salmonella enterica enterica serovar Typhi Ty2
cgguucacggccaaagcgcg

SEQ ID NO: 3738948 - RNA, 19 nt, Salmonella enterica enterica serovar Typhi Ty2
cgguucauaauccggaaaa

SEQ ID NO: 3738949 - RNA, 13 nt, Salmonella enterica enterica serovar Typhi Ty2
cgguucauccugc

SEQ ID NO: 3738950 - RNA, 13 nt, Salmonella enterica enterica serovar Typhi Ty2
cgguuccagcggc

SEQ ID NO: 3738951 - RNA, 18 nt, Salmonella enterica enterica serovar Typhi Ty2
cgguuccagcguggcgau

SEQ ID NO: 3738952 - RNA, 15 nt, Salmonella enterica enterica serovar Typhi Ty2
cgguuccggggaaag

SEQ ID NO: 3738953 - RNA, 14 nt, Salmonella enterica enterica serovar Typhi Ty2
cgguucgccgcgcg

SEQ ID NO: 3738954 - RNA, 16 nt, Salmonella enterica enterica serovar Typhi Ty2
cgguucgccgcgcgca

SEQ ID NO: 3738955 - RNA, 16 nt, Salmonella enterica enterica serovar Typhi Ty2
cgguucucccggcaua

SEQ ID NO: 3738956 - RNA, 15 nt, Salmonella enterica enterica serovar Typhi Ty2
cgguugcaauuccgc

SEQ ID NO: 3738957 - RNA, 18 nt, Salmonella enterica enterica serovar Typhi Ty2
cgguugccuuucgccagc

SEQ ID NO: 3738958 - RNA, 17 nt, Salmonella enterica enterica serovar Typhi Ty2
cgguugcgcuucggcga

SEQ ID NO: 3738959 - RNA, 18 nt, Salmonella enterica enterica serovar Typhi Ty2
cgguuggaucggcaaaca

SEQ ID NO: 3738960 - RNA, 14 nt, Salmonella enterica enterica serovar Typhi Ty2
cgguuguucagugc

SEQ ID NO: 3738961 - RNA, 15 nt, Salmonella enterica enterica serovar Typhi Ty2
cgguuuaagcggaua

SEQ ID NO: 3738962 - RNA, 17 nt, Salmonella enterica enterica serovar Typhi Ty2
cgguuucuaccacccag

SEQ ID NO: 3738963 - RNA, 17 nt, Salmonella enterica enterica serovar Typhi Ty2
cgguuucuccagccucg

SEQ ID NO: 3738964 - RNA, 15 nt, Salmonella enterica enterica serovar Typhi Ty2
cgguuucugcgcgcu

SEQ ID NO: 3738965 - RNA, 17 nt, Salmonella enterica enterica serovar Typhi Ty2
cgguuugagcaccacgc

SEQ ID NO: 3738966 - RNA, 19 nt, Salmonella enterica enterica serovar Typhi Ty2
cgguuugcaggccggauaa

SEQ ID NO: 3738967 - RNA, 17 nt, Salmonella enterica enterica serovar Typhi Ty2
cgguuugcgccuacgau

SEQ ID NO: 3738968 - RNA, 22 nt, Salmonella enterica enterica serovar Typhi Ty2
cgguuugcgccuacgauggcga

SEQ ID NO: 3738969 - RNA, 21 nt, Salmonella enterica enterica serovar Typhi Ty2
cgguuuuauuaacgugcugcc

SEQ ID NO: 3738970 - RNA, 14 nt, Salmonella enterica enterica serovar Typhi Ty2
cgguuuuccggguc

SEQ ID NO: 3738971 - RNA, 17 nt, Salmonella enterica enterica serovar Typhi Ty2
cgguuuugcgccauccu

SEQ ID NO: 3738972 - RNA, 13 nt, Salmonella enterica enterica serovar Typhi Ty2
cgguuuuuccgcu

SEQ ID NO: 3738973 - RNA, 23 nt, Salmonella enterica enterica serovar Typhi Ty2
cgguuuuuuuguggccugcuuaa

SEQ ID NO: 3738974 - RNA, 18 nt, Salmonella enterica enterica serovar Typhi Ty2
cguaaaacaacagcggcg

SEQ ID NO: 3738975 - RNA, 14 nt, Salmonella enterica enterica serovar Typhi Ty2
cguaaaaccgcgcu

SEQ ID NO: 3738976 - RNA, 18 nt, Salmonella enterica enterica serovar Typhi Ty2
cguaaaacugcaccaacg

SEQ ID NO: 3738977 - RNA, 15 nt, Salmonella enterica enterica serovar Typhi Ty2
cguaaaacuuuucug

SEQ ID NO: 3738978 - RNA, 19 nt, Salmonella enterica enterica serovar Typhi Ty2
cguaaaagcgauaaagaca

SEQ ID NO: 3738979 - RNA, 16 nt, Salmonella enterica enterica serovar Typhi Ty2
cguaaacacguuaucu

SEQ ID NO: 3738980 - RNA, 18 nt, Salmonella enterica enterica serovar Typhi Ty2
cguaaacacguuaucuga

SEQ ID NO: 3738981 - RNA, 19 nt, Salmonella enterica enterica serovar Typhi Ty2
cguaaaccccuucaccgcu

SEQ ID NO: 3738982 - RNA, 20 nt, Salmonella enterica enterica serovar Typhi Ty2
cguaaaccccuucaccgcuu

SEQ ID NO: 3738983 - RNA, 21 nt, Salmonella enterica enterica serovar Typhi Ty2
cguaaaccccuucaccgcuuu

SEQ ID NO: 3738984 - RNA, 18 nt, Salmonella enterica enterica serovar Typhi Ty2
cguaaagaggguaacggc

SEQ ID NO: 3738985 - RNA, 16 nt, Salmonella enterica enterica serovar Typhi Ty2
cguaaagcgcauccag

SEQ ID NO: 3738986 - RNA, 18 nt, Salmonella enterica enterica serovar Typhi Ty2
cguaaagcgcauccagcu

SEQ ID NO: 3738987 - RNA, 12 nt, Salmonella enterica enterica serovar Typhi Ty2
cguaaagcuggc

SEQ ID NO: 3738988 - RNA, 22 nt, Salmonella enterica enterica serovar Typhi Ty2
cguaaagggaagaucauuauca

SEQ ID NO: 3738989 - RNA, 22 nt, Salmonella enterica enterica serovar Typhi Ty2
cguaaauagagaaaucaacgaa

SEQ ID NO: 3738990 - RNA, 20 nt, Salmonella enterica enterica serovar Typhi Ty2
cguaaauccacauuccagac

SEQ ID NO: 3738991 - RNA, 22 nt, Salmonella enterica enterica serovar Typhi Ty2
cguaaauuauuuuacgcgggau

SEQ ID NO: 3738992 - RNA, 17 nt, Salmonella enterica enterica serovar Typhi Ty2
cguaaauucccuccaga

SEQ ID NO: 3738993 - RNA, 19 nt, Salmonella enterica enterica serovar Typhi Ty2
cguagcgaauaaucccggc

SEQ ID NO: 3738994 - RNA, 23 nt, Salmonella enterica enterica serovar Typhi Ty2
cguagcgaauaaucccggcgcca

SEQ ID NO: 3738995 - RNA, 11 nt, Salmonella enterica enterica serovar Typhi Ty2
cguagcgccau

SEQ ID NO: 3738996 - RNA, 20 nt, Salmonella enterica enterica serovar Typhi Ty2
cguagcgcgcggauauggcg

SEQ ID NO: 3738997 - RNA, 11 nt, Salmonella enterica enterica serovar Typhi Ty2
cguagcgcguu

SEQ ID NO: 3738998 - RNA, 20 nt, Salmonella enterica enterica serovar Typhi Ty2
cguagcgcguucaggguauc

SEQ ID NO: 3738999 - RNA, 14 nt, Salmonella enterica enterica serovar Typhi Ty2
cguagcggcaggga

SEQ ID NO: 3739000 - RNA, 20 nt, Salmonella enterica enterica serovar Typhi Ty2
cguagcguucauucccgcca

SEQ ID NO: 3739001 - RNA, 13 nt, Salmonella enterica enterica serovar Typhi Ty2
cguagcuccagac

SEQ ID NO: 3739002 - RNA, 20 nt, Salmonella enterica enterica serovar Typhi Ty2
cguaggccgaauaagacgcu

SEQ ID NO: 3739003 - RNA, 17 nt, Salmonella enterica enterica serovar Typhi Ty2
cguaggccggaagacgu

SEQ ID NO: 3739004 - RNA, 19 nt, Salmonella enterica enterica serovar Typhi Ty2
cguaggccggauaagacgc

SEQ ID NO: 3739005 - RNA, 20 nt, Salmonella enterica enterica serovar Typhi Ty2
cguaggccggauaagacgcg

SEQ ID NO: 3739006 - RNA, 19 nt, Salmonella enterica enterica serovar Typhi Ty2
cguaggccggauaagcgca

SEQ ID NO: 3739007 - RNA, 15 nt, Salmonella enterica enterica serovar Typhi Ty2
cguaggccugauaag

SEQ ID NO: 3739008 - RNA, 20 nt, Salmonella enterica enterica serovar Typhi Ty2
cguaggccugauaagacgca

SEQ ID NO: 3739009 - RNA, 18 nt, Salmonella enterica enterica serovar Typhi Ty2
cguaggccugauaagcgc

SEQ ID NO: 3739010 - RNA, 22 nt, Salmonella enterica enterica serovar Typhi Ty2
cguaggccugauaagcgcagcg

SEQ ID NO: 3739011 - RNA, 15 nt, Salmonella enterica enterica serovar Typhi Ty2
cguaggcgcaaaccg

SEQ ID NO: 3739012 - RNA, 23 nt, Salmonella enterica enterica serovar Typhi Ty2
cguaggguacagagguaagaugu

SEQ ID NO: 3739013 - RNA, 19 nt, Salmonella enterica enterica serovar Typhi Ty2
cguaggguagaucacgcca

SEQ ID NO: 3739014 - RNA, 24 nt, Salmonella enterica enterica serovar Typhi Ty2
cguaggguagaucacgccagcgcu

SEQ ID NO: 3739015 - RNA, 13 nt, Salmonella enterica enterica serovar Typhi Ty2
cguagguaagaua

SEQ ID NO: 3739016 - RNA, 13 nt, Salmonella enterica enterica serovar Typhi Ty2
cguaguacgcgcg

SEQ ID NO: 3739017 - RNA, 13 nt, Salmonella enterica enterica serovar Typhi Ty2
cguaguacguucc

SEQ ID NO: 3739018 - RNA, 22 nt, Salmonella enterica enterica serovar Typhi Ty2
cguaguagucaggaucgcuggc

SEQ ID NO: 3739019 - RNA, 22 nt, Salmonella enterica enterica serovar Typhi Ty2
cguagugacacggucagcggcg

SEQ ID NO: 3739020 - RNA, 17 nt, Salmonella enterica enterica serovar Typhi Ty2
cguagugcuucucuuca

SEQ ID NO: 3739021 - RNA, 19 nt, Salmonella enterica enterica serovar Typhi Ty2
cguauaaggcgaagcccau

SEQ ID NO: 3739022 - RNA, 14 nt, Salmonella enterica enterica serovar Typhi Ty2
cguaucacuguaaa

SEQ ID NO: 3739023 - RNA, 11 nt, Salmonella enterica enterica serovar Typhi Ty2
cguauccagca

SEQ ID NO: 3739024 - RNA, 12 nt, Salmonella enterica enterica serovar Typhi Ty2
cguauccagcgc

SEQ ID NO: 3739025 - RNA, 13 nt, Salmonella enterica enterica serovar Typhi Ty2
cguauccagcgcg

SEQ ID NO: 3739026 - RNA, 19 nt, Salmonella enterica enterica serovar Typhi Ty2
cguauccccagucuuccug

SEQ ID NO: 3739027 - RNA, 20 nt, Salmonella enterica enterica serovar Typhi Ty2
cguauccccagucuuccugc

SEQ ID NO: 3739028 - RNA, 15 nt, Salmonella enterica enterica serovar Typhi Ty2
cguaucgcucugcuu

SEQ ID NO: 3739029 - RNA, 23 nt, Salmonella enterica enterica serovar Typhi Ty2
cguaucucgcgguugacgcugcu

SEQ ID NO: 3739030 - RNA, 10 nt, Salmonella enterica enterica serovar Typhi Ty2
cguaucuucc

SEQ ID NO: 3739031 - RNA, 23 nt, Salmonella enterica enterica serovar Typhi Ty2
cguaucuuccggugugaccagcg

SEQ ID NO: 3739032 - RNA, 14 nt, Salmonella enterica enterica serovar Typhi Ty2
cguaugaaugaaac

SEQ ID NO: 3739033 - RNA, 22 nt, Salmonella enterica enterica serovar Typhi Ty2
cguaugacguggccagcaugcc

SEQ ID NO: 3739034 - RNA, 21 nt, Salmonella enterica enterica serovar Typhi Ty2
cguaugauuuucuuauuacaa

SEQ ID NO: 3739035 - RNA, 18 nt, Salmonella enterica enterica serovar Typhi Ty2
cguaugcagccaggccau

SEQ ID NO: 3739036 - RNA, 14 nt, Salmonella enterica enterica serovar Typhi Ty2
cguauggcgucgug

SEQ ID NO: 3739037 - RNA, 22 nt, Salmonella enterica enterica serovar Typhi Ty2
cguauuaagccaacguugaaaa

SEQ ID NO: 3739038 - RNA, 12 nt, Salmonella enterica enterica serovar Typhi Ty2
cguauuacaagu

SEQ ID NO: 3739039 - RNA, 15 nt, Salmonella enterica enterica serovar Typhi Ty2
cguauuauccacccc

SEQ ID NO: 3739040 - RNA, 23 nt, Salmonella enterica enterica serovar Typhi Ty2
cguauuauccacccccgcaacgg

SEQ ID NO: 3739041 - RNA, 16 nt, Salmonella enterica enterica serovar Typhi Ty2
cguauucaccucccug

SEQ ID NO: 3739042 - RNA, 19 nt, Salmonella enterica enterica serovar Typhi Ty2
cguauucucaaccagccga

SEQ ID NO: 3739043 - RNA, 15 nt, Salmonella enterica enterica serovar Typhi Ty2
cguauucuuacccac

SEQ ID NO: 3739044 - RNA, 14 nt, Salmonella enterica enterica serovar Typhi Ty2
cguauugagcugga

SEQ ID NO: 3739045 - RNA, 12 nt, Salmonella enterica enterica serovar Typhi Ty2
cguauugccauc

SEQ ID NO: 3739046 - RNA, 20 nt, Salmonella enterica enterica serovar Typhi Ty2
cguauugccggauaagacgc

SEQ ID NO: 3739047 - RNA, 21 nt, Salmonella enterica enterica serovar Typhi Ty2
cguauugccggauaagacgca

SEQ ID NO: 3739048 - RNA, 17 nt, Salmonella enterica enterica serovar Typhi Ty2
cguauuucacuuuugcc

SEQ ID NO: 3739049 - RNA, 18 nt, Salmonella enterica enterica serovar Typhi Ty2
cgucaaaaccaaacagcg

SEQ ID NO: 3739050 - RNA, 15 nt, Salmonella enterica enterica serovar Typhi Ty2
cgucaaaacgcgcau

SEQ ID NO: 3739051 - RNA, 17 nt, Salmonella enterica enterica serovar Typhi Ty2
cgucaaacaguucagac

SEQ ID NO: 3739052 - RNA, 16 nt, Salmonella enterica enterica serovar Typhi Ty2
cgucaaacaguuccug

SEQ ID NO: 3739053 - RNA, 13 nt, Salmonella enterica enterica serovar Typhi Ty2
cgucaaagaaaac

SEQ ID NO: 3739054 - RNA, 21 nt, Salmonella enterica enterica serovar Typhi Ty2
cgucaaauagagaaaauaaca

SEQ ID NO: 3739055 - RNA, 15 nt, Salmonella enterica enterica serovar Typhi Ty2
cgucaacgaccagaa

SEQ ID NO: 3739056 - RNA, 22 nt, Salmonella enterica enterica serovar Typhi Ty2
cgucaacgcacuguaacgcacu

SEQ ID NO: 3739057 - RNA, 16 nt, Salmonella enterica enterica serovar Typhi Ty2
cgucaacguuuuucag

SEQ ID NO: 3739058 - RNA, 12 nt, Salmonella enterica enterica serovar Typhi Ty2
cgucaagacgcu

SEQ ID NO: 3739059 - RNA, 14 nt, Salmonella enterica enterica serovar Typhi Ty2
cgucaagaucgcgc

SEQ ID NO: 3739060 - RNA, 13 nt, Salmonella enterica enterica serovar Typhi Ty2
cgucaauaacagg

SEQ ID NO: 3739061 - RNA, 19 nt, Salmonella enterica enterica serovar Typhi Ty2
cgucaauaaucgcgcgcgu

SEQ ID NO: 3739062 - RNA, 13 nt, Salmonella enterica enterica serovar Typhi Ty2
cgucaaucaggaa

SEQ ID NO: 3739063 - RNA, 21 nt, Salmonella enterica enterica serovar Typhi Ty2
cgucaaucaggaaagagccgc

SEQ ID NO: 3739064 - RNA, 15 nt, Salmonella enterica enterica serovar Typhi Ty2
cgucaaugcugcuuu

SEQ ID NO: 3739065 - RNA, 15 nt, Salmonella enterica enterica serovar Typhi Ty2
cgucaaugugaaucc

SEQ ID NO: 3739066 - RNA, 19 nt, Salmonella enterica enterica serovar Typhi Ty2
cgucacaagcucacaacga

SEQ ID NO: 3739067 - RNA, 21 nt, Salmonella enterica enterica serovar Typhi Ty2
cgucacaauaucgagaugacc

SEQ ID NO: 3739068 - RNA, 13 nt, Salmonella enterica enterica serovar Typhi Ty2
cgucacaaucgcg

SEQ ID NO: 3739069 - RNA, 14 nt, Salmonella enterica enterica serovar Typhi Ty2
cgucacagaccccg

SEQ ID NO: 3739070 - RNA, 15 nt, Salmonella enterica enterica serovar Typhi Ty2
cgucaccauuaacau

SEQ ID NO: 3739071 - RNA, 19 nt, Salmonella enterica enterica serovar Typhi Ty2
cgucacccgccggcagcag

SEQ ID NO: 3739072 - RNA, 11 nt, Salmonella enterica enterica serovar Typhi Ty2
cgucacccggc

SEQ ID NO: 3739073 - RNA, 15 nt, Salmonella enterica enterica serovar Typhi Ty2
cgucaccgaauagcg

SEQ ID NO: 3739074 - RNA, 15 nt, Salmonella enterica enterica serovar Typhi Ty2
cgucaccgggcugca

SEQ ID NO: 3739075 - RNA, 14 nt, Salmonella enterica enterica serovar Typhi Ty2
cgucgacgccgaua

SEQ ID NO: 3739076 - RNA, 16 nt, Salmonella enterica enterica serovar Typhi Ty2
cgucgacgccuuccac

SEQ ID NO: 3739077 - RNA, 18 nt, Salmonella enterica enterica serovar Typhi Ty2
cgucgagaaaccgcucgc

SEQ ID NO: 3739078 - RNA, 22 nt, Salmonella enterica enterica serovar Typhi Ty2
cgucgaggaagcugcgcagcac

SEQ ID NO: 3739079 - RNA, 21 nt, Salmonella enterica enterica serovar Typhi Ty2
cgucgauauguaaaucgguuu

SEQ ID NO: 3739080 - RNA, 14 nt, Salmonella enterica enterica serovar Typhi Ty2
cgucgaucagcgcg

SEQ ID NO: 3739081 - RNA, 13 nt, Salmonella enterica enterica serovar Typhi Ty2
cgucgcacgaauc

SEQ ID NO: 3739082 - RNA, 14 nt, Salmonella enterica enterica serovar Typhi Ty2
cgucgccaaagcag

SEQ ID NO: 3739083 - RNA, 20 nt, Salmonella enterica enterica serovar Typhi Ty2
cgucgccaaagcagcugcug

SEQ ID NO: 3739084 - RNA, 14 nt, Salmonella enterica enterica serovar Typhi Ty2
cgucgccagcaacg

SEQ ID NO: 3739085 - RNA, 14 nt, Salmonella enterica enterica serovar Typhi Ty2
cgucgccagggcgg

SEQ ID NO: 3739086 - RNA, 16 nt, Salmonella enterica enterica serovar Typhi Ty2
cgucgccauccggcga

SEQ ID NO: 3739087 - RNA, 14 nt, Salmonella enterica enterica serovar Typhi Ty2
cgucgccgacaacg

SEQ ID NO: 3739088 - RNA, 17 nt, Salmonella enterica enterica serovar Typhi Ty2
cgucgccgaucggcguu

SEQ ID NO: 3739089 - RNA, 17 nt, Salmonella enterica enterica serovar Typhi Ty2
cgucgccggaaugcgaa

SEQ ID NO: 3739090 - RNA, 18 nt, Salmonella enterica enterica serovar Typhi Ty2
cgucgcgaauaauuauuu

SEQ ID NO: 3739091 - RNA, 17 nt, Salmonella enterica enterica serovar Typhi Ty2
cgucgcgacguccgcca

SEQ ID NO: 3739092 - RNA, 16 nt, Salmonella enterica enterica serovar Typhi Ty2
cgucgcgcgccgccug

SEQ ID NO: 3739093 - RNA, 20 nt, Salmonella enterica enterica serovar Typhi Ty2
cgucgcgcuuucaaucguca

SEQ ID NO: 3739094 - RNA, 17 nt, Salmonella enterica enterica serovar Typhi Ty2
cgucgcgguugccguca

SEQ ID NO: 3739095 - RNA, 22 nt, Salmonella enterica enterica serovar Typhi Ty2
cgucggcaagaauuucaaucau

SEQ ID NO: 3739096 - RNA, 14 nt, Salmonella enterica enterica serovar Typhi Ty2
cgucggcaccauuc

SEQ ID NO: 3739097 - RNA, 21 nt, Salmonella enterica enterica serovar Typhi Ty2
cgucggcaggguuugaccuca

SEQ ID NO: 3739098 - RNA, 14 nt, Salmonella enterica enterica serovar Typhi Ty2
cgucggccaccauu

SEQ ID NO: 3739099 - RNA, 19 nt, Salmonella enterica enterica serovar Typhi Ty2
cgucggcgauugucaucau

SEQ ID NO: 3739100 - RNA, 17 nt, Salmonella enterica enterica serovar Typhi Ty2
cgucggcgccagccaca

SEQ ID NO: 3739101 - RNA, 18 nt, Salmonella enterica enterica serovar Typhi Ty2
cgucggcgucugcgcgcu

SEQ ID NO: 3739102 - RNA, 21 nt, Salmonella enterica enterica serovar Typhi Ty2
cgucgggauaagcgaugcgcg

SEQ ID NO: 3739103 - RNA, 23 nt, Salmonella enterica enterica serovar Typhi Ty2
cgucgggccgcgcugcgccugcu

SEQ ID NO: 3739104 - RNA, 16 nt, Salmonella enterica enterica serovar Typhi Ty2
cgucggggauggcgga

SEQ ID NO: 3739105 - RNA, 14 nt, Salmonella enterica enterica serovar Typhi Ty2
cgucggucgcguag

SEQ ID NO: 3739106 - RNA, 16 nt, Salmonella enterica enterica serovar Typhi Ty2
cgucggugcccggcug

SEQ ID NO: 3739107 - RNA, 16 nt, Salmonella enterica enterica serovar Typhi Ty2
cgucggugcugccgcu

SEQ ID NO: 3739108 - RNA, 23 nt, Salmonella enterica enterica serovar Typhi Ty2
cgucgucaaaggaauagccgcgc

SEQ ID NO: 3739109 - RNA, 15 nt, Salmonella enterica enterica serovar Typhi Ty2
cgucgucccaggcca

SEQ ID NO: 3739110 - RNA, 22 nt, Salmonella enterica enterica serovar Typhi Ty2
cgucgucccgcgaguacgcaca

SEQ ID NO: 3739111 - RNA, 15 nt, Salmonella enterica enterica serovar Typhi Ty2
cgucgucggugggcu

SEQ ID NO: 3739112 - RNA, 16 nt, Salmonella enterica enterica serovar Typhi Ty2
cgucgucguuuguagg

SEQ ID NO: 3739113 - RNA, 22 nt, Salmonella enterica enterica serovar Typhi Ty2
cgucguuaacaucaucaggccu

SEQ ID NO: 3739114 - RNA, 23 nt, Salmonella enterica enterica serovar Typhi Ty2
cgucguuaacaucaucaggccug

SEQ ID NO: 3739115 - RNA, 19 nt, Salmonella enterica enterica serovar Typhi Ty2
cgucguuaacugcauuaca

SEQ ID NO: 3739116 - RNA, 22 nt, Salmonella enterica enterica serovar Typhi Ty2
cgucguuacccuccugcaaucc

SEQ ID NO: 3739117 - RNA, 15 nt, Salmonella enterica enterica serovar Typhi Ty2
cgucguuccgccagg

SEQ ID NO: 3739118 - RNA, 17 nt, Salmonella enterica enterica serovar Typhi Ty2
cgucguuucguguuguc

SEQ ID NO: 3739119 - RNA, 19 nt, Salmonella enterica enterica serovar Typhi Ty2
cgucuccagacaauccgcg

SEQ ID NO: 3739120 - RNA, 15 nt, Salmonella enterica enterica serovar Typhi Ty2
cgucucccaaaugaa

SEQ ID NO: 3739121 - RNA, 21 nt, Salmonella enterica enterica serovar Typhi Ty2
cgucuccggcgcgccgcuggc

SEQ ID NO: 3739122 - RNA, 16 nt, Salmonella enterica enterica serovar Typhi Ty2
cgucucgcuuaauccg

SEQ ID NO: 3739123 - RNA, 14 nt, Salmonella enterica enterica serovar Typhi Ty2
cgucucggccuggc

SEQ ID NO: 3739124 - RNA, 16 nt, Salmonella enterica enterica serovar Typhi Ty2
cgucucucauccgcca

SEQ ID NO: 3739125 - RNA, 20 nt, Salmonella enterica enterica serovar Typhi Ty2
cgucugaagaaguucuucug

SEQ ID NO: 3739126 - RNA, 22 nt, Salmonella enterica enterica serovar Typhi Ty2
cgucugcaaugguaaaacgcug

SEQ ID NO: 3739127 - RNA, 17 nt, Salmonella enterica enterica serovar Typhi Ty2
cgucugccccaaacgcu

SEQ ID NO: 3739128 - RNA, 16 nt, Salmonella enterica enterica serovar Typhi Ty2
cgucugcccuccugaa

SEQ ID NO: 3739129 - RNA, 18 nt, Salmonella enterica enterica serovar Typhi Ty2
cgucugcgcgcugguguc

SEQ ID NO: 3739130 - RNA, 13 nt, Salmonella enterica enterica serovar Typhi Ty2
cgucugcucagaa

SEQ ID NO: 3739131 - RNA, 17 nt, Salmonella enterica enterica serovar Typhi Ty2
cgucuggaguacgggca

SEQ ID NO: 3739132 - RNA, 14 nt, Salmonella enterica enterica serovar Typhi Ty2
cgucuggcgaaaac

SEQ ID NO: 3739133 - RNA, 18 nt, Salmonella enterica enterica serovar Typhi Ty2
cgucuggcgaaaacggcg

SEQ ID NO: 3739134 - RNA, 20 nt, Salmonella enterica enterica serovar Typhi Ty2
cgucugguaauaggccggag

SEQ ID NO: 3739135 - RNA, 19 nt, Salmonella enterica enterica serovar Typhi Ty2
cgucugguacggccaccag

SEQ ID NO: 3739136 - RNA, 14 nt, Salmonella enterica enterica serovar Typhi Ty2
cgucuggugaucca

SEQ ID NO: 3739137 - RNA, 15 nt, Salmonella enterica enterica serovar Typhi Ty2
cgucuguguuuaucc

SEQ ID NO: 3739138 - RNA, 21 nt, Salmonella enterica enterica serovar Typhi Ty2
cgucuuaaaauugcucagcca

SEQ ID NO: 3739139 - RNA, 17 nt, Salmonella enterica enterica serovar Typhi Ty2
cgucuuaaugcucucca

SEQ ID NO: 3739140 - RNA, 21 nt, Salmonella enterica enterica serovar Typhi Ty2
cgucuuaaugguggucgcggc

SEQ ID NO: 3739141 - RNA, 23 nt, Salmonella enterica enterica serovar Typhi Ty2
cgucuuaaugguggucgcggcca

SEQ ID NO: 3739142 - RNA, 14 nt, Salmonella enterica enterica serovar Typhi Ty2
cgucuuagaacugg

SEQ ID NO: 3739143 - RNA, 15 nt, Salmonella enterica enterica serovar Typhi Ty2
cgucuuauccggccu

SEQ ID NO: 3739144 - RNA, 23 nt, Salmonella enterica enterica serovar Typhi Ty2
cgucuucaggucauucaggacgg

SEQ ID NO: 3739145 - RNA, 18 nt, Salmonella enterica enterica serovar Typhi Ty2
cgucuucaucagccagca

SEQ ID NO: 3739146 - RNA, 18 nt, Salmonella enterica enterica serovar Typhi Ty2
cgucuucaucguucauug

SEQ ID NO: 3739147 - RNA, 21 nt, Salmonella enterica enterica serovar Typhi Ty2
cgucuuccggauaacgcgcug

SEQ ID NO: 3739148 - RNA, 12 nt, Salmonella enterica enterica serovar Typhi Ty2
cgucuugccgug

SEQ ID NO: 3739149 - RNA, 22 nt, Salmonella enterica enterica serovar Typhi Ty2
cgucuuuuauccccaccaccgc

SEQ ID NO: 3739150 - RNA, 17 nt, Salmonella enterica enterica serovar Typhi Ty2
cgucuuuugcugcuuug

SEQ ID NO: 3739151 - RNA, 22 nt, Salmonella enterica enterica serovar Typhi Ty2
cgugaaaaugcguccagaggau

SEQ ID NO: 3739152 - RNA, 14 nt, Salmonella enterica enterica serovar Typhi Ty2
cgugaaagcauacc

SEQ ID NO: 3739153 - RNA, 13 nt, Salmonella enterica enterica serovar Typhi Ty2
cgugaaagcgcuu

SEQ ID NO: 3739154 - RNA, 16 nt, Salmonella enterica enterica serovar Typhi Ty2
cgugaacaccacugaa

SEQ ID NO: 3739155 - RNA, 16 nt, Salmonella enterica enterica serovar Typhi Ty2
cgugaaccagcauccc

SEQ ID NO: 3739156 - RNA, 21 nt, Salmonella enterica enterica serovar Typhi Ty2
cgugaaccagcaucccacgaa

SEQ ID NO: 3739157 - RNA, 13 nt, Salmonella enterica enterica serovar Typhi Ty2
cgugaacgccaaa

SEQ ID NO: 3739158 - RNA, 20 nt, Salmonella enterica enterica serovar Typhi Ty2
cgugaaucaucaucauccgc

SEQ ID NO: 3739159 - RNA, 19 nt, Salmonella enterica enterica serovar Typhi Ty2
cgugaauguccugcggcac

SEQ ID NO: 3739160 - RNA, 20 nt, Salmonella enterica enterica serovar Typhi Ty2
cgugaauugcgguuuauccc

SEQ ID NO: 3739161 - RNA, 20 nt, Salmonella enterica enterica serovar Typhi Ty2
cgugaauuucugcugccagc

SEQ ID NO: 3739162 - RNA, 16 nt, Salmonella enterica enterica serovar Typhi Ty2
cgugacaguuaccccg

SEQ ID NO: 3739163 - RNA, 15 nt, Salmonella enterica enterica serovar Typhi Ty2
cgugacccgccagca

SEQ ID NO: 3739164 - RNA, 20 nt, Salmonella enterica enterica serovar Typhi Ty2
cgugaccgauaaaaaagccu

SEQ ID NO: 3739165 - RNA, 17 nt, Salmonella enterica enterica serovar Typhi Ty2
cgugaccguuucaaaga

SEQ ID NO: 3739166 - RNA, 14 nt, Salmonella enterica enterica serovar Typhi Ty2
cgugacgcgccagc

SEQ ID NO: 3739167 - RNA, 17 nt, Salmonella enterica enterica serovar Typhi Ty2
cgugacgcgccagcgga

SEQ ID NO: 3739168 - RNA, 18 nt, Salmonella enterica enterica serovar Typhi Ty2
cgugagaaguaagcgcca

SEQ ID NO: 3739169 - RNA, 22 nt, Salmonella enterica enterica serovar Typhi Ty2
cgugagaucguuauuaaacaga

SEQ ID NO: 3739170 - RNA, 22 nt, Salmonella enterica enterica serovar Typhi Ty2
cgugagccacuauccagucagc

SEQ ID NO: 3739171 - RNA, 21 nt, Salmonella enterica enterica serovar Typhi Ty2
cgugagccgaaauccaccagc

SEQ ID NO: 3739172 - RNA, 17 nt, Salmonella enterica enterica serovar Typhi Ty2
cgugagccggacacugc

SEQ ID NO: 3739173 - RNA, 17 nt, Salmonella enterica enterica serovar Typhi Ty2
cgugagcgcauccggca

SEQ ID NO: 3739174 - RNA, 13 nt, Salmonella enterica enterica serovar Typhi Ty2
cgugagcgcgccg

SEQ ID NO: 3739175 - RNA, 15 nt, Salmonella enterica enterica serovar Typhi Ty2
cgugaggcugaagcg

SEQ ID NO: 3739176 - RNA, 18 nt, Salmonella enterica enterica serovar Typhi Ty2
cgugaguaucgaucguca

SEQ ID NO: 3739177 - RNA, 19 nt, Salmonella enterica enterica serovar Typhi Ty2
cgugaguggcggcgcgcag

SEQ ID NO: 3739178 - RNA, 21 nt, Salmonella enterica enterica serovar Typhi Ty2
cgugagugguagaaacuggca

SEQ ID NO: 3739179 - RNA, 17 nt, Salmonella enterica enterica serovar Typhi Ty2
cgugaguuucaguauca

SEQ ID NO: 3739180 - RNA, 13 nt, Salmonella enterica enterica serovar Typhi Ty2
cgugaguuuuaac

SEQ ID NO: 3739181 - RNA, 19 nt, Salmonella enterica enterica serovar Typhi Ty2
cgugauaaagcugacgcgc

SEQ ID NO: 3739182 - RNA, 22 nt, Salmonella enterica enterica serovar Typhi Ty2
cgugaucacucccggaauaucg

SEQ ID NO: 3739183 - RNA, 16 nt, Salmonella enterica enterica serovar Typhi Ty2
cgugaucgccaaagcg

SEQ ID NO: 3739184 - RNA, 19 nt, Salmonella enterica enterica serovar Typhi Ty2
cgugaugcgacgcgcucac

SEQ ID NO: 3739185 - RNA, 22 nt, Salmonella enterica enterica serovar Typhi Ty2
cgugauugagcagaucagcacg

SEQ ID NO: 3739186 - RNA, 14 nt, Salmonella enterica enterica serovar Typhi Ty2
cgugcaaugucaug

SEQ ID NO: 3739187 - RNA, 16 nt, Salmonella enterica enterica serovar Typhi Ty2
cgugcagcgccgccug

SEQ ID NO: 3739188 - RNA, 18 nt, Salmonella enterica enterica serovar Typhi Ty2
cgugcagcgugccgggau

SEQ ID NO: 3739189 - RNA, 18 nt, Salmonella enterica enterica serovar Typhi Ty2
cgugcaggccggauaagc

SEQ ID NO: 3739190 - RNA, 23 nt, Salmonella enterica enterica serovar Typhi Ty2
cgugcaggccggauaagccggau

SEQ ID NO: 3739191 - RNA, 22 nt, Salmonella enterica enterica serovar Typhi Ty2
cgugcaguuuugcuucaugcac

SEQ ID NO: 3739192 - RNA, 22 nt, Salmonella enterica enterica serovar Typhi Ty2
cgugcaugggauacgccagcag

SEQ ID NO: 3739193 - RNA, 20 nt, Salmonella enterica enterica serovar Typhi Ty2
cgugccagaaacaagaagca

SEQ ID NO: 3739194 - RNA, 14 nt, Salmonella enterica enterica serovar Typhi Ty2
cgugccgaccagcg

SEQ ID NO: 3739195 - RNA, 23 nt, Salmonella enterica enterica serovar Typhi Ty2
cgugccggaugauguuuauccgg

SEQ ID NO: 3739196 - RNA, 14 nt, Salmonella enterica enterica serovar Typhi Ty2
cgugccguccggca

SEQ ID NO: 3739197 - RNA, 18 nt, Salmonella enterica enterica serovar Typhi Ty2
cgugccuuccaucggccc

SEQ ID NO: 3739198 - RNA, 13 nt, Salmonella enterica enterica serovar Typhi Ty2
cgugccuuccgca

SEQ ID NO: 3739199 - RNA, 18 nt, Salmonella enterica enterica serovar Typhi Ty2
cgugcgauagcgucccgu

SEQ ID NO: 3739200 - RNA, 17 nt, Salmonella enterica enterica serovar Typhi Ty2
cgugcgaucucauacca

SEQ ID NO: 3739201 - RNA, 15 nt, Salmonella enterica enterica serovar Typhi Ty2
cgugcgccgacaucg

SEQ ID NO: 3739202 - RNA, 21 nt, Salmonella enterica enterica serovar Typhi Ty2
cgugcggcgaagcaucuuucc

SEQ ID NO: 3739203 - RNA, 18 nt, Salmonella enterica enterica serovar Typhi Ty2
cgugcucuucguggaacu

SEQ ID NO: 3739204 - RNA, 18 nt, Salmonella enterica enterica serovar Typhi Ty2
cgugcugacggagcuggc

SEQ ID NO: 3739205 - RNA, 20 nt, Salmonella enterica enterica serovar Typhi Ty2
cgugcugaucccgcgcgccu

SEQ ID NO: 3739206 - RNA, 13 nt, Salmonella enterica enterica serovar Typhi Ty2
cgugcuucaacgg

SEQ ID NO: 3739207 - RNA, 12 nt, Salmonella enterica enterica serovar Typhi Ty2
cguggaaaagag

SEQ ID NO: 3739208 - RNA, 13 nt, Salmonella enterica enterica serovar Typhi Ty2
cguggacgcuggg

SEQ ID NO: 3739209 - RNA, 20 nt, Salmonella enterica enterica serovar Typhi Ty2
cguggaucucgucgccggug

SEQ ID NO: 3739210 - RNA, 13 nt, Salmonella enterica enterica serovar Typhi Ty2
cguggcaaucagc

SEQ ID NO: 3739211 - RNA, 14 nt, Salmonella enterica enterica serovar Typhi Ty2
cguggcaaucagca

SEQ ID NO: 3739212 - RNA, 15 nt, Salmonella enterica enterica serovar Typhi Ty2
cguggcaaucagcaa

SEQ ID NO: 3739213 - RNA, 16 nt, Salmonella enterica enterica serovar Typhi Ty2
cguggcaaucagcaau

SEQ ID NO: 3739214 - RNA, 17 nt, Salmonella enterica enterica serovar Typhi Ty2
cguggcauucgcuugcc

SEQ ID NO: 3739215 - RNA, 15 nt, Salmonella enterica enterica serovar Typhi Ty2
cguggccaaaaaauc

SEQ ID NO: 3739216 - RNA, 22 nt, Salmonella enterica enterica serovar Typhi Ty2
cguggccagcaugcccgccagc

SEQ ID NO: 3739217 - RNA, 21 nt, Salmonella enterica enterica serovar Typhi Ty2
cguggccgauauugccuucac

SEQ ID NO: 3739218 - RNA, 16 nt, Salmonella enterica enterica serovar Typhi Ty2
cguggcgcaaccgaua

SEQ ID NO: 3739219 - RNA, 13 nt, Salmonella enterica enterica serovar Typhi Ty2
cguggcgcaucuc

SEQ ID NO: 3739220 - RNA, 16 nt, Salmonella enterica enterica serovar Typhi Ty2
cguggcgcuuuccggc

SEQ ID NO: 3739221 - RNA, 16 nt, Salmonella enterica enterica serovar Typhi Ty2
cguggcggcagagcca

SEQ ID NO: 3739222 - RNA, 16 nt, Salmonella enterica enterica serovar Typhi Ty2
cguggcgggaugcccc

SEQ ID NO: 3739223 - RNA, 22 nt, Salmonella enterica enterica serovar Typhi Ty2
cguggcguuuucauuagccgcc

SEQ ID NO: 3739224 - RNA, 14 nt, Salmonella enterica enterica serovar Typhi Ty2
cgugguaucgaaaa

SEQ ID NO: 3739225 - RNA, 20 nt, Salmonella enterica enterica serovar Typhi Ty2
cguggucguaaaacugcacc

SEQ ID NO: 3739226 - RNA, 21 nt, Salmonella enterica enterica serovar Typhi Ty2
cguggucguaaaacugcacca

SEQ ID NO: 3739227 - RNA, 14 nt, Salmonella enterica enterica serovar Typhi Ty2
cguggugggguucc

SEQ ID NO: 3739228 - RNA, 13 nt, Salmonella enterica enterica serovar Typhi Ty2
cgugguuuccggc

SEQ ID NO: 3739229 - RNA, 17 nt, Salmonella enterica enterica serovar Typhi Ty2
cgugguuuccggcagcu

SEQ ID NO: 3739230 - RNA, 21 nt, Salmonella enterica enterica serovar Typhi Ty2
cgugguuuguugcgcgacgac

SEQ ID NO: 3739231 - RNA, 12 nt, Salmonella enterica enterica serovar Typhi Ty2
cguguacggcga

SEQ ID NO: 3739232 - RNA, 17 nt, Salmonella enterica enterica serovar Typhi Ty2
cguguagccaguacgcg

SEQ ID NO: 3739233 - RNA, 22 nt, Salmonella enterica enterica serovar Typhi Ty2
cguguaguuauaaauuuauuuu

SEQ ID NO: 3739234 - RNA, 22 nt, Salmonella enterica enterica serovar Typhi Ty2
cguguauuccagucgcuccacc

SEQ ID NO: 3739235 - RNA, 20 nt, Salmonella enterica enterica serovar Typhi Ty2
cgugucaggaugcugauuaa

SEQ ID NO: 3739236 - RNA, 12 nt, Salmonella enterica enterica serovar Typhi Ty2
cgugucaucaaa

SEQ ID NO: 3739237 - RNA, 23 nt, Salmonella enterica enterica serovar Typhi Ty2
cgugucaucaaaaucaucgccac

SEQ ID NO: 3739238 - RNA, 19 nt, Salmonella enterica enterica serovar Typhi Ty2
cguguccggauucgcggca

SEQ ID NO: 3739239 - RNA, 17 nt, Salmonella enterica enterica serovar Typhi Ty2
cguucgcauauucugcg

SEQ ID NO: 3739240 - RNA, 12 nt, Salmonella enterica enterica serovar Typhi Ty2
cguucgccgcau

SEQ ID NO: 3739241 - RNA, 19 nt, Salmonella enterica enterica serovar Typhi Ty2
cguucgcgaauuucacgca

SEQ ID NO: 3739242 - RNA, 18 nt, Salmonella enterica enterica serovar Typhi Ty2
cguucgcgcaauucuucu

SEQ ID NO: 3739243 - RNA, 17 nt, Salmonella enterica enterica serovar Typhi Ty2
cguucgcgguaaucgcg

SEQ ID NO: 3739244 - RNA, 21 nt, Salmonella enterica enterica serovar Typhi Ty2
cguucggaagacugcuccggc

SEQ ID NO: 3739245 - RNA, 20 nt, Salmonella enterica enterica serovar Typhi Ty2
cguucggcaaaacgccgcag

SEQ ID NO: 3739246 - RNA, 13 nt, Salmonella enterica enterica serovar Typhi Ty2
cguucggguuuuc

SEQ ID NO: 3739247 - RNA, 16 nt, Salmonella enterica enterica serovar Typhi Ty2
cguucggguuuuccug

SEQ ID NO: 3739248 - RNA, 13 nt, Salmonella enterica enterica serovar Typhi Ty2
cguucgucgccgg

SEQ ID NO: 3739249 - RNA, 21 nt, Salmonella enterica enterica serovar Typhi Ty2
cguucgugaauaugacgggca

SEQ ID NO: 3739250 - RNA, 15 nt, Salmonella enterica enterica serovar Typhi Ty2
cguucucauugcugu

SEQ ID NO: 3739251 - RNA, 16 nt, Salmonella enterica enterica serovar Typhi Ty2
cguucugcacgccggu

SEQ ID NO: 3739252 - RNA, 15 nt, Salmonella enterica enterica serovar Typhi Ty2
cguucuucgauaaag

SEQ ID NO: 3739253 - RNA, 11 nt, Salmonella enterica enterica serovar Typhi Ty2
cguugaaaacg

SEQ ID NO: 3739254 - RNA, 13 nt, Salmonella enterica enterica serovar Typhi Ty2
cguugaaauccuc

SEQ ID NO: 3739255 - RNA, 21 nt, Salmonella enterica enterica serovar Typhi Ty2
cguugaauauuggcaucaagc

SEQ ID NO: 3739256 - RNA, 12 nt, Salmonella enterica enterica serovar Typhi Ty2
cguugaccagcg

SEQ ID NO: 3739257 - RNA, 15 nt, Salmonella enterica enterica serovar Typhi Ty2
cguugaccagcgacg

SEQ ID NO: 3739258 - RNA, 15 nt, Salmonella enterica enterica serovar Typhi Ty2
cguugauagacgaca

SEQ ID NO: 3739259 - RNA, 23 nt, Salmonella enterica enterica serovar Typhi Ty2
cguugauccugaccgggcucacg

SEQ ID NO: 3739260 - RNA, 13 nt, Salmonella enterica enterica serovar Typhi Ty2
cguugaucgccau

SEQ ID NO: 3739261 - RNA, 15 nt, Salmonella enterica enterica serovar Typhi Ty2
cguugccaaaagguu

SEQ ID NO: 3739262 - RNA, 16 nt, Salmonella enterica enterica serovar Typhi Ty2
cguugccagcggccag

SEQ ID NO: 3739263 - RNA, 23 nt, Salmonella enterica enterica serovar Typhi Ty2
cguugccauacgcccacgcggcg

SEQ ID NO: 3739264 - RNA, 15 nt, Salmonella enterica enterica serovar Typhi Ty2
cguugcccaucgcaa

SEQ ID NO: 3739265 - RNA, 16 nt, Salmonella enterica enterica serovar Typhi Ty2
cguugccgcaggcaac

SEQ ID NO: 3739266 - RNA, 21 nt, Salmonella enterica enterica serovar Typhi Ty2
cguugccgcaggcaacggccc

SEQ ID NO: 3739267 - RNA, 12 nt, Salmonella enterica enterica serovar Typhi Ty2
cguugccgccgu

SEQ ID NO: 3739268 - RNA, 17 nt, Salmonella enterica enterica serovar Typhi Ty2
cguugccguaggcaacg

SEQ ID NO: 3739269 - RNA, 21 nt, Salmonella enterica enterica serovar Typhi Ty2
cguugccguaggcaacgaccc

SEQ ID NO: 3739270 - RNA, 15 nt, Salmonella enterica enterica serovar Typhi Ty2
cguugccugauaaau

SEQ ID NO: 3739271 - RNA, 18 nt, Salmonella enterica enterica serovar Typhi Ty2
cguugcgaaucagguaca

SEQ ID NO: 3739272 - RNA, 16 nt, Salmonella enterica enterica serovar Typhi Ty2
cguugcgacuaucggc

SEQ ID NO: 3739273 - RNA, 19 nt, Salmonella enterica enterica serovar Typhi Ty2
cguugcgcccaucaucauc

SEQ ID NO: 3739274 - RNA, 15 nt, Salmonella enterica enterica serovar Typhi Ty2
cguugcgccgccagg

SEQ ID NO: 3739275 - RNA, 19 nt, Salmonella enterica enterica serovar Typhi Ty2
cguugcguguuguacagca

SEQ ID NO: 3739276 - RNA, 21 nt, Salmonella enterica enterica serovar Typhi Ty2
cguugcuguaaccggaauaga

SEQ ID NO: 3739277 - RNA, 12 nt, Salmonella enterica enterica serovar Typhi Ty2
cguugcuuuaua

SEQ ID NO: 3739278 - RNA, 20 nt, Salmonella enterica enterica serovar Typhi Ty2
cguuggaagugcguuaaccc

SEQ ID NO: 3739279 - RNA, 17 nt, Salmonella enterica enterica serovar Typhi Ty2
cguuggauaacagcgcg

SEQ ID NO: 3739280 - RNA, 20 nt, Salmonella enterica enterica serovar Typhi Ty2
cguuggcguaaaucaggcca

SEQ ID NO: 3739281 - RNA, 14 nt, Salmonella enterica enterica serovar Typhi Ty2
cguuggggaaaaua

SEQ ID NO: 3739282 - RNA, 13 nt, Salmonella enterica enterica serovar Typhi Ty2
cguuguauaaaca

SEQ ID NO: 3739283 - RNA, 14 nt, Salmonella enterica enterica serovar Typhi Ty2
cguuguccagcaga

SEQ ID NO: 3739284 - RNA, 15 nt, Salmonella enterica enterica serovar Typhi Ty2
cguugugcaagcuca

SEQ ID NO: 3739285 - RNA, 17 nt, Salmonella enterica enterica serovar Typhi Ty2
cguugugcagaaucauu

SEQ ID NO: 3739286 - RNA, 18 nt, Salmonella enterica enterica serovar Typhi Ty2
cguuguggcgaccagcag

SEQ ID NO: 3739287 - RNA, 17 nt, Salmonella enterica enterica serovar Typhi Ty2
cguuguguccagggugu

SEQ ID NO: 3739288 - RNA, 18 nt, Salmonella enterica enterica serovar Typhi Ty2
cguuuaaaagcggauaag

SEQ ID NO: 3739289 - RNA, 16 nt, Salmonella enterica enterica serovar Typhi Ty2
cguuuaaacucccggc

SEQ ID NO: 3739290 - RNA, 12 nt, Salmonella enterica enterica serovar Typhi Ty2
cguuuaaagcgc

SEQ ID NO: 3739291 - RNA, 14 nt, Salmonella enterica enterica serovar Typhi Ty2
cguuuaaagcgcuc

SEQ ID NO: 3739292 - RNA, 16 nt, Salmonella enterica enterica serovar Typhi Ty2
cguuuaagcaugguga

SEQ ID NO: 3739293 - RNA, 21 nt, Salmonella enterica enterica serovar Typhi Ty2
cguuuacaccgccauccggca

SEQ ID NO: 3739294 - RNA, 18 nt, Salmonella enterica enterica serovar Typhi Ty2
cguuuaccggugcagacc

SEQ ID NO: 3739295 - RNA, 14 nt, Salmonella enterica enterica serovar Typhi Ty2
cguuuagcgccagc

SEQ ID NO: 3739296 - RNA, 14 nt, Salmonella enterica enterica serovar Typhi Ty2
cguuuaugccgcca

SEQ ID NO: 3739297 - RNA, 19 nt, Salmonella enterica enterica serovar Typhi Ty2
cguuuauguucuuugugau

SEQ ID NO: 3739298 - RNA, 17 nt, Salmonella enterica enterica serovar Typhi Ty2
cguuuauguuugcugau

SEQ ID NO: 3739299 - RNA, 17 nt, Salmonella enterica enterica serovar Typhi Ty2
cguuucaaaaugcccca

SEQ ID NO: 3739300 - RNA, 14 nt, Salmonella enterica enterica serovar Typhi Ty2
cguuucagccccuu

SEQ ID NO: 3739301 - RNA, 22 nt, Salmonella enterica enterica serovar Typhi Ty2
cguuucauuuuucccaucaauc

SEQ ID NO: 3739302 - RNA, 18 nt, Salmonella enterica enterica serovar Typhi Ty2
cguuuccagcaucgacca

SEQ ID NO: 3739303 - RNA, 13 nt, Salmonella enterica enterica serovar Typhi Ty2
cguuuccagugca

SEQ ID NO: 3739304 - RNA, 16 nt, Salmonella enterica enterica serovar Typhi Ty2
cguuuccgcaauaagu

SEQ ID NO: 3739305 - RNA, 13 nt, Salmonella enterica enterica serovar Typhi Ty2
cguuucuacaaua

SEQ ID NO: 3739306 - RNA, 16 nt, Salmonella enterica enterica serovar Typhi Ty2
cguuucucgcgaccag

SEQ ID NO: 3739307 - RNA, 23 nt, Salmonella enterica enterica serovar Typhi Ty2
cguuugaaauaccaggcggcuuu

SEQ ID NO: 3739308 - RNA, 14 nt, Salmonella enterica enterica serovar Typhi Ty2
cguuugaacagcag

SEQ ID NO: 3739309 - RNA, 14 nt, Salmonella enterica enterica serovar Typhi Ty2
cguuugcagccaga

SEQ ID NO: 3739310 - RNA, 17 nt, Salmonella enterica enterica serovar Typhi Ty2
cguuugccccucuuccc

SEQ ID NO: 3739311 - RNA, 22 nt, Salmonella enterica enterica serovar Typhi Ty2
cguuugcgcgaggucgagcuca

SEQ ID NO: 3739312 - RNA, 15 nt, Salmonella enterica enterica serovar Typhi Ty2
cguuugcgcgcgcca

SEQ ID NO: 3739313 - RNA, 17 nt, Salmonella enterica enterica serovar Typhi Ty2
cguuugcgcuacgcugc

SEQ ID NO: 3739314 - RNA, 20 nt, Salmonella enterica enterica serovar Typhi Ty2
cguuugcgucaaucaggaaa

SEQ ID NO: 3739315 - RNA, 21 nt, Salmonella enterica enterica serovar Typhi Ty2
cguuuguaacagcaggacccg

SEQ ID NO: 3739316 - RNA, 20 nt, Salmonella enterica enterica serovar Typhi Ty2
cguuuguuugucgauuuccg

SEQ ID NO: 3739317 - RNA, 20 nt, Salmonella enterica enterica serovar Typhi Ty2
cguuuuaacgucauuaccag

SEQ ID NO: 3739318 - RNA, 18 nt, Salmonella enterica enterica serovar Typhi Ty2
cguuuuagguucuucaau

SEQ ID NO: 3739319 - RNA, 17 nt, Salmonella enterica enterica serovar Typhi Ty2
cguuuuaucaugcgcca

SEQ ID NO: 3739320 - RNA, 15 nt, Salmonella enterica enterica serovar Typhi Ty2
cguuuucaugcacga

SEQ ID NO: 3739321 - RNA, 20 nt, Salmonella enterica enterica serovar Typhi Ty2
cguuuucauuagccgccagc

SEQ ID NO: 3739322 - RNA, 16 nt, Salmonella enterica enterica serovar Typhi Ty2
cuaaugauuaucuuuu

SEQ ID NO: 3739323 - RNA, 21 nt, Salmonella enterica enterica serovar Typhi Ty2
cuaaugauuaucuuuuuuagu

SEQ ID NO: 3739324 - RNA, 19 nt, Salmonella enterica enterica serovar Typhi Ty2
cuaaugcuuauccggccua

SEQ ID NO: 3739325 - RNA, 19 nt, Salmonella enterica enterica serovar Typhi Ty2
cuaaugggccagauucuua

SEQ ID NO: 3739326 - RNA, 14 nt, Salmonella enterica enterica serovar Typhi Ty2
cuaauuaauucuaa

SEQ ID NO: 3739327 - RNA, 15 nt, Salmonella enterica enterica serovar Typhi Ty2
cuaauuauuuuucaa

SEQ ID NO: 3739328 - RNA, 19 nt, Salmonella enterica enterica serovar Typhi Ty2
cuaauuauuuuucaaauga

SEQ ID NO: 3739329 - RNA, 13 nt, Salmonella enterica enterica serovar Typhi Ty2
cuaauuguuugua

SEQ ID NO: 3739330 - RNA, 20 nt, Salmonella enterica enterica serovar Typhi Ty2
cuaauuuauugccacgccau

SEQ ID NO: 3739331 - RNA, 13 nt, Salmonella enterica enterica serovar Typhi Ty2
cuaauuucaauuu

SEQ ID NO: 3739332 - RNA, 17 nt, Salmonella enterica enterica serovar Typhi Ty2
cuaauuugaugccuggc

SEQ ID NO: 3739333 - RNA, 15 nt, Salmonella enterica enterica serovar Typhi Ty2
cuaauuuucagggug

SEQ ID NO: 3739334 - RNA, 13 nt, Salmonella enterica enterica serovar Typhi Ty2
cuacaacucagcg

SEQ ID NO: 3739335 - RNA, 20 nt, Salmonella enterica enterica serovar Typhi Ty2
cuacaaucgugugaugcacc

SEQ ID NO: 3739336 - RNA, 18 nt, Salmonella enterica enterica serovar Typhi Ty2
cuacaccguauccggccu

SEQ ID NO: 3739337 - RNA, 14 nt, Salmonella enterica enterica serovar Typhi Ty2
cuacaccugggcuu

SEQ ID NO: 3739338 - RNA, 18 nt, Salmonella enterica enterica serovar Typhi Ty2
cuacaccuucuucgccaa

SEQ ID NO: 3739339 - RNA, 13 nt, Salmonella enterica enterica serovar Typhi Ty2
cuacacucaauac

SEQ ID NO: 3739340 - RNA, 21 nt, Salmonella enterica enterica serovar Typhi Ty2
cuacacucuuaacauggcgga

SEQ ID NO: 3739341 - RNA, 21 nt, Salmonella enterica enterica serovar Typhi Ty2
cuacagacaucuuugccaaac

SEQ ID NO: 3739342 - RNA, 15 nt, Salmonella enterica enterica serovar Typhi Ty2
cuacaucaagagaaa

SEQ ID NO: 3739343 - RNA, 13 nt, Salmonella enterica enterica serovar Typhi Ty2
cuaccacccagcc

SEQ ID NO: 3739344 - RNA, 20 nt, Salmonella enterica enterica serovar Typhi Ty2
cuaccacccagccagacgcc

SEQ ID NO: 3739345 - RNA, 20 nt, Salmonella enterica enterica serovar Typhi Ty2
cuaccacgccgcuacugccg

SEQ ID NO: 3739346 - RNA, 19 nt, Salmonella enterica enterica serovar Typhi Ty2
cuaccagcgcuauccaggc

SEQ ID NO: 3739347 - RNA, 13 nt, Salmonella enterica enterica serovar Typhi Ty2
cuaccauaaugau

SEQ ID NO: 3739348 - RNA, 11 nt, Salmonella enterica enterica serovar Typhi Ty2
cuaccaucggc

SEQ ID NO: 3739349 - RNA, 16 nt, Salmonella enterica enterica serovar Typhi Ty2
cuaccaucggcgcuac

SEQ ID NO: 3739350 - RNA, 16 nt, Salmonella enterica enterica serovar Typhi Ty2
cuaccauuacccgaac

SEQ ID NO: 3739351 - RNA, 16 nt, Salmonella enterica enterica serovar Typhi Ty2
cuacccgcaauaccaa

SEQ ID NO: 3739352 - RNA, 19 nt, Salmonella enterica enterica serovar Typhi Ty2
cuacccgguguaaaaaaug

SEQ ID NO: 3739353 - RNA, 14 nt, Salmonella enterica enterica serovar Typhi Ty2
cuaccgaggcaggg

SEQ ID NO: 3739354 - RNA, 21 nt, Salmonella enterica enterica serovar Typhi Ty2
cuaccgcaauacgcuucauau

SEQ ID NO: 3739355 - RNA, 15 nt, Salmonella enterica enterica serovar Typhi Ty2
cuaccgccaccaucg

SEQ ID NO: 3739356 - RNA, 19 nt, Salmonella enterica enterica serovar Typhi Ty2
cuaccgccaccaucgcauu

SEQ ID NO: 3739357 - RNA, 20 nt, Salmonella enterica enterica serovar Typhi Ty2
cuaccgcucaggcgcgcgcu

SEQ ID NO: 3739358 - RNA, 14 nt, Salmonella enterica enterica serovar Typhi Ty2
cuaccgcugcgaua

SEQ ID NO: 3739359 - RNA, 17 nt, Salmonella enterica enterica serovar Typhi Ty2
cuaccgcuucgcgcgcc

SEQ ID NO: 3739360 - RNA, 23 nt, Salmonella enterica enterica serovar Typhi Ty2
cuaccggcgguucuuuugcuaac

SEQ ID NO: 3739361 - RNA, 14 nt, Salmonella enterica enterica serovar Typhi Ty2
cuaccgggcaaaca

SEQ ID NO: 3739362 - RNA, 16 nt, Salmonella enterica enterica serovar Typhi Ty2
cuaccgggcagcaucu

SEQ ID NO: 3739363 - RNA, 17 nt, Salmonella enterica enterica serovar Typhi Ty2
cuaccguucacggcgau

SEQ ID NO: 3739364 - RNA, 18 nt, Salmonella enterica enterica serovar Typhi Ty2
cuaccugcagggugaaga

SEQ ID NO: 3739365 - RNA, 17 nt, Salmonella enterica enterica serovar Typhi Ty2
cuaccuucacccccauc

SEQ ID NO: 3739366 - RNA, 13 nt, Salmonella enterica enterica serovar Typhi Ty2
cuacgccauggca

SEQ ID NO: 3739367 - RNA, 19 nt, Salmonella enterica enterica serovar Typhi Ty2
cuacgccuuauccggccua

SEQ ID NO: 3739368 - RNA, 19 nt, Salmonella enterica enterica serovar Typhi Ty2
cuacgcuauccggcgcgcu

SEQ ID NO: 3739369 - RNA, 13 nt, Salmonella enterica enterica serovar Typhi Ty2
cuacgcuauuucc

SEQ ID NO: 3739370 - RNA, 14 nt, Salmonella enterica enterica serovar Typhi Ty2
cuacgcuauuucca

SEQ ID NO: 3739371 - RNA, 16 nt, Salmonella enterica enterica serovar Typhi Ty2
cuacgcugcgcguucu

SEQ ID NO: 3739372 - RNA, 15 nt, Salmonella enterica enterica serovar Typhi Ty2
cuacgcuuaucaggc

SEQ ID NO: 3739373 - RNA, 23 nt, Salmonella enterica enterica serovar Typhi Ty2
cuacgcuuaucaggccuacaacg

SEQ ID NO: 3739374 - RNA, 17 nt, Salmonella enterica enterica serovar Typhi Ty2
cuacgcuuauccggcuu

SEQ ID NO: 3739375 - RNA, 13 nt, Salmonella enterica enterica serovar Typhi Ty2
cuacggcaaacac

SEQ ID NO: 3739376 - RNA, 14 nt, Salmonella enterica enterica serovar Typhi Ty2
cuacggcccuggcu

SEQ ID NO: 3739377 - RNA, 16 nt, Salmonella enterica enterica serovar Typhi Ty2
cuacggcccuggcuca

SEQ ID NO: 3739378 - RNA, 15 nt, Salmonella enterica enterica serovar Typhi Ty2
cuacgguaaaccagg

SEQ ID NO: 3739379 - RNA, 13 nt, Salmonella enterica enterica serovar Typhi Ty2
cuacguaauucau

SEQ ID NO: 3739380 - RNA, 18 nt, Salmonella enterica enterica serovar Typhi Ty2
cuacguauccuggcgcgu

SEQ ID NO: 3739381 - RNA, 13 nt, Salmonella enterica enterica serovar Typhi Ty2
cuacguucaucag

SEQ ID NO: 3739382 - RNA, 14 nt, Salmonella enterica enterica serovar Typhi Ty2
cuacguuccaugcg

SEQ ID NO: 3739383 - RNA, 14 nt, Salmonella enterica enterica serovar Typhi Ty2
cuacguuuaucugg

SEQ ID NO: 3739384 - RNA, 18 nt, Salmonella enterica enterica serovar Typhi Ty2
cuacguuugaacagcagu

SEQ ID NO: 3739385 - RNA, 17 nt, Salmonella enterica enterica serovar Typhi Ty2
cuacuauuaguucugag

SEQ ID NO: 3739386 - RNA, 13 nt, Salmonella enterica enterica serovar Typhi Ty2
cuacucaggagau

SEQ ID NO: 3739387 - RNA, 17 nt, Salmonella enterica enterica serovar Typhi Ty2
cuacugccagcgucgcu

SEQ ID NO: 3739388 - RNA, 17 nt, Salmonella enterica enterica serovar Typhi Ty2
cuacuguggugugccug

SEQ ID NO: 3739389 - RNA, 16 nt, Salmonella enterica enterica serovar Typhi Ty2
cuacuuaccggcgcca

SEQ ID NO: 3739390 - RNA, 14 nt, Salmonella enterica enterica serovar Typhi Ty2
cuacuucagcacgg

SEQ ID NO: 3739391 - RNA, 15 nt, Salmonella enterica enterica serovar Typhi Ty2
cuacuuuauuuuucg

SEQ ID NO: 3739392 - RNA, 14 nt, Salmonella enterica enterica serovar Typhi Ty2
cuacuuuuacccuu

SEQ ID NO: 3739393 - RNA, 13 nt, Salmonella enterica enterica serovar Typhi Ty2
cuagaacauuucc

SEQ ID NO: 3739394 - RNA, 20 nt, Salmonella enterica enterica serovar Typhi Ty2
cuagaugaugauuuaugaau

SEQ ID NO: 3739395 - RNA, 21 nt, Salmonella enterica enterica serovar Typhi Ty2
cuagaugaugauuuaugaaua

SEQ ID NO: 3739396 - RNA, 18 nt, Salmonella enterica enterica serovar Typhi Ty2
cuagauuuuagaaaauaa

SEQ ID NO: 3739397 - RNA, 22 nt, Salmonella enterica enterica serovar Typhi Ty2
cuagccgccguguugugugccg

SEQ ID NO: 3739398 - RNA, 20 nt, Salmonella enterica enterica serovar Typhi Ty2
cuagcgccuuauccggccua

SEQ ID NO: 3739399 - RNA, 14 nt, Salmonella enterica enterica serovar Typhi Ty2
cuagcugcagcgcu

SEQ ID NO: 3739400 - RNA, 14 nt, Salmonella enterica enterica serovar Typhi Ty2
cuaggaacagugac

SEQ ID NO: 3739401 - RNA, 19 nt, Salmonella enterica enterica serovar Typhi Ty2
cuaggccagugccaagcaa

SEQ ID NO: 3739402 - RNA, 21 nt, Salmonella enterica enterica serovar Typhi Ty2
cuaggccagugccaagcaaca

SEQ ID NO: 3739403 - RNA, 23 nt, Salmonella enterica enterica serovar Typhi Ty2
cuaggcgcugcuggcagcgcuga

SEQ ID NO: 3739404 - RNA, 19 nt, Salmonella enterica enterica serovar Typhi Ty2
cuaguaaagaaauuuugca

SEQ ID NO: 3739405 - RNA, 19 nt, Salmonella enterica enterica serovar Typhi Ty2
cucaacauugccggcauca

SEQ ID NO: 3739406 - RNA, 21 nt, Salmonella enterica enterica serovar Typhi Ty2
cucaacauugccggcaucauu

SEQ ID NO: 3739407 - RNA, 21 nt, Salmonella enterica enterica serovar Typhi Ty2
cucaaccaccaccgauaaacg

SEQ ID NO: 3739408 - RNA, 14 nt, Salmonella enterica enterica serovar Typhi Ty2
cucaaccagcaaug

SEQ ID NO: 3739409 - RNA, 12 nt, Salmonella enterica enterica serovar Typhi Ty2
cucaaccagccg

SEQ ID NO: 3739410 - RNA, 21 nt, Salmonella enterica enterica serovar Typhi Ty2
cucaaccaucaaaaaaaauag

SEQ ID NO: 3739411 - RNA, 14 nt, Salmonella enterica enterica serovar Typhi Ty2
cucaaccaugauaa

SEQ ID NO: 3739412 - RNA, 23 nt, Salmonella enterica enterica serovar Typhi Ty2
cucaaccaugauaaccagccccg

SEQ ID NO: 3739413 - RNA, 16 nt, Salmonella enterica enterica serovar Typhi Ty2
cucaaccgguuuguca

SEQ ID NO: 3739414 - RNA, 21 nt, Salmonella enterica enterica serovar Typhi Ty2
cucaacgcccucaaguaaaau

SEQ ID NO: 3739415 - RNA, 13 nt, Salmonella enterica enterica serovar Typhi Ty2
cucaacgcccugc

SEQ ID NO: 3739416 - RNA, 15 nt, Salmonella enterica enterica serovar Typhi Ty2
cucaacgcccugcuc

SEQ ID NO: 3739417 - RNA, 23 nt, Salmonella enterica enterica serovar Typhi Ty2
cucaacgcgcccagauuggugau

SEQ ID NO: 3739418 - RNA, 13 nt, Salmonella enterica enterica serovar Typhi Ty2
cucaacuauuaaa

SEQ ID NO: 3739419 - RNA, 13 nt, Salmonella enterica enterica serovar Typhi Ty2
cucaacugagcgg

SEQ ID NO: 3739420 - RNA, 22 nt, Salmonella enterica enterica serovar Typhi Ty2
cucaacugggcgagggaggcaa

SEQ ID NO: 3739421 - RNA, 19 nt, Salmonella enterica enterica serovar Typhi Ty2
cucaagacgguuauuuuuc

SEQ ID NO: 3739422 - RNA, 14 nt, Salmonella enterica enterica serovar Typhi Ty2
cucaagcgcagcac

SEQ ID NO: 3739423 - RNA, 16 nt, Salmonella enterica enterica serovar Typhi Ty2
cucaagcggcaccaca

SEQ ID NO: 3739424 - RNA, 16 nt, Salmonella enterica enterica serovar Typhi Ty2
cucaagcuguagcguu

SEQ ID NO: 3739425 - RNA, 21 nt, Salmonella enterica enterica serovar Typhi Ty2
cucaaggcuauuagccaaagc

SEQ ID NO: 3739426 - RNA, 20 nt, Salmonella enterica enterica serovar Typhi Ty2
cucaagguagcgugucuacc

SEQ ID NO: 3739427 - RNA, 15 nt, Salmonella enterica enterica serovar Typhi Ty2
cucaaggucugucag

SEQ ID NO: 3739428 - RNA, 20 nt, Salmonella enterica enterica serovar Typhi Ty2
cucaaguuauguuaucccca

SEQ ID NO: 3739429 - RNA, 19 nt, Salmonella enterica enterica serovar Typhi Ty2
cucaauaaaaugucuguuu

SEQ ID NO: 3739430 - RNA, 21 nt, Salmonella enterica enterica serovar Typhi Ty2
cucaauacgagugacauuauu

SEQ ID NO: 3739431 - RNA, 18 nt, Salmonella enterica enterica serovar Typhi Ty2
cucaaucauugucauuaa

SEQ ID NO: 3739432 - RNA, 15 nt, Salmonella enterica enterica serovar Typhi Ty2
cucaaucugaugaug

SEQ ID NO: 3739433 - RNA, 15 nt, Salmonella enterica enterica serovar Typhi Ty2
cucaaugauuuccgc

SEQ ID NO: 3739434 - RNA, 14 nt, Salmonella enterica enterica serovar Typhi Ty2
cucaauuuuacagc

SEQ ID NO: 3739435 - RNA, 15 nt, Salmonella enterica enterica serovar Typhi Ty2
cucaauuuuacagcc

SEQ ID NO: 3739436 - RNA, 18 nt, Salmonella enterica enterica serovar Typhi Ty2
cucacaauaauuuuacca

SEQ ID NO: 3739437 - RNA, 22 nt, Salmonella enterica enterica serovar Typhi Ty2
cucacacauuggcgcggcagga

SEQ ID NO: 3739438 - RNA, 14 nt, Salmonella enterica enterica serovar Typhi Ty2
cucacauaacaaaa

SEQ ID NO: 3739439 - RNA, 19 nt, Salmonella enterica enterica serovar Typhi Ty2
cucacauucauugccgcca

SEQ ID NO: 3739440 - RNA, 22 nt, Salmonella enterica enterica serovar Typhi Ty2
cucaccagcugacgcagcaguu

SEQ ID NO: 3739441 - RNA, 22 nt, Salmonella enterica enterica serovar Typhi Ty2
cucaccaguagcgcgacgccaa

SEQ ID NO: 3739442 - RNA, 13 nt, Salmonella enterica enterica serovar Typhi Ty2
cucacccaggcga

SEQ ID NO: 3739443 - RNA, 14 nt, Salmonella enterica enterica serovar Typhi Ty2
cucacccaggcgau

SEQ ID NO: 3739444 - RNA, 15 nt, Salmonella enterica enterica serovar Typhi Ty2
cucaccgaccugccu

SEQ ID NO: 3739445 - RNA, 16 nt, Salmonella enterica enterica serovar Typhi Ty2
cucaccgaccugccuu

SEQ ID NO: 3739446 - RNA, 20 nt, Salmonella enterica enterica serovar Typhi Ty2
cucaccgagacugcccggca

SEQ ID NO: 3739447 - RNA, 16 nt, Salmonella enterica enterica serovar Typhi Ty2
cucaccgccuaggcca

SEQ ID NO: 3739448 - RNA, 17 nt, Salmonella enterica enterica serovar Typhi Ty2
cucaccugguaagcgcc

SEQ ID NO: 3739449 - RNA, 22 nt, Salmonella enterica enterica serovar Typhi Ty2
cucacgaaguuuacguugguau

SEQ ID NO: 3739450 - RNA, 19 nt, Salmonella enterica enterica serovar Typhi Ty2
cucacgauaacgcagcgcg

SEQ ID NO: 3739451 - RNA, 16 nt, Salmonella enterica enterica serovar Typhi Ty2
cucacgcaaugccuga

SEQ ID NO: 3739452 - RNA, 14 nt, Salmonella enterica enterica serovar Typhi Ty2
cucacgcuggugcu

SEQ ID NO: 3739453 - RNA, 19 nt, Salmonella enterica enterica serovar Typhi Ty2
cucacgcuuauccggccua

SEQ ID NO: 3739454 - RNA, 14 nt, Salmonella enterica enterica serovar Typhi Ty2
cucacggucuccug

SEQ ID NO: 3739455 - RNA, 13 nt, Salmonella enterica enterica serovar Typhi Ty2
cucacgucccguu

SEQ ID NO: 3739456 - RNA, 15 nt, Salmonella enterica enterica serovar Typhi Ty2
cucacguuccccagc

SEQ ID NO: 3739457 - RNA, 16 nt, Salmonella enterica enterica serovar Typhi Ty2
cucacguuccccagca

SEQ ID NO: 3739458 - RNA, 21 nt, Salmonella enterica enterica serovar Typhi Ty2
cucacuacccggaggcaauau

SEQ ID NO: 3739459 - RNA, 18 nt, Salmonella enterica enterica serovar Typhi Ty2
cucacugccgacgcccuc

SEQ ID NO: 3739460 - RNA, 13 nt, Salmonella enterica enterica serovar Typhi Ty2
cucacuguugaua

SEQ ID NO: 3739461 - RNA, 17 nt, Salmonella enterica enterica serovar Typhi Ty2
cucacuuuucuuuccug

SEQ ID NO: 3739462 - RNA, 19 nt, Salmonella enterica enterica serovar Typhi Ty2
cucagaccauauucacgca

SEQ ID NO: 3739463 - RNA, 24 nt, Salmonella enterica enterica serovar Typhi Ty2
cucagcaaaaucacgcacacgucu

SEQ ID NO: 3739464 - RNA, 13 nt, Salmonella enterica enterica serovar Typhi Ty2
cucagccacccac

SEQ ID NO: 3739465 - RNA, 22 nt, Salmonella enterica enterica serovar Typhi Ty2
cucagccaggucugcaccacgg

SEQ ID NO: 3739466 - RNA, 14 nt, Salmonella enterica enterica serovar Typhi Ty2
cucagccccaggcc

SEQ ID NO: 3739467 - RNA, 23 nt, Salmonella enterica enterica serovar Typhi Ty2
cucagcgccacgcccaacauaaa

SEQ ID NO: 3739468 - RNA, 15 nt, Salmonella enterica enterica serovar Typhi Ty2
cucagcgccguagcg

SEQ ID NO: 3739469 - RNA, 15 nt, Salmonella enterica enterica serovar Typhi Ty2
cucagcgcggcagcc

SEQ ID NO: 3739470 - RNA, 16 nt, Salmonella enterica enterica serovar Typhi Ty2
cucagcggcccaaugg

SEQ ID NO: 3739471 - RNA, 21 nt, Salmonella enterica enterica serovar Typhi Ty2
cucagcgucggugaagaaaau

SEQ ID NO: 3739472 - RNA, 19 nt, Salmonella enterica enterica serovar Typhi Ty2
cucagcuaaaaacagcgca

SEQ ID NO: 3739473 - RNA, 14 nt, Salmonella enterica enterica serovar Typhi Ty2
cucagcuugcgcug

SEQ ID NO: 3739474 - RNA, 21 nt, Salmonella enterica enterica serovar Typhi Ty2
cucaggaagcguccagaugca

SEQ ID NO: 3739475 - RNA, 18 nt, Salmonella enterica enterica serovar Typhi Ty2
cucaggcaagacacagcg

SEQ ID NO: 3739476 - RNA, 13 nt, Salmonella enterica enterica serovar Typhi Ty2
cucaggcgagccc

SEQ ID NO: 3739477 - RNA, 23 nt, Salmonella enterica enterica serovar Typhi Ty2
cucaggcgcgaauaaugcguccg

SEQ ID NO: 3739478 - RNA, 20 nt, Salmonella enterica enterica serovar Typhi Ty2
cucaggcuccgcgcagggug

SEQ ID NO: 3739479 - RNA, 17 nt, Salmonella enterica enterica serovar Typhi Ty2
cucagggagaacucauc

SEQ ID NO: 3739480 - RNA, 19 nt, Salmonella enterica enterica serovar Typhi Ty2
cucaggguccccauauccc

SEQ ID NO: 3739481 - RNA, 14 nt, Salmonella enterica enterica serovar Typhi Ty2
cucagucagucccg

SEQ ID NO: 3739482 - RNA, 20 nt, Salmonella enterica enterica serovar Typhi Ty2
cucaguccagccgccgcgcg

SEQ ID NO: 3739483 - RNA, 22 nt, Salmonella enterica enterica serovar Typhi Ty2
cucauaaaacauuccugacauu

SEQ ID NO: 3739484 - RNA, 18 nt, Salmonella enterica enterica serovar Typhi Ty2
cucauaaauugcagcgac

SEQ ID NO: 3739485 - RNA, 16 nt, Salmonella enterica enterica serovar Typhi Ty2
cucauaaugauggggu

SEQ ID NO: 3739486 - RNA, 20 nt, Salmonella enterica enterica serovar Typhi Ty2
cucauacagcccgcgcagaa

SEQ ID NO: 3739487 - RNA, 16 nt, Salmonella enterica enterica serovar Typhi Ty2
cucccgguucgccgcu

SEQ ID NO: 3739488 - RNA, 13 nt, Salmonella enterica enterica serovar Typhi Ty2
cucccuccugcuc

SEQ ID NO: 3739489 - RNA, 16 nt, Salmonella enterica enterica serovar Typhi Ty2
cucccugagucuugcc

SEQ ID NO: 3739490 - RNA, 17 nt, Salmonella enterica enterica serovar Typhi Ty2
cucccugccuaaagaaa

SEQ ID NO: 3739491 - RNA, 18 nt, Salmonella enterica enterica serovar Typhi Ty2
cucccuggcagugaucca

SEQ ID NO: 3739492 - RNA, 19 nt, Salmonella enterica enterica serovar Typhi Ty2
cucccuguuccuguauuug

SEQ ID NO: 3739493 - RNA, 13 nt, Salmonella enterica enterica serovar Typhi Ty2
cucccuuccccca

SEQ ID NO: 3739494 - RNA, 21 nt, Salmonella enterica enterica serovar Typhi Ty2
cuccgaaacaaucaccugaug

SEQ ID NO: 3739495 - RNA, 18 nt, Salmonella enterica enterica serovar Typhi Ty2
cuccgacaaacuucaucg

SEQ ID NO: 3739496 - RNA, 15 nt, Salmonella enterica enterica serovar Typhi Ty2
cuccgaccaucgccg

SEQ ID NO: 3739497 - RNA, 18 nt, Salmonella enterica enterica serovar Typhi Ty2
cuccgagacucaaagaaa

SEQ ID NO: 3739498 - RNA, 16 nt, Salmonella enterica enterica serovar Typhi Ty2
cuccgaggaacgugag

SEQ ID NO: 3739499 - RNA, 17 nt, Salmonella enterica enterica serovar Typhi Ty2
cuccgcaaagcccauca

SEQ ID NO: 3739500 - RNA, 15 nt, Salmonella enterica enterica serovar Typhi Ty2
cuccgcaauuuccug

SEQ ID NO: 3739501 - RNA, 14 nt, Salmonella enterica enterica serovar Typhi Ty2
cuccgccagggcgg

SEQ ID NO: 3739502 - RNA, 15 nt, Salmonella enterica enterica serovar Typhi Ty2
cuccgcccauccagg

SEQ ID NO: 3739503 - RNA, 21 nt, Salmonella enterica enterica serovar Typhi Ty2
cuccgccgcuuuaucguaacc

SEQ ID NO: 3739504 - RNA, 14 nt, Salmonella enterica enterica serovar Typhi Ty2
cuccgcgcuggcaa

SEQ ID NO: 3739505 - RNA, 15 nt, Salmonella enterica enterica serovar Typhi Ty2
cuccgcgcuggcaau

SEQ ID NO: 3739506 - RNA, 18 nt, Salmonella enterica enterica serovar Typhi Ty2
cuccgcguagcccagcgc

SEQ ID NO: 3739507 - RNA, 13 nt, Salmonella enterica enterica serovar Typhi Ty2
cuccggacgcacc

SEQ ID NO: 3739508 - RNA, 14 nt, Salmonella enterica enterica serovar Typhi Ty2
cuccggacguaccc

SEQ ID NO: 3739509 - RNA, 16 nt, Salmonella enterica enterica serovar Typhi Ty2
cuccggcacauucacc

SEQ ID NO: 3739510 - RNA, 18 nt, Salmonella enterica enterica serovar Typhi Ty2
cuccggcacauucaccac

SEQ ID NO: 3739511 - RNA, 17 nt, Salmonella enterica enterica serovar Typhi Ty2
cuccggcagaaaugacc

SEQ ID NO: 3739512 - RNA, 14 nt, Salmonella enterica enterica serovar Typhi Ty2
cuccggcagcgaau

SEQ ID NO: 3739513 - RNA, 13 nt, Salmonella enterica enterica serovar Typhi Ty2
cuccggcaggcaa

SEQ ID NO: 3739514 - RNA, 14 nt, Salmonella enterica enterica serovar Typhi Ty2
cuccggcaguccau

SEQ ID NO: 3739515 - RNA, 16 nt, Salmonella enterica enterica serovar Typhi Ty2
cuccggccagcgccag

SEQ ID NO: 3739516 - RNA, 13 nt, Salmonella enterica enterica serovar Typhi Ty2
cuccggcggguaa

SEQ ID NO: 3739517 - RNA, 17 nt, Salmonella enterica enterica serovar Typhi Ty2
cuccggcuaugccggag

SEQ ID NO: 3739518 - RNA, 21 nt, Salmonella enterica enterica serovar Typhi Ty2
cuccggcuuaaugcauggcag

SEQ ID NO: 3739519 - RNA, 14 nt, Salmonella enterica enterica serovar Typhi Ty2
cuccgguaaucacc

SEQ ID NO: 3739520 - RNA, 23 nt, Salmonella enterica enterica serovar Typhi Ty2
cuccgguaaucaccagaucggca

SEQ ID NO: 3739521 - RNA, 14 nt, Salmonella enterica enterica serovar Typhi Ty2
cuccgguugcugau

SEQ ID NO: 3739522 - RNA, 17 nt, Salmonella enterica enterica serovar Typhi Ty2
cuccgguugcugauaac

SEQ ID NO: 3739523 - RNA, 12 nt, Salmonella enterica enterica serovar Typhi Ty2
cuccgucaaaga

SEQ ID NO: 3739524 - RNA, 22 nt, Salmonella enterica enterica serovar Typhi Ty2
cuccgucucuuuauugaaaagc

SEQ ID NO: 3739525 - RNA, 16 nt, Salmonella enterica enterica serovar Typhi Ty2
cuccuaagagaaaacc

SEQ ID NO: 3739526 - RNA, 18 nt, Salmonella enterica enterica serovar Typhi Ty2
cuccucagcgcuuaccac

SEQ ID NO: 3739527 - RNA, 14 nt, Salmonella enterica enterica serovar Typhi Ty2
cuccuccagcgcgu

SEQ ID NO: 3739528 - RNA, 22 nt, Salmonella enterica enterica serovar Typhi Ty2
cuccugaauagcuuucaccggu

SEQ ID NO: 3739529 - RNA, 20 nt, Salmonella enterica enterica serovar Typhi Ty2
cuccugcaucgauuccccac

SEQ ID NO: 3739530 - RNA, 20 nt, Salmonella enterica enterica serovar Typhi Ty2
cuccugccagauuuucuuua

SEQ ID NO: 3739531 - RNA, 18 nt, Salmonella enterica enterica serovar Typhi Ty2
cuccugccgaugccgccg

SEQ ID NO: 3739532 - RNA, 18 nt, Salmonella enterica enterica serovar Typhi Ty2
cuccugcgauagcugcug

SEQ ID NO: 3739533 - RNA, 21 nt, Salmonella enterica enterica serovar Typhi Ty2
cuccugcggccuugccgccag

SEQ ID NO: 3739534 - RNA, 22 nt, Salmonella enterica enterica serovar Typhi Ty2
cuccugcggccuugccgccagc

SEQ ID NO: 3739535 - RNA, 11 nt, Salmonella enterica enterica serovar Typhi Ty2
cuccugcuccu

SEQ ID NO: 3739536 - RNA, 17 nt, Salmonella enterica enterica serovar Typhi Ty2
cuccuggaugcgcugaa

SEQ ID NO: 3739537 - RNA, 15 nt, Salmonella enterica enterica serovar Typhi Ty2
cuccuggauuuuacc

SEQ ID NO: 3739538 - RNA, 15 nt, Salmonella enterica enterica serovar Typhi Ty2
cuccuggcauggcuc

SEQ ID NO: 3739539 - RNA, 19 nt, Salmonella enterica enterica serovar Typhi Ty2
cuccuguugaagauuagcc

SEQ ID NO: 3739540 - RNA, 23 nt, Salmonella enterica enterica serovar Typhi Ty2
cuccuugcggugagaaacgcgcc

SEQ ID NO: 3739541 - RNA, 21 nt, Salmonella enterica enterica serovar Typhi Ty2
cuccuuguaagggaggugcuc

SEQ ID NO: 3739542 - RNA, 23 nt, Salmonella enterica enterica serovar Typhi Ty2
cuccuuguaagggaggugcucuc

SEQ ID NO: 3739543 - RNA, 13 nt, Salmonella enterica enterica serovar Typhi Ty2
cucgaauccacuu

SEQ ID NO: 3739544 - RNA, 17 nt, Salmonella enterica enterica serovar Typhi Ty2
cucgaauuguuaaaagc

SEQ ID NO: 3739545 - RNA, 18 nt, Salmonella enterica enterica serovar Typhi Ty2
cucgacacacucaucuuc

SEQ ID NO: 3739546 - RNA, 19 nt, Salmonella enterica enterica serovar Typhi Ty2
cucgacauagguucugcga

SEQ ID NO: 3739547 - RNA, 19 nt, Salmonella enterica enterica serovar Typhi Ty2
cucgacaugucaugacuua

SEQ ID NO: 3739548 - RNA, 17 nt, Salmonella enterica enterica serovar Typhi Ty2
cucgaccaguuuuuccg

SEQ ID NO: 3739549 - RNA, 15 nt, Salmonella enterica enterica serovar Typhi Ty2
cucgaccuggcgcuc

SEQ ID NO: 3739550 - RNA, 15 nt, Salmonella enterica enterica serovar Typhi Ty2
cucgacgcacuccag

SEQ ID NO: 3739551 - RNA, 11 nt, Salmonella enterica enterica serovar Typhi Ty2
cucgacggugc

SEQ ID NO: 3739552 - RNA, 16 nt, Salmonella enterica enterica serovar Typhi Ty2
cucgacguccagcgcg

SEQ ID NO: 3739553 - RNA, 21 nt, Salmonella enterica enterica serovar Typhi Ty2
cucgacguuuuccaucaccau

SEQ ID NO: 3739554 - RNA, 15 nt, Salmonella enterica enterica serovar Typhi Ty2
cucgaggaacuguuc

SEQ ID NO: 3739555 - RNA, 20 nt, Salmonella enterica enterica serovar Typhi Ty2
cucgaggaacuguucagcca

SEQ ID NO: 3739556 - RNA, 21 nt, Salmonella enterica enterica serovar Typhi Ty2
cucgaggaacuguucagccag

SEQ ID NO: 3739557 - RNA, 13 nt, Salmonella enterica enterica serovar Typhi Ty2
cucgauauauuuu

SEQ ID NO: 3739558 - RNA, 13 nt, Salmonella enterica enterica serovar Typhi Ty2
cucgaucgccugg

SEQ ID NO: 3739559 - RNA, 17 nt, Salmonella enterica enterica serovar Typhi Ty2
cucgauuccugacgcac

SEQ ID NO: 3739560 - RNA, 15 nt, Salmonella enterica enterica serovar Typhi Ty2
cucgcaagauuccag

SEQ ID NO: 3739561 - RNA, 21 nt, Salmonella enterica enterica serovar Typhi Ty2
cucgcagguacgacacccgau

SEQ ID NO: 3739562 - RNA, 20 nt, Salmonella enterica enterica serovar Typhi Ty2
cucgcaugcauagccgcugc

SEQ ID NO: 3739563 - RNA, 20 nt, Salmonella enterica enterica serovar Typhi Ty2
cucgccaaagcgcugcugcu

SEQ ID NO: 3739564 - RNA, 19 nt, Salmonella enterica enterica serovar Typhi Ty2
cucgccaccggcacaucca

SEQ ID NO: 3739565 - RNA, 12 nt, Salmonella enterica enterica serovar Typhi Ty2
cucgccagucag

SEQ ID NO: 3739566 - RNA, 12 nt, Salmonella enterica enterica serovar Typhi Ty2
cucgccagugcg

SEQ ID NO: 3739567 - RNA, 23 nt, Salmonella enterica enterica serovar Typhi Ty2
cucgccauaauuguucagcuacu

SEQ ID NO: 3739568 - RNA, 14 nt, Salmonella enterica enterica serovar Typhi Ty2
cucgcccgccagau

SEQ ID NO: 3739569 - RNA, 21 nt, Salmonella enterica enterica serovar Typhi Ty2
cucugcaaagaaauugggcuu

SEQ ID NO: 3739570 - RNA, 14 nt, Salmonella enterica enterica serovar Typhi Ty2
cucugccagcgccc

SEQ ID NO: 3739571 - RNA, 18 nt, Salmonella enterica enterica serovar Typhi Ty2
cucugccaguugcucaua

SEQ ID NO: 3739572 - RNA, 18 nt, Salmonella enterica enterica serovar Typhi Ty2
cucugccgguugaccggc

SEQ ID NO: 3739573 - RNA, 19 nt, Salmonella enterica enterica serovar Typhi Ty2
cucugccgguugaccggcc

SEQ ID NO: 3739574 - RNA, 13 nt, Salmonella enterica enterica serovar Typhi Ty2
cucugccucagca

SEQ ID NO: 3739575 - RNA, 20 nt, Salmonella enterica enterica serovar Typhi Ty2
cucugccucagcaagaaguu

SEQ ID NO: 3739576 - RNA, 21 nt, Salmonella enterica enterica serovar Typhi Ty2
cucugccuguagcagcgccag

SEQ ID NO: 3739577 - RNA, 16 nt, Salmonella enterica enterica serovar Typhi Ty2
cucugcugugccagua

SEQ ID NO: 3739578 - RNA, 13 nt, Salmonella enterica enterica serovar Typhi Ty2
cucugcuuuuuca

SEQ ID NO: 3739579 - RNA, 21 nt, Salmonella enterica enterica serovar Typhi Ty2
cucuggccgcgcuuuuuuaac

SEQ ID NO: 3739580 - RNA, 22 nt, Salmonella enterica enterica serovar Typhi Ty2
cucugguugcagcgccagagau

SEQ ID NO: 3739581 - RNA, 16 nt, Salmonella enterica enterica serovar Typhi Ty2
cucugguuucccugcc

SEQ ID NO: 3739582 - RNA, 18 nt, Salmonella enterica enterica serovar Typhi Ty2
cucugucgaccaucgcau

SEQ ID NO: 3739583 - RNA, 18 nt, Salmonella enterica enterica serovar Typhi Ty2
cucuuauucaaucaauuu

SEQ ID NO: 3739584 - RNA, 19 nt, Salmonella enterica enterica serovar Typhi Ty2
cucuucaaacuccccuguc

SEQ ID NO: 3739585 - RNA, 18 nt, Salmonella enterica enterica serovar Typhi Ty2
cucuucagcguccggaaa

SEQ ID NO: 3739586 - RNA, 14 nt, Salmonella enterica enterica serovar Typhi Ty2
cucuucaguaacca

SEQ ID NO: 3739587 - RNA, 14 nt, Salmonella enterica enterica serovar Typhi Ty2
cucuucaguaagcg

SEQ ID NO: 3739588 - RNA, 17 nt, Salmonella enterica enterica serovar Typhi Ty2
cucuucaucgcgccucc

SEQ ID NO: 3739589 - RNA, 23 nt, Salmonella enterica enterica serovar Typhi Ty2
cucuucaucgcgccuccccugcc

SEQ ID NO: 3739590 - RNA, 15 nt, Salmonella enterica enterica serovar Typhi Ty2
cucuucaucuuuuuc

SEQ ID NO: 3739591 - RNA, 16 nt, Salmonella enterica enterica serovar Typhi Ty2
cucuuccccgacaaaa

SEQ ID NO: 3739592 - RNA, 20 nt, Salmonella enterica enterica serovar Typhi Ty2
cucuuccccggucaguccca

SEQ ID NO: 3739593 - RNA, 17 nt, Salmonella enterica enterica serovar Typhi Ty2
cucuucccgucgcagca

SEQ ID NO: 3739594 - RNA, 12 nt, Salmonella enterica enterica serovar Typhi Ty2
cucuuccgccag

SEQ ID NO: 3739595 - RNA, 13 nt, Salmonella enterica enterica serovar Typhi Ty2
cucuuccgccagc

SEQ ID NO: 3739596 - RNA, 20 nt, Salmonella enterica enterica serovar Typhi Ty2
cucuuccgcgguccagccgg

SEQ ID NO: 3739597 - RNA, 18 nt, Salmonella enterica enterica serovar Typhi Ty2
cucuuccgguacacgcag

SEQ ID NO: 3739598 - RNA, 15 nt, Salmonella enterica enterica serovar Typhi Ty2
cucuuccuccccagg

SEQ ID NO: 3739599 - RNA, 14 nt, Salmonella enterica enterica serovar Typhi Ty2
cucuuccugcugcg

SEQ ID NO: 3739600 - RNA, 21 nt, Salmonella enterica enterica serovar Typhi Ty2
cucuucgccauuacaggacag

SEQ ID NO: 3739601 - RNA, 12 nt, Salmonella enterica enterica serovar Typhi Ty2
cucuucggcuuc

SEQ ID NO: 3739602 - RNA, 16 nt, Salmonella enterica enterica serovar Typhi Ty2
cucuucgugacccgcc

SEQ ID NO: 3739603 - RNA, 20 nt, Salmonella enterica enterica serovar Typhi Ty2
cucuucgugacccgccagca

SEQ ID NO: 3739604 - RNA, 21 nt, Salmonella enterica enterica serovar Typhi Ty2
cucuucguucauccgucuggc

SEQ ID NO: 3739605 - RNA, 18 nt, Salmonella enterica enterica serovar Typhi Ty2
cucuucucugaaaagagu

SEQ ID NO: 3739606 - RNA, 11 nt, Salmonella enterica enterica serovar Typhi Ty2
cucuucugcug

SEQ ID NO: 3739607 - RNA, 17 nt, Salmonella enterica enterica serovar Typhi Ty2
cucuucuggcucccgca

SEQ ID NO: 3739608 - RNA, 14 nt, Salmonella enterica enterica serovar Typhi Ty2
cucuucuuugcgcg

SEQ ID NO: 3739609 - RNA, 22 nt, Salmonella enterica enterica serovar Typhi Ty2
cucuucuuuuaauugccaggcg

SEQ ID NO: 3739610 - RNA, 22 nt, Salmonella enterica enterica serovar Typhi Ty2
cucuugcauaauauccaggagc

SEQ ID NO: 3739611 - RNA, 23 nt, Salmonella enterica enterica serovar Typhi Ty2
cucuugccccacauguuggcauu

SEQ ID NO: 3739612 - RNA, 19 nt, Salmonella enterica enterica serovar Typhi Ty2
cucuugcuggguuaacgcg

SEQ ID NO: 3739613 - RNA, 15 nt, Salmonella enterica enterica serovar Typhi Ty2
cucuuggguuauuuc

SEQ ID NO: 3739614 - RNA, 20 nt, Salmonella enterica enterica serovar Typhi Ty2
cucuugugcuuccagcucca

SEQ ID NO: 3739615 - RNA, 12 nt, Salmonella enterica enterica serovar Typhi Ty2
cucuuguuucuc

SEQ ID NO: 3739616 - RNA, 20 nt, Salmonella enterica enterica serovar Typhi Ty2
cucuuuaaugauguccagaa

SEQ ID NO: 3739617 - RNA, 15 nt, Salmonella enterica enterica serovar Typhi Ty2
cucuuuaucaaacaa

SEQ ID NO: 3739618 - RNA, 20 nt, Salmonella enterica enterica serovar Typhi Ty2
cucuuucagccgacuaucuu

SEQ ID NO: 3739619 - RNA, 23 nt, Salmonella enterica enterica serovar Typhi Ty2
cucuuucagccgacuaucuucuu

SEQ ID NO: 3739620 - RNA, 17 nt, Salmonella enterica enterica serovar Typhi Ty2
cucuuucgguagccaca

SEQ ID NO: 3739621 - RNA, 13 nt, Salmonella enterica enterica serovar Typhi Ty2
cucuuucuccaca

SEQ ID NO: 3739622 - RNA, 16 nt, Salmonella enterica enterica serovar Typhi Ty2
cucuuugaacagccag

SEQ ID NO: 3739623 - RNA, 21 nt, Salmonella enterica enterica serovar Typhi Ty2
cucuuugguccauaaccaggc

SEQ ID NO: 3739624 - RNA, 14 nt, Salmonella enterica enterica serovar Typhi Ty2
cucuuuugcuucaa

SEQ ID NO: 3739625 - RNA, 11 nt, Salmonella enterica enterica serovar Typhi Ty2
cucuuuuucau

SEQ ID NO: 3739626 - RNA, 17 nt, Salmonella enterica enterica serovar Typhi Ty2
cucuuuuuccgccugau

SEQ ID NO: 3739627 - RNA, 12 nt, Salmonella enterica enterica serovar Typhi Ty2
cucuuuuucuuu

SEQ ID NO: 3739628 - RNA, 13 nt, Salmonella enterica enterica serovar Typhi Ty2
cugaaaaaauucc

SEQ ID NO: 3739629 - RNA, 12 nt, Salmonella enterica enterica serovar Typhi Ty2
cugaaaaauccc

SEQ ID NO: 3739630 - RNA, 13 nt, Salmonella enterica enterica serovar Typhi Ty2
cugaaaaaucccc

SEQ ID NO: 3739631 - RNA, 19 nt, Salmonella enterica enterica serovar Typhi Ty2
cugaaaaauccccccuccu

SEQ ID NO: 3739632 - RNA, 22 nt, Salmonella enterica enterica serovar Typhi Ty2
cugaaaacggcaucaagcccau

SEQ ID NO: 3739633 - RNA, 21 nt, Salmonella enterica enterica serovar Typhi Ty2
cugaaaauaauugauaauaac

SEQ ID NO: 3739634 - RNA, 23 nt, Salmonella enterica enterica serovar Typhi Ty2
cugaaaaucaaaucggcgccggc

SEQ ID NO: 3739635 - RNA, 13 nt, Salmonella enterica enterica serovar Typhi Ty2
cugaaaaugcccg

SEQ ID NO: 3739636 - RNA, 17 nt, Salmonella enterica enterica serovar Typhi Ty2
cugaaacagaauaaacg

SEQ ID NO: 3739637 - RNA, 18 nt, Salmonella enterica enterica serovar Typhi Ty2
cugaaacgcuucaccggc

SEQ ID NO: 3739638 - RNA, 17 nt, Salmonella enterica enterica serovar Typhi Ty2
cugaaacggaucaaaaa

SEQ ID NO: 3739639 - RNA, 12 nt, Salmonella enterica enterica serovar Typhi Ty2
cugaaacgggaa

SEQ ID NO: 3739640 - RNA, 20 nt, Salmonella enterica enterica serovar Typhi Ty2
cugaaagauuauuuuaucau

SEQ ID NO: 3739641 - RNA, 12 nt, Salmonella enterica enterica serovar Typhi Ty2
cugaaagcgccu

SEQ ID NO: 3739642 - RNA, 15 nt, Salmonella enterica enterica serovar Typhi Ty2
cugaaauuucuuuuc

SEQ ID NO: 3739643 - RNA, 13 nt, Salmonella enterica enterica serovar Typhi Ty2
cugaaccaacagc

SEQ ID NO: 3739644 - RNA, 18 nt, Salmonella enterica enterica serovar Typhi Ty2
cugaacgcccggcgcgac

SEQ ID NO: 3739645 - RNA, 11 nt, Salmonella enterica enterica serovar Typhi Ty2
cugaacgcugc

SEQ ID NO: 3739646 - RNA, 13 nt, Salmonella enterica enterica serovar Typhi Ty2
cugaacuguaacc

SEQ ID NO: 3739647 - RNA, 17 nt, Salmonella enterica enterica serovar Typhi Ty2
cugaagaaaaggaaugc

SEQ ID NO: 3739648 - RNA, 14 nt, Salmonella enterica enterica serovar Typhi Ty2
cugaagauaaaauu

SEQ ID NO: 3739649 - RNA, 13 nt, Salmonella enterica enterica serovar Typhi Ty2
cugaagccccaac

SEQ ID NO: 3739650 - RNA, 16 nt, Salmonella enterica enterica serovar Typhi Ty2
cugaagcccuuuagug

SEQ ID NO: 3739651 - RNA, 13 nt, Salmonella enterica enterica serovar Typhi Ty2
cugaagccugcuu

SEQ ID NO: 3739652 - RNA, 16 nt, Salmonella enterica enterica serovar Typhi Ty2
cugagcacgcccgguc

SEQ ID NO: 3739653 - RNA, 23 nt, Salmonella enterica enterica serovar Typhi Ty2
cugagccgcccggcgcgcuggag

SEQ ID NO: 3739654 - RNA, 22 nt, Salmonella enterica enterica serovar Typhi Ty2
cugagcgaauccccgggaacau

SEQ ID NO: 3739655 - RNA, 16 nt, Salmonella enterica enterica serovar Typhi Ty2
cugagcgcgccaugag

SEQ ID NO: 3739656 - RNA, 16 nt, Salmonella enterica enterica serovar Typhi Ty2
cugagcggcucaucca

SEQ ID NO: 3739657 - RNA, 17 nt, Salmonella enterica enterica serovar Typhi Ty2
cugagcuaaucacccac

SEQ ID NO: 3739658 - RNA, 18 nt, Salmonella enterica enterica serovar Typhi Ty2
cugagcuaaucacccacu

SEQ ID NO: 3739659 - RNA, 20 nt, Salmonella enterica enterica serovar Typhi Ty2
cugaggaguauuauccauug

SEQ ID NO: 3739660 - RNA, 14 nt, Salmonella enterica enterica serovar Typhi Ty2
cugaggcgcuggcu

SEQ ID NO: 3739661 - RNA, 17 nt, Salmonella enterica enterica serovar Typhi Ty2
cugaggcguugcuccag

SEQ ID NO: 3739662 - RNA, 22 nt, Salmonella enterica enterica serovar Typhi Ty2
cugaguauaaaacucgccgcga

SEQ ID NO: 3739663 - RNA, 13 nt, Salmonella enterica enterica serovar Typhi Ty2
cugaguauagagc

SEQ ID NO: 3739664 - RNA, 12 nt, Salmonella enterica enterica serovar Typhi Ty2
cugaguauguua

SEQ ID NO: 3739665 - RNA, 12 nt, Salmonella enterica enterica serovar Typhi Ty2
cugagucauccu

SEQ ID NO: 3739666 - RNA, 13 nt, Salmonella enterica enterica serovar Typhi Ty2
cugagucuugccu

SEQ ID NO: 3739667 - RNA, 22 nt, Salmonella enterica enterica serovar Typhi Ty2
cugaguuacgaucguuugccca

SEQ ID NO: 3739668 - RNA, 19 nt, Salmonella enterica enterica serovar Typhi Ty2
cugaguuucucccgccaga

SEQ ID NO: 3739669 - RNA, 23 nt, Salmonella enterica enterica serovar Typhi Ty2
cugaguuucucccgccagaugca

SEQ ID NO: 3739670 - RNA, 18 nt, Salmonella enterica enterica serovar Typhi Ty2
cugauaaaacgcaggcag

SEQ ID NO: 3739671 - RNA, 19 nt, Salmonella enterica enterica serovar Typhi Ty2
cugauaaaagagagcgcca

SEQ ID NO: 3739672 - RNA, 13 nt, Salmonella enterica enterica serovar Typhi Ty2
cugauaaaagccc

SEQ ID NO: 3739673 - RNA, 11 nt, Salmonella enterica enterica serovar Typhi Ty2
cugauaaaauu

SEQ ID NO: 3739674 - RNA, 18 nt, Salmonella enterica enterica serovar Typhi Ty2
cugauaaccuauuuugca

SEQ ID NO: 3739675 - RNA, 19 nt, Salmonella enterica enterica serovar Typhi Ty2
cugauaagcgcagcgccau

SEQ ID NO: 3739676 - RNA, 16 nt, Salmonella enterica enterica serovar Typhi Ty2
cugauaagguaaagcc

SEQ ID NO: 3739677 - RNA, 12 nt, Salmonella enterica enterica serovar Typhi Ty2
cugauaauaaga

SEQ ID NO: 3739678 - RNA, 16 nt, Salmonella enterica enterica serovar Typhi Ty2
cugauaaucgagacug

SEQ ID NO: 3739679 - RNA, 14 nt, Salmonella enterica enterica serovar Typhi Ty2
cugauacagccaaa

SEQ ID NO: 3739680 - RNA, 17 nt, Salmonella enterica enterica serovar Typhi Ty2
cugauaccccagcgauc

SEQ ID NO: 3739681 - RNA, 20 nt, Salmonella enterica enterica serovar Typhi Ty2
cugauaccgcguuugcgcaa

SEQ ID NO: 3739682 - RNA, 20 nt, Salmonella enterica enterica serovar Typhi Ty2
cugauacgcaccagcucuac

SEQ ID NO: 3739683 - RNA, 21 nt, Salmonella enterica enterica serovar Typhi Ty2
cugauacggaaauagcgccau

SEQ ID NO: 3739684 - RNA, 14 nt, Salmonella enterica enterica serovar Typhi Ty2
cugauacugcuccg

SEQ ID NO: 3739685 - RNA, 16 nt, Salmonella enterica enterica serovar Typhi Ty2
cugauacugcuccggc

SEQ ID NO: 3739686 - RNA, 17 nt, Salmonella enterica enterica serovar Typhi Ty2
cugauagacaauugcug

SEQ ID NO: 3739687 - RNA, 15 nt, Salmonella enterica enterica serovar Typhi Ty2
cugauagcacagcgc

SEQ ID NO: 3739688 - RNA, 16 nt, Salmonella enterica enterica serovar Typhi Ty2
cugauagcacagcgcu

SEQ ID NO: 3739689 - RNA, 12 nt, Salmonella enterica enterica serovar Typhi Ty2
cugauagcccau

SEQ ID NO: 3739690 - RNA, 16 nt, Salmonella enterica enterica serovar Typhi Ty2
cugauagccgccagug

SEQ ID NO: 3739691 - RNA, 19 nt, Salmonella enterica enterica serovar Typhi Ty2
cugauagggacacauuucu

SEQ ID NO: 3739692 - RNA, 14 nt, Salmonella enterica enterica serovar Typhi Ty2
cugauauaacgugc

SEQ ID NO: 3739693 - RNA, 18 nt, Salmonella enterica enterica serovar Typhi Ty2
cugauauaucuucaucgu

SEQ ID NO: 3739694 - RNA, 21 nt, Salmonella enterica enterica serovar Typhi Ty2
cugauauucccguuccagcuu

SEQ ID NO: 3739695 - RNA, 16 nt, Salmonella enterica enterica serovar Typhi Ty2
cugauauuuuuacuga

SEQ ID NO: 3739696 - RNA, 17 nt, Salmonella enterica enterica serovar Typhi Ty2
cugauauuuuuacugau

SEQ ID NO: 3739697 - RNA, 13 nt, Salmonella enterica enterica serovar Typhi Ty2
cugaucaauugcg

SEQ ID NO: 3739698 - RNA, 18 nt, Salmonella enterica enterica serovar Typhi Ty2
cugaucaucggcgcgucg

SEQ ID NO: 3739699 - RNA, 17 nt, Salmonella enterica enterica serovar Typhi Ty2
cugauccuguuaaucau

SEQ ID NO: 3739700 - RNA, 16 nt, Salmonella enterica enterica serovar Typhi Ty2
cugaucgaucagcuga

SEQ ID NO: 3739701 - RNA, 19 nt, Salmonella enterica enterica serovar Typhi Ty2
cugaucgccaacgaccggc

SEQ ID NO: 3739702 - RNA, 22 nt, Salmonella enterica enterica serovar Typhi Ty2
cugaucgccacgccuaaacuga

SEQ ID NO: 3739703 - RNA, 22 nt, Salmonella enterica enterica serovar Typhi Ty2
cugaucgcgcagacaguggcca

SEQ ID NO: 3739704 - RNA, 15 nt, Salmonella enterica enterica serovar Typhi Ty2
cugaucggccagcgu

SEQ ID NO: 3739705 - RNA, 22 nt, Salmonella enterica enterica serovar Typhi Ty2
cugaugaccgccgucauagcag

SEQ ID NO: 3739706 - RNA, 19 nt, Salmonella enterica enterica serovar Typhi Ty2
cugaugagauaagcgcuua

SEQ ID NO: 3739707 - RNA, 21 nt, Salmonella enterica enterica serovar Typhi Ty2
cugaugauggaacagacgccu

SEQ ID NO: 3739708 - RNA, 15 nt, Salmonella enterica enterica serovar Typhi Ty2
cugaugcagcuugca

SEQ ID NO: 3739709 - RNA, 21 nt, Salmonella enterica enterica serovar Typhi Ty2
cugaugcagcuugcaggcaaa

SEQ ID NO: 3739710 - RNA, 22 nt, Salmonella enterica enterica serovar Typhi Ty2
cugaugccauaaaaugcugggc

SEQ ID NO: 3739711 - RNA, 22 nt, Salmonella enterica enterica serovar Typhi Ty2
cugaugcccagguuagcagcca

SEQ ID NO: 3739712 - RNA, 13 nt, Salmonella enterica enterica serovar Typhi Ty2
cugaugccgucga

SEQ ID NO: 3739713 - RNA, 14 nt, Salmonella enterica enterica serovar Typhi Ty2
cugaugccugaagg

SEQ ID NO: 3739714 - RNA, 24 nt, Salmonella enterica enterica serovar Typhi Ty2
cugaugcgcguuuagcgccagcag

SEQ ID NO: 3739715 - RNA, 13 nt, Salmonella enterica enterica serovar Typhi Ty2
cugaugcugcgca

SEQ ID NO: 3739716 - RNA, 16 nt, Salmonella enterica enterica serovar Typhi Ty2
cugaugcuggcgccau

SEQ ID NO: 3739717 - RNA, 13 nt, Salmonella enterica enterica serovar Typhi Ty2
cugaugcugugca

SEQ ID NO: 3739718 - RNA, 21 nt, Salmonella enterica enterica serovar Typhi Ty2
cugauggcgaaaaugguuuug

SEQ ID NO: 3739719 - RNA, 18 nt, Salmonella enterica enterica serovar Typhi Ty2
cugauggcgcuacguuua

SEQ ID NO: 3739720 - RNA, 13 nt, Salmonella enterica enterica serovar Typhi Ty2
cugauggcgcugc

SEQ ID NO: 3739721 - RNA, 17 nt, Salmonella enterica enterica serovar Typhi Ty2
cugauggcguggcgcag

SEQ ID NO: 3739722 - RNA, 14 nt, Salmonella enterica enterica serovar Typhi Ty2
cugauggcguucca

SEQ ID NO: 3739723 - RNA, 20 nt, Salmonella enterica enterica serovar Typhi Ty2
cugauggucgcucuggucga

SEQ ID NO: 3739724 - RNA, 19 nt, Salmonella enterica enterica serovar Typhi Ty2
cugauguaccugcguuaaa

SEQ ID NO: 3739725 - RNA, 16 nt, Salmonella enterica enterica serovar Typhi Ty2
cugauguagcucuuca

SEQ ID NO: 3739726 - RNA, 21 nt, Salmonella enterica enterica serovar Typhi Ty2
cugauuaaugauuugcuuuau

SEQ ID NO: 3739727 - RNA, 22 nt, Salmonella enterica enterica serovar Typhi Ty2
cugauuacguugauuaucaccc

SEQ ID NO: 3739728 - RNA, 15 nt, Salmonella enterica enterica serovar Typhi Ty2
cugauuauucaguac

SEQ ID NO: 3739729 - RNA, 20 nt, Salmonella enterica enterica serovar Typhi Ty2
cugauucaggugacaguccg

SEQ ID NO: 3739730 - RNA, 15 nt, Salmonella enterica enterica serovar Typhi Ty2
cugauucguuuuuac

SEQ ID NO: 3739731 - RNA, 17 nt, Salmonella enterica enterica serovar Typhi Ty2
cugauugccggaugucg

SEQ ID NO: 3739732 - RNA, 19 nt, Salmonella enterica enterica serovar Typhi Ty2
cugauuucgacgauaaaaa

SEQ ID NO: 3739733 - RNA, 20 nt, Salmonella enterica enterica serovar Typhi Ty2
cugauuucgacgauaaaaaa

SEQ ID NO: 3739734 - RNA, 13 nt, Salmonella enterica enterica serovar Typhi Ty2
cugcccaccuucg

SEQ ID NO: 3739735 - RNA, 22 nt, Salmonella enterica enterica serovar Typhi Ty2
cugcccaucuaaccgggccuga

SEQ ID NO: 3739736 - RNA, 15 nt, Salmonella enterica enterica serovar Typhi Ty2
cugccccagacgccc

SEQ ID NO: 3739737 - RNA, 18 nt, Salmonella enterica enterica serovar Typhi Ty2
cugccccagacgcccuuc

SEQ ID NO: 3739738 - RNA, 20 nt, Salmonella enterica enterica serovar Typhi Ty2
cugccccgccacagccgcau

SEQ ID NO: 3739739 - RNA, 18 nt, Salmonella enterica enterica serovar Typhi Ty2
cugccccggugagcgccg

SEQ ID NO: 3739740 - RNA, 17 nt, Salmonella enterica enterica serovar Typhi Ty2
cugcccgccgccaccau

SEQ ID NO: 3739741 - RNA, 13 nt, Salmonella enterica enterica serovar Typhi Ty2
cugcccgccgccg

SEQ ID NO: 3739742 - RNA, 12 nt, Salmonella enterica enterica serovar Typhi Ty2
cugcccugcggu

SEQ ID NO: 3739743 - RNA, 13 nt, Salmonella enterica enterica serovar Typhi Ty2
cugcccugcggua

SEQ ID NO: 3739744 - RNA, 17 nt, Salmonella enterica enterica serovar Typhi Ty2
cugcccuggugagcucc

SEQ ID NO: 3739745 - RNA, 21 nt, Salmonella enterica enterica serovar Typhi Ty2
cugcccuggugagcuccagcc

SEQ ID NO: 3739746 - RNA, 23 nt, Salmonella enterica enterica serovar Typhi Ty2
cugcccuguucggcgcggaaggu

SEQ ID NO: 3739747 - RNA, 18 nt, Salmonella enterica enterica serovar Typhi Ty2
cugcccuuucagagcguc

SEQ ID NO: 3739748 - RNA, 18 nt, Salmonella enterica enterica serovar Typhi Ty2
cugcccuuucuucaaugg

SEQ ID NO: 3739749 - RNA, 19 nt, Salmonella enterica enterica serovar Typhi Ty2
cugccgacaaagagcuccc

SEQ ID NO: 3739750 - RNA, 12 nt, Salmonella enterica enterica serovar Typhi Ty2
cugccgacaacg

SEQ ID NO: 3739751 - RNA, 14 nt, Salmonella enterica enterica serovar Typhi Ty2
cugccgacaggcag

SEQ ID NO: 3739752 - RNA, 13 nt, Salmonella enterica enterica serovar Typhi Ty2
cugccgaucagau

SEQ ID NO: 3739753 - RNA, 23 nt, Salmonella enterica enterica serovar Typhi Ty2
cugccgaugaaagagcgcgcgcg

SEQ ID NO: 3739754 - RNA, 17 nt, Salmonella enterica enterica serovar Typhi Ty2
cugccgcaaacgccugc

SEQ ID NO: 3739755 - RNA, 19 nt, Salmonella enterica enterica serovar Typhi Ty2
cugccgcaaacgccugcuc

SEQ ID NO: 3739756 - RNA, 15 nt, Salmonella enterica enterica serovar Typhi Ty2
cugccgcagccgcuc

SEQ ID NO: 3739757 - RNA, 18 nt, Salmonella enterica enterica serovar Typhi Ty2
cugccgccagcaguugca

SEQ ID NO: 3739758 - RNA, 22 nt, Salmonella enterica enterica serovar Typhi Ty2
cugccgccauaacgccggcgcu

SEQ ID NO: 3739759 - RNA, 20 nt, Salmonella enterica enterica serovar Typhi Ty2
cugccgccauuugcgcggcu

SEQ ID NO: 3739760 - RNA, 17 nt, Salmonella enterica enterica serovar Typhi Ty2
cugccgcccaucgccac

SEQ ID NO: 3739761 - RNA, 14 nt, Salmonella enterica enterica serovar Typhi Ty2
cugccgccgcacca

SEQ ID NO: 3739762 - RNA, 21 nt, Salmonella enterica enterica serovar Typhi Ty2
cugccgccgucaucugcgccg

SEQ ID NO: 3739763 - RNA, 17 nt, Salmonella enterica enterica serovar Typhi Ty2
cugccgcgaucgcggca

SEQ ID NO: 3739764 - RNA, 16 nt, Salmonella enterica enterica serovar Typhi Ty2
cugccggcuuaacgcu

SEQ ID NO: 3739765 - RNA, 18 nt, Salmonella enterica enterica serovar Typhi Ty2
cugccgggguaucauaaa

SEQ ID NO: 3739766 - RNA, 14 nt, Salmonella enterica enterica serovar Typhi Ty2
cugccggugguggu

SEQ ID NO: 3739767 - RNA, 21 nt, Salmonella enterica enterica serovar Typhi Ty2
cugccguaaacaggcaggccc

SEQ ID NO: 3739768 - RNA, 18 nt, Salmonella enterica enterica serovar Typhi Ty2
cugccguaaggcgauuca

SEQ ID NO: 3739769 - RNA, 15 nt, Salmonella enterica enterica serovar Typhi Ty2
cugccgucaauuuua

SEQ ID NO: 3739770 - RNA, 13 nt, Salmonella enterica enterica serovar Typhi Ty2
cugccgucaucga

SEQ ID NO: 3739771 - RNA, 16 nt, Salmonella enterica enterica serovar Typhi Ty2
cugccgucaucgacuu

SEQ ID NO: 3739772 - RNA, 21 nt, Salmonella enterica enterica serovar Typhi Ty2
cugccgucaucgacuucaagg

SEQ ID NO: 3739773 - RNA, 22 nt, Salmonella enterica enterica serovar Typhi Ty2
cugccgucaucgacuucgaagg

SEQ ID NO: 3739774 - RNA, 14 nt, Salmonella enterica enterica serovar Typhi Ty2
cugccgucccagcg

SEQ ID NO: 3739775 - RNA, 12 nt, Salmonella enterica enterica serovar Typhi Ty2
cugccguccuga

SEQ ID NO: 3739776 - RNA, 14 nt, Salmonella enterica enterica serovar Typhi Ty2
cugccgucgcggcu

SEQ ID NO: 3739777 - RNA, 22 nt, Salmonella enterica enterica serovar Typhi Ty2
cugccguuuuuaacgccggcaa

SEQ ID NO: 3739778 - RNA, 16 nt, Salmonella enterica enterica serovar Typhi Ty2
cugccuaaauugacgc

SEQ ID NO: 3739779 - RNA, 13 nt, Salmonella enterica enterica serovar Typhi Ty2
cugccuacugccc

SEQ ID NO: 3739780 - RNA, 12 nt, Salmonella enterica enterica serovar Typhi Ty2
cugccugcagac

SEQ ID NO: 3739781 - RNA, 12 nt, Salmonella enterica enterica serovar Typhi Ty2
cugccugcuuca

SEQ ID NO: 3739782 - RNA, 13 nt, Salmonella enterica enterica serovar Typhi Ty2
cugccugcuucag

SEQ ID NO: 3739783 - RNA, 18 nt, Salmonella enterica enterica serovar Typhi Ty2
cugccuguagcagcgcca

SEQ ID NO: 3739784 - RNA, 16 nt, Salmonella enterica enterica serovar Typhi Ty2
cugccuguuuacggca

SEQ ID NO: 3739785 - RNA, 22 nt, Salmonella enterica enterica serovar Typhi Ty2
cugccuguuuacggcaggcccg

SEQ ID NO: 3739786 - RNA, 21 nt, Salmonella enterica enterica serovar Typhi Ty2
cugccuuaauccccggcccgc

SEQ ID NO: 3739787 - RNA, 22 nt, Salmonella enterica enterica serovar Typhi Ty2
cugccuuuaacaaauuaaaucc

SEQ ID NO: 3739788 - RNA, 19 nt, Salmonella enterica enterica serovar Typhi Ty2
cugccuuuacugaaucuca

SEQ ID NO: 3739789 - RNA, 19 nt, Salmonella enterica enterica serovar Typhi Ty2
cugccuuuguacagcuugc

SEQ ID NO: 3739790 - RNA, 18 nt, Salmonella enterica enterica serovar Typhi Ty2
cugccuuuuuuauugccu

SEQ ID NO: 3739791 - RNA, 15 nt, Salmonella enterica enterica serovar Typhi Ty2
cugcgaaaagcgugc

SEQ ID NO: 3739792 - RNA, 17 nt, Salmonella enterica enterica serovar Typhi Ty2
cugcgaacagcgcucca

SEQ ID NO: 3739793 - RNA, 23 nt, Salmonella enterica enterica serovar Typhi Ty2
cugcgaccgagugucgcccgcuc

SEQ ID NO: 3739794 - RNA, 23 nt, Salmonella enterica enterica serovar Typhi Ty2
cugcgaggucaccgggcgaaagc

SEQ ID NO: 3739795 - RNA, 21 nt, Salmonella enterica enterica serovar Typhi Ty2
cugcgcaacauucugcuucca

SEQ ID NO: 3739796 - RNA, 14 nt, Salmonella enterica enterica serovar Typhi Ty2
cugcgcaaucauga

SEQ ID NO: 3739797 - RNA, 13 nt, Salmonella enterica enterica serovar Typhi Ty2
cugcgcaccugca

SEQ ID NO: 3739798 - RNA, 23 nt, Salmonella enterica enterica serovar Typhi Ty2
cugcgcaggucgccagaagccgu

SEQ ID NO: 3739799 - RNA, 18 nt, Salmonella enterica enterica serovar Typhi Ty2
cugcgcauccgcggcgcu

SEQ ID NO: 3739800 - RNA, 15 nt, Salmonella enterica enterica serovar Typhi Ty2
cugcgcauccucuuu

SEQ ID NO: 3739801 - RNA, 16 nt, Salmonella enterica enterica serovar Typhi Ty2
cugcgcauccucuuuc

SEQ ID NO: 3739802 - RNA, 18 nt, Salmonella enterica enterica serovar Typhi Ty2
cugcgcauuaacgccaug

SEQ ID NO: 3739803 - RNA, 13 nt, Salmonella enterica enterica serovar Typhi Ty2
cugcgccacauca

SEQ ID NO: 3739804 - RNA, 14 nt, Salmonella enterica enterica serovar Typhi Ty2
cugcgccagaucag

SEQ ID NO: 3739805 - RNA, 16 nt, Salmonella enterica enterica serovar Typhi Ty2
cugcgccagcauggcg

SEQ ID NO: 3739806 - RNA, 15 nt, Salmonella enterica enterica serovar Typhi Ty2
cugcgccagccugcu

SEQ ID NO: 3739807 - RNA, 14 nt, Salmonella enterica enterica serovar Typhi Ty2
cugcgccagcgccg

SEQ ID NO: 3739808 - RNA, 15 nt, Salmonella enterica enterica serovar Typhi Ty2
cugcgccagcggcac

SEQ ID NO: 3739809 - RNA, 17 nt, Salmonella enterica enterica serovar Typhi Ty2
cugcgccagcggcacug

SEQ ID NO: 3739810 - RNA, 18 nt, Salmonella enterica enterica serovar Typhi Ty2
cugcgccauugcgggagc

SEQ ID NO: 3739811 - RNA, 16 nt, Salmonella enterica enterica serovar Typhi Ty2
cugcgcccgcaagcug

SEQ ID NO: 3739812 - RNA, 14 nt, Salmonella enterica enterica serovar Typhi Ty2
cugcgcccgccugc

SEQ ID NO: 3739813 - RNA, 13 nt, Salmonella enterica enterica serovar Typhi Ty2
cugcgccgcaucu

SEQ ID NO: 3739814 - RNA, 15 nt, Salmonella enterica enterica serovar Typhi Ty2
cugcgccggcugcgc

SEQ ID NO: 3739815 - RNA, 15 nt, Salmonella enterica enterica serovar Typhi Ty2
cugcgccugcauauc

SEQ ID NO: 3739816 - RNA, 16 nt, Salmonella enterica enterica serovar Typhi Ty2
cugcugcgccuuuacc

SEQ ID NO: 3739817 - RNA, 18 nt, Salmonella enterica enterica serovar Typhi Ty2
cugcugcggcguucccca

SEQ ID NO: 3739818 - RNA, 21 nt, Salmonella enterica enterica serovar Typhi Ty2
cugcugcucccucacgcguca

SEQ ID NO: 3739819 - RNA, 23 nt, Salmonella enterica enterica serovar Typhi Ty2
cugcugcuugcuuuucaucacca

SEQ ID NO: 3739820 - RNA, 18 nt, Salmonella enterica enterica serovar Typhi Ty2
cugcuggaaaucuuucuc

SEQ ID NO: 3739821 - RNA, 15 nt, Salmonella enterica enterica serovar Typhi Ty2
cugcuggagccggaa

SEQ ID NO: 3739822 - RNA, 16 nt, Salmonella enterica enterica serovar Typhi Ty2
cugcuggcaaaacgca

SEQ ID NO: 3739823 - RNA, 16 nt, Salmonella enterica enterica serovar Typhi Ty2
cugcuggcgagcagga

SEQ ID NO: 3739824 - RNA, 14 nt, Salmonella enterica enterica serovar Typhi Ty2
cugcuggcgcguca

SEQ ID NO: 3739825 - RNA, 23 nt, Salmonella enterica enterica serovar Typhi Ty2
cugcuggcggaauccaucccccu

SEQ ID NO: 3739826 - RNA, 20 nt, Salmonella enterica enterica serovar Typhi Ty2
cugcugguaccuuuguggca

SEQ ID NO: 3739827 - RNA, 15 nt, Salmonella enterica enterica serovar Typhi Ty2
cugcugguagagcau

SEQ ID NO: 3739828 - RNA, 16 nt, Salmonella enterica enterica serovar Typhi Ty2
cugcuguaacagacgc

SEQ ID NO: 3739829 - RNA, 22 nt, Salmonella enterica enterica serovar Typhi Ty2
cugcuguaacagacgcaggccg

SEQ ID NO: 3739830 - RNA, 16 nt, Salmonella enterica enterica serovar Typhi Ty2
cugcuguaccucuugc

SEQ ID NO: 3739831 - RNA, 20 nt, Salmonella enterica enterica serovar Typhi Ty2
cugcuguagcgucucaucaa

SEQ ID NO: 3739832 - RNA, 15 nt, Salmonella enterica enterica serovar Typhi Ty2
cugcuguagcugucc

SEQ ID NO: 3739833 - RNA, 16 nt, Salmonella enterica enterica serovar Typhi Ty2
cugcuguccgccagca

SEQ ID NO: 3739834 - RNA, 18 nt, Salmonella enterica enterica serovar Typhi Ty2
cugcugugacaucgcccc

SEQ ID NO: 3739835 - RNA, 17 nt, Salmonella enterica enterica serovar Typhi Ty2
cugcuguguccagguca

SEQ ID NO: 3739836 - RNA, 21 nt, Salmonella enterica enterica serovar Typhi Ty2
cugcuuaucgauaucugccug

SEQ ID NO: 3739837 - RNA, 22 nt, Salmonella enterica enterica serovar Typhi Ty2
cugcuuaucgauaucugccugc

SEQ ID NO: 3739838 - RNA, 20 nt, Salmonella enterica enterica serovar Typhi Ty2
cugcuuaugaucgcccagcc

SEQ ID NO: 3739839 - RNA, 22 nt, Salmonella enterica enterica serovar Typhi Ty2
cugcuuaugaucgcccagccac

SEQ ID NO: 3739840 - RNA, 14 nt, Salmonella enterica enterica serovar Typhi Ty2
cugcuucaccgcgc

SEQ ID NO: 3739841 - RNA, 12 nt, Salmonella enterica enterica serovar Typhi Ty2
cugcuucagcca

SEQ ID NO: 3739842 - RNA, 16 nt, Salmonella enterica enterica serovar Typhi Ty2
cugcuucagccacugg

SEQ ID NO: 3739843 - RNA, 13 nt, Salmonella enterica enterica serovar Typhi Ty2
cugcuuccagaau

SEQ ID NO: 3739844 - RNA, 14 nt, Salmonella enterica enterica serovar Typhi Ty2
cugcuuccugccgc

SEQ ID NO: 3739845 - RNA, 18 nt, Salmonella enterica enterica serovar Typhi Ty2
cugcuucuggcuugcgcu

SEQ ID NO: 3739846 - RNA, 16 nt, Salmonella enterica enterica serovar Typhi Ty2
cugcuugccugugccc

SEQ ID NO: 3739847 - RNA, 20 nt, Salmonella enterica enterica serovar Typhi Ty2
cugcuuguuuaauggcagaa

SEQ ID NO: 3739848 - RNA, 19 nt, Salmonella enterica enterica serovar Typhi Ty2
cugcuuucuuacaccucgc

SEQ ID NO: 3739849 - RNA, 17 nt, Salmonella enterica enterica serovar Typhi Ty2
cugcuuugucgcgguua

SEQ ID NO: 3739850 - RNA, 14 nt, Salmonella enterica enterica serovar Typhi Ty2
cugcuuuuccggca

SEQ ID NO: 3739851 - RNA, 15 nt, Salmonella enterica enterica serovar Typhi Ty2
cugcuuuuugauaca

SEQ ID NO: 3739852 - RNA, 23 nt, Salmonella enterica enterica serovar Typhi Ty2
cugcuuuuugauacagcagcacc

SEQ ID NO: 3739853 - RNA, 17 nt, Salmonella enterica enterica serovar Typhi Ty2
cuggaaaauuucaguga

SEQ ID NO: 3739854 - RNA, 16 nt, Salmonella enterica enterica serovar Typhi Ty2
cuggaacaaaccgacu

SEQ ID NO: 3739855 - RNA, 20 nt, Salmonella enterica enterica serovar Typhi Ty2
cuggaacaaaccgacuuuca

SEQ ID NO: 3739856 - RNA, 22 nt, Salmonella enterica enterica serovar Typhi Ty2
cuggaagaaaucguugccuuug

SEQ ID NO: 3739857 - RNA, 23 nt, Salmonella enterica enterica serovar Typhi Ty2
cuggaagagaacguucguugucc

SEQ ID NO: 3739858 - RNA, 22 nt, Salmonella enterica enterica serovar Typhi Ty2
cuggaagcgcccaggccgggcg

SEQ ID NO: 3739859 - RNA, 18 nt, Salmonella enterica enterica serovar Typhi Ty2
cuggaaguuuugcuggaa

SEQ ID NO: 3739860 - RNA, 19 nt, Salmonella enterica enterica serovar Typhi Ty2
cuggaaucauccaccagaa

SEQ ID NO: 3739861 - RNA, 23 nt, Salmonella enterica enterica serovar Typhi Ty2
cuggacaaagcguuugccgugga

SEQ ID NO: 3739862 - RNA, 20 nt, Salmonella enterica enterica serovar Typhi Ty2
cuggacauauuccagaagcg

SEQ ID NO: 3739863 - RNA, 22 nt, Salmonella enterica enterica serovar Typhi Ty2
cuggacauguuccgccccgccu

SEQ ID NO: 3739864 - RNA, 17 nt, Salmonella enterica enterica serovar Typhi Ty2
cuggagagcaacgccau

SEQ ID NO: 3739865 - RNA, 20 nt, Salmonella enterica enterica serovar Typhi Ty2
cuggagagcagcgccagcga

SEQ ID NO: 3739866 - RNA, 14 nt, Salmonella enterica enterica serovar Typhi Ty2
cuggagcugaucga

SEQ ID NO: 3739867 - RNA, 16 nt, Salmonella enterica enterica serovar Typhi Ty2
cuggagggguuucccc

SEQ ID NO: 3739868 - RNA, 20 nt, Salmonella enterica enterica serovar Typhi Ty2
cuggagguuauccugaaagg

SEQ ID NO: 3739869 - RNA, 20 nt, Salmonella enterica enterica serovar Typhi Ty2
cuggagugacuaaaagacgc

SEQ ID NO: 3739870 - RNA, 21 nt, Salmonella enterica enterica serovar Typhi Ty2
cuggaguuuaaacacucucca

SEQ ID NO: 3739871 - RNA, 14 nt, Salmonella enterica enterica serovar Typhi Ty2
cuggauaaaagguc

SEQ ID NO: 3739872 - RNA, 16 nt, Salmonella enterica enterica serovar Typhi Ty2
cuggauagucuucaag

SEQ ID NO: 3739873 - RNA, 21 nt, Salmonella enterica enterica serovar Typhi Ty2
cuggaucacuuuugccgucag

SEQ ID NO: 3739874 - RNA, 22 nt, Salmonella enterica enterica serovar Typhi Ty2
cuggaucgugcggcgaagcauc

SEQ ID NO: 3739875 - RNA, 16 nt, Salmonella enterica enterica serovar Typhi Ty2
cuggaucugcgcauua

SEQ ID NO: 3739876 - RNA, 12 nt, Salmonella enterica enterica serovar Typhi Ty2
cuggaugauaaa

SEQ ID NO: 3739877 - RNA, 12 nt, Salmonella enterica enterica serovar Typhi Ty2
cuggauggcaga

SEQ ID NO: 3739878 - RNA, 18 nt, Salmonella enterica enterica serovar Typhi Ty2
cuggauuacaaaaauaga

SEQ ID NO: 3739879 - RNA, 14 nt, Salmonella enterica enterica serovar Typhi Ty2
cuggauuaucaaua

SEQ ID NO: 3739880 - RNA, 17 nt, Salmonella enterica enterica serovar Typhi Ty2
cuggcaaaacgcaucca

SEQ ID NO: 3739881 - RNA, 18 nt, Salmonella enterica enterica serovar Typhi Ty2
cuggcaacaugaccagcg

SEQ ID NO: 3739882 - RNA, 14 nt, Salmonella enterica enterica serovar Typhi Ty2
cuggcaagcgccag

SEQ ID NO: 3739883 - RNA, 21 nt, Salmonella enterica enterica serovar Typhi Ty2
cuggcaagcgccagcauggcg

SEQ ID NO: 3739884 - RNA, 19 nt, Salmonella enterica enterica serovar Typhi Ty2
cuggcaauaaagcagggcg

SEQ ID NO: 3739885 - RNA, 14 nt, Salmonella enterica enterica serovar Typhi Ty2
cuggcaaucaugcg

SEQ ID NO: 3739886 - RNA, 16 nt, Salmonella enterica enterica serovar Typhi Ty2
cuggcacagggcaaua

SEQ ID NO: 3739887 - RNA, 14 nt, Salmonella enterica enterica serovar Typhi Ty2
cuggcacuggcagc

SEQ ID NO: 3739888 - RNA, 15 nt, Salmonella enterica enterica serovar Typhi Ty2
cuggcagaaggcaug

SEQ ID NO: 3739889 - RNA, 16 nt, Salmonella enterica enterica serovar Typhi Ty2
cuggcagaugaacaua

SEQ ID NO: 3739890 - RNA, 23 nt, Salmonella enterica enterica serovar Typhi Ty2
cuggcagcagugacauuuaucuu

SEQ ID NO: 3739891 - RNA, 18 nt, Salmonella enterica enterica serovar Typhi Ty2
cuggcagcgccugacggc

SEQ ID NO: 3739892 - RNA, 16 nt, Salmonella enterica enterica serovar Typhi Ty2
cuggcagcggcaguaa

SEQ ID NO: 3739893 - RNA, 21 nt, Salmonella enterica enterica serovar Typhi Ty2
cuggcagguauuaauccugcg

SEQ ID NO: 3739894 - RNA, 20 nt, Salmonella enterica enterica serovar Typhi Ty2
cuggcaguccacguagcugc

SEQ ID NO: 3739895 - RNA, 14 nt, Salmonella enterica enterica serovar Typhi Ty2
cuggcaguucaucu

SEQ ID NO: 3739896 - RNA, 19 nt, Salmonella enterica enterica serovar Typhi Ty2
cuggcauaaccgcagcgcg

SEQ ID NO: 3739897 - RNA, 20 nt, Salmonella enterica enterica serovar Typhi Ty2
cuggcauaaccgcagcgcgg

SEQ ID NO: 3739898 - RNA, 13 nt, Salmonella enterica enterica serovar Typhi Ty2
cuggguaauagau

SEQ ID NO: 3739899 - RNA, 16 nt, Salmonella enterica enterica serovar Typhi Ty2
cuggguagaguaaccc

SEQ ID NO: 3739900 - RNA, 18 nt, Salmonella enterica enterica serovar Typhi Ty2
cuggguagcuucugucug

SEQ ID NO: 3739901 - RNA, 20 nt, Salmonella enterica enterica serovar Typhi Ty2
cuggguaugcagugggccgg

SEQ ID NO: 3739902 - RNA, 17 nt, Salmonella enterica enterica serovar Typhi Ty2
cugggucacgauaacca

SEQ ID NO: 3739903 - RNA, 18 nt, Salmonella enterica enterica serovar Typhi Ty2
cugggucugcugggcgau

SEQ ID NO: 3739904 - RNA, 20 nt, Salmonella enterica enterica serovar Typhi Ty2
cuggguuagccaaacucuga

SEQ ID NO: 3739905 - RNA, 14 nt, Salmonella enterica enterica serovar Typhi Ty2
cuggguugcccaaa

SEQ ID NO: 3739906 - RNA, 17 nt, Salmonella enterica enterica serovar Typhi Ty2
cuggguuuauuugguac

SEQ ID NO: 3739907 - RNA, 16 nt, Salmonella enterica enterica serovar Typhi Ty2
cuggguuugcugaauc

SEQ ID NO: 3739908 - RNA, 19 nt, Salmonella enterica enterica serovar Typhi Ty2
cugguaaccguaacgcucc

SEQ ID NO: 3739909 - RNA, 16 nt, Salmonella enterica enterica serovar Typhi Ty2
cugguaacggcacugc

SEQ ID NO: 3739910 - RNA, 13 nt, Salmonella enterica enterica serovar Typhi Ty2
cugguaagagagc

SEQ ID NO: 3739911 - RNA, 17 nt, Salmonella enterica enterica serovar Typhi Ty2
cugguaagagagccuua

SEQ ID NO: 3739912 - RNA, 16 nt, Salmonella enterica enterica serovar Typhi Ty2
cugguaaggcaaauau

SEQ ID NO: 3739913 - RNA, 14 nt, Salmonella enterica enterica serovar Typhi Ty2
cugguacguccauc

SEQ ID NO: 3739914 - RNA, 21 nt, Salmonella enterica enterica serovar Typhi Ty2
cugguacguccauccgccggg

SEQ ID NO: 3739915 - RNA, 18 nt, Salmonella enterica enterica serovar Typhi Ty2
cugguagagaucgacaaa

SEQ ID NO: 3739916 - RNA, 23 nt, Salmonella enterica enterica serovar Typhi Ty2
cugguaggucaacccuauugcca

SEQ ID NO: 3739917 - RNA, 19 nt, Salmonella enterica enterica serovar Typhi Ty2
cuggucaacacgcggucgu

SEQ ID NO: 3739918 - RNA, 13 nt, Salmonella enterica enterica serovar Typhi Ty2
cuggucacgguuu

SEQ ID NO: 3739919 - RNA, 17 nt, Salmonella enterica enterica serovar Typhi Ty2
cuggucaggugauugcc

SEQ ID NO: 3739920 - RNA, 18 nt, Salmonella enterica enterica serovar Typhi Ty2
cuggucauaacgcuuugu

SEQ ID NO: 3739921 - RNA, 21 nt, Salmonella enterica enterica serovar Typhi Ty2
cuggucauggcuuagcgccag

SEQ ID NO: 3739922 - RNA, 15 nt, Salmonella enterica enterica serovar Typhi Ty2
cuggucgccagcgcc

SEQ ID NO: 3739923 - RNA, 22 nt, Salmonella enterica enterica serovar Typhi Ty2
cuggucgcgguuuacuucuuca

SEQ ID NO: 3739924 - RNA, 16 nt, Salmonella enterica enterica serovar Typhi Ty2
cuggucgcucugcgca

SEQ ID NO: 3739925 - RNA, 18 nt, Salmonella enterica enterica serovar Typhi Ty2
cuggucggcgaccagcag

SEQ ID NO: 3739926 - RNA, 15 nt, Salmonella enterica enterica serovar Typhi Ty2
cuggucgggcaggcu

SEQ ID NO: 3739927 - RNA, 22 nt, Salmonella enterica enterica serovar Typhi Ty2
cuggucguaagaauuauuacca

SEQ ID NO: 3739928 - RNA, 18 nt, Salmonella enterica enterica serovar Typhi Ty2
cuggucugaaucugcucc

SEQ ID NO: 3739929 - RNA, 20 nt, Salmonella enterica enterica serovar Typhi Ty2
cuggugagguuucagcaccu

SEQ ID NO: 3739930 - RNA, 15 nt, Salmonella enterica enterica serovar Typhi Ty2
cuggugauaaagcag

SEQ ID NO: 3739931 - RNA, 23 nt, Salmonella enterica enterica serovar Typhi Ty2
cuggugcagcaagcggcugucau

SEQ ID NO: 3739932 - RNA, 17 nt, Salmonella enterica enterica serovar Typhi Ty2
cuggugcaggcggucga

SEQ ID NO: 3739933 - RNA, 19 nt, Salmonella enterica enterica serovar Typhi Ty2
cuggugcccgcaaaaccuu

SEQ ID NO: 3739934 - RNA, 15 nt, Salmonella enterica enterica serovar Typhi Ty2
cuggugcgaauaagc

SEQ ID NO: 3739935 - RNA, 19 nt, Salmonella enterica enterica serovar Typhi Ty2
cuggugcggggaacacuaa

SEQ ID NO: 3739936 - RNA, 20 nt, Salmonella enterica enterica serovar Typhi Ty2
cugguggugccgacgccagc

SEQ ID NO: 3739937 - RNA, 14 nt, Salmonella enterica enterica serovar Typhi Ty2
cuggugucuuuuuc

SEQ ID NO: 3739938 - RNA, 16 nt, Salmonella enterica enterica serovar Typhi Ty2
cuggugugaacaucac

SEQ ID NO: 3739939 - RNA, 19 nt, Salmonella enterica enterica serovar Typhi Ty2
cugguuaacgccgccauca

SEQ ID NO: 3739940 - RNA, 20 nt, Salmonella enterica enterica serovar Typhi Ty2
cugguuaaugaccugccgcg

SEQ ID NO: 3739941 - RNA, 22 nt, Salmonella enterica enterica serovar Typhi Ty2
cugguuaaugccuucgccgccg

SEQ ID NO: 3739942 - RNA, 13 nt, Salmonella enterica enterica serovar Typhi Ty2
cugguuauaugaa

SEQ ID NO: 3739943 - RNA, 17 nt, Salmonella enterica enterica serovar Typhi Ty2
cugguucgaauccaggu

SEQ ID NO: 3739944 - RNA, 14 nt, Salmonella enterica enterica serovar Typhi Ty2
cugguugaccggaa

SEQ ID NO: 3739945 - RNA, 12 nt, Salmonella enterica enterica serovar Typhi Ty2
cugguugucuca

SEQ ID NO: 3739946 - RNA, 15 nt, Salmonella enterica enterica serovar Typhi Ty2
cugguuuuuccauuc

SEQ ID NO: 3739947 - RNA, 20 nt, Salmonella enterica enterica serovar Typhi Ty2
cuguaaaccgccuccaggcc

SEQ ID NO: 3739948 - RNA, 14 nt, Salmonella enterica enterica serovar Typhi Ty2
cuguaaaucugccg

SEQ ID NO: 3739949 - RNA, 20 nt, Salmonella enterica enterica serovar Typhi Ty2
cuguaacaacuguuuuucac

SEQ ID NO: 3739950 - RNA, 15 nt, Salmonella enterica enterica serovar Typhi Ty2
cuguaacacacuggu

SEQ ID NO: 3739951 - RNA, 16 nt, Salmonella enterica enterica serovar Typhi Ty2
cuguaacacugccgaa

SEQ ID NO: 3739952 - RNA, 14 nt, Salmonella enterica enterica serovar Typhi Ty2
cuguaacaguaucc

SEQ ID NO: 3739953 - RNA, 20 nt, Salmonella enterica enterica serovar Typhi Ty2
cuguaaccccagcaucugca

SEQ ID NO: 3739954 - RNA, 14 nt, Salmonella enterica enterica serovar Typhi Ty2
cuguaaccccugcg

SEQ ID NO: 3739955 - RNA, 16 nt, Salmonella enterica enterica serovar Typhi Ty2
cuguaaccccugcgcg

SEQ ID NO: 3739956 - RNA, 17 nt, Salmonella enterica enterica serovar Typhi Ty2
cuguaacuucacgccau

SEQ ID NO: 3739957 - RNA, 17 nt, Salmonella enterica enterica serovar Typhi Ty2
cuguaacuucggccagc

SEQ ID NO: 3739958 - RNA, 20 nt, Salmonella enterica enterica serovar Typhi Ty2
cuguaacuucggccagcgag

SEQ ID NO: 3739959 - RNA, 14 nt, Salmonella enterica enterica serovar Typhi Ty2
cuguaagaggcaua

SEQ ID NO: 3739960 - RNA, 14 nt, Salmonella enterica enterica serovar Typhi Ty2
cuguaauacgcugu

SEQ ID NO: 3739961 - RNA, 23 nt, Salmonella enterica enterica serovar Typhi Ty2
cuguaauagauaugaaagaagga

SEQ ID NO: 3739962 - RNA, 17 nt, Salmonella enterica enterica serovar Typhi Ty2
cuguaauagugcgcggg

SEQ ID NO: 3739963 - RNA, 13 nt, Salmonella enterica enterica serovar Typhi Ty2
cuguaaugaggca

SEQ ID NO: 3739964 - RNA, 23 nt, Salmonella enterica enterica serovar Typhi Ty2
cuguaauucucccaaauuuuuuu

SEQ ID NO: 3739965 - RNA, 19 nt, Salmonella enterica enterica serovar Typhi Ty2
cuguacaaaaucaucauca

SEQ ID NO: 3739966 - RNA, 13 nt, Salmonella enterica enterica serovar Typhi Ty2
cuguacauaucca

SEQ ID NO: 3739967 - RNA, 14 nt, Salmonella enterica enterica serovar Typhi Ty2
cuguaccaccacgc

SEQ ID NO: 3739968 - RNA, 12 nt, Salmonella enterica enterica serovar Typhi Ty2
cuguaccaccag

SEQ ID NO: 3739969 - RNA, 21 nt, Salmonella enterica enterica serovar Typhi Ty2
cuguaccaccagaaucgccag

SEQ ID NO: 3739970 - RNA, 22 nt, Salmonella enterica enterica serovar Typhi Ty2
cuguaccaccagaaucgccagc

SEQ ID NO: 3739971 - RNA, 12 nt, Salmonella enterica enterica serovar Typhi Ty2
cuguaccaggac

SEQ ID NO: 3739972 - RNA, 16 nt, Salmonella enterica enterica serovar Typhi Ty2
cuguaccuuaaccggg

SEQ ID NO: 3739973 - RNA, 15 nt, Salmonella enterica enterica serovar Typhi Ty2
cuguacgccacggcu

SEQ ID NO: 3739974 - RNA, 21 nt, Salmonella enterica enterica serovar Typhi Ty2
cuguacgccacggcuuaaauc

SEQ ID NO: 3739975 - RNA, 14 nt, Salmonella enterica enterica serovar Typhi Ty2
cuguacgcccagcc

SEQ ID NO: 3739976 - RNA, 16 nt, Salmonella enterica enterica serovar Typhi Ty2
cuguacgcccagccgu

SEQ ID NO: 3739977 - RNA, 13 nt, Salmonella enterica enterica serovar Typhi Ty2
cuguacgccucuu

SEQ ID NO: 3739978 - RNA, 19 nt, Salmonella enterica enterica serovar Typhi Ty2
cuguacgcgggaaauaccu

SEQ ID NO: 3739979 - RNA, 16 nt, Salmonella enterica enterica serovar Typhi Ty2
cuguacggaauaagcg

SEQ ID NO: 3739980 - RNA, 17 nt, Salmonella enterica enterica serovar Typhi Ty2
cugugugggcacucgaa

SEQ ID NO: 3739981 - RNA, 19 nt, Salmonella enterica enterica serovar Typhi Ty2
cuguguuuucagccaggug

SEQ ID NO: 3739982 - RNA, 12 nt, Salmonella enterica enterica serovar Typhi Ty2
cuguuaaaaaau

SEQ ID NO: 3739983 - RNA, 23 nt, Salmonella enterica enterica serovar Typhi Ty2
cuguuaaccuguaacacacuggu

SEQ ID NO: 3739984 - RNA, 22 nt, Salmonella enterica enterica serovar Typhi Ty2
cuguuaccaaugccaaaaaaac

SEQ ID NO: 3739985 - RNA, 15 nt, Salmonella enterica enterica serovar Typhi Ty2
cuguuaugaaacccg

SEQ ID NO: 3739986 - RNA, 20 nt, Salmonella enterica enterica serovar Typhi Ty2
cuguuaugcacgcgcggcgc

SEQ ID NO: 3739987 - RNA, 19 nt, Salmonella enterica enterica serovar Typhi Ty2
cuguuauucagggcuuuau

SEQ ID NO: 3739988 - RNA, 15 nt, Salmonella enterica enterica serovar Typhi Ty2
cuguucaaaagccug

SEQ ID NO: 3739989 - RNA, 20 nt, Salmonella enterica enterica serovar Typhi Ty2
cuguucaaacaucagcgcau

SEQ ID NO: 3739990 - RNA, 20 nt, Salmonella enterica enterica serovar Typhi Ty2
cuguucaaguggcaaucgac

SEQ ID NO: 3739991 - RNA, 13 nt, Salmonella enterica enterica serovar Typhi Ty2
cuguucacaucca

SEQ ID NO: 3739992 - RNA, 23 nt, Salmonella enterica enterica serovar Typhi Ty2
cuguucagaaaucggcagcaccc

SEQ ID NO: 3739993 - RNA, 17 nt, Salmonella enterica enterica serovar Typhi Ty2
cuguucaucaaagaaaa

SEQ ID NO: 3739994 - RNA, 17 nt, Salmonella enterica enterica serovar Typhi Ty2
cuguuccagccgcccgc

SEQ ID NO: 3739995 - RNA, 19 nt, Salmonella enterica enterica serovar Typhi Ty2
cuguuccagugggcggaua

SEQ ID NO: 3739996 - RNA, 19 nt, Salmonella enterica enterica serovar Typhi Ty2
cuguuccgaaauaaaucga

SEQ ID NO: 3739997 - RNA, 12 nt, Salmonella enterica enterica serovar Typhi Ty2
cuguuccucuuu

SEQ ID NO: 3739998 - RNA, 21 nt, Salmonella enterica enterica serovar Typhi Ty2
cuguuccugcgggaacagaua

SEQ ID NO: 3739999 - RNA, 14 nt, Salmonella enterica enterica serovar Typhi Ty2
cuguuccuucagaa

SEQ ID NO: 3740000 - RNA, 14 nt, Salmonella enterica enterica serovar Typhi Ty2
cuguucgccuucgu

SEQ ID NO: 3740001 - RNA, 12 nt, Salmonella enterica enterica serovar Typhi Ty2
cuguucuggcuc

SEQ ID NO: 3740002 - RNA, 20 nt, Salmonella enterica enterica serovar Typhi Ty2
cuguucuggcucggccuguc

SEQ ID NO: 3740003 - RNA, 11 nt, Salmonella enterica enterica serovar Typhi Ty2
cuguucugucc

SEQ ID NO: 3740004 - RNA, 17 nt, Salmonella enterica enterica serovar Typhi Ty2
cuguucuugcugcugcu

SEQ ID NO: 3740005 - RNA, 18 nt, Salmonella enterica enterica serovar Typhi Ty2
cuguucuuuuucggcugg

SEQ ID NO: 3740006 - RNA, 19 nt, Salmonella enterica enterica serovar Typhi Ty2
cuguugaguucccuucucc

SEQ ID NO: 3740007 - RNA, 21 nt, Salmonella enterica enterica serovar Typhi Ty2
cuguugaguucccuucuccuc

SEQ ID NO: 3740008 - RNA, 20 nt, Salmonella enterica enterica serovar Typhi Ty2
cuguugauacaguaccuuua

SEQ ID NO: 3740009 - RNA, 20 nt, Salmonella enterica enterica serovar Typhi Ty2
cuguugaugauaaccgccgc

SEQ ID NO: 3740010 - RNA, 21 nt, Salmonella enterica enterica serovar Typhi Ty2
cuguugaugauaaccgccgcc

SEQ ID NO: 3740011 - RNA, 15 nt, Salmonella enterica enterica serovar Typhi Ty2
cuguugauuacgcuc

SEQ ID NO: 3740012 - RNA, 20 nt, Salmonella enterica enterica serovar Typhi Ty2
cuguugccuuugcgcgcgau

SEQ ID NO: 3740013 - RNA, 18 nt, Salmonella enterica enterica serovar Typhi Ty2
cuguugcgggccagcagc

SEQ ID NO: 3740014 - RNA, 14 nt, Salmonella enterica enterica serovar Typhi Ty2
cuguugcugugcau

SEQ ID NO: 3740015 - RNA, 20 nt, Salmonella enterica enterica serovar Typhi Ty2
cuguugguuuaucgccgauu

SEQ ID NO: 3740016 - RNA, 13 nt, Salmonella enterica enterica serovar Typhi Ty2
cuguuuaucugau

SEQ ID NO: 3740017 - RNA, 22 nt, Salmonella enterica enterica serovar Typhi Ty2
cuguuuauucuucgucagaugc

SEQ ID NO: 3740018 - RNA, 23 nt, Salmonella enterica enterica serovar Typhi Ty2
cuguuuauucuucgucagaugcg

SEQ ID NO: 3740019 - RNA, 16 nt, Salmonella enterica enterica serovar Typhi Ty2
cuguuuccaguuaccg

SEQ ID NO: 3740020 - RNA, 22 nt, Salmonella enterica enterica serovar Typhi Ty2
cuguuucuccguuguugcacca

SEQ ID NO: 3740021 - RNA, 22 nt, Salmonella enterica enterica serovar Typhi Ty2
cuguuucucgaucccgaauggc

SEQ ID NO: 3740022 - RNA, 21 nt, Salmonella enterica enterica serovar Typhi Ty2
cuguuucugauagcccuauuc

SEQ ID NO: 3740023 - RNA, 16 nt, Salmonella enterica enterica serovar Typhi Ty2
cuguuucugcuggccu

SEQ ID NO: 3740024 - RNA, 22 nt, Salmonella enterica enterica serovar Typhi Ty2
cuguuugcugacaaucugcugg

SEQ ID NO: 3740025 - RNA, 15 nt, Salmonella enterica enterica serovar Typhi Ty2
cuguuugugguccaa

SEQ ID NO: 3740026 - RNA, 15 nt, Salmonella enterica enterica serovar Typhi Ty2
cuguuugugguuggu

SEQ ID NO: 3740027 - RNA, 14 nt, Salmonella enterica enterica serovar Typhi Ty2
cuguuuuauuuccu

SEQ ID NO: 3740028 - RNA, 18 nt, Salmonella enterica enterica serovar Typhi Ty2
cuguuuuauuuccucaga

SEQ ID NO: 3740029 - RNA, 15 nt, Salmonella enterica enterica serovar Typhi Ty2
cuguuuucacucuuu

SEQ ID NO: 3740030 - RNA, 12 nt, Salmonella enterica enterica serovar Typhi Ty2
cuguuuuccgcu

SEQ ID NO: 3740031 - RNA, 14 nt, Salmonella enterica enterica serovar Typhi Ty2
cuguuuugccuugc

SEQ ID NO: 3740032 - RNA, 16 nt, Salmonella enterica enterica serovar Typhi Ty2
cuguuuuugcuuuaau

SEQ ID NO: 3740033 - RNA, 21 nt, Salmonella enterica enterica serovar Typhi Ty2
cuuaaaacgauuuggucggcg

SEQ ID NO: 3740034 - RNA, 20 nt, Salmonella enterica enterica serovar Typhi Ty2
cuuaaacagcgaucacgccg

SEQ ID NO: 3740035 - RNA, 16 nt, Salmonella enterica enterica serovar Typhi Ty2
cuuaaacaguauuuau

SEQ ID NO: 3740036 - RNA, 21 nt, Salmonella enterica enterica serovar Typhi Ty2
cuuaaacaucgcccuccagcu

SEQ ID NO: 3740037 - RNA, 15 nt, Salmonella enterica enterica serovar Typhi Ty2
cuuaaaccugcgccg

SEQ ID NO: 3740038 - RNA, 13 nt, Salmonella enterica enterica serovar Typhi Ty2
cuuaaauaugaaa

SEQ ID NO: 3740039 - RNA, 19 nt, Salmonella enterica enterica serovar Typhi Ty2
cuuaaauaugaaagagaaa

SEQ ID NO: 3740040 - RNA, 14 nt, Salmonella enterica enterica serovar Typhi Ty2
cuuaaaugccgccg

SEQ ID NO: 3740041 - RNA, 15 nt, Salmonella enterica enterica serovar Typhi Ty2
cuuaacagaauugcg

SEQ ID NO: 3740042 - RNA, 14 nt, Salmonella enterica enterica serovar Typhi Ty2
cuuaacccacaaga

SEQ ID NO: 3740043 - RNA, 22 nt, Salmonella enterica enterica serovar Typhi Ty2
cuuaacccugccguuugcgcca

SEQ ID NO: 3740044 - RNA, 21 nt, Salmonella enterica enterica serovar Typhi Ty2
cuuaaccgggaucgggacaug

SEQ ID NO: 3740045 - RNA, 18 nt, Salmonella enterica enterica serovar Typhi Ty2
cuuaaccucgcuacuggc

SEQ ID NO: 3740046 - RNA, 16 nt, Salmonella enterica enterica serovar Typhi Ty2
cuuaacgcccgcgucu

SEQ ID NO: 3740047 - RNA, 18 nt, Salmonella enterica enterica serovar Typhi Ty2
cuuaauacccauuucuuc

SEQ ID NO: 3740048 - RNA, 21 nt, Salmonella enterica enterica serovar Typhi Ty2
cuuaauacccauuucuucuuc

SEQ ID NO: 3740049 - RNA, 17 nt, Salmonella enterica enterica serovar Typhi Ty2
cuuaauacgcagaucuu

SEQ ID NO: 3740050 - RNA, 18 nt, Salmonella enterica enterica serovar Typhi Ty2
cuuaauacucgccccguu

SEQ ID NO: 3740051 - RNA, 13 nt, Salmonella enterica enterica serovar Typhi Ty2
cuuaaucaccagc

SEQ ID NO: 3740052 - RNA, 20 nt, Salmonella enterica enterica serovar Typhi Ty2
cuuaaucaguucggcaucca

SEQ ID NO: 3740053 - RNA, 17 nt, Salmonella enterica enterica serovar Typhi Ty2
cuuaauuaacgccgcga

SEQ ID NO: 3740054 - RNA, 19 nt, Salmonella enterica enterica serovar Typhi Ty2
cuuaauuugcuguuuuuug

SEQ ID NO: 3740055 - RNA, 16 nt, Salmonella enterica enterica serovar Typhi Ty2
cuuacaaaaaauacau

SEQ ID NO: 3740056 - RNA, 20 nt, Salmonella enterica enterica serovar Typhi Ty2
cuuacaacauuguuauguuu

SEQ ID NO: 3740057 - RNA, 13 nt, Salmonella enterica enterica serovar Typhi Ty2
cuuacaauuuauc

SEQ ID NO: 3740058 - RNA, 23 nt, Salmonella enterica enterica serovar Typhi Ty2
cuuacagcuucgguccggcgcua

SEQ ID NO: 3740059 - RNA, 13 nt, Salmonella enterica enterica serovar Typhi Ty2
cuuacaggcgcau

SEQ ID NO: 3740060 - RNA, 19 nt, Salmonella enterica enterica serovar Typhi Ty2
cuuacaggcgcaucagaaa

SEQ ID NO: 3740061 - RNA, 17 nt, Salmonella enterica enterica serovar Typhi Ty2
cuuacaggcuggaaaua

SEQ ID NO: 3740062 - RNA, 15 nt, Salmonella enterica enterica serovar Typhi Ty2
cuucaacgccgcgcu

SEQ ID NO: 3740063 - RNA, 14 nt, Salmonella enterica enterica serovar Typhi Ty2
cuucaagaaucaau

SEQ ID NO: 3740064 - RNA, 14 nt, Salmonella enterica enterica serovar Typhi Ty2
cuucaagccaggcu

SEQ ID NO: 3740065 - RNA, 18 nt, Salmonella enterica enterica serovar Typhi Ty2
cuucaagccaggcuuuaa

SEQ ID NO: 3740066 - RNA, 23 nt, Salmonella enterica enterica serovar Typhi Ty2
cuucaaggcucaauacgcauaau

SEQ ID NO: 3740067 - RNA, 20 nt, Salmonella enterica enterica serovar Typhi Ty2
cuucaaucgucguuccgcca

SEQ ID NO: 3740068 - RNA, 12 nt, Salmonella enterica enterica serovar Typhi Ty2
cuucaaugaaca

SEQ ID NO: 3740069 - RNA, 18 nt, Salmonella enterica enterica serovar Typhi Ty2
cuucaaugcgccccgucu

SEQ ID NO: 3740070 - RNA, 16 nt, Salmonella enterica enterica serovar Typhi Ty2
cuucaauucagaaagu

SEQ ID NO: 3740071 - RNA, 20 nt, Salmonella enterica enterica serovar Typhi Ty2
cuucaauuccuggaacugac

SEQ ID NO: 3740072 - RNA, 21 nt, Salmonella enterica enterica serovar Typhi Ty2
cuucaauuugaccugaccugg

SEQ ID NO: 3740073 - RNA, 23 nt, Salmonella enterica enterica serovar Typhi Ty2
cuucaauuugccggaacucagcu

SEQ ID NO: 3740074 - RNA, 18 nt, Salmonella enterica enterica serovar Typhi Ty2
cuucacaaacaauuuccc

SEQ ID NO: 3740075 - RNA, 23 nt, Salmonella enterica enterica serovar Typhi Ty2
cuucacauacccgcuuaccgcgg

SEQ ID NO: 3740076 - RNA, 14 nt, Salmonella enterica enterica serovar Typhi Ty2
cuucaccacgccau

SEQ ID NO: 3740077 - RNA, 19 nt, Salmonella enterica enterica serovar Typhi Ty2
cuucacccagacugugaug

SEQ ID NO: 3740078 - RNA, 22 nt, Salmonella enterica enterica serovar Typhi Ty2
cuucacccagacugugauggcg

SEQ ID NO: 3740079 - RNA, 18 nt, Salmonella enterica enterica serovar Typhi Ty2
cuucacccaucgccagau

SEQ ID NO: 3740080 - RNA, 18 nt, Salmonella enterica enterica serovar Typhi Ty2
cuucaccgagaaauuuag

SEQ ID NO: 3740081 - RNA, 19 nt, Salmonella enterica enterica serovar Typhi Ty2
cuucaccggcgugcgcuua

SEQ ID NO: 3740082 - RNA, 15 nt, Salmonella enterica enterica serovar Typhi Ty2
cuucaccucagccaa

SEQ ID NO: 3740083 - RNA, 19 nt, Salmonella enterica enterica serovar Typhi Ty2
cuucaccucagccaaccca

SEQ ID NO: 3740084 - RNA, 14 nt, Salmonella enterica enterica serovar Typhi Ty2
cuucaccuugcugc

SEQ ID NO: 3740085 - RNA, 15 nt, Salmonella enterica enterica serovar Typhi Ty2
cuucacgccauccag

SEQ ID NO: 3740086 - RNA, 21 nt, Salmonella enterica enterica serovar Typhi Ty2
cuucacgccgugaauuucugc

SEQ ID NO: 3740087 - RNA, 22 nt, Salmonella enterica enterica serovar Typhi Ty2
cuucacgcgcggcuacugccag

SEQ ID NO: 3740088 - RNA, 14 nt, Salmonella enterica enterica serovar Typhi Ty2
cuucacgcuaaucc

SEQ ID NO: 3740089 - RNA, 16 nt, Salmonella enterica enterica serovar Typhi Ty2
cuucacggaaggggcc

SEQ ID NO: 3740090 - RNA, 18 nt, Salmonella enterica enterica serovar Typhi Ty2
cuucacguugacgcaaac

SEQ ID NO: 3740091 - RNA, 23 nt, Salmonella enterica enterica serovar Typhi Ty2
cuucacguugacgcaaacugcca

SEQ ID NO: 3740092 - RNA, 18 nt, Salmonella enterica enterica serovar Typhi Ty2
cuucacuguuaucgccau

SEQ ID NO: 3740093 - RNA, 16 nt, Salmonella enterica enterica serovar Typhi Ty2
cuucagacaacgccgc

SEQ ID NO: 3740094 - RNA, 13 nt, Salmonella enterica enterica serovar Typhi Ty2
cuucagagcaggu

SEQ ID NO: 3740095 - RNA, 15 nt, Salmonella enterica enterica serovar Typhi Ty2
cuucagagcugaaaa

SEQ ID NO: 3740096 - RNA, 22 nt, Salmonella enterica enterica serovar Typhi Ty2
cuucagauaccgccuuaccgcg

SEQ ID NO: 3740097 - RNA, 18 nt, Salmonella enterica enterica serovar Typhi Ty2
cuucagcauacaggucuu

SEQ ID NO: 3740098 - RNA, 12 nt, Salmonella enterica enterica serovar Typhi Ty2
cuucagccagac

SEQ ID NO: 3740099 - RNA, 17 nt, Salmonella enterica enterica serovar Typhi Ty2
cuucagcgacaucguca

SEQ ID NO: 3740100 - RNA, 13 nt, Salmonella enterica enterica serovar Typhi Ty2
cuucagcgcgccc

SEQ ID NO: 3740101 - RNA, 23 nt, Salmonella enterica enterica serovar Typhi Ty2
cuucagcguccggaaaauccuca

SEQ ID NO: 3740102 - RNA, 16 nt, Salmonella enterica enterica serovar Typhi Ty2
cuucagcguugucccg

SEQ ID NO: 3740103 - RNA, 13 nt, Salmonella enterica enterica serovar Typhi Ty2
cuucaggagaccu

SEQ ID NO: 3740104 - RNA, 20 nt, Salmonella enterica enterica serovar Typhi Ty2
cuucaggcucaucagcgcca

SEQ ID NO: 3740105 - RNA, 13 nt, Salmonella enterica enterica serovar Typhi Ty2
cuucaggcuguug

SEQ ID NO: 3740106 - RNA, 23 nt, Salmonella enterica enterica serovar Typhi Ty2
cuucaggcuguugcgcauucagg

SEQ ID NO: 3740107 - RNA, 14 nt, Salmonella enterica enterica serovar Typhi Ty2
cuucagguuaagug

SEQ ID NO: 3740108 - RNA, 12 nt, Salmonella enterica enterica serovar Typhi Ty2
cuucaguaacca

SEQ ID NO: 3740109 - RNA, 19 nt, Salmonella enterica enterica serovar Typhi Ty2
cuucaguaaccagggagga

SEQ ID NO: 3740110 - RNA, 15 nt, Salmonella enterica enterica serovar Typhi Ty2
cuucaguaagcgagu

SEQ ID NO: 3740111 - RNA, 17 nt, Salmonella enterica enterica serovar Typhi Ty2
cuucaguucagccgcca

SEQ ID NO: 3740112 - RNA, 18 nt, Salmonella enterica enterica serovar Typhi Ty2
cuucaguucagccgccag

SEQ ID NO: 3740113 - RNA, 12 nt, Salmonella enterica enterica serovar Typhi Ty2
cuucauaaauac

SEQ ID NO: 3740114 - RNA, 23 nt, Salmonella enterica enterica serovar Typhi Ty2
cuucauauuaaauuccggcucgc

SEQ ID NO: 3740115 - RNA, 13 nt, Salmonella enterica enterica serovar Typhi Ty2
cuucaucagccag

SEQ ID NO: 3740116 - RNA, 14 nt, Salmonella enterica enterica serovar Typhi Ty2
cuucaucagccagc

SEQ ID NO: 3740117 - RNA, 17 nt, Salmonella enterica enterica serovar Typhi Ty2
cuucauccgcucccgcu

SEQ ID NO: 3740118 - RNA, 15 nt, Salmonella enterica enterica serovar Typhi Ty2
cuucauccggcguug

SEQ ID NO: 3740119 - RNA, 18 nt, Salmonella enterica enterica serovar Typhi Ty2
cuucaucgcgccuccccu

SEQ ID NO: 3740120 - RNA, 18 nt, Salmonella enterica enterica serovar Typhi Ty2
cuucaucggauagaugaa

SEQ ID NO: 3740121 - RNA, 22 nt, Salmonella enterica enterica serovar Typhi Ty2
cuucaucggauagaugaagaca

SEQ ID NO: 3740122 - RNA, 14 nt, Salmonella enterica enterica serovar Typhi Ty2
cuucaucuucaccu

SEQ ID NO: 3740123 - RNA, 12 nt, Salmonella enterica enterica serovar Typhi Ty2
cuucaucuucca

SEQ ID NO: 3740124 - RNA, 16 nt, Salmonella enterica enterica serovar Typhi Ty2
cuucaucuuccaguac

SEQ ID NO: 3740125 - RNA, 13 nt, Salmonella enterica enterica serovar Typhi Ty2
cuucaugcacaaa

SEQ ID NO: 3740126 - RNA, 13 nt, Salmonella enterica enterica serovar Typhi Ty2
cuucaugcgcuuu

SEQ ID NO: 3740127 - RNA, 20 nt, Salmonella enterica enterica serovar Typhi Ty2
cuucaugguaaaauccuuuu

SEQ ID NO: 3740128 - RNA, 19 nt, Salmonella enterica enterica serovar Typhi Ty2
cuucauggucggacgggcc

SEQ ID NO: 3740129 - RNA, 22 nt, Salmonella enterica enterica serovar Typhi Ty2
cuucaugugguaggcuucaacc

SEQ ID NO: 3740130 - RNA, 24 nt, Salmonella enterica enterica serovar Typhi Ty2
cuucauuuauggguuccaguugca

SEQ ID NO: 3740131 - RNA, 18 nt, Salmonella enterica enterica serovar Typhi Ty2
cuuccaccaccuccugcu

SEQ ID NO: 3740132 - RNA, 23 nt, Salmonella enterica enterica serovar Typhi Ty2
cuuccaccauccgcgcauacucu

SEQ ID NO: 3740133 - RNA, 21 nt, Salmonella enterica enterica serovar Typhi Ty2
cuuccacccgcgcgcuuucca

SEQ ID NO: 3740134 - RNA, 15 nt, Salmonella enterica enterica serovar Typhi Ty2
cuuccacgcacgccg

SEQ ID NO: 3740135 - RNA, 21 nt, Salmonella enterica enterica serovar Typhi Ty2
cuuccagauacauggcuauuc

SEQ ID NO: 3740136 - RNA, 23 nt, Salmonella enterica enterica serovar Typhi Ty2
cuuccagcaaaccuuccgccagg

SEQ ID NO: 3740137 - RNA, 22 nt, Salmonella enterica enterica serovar Typhi Ty2
cuuccagcacgauauccagcac

SEQ ID NO: 3740138 - RNA, 14 nt, Salmonella enterica enterica serovar Typhi Ty2
cuuccagcagaucc

SEQ ID NO: 3740139 - RNA, 19 nt, Salmonella enterica enterica serovar Typhi Ty2
cuuccagcauucuauuguu

SEQ ID NO: 3740140 - RNA, 17 nt, Salmonella enterica enterica serovar Typhi Ty2
cuuccagcgacuccgga

SEQ ID NO: 3740141 - RNA, 14 nt, Salmonella enterica enterica serovar Typhi Ty2
cuuccagcgcgccg

SEQ ID NO: 3740142 - RNA, 13 nt, Salmonella enterica enterica serovar Typhi Ty2
cuuccagcggcag

SEQ ID NO: 3740143 - RNA, 10 nt, Salmonella enterica enterica serovar Typhi Ty2
cuuccaguac

SEQ ID NO: 3740144 - RNA, 14 nt, Salmonella enterica enterica serovar Typhi Ty2
cuucgucagcgcau

SEQ ID NO: 3740145 - RNA, 20 nt, Salmonella enterica enterica serovar Typhi Ty2
cuucgucaggcggcugcgca

SEQ ID NO: 3740146 - RNA, 15 nt, Salmonella enterica enterica serovar Typhi Ty2
cuucguuaagcgguu

SEQ ID NO: 3740147 - RNA, 18 nt, Salmonella enterica enterica serovar Typhi Ty2
cuucguuauaaggccugc

SEQ ID NO: 3740148 - RNA, 19 nt, Salmonella enterica enterica serovar Typhi Ty2
cuucguuauuuuccugaaa

SEQ ID NO: 3740149 - RNA, 16 nt, Salmonella enterica enterica serovar Typhi Ty2
cuucguucaguuccag

SEQ ID NO: 3740150 - RNA, 19 nt, Salmonella enterica enterica serovar Typhi Ty2
cuucuaacgcaacggaagg

SEQ ID NO: 3740151 - RNA, 18 nt, Salmonella enterica enterica serovar Typhi Ty2
cuucuaauuuuuccagca

SEQ ID NO: 3740152 - RNA, 21 nt, Salmonella enterica enterica serovar Typhi Ty2
cuucuacacgacgcauugcca

SEQ ID NO: 3740153 - RNA, 20 nt, Salmonella enterica enterica serovar Typhi Ty2
cuucuaccacgcugccgccg

SEQ ID NO: 3740154 - RNA, 15 nt, Salmonella enterica enterica serovar Typhi Ty2
cuucuaccugcacau

SEQ ID NO: 3740155 - RNA, 12 nt, Salmonella enterica enterica serovar Typhi Ty2
cuucuauccacu

SEQ ID NO: 3740156 - RNA, 19 nt, Salmonella enterica enterica serovar Typhi Ty2
cuucuauuaccgcagcgcg

SEQ ID NO: 3740157 - RNA, 19 nt, Salmonella enterica enterica serovar Typhi Ty2
cuucucaaaaucgccgccg

SEQ ID NO: 3740158 - RNA, 18 nt, Salmonella enterica enterica serovar Typhi Ty2
cuucucaauuucuuaucu

SEQ ID NO: 3740159 - RNA, 21 nt, Salmonella enterica enterica serovar Typhi Ty2
cuucucccaacagacgaucua

SEQ ID NO: 3740160 - RNA, 13 nt, Salmonella enterica enterica serovar Typhi Ty2
cuucuccccuuca

SEQ ID NO: 3740161 - RNA, 23 nt, Salmonella enterica enterica serovar Typhi Ty2
cuucuccccuucaucaguaacug

SEQ ID NO: 3740162 - RNA, 16 nt, Salmonella enterica enterica serovar Typhi Ty2
cuucuccucaacagac

SEQ ID NO: 3740163 - RNA, 17 nt, Salmonella enterica enterica serovar Typhi Ty2
cuucuccucaacagaca

SEQ ID NO: 3740164 - RNA, 23 nt, Salmonella enterica enterica serovar Typhi Ty2
cuucuccuucaaucacaaaaugg

SEQ ID NO: 3740165 - RNA, 14 nt, Salmonella enterica enterica serovar Typhi Ty2
cuucucgcaagagc

SEQ ID NO: 3740166 - RNA, 17 nt, Salmonella enterica enterica serovar Typhi Ty2
cuucucuaucagcgccu

SEQ ID NO: 3740167 - RNA, 21 nt, Salmonella enterica enterica serovar Typhi Ty2
cuucucugucgagcaucucca

SEQ ID NO: 3740168 - RNA, 18 nt, Salmonella enterica enterica serovar Typhi Ty2
cuucucuuuaugcgucaa

SEQ ID NO: 3740169 - RNA, 19 nt, Salmonella enterica enterica serovar Typhi Ty2
cuucugauggcuuugcugu

SEQ ID NO: 3740170 - RNA, 20 nt, Salmonella enterica enterica serovar Typhi Ty2
cuucugauuauugacauuca

SEQ ID NO: 3740171 - RNA, 15 nt, Salmonella enterica enterica serovar Typhi Ty2
cuucugccgcgcggu

SEQ ID NO: 3740172 - RNA, 13 nt, Salmonella enterica enterica serovar Typhi Ty2
cuucugcugugca

SEQ ID NO: 3740173 - RNA, 15 nt, Salmonella enterica enterica serovar Typhi Ty2
cuucugcugugcaua

SEQ ID NO: 3740174 - RNA, 12 nt, Salmonella enterica enterica serovar Typhi Ty2
cuucuggaauuc

SEQ ID NO: 3740175 - RNA, 16 nt, Salmonella enterica enterica serovar Typhi Ty2
cuucuggcgcaucaac

SEQ ID NO: 3740176 - RNA, 13 nt, Salmonella enterica enterica serovar Typhi Ty2
cuucuggcucaga

SEQ ID NO: 3740177 - RNA, 21 nt, Salmonella enterica enterica serovar Typhi Ty2
cuucuguacgcugaauaaccc

SEQ ID NO: 3740178 - RNA, 22 nt, Salmonella enterica enterica serovar Typhi Ty2
cuucugucagccuugcaucuca

SEQ ID NO: 3740179 - RNA, 14 nt, Salmonella enterica enterica serovar Typhi Ty2
cuucuuaguaacau

SEQ ID NO: 3740180 - RNA, 15 nt, Salmonella enterica enterica serovar Typhi Ty2
cuucuucacuaaaaa

SEQ ID NO: 3740181 - RNA, 14 nt, Salmonella enterica enterica serovar Typhi Ty2
cuucuucaggcuug

SEQ ID NO: 3740182 - RNA, 18 nt, Salmonella enterica enterica serovar Typhi Ty2
cuucuucaguuccgccag

SEQ ID NO: 3740183 - RNA, 19 nt, Salmonella enterica enterica serovar Typhi Ty2
cuucuucaguuccgccaga

SEQ ID NO: 3740184 - RNA, 13 nt, Salmonella enterica enterica serovar Typhi Ty2
cuucuucaucuuc

SEQ ID NO: 3740185 - RNA, 14 nt, Salmonella enterica enterica serovar Typhi Ty2
cuucuucaucuuca

SEQ ID NO: 3740186 - RNA, 13 nt, Salmonella enterica enterica serovar Typhi Ty2
cuucuucccccug

SEQ ID NO: 3740187 - RNA, 15 nt, Salmonella enterica enterica serovar Typhi Ty2
cuucuucgcggccgc

SEQ ID NO: 3740188 - RNA, 18 nt, Salmonella enterica enterica serovar Typhi Ty2
cuucuucuaccaccuuau

SEQ ID NO: 3740189 - RNA, 15 nt, Salmonella enterica enterica serovar Typhi Ty2
cuucuucuuccguca

SEQ ID NO: 3740190 - RNA, 14 nt, Salmonella enterica enterica serovar Typhi Ty2
cuucuuuagauaau

SEQ ID NO: 3740191 - RNA, 17 nt, Salmonella enterica enterica serovar Typhi Ty2
cuucuuuauagauauca

SEQ ID NO: 3740192 - RNA, 19 nt, Salmonella enterica enterica serovar Typhi Ty2
cuucuuuauccugaagaug

SEQ ID NO: 3740193 - RNA, 17 nt, Salmonella enterica enterica serovar Typhi Ty2
cuucuuuaucuucugcu

SEQ ID NO: 3740194 - RNA, 21 nt, Salmonella enterica enterica serovar Typhi Ty2
cuucuuuaucuucugcugcuc

SEQ ID NO: 3740195 - RNA, 23 nt, Salmonella enterica enterica serovar Typhi Ty2
cuucuuugaccagcgacgaugaa

SEQ ID NO: 3740196 - RNA, 19 nt, Salmonella enterica enterica serovar Typhi Ty2
cuucuuuggugcgacgcca

SEQ ID NO: 3740197 - RNA, 13 nt, Salmonella enterica enterica serovar Typhi Ty2
cuucuuuuacugc

SEQ ID NO: 3740198 - RNA, 20 nt, Salmonella enterica enterica serovar Typhi Ty2
cuugaaguuauccagcgccc

SEQ ID NO: 3740199 - RNA, 15 nt, Salmonella enterica enterica serovar Typhi Ty2
cuugaauaacauaaa

SEQ ID NO: 3740200 - RNA, 18 nt, Salmonella enterica enterica serovar Typhi Ty2
cuugacucugaagcggga

SEQ ID NO: 3740201 - RNA, 20 nt, Salmonella enterica enterica serovar Typhi Ty2
cuugagaaauuauuuuaaau

SEQ ID NO: 3740202 - RNA, 19 nt, Salmonella enterica enterica serovar Typhi Ty2
cuugagacuguuugucuca

SEQ ID NO: 3740203 - RNA, 17 nt, Salmonella enterica enterica serovar Typhi Ty2
cuugaguuuuccgccau

SEQ ID NO: 3740204 - RNA, 22 nt, Salmonella enterica enterica serovar Typhi Ty2
cuugaguuuuccgccauuggcg

SEQ ID NO: 3740205 - RNA, 12 nt, Salmonella enterica enterica serovar Typhi Ty2
cuugaucgcgca

SEQ ID NO: 3740206 - RNA, 14 nt, Salmonella enterica enterica serovar Typhi Ty2
cuugaucggcuggc

SEQ ID NO: 3740207 - RNA, 19 nt, Salmonella enterica enterica serovar Typhi Ty2
cuugaucggguuuuccuga

SEQ ID NO: 3740208 - RNA, 19 nt, Salmonella enterica enterica serovar Typhi Ty2
cuugaucgugccguccggc

SEQ ID NO: 3740209 - RNA, 23 nt, Salmonella enterica enterica serovar Typhi Ty2
cuugaugauucacccucgucuuu

SEQ ID NO: 3740210 - RNA, 18 nt, Salmonella enterica enterica serovar Typhi Ty2
cuugauggaaaacgcauc

SEQ ID NO: 3740211 - RNA, 21 nt, Salmonella enterica enterica serovar Typhi Ty2
cuugauggaaaacgcaucugg

SEQ ID NO: 3740212 - RNA, 20 nt, Salmonella enterica enterica serovar Typhi Ty2
cuugauggcgaucagcgcca

SEQ ID NO: 3740213 - RNA, 13 nt, Salmonella enterica enterica serovar Typhi Ty2
cuugaugugucua

SEQ ID NO: 3740214 - RNA, 18 nt, Salmonella enterica enterica serovar Typhi Ty2
cuugcaacccauacagcc

SEQ ID NO: 3740215 - RNA, 19 nt, Salmonella enterica enterica serovar Typhi Ty2
cuugcaaugaaaaaucccc

SEQ ID NO: 3740216 - RNA, 15 nt, Salmonella enterica enterica serovar Typhi Ty2
cuugcaauuuaucca

SEQ ID NO: 3740217 - RNA, 19 nt, Salmonella enterica enterica serovar Typhi Ty2
cuugcacgccaaaaaguga

SEQ ID NO: 3740218 - RNA, 22 nt, Salmonella enterica enterica serovar Typhi Ty2
cuugcagccagaacucaucuuc

SEQ ID NO: 3740219 - RNA, 24 nt, Salmonella enterica enterica serovar Typhi Ty2
cuugcaucucauaaaacauuccug

SEQ ID NO: 3740220 - RNA, 17 nt, Salmonella enterica enterica serovar Typhi Ty2
cuugcauggcagccccg

SEQ ID NO: 3740221 - RNA, 13 nt, Salmonella enterica enterica serovar Typhi Ty2
cuugccacuggcc

SEQ ID NO: 3740222 - RNA, 14 nt, Salmonella enterica enterica serovar Typhi Ty2
cuugccacuggccu

SEQ ID NO: 3740223 - RNA, 17 nt, Salmonella enterica enterica serovar Typhi Ty2
cuugccagagccccaau

SEQ ID NO: 3740224 - RNA, 13 nt, Salmonella enterica enterica serovar Typhi Ty2
cuugccagcgaga

SEQ ID NO: 3740225 - RNA, 18 nt, Salmonella enterica enterica serovar Typhi Ty2
cuugccaugugccgcgaa

SEQ ID NO: 3740226 - RNA, 20 nt, Salmonella enterica enterica serovar Typhi Ty2
cuuuaucuuuuagcgcgccg

SEQ ID NO: 3740227 - RNA, 24 nt, Salmonella enterica enterica serovar Typhi Ty2
cuuuaugcccuucgacaaucagca

SEQ ID NO: 3740228 - RNA, 14 nt, Salmonella enterica enterica serovar Typhi Ty2
cuuuaugucaguaa

SEQ ID NO: 3740229 - RNA, 13 nt, Salmonella enterica enterica serovar Typhi Ty2
cuuuauucauuuc

SEQ ID NO: 3740230 - RNA, 22 nt, Salmonella enterica enterica serovar Typhi Ty2
cuuuauugaaaagcagccagac

SEQ ID NO: 3740231 - RNA, 11 nt, Salmonella enterica enterica serovar Typhi Ty2
cuuuauugaug

SEQ ID NO: 3740232 - RNA, 19 nt, Salmonella enterica enterica serovar Typhi Ty2
cuuuauuuuacaacuacuc

SEQ ID NO: 3740233 - RNA, 13 nt, Salmonella enterica enterica serovar Typhi Ty2
cuuucaccgccuc

SEQ ID NO: 3740234 - RNA, 22 nt, Salmonella enterica enterica serovar Typhi Ty2
cuuucacugucaugguuauuuu

SEQ ID NO: 3740235 - RNA, 20 nt, Salmonella enterica enterica serovar Typhi Ty2
cuuucagaccaaauucagcg

SEQ ID NO: 3740236 - RNA, 15 nt, Salmonella enterica enterica serovar Typhi Ty2
cuuucagaucggcaa

SEQ ID NO: 3740237 - RNA, 13 nt, Salmonella enterica enterica serovar Typhi Ty2
cuuucagauuuuu

SEQ ID NO: 3740238 - RNA, 20 nt, Salmonella enterica enterica serovar Typhi Ty2
cuuucagccgacuaucuucu

SEQ ID NO: 3740239 - RNA, 22 nt, Salmonella enterica enterica serovar Typhi Ty2
cuuucagccgacuaucuucuuc

SEQ ID NO: 3740240 - RNA, 18 nt, Salmonella enterica enterica serovar Typhi Ty2
cuuucagcguugcagcca

SEQ ID NO: 3740241 - RNA, 20 nt, Salmonella enterica enterica serovar Typhi Ty2
cuuucaguuucggccccccc

SEQ ID NO: 3740242 - RNA, 13 nt, Salmonella enterica enterica serovar Typhi Ty2
cuuucaucaaacg

SEQ ID NO: 3740243 - RNA, 14 nt, Salmonella enterica enterica serovar Typhi Ty2
cuuucauuccuuua

SEQ ID NO: 3740244 - RNA, 17 nt, Salmonella enterica enterica serovar Typhi Ty2
cuuucauuccuuuagcu

SEQ ID NO: 3740245 - RNA, 17 nt, Salmonella enterica enterica serovar Typhi Ty2
cuuucauucgucaaauu

SEQ ID NO: 3740246 - RNA, 15 nt, Salmonella enterica enterica serovar Typhi Ty2
cuuuccaaagcgaag

SEQ ID NO: 3740247 - RNA, 14 nt, Salmonella enterica enterica serovar Typhi Ty2
cuuuccacaaucaa

SEQ ID NO: 3740248 - RNA, 23 nt, Salmonella enterica enterica serovar Typhi Ty2
cuuuccacaaucccggcaacugc

SEQ ID NO: 3740249 - RNA, 13 nt, Salmonella enterica enterica serovar Typhi Ty2
cuuuccagcagcc

SEQ ID NO: 3740250 - RNA, 14 nt, Salmonella enterica enterica serovar Typhi Ty2
cuuuccagcagcca

SEQ ID NO: 3740251 - RNA, 14 nt, Salmonella enterica enterica serovar Typhi Ty2
cuuuccagcuccag

SEQ ID NO: 3740252 - RNA, 18 nt, Salmonella enterica enterica serovar Typhi Ty2
cuuuccccaaagguguua

SEQ ID NO: 3740253 - RNA, 18 nt, Salmonella enterica enterica serovar Typhi Ty2
cuuucccuuuuuaaaaug

SEQ ID NO: 3740254 - RNA, 19 nt, Salmonella enterica enterica serovar Typhi Ty2
cuuuccgacccuuauguca

SEQ ID NO: 3740255 - RNA, 19 nt, Salmonella enterica enterica serovar Typhi Ty2
cuuuccgccaugaaaaaaa

SEQ ID NO: 3740256 - RNA, 21 nt, Salmonella enterica enterica serovar Typhi Ty2
cuuuccugaucaaucaacucu

SEQ ID NO: 3740257 - RNA, 17 nt, Salmonella enterica enterica serovar Typhi Ty2
cuuuccuuuuucaggca

SEQ ID NO: 3740258 - RNA, 18 nt, Salmonella enterica enterica serovar Typhi Ty2
cuuucgacagucgguaac

SEQ ID NO: 3740259 - RNA, 14 nt, Salmonella enterica enterica serovar Typhi Ty2
cuuucgccaguuca

SEQ ID NO: 3740260 - RNA, 18 nt, Salmonella enterica enterica serovar Typhi Ty2
cuuucggaauauugguac

SEQ ID NO: 3740261 - RNA, 16 nt, Salmonella enterica enterica serovar Typhi Ty2
cuuucggacuuccugu

SEQ ID NO: 3740262 - RNA, 17 nt, Salmonella enterica enterica serovar Typhi Ty2
cuuucggacuuccugua

SEQ ID NO: 3740263 - RNA, 22 nt, Salmonella enterica enterica serovar Typhi Ty2
cuuucggguugcccugcuuguc

SEQ ID NO: 3740264 - RNA, 18 nt, Salmonella enterica enterica serovar Typhi Ty2
cuuucgguagccacagau

SEQ ID NO: 3740265 - RNA, 22 nt, Salmonella enterica enterica serovar Typhi Ty2
cuuucgucguccacucuuccgg

SEQ ID NO: 3740266 - RNA, 12 nt, Salmonella enterica enterica serovar Typhi Ty2
cuuucguuggua

SEQ ID NO: 3740267 - RNA, 12 nt, Salmonella enterica enterica serovar Typhi Ty2
cuuucuacaaau

SEQ ID NO: 3740268 - RNA, 22 nt, Salmonella enterica enterica serovar Typhi Ty2
cuuucucgaauccacuuuuguc

SEQ ID NO: 3740269 - RNA, 18 nt, Salmonella enterica enterica serovar Typhi Ty2
cuuucucgggccuguucc

SEQ ID NO: 3740270 - RNA, 16 nt, Salmonella enterica enterica serovar Typhi Ty2
cuuucucuccuucacg

SEQ ID NO: 3740271 - RNA, 22 nt, Salmonella enterica enterica serovar Typhi Ty2
cuuucugauaacgcaggcgaua

SEQ ID NO: 3740272 - RNA, 14 nt, Salmonella enterica enterica serovar Typhi Ty2
cuuucugccagguu

SEQ ID NO: 3740273 - RNA, 15 nt, Salmonella enterica enterica serovar Typhi Ty2
cuuucugcugccgca

SEQ ID NO: 3740274 - RNA, 14 nt, Salmonella enterica enterica serovar Typhi Ty2
cuuucuucaauggc

SEQ ID NO: 3740275 - RNA, 12 nt, Salmonella enterica enterica serovar Typhi Ty2
cuuucuugccac

SEQ ID NO: 3740276 - RNA, 11 nt, Salmonella enterica enterica serovar Typhi Ty2
cuuucuuucuc

SEQ ID NO: 3740277 - RNA, 11 nt, Salmonella enterica enterica serovar Typhi Ty2
cuuugaacagc

SEQ ID NO: 3740278 - RNA, 18 nt, Salmonella enterica enterica serovar Typhi Ty2
cuuugaccagcaucgccg

SEQ ID NO: 3740279 - RNA, 22 nt, Salmonella enterica enterica serovar Typhi Ty2
cuuugaccagcaucgccgguag

SEQ ID NO: 3740280 - RNA, 15 nt, Salmonella enterica enterica serovar Typhi Ty2
cuuugaccagcgacg

SEQ ID NO: 3740281 - RNA, 20 nt, Salmonella enterica enterica serovar Typhi Ty2
cuuugacgccgggaaauuuu

SEQ ID NO: 3740282 - RNA, 15 nt, Salmonella enterica enterica serovar Typhi Ty2
cuuugaggaucaauu

SEQ ID NO: 3740283 - RNA, 22 nt, Salmonella enterica enterica serovar Typhi Ty2
cuuugagggcgauaauccgcuc

SEQ ID NO: 3740284 - RNA, 20 nt, Salmonella enterica enterica serovar Typhi Ty2
cuuugcacagucugcagacc

SEQ ID NO: 3740285 - RNA, 15 nt, Salmonella enterica enterica serovar Typhi Ty2
cuuugcccucaaaga

SEQ ID NO: 3740286 - RNA, 21 nt, Salmonella enterica enterica serovar Typhi Ty2
cuuugccuuuuucccacugcg

SEQ ID NO: 3740287 - RNA, 15 nt, Salmonella enterica enterica serovar Typhi Ty2
cuuugcgauuugucc

SEQ ID NO: 3740288 - RNA, 17 nt, Salmonella enterica enterica serovar Typhi Ty2
cuuugcgauuuguccgc

SEQ ID NO: 3740289 - RNA, 20 nt, Salmonella enterica enterica serovar Typhi Ty2
cuuugcgccggcaguuuaag

SEQ ID NO: 3740290 - RNA, 16 nt, Salmonella enterica enterica serovar Typhi Ty2
cuuugcgcuccugcuc

SEQ ID NO: 3740291 - RNA, 15 nt, Salmonella enterica enterica serovar Typhi Ty2
cuuugcgcugcgcau

SEQ ID NO: 3740292 - RNA, 17 nt, Salmonella enterica enterica serovar Typhi Ty2
cuuugcguaaaaaacau

SEQ ID NO: 3740293 - RNA, 20 nt, Salmonella enterica enterica serovar Typhi Ty2
cuuugcguaaaaaacaucau

SEQ ID NO: 3740294 - RNA, 19 nt, Salmonella enterica enterica serovar Typhi Ty2
cuuugcguuuacuuacaaa

SEQ ID NO: 3740295 - RNA, 16 nt, Salmonella enterica enterica serovar Typhi Ty2
cuuugcugacgccaua

SEQ ID NO: 3740296 - RNA, 11 nt, Salmonella enterica enterica serovar Typhi Ty2
cuuugcugcug

SEQ ID NO: 3740297 - RNA, 18 nt, Salmonella enterica enterica serovar Typhi Ty2
cuuugcuuauccggccua

SEQ ID NO: 3740298 - RNA, 20 nt, Salmonella enterica enterica serovar Typhi Ty2
cuuugcuuuguaaagcgcca

SEQ ID NO: 3740299 - RNA, 15 nt, Salmonella enterica enterica serovar Typhi Ty2
cuuuggcaaaaaagg

SEQ ID NO: 3740300 - RNA, 22 nt, Salmonella enterica enterica serovar Typhi Ty2
cuuuggcgcccauuucguuaau

SEQ ID NO: 3740301 - RNA, 20 nt, Salmonella enterica enterica serovar Typhi Ty2
cuuuggcgcgcgguuuaucc

SEQ ID NO: 3740302 - RNA, 20 nt, Salmonella enterica enterica serovar Typhi Ty2
cuuuguacagcuugccguca

SEQ ID NO: 3740303 - RNA, 21 nt, Salmonella enterica enterica serovar Typhi Ty2
cuuugucgaaauugccgcccg

SEQ ID NO: 3740304 - RNA, 15 nt, Salmonella enterica enterica serovar Typhi Ty2
cuuugucgccaauaa

SEQ ID NO: 3740305 - RNA, 22 nt, Salmonella enterica enterica serovar Typhi Ty2
cuuugucgcgguuaaggaugua

SEQ ID NO: 3740306 - RNA, 19 nt, Salmonella enterica enterica serovar Typhi Ty2
cuuugugggacugcuucaa

SEQ ID NO: 3740307 - RNA, 21 nt, Salmonella enterica enterica serovar Typhi Ty2
cuuuguucuguugaguucccu

SEQ ID NO: 3740308 - RNA, 23 nt, Salmonella enterica enterica serovar Typhi Ty2
gaaaaauuuaagccagauguaau

SEQ ID NO: 3740309 - RNA, 21 nt, Salmonella enterica enterica serovar Typhi Ty2
gaaaacaccagggauuuugcu

SEQ ID NO: 3740310 - RNA, 15 nt, Salmonella enterica enterica serovar Typhi Ty2
gaaaacagcgccggc

SEQ ID NO: 3740311 - RNA, 16 nt, Salmonella enterica enterica serovar Typhi Ty2
gaaaacagcgccggca

SEQ ID NO: 3740312 - RNA, 19 nt, Salmonella enterica enterica serovar Typhi Ty2
gaaaacagcgccggcagca

SEQ ID NO: 3740313 - RNA, 20 nt, Salmonella enterica enterica serovar Typhi Ty2
gaaaacagcgccggcagcag

SEQ ID NO: 3740314 - RNA, 20 nt, Salmonella enterica enterica serovar Typhi Ty2
gaaaacaucgcuccggcauc

SEQ ID NO: 3740315 - RNA, 13 nt, Salmonella enterica enterica serovar Typhi Ty2
gaaaaccgaugcc

SEQ ID NO: 3740316 - RNA, 22 nt, Salmonella enterica enterica serovar Typhi Ty2
gaaaacggccagugaaauaaau

SEQ ID NO: 3740317 - RNA, 16 nt, Salmonella enterica enterica serovar Typhi Ty2
gaaaacuccagcagac

SEQ ID NO: 3740318 - RNA, 12 nt, Salmonella enterica enterica serovar Typhi Ty2
gaaaacugcgcc

SEQ ID NO: 3740319 - RNA, 16 nt, Salmonella enterica enterica serovar Typhi Ty2
gaaaagaccaguggac

SEQ ID NO: 3740320 - RNA, 16 nt, Salmonella enterica enterica serovar Typhi Ty2
gaaaagcagccagacc

SEQ ID NO: 3740321 - RNA, 19 nt, Salmonella enterica enterica serovar Typhi Ty2
gaaaagccggaauauugag

SEQ ID NO: 3740322 - RNA, 20 nt, Salmonella enterica enterica serovar Typhi Ty2
gaaaagcgcgucgaaugacg

SEQ ID NO: 3740323 - RNA, 16 nt, Salmonella enterica enterica serovar Typhi Ty2
gaaaagcgcuggcugg

SEQ ID NO: 3740324 - RNA, 16 nt, Salmonella enterica enterica serovar Typhi Ty2
gaaaagcgucuucuua

SEQ ID NO: 3740325 - RNA, 21 nt, Salmonella enterica enterica serovar Typhi Ty2
gaaaagcugguauugaauauu

SEQ ID NO: 3740326 - RNA, 21 nt, Salmonella enterica enterica serovar Typhi Ty2
gaaaaggccuggcugagaaaa

SEQ ID NO: 3740327 - RNA, 22 nt, Salmonella enterica enterica serovar Typhi Ty2
gaaaaggccuggcugagaaaaa

SEQ ID NO: 3740328 - RNA, 16 nt, Salmonella enterica enterica serovar Typhi Ty2
gaaaagucauuuucau

SEQ ID NO: 3740329 - RNA, 19 nt, Salmonella enterica enterica serovar Typhi Ty2
gaaaauaacaauauuaaau

SEQ ID NO: 3740330 - RNA, 15 nt, Salmonella enterica enterica serovar Typhi Ty2
gaaaauaauucuuaa

SEQ ID NO: 3740331 - RNA, 23 nt, Salmonella enterica enterica serovar Typhi Ty2
gaaaauaccccagcgcgccgcag

SEQ ID NO: 3740332 - RNA, 14 nt, Salmonella enterica enterica serovar Typhi Ty2
gaaaauagaggaaa

SEQ ID NO: 3740333 - RNA, 15 nt, Salmonella enterica enterica serovar Typhi Ty2
gaaaauauaugacaa

SEQ ID NO: 3740334 - RNA, 13 nt, Salmonella enterica enterica serovar Typhi Ty2
gaaaauaucggcc

SEQ ID NO: 3740335 - RNA, 18 nt, Salmonella enterica enterica serovar Typhi Ty2
gaaaauaucggccugaau

SEQ ID NO: 3740336 - RNA, 18 nt, Salmonella enterica enterica serovar Typhi Ty2
gaaaauauuagcggcggc

SEQ ID NO: 3740337 - RNA, 18 nt, Salmonella enterica enterica serovar Typhi Ty2
gaaaaucacaucgccgga

SEQ ID NO: 3740338 - RNA, 22 nt, Salmonella enterica enterica serovar Typhi Ty2
gaaaaucacuaucaguuuuggc

SEQ ID NO: 3740339 - RNA, 18 nt, Salmonella enterica enterica serovar Typhi Ty2
gaaaaucgcugcgcccga

SEQ ID NO: 3740340 - RNA, 13 nt, Salmonella enterica enterica serovar Typhi Ty2
gaaaaucggcggc

SEQ ID NO: 3740341 - RNA, 14 nt, Salmonella enterica enterica serovar Typhi Ty2
gaaaaucgucucuc

SEQ ID NO: 3740342 - RNA, 13 nt, Salmonella enterica enterica serovar Typhi Ty2
gaaaaucugguuu

SEQ ID NO: 3740343 - RNA, 19 nt, Salmonella enterica enterica serovar Typhi Ty2
gaaaaugcccgacgcgccg

SEQ ID NO: 3740344 - RNA, 23 nt, Salmonella enterica enterica serovar Typhi Ty2
gaaaaugcccgacgcgccgccag

SEQ ID NO: 3740345 - RNA, 18 nt, Salmonella enterica enterica serovar Typhi Ty2
gaaaaugcgccaggaaac

SEQ ID NO: 3740346 - RNA, 14 nt, Salmonella enterica enterica serovar Typhi Ty2
gaaaaugcgcuggg

SEQ ID NO: 3740347 - RNA, 19 nt, Salmonella enterica enterica serovar Typhi Ty2
gaaaaugcguccagaggau

SEQ ID NO: 3740348 - RNA, 17 nt, Salmonella enterica enterica serovar Typhi Ty2
gaaaaugguuuugccca

SEQ ID NO: 3740349 - RNA, 16 nt, Salmonella enterica enterica serovar Typhi Ty2
gaaaaugugcaaagag

SEQ ID NO: 3740350 - RNA, 17 nt, Salmonella enterica enterica serovar Typhi Ty2
gaaaaugugcaaagaga

SEQ ID NO: 3740351 - RNA, 19 nt, Salmonella enterica enterica serovar Typhi Ty2
gaaaauuauuuucacgcuc

SEQ ID NO: 3740352 - RNA, 17 nt, Salmonella enterica enterica serovar Typhi Ty2
gaaaauuccuggauuaa

SEQ ID NO: 3740353 - RNA, 23 nt, Salmonella enterica enterica serovar Typhi Ty2
gaaacaacacaaaucgggcgggc

SEQ ID NO: 3740354 - RNA, 14 nt, Salmonella enterica enterica serovar Typhi Ty2
gaaacaagaagcac

SEQ ID NO: 3740355 - RNA, 23 nt, Salmonella enterica enterica serovar Typhi Ty2
gaaacaauccguuauuucacagc

SEQ ID NO: 3740356 - RNA, 12 nt, Salmonella enterica enterica serovar Typhi Ty2
gaaacaccagaa

SEQ ID NO: 3740357 - RNA, 13 nt, Salmonella enterica enterica serovar Typhi Ty2
gaaacagaauaaa

SEQ ID NO: 3740358 - RNA, 18 nt, Salmonella enterica enterica serovar Typhi Ty2
gaaacaggucggcaugca

SEQ ID NO: 3740359 - RNA, 23 nt, Salmonella enterica enterica serovar Typhi Ty2
gaaacaguuggcggacucgcugg

SEQ ID NO: 3740360 - RNA, 14 nt, Salmonella enterica enterica serovar Typhi Ty2
gaaacaucaucguu

SEQ ID NO: 3740361 - RNA, 15 nt, Salmonella enterica enterica serovar Typhi Ty2
gaaacaucaucguuu

SEQ ID NO: 3740362 - RNA, 22 nt, Salmonella enterica enterica serovar Typhi Ty2
gaaaccagauaucccgccaaac

SEQ ID NO: 3740363 - RNA, 11 nt, Salmonella enterica enterica serovar Typhi Ty2
gaaaccagcau

SEQ ID NO: 3740364 - RNA, 19 nt, Salmonella enterica enterica serovar Typhi Ty2
gaaaccagcauaauauuca

SEQ ID NO: 3740365 - RNA, 21 nt, Salmonella enterica enterica serovar Typhi Ty2
gaaacccgccaccgccagcca

SEQ ID NO: 3740366 - RNA, 19 nt, Salmonella enterica enterica serovar Typhi Ty2
gaaaccgagguucaccagc

SEQ ID NO: 3740367 - RNA, 15 nt, Salmonella enterica enterica serovar Typhi Ty2
gaaaccgcagaaaaa

SEQ ID NO: 3740368 - RNA, 17 nt, Salmonella enterica enterica serovar Typhi Ty2
gaaaccgcuacccggca

SEQ ID NO: 3740369 - RNA, 20 nt, Salmonella enterica enterica serovar Typhi Ty2
gaaaccgcuacccggcacaa

SEQ ID NO: 3740370 - RNA, 19 nt, Salmonella enterica enterica serovar Typhi Ty2
gaaaccgcucgccgccucc

SEQ ID NO: 3740371 - RNA, 13 nt, Salmonella enterica enterica serovar Typhi Ty2
gaaaccggcggcg

SEQ ID NO: 3740372 - RNA, 21 nt, Salmonella enterica enterica serovar Typhi Ty2
gaaaccggcgucuuuugcugc

SEQ ID NO: 3740373 - RNA, 12 nt, Salmonella enterica enterica serovar Typhi Ty2
gaaaccuccgca

SEQ ID NO: 3740374 - RNA, 20 nt, Salmonella enterica enterica serovar Typhi Ty2
gaaaccuccgcagugcggag

SEQ ID NO: 3740375 - RNA, 24 nt, Salmonella enterica enterica serovar Typhi Ty2
gaaacgacugguaaugucauccag

SEQ ID NO: 3740376 - RNA, 19 nt, Salmonella enterica enterica serovar Typhi Ty2
gaaacgccgaccacuucaa

SEQ ID NO: 3740377 - RNA, 20 nt, Salmonella enterica enterica serovar Typhi Ty2
gaaacgcuuuccggggugaa

SEQ ID NO: 3740378 - RNA, 16 nt, Salmonella enterica enterica serovar Typhi Ty2
gaaacggaucaaaaag

SEQ ID NO: 3740379 - RNA, 22 nt, Salmonella enterica enterica serovar Typhi Ty2
gaaacgguccugauccggaaua

SEQ ID NO: 3740380 - RNA, 21 nt, Salmonella enterica enterica serovar Typhi Ty2
gaaacgguuaaaaacagccag

SEQ ID NO: 3740381 - RNA, 17 nt, Salmonella enterica enterica serovar Typhi Ty2
gaaacguagcguucauu

SEQ ID NO: 3740382 - RNA, 19 nt, Salmonella enterica enterica serovar Typhi Ty2
gaaacgugcauuauuuuag

SEQ ID NO: 3740383 - RNA, 18 nt, Salmonella enterica enterica serovar Typhi Ty2
gaaacuccagcggcagga

SEQ ID NO: 3740384 - RNA, 22 nt, Salmonella enterica enterica serovar Typhi Ty2
gaaacuccuccgggaaaacauc

SEQ ID NO: 3740385 - RNA, 22 nt, Salmonella enterica enterica serovar Typhi Ty2
gaaacucgcuguggccaggcac

SEQ ID NO: 3740386 - RNA, 21 nt, Salmonella enterica enterica serovar Typhi Ty2
gaaacugaaccaacagcuggg

SEQ ID NO: 3740387 - RNA, 23 nt, Salmonella enterica enterica serovar Typhi Ty2
gaaacugauaguuuaaauccagc

SEQ ID NO: 3740388 - RNA, 12 nt, Salmonella enterica enterica serovar Typhi Ty2
gaaacugauauu

SEQ ID NO: 3740389 - RNA, 15 nt, Salmonella enterica enterica serovar Typhi Ty2
gaaacugccuaaauu

SEQ ID NO: 3740390 - RNA, 21 nt, Salmonella enterica enterica serovar Typhi Ty2
gaacggggaccaugauaucgc

SEQ ID NO: 3740391 - RNA, 20 nt, Salmonella enterica enterica serovar Typhi Ty2
gaacgguucauccagcagca

SEQ ID NO: 3740392 - RNA, 22 nt, Salmonella enterica enterica serovar Typhi Ty2
gaacguuaucggcauaggcuau

SEQ ID NO: 3740393 - RNA, 15 nt, Salmonella enterica enterica serovar Typhi Ty2
gaacguuggcugggu

SEQ ID NO: 3740394 - RNA, 22 nt, Salmonella enterica enterica serovar Typhi Ty2
gaacuacccuucaaggagaaaa

SEQ ID NO: 3740395 - RNA, 18 nt, Salmonella enterica enterica serovar Typhi Ty2
gaacuacugauuccugcc

SEQ ID NO: 3740396 - RNA, 19 nt, Salmonella enterica enterica serovar Typhi Ty2
gaacucccuguuccuguau

SEQ ID NO: 3740397 - RNA, 19 nt, Salmonella enterica enterica serovar Typhi Ty2
gaacucggaggcggcguaa

SEQ ID NO: 3740398 - RNA, 17 nt, Salmonella enterica enterica serovar Typhi Ty2
gaacucgucuuauccga

SEQ ID NO: 3740399 - RNA, 20 nt, Salmonella enterica enterica serovar Typhi Ty2
gaacucugcgacgccaggcg

SEQ ID NO: 3740400 - RNA, 15 nt, Salmonella enterica enterica serovar Typhi Ty2
gaacucuuucagacc

SEQ ID NO: 3740401 - RNA, 20 nt, Salmonella enterica enterica serovar Typhi Ty2
gaacugaauagucggcugcu

SEQ ID NO: 3740402 - RNA, 20 nt, Salmonella enterica enterica serovar Typhi Ty2
gaacugauggcgcuaagcca

SEQ ID NO: 3740403 - RNA, 21 nt, Salmonella enterica enterica serovar Typhi Ty2
gaacugcaaauaccacaucag

SEQ ID NO: 3740404 - RNA, 19 nt, Salmonella enterica enterica serovar Typhi Ty2
gaacugcagcgcgucgacc

SEQ ID NO: 3740405 - RNA, 18 nt, Salmonella enterica enterica serovar Typhi Ty2
gaacuggguaugcagugg

SEQ ID NO: 3740406 - RNA, 19 nt, Salmonella enterica enterica serovar Typhi Ty2
gaacuggguaugcaguggg

SEQ ID NO: 3740407 - RNA, 17 nt, Salmonella enterica enterica serovar Typhi Ty2
gaacugggugccgugaa

SEQ ID NO: 3740408 - RNA, 14 nt, Salmonella enterica enterica serovar Typhi Ty2
gaacuggugaaaca

SEQ ID NO: 3740409 - RNA, 15 nt, Salmonella enterica enterica serovar Typhi Ty2
gaacuguucagccag

SEQ ID NO: 3740410 - RNA, 16 nt, Salmonella enterica enterica serovar Typhi Ty2
gaacuguucagccagc

SEQ ID NO: 3740411 - RNA, 17 nt, Salmonella enterica enterica serovar Typhi Ty2
gaacuguucagccagca

SEQ ID NO: 3740412 - RNA, 23 nt, Salmonella enterica enterica serovar Typhi Ty2
gaacuuacacuuaccugauuaua

SEQ ID NO: 3740413 - RNA, 15 nt, Salmonella enterica enterica serovar Typhi Ty2
gaacuuacccagcaa

SEQ ID NO: 3740414 - RNA, 17 nt, Salmonella enterica enterica serovar Typhi Ty2
gaacuuguaaaaaugcc

SEQ ID NO: 3740415 - RNA, 12 nt, Salmonella enterica enterica serovar Typhi Ty2
gaagaaaccgca

SEQ ID NO: 3740416 - RNA, 16 nt, Salmonella enterica enterica serovar Typhi Ty2
gaagaaaccgcagaaa

SEQ ID NO: 3740417 - RNA, 19 nt, Salmonella enterica enterica serovar Typhi Ty2
gaagaaaccgcagaaaaag

SEQ ID NO: 3740418 - RNA, 18 nt, Salmonella enterica enterica serovar Typhi Ty2
gaagaacacgccgccuau

SEQ ID NO: 3740419 - RNA, 16 nt, Salmonella enterica enterica serovar Typhi Ty2
gaagaccguuuaaacg

SEQ ID NO: 3740420 - RNA, 21 nt, Salmonella enterica enterica serovar Typhi Ty2
gaagacgaugauguagccgcg

SEQ ID NO: 3740421 - RNA, 23 nt, Salmonella enterica enterica serovar Typhi Ty2
gaagacgaugauguagccgcguc

SEQ ID NO: 3740422 - RNA, 17 nt, Salmonella enterica enterica serovar Typhi Ty2
gaagacgcugcaacucu

SEQ ID NO: 3740423 - RNA, 19 nt, Salmonella enterica enterica serovar Typhi Ty2
gaagacguuuacaccgcca

SEQ ID NO: 3740424 - RNA, 19 nt, Salmonella enterica enterica serovar Typhi Ty2
gaagagcucgaccaacaua

SEQ ID NO: 3740425 - RNA, 16 nt, Salmonella enterica enterica serovar Typhi Ty2
gaagagugaauaacaa

SEQ ID NO: 3740426 - RNA, 19 nt, Salmonella enterica enterica serovar Typhi Ty2
gaagagugaauaacaaccg

SEQ ID NO: 3740427 - RNA, 21 nt, Salmonella enterica enterica serovar Typhi Ty2
gaagaguuaacuucuccgcca

SEQ ID NO: 3740428 - RNA, 14 nt, Salmonella enterica enterica serovar Typhi Ty2
gaagauaagaaaaa

SEQ ID NO: 3740429 - RNA, 21 nt, Salmonella enterica enterica serovar Typhi Ty2
gaagauacgccagguuaugcg

SEQ ID NO: 3740430 - RNA, 18 nt, Salmonella enterica enterica serovar Typhi Ty2
gaagauccgcucacgcca

SEQ ID NO: 3740431 - RNA, 20 nt, Salmonella enterica enterica serovar Typhi Ty2
gaagaucgcguacagcgcca

SEQ ID NO: 3740432 - RNA, 17 nt, Salmonella enterica enterica serovar Typhi Ty2
gaagaucgggagaaggc

SEQ ID NO: 3740433 - RNA, 20 nt, Salmonella enterica enterica serovar Typhi Ty2
gaagaucguuauccagcagc

SEQ ID NO: 3740434 - RNA, 18 nt, Salmonella enterica enterica serovar Typhi Ty2
gaagauuucuuaauuccu

SEQ ID NO: 3740435 - RNA, 17 nt, Salmonella enterica enterica serovar Typhi Ty2
gaagauuuuuauucccg

SEQ ID NO: 3740436 - RNA, 15 nt, Salmonella enterica enterica serovar Typhi Ty2
gaagcacgacacaaa

SEQ ID NO: 3740437 - RNA, 19 nt, Salmonella enterica enterica serovar Typhi Ty2
gaagcaucuuuccggaacg

SEQ ID NO: 3740438 - RNA, 20 nt, Salmonella enterica enterica serovar Typhi Ty2
gaagccacaaucugauaauc

SEQ ID NO: 3740439 - RNA, 23 nt, Salmonella enterica enterica serovar Typhi Ty2
gaagccacguucuuccagaacgc

SEQ ID NO: 3740440 - RNA, 14 nt, Salmonella enterica enterica serovar Typhi Ty2
gaagccagcgcagu

SEQ ID NO: 3740441 - RNA, 13 nt, Salmonella enterica enterica serovar Typhi Ty2
gaagccagugccc

SEQ ID NO: 3740442 - RNA, 14 nt, Salmonella enterica enterica serovar Typhi Ty2
gaagccaucaaauu

SEQ ID NO: 3740443 - RNA, 12 nt, Salmonella enterica enterica serovar Typhi Ty2
gaagcccaacua

SEQ ID NO: 3740444 - RNA, 20 nt, Salmonella enterica enterica serovar Typhi Ty2
gaagcccaacuacacucuua

SEQ ID NO: 3740445 - RNA, 18 nt, Salmonella enterica enterica serovar Typhi Ty2
gaagcccaugauggugaa

SEQ ID NO: 3740446 - RNA, 22 nt, Salmonella enterica enterica serovar Typhi Ty2
gaagcccaugauggugaacaga

SEQ ID NO: 3740447 - RNA, 17 nt, Salmonella enterica enterica serovar Typhi Ty2
gaagcccggccacagcg

SEQ ID NO: 3740448 - RNA, 23 nt, Salmonella enterica enterica serovar Typhi Ty2
gaagcccggccacagcgccagac

SEQ ID NO: 3740449 - RNA, 19 nt, Salmonella enterica enterica serovar Typhi Ty2
gaagccuuagcgggaggug

SEQ ID NO: 3740450 - RNA, 17 nt, Salmonella enterica enterica serovar Typhi Ty2
gaagcgaauagcguauu

SEQ ID NO: 3740451 - RNA, 13 nt, Salmonella enterica enterica serovar Typhi Ty2
gaagcgaccggcg

SEQ ID NO: 3740452 - RNA, 20 nt, Salmonella enterica enterica serovar Typhi Ty2
gaagcgaccggcgucaucau

SEQ ID NO: 3740453 - RNA, 17 nt, Salmonella enterica enterica serovar Typhi Ty2
gaagcgacgacacggcg

SEQ ID NO: 3740454 - RNA, 19 nt, Salmonella enterica enterica serovar Typhi Ty2
gaagcgauguauuuaucca

SEQ ID NO: 3740455 - RNA, 20 nt, Salmonella enterica enterica serovar Typhi Ty2
gaagcgauguauuuauccac

SEQ ID NO: 3740456 - RNA, 14 nt, Salmonella enterica enterica serovar Typhi Ty2
gaagcgcaguguua

SEQ ID NO: 3740457 - RNA, 14 nt, Salmonella enterica enterica serovar Typhi Ty2
gaagcgcguguauu

SEQ ID NO: 3740458 - RNA, 17 nt, Salmonella enterica enterica serovar Typhi Ty2
gaagcgcguucguccca

SEQ ID NO: 3740459 - RNA, 20 nt, Salmonella enterica enterica serovar Typhi Ty2
gaagcgcguuggcguuaccu

SEQ ID NO: 3740460 - RNA, 21 nt, Salmonella enterica enterica serovar Typhi Ty2
gaagcggaaaggacguucuuc

SEQ ID NO: 3740461 - RNA, 14 nt, Salmonella enterica enterica serovar Typhi Ty2
gaagcggacgggcg

SEQ ID NO: 3740462 - RNA, 16 nt, Salmonella enterica enterica serovar Typhi Ty2
gaagcgguaaaaccgg

SEQ ID NO: 3740463 - RNA, 18 nt, Salmonella enterica enterica serovar Typhi Ty2
gaagcguuucucuugugc

SEQ ID NO: 3740464 - RNA, 21 nt, Salmonella enterica enterica serovar Typhi Ty2
gaagcuacuugaucggcuggc

SEQ ID NO: 3740465 - RNA, 23 nt, Salmonella enterica enterica serovar Typhi Ty2
gaagcucaugugcagcauccagc

SEQ ID NO: 3740466 - RNA, 21 nt, Salmonella enterica enterica serovar Typhi Ty2
gaagcugaccagggcaaauua

SEQ ID NO: 3740467 - RNA, 14 nt, Salmonella enterica enterica serovar Typhi Ty2
gaagcugagaaaag

SEQ ID NO: 3740468 - RNA, 20 nt, Salmonella enterica enterica serovar Typhi Ty2
gaagcugcagggauaugcug

SEQ ID NO: 3740469 - RNA, 22 nt, Salmonella enterica enterica serovar Typhi Ty2
gaagcugcagggauaugcugau

SEQ ID NO: 3740470 - RNA, 15 nt, Salmonella enterica enterica serovar Typhi Ty2
gaagcugccguccca

SEQ ID NO: 3740471 - RNA, 17 nt, Salmonella enterica enterica serovar Typhi Ty2
gaagcugccgucccagc

SEQ ID NO: 3740472 - RNA, 12 nt, Salmonella enterica enterica serovar Typhi Ty2
gaaggacaagcu

SEQ ID NO: 3740473 - RNA, 14 nt, Salmonella enterica enterica serovar Typhi Ty2
gaaggagaaaacgg

SEQ ID NO: 3740474 - RNA, 20 nt, Salmonella enterica enterica serovar Typhi Ty2
gaaggagcaaugagauccac

SEQ ID NO: 3740475 - RNA, 19 nt, Salmonella enterica enterica serovar Typhi Ty2
gaaggauuauuggcaucau

SEQ ID NO: 3740476 - RNA, 15 nt, Salmonella enterica enterica serovar Typhi Ty2
gaaggcaacgccgcc

SEQ ID NO: 3740477 - RNA, 20 nt, Salmonella enterica enterica serovar Typhi Ty2
gaaggcaacugauccugcgu

SEQ ID NO: 3740478 - RNA, 13 nt, Salmonella enterica enterica serovar Typhi Ty2
gaaggcaggcugg

SEQ ID NO: 3740479 - RNA, 17 nt, Salmonella enterica enterica serovar Typhi Ty2
gaaggcaggcuggguuu

SEQ ID NO: 3740480 - RNA, 21 nt, Salmonella enterica enterica serovar Typhi Ty2
gaaggcaucuucagacaguuu

SEQ ID NO: 3740481 - RNA, 15 nt, Salmonella enterica enterica serovar Typhi Ty2
gaaggcgaaaacauu

SEQ ID NO: 3740482 - RNA, 11 nt, Salmonella enterica enterica serovar Typhi Ty2
gaaggcggcgg

SEQ ID NO: 3740483 - RNA, 17 nt, Salmonella enterica enterica serovar Typhi Ty2
gaaggcuaacagcuggc

SEQ ID NO: 3740484 - RNA, 14 nt, Salmonella enterica enterica serovar Typhi Ty2
gaaggcuccggcac

SEQ ID NO: 3740485 - RNA, 13 nt, Salmonella enterica enterica serovar Typhi Ty2
gaaggcuuuugcu

SEQ ID NO: 3740486 - RNA, 15 nt, Salmonella enterica enterica serovar Typhi Ty2
gaagggauucccauc

SEQ ID NO: 3740487 - RNA, 16 nt, Salmonella enterica enterica serovar Typhi Ty2
gaagggauucccaucc

SEQ ID NO: 3740488 - RNA, 17 nt, Salmonella enterica enterica serovar Typhi Ty2
gaagggcagaucgagga

SEQ ID NO: 3740489 - RNA, 22 nt, Salmonella enterica enterica serovar Typhi Ty2
gaagggguggcgaucguuguuu

SEQ ID NO: 3740490 - RNA, 15 nt, Salmonella enterica enterica serovar Typhi Ty2
gaaggucugacaacu

SEQ ID NO: 3740491 - RNA, 22 nt, Salmonella enterica enterica serovar Typhi Ty2
gaaguaaaggccguuaaaccaa

SEQ ID NO: 3740492 - RNA, 12 nt, Salmonella enterica enterica serovar Typhi Ty2
gaaguaaggcau

SEQ ID NO: 3740493 - RNA, 23 nt, Salmonella enterica enterica serovar Typhi Ty2
gaaguaaucguuagcgagguucc

SEQ ID NO: 3740494 - RNA, 18 nt, Salmonella enterica enterica serovar Typhi Ty2
gaaguauccuggaacaaa

SEQ ID NO: 3740495 - RNA, 18 nt, Salmonella enterica enterica serovar Typhi Ty2
gaagucagcuuccugcac

SEQ ID NO: 3740496 - RNA, 14 nt, Salmonella enterica enterica serovar Typhi Ty2
gaagucggaaaucu

SEQ ID NO: 3740497 - RNA, 19 nt, Salmonella enterica enterica serovar Typhi Ty2
gaagucugugagaaaagcg

SEQ ID NO: 3740498 - RNA, 18 nt, Salmonella enterica enterica serovar Typhi Ty2
gaagugauccuucaacgu

SEQ ID NO: 3740499 - RNA, 14 nt, Salmonella enterica enterica serovar Typhi Ty2
gaagugccagguuu

SEQ ID NO: 3740500 - RNA, 13 nt, Salmonella enterica enterica serovar Typhi Ty2
gaaguggcaaucg

SEQ ID NO: 3740501 - RNA, 20 nt, Salmonella enterica enterica serovar Typhi Ty2
gaaguggugggugaugacgg

SEQ ID NO: 3740502 - RNA, 13 nt, Salmonella enterica enterica serovar Typhi Ty2
gaaguuauccagc

SEQ ID NO: 3740503 - RNA, 15 nt, Salmonella enterica enterica serovar Typhi Ty2
gaaguugcuuccagu

SEQ ID NO: 3740504 - RNA, 16 nt, Salmonella enterica enterica serovar Typhi Ty2
gaaguuuaauucuuug

SEQ ID NO: 3740505 - RNA, 19 nt, Salmonella enterica enterica serovar Typhi Ty2
gaaguuuaauucuuugagc

SEQ ID NO: 3740506 - RNA, 16 nt, Salmonella enterica enterica serovar Typhi Ty2
gaaguuuugcuggaau

SEQ ID NO: 3740507 - RNA, 16 nt, Salmonella enterica enterica serovar Typhi Ty2
gaauaaaaccggcaua

SEQ ID NO: 3740508 - RNA, 13 nt, Salmonella enterica enterica serovar Typhi Ty2
gaauaaacgguaa

SEQ ID NO: 3740509 - RNA, 16 nt, Salmonella enterica enterica serovar Typhi Ty2
gaauaaagacacugcu

SEQ ID NO: 3740510 - RNA, 22 nt, Salmonella enterica enterica serovar Typhi Ty2
gaauaaaggauuguacuuauua

SEQ ID NO: 3740511 - RNA, 23 nt, Salmonella enterica enterica serovar Typhi Ty2
gaauaaaugaauuauuuuuucau

SEQ ID NO: 3740512 - RNA, 20 nt, Salmonella enterica enterica serovar Typhi Ty2
gaauaaccacugauggcugg

SEQ ID NO: 3740513 - RNA, 14 nt, Salmonella enterica enterica serovar Typhi Ty2
gaauaaccaucgga

SEQ ID NO: 3740514 - RNA, 23 nt, Salmonella enterica enterica serovar Typhi Ty2
gaauaacuccagugcagaaagug

SEQ ID NO: 3740515 - RNA, 19 nt, Salmonella enterica enterica serovar Typhi Ty2
gaauaagggugagagggga

SEQ ID NO: 3740516 - RNA, 22 nt, Salmonella enterica enterica serovar Typhi Ty2
gaauaaucaaccauacauccug

SEQ ID NO: 3740517 - RNA, 15 nt, Salmonella enterica enterica serovar Typhi Ty2
gaauaauccuucccg

SEQ ID NO: 3740518 - RNA, 15 nt, Salmonella enterica enterica serovar Typhi Ty2
gaauaaucgccgccg

SEQ ID NO: 3740519 - RNA, 18 nt, Salmonella enterica enterica serovar Typhi Ty2
gaauaaucgccgggcggc

SEQ ID NO: 3740520 - RNA, 16 nt, Salmonella enterica enterica serovar Typhi Ty2
gaauaauguaaaaaaa

SEQ ID NO: 3740521 - RNA, 21 nt, Salmonella enterica enterica serovar Typhi Ty2
gaauaauguugguauauucga

SEQ ID NO: 3740522 - RNA, 16 nt, Salmonella enterica enterica serovar Typhi Ty2
gaauacaaaaaagccg

SEQ ID NO: 3740523 - RNA, 12 nt, Salmonella enterica enterica serovar Typhi Ty2
gaauacacaaug

SEQ ID NO: 3740524 - RNA, 12 nt, Salmonella enterica enterica serovar Typhi Ty2
gaauaccacauc

SEQ ID NO: 3740525 - RNA, 12 nt, Salmonella enterica enterica serovar Typhi Ty2
gaauaccacugu

SEQ ID NO: 3740526 - RNA, 15 nt, Salmonella enterica enterica serovar Typhi Ty2
gaauacccaacugua

SEQ ID NO: 3740527 - RNA, 19 nt, Salmonella enterica enterica serovar Typhi Ty2
gaauacccgcccgguuuug

SEQ ID NO: 3740528 - RNA, 13 nt, Salmonella enterica enterica serovar Typhi Ty2
gaauaccuucccg

SEQ ID NO: 3740529 - RNA, 17 nt, Salmonella enterica enterica serovar Typhi Ty2
gaauaccuugauaacug

SEQ ID NO: 3740530 - RNA, 21 nt, Salmonella enterica enterica serovar Typhi Ty2
gaauacgcuccagcuggcugg

SEQ ID NO: 3740531 - RNA, 22 nt, Salmonella enterica enterica serovar Typhi Ty2
gaauacgcuccagcuggcuggc

SEQ ID NO: 3740532 - RNA, 19 nt, Salmonella enterica enterica serovar Typhi Ty2
gaauacgguccguuuucgc

SEQ ID NO: 3740533 - RNA, 22 nt, Salmonella enterica enterica serovar Typhi Ty2
gaauagacggccugcaaacgaa

SEQ ID NO: 3740534 - RNA, 23 nt, Salmonella enterica enterica serovar Typhi Ty2
gaauagcccucgguggauaaauu

SEQ ID NO: 3740535 - RNA, 17 nt, Salmonella enterica enterica serovar Typhi Ty2
gaauagcgaacagucca

SEQ ID NO: 3740536 - RNA, 22 nt, Salmonella enterica enterica serovar Typhi Ty2
gaauagcggcaguacgagcauc

SEQ ID NO: 3740537 - RNA, 20 nt, Salmonella enterica enterica serovar Typhi Ty2
gaauagcggcuaaucaccac

SEQ ID NO: 3740538 - RNA, 15 nt, Salmonella enterica enterica serovar Typhi Ty2
gaauagcguauuuuu

SEQ ID NO: 3740539 - RNA, 17 nt, Salmonella enterica enterica serovar Typhi Ty2
gaauagcuuacuuucag

SEQ ID NO: 3740540 - RNA, 15 nt, Salmonella enterica enterica serovar Typhi Ty2
gaauagugcaggaag

SEQ ID NO: 3740541 - RNA, 19 nt, Salmonella enterica enterica serovar Typhi Ty2
gaauaguuacggacaugcg

SEQ ID NO: 3740542 - RNA, 15 nt, Salmonella enterica enterica serovar Typhi Ty2
gaauaguuucaccuu

SEQ ID NO: 3740543 - RNA, 15 nt, Salmonella enterica enterica serovar Typhi Ty2
gaauaguuuugccca

SEQ ID NO: 3740544 - RNA, 18 nt, Salmonella enterica enterica serovar Typhi Ty2
gaauauaguuagaaaaua

SEQ ID NO: 3740545 - RNA, 15 nt, Salmonella enterica enterica serovar Typhi Ty2
gaauaucuucccgac

SEQ ID NO: 3740546 - RNA, 23 nt, Salmonella enterica enterica serovar Typhi Ty2
gaauaugagauugugcuuuagcu

SEQ ID NO: 3740547 - RNA, 15 nt, Salmonella enterica enterica serovar Typhi Ty2
gaauaugauuuaaaa

SEQ ID NO: 3740548 - RNA, 18 nt, Salmonella enterica enterica serovar Typhi Ty2
gaauaugauuuaaaaaag

SEQ ID NO: 3740549 - RNA, 13 nt, Salmonella enterica enterica serovar Typhi Ty2
gaauaugcagugc

SEQ ID NO: 3740550 - RNA, 20 nt, Salmonella enterica enterica serovar Typhi Ty2
gaauaugccaggggaagccg

SEQ ID NO: 3740551 - RNA, 16 nt, Salmonella enterica enterica serovar Typhi Ty2
gaauauucauuuccag

SEQ ID NO: 3740552 - RNA, 19 nt, Salmonella enterica enterica serovar Typhi Ty2
gaauauugcgccacgcugu

SEQ ID NO: 3740553 - RNA, 13 nt, Salmonella enterica enterica serovar Typhi Ty2
gaauuucaggaag

SEQ ID NO: 3740554 - RNA, 20 nt, Salmonella enterica enterica serovar Typhi Ty2
gaauuuccagcgggcgaucg

SEQ ID NO: 3740555 - RNA, 13 nt, Salmonella enterica enterica serovar Typhi Ty2
gaauuuccugcgc

SEQ ID NO: 3740556 - RNA, 19 nt, Salmonella enterica enterica serovar Typhi Ty2
gaauuucgcgaauaaucug

SEQ ID NO: 3740557 - RNA, 20 nt, Salmonella enterica enterica serovar Typhi Ty2
gaauuucugcugccagcgcc

SEQ ID NO: 3740558 - RNA, 18 nt, Salmonella enterica enterica serovar Typhi Ty2
gaauuugaacucuuucag

SEQ ID NO: 3740559 - RNA, 14 nt, Salmonella enterica enterica serovar Typhi Ty2
gaauuugccccaga

SEQ ID NO: 3740560 - RNA, 13 nt, Salmonella enterica enterica serovar Typhi Ty2
gacaaaaagcgcg

SEQ ID NO: 3740561 - RNA, 13 nt, Salmonella enterica enterica serovar Typhi Ty2
gacaaaaauacca

SEQ ID NO: 3740562 - RNA, 19 nt, Salmonella enterica enterica serovar Typhi Ty2
gacaaaagauuuaucaauu

SEQ ID NO: 3740563 - RNA, 21 nt, Salmonella enterica enterica serovar Typhi Ty2
gacaaaauaaagugaaauaaa

SEQ ID NO: 3740564 - RNA, 21 nt, Salmonella enterica enterica serovar Typhi Ty2
gacaaaaucuuuccagcucca

SEQ ID NO: 3740565 - RNA, 20 nt, Salmonella enterica enterica serovar Typhi Ty2
gacaaaccacugcuguacgc

SEQ ID NO: 3740566 - RNA, 14 nt, Salmonella enterica enterica serovar Typhi Ty2
gacaaacccuguau

SEQ ID NO: 3740567 - RNA, 17 nt, Salmonella enterica enterica serovar Typhi Ty2
gacaaaggcaagauccg

SEQ ID NO: 3740568 - RNA, 17 nt, Salmonella enterica enterica serovar Typhi Ty2
gacaaauaccuccuggc

SEQ ID NO: 3740569 - RNA, 16 nt, Salmonella enterica enterica serovar Typhi Ty2
gacaaauuguuuaaaa

SEQ ID NO: 3740570 - RNA, 20 nt, Salmonella enterica enterica serovar Typhi Ty2
gacaacacauccgcagcgaa

SEQ ID NO: 3740571 - RNA, 20 nt, Salmonella enterica enterica serovar Typhi Ty2
gacaacaucccagaaaauga

SEQ ID NO: 3740572 - RNA, 11 nt, Salmonella enterica enterica serovar Typhi Ty2
gacaaccagcg

SEQ ID NO: 3740573 - RNA, 15 nt, Salmonella enterica enterica serovar Typhi Ty2
gacaaccagcgaaau

SEQ ID NO: 3740574 - RNA, 15 nt, Salmonella enterica enterica serovar Typhi Ty2
gacaaccgccugcgu

SEQ ID NO: 3740575 - RNA, 14 nt, Salmonella enterica enterica serovar Typhi Ty2
gacaaccugcccuu

SEQ ID NO: 3740576 - RNA, 23 nt, Salmonella enterica enterica serovar Typhi Ty2
gacaaccugccguuuuccagccg

SEQ ID NO: 3740577 - RNA, 12 nt, Salmonella enterica enterica serovar Typhi Ty2
gacaacgcccac

SEQ ID NO: 3740578 - RNA, 17 nt, Salmonella enterica enterica serovar Typhi Ty2
gacaacgccgccuggca

SEQ ID NO: 3740579 - RNA, 19 nt, Salmonella enterica enterica serovar Typhi Ty2
gacaacgccgccuggcauc

SEQ ID NO: 3740580 - RNA, 23 nt, Salmonella enterica enterica serovar Typhi Ty2
gacaacgccgguacgcagcaggc

SEQ ID NO: 3740581 - RNA, 21 nt, Salmonella enterica enterica serovar Typhi Ty2
gacaacgcguuuauuauaaac

SEQ ID NO: 3740582 - RNA, 18 nt, Salmonella enterica enterica serovar Typhi Ty2
gacaacgcuccagcaguu

SEQ ID NO: 3740583 - RNA, 16 nt, Salmonella enterica enterica serovar Typhi Ty2
gacaacguaaacggca

SEQ ID NO: 3740584 - RNA, 22 nt, Salmonella enterica enterica serovar Typhi Ty2
gacaacguaaacggcagccgcc

SEQ ID NO: 3740585 - RNA, 23 nt, Salmonella enterica enterica serovar Typhi Ty2
gacaacguaaacggcagccgcca

SEQ ID NO: 3740586 - RNA, 18 nt, Salmonella enterica enterica serovar Typhi Ty2
gacaacguuuucagcagu

SEQ ID NO: 3740587 - RNA, 17 nt, Salmonella enterica enterica serovar Typhi Ty2
gacaagaaucacguaau

SEQ ID NO: 3740588 - RNA, 19 nt, Salmonella enterica enterica serovar Typhi Ty2
gacaaggcgguacgccgcc

SEQ ID NO: 3740589 - RNA, 11 nt, Salmonella enterica enterica serovar Typhi Ty2
gacaauagcgg

SEQ ID NO: 3740590 - RNA, 16 nt, Salmonella enterica enterica serovar Typhi Ty2
gacaauagcggacggc

SEQ ID NO: 3740591 - RNA, 18 nt, Salmonella enterica enterica serovar Typhi Ty2
gacaaucaccaucccaug

SEQ ID NO: 3740592 - RNA, 14 nt, Salmonella enterica enterica serovar Typhi Ty2
gacaaucagcacca

SEQ ID NO: 3740593 - RNA, 20 nt, Salmonella enterica enterica serovar Typhi Ty2
gacaauccgcgaaugguuca

SEQ ID NO: 3740594 - RNA, 17 nt, Salmonella enterica enterica serovar Typhi Ty2
gacaaucucaauaccac

SEQ ID NO: 3740595 - RNA, 19 nt, Salmonella enterica enterica serovar Typhi Ty2
gacaaucuccuccggcuuc

SEQ ID NO: 3740596 - RNA, 13 nt, Salmonella enterica enterica serovar Typhi Ty2
gacaaucugcugg

SEQ ID NO: 3740597 - RNA, 17 nt, Salmonella enterica enterica serovar Typhi Ty2
gacaauguccgccagac

SEQ ID NO: 3740598 - RNA, 15 nt, Salmonella enterica enterica serovar Typhi Ty2
gacaauuuucuucau

SEQ ID NO: 3740599 - RNA, 23 nt, Salmonella enterica enterica serovar Typhi Ty2
gacaauuuugauaagagaaaaua

SEQ ID NO: 3740600 - RNA, 18 nt, Salmonella enterica enterica serovar Typhi Ty2
gacacaaaucuguuaucu

SEQ ID NO: 3740601 - RNA, 19 nt, Salmonella enterica enterica serovar Typhi Ty2
gacacagcguacaauggca

SEQ ID NO: 3740602 - RNA, 21 nt, Salmonella enterica enterica serovar Typhi Ty2
gacacagcguacaauggcagg

SEQ ID NO: 3740603 - RNA, 18 nt, Salmonella enterica enterica serovar Typhi Ty2
gacacagcguuuaacuga

SEQ ID NO: 3740604 - RNA, 15 nt, Salmonella enterica enterica serovar Typhi Ty2
gacacaguaaaaaaa

SEQ ID NO: 3740605 - RNA, 20 nt, Salmonella enterica enterica serovar Typhi Ty2
gacacagucauugguaagag

SEQ ID NO: 3740606 - RNA, 17 nt, Salmonella enterica enterica serovar Typhi Ty2
gacacaugaccugaaua

SEQ ID NO: 3740607 - RNA, 15 nt, Salmonella enterica enterica serovar Typhi Ty2
gacacauuugauacu

SEQ ID NO: 3740608 - RNA, 13 nt, Salmonella enterica enterica serovar Typhi Ty2
gacaccacgcagg

SEQ ID NO: 3740609 - RNA, 23 nt, Salmonella enterica enterica serovar Typhi Ty2
gacacccgcagccagaacagaag

SEQ ID NO: 3740610 - RNA, 15 nt, Salmonella enterica enterica serovar Typhi Ty2
gacaccgcaaaccgu

SEQ ID NO: 3740611 - RNA, 21 nt, Salmonella enterica enterica serovar Typhi Ty2
gacacgcuaccuugagguggu

SEQ ID NO: 3740612 - RNA, 23 nt, Salmonella enterica enterica serovar Typhi Ty2
gacacggugugccgccaucagcg

SEQ ID NO: 3740613 - RNA, 17 nt, Salmonella enterica enterica serovar Typhi Ty2
gacacucauccagacca

SEQ ID NO: 3740614 - RNA, 18 nt, Salmonella enterica enterica serovar Typhi Ty2
gacacuugcaacucgcac

SEQ ID NO: 3740615 - RNA, 14 nt, Salmonella enterica enterica serovar Typhi Ty2
gacagaacugauuu

SEQ ID NO: 3740616 - RNA, 18 nt, Salmonella enterica enterica serovar Typhi Ty2
gacagaacugauuuccgg

SEQ ID NO: 3740617 - RNA, 18 nt, Salmonella enterica enterica serovar Typhi Ty2
gacagaagcugagaaaag

SEQ ID NO: 3740618 - RNA, 16 nt, Salmonella enterica enterica serovar Typhi Ty2
gacagaauaugcauau

SEQ ID NO: 3740619 - RNA, 15 nt, Salmonella enterica enterica serovar Typhi Ty2
gacagagcucgucaa

SEQ ID NO: 3740620 - RNA, 19 nt, Salmonella enterica enterica serovar Typhi Ty2
gacagagcucgucaaaaau

SEQ ID NO: 3740621 - RNA, 24 nt, Salmonella enterica enterica serovar Typhi Ty2
gacagaugcagguucccgcccugc

SEQ ID NO: 3740622 - RNA, 19 nt, Salmonella enterica enterica serovar Typhi Ty2
gacagauuggucagcagcc

SEQ ID NO: 3740623 - RNA, 16 nt, Salmonella enterica enterica serovar Typhi Ty2
gacagauuuggucagu

SEQ ID NO: 3740624 - RNA, 16 nt, Salmonella enterica enterica serovar Typhi Ty2
gacagauuuugcacuu

SEQ ID NO: 3740625 - RNA, 23 nt, Salmonella enterica enterica serovar Typhi Ty2
gacagauuuugcacuuuugccag

SEQ ID NO: 3740626 - RNA, 16 nt, Salmonella enterica enterica serovar Typhi Ty2
gacagcaagauuucaa

SEQ ID NO: 3740627 - RNA, 16 nt, Salmonella enterica enterica serovar Typhi Ty2
gacagcacauagccua

SEQ ID NO: 3740628 - RNA, 17 nt, Salmonella enterica enterica serovar Typhi Ty2
gacagcaccgccgggaa

SEQ ID NO: 3740629 - RNA, 19 nt, Salmonella enterica enterica serovar Typhi Ty2
gacagccaaacugcuguag

SEQ ID NO: 3740630 - RNA, 16 nt, Salmonella enterica enterica serovar Typhi Ty2
gacagccgaucaggcc

SEQ ID NO: 3740631 - RNA, 17 nt, Salmonella enterica enterica serovar Typhi Ty2
gacagccuauuaaucac

SEQ ID NO: 3740632 - RNA, 23 nt, Salmonella enterica enterica serovar Typhi Ty2
gacagcgacacuccgcgcaugua

SEQ ID NO: 3740633 - RNA, 13 nt, Salmonella enterica enterica serovar Typhi Ty2
gacagcgccauau

SEQ ID NO: 3740634 - RNA, 21 nt, Salmonella enterica enterica serovar Typhi Ty2
gacagcgccugaaaagagcga

SEQ ID NO: 3740635 - RNA, 18 nt, Salmonella enterica enterica serovar Typhi Ty2
gaccaguucaccggcggc

SEQ ID NO: 3740636 - RNA, 21 nt, Salmonella enterica enterica serovar Typhi Ty2
gaccaguucaccggcggccag

SEQ ID NO: 3740637 - RNA, 18 nt, Salmonella enterica enterica serovar Typhi Ty2
gaccauaaauagccgacc

SEQ ID NO: 3740638 - RNA, 16 nt, Salmonella enterica enterica serovar Typhi Ty2
gaccauaaaugaaaug

SEQ ID NO: 3740639 - RNA, 17 nt, Salmonella enterica enterica serovar Typhi Ty2
gaccauaauuuccggcg

SEQ ID NO: 3740640 - RNA, 19 nt, Salmonella enterica enterica serovar Typhi Ty2
gaccauacgcagcauuucg

SEQ ID NO: 3740641 - RNA, 14 nt, Salmonella enterica enterica serovar Typhi Ty2
gaccauauucacgc

SEQ ID NO: 3740642 - RNA, 19 nt, Salmonella enterica enterica serovar Typhi Ty2
gaccauauucacgcagcuu

SEQ ID NO: 3740643 - RNA, 17 nt, Salmonella enterica enterica serovar Typhi Ty2
gaccaucaagcauauca

SEQ ID NO: 3740644 - RNA, 12 nt, Salmonella enterica enterica serovar Typhi Ty2
gaccauccacca

SEQ ID NO: 3740645 - RNA, 14 nt, Salmonella enterica enterica serovar Typhi Ty2
gaccaucggccgcu

SEQ ID NO: 3740646 - RNA, 17 nt, Salmonella enterica enterica serovar Typhi Ty2
gaccaucggccgcuauc

SEQ ID NO: 3740647 - RNA, 15 nt, Salmonella enterica enterica serovar Typhi Ty2
gaccaucucuuccgc

SEQ ID NO: 3740648 - RNA, 15 nt, Salmonella enterica enterica serovar Typhi Ty2
gaccaucuuccaacu

SEQ ID NO: 3740649 - RNA, 21 nt, Salmonella enterica enterica serovar Typhi Ty2
gaccaugauaucgccaauggc

SEQ ID NO: 3740650 - RNA, 20 nt, Salmonella enterica enterica serovar Typhi Ty2
gaccauuaccauuccucacg

SEQ ID NO: 3740651 - RNA, 15 nt, Salmonella enterica enterica serovar Typhi Ty2
gaccauuccagguca

SEQ ID NO: 3740652 - RNA, 16 nt, Salmonella enterica enterica serovar Typhi Ty2
gaccauugauuuccgc

SEQ ID NO: 3740653 - RNA, 17 nt, Salmonella enterica enterica serovar Typhi Ty2
gaccauugcguauuuca

SEQ ID NO: 3740654 - RNA, 23 nt, Salmonella enterica enterica serovar Typhi Ty2
gacccacaguuucauauccgaca

SEQ ID NO: 3740655 - RNA, 17 nt, Salmonella enterica enterica serovar Typhi Ty2
gacccacgccagcagcu

SEQ ID NO: 3740656 - RNA, 19 nt, Salmonella enterica enterica serovar Typhi Ty2
gacccagcgcgaauuugcc

SEQ ID NO: 3740657 - RNA, 16 nt, Salmonella enterica enterica serovar Typhi Ty2
gacccaguacaaacaa

SEQ ID NO: 3740658 - RNA, 12 nt, Salmonella enterica enterica serovar Typhi Ty2
gacccauuuuaa

SEQ ID NO: 3740659 - RNA, 13 nt, Salmonella enterica enterica serovar Typhi Ty2
gaccccagauaau

SEQ ID NO: 3740660 - RNA, 22 nt, Salmonella enterica enterica serovar Typhi Ty2
gaccccauuaaacuggccccgc

SEQ ID NO: 3740661 - RNA, 18 nt, Salmonella enterica enterica serovar Typhi Ty2
gaccccggccucgcccgc

SEQ ID NO: 3740662 - RNA, 21 nt, Salmonella enterica enterica serovar Typhi Ty2
gaccccguccguucacuaacg

SEQ ID NO: 3740663 - RNA, 14 nt, Salmonella enterica enterica serovar Typhi Ty2
gaccccucuucuuu

SEQ ID NO: 3740664 - RNA, 14 nt, Salmonella enterica enterica serovar Typhi Ty2
gacccgaaguggug

SEQ ID NO: 3740665 - RNA, 22 nt, Salmonella enterica enterica serovar Typhi Ty2
gacccgcaaaccaggucugcgc

SEQ ID NO: 3740666 - RNA, 15 nt, Salmonella enterica enterica serovar Typhi Ty2
gacccgcaucagacc

SEQ ID NO: 3740667 - RNA, 17 nt, Salmonella enterica enterica serovar Typhi Ty2
gacccgccgccagcacc

SEQ ID NO: 3740668 - RNA, 21 nt, Salmonella enterica enterica serovar Typhi Ty2
gacccgcuuccaguuuugcca

SEQ ID NO: 3740669 - RNA, 22 nt, Salmonella enterica enterica serovar Typhi Ty2
gacccguuacgcagucagcacu

SEQ ID NO: 3740670 - RNA, 14 nt, Salmonella enterica enterica serovar Typhi Ty2
gaccgacaucgcca

SEQ ID NO: 3740671 - RNA, 17 nt, Salmonella enterica enterica serovar Typhi Ty2
gaccgagacccagcgcg

SEQ ID NO: 3740672 - RNA, 18 nt, Salmonella enterica enterica serovar Typhi Ty2
gaccgagacccagcgcga

SEQ ID NO: 3740673 - RNA, 13 nt, Salmonella enterica enterica serovar Typhi Ty2
gaccgagucuaca

SEQ ID NO: 3740674 - RNA, 23 nt, Salmonella enterica enterica serovar Typhi Ty2
gaccgagucuacaucaagagaaa

SEQ ID NO: 3740675 - RNA, 14 nt, Salmonella enterica enterica serovar Typhi Ty2
gaccgauaaauacc

SEQ ID NO: 3740676 - RNA, 23 nt, Salmonella enterica enterica serovar Typhi Ty2
gaccgauagagacugccgccguc

SEQ ID NO: 3740677 - RNA, 14 nt, Salmonella enterica enterica serovar Typhi Ty2
gaccgauauagcca

SEQ ID NO: 3740678 - RNA, 22 nt, Salmonella enterica enterica serovar Typhi Ty2
gaccgaucucaugcaacuggca

SEQ ID NO: 3740679 - RNA, 13 nt, Salmonella enterica enterica serovar Typhi Ty2
gaccgcaaaccga

SEQ ID NO: 3740680 - RNA, 15 nt, Salmonella enterica enterica serovar Typhi Ty2
gaccgcacagcagac

SEQ ID NO: 3740681 - RNA, 14 nt, Salmonella enterica enterica serovar Typhi Ty2
gaccgcagcuuauu

SEQ ID NO: 3740682 - RNA, 18 nt, Salmonella enterica enterica serovar Typhi Ty2
gaccgcagcuuauuccag

SEQ ID NO: 3740683 - RNA, 13 nt, Salmonella enterica enterica serovar Typhi Ty2
gaccgccagcaga

SEQ ID NO: 3740684 - RNA, 11 nt, Salmonella enterica enterica serovar Typhi Ty2
gaccgccauaa

SEQ ID NO: 3740685 - RNA, 10 nt, Salmonella enterica enterica serovar Typhi Ty2
gaccgccaug

SEQ ID NO: 3740686 - RNA, 23 nt, Salmonella enterica enterica serovar Typhi Ty2
gaccgcccaggauaucgcgggcg

SEQ ID NO: 3740687 - RNA, 22 nt, Salmonella enterica enterica serovar Typhi Ty2
gaccgccgaugcugaauagcca

SEQ ID NO: 3740688 - RNA, 18 nt, Salmonella enterica enterica serovar Typhi Ty2
gaccgccgcgcgucagca

SEQ ID NO: 3740689 - RNA, 18 nt, Salmonella enterica enterica serovar Typhi Ty2
gaccgccuaacagcgccg

SEQ ID NO: 3740690 - RNA, 22 nt, Salmonella enterica enterica serovar Typhi Ty2
gaccgccugcaucaccucagaa

SEQ ID NO: 3740691 - RNA, 15 nt, Salmonella enterica enterica serovar Typhi Ty2
gaccgcgcuguauca

SEQ ID NO: 3740692 - RNA, 17 nt, Salmonella enterica enterica serovar Typhi Ty2
gaccgcuuucccggcau

SEQ ID NO: 3740693 - RNA, 16 nt, Salmonella enterica enterica serovar Typhi Ty2
gaccggacguugaaaa

SEQ ID NO: 3740694 - RNA, 20 nt, Salmonella enterica enterica serovar Typhi Ty2
gaccggaugauggccuggcg

SEQ ID NO: 3740695 - RNA, 22 nt, Salmonella enterica enterica serovar Typhi Ty2
gaccggcacucaccucuuccgc

SEQ ID NO: 3740696 - RNA, 13 nt, Salmonella enterica enterica serovar Typhi Ty2
gaccggcccgcuu

SEQ ID NO: 3740697 - RNA, 22 nt, Salmonella enterica enterica serovar Typhi Ty2
gaccgggcugcacgccaucggc

SEQ ID NO: 3740698 - RNA, 21 nt, Salmonella enterica enterica serovar Typhi Ty2
gaccgggggcuggccacugga

SEQ ID NO: 3740699 - RNA, 19 nt, Salmonella enterica enterica serovar Typhi Ty2
gaccgguaagcccauggca

SEQ ID NO: 3740700 - RNA, 19 nt, Salmonella enterica enterica serovar Typhi Ty2
gaccgguccaccgggggcg

SEQ ID NO: 3740701 - RNA, 22 nt, Salmonella enterica enterica serovar Typhi Ty2
gaccguaguagguauccagcag

SEQ ID NO: 3740702 - RNA, 14 nt, Salmonella enterica enterica serovar Typhi Ty2
gaccguauccgcca

SEQ ID NO: 3740703 - RNA, 18 nt, Salmonella enterica enterica serovar Typhi Ty2
gaccgucaaacguccaua

SEQ ID NO: 3740704 - RNA, 16 nt, Salmonella enterica enterica serovar Typhi Ty2
gaccgucgcgcccucc

SEQ ID NO: 3740705 - RNA, 20 nt, Salmonella enterica enterica serovar Typhi Ty2
gaccgucgcgcccuccucca

SEQ ID NO: 3740706 - RNA, 19 nt, Salmonella enterica enterica serovar Typhi Ty2
gaccgugagaaucgaucag

SEQ ID NO: 3740707 - RNA, 15 nt, Salmonella enterica enterica serovar Typhi Ty2
gaccguuagcgacgg

SEQ ID NO: 3740708 - RNA, 15 nt, Salmonella enterica enterica serovar Typhi Ty2
gaccguuucaaagaa

SEQ ID NO: 3740709 - RNA, 20 nt, Salmonella enterica enterica serovar Typhi Ty2
gaccguuuucaacgccgcgc

SEQ ID NO: 3740710 - RNA, 17 nt, Salmonella enterica enterica serovar Typhi Ty2
gaccuaaaguaaaggaa

SEQ ID NO: 3740711 - RNA, 12 nt, Salmonella enterica enterica serovar Typhi Ty2
gaccucaagaau

SEQ ID NO: 3740712 - RNA, 13 nt, Salmonella enterica enterica serovar Typhi Ty2
gaccucaauccgu

SEQ ID NO: 3740713 - RNA, 14 nt, Salmonella enterica enterica serovar Typhi Ty2
gaccucaucaaaca

SEQ ID NO: 3740714 - RNA, 21 nt, Salmonella enterica enterica serovar Typhi Ty2
gaccucauccaucagcgcggg

SEQ ID NO: 3740715 - RNA, 13 nt, Salmonella enterica enterica serovar Typhi Ty2
gaccuccgcguac

SEQ ID NO: 3740716 - RNA, 21 nt, Salmonella enterica enterica serovar Typhi Ty2
gaccucuucuuugagcucccg

SEQ ID NO: 3740717 - RNA, 11 nt, Salmonella enterica enterica serovar Typhi Ty2
gacggagaaaa

SEQ ID NO: 3740718 - RNA, 12 nt, Salmonella enterica enterica serovar Typhi Ty2
gacggagaaaaa

SEQ ID NO: 3740719 - RNA, 18 nt, Salmonella enterica enterica serovar Typhi Ty2
gacggagaugaucguuuc

SEQ ID NO: 3740720 - RNA, 16 nt, Salmonella enterica enterica serovar Typhi Ty2
gacggauucuuccucu

SEQ ID NO: 3740721 - RNA, 22 nt, Salmonella enterica enterica serovar Typhi Ty2
gacggcaacggcgacaagaaua

SEQ ID NO: 3740722 - RNA, 22 nt, Salmonella enterica enterica serovar Typhi Ty2
gacggcaauagaacgucgcgcg

SEQ ID NO: 3740723 - RNA, 14 nt, Salmonella enterica enterica serovar Typhi Ty2
gacggcagccacgc

SEQ ID NO: 3740724 - RNA, 13 nt, Salmonella enterica enterica serovar Typhi Ty2
gacggcaucagga

SEQ ID NO: 3740725 - RNA, 13 nt, Salmonella enterica enterica serovar Typhi Ty2
gacggccaccagc

SEQ ID NO: 3740726 - RNA, 22 nt, Salmonella enterica enterica serovar Typhi Ty2
gacggccucuucacgcagcgcc

SEQ ID NO: 3740727 - RNA, 15 nt, Salmonella enterica enterica serovar Typhi Ty2
gacggccugucuccu

SEQ ID NO: 3740728 - RNA, 22 nt, Salmonella enterica enterica serovar Typhi Ty2
gacggcguauucggcauagcgc

SEQ ID NO: 3740729 - RNA, 20 nt, Salmonella enterica enterica serovar Typhi Ty2
gacggcuaauaugccaggcu

SEQ ID NO: 3740730 - RNA, 15 nt, Salmonella enterica enterica serovar Typhi Ty2
gacggcuucacugcc

SEQ ID NO: 3740731 - RNA, 18 nt, Salmonella enterica enterica serovar Typhi Ty2
gacgggacgaauuuccag

SEQ ID NO: 3740732 - RNA, 23 nt, Salmonella enterica enterica serovar Typhi Ty2
gacgggacgaauuuccagcgggc

SEQ ID NO: 3740733 - RNA, 22 nt, Salmonella enterica enterica serovar Typhi Ty2
gacgggaucgaaccgccgaccc

SEQ ID NO: 3740734 - RNA, 14 nt, Salmonella enterica enterica serovar Typhi Ty2
gacgggauuaaaug

SEQ ID NO: 3740735 - RNA, 21 nt, Salmonella enterica enterica serovar Typhi Ty2
gacgggauuaaaugacgcccu

SEQ ID NO: 3740736 - RNA, 22 nt, Salmonella enterica enterica serovar Typhi Ty2
gacgggcaagguuaugcagcau

SEQ ID NO: 3740737 - RNA, 12 nt, Salmonella enterica enterica serovar Typhi Ty2
gacgggccaggc

SEQ ID NO: 3740738 - RNA, 22 nt, Salmonella enterica enterica serovar Typhi Ty2
gacgggccgccaucuccggcag

SEQ ID NO: 3740739 - RNA, 20 nt, Salmonella enterica enterica serovar Typhi Ty2
gacgggcggcgacagagaau

SEQ ID NO: 3740740 - RNA, 23 nt, Salmonella enterica enterica serovar Typhi Ty2
gacgggggcgaucagcaggucag

SEQ ID NO: 3740741 - RNA, 19 nt, Salmonella enterica enterica serovar Typhi Ty2
gacgguaccugaagccauc

SEQ ID NO: 3740742 - RNA, 17 nt, Salmonella enterica enterica serovar Typhi Ty2
gacgguccuggccaggc

SEQ ID NO: 3740743 - RNA, 14 nt, Salmonella enterica enterica serovar Typhi Ty2
gacggugagcugaa

SEQ ID NO: 3740744 - RNA, 15 nt, Salmonella enterica enterica serovar Typhi Ty2
gacggugcucaugac

SEQ ID NO: 3740745 - RNA, 13 nt, Salmonella enterica enterica serovar Typhi Ty2
gacgguuuucacu

SEQ ID NO: 3740746 - RNA, 18 nt, Salmonella enterica enterica serovar Typhi Ty2
gacguaacugucuuaucc

SEQ ID NO: 3740747 - RNA, 22 nt, Salmonella enterica enterica serovar Typhi Ty2
gacguaacugucuuauccggcc

SEQ ID NO: 3740748 - RNA, 12 nt, Salmonella enterica enterica serovar Typhi Ty2
gacguacaaaca

SEQ ID NO: 3740749 - RNA, 23 nt, Salmonella enterica enterica serovar Typhi Ty2
gacgucaagaucgcgcagcaggc

SEQ ID NO: 3740750 - RNA, 11 nt, Salmonella enterica enterica serovar Typhi Ty2
gacguccagac

SEQ ID NO: 3740751 - RNA, 13 nt, Salmonella enterica enterica serovar Typhi Ty2
gacgucgccauau

SEQ ID NO: 3740752 - RNA, 18 nt, Salmonella enterica enterica serovar Typhi Ty2
gacgucgccauauccaag

SEQ ID NO: 3740753 - RNA, 13 nt, Salmonella enterica enterica serovar Typhi Ty2
gacgugauaauaa

SEQ ID NO: 3740754 - RNA, 20 nt, Salmonella enterica enterica serovar Typhi Ty2
gacgugauuuuggcagcccg

SEQ ID NO: 3740755 - RNA, 18 nt, Salmonella enterica enterica serovar Typhi Ty2
gacgugccuuccaucggc

SEQ ID NO: 3740756 - RNA, 19 nt, Salmonella enterica enterica serovar Typhi Ty2
gacgugccuuccaucggcc

SEQ ID NO: 3740757 - RNA, 19 nt, Salmonella enterica enterica serovar Typhi Ty2
gacguggauauucaucagu

SEQ ID NO: 3740758 - RNA, 17 nt, Salmonella enterica enterica serovar Typhi Ty2
gacguggggguucaagu

SEQ ID NO: 3740759 - RNA, 17 nt, Salmonella enterica enterica serovar Typhi Ty2
gacgugugauuguggcg

SEQ ID NO: 3740760 - RNA, 15 nt, Salmonella enterica enterica serovar Typhi Ty2
gacguuaucucgcca

SEQ ID NO: 3740761 - RNA, 19 nt, Salmonella enterica enterica serovar Typhi Ty2
gacguucagcauauccagc

SEQ ID NO: 3740762 - RNA, 13 nt, Salmonella enterica enterica serovar Typhi Ty2
gacguuccgcgac

SEQ ID NO: 3740763 - RNA, 19 nt, Salmonella enterica enterica serovar Typhi Ty2
gacguugaucgccaucgcg

SEQ ID NO: 3740764 - RNA, 15 nt, Salmonella enterica enterica serovar Typhi Ty2
gacguuuauacccca

SEQ ID NO: 3740765 - RNA, 18 nt, Salmonella enterica enterica serovar Typhi Ty2
gacguuuaugccgccauc

SEQ ID NO: 3740766 - RNA, 22 nt, Salmonella enterica enterica serovar Typhi Ty2
gacuaaaaagcgcguccccggu

SEQ ID NO: 3740767 - RNA, 14 nt, Salmonella enterica enterica serovar Typhi Ty2
gacuaaaacgugcu

SEQ ID NO: 3740768 - RNA, 19 nt, Salmonella enterica enterica serovar Typhi Ty2
gacuacgguaaaccaggcc

SEQ ID NO: 3740769 - RNA, 15 nt, Salmonella enterica enterica serovar Typhi Ty2
gacuacguucaucag

SEQ ID NO: 3740770 - RNA, 16 nt, Salmonella enterica enterica serovar Typhi Ty2
gacuacguucaucagg

SEQ ID NO: 3740771 - RNA, 16 nt, Salmonella enterica enterica serovar Typhi Ty2
gacuagacagccucuc

SEQ ID NO: 3740772 - RNA, 16 nt, Salmonella enterica enterica serovar Typhi Ty2
gacuauacccaaaaua

SEQ ID NO: 3740773 - RNA, 18 nt, Salmonella enterica enterica serovar Typhi Ty2
gacuauccagccagggau

SEQ ID NO: 3740774 - RNA, 18 nt, Salmonella enterica enterica serovar Typhi Ty2
gacuauccguccucuuuc

SEQ ID NO: 3740775 - RNA, 14 nt, Salmonella enterica enterica serovar Typhi Ty2
gacuaucgucaccc

SEQ ID NO: 3740776 - RNA, 19 nt, Salmonella enterica enterica serovar Typhi Ty2
gacuauucgcuaucagaau

SEQ ID NO: 3740777 - RNA, 15 nt, Salmonella enterica enterica serovar Typhi Ty2
gacuauugcugagcu

SEQ ID NO: 3740778 - RNA, 15 nt, Salmonella enterica enterica serovar Typhi Ty2
gacucagcagcgcau

SEQ ID NO: 3740779 - RNA, 12 nt, Salmonella enterica enterica serovar Typhi Ty2
gacucagccagg

SEQ ID NO: 3740780 - RNA, 13 nt, Salmonella enterica enterica serovar Typhi Ty2
gacucagccaggu

SEQ ID NO: 3740781 - RNA, 16 nt, Salmonella enterica enterica serovar Typhi Ty2
gacucaggccuuuuua

SEQ ID NO: 3740782 - RNA, 19 nt, Salmonella enterica enterica serovar Typhi Ty2
gacucaucgccgcaaugac

SEQ ID NO: 3740783 - RNA, 18 nt, Salmonella enterica enterica serovar Typhi Ty2
gacucauuaaaaaaacau

SEQ ID NO: 3740784 - RNA, 20 nt, Salmonella enterica enterica serovar Typhi Ty2
gacucauucagcaacugcgu

SEQ ID NO: 3740785 - RNA, 22 nt, Salmonella enterica enterica serovar Typhi Ty2
gacuccagcaacgcugcauccu

SEQ ID NO: 3740786 - RNA, 23 nt, Salmonella enterica enterica serovar Typhi Ty2
gacuccccacaaucccgccagac

SEQ ID NO: 3740787 - RNA, 23 nt, Salmonella enterica enterica serovar Typhi Ty2
gacucgcuggacauuaagcguaa

SEQ ID NO: 3740788 - RNA, 18 nt, Salmonella enterica enterica serovar Typhi Ty2
gacucucaaugcccaucu

SEQ ID NO: 3740789 - RNA, 18 nt, Salmonella enterica enterica serovar Typhi Ty2
gacucugaagcgggaaag

SEQ ID NO: 3740790 - RNA, 19 nt, Salmonella enterica enterica serovar Typhi Ty2
gacucugaagcgggaaagc

SEQ ID NO: 3740791 - RNA, 23 nt, Salmonella enterica enterica serovar Typhi Ty2
gacucugaagcgggaaagcguaa

SEQ ID NO: 3740792 - RNA, 19 nt, Salmonella enterica enterica serovar Typhi Ty2
gacucuguggccgcgcaug

SEQ ID NO: 3740793 - RNA, 17 nt, Salmonella enterica enterica serovar Typhi Ty2
gacucuuuuuucagaau

SEQ ID NO: 3740794 - RNA, 18 nt, Salmonella enterica enterica serovar Typhi Ty2
gacucuuuuuucagaaua

SEQ ID NO: 3740795 - RNA, 14 nt, Salmonella enterica enterica serovar Typhi Ty2
gacugaaaaucaaa

SEQ ID NO: 3740796 - RNA, 19 nt, Salmonella enterica enterica serovar Typhi Ty2
gacugaaaaucaaaaacau

SEQ ID NO: 3740797 - RNA, 11 nt, Salmonella enterica enterica serovar Typhi Ty2
gacugaacaua

SEQ ID NO: 3740798 - RNA, 16 nt, Salmonella enterica enterica serovar Typhi Ty2
gacugaaccuucacgc

SEQ ID NO: 3740799 - RNA, 14 nt, Salmonella enterica enterica serovar Typhi Ty2
gagacucagcagcg

SEQ ID NO: 3740800 - RNA, 13 nt, Salmonella enterica enterica serovar Typhi Ty2
gagacugauaaug

SEQ ID NO: 3740801 - RNA, 13 nt, Salmonella enterica enterica serovar Typhi Ty2
gagacugccgccg

SEQ ID NO: 3740802 - RNA, 15 nt, Salmonella enterica enterica serovar Typhi Ty2
gagacuguuugucuc

SEQ ID NO: 3740803 - RNA, 12 nt, Salmonella enterica enterica serovar Typhi Ty2
gagagaaaaaaa

SEQ ID NO: 3740804 - RNA, 18 nt, Salmonella enterica enterica serovar Typhi Ty2
gagagaaaaaaauccagu

SEQ ID NO: 3740805 - RNA, 22 nt, Salmonella enterica enterica serovar Typhi Ty2
gagagacguucauuucuuccag

SEQ ID NO: 3740806 - RNA, 19 nt, Salmonella enterica enterica serovar Typhi Ty2
gagagaguauaagcgccgc

SEQ ID NO: 3740807 - RNA, 17 nt, Salmonella enterica enterica serovar Typhi Ty2
gagagcaacauaccgca

SEQ ID NO: 3740808 - RNA, 13 nt, Salmonella enterica enterica serovar Typhi Ty2
gagagcaacuggc

SEQ ID NO: 3740809 - RNA, 15 nt, Salmonella enterica enterica serovar Typhi Ty2
gagagcagcgccagc

SEQ ID NO: 3740810 - RNA, 18 nt, Salmonella enterica enterica serovar Typhi Ty2
gagagcaucaucugccau

SEQ ID NO: 3740811 - RNA, 19 nt, Salmonella enterica enterica serovar Typhi Ty2
gagagccuuacaggcgcau

SEQ ID NO: 3740812 - RNA, 13 nt, Salmonella enterica enterica serovar Typhi Ty2
gagagcgauaucg

SEQ ID NO: 3740813 - RNA, 18 nt, Salmonella enterica enterica serovar Typhi Ty2
gagagcguauccagcacc

SEQ ID NO: 3740814 - RNA, 19 nt, Salmonella enterica enterica serovar Typhi Ty2
gagagcguauccagcaccu

SEQ ID NO: 3740815 - RNA, 18 nt, Salmonella enterica enterica serovar Typhi Ty2
gagaggccaccagcgcca

SEQ ID NO: 3740816 - RNA, 19 nt, Salmonella enterica enterica serovar Typhi Ty2
gagaggccaccagcgccag

SEQ ID NO: 3740817 - RNA, 20 nt, Salmonella enterica enterica serovar Typhi Ty2
gagaguaaaaccggcacauc

SEQ ID NO: 3740818 - RNA, 14 nt, Salmonella enterica enterica serovar Typhi Ty2
gagaguccagcgcc

SEQ ID NO: 3740819 - RNA, 18 nt, Salmonella enterica enterica serovar Typhi Ty2
gagagucgauacgcugaa

SEQ ID NO: 3740820 - RNA, 13 nt, Salmonella enterica enterica serovar Typhi Ty2
gagagucgccagg

SEQ ID NO: 3740821 - RNA, 20 nt, Salmonella enterica enterica serovar Typhi Ty2
gagagucgccaggaucgccg

SEQ ID NO: 3740822 - RNA, 17 nt, Salmonella enterica enterica serovar Typhi Ty2
gagaguugcuuuccguu

SEQ ID NO: 3740823 - RNA, 19 nt, Salmonella enterica enterica serovar Typhi Ty2
gagauaauagcugaacaua

SEQ ID NO: 3740824 - RNA, 15 nt, Salmonella enterica enterica serovar Typhi Ty2
gagauaauuuaugau

SEQ ID NO: 3740825 - RNA, 20 nt, Salmonella enterica enterica serovar Typhi Ty2
gagauaguugagcagcgcga

SEQ ID NO: 3740826 - RNA, 15 nt, Salmonella enterica enterica serovar Typhi Ty2
gagaucagcaguugc

SEQ ID NO: 3740827 - RNA, 18 nt, Salmonella enterica enterica serovar Typhi Ty2
gagaucaucggaacggau

SEQ ID NO: 3740828 - RNA, 21 nt, Salmonella enterica enterica serovar Typhi Ty2
gagaucgacaaaccacugcug

SEQ ID NO: 3740829 - RNA, 18 nt, Salmonella enterica enterica serovar Typhi Ty2
gagaucgguaauuuccac

SEQ ID NO: 3740830 - RNA, 20 nt, Salmonella enterica enterica serovar Typhi Ty2
gagaucgguaauuuccacgc

SEQ ID NO: 3740831 - RNA, 13 nt, Salmonella enterica enterica serovar Typhi Ty2
gagaucuccagau

SEQ ID NO: 3740832 - RNA, 18 nt, Salmonella enterica enterica serovar Typhi Ty2
gagaugaucguuuccagc

SEQ ID NO: 3740833 - RNA, 18 nt, Salmonella enterica enterica serovar Typhi Ty2
gagaugcagacaauuucc

SEQ ID NO: 3740834 - RNA, 17 nt, Salmonella enterica enterica serovar Typhi Ty2
gagaugcaggccaagca

SEQ ID NO: 3740835 - RNA, 20 nt, Salmonella enterica enterica serovar Typhi Ty2
gagauguuuuaccaguacaa

SEQ ID NO: 3740836 - RNA, 23 nt, Salmonella enterica enterica serovar Typhi Ty2
gagauuacugcgugcuggcggcc

SEQ ID NO: 3740837 - RNA, 17 nt, Salmonella enterica enterica serovar Typhi Ty2
gagauucugcaggccaa

SEQ ID NO: 3740838 - RNA, 15 nt, Salmonella enterica enterica serovar Typhi Ty2
gagauuuaucuucuc

SEQ ID NO: 3740839 - RNA, 20 nt, Salmonella enterica enterica serovar Typhi Ty2
gagcaaaccgacccaaaaau

SEQ ID NO: 3740840 - RNA, 14 nt, Salmonella enterica enterica serovar Typhi Ty2
gagcaaauacugga

SEQ ID NO: 3740841 - RNA, 17 nt, Salmonella enterica enterica serovar Typhi Ty2
gagcaacagaaaccaua

SEQ ID NO: 3740842 - RNA, 20 nt, Salmonella enterica enterica serovar Typhi Ty2
gagcaacagaaaccauaaac

SEQ ID NO: 3740843 - RNA, 19 nt, Salmonella enterica enterica serovar Typhi Ty2
gagcaacgccaucagcaaa

SEQ ID NO: 3740844 - RNA, 20 nt, Salmonella enterica enterica serovar Typhi Ty2
gagcaacguuuugcacagug

SEQ ID NO: 3740845 - RNA, 15 nt, Salmonella enterica enterica serovar Typhi Ty2
gagcaauggcguggc

SEQ ID NO: 3740846 - RNA, 15 nt, Salmonella enterica enterica serovar Typhi Ty2
gagcaccacgcgggc

SEQ ID NO: 3740847 - RNA, 23 nt, Salmonella enterica enterica serovar Typhi Ty2
gagcacuaauauucgauuuaaug

SEQ ID NO: 3740848 - RNA, 22 nt, Salmonella enterica enterica serovar Typhi Ty2
gagcacuucugacauucagcgc

SEQ ID NO: 3740849 - RNA, 18 nt, Salmonella enterica enterica serovar Typhi Ty2
gagcagauuuuucgccag

SEQ ID NO: 3740850 - RNA, 16 nt, Salmonella enterica enterica serovar Typhi Ty2
gagcagcaacccugcc

SEQ ID NO: 3740851 - RNA, 19 nt, Salmonella enterica enterica serovar Typhi Ty2
gagcagcgccagcgacaga

SEQ ID NO: 3740852 - RNA, 16 nt, Salmonella enterica enterica serovar Typhi Ty2
gagcagcuuggcggcu

SEQ ID NO: 3740853 - RNA, 13 nt, Salmonella enterica enterica serovar Typhi Ty2
gagcaggggccgg

SEQ ID NO: 3740854 - RNA, 22 nt, Salmonella enterica enterica serovar Typhi Ty2
gagcaggggcuccugcgccgga

SEQ ID NO: 3740855 - RNA, 19 nt, Salmonella enterica enterica serovar Typhi Ty2
gagcagguuacucuuccac

SEQ ID NO: 3740856 - RNA, 15 nt, Salmonella enterica enterica serovar Typhi Ty2
gagcagucguugcgc

SEQ ID NO: 3740857 - RNA, 19 nt, Salmonella enterica enterica serovar Typhi Ty2
gagcagucguugcgccugu

SEQ ID NO: 3740858 - RNA, 20 nt, Salmonella enterica enterica serovar Typhi Ty2
gagcagucguugcgccuguu

SEQ ID NO: 3740859 - RNA, 18 nt, Salmonella enterica enterica serovar Typhi Ty2
gagcagugauuuuaucuc

SEQ ID NO: 3740860 - RNA, 15 nt, Salmonella enterica enterica serovar Typhi Ty2
gagcauaugcgcugc

SEQ ID NO: 3740861 - RNA, 22 nt, Salmonella enterica enterica serovar Typhi Ty2
gagcaugguccggugcguucug

SEQ ID NO: 3740862 - RNA, 14 nt, Salmonella enterica enterica serovar Typhi Ty2
gagcauuggaaauu

SEQ ID NO: 3740863 - RNA, 16 nt, Salmonella enterica enterica serovar Typhi Ty2
gagcauuuccgcagcc

SEQ ID NO: 3740864 - RNA, 14 nt, Salmonella enterica enterica serovar Typhi Ty2
gagccaaugaccau

SEQ ID NO: 3740865 - RNA, 21 nt, Salmonella enterica enterica serovar Typhi Ty2
gagccacgcggcaucaggcau

SEQ ID NO: 3740866 - RNA, 19 nt, Salmonella enterica enterica serovar Typhi Ty2
gagccacuauccagucagc

SEQ ID NO: 3740867 - RNA, 22 nt, Salmonella enterica enterica serovar Typhi Ty2
gagccauaacaacuauuuuucc

SEQ ID NO: 3740868 - RNA, 19 nt, Salmonella enterica enterica serovar Typhi Ty2
gagccauuaaugcaggcag

SEQ ID NO: 3740869 - RNA, 21 nt, Salmonella enterica enterica serovar Typhi Ty2
gagcccugugcgguauugaua

SEQ ID NO: 3740870 - RNA, 14 nt, Salmonella enterica enterica serovar Typhi Ty2
gagccgccauccgg

SEQ ID NO: 3740871 - RNA, 20 nt, Salmonella enterica enterica serovar Typhi Ty2
gagccgcccggcgcgcugga

SEQ ID NO: 3740872 - RNA, 13 nt, Salmonella enterica enterica serovar Typhi Ty2
gagccgcugcuca

SEQ ID NO: 3740873 - RNA, 23 nt, Salmonella enterica enterica serovar Typhi Ty2
gagccggacacugcgagggauuu

SEQ ID NO: 3740874 - RNA, 19 nt, Salmonella enterica enterica serovar Typhi Ty2
gagccguaaacggaaccaa

SEQ ID NO: 3740875 - RNA, 14 nt, Salmonella enterica enterica serovar Typhi Ty2
gagccgucgccggc

SEQ ID NO: 3740876 - RNA, 17 nt, Salmonella enterica enterica serovar Typhi Ty2
gagccgucgcuaucaau

SEQ ID NO: 3740877 - RNA, 23 nt, Salmonella enterica enterica serovar Typhi Ty2
gagccucugcgggacgcaucauc

SEQ ID NO: 3740878 - RNA, 17 nt, Salmonella enterica enterica serovar Typhi Ty2
gagccuguuccagcugc

SEQ ID NO: 3740879 - RNA, 23 nt, Salmonella enterica enterica serovar Typhi Ty2
gagcgaacggcuuuccagcagcc

SEQ ID NO: 3740880 - RNA, 13 nt, Salmonella enterica enterica serovar Typhi Ty2
gagcgaaggggcg

SEQ ID NO: 3740881 - RNA, 18 nt, Salmonella enterica enterica serovar Typhi Ty2
gagucagaaacggccugg

SEQ ID NO: 3740882 - RNA, 20 nt, Salmonella enterica enterica serovar Typhi Ty2
gaguccauauccguacauaa

SEQ ID NO: 3740883 - RNA, 16 nt, Salmonella enterica enterica serovar Typhi Ty2
gaguccugccggacug

SEQ ID NO: 3740884 - RNA, 21 nt, Salmonella enterica enterica serovar Typhi Ty2
gagucgacugguaggccugau

SEQ ID NO: 3740885 - RNA, 12 nt, Salmonella enterica enterica serovar Typhi Ty2
gagucguuaucc

SEQ ID NO: 3740886 - RNA, 14 nt, Salmonella enterica enterica serovar Typhi Ty2
gagucuacaucaag

SEQ ID NO: 3740887 - RNA, 19 nt, Salmonella enterica enterica serovar Typhi Ty2
gagucuacaucaagagaaa

SEQ ID NO: 3740888 - RNA, 14 nt, Salmonella enterica enterica serovar Typhi Ty2
gagucuauuuccuc

SEQ ID NO: 3740889 - RNA, 19 nt, Salmonella enterica enterica serovar Typhi Ty2
gagucugaaaacucacgcc

SEQ ID NO: 3740890 - RNA, 20 nt, Salmonella enterica enterica serovar Typhi Ty2
gagucuuauccgacugacca

SEQ ID NO: 3740891 - RNA, 19 nt, Salmonella enterica enterica serovar Typhi Ty2
gagugcguucuuccacuuc

SEQ ID NO: 3740892 - RNA, 17 nt, Salmonella enterica enterica serovar Typhi Ty2
gaguggagcggucgaca

SEQ ID NO: 3740893 - RNA, 19 nt, Salmonella enterica enterica serovar Typhi Ty2
gaguguggaaaacagcgcc

SEQ ID NO: 3740894 - RNA, 16 nt, Salmonella enterica enterica serovar Typhi Ty2
gaguguuggucuuggu

SEQ ID NO: 3740895 - RNA, 17 nt, Salmonella enterica enterica serovar Typhi Ty2
gaguuaaugccaucauc

SEQ ID NO: 3740896 - RNA, 18 nt, Salmonella enterica enterica serovar Typhi Ty2
gaguuaaugccaucauca

SEQ ID NO: 3740897 - RNA, 20 nt, Salmonella enterica enterica serovar Typhi Ty2
gaguuaaugccaucaucagu

SEQ ID NO: 3740898 - RNA, 17 nt, Salmonella enterica enterica serovar Typhi Ty2
gaguuaguggucauauu

SEQ ID NO: 3740899 - RNA, 12 nt, Salmonella enterica enterica serovar Typhi Ty2
gaguuccuccug

SEQ ID NO: 3740900 - RNA, 18 nt, Salmonella enterica enterica serovar Typhi Ty2
gaguucguuaaucucaaa

SEQ ID NO: 3740901 - RNA, 16 nt, Salmonella enterica enterica serovar Typhi Ty2
gaguuugcaauccaga

SEQ ID NO: 3740902 - RNA, 14 nt, Salmonella enterica enterica serovar Typhi Ty2
gaguuugucaucca

SEQ ID NO: 3740903 - RNA, 10 nt, Salmonella enterica enterica serovar Typhi Ty2
gaguuuuaac

SEQ ID NO: 3740904 - RNA, 17 nt, Salmonella enterica enterica serovar Typhi Ty2
gaguuuuuuauggcaga

SEQ ID NO: 3740905 - RNA, 11 nt, Salmonella enterica enterica serovar Typhi Ty2
gauaaaaaaag

SEQ ID NO: 3740906 - RNA, 14 nt, Salmonella enterica enterica serovar Typhi Ty2
gauaaaaaaaguau

SEQ ID NO: 3740907 - RNA, 16 nt, Salmonella enterica enterica serovar Typhi Ty2
gauaaaaaaaguaucc

SEQ ID NO: 3740908 - RNA, 16 nt, Salmonella enterica enterica serovar Typhi Ty2
gauaaaaagacagaua

SEQ ID NO: 3740909 - RNA, 16 nt, Salmonella enterica enterica serovar Typhi Ty2
gauaaaaagcaaagag

SEQ ID NO: 3740910 - RNA, 15 nt, Salmonella enterica enterica serovar Typhi Ty2
gauaaaauaaacacu

SEQ ID NO: 3740911 - RNA, 13 nt, Salmonella enterica enterica serovar Typhi Ty2
gauaaaauuguua

SEQ ID NO: 3740912 - RNA, 14 nt, Salmonella enterica enterica serovar Typhi Ty2
gauaaacagcagcg

SEQ ID NO: 3740913 - RNA, 18 nt, Salmonella enterica enterica serovar Typhi Ty2
gauaaacagguaaaacaa

SEQ ID NO: 3740914 - RNA, 15 nt, Salmonella enterica enterica serovar Typhi Ty2
gauaaaccaacagcc

SEQ ID NO: 3740915 - RNA, 21 nt, Salmonella enterica enterica serovar Typhi Ty2
gauaaacccguaaagcauucc

SEQ ID NO: 3740916 - RNA, 20 nt, Salmonella enterica enterica serovar Typhi Ty2
gauaaacgcaaugucaucag

SEQ ID NO: 3740917 - RNA, 19 nt, Salmonella enterica enterica serovar Typhi Ty2
gauaaacgcgucuucauca

SEQ ID NO: 3740918 - RNA, 20 nt, Salmonella enterica enterica serovar Typhi Ty2
gauaaacgcgucuucaucag

SEQ ID NO: 3740919 - RNA, 20 nt, Salmonella enterica enterica serovar Typhi Ty2
gauaaacguagcgucaucag

SEQ ID NO: 3740920 - RNA, 18 nt, Salmonella enterica enterica serovar Typhi Ty2
gauaaacucaaucaggcu

SEQ ID NO: 3740921 - RNA, 16 nt, Salmonella enterica enterica serovar Typhi Ty2
gauaaagaacgcgccg

SEQ ID NO: 3740922 - RNA, 21 nt, Salmonella enterica enterica serovar Typhi Ty2
gauaaagaacgcgccgaccau

SEQ ID NO: 3740923 - RNA, 13 nt, Salmonella enterica enterica serovar Typhi Ty2
gauaaagauauuc

SEQ ID NO: 3740924 - RNA, 18 nt, Salmonella enterica enterica serovar Typhi Ty2
gauaaagauauucuccuc

SEQ ID NO: 3740925 - RNA, 17 nt, Salmonella enterica enterica serovar Typhi Ty2
gauaaagcgaauaacau

SEQ ID NO: 3740926 - RNA, 22 nt, Salmonella enterica enterica serovar Typhi Ty2
gauaaagcgcucaugccacgcc

SEQ ID NO: 3740927 - RNA, 16 nt, Salmonella enterica enterica serovar Typhi Ty2
gauaaaggauaauagu

SEQ ID NO: 3740928 - RNA, 18 nt, Salmonella enterica enterica serovar Typhi Ty2
gauaaagguacuuucccc

SEQ ID NO: 3740929 - RNA, 19 nt, Salmonella enterica enterica serovar Typhi Ty2
gauaaaguacggcgcgcca

SEQ ID NO: 3740930 - RNA, 20 nt, Salmonella enterica enterica serovar Typhi Ty2
gauaaauguuuacuucgcuu

SEQ ID NO: 3740931 - RNA, 15 nt, Salmonella enterica enterica serovar Typhi Ty2
gauaaauucaaugag

SEQ ID NO: 3740932 - RNA, 14 nt, Salmonella enterica enterica serovar Typhi Ty2
gauaaauucugucu

SEQ ID NO: 3740933 - RNA, 20 nt, Salmonella enterica enterica serovar Typhi Ty2
gauaacaccagcgauccaga

SEQ ID NO: 3740934 - RNA, 22 nt, Salmonella enterica enterica serovar Typhi Ty2
gauaaccacguucauuucguac

SEQ ID NO: 3740935 - RNA, 20 nt, Salmonella enterica enterica serovar Typhi Ty2
gauaaccagcgcgccgccaa

SEQ ID NO: 3740936 - RNA, 12 nt, Salmonella enterica enterica serovar Typhi Ty2
gauaaccagguc

SEQ ID NO: 3740937 - RNA, 14 nt, Salmonella enterica enterica serovar Typhi Ty2
gauaaccaggucac

SEQ ID NO: 3740938 - RNA, 16 nt, Salmonella enterica enterica serovar Typhi Ty2
gauaaccgcccgcggc

SEQ ID NO: 3740939 - RNA, 17 nt, Salmonella enterica enterica serovar Typhi Ty2
gauaaccuauuuugcaa

SEQ ID NO: 3740940 - RNA, 23 nt, Salmonella enterica enterica serovar Typhi Ty2
gauaaccuauuuugcaaaacuga

SEQ ID NO: 3740941 - RNA, 14 nt, Salmonella enterica enterica serovar Typhi Ty2
gauaaccugcugug

SEQ ID NO: 3740942 - RNA, 16 nt, Salmonella enterica enterica serovar Typhi Ty2
gauaaccugcugugac

SEQ ID NO: 3740943 - RNA, 18 nt, Salmonella enterica enterica serovar Typhi Ty2
gauaaccuguaaauaaua

SEQ ID NO: 3740944 - RNA, 16 nt, Salmonella enterica enterica serovar Typhi Ty2
gauaaccuuccggcac

SEQ ID NO: 3740945 - RNA, 16 nt, Salmonella enterica enterica serovar Typhi Ty2
gauaaccuucuucguu

SEQ ID NO: 3740946 - RNA, 15 nt, Salmonella enterica enterica serovar Typhi Ty2
gauaacgaaaagggu

SEQ ID NO: 3740947 - RNA, 14 nt, Salmonella enterica enterica serovar Typhi Ty2
gauaacgaaccauc

SEQ ID NO: 3740948 - RNA, 19 nt, Salmonella enterica enterica serovar Typhi Ty2
gauaacgaauuaagcggau

SEQ ID NO: 3740949 - RNA, 15 nt, Salmonella enterica enterica serovar Typhi Ty2
gauaacgcaacaaca

SEQ ID NO: 3740950 - RNA, 15 nt, Salmonella enterica enterica serovar Typhi Ty2
gauaacgcgcuggcg

SEQ ID NO: 3740951 - RNA, 15 nt, Salmonella enterica enterica serovar Typhi Ty2
gauaacgcuaugcuu

SEQ ID NO: 3740952 - RNA, 12 nt, Salmonella enterica enterica serovar Typhi Ty2
gauaacggcgca

SEQ ID NO: 3740953 - RNA, 18 nt, Salmonella enterica enterica serovar Typhi Ty2
gauaacggcgcaaagaca

SEQ ID NO: 3740954 - RNA, 15 nt, Salmonella enterica enterica serovar Typhi Ty2
gauaacguauuucuu

SEQ ID NO: 3740955 - RNA, 13 nt, Salmonella enterica enterica serovar Typhi Ty2
gauaacucuucau

SEQ ID NO: 3740956 - RNA, 19 nt, Salmonella enterica enterica serovar Typhi Ty2
gauaagaaagauaaaauac

SEQ ID NO: 3740957 - RNA, 19 nt, Salmonella enterica enterica serovar Typhi Ty2
gauaagaaguaaacagaau

SEQ ID NO: 3740958 - RNA, 13 nt, Salmonella enterica enterica serovar Typhi Ty2
gauaagagaaaau

SEQ ID NO: 3740959 - RNA, 15 nt, Salmonella enterica enterica serovar Typhi Ty2
gauaagagaaaauac

SEQ ID NO: 3740960 - RNA, 16 nt, Salmonella enterica enterica serovar Typhi Ty2
gauaagcaacgcgcca

SEQ ID NO: 3740961 - RNA, 22 nt, Salmonella enterica enterica serovar Typhi Ty2
gauaagcaagcgccaucgggca

SEQ ID NO: 3740962 - RNA, 20 nt, Salmonella enterica enterica serovar Typhi Ty2
gauaagcaccguaaacggcu

SEQ ID NO: 3740963 - RNA, 20 nt, Salmonella enterica enterica serovar Typhi Ty2
gauaagcauagcgccaucag

SEQ ID NO: 3740964 - RNA, 14 nt, Salmonella enterica enterica serovar Typhi Ty2
gauagcgauuuuug

SEQ ID NO: 3740965 - RNA, 18 nt, Salmonella enterica enterica serovar Typhi Ty2
gauagcgcagcacgguaa

SEQ ID NO: 3740966 - RNA, 19 nt, Salmonella enterica enterica serovar Typhi Ty2
gauagcgcagcacgguaac

SEQ ID NO: 3740967 - RNA, 13 nt, Salmonella enterica enterica serovar Typhi Ty2
gauagcgccgcau

SEQ ID NO: 3740968 - RNA, 22 nt, Salmonella enterica enterica serovar Typhi Ty2
gauagcgccgguuucuccagcc

SEQ ID NO: 3740969 - RNA, 18 nt, Salmonella enterica enterica serovar Typhi Ty2
gauagcgcggaauaucaa

SEQ ID NO: 3740970 - RNA, 14 nt, Salmonella enterica enterica serovar Typhi Ty2
gauagcgcuuucca

SEQ ID NO: 3740971 - RNA, 19 nt, Salmonella enterica enterica serovar Typhi Ty2
gauagcgcuuuccaguccc

SEQ ID NO: 3740972 - RNA, 17 nt, Salmonella enterica enterica serovar Typhi Ty2
gauagcgggcaaugcca

SEQ ID NO: 3740973 - RNA, 15 nt, Salmonella enterica enterica serovar Typhi Ty2
gauagcguuuuccag

SEQ ID NO: 3740974 - RNA, 17 nt, Salmonella enterica enterica serovar Typhi Ty2
gauaggagacgccgccc

SEQ ID NO: 3740975 - RNA, 22 nt, Salmonella enterica enterica serovar Typhi Ty2
gauaggcgcgucauaaccgcag

SEQ ID NO: 3740976 - RNA, 13 nt, Salmonella enterica enterica serovar Typhi Ty2
gauagggcagcag

SEQ ID NO: 3740977 - RNA, 14 nt, Salmonella enterica enterica serovar Typhi Ty2
gauagggcagcagu

SEQ ID NO: 3740978 - RNA, 15 nt, Salmonella enterica enterica serovar Typhi Ty2
gauagggcagcaguu

SEQ ID NO: 3740979 - RNA, 14 nt, Salmonella enterica enterica serovar Typhi Ty2
gauagggccaggcg

SEQ ID NO: 3740980 - RNA, 21 nt, Salmonella enterica enterica serovar Typhi Ty2
gauagggcguaaguugcccga

SEQ ID NO: 3740981 - RNA, 13 nt, Salmonella enterica enterica serovar Typhi Ty2
gauagucaggcga

SEQ ID NO: 3740982 - RNA, 18 nt, Salmonella enterica enterica serovar Typhi Ty2
gauagucauugacagcaa

SEQ ID NO: 3740983 - RNA, 14 nt, Salmonella enterica enterica serovar Typhi Ty2
gauagugccugccg

SEQ ID NO: 3740984 - RNA, 19 nt, Salmonella enterica enterica serovar Typhi Ty2
gauagugcugcgcaaauac

SEQ ID NO: 3740985 - RNA, 14 nt, Salmonella enterica enterica serovar Typhi Ty2
gauaguggcgaucu

SEQ ID NO: 3740986 - RNA, 20 nt, Salmonella enterica enterica serovar Typhi Ty2
gauagugucgccauaaauca

SEQ ID NO: 3740987 - RNA, 16 nt, Salmonella enterica enterica serovar Typhi Ty2
gauaguuugccagaga

SEQ ID NO: 3740988 - RNA, 16 nt, Salmonella enterica enterica serovar Typhi Ty2
gauauaaaacgggcca

SEQ ID NO: 3740989 - RNA, 16 nt, Salmonella enterica enterica serovar Typhi Ty2
gauauaacccaguuca

SEQ ID NO: 3740990 - RNA, 17 nt, Salmonella enterica enterica serovar Typhi Ty2
gauauaacccucauccc

SEQ ID NO: 3740991 - RNA, 13 nt, Salmonella enterica enterica serovar Typhi Ty2
gauauaagcgcca

SEQ ID NO: 3740992 - RNA, 20 nt, Salmonella enterica enterica serovar Typhi Ty2
gauauaauuuuauuauauuu

SEQ ID NO: 3740993 - RNA, 23 nt, Salmonella enterica enterica serovar Typhi Ty2
gauauaccacccgcuaugaagac

SEQ ID NO: 3740994 - RNA, 22 nt, Salmonella enterica enterica serovar Typhi Ty2
gauauaccaugcugccauuuua

SEQ ID NO: 3740995 - RNA, 21 nt, Salmonella enterica enterica serovar Typhi Ty2
gauauagcaacguccgcagcc

SEQ ID NO: 3740996 - RNA, 12 nt, Salmonella enterica enterica serovar Typhi Ty2
gauauagcgcca

SEQ ID NO: 3740997 - RNA, 19 nt, Salmonella enterica enterica serovar Typhi Ty2
gauauagcggugcguuucc

SEQ ID NO: 3740998 - RNA, 17 nt, Salmonella enterica enterica serovar Typhi Ty2
gauauaggguggucacg

SEQ ID NO: 3740999 - RNA, 19 nt, Salmonella enterica enterica serovar Typhi Ty2
gauauaggguggucacgcc

SEQ ID NO: 3741000 - RNA, 14 nt, Salmonella enterica enterica serovar Typhi Ty2
gauauagucgccca

SEQ ID NO: 3741001 - RNA, 18 nt, Salmonella enterica enterica serovar Typhi Ty2
gauauaucgcgucaucaa

SEQ ID NO: 3741002 - RNA, 23 nt, Salmonella enterica enterica serovar Typhi Ty2
gauauaucuucaucguuucugcc

SEQ ID NO: 3741003 - RNA, 14 nt, Salmonella enterica enterica serovar Typhi Ty2
gauauauuuuccgu

SEQ ID NO: 3741004 - RNA, 15 nt, Salmonella enterica enterica serovar Typhi Ty2
gauaucaaugcgaaa

SEQ ID NO: 3741005 - RNA, 16 nt, Salmonella enterica enterica serovar Typhi Ty2
gauaucaaugcgcgua

SEQ ID NO: 3741006 - RNA, 22 nt, Salmonella enterica enterica serovar Typhi Ty2
gauaucagggcuuuuuucucgc

SEQ ID NO: 3741007 - RNA, 21 nt, Salmonella enterica enterica serovar Typhi Ty2
gauauccagcaccucaucacc

SEQ ID NO: 3741008 - RNA, 13 nt, Salmonella enterica enterica serovar Typhi Ty2
gauauccagcaua

SEQ ID NO: 3741009 - RNA, 22 nt, Salmonella enterica enterica serovar Typhi Ty2
gauauccauugggggguuagug

SEQ ID NO: 3741010 - RNA, 14 nt, Salmonella enterica enterica serovar Typhi Ty2
gauaucgccccaga

SEQ ID NO: 3741011 - RNA, 23 nt, Salmonella enterica enterica serovar Typhi Ty2
gauaucgucauuaacgggaaacu

SEQ ID NO: 3741012 - RNA, 13 nt, Salmonella enterica enterica serovar Typhi Ty2
gauaucugccgcg

SEQ ID NO: 3741013 - RNA, 22 nt, Salmonella enterica enterica serovar Typhi Ty2
gauaucugccgcgcccgccauc

SEQ ID NO: 3741014 - RNA, 19 nt, Salmonella enterica enterica serovar Typhi Ty2
gauaucugccugcagaccc

SEQ ID NO: 3741015 - RNA, 21 nt, Salmonella enterica enterica serovar Typhi Ty2
gauaucuucauagcuuagcug

SEQ ID NO: 3741016 - RNA, 12 nt, Salmonella enterica enterica serovar Typhi Ty2
gauaucuuccag

SEQ ID NO: 3741017 - RNA, 13 nt, Salmonella enterica enterica serovar Typhi Ty2
gauaugcagcagc

SEQ ID NO: 3741018 - RNA, 17 nt, Salmonella enterica enterica serovar Typhi Ty2
gauaugcagcagccagu

SEQ ID NO: 3741019 - RNA, 20 nt, Salmonella enterica enterica serovar Typhi Ty2
gauaugcgggggcaguaaau

SEQ ID NO: 3741020 - RNA, 21 nt, Salmonella enterica enterica serovar Typhi Ty2
gauaugcggucguauuaccaa

SEQ ID NO: 3741021 - RNA, 13 nt, Salmonella enterica enterica serovar Typhi Ty2
gauauggcaaacg

SEQ ID NO: 3741022 - RNA, 23 nt, Salmonella enterica enterica serovar Typhi Ty2
gauauggccguuuucaugcacga

SEQ ID NO: 3741023 - RNA, 13 nt, Salmonella enterica enterica serovar Typhi Ty2
gauauuacagauc

SEQ ID NO: 3741024 - RNA, 16 nt, Salmonella enterica enterica serovar Typhi Ty2
gauauuacuaauaaaa

SEQ ID NO: 3741025 - RNA, 17 nt, Salmonella enterica enterica serovar Typhi Ty2
gauauuacuuuccagca

SEQ ID NO: 3741026 - RNA, 15 nt, Salmonella enterica enterica serovar Typhi Ty2
gauauuccauacagu

SEQ ID NO: 3741027 - RNA, 22 nt, Salmonella enterica enterica serovar Typhi Ty2
gauauugccgaccgccagcaga

SEQ ID NO: 3741028 - RNA, 20 nt, Salmonella enterica enterica serovar Typhi Ty2
gauauuguguuuaccucaua

SEQ ID NO: 3741029 - RNA, 15 nt, Salmonella enterica enterica serovar Typhi Ty2
gauauuuaaaacugg

SEQ ID NO: 3741030 - RNA, 14 nt, Salmonella enterica enterica serovar Typhi Ty2
gauauuuugcugca

SEQ ID NO: 3741031 - RNA, 16 nt, Salmonella enterica enterica serovar Typhi Ty2
gaucaaacuccgcgcu

SEQ ID NO: 3741032 - RNA, 13 nt, Salmonella enterica enterica serovar Typhi Ty2
gaucaaccggaug

SEQ ID NO: 3741033 - RNA, 18 nt, Salmonella enterica enterica serovar Typhi Ty2
gaucaacgccgcgccauc

SEQ ID NO: 3741034 - RNA, 20 nt, Salmonella enterica enterica serovar Typhi Ty2
gaucaacgggguuagcguuu

SEQ ID NO: 3741035 - RNA, 14 nt, Salmonella enterica enterica serovar Typhi Ty2
gaucaagcgggggc

SEQ ID NO: 3741036 - RNA, 13 nt, Salmonella enterica enterica serovar Typhi Ty2
gaucaaucacgcc

SEQ ID NO: 3741037 - RNA, 16 nt, Salmonella enterica enterica serovar Typhi Ty2
gaucaauugcgguggc

SEQ ID NO: 3741038 - RNA, 14 nt, Salmonella enterica enterica serovar Typhi Ty2
gaucaauuugccuu

SEQ ID NO: 3741039 - RNA, 14 nt, Salmonella enterica enterica serovar Typhi Ty2
gaucaauuuugcuc

SEQ ID NO: 3741040 - RNA, 17 nt, Salmonella enterica enterica serovar Typhi Ty2
gaucacaaaaucauugc

SEQ ID NO: 3741041 - RNA, 14 nt, Salmonella enterica enterica serovar Typhi Ty2
gaucaccaucuuca

SEQ ID NO: 3741042 - RNA, 18 nt, Salmonella enterica enterica serovar Typhi Ty2
gaucacccacaucagcgg

SEQ ID NO: 3741043 - RNA, 20 nt, Salmonella enterica enterica serovar Typhi Ty2
gaucacuaccgccaucaaac

SEQ ID NO: 3741044 - RNA, 21 nt, Salmonella enterica enterica serovar Typhi Ty2
gaucacuuccgccaccacgcc

SEQ ID NO: 3741045 - RNA, 12 nt, Salmonella enterica enterica serovar Typhi Ty2
gaucagaaaacc

SEQ ID NO: 3741046 - RNA, 15 nt, Salmonella enterica enterica serovar Typhi Ty2
gaucgggcuuccagc

SEQ ID NO: 3741047 - RNA, 15 nt, Salmonella enterica enterica serovar Typhi Ty2
gaucguaggcggcgg

SEQ ID NO: 3741048 - RNA, 21 nt, Salmonella enterica enterica serovar Typhi Ty2
gaucguaugcagccaggccau

SEQ ID NO: 3741049 - RNA, 14 nt, Salmonella enterica enterica serovar Typhi Ty2
gaucguaugcgccu

SEQ ID NO: 3741050 - RNA, 12 nt, Salmonella enterica enterica serovar Typhi Ty2
gaucgucaacga

SEQ ID NO: 3741051 - RNA, 20 nt, Salmonella enterica enterica serovar Typhi Ty2
gaucgucauauguugcgcuu

SEQ ID NO: 3741052 - RNA, 24 nt, Salmonella enterica enterica serovar Typhi Ty2
gaucgugccaugaccauucacacu

SEQ ID NO: 3741053 - RNA, 15 nt, Salmonella enterica enterica serovar Typhi Ty2
gaucgugccguccgg

SEQ ID NO: 3741054 - RNA, 13 nt, Salmonella enterica enterica serovar Typhi Ty2
gaucgugguacgc

SEQ ID NO: 3741055 - RNA, 23 nt, Salmonella enterica enterica serovar Typhi Ty2
gaucguuauccagcagccacagg

SEQ ID NO: 3741056 - RNA, 19 nt, Salmonella enterica enterica serovar Typhi Ty2
gaucguuauuaaacagaca

SEQ ID NO: 3741057 - RNA, 14 nt, Salmonella enterica enterica serovar Typhi Ty2
gaucguuuccagca

SEQ ID NO: 3741058 - RNA, 19 nt, Salmonella enterica enterica serovar Typhi Ty2
gaucuaaagccaguuucuc

SEQ ID NO: 3741059 - RNA, 15 nt, Salmonella enterica enterica serovar Typhi Ty2
gaucucauaaacgcc

SEQ ID NO: 3741060 - RNA, 23 nt, Salmonella enterica enterica serovar Typhi Ty2
gaucucauaaacgccuggaguga

SEQ ID NO: 3741061 - RNA, 12 nt, Salmonella enterica enterica serovar Typhi Ty2
gaucucauacca

SEQ ID NO: 3741062 - RNA, 12 nt, Salmonella enterica enterica serovar Typhi Ty2
gaucucucccug

SEQ ID NO: 3741063 - RNA, 22 nt, Salmonella enterica enterica serovar Typhi Ty2
gaucucuugcauaauauccagg

SEQ ID NO: 3741064 - RNA, 17 nt, Salmonella enterica enterica serovar Typhi Ty2
gaucugauacggaaaua

SEQ ID NO: 3741065 - RNA, 15 nt, Salmonella enterica enterica serovar Typhi Ty2
gaucugaucgucguu

SEQ ID NO: 3741066 - RNA, 19 nt, Salmonella enterica enterica serovar Typhi Ty2
gaucugcgcaacauucugc

SEQ ID NO: 3741067 - RNA, 18 nt, Salmonella enterica enterica serovar Typhi Ty2
gaucugcuuaugaucgcc

SEQ ID NO: 3741068 - RNA, 18 nt, Salmonella enterica enterica serovar Typhi Ty2
gaucugcuugagcaggca

SEQ ID NO: 3741069 - RNA, 20 nt, Salmonella enterica enterica serovar Typhi Ty2
gaucugcuugagcaggcaga

SEQ ID NO: 3741070 - RNA, 15 nt, Salmonella enterica enterica serovar Typhi Ty2
gaucuggccgucugg

SEQ ID NO: 3741071 - RNA, 15 nt, Salmonella enterica enterica serovar Typhi Ty2
gaucugguuauccac

SEQ ID NO: 3741072 - RNA, 19 nt, Salmonella enterica enterica serovar Typhi Ty2
gaucuuauaugagcgggcc

SEQ ID NO: 3741073 - RNA, 18 nt, Salmonella enterica enterica serovar Typhi Ty2
gaucuuaucuuucagcgc

SEQ ID NO: 3741074 - RNA, 12 nt, Salmonella enterica enterica serovar Typhi Ty2
gaucuucauccc

SEQ ID NO: 3741075 - RNA, 17 nt, Salmonella enterica enterica serovar Typhi Ty2
gaucuucaucccauccg

SEQ ID NO: 3741076 - RNA, 18 nt, Salmonella enterica enterica serovar Typhi Ty2
gaucuucaucccauccgg

SEQ ID NO: 3741077 - RNA, 15 nt, Salmonella enterica enterica serovar Typhi Ty2
gaucuuuccuuuuuc

SEQ ID NO: 3741078 - RNA, 21 nt, Salmonella enterica enterica serovar Typhi Ty2
gaucuuuccuuuuucaggcac

SEQ ID NO: 3741079 - RNA, 23 nt, Salmonella enterica enterica serovar Typhi Ty2
gaucuuugccgcgcggauucucc

SEQ ID NO: 3741080 - RNA, 14 nt, Salmonella enterica enterica serovar Typhi Ty2
gaucuuuuugcucc

SEQ ID NO: 3741081 - RNA, 22 nt, Salmonella enterica enterica serovar Typhi Ty2
gaugaaacaguccggcgaaaaa

SEQ ID NO: 3741082 - RNA, 21 nt, Salmonella enterica enterica serovar Typhi Ty2
gaugaaagcggcacaaauaaa

SEQ ID NO: 3741083 - RNA, 11 nt, Salmonella enterica enterica serovar Typhi Ty2
gaugaaagguc

SEQ ID NO: 3741084 - RNA, 22 nt, Salmonella enterica enterica serovar Typhi Ty2
gaugaaauaaacgaccacucuu

SEQ ID NO: 3741085 - RNA, 20 nt, Salmonella enterica enterica serovar Typhi Ty2
gaugaaccauaucaaacagg

SEQ ID NO: 3741086 - RNA, 22 nt, Salmonella enterica enterica serovar Typhi Ty2
gaugaacgacgcugauuugcca

SEQ ID NO: 3741087 - RNA, 23 nt, Salmonella enterica enterica serovar Typhi Ty2
gaugaagcugcagggauaugcug

SEQ ID NO: 3741088 - RNA, 19 nt, Salmonella enterica enterica serovar Typhi Ty2
gaugaauuccugcggcggu

SEQ ID NO: 3741089 - RNA, 22 nt, Salmonella enterica enterica serovar Typhi Ty2
gaugacaucgcaaugccaccac

SEQ ID NO: 3741090 - RNA, 17 nt, Salmonella enterica enterica serovar Typhi Ty2
gaugaccauaaaugaaa

SEQ ID NO: 3741091 - RNA, 21 nt, Salmonella enterica enterica serovar Typhi Ty2
gaugacgcuaacgcuuauccg

SEQ ID NO: 3741092 - RNA, 20 nt, Salmonella enterica enterica serovar Typhi Ty2
gaugacgcugcgcuuauccg

SEQ ID NO: 3741093 - RNA, 22 nt, Salmonella enterica enterica serovar Typhi Ty2
gaugacgcuucgcuuauccggc

SEQ ID NO: 3741094 - RNA, 17 nt, Salmonella enterica enterica serovar Typhi Ty2
gaugacggcagcgcguu

SEQ ID NO: 3741095 - RNA, 16 nt, Salmonella enterica enterica serovar Typhi Ty2
gaugacuaaaucagca

SEQ ID NO: 3741096 - RNA, 19 nt, Salmonella enterica enterica serovar Typhi Ty2
gaugacucccaguccggua

SEQ ID NO: 3741097 - RNA, 15 nt, Salmonella enterica enterica serovar Typhi Ty2
gaugagaugucaucg

SEQ ID NO: 3741098 - RNA, 14 nt, Salmonella enterica enterica serovar Typhi Ty2
gaugagcaggccag

SEQ ID NO: 3741099 - RNA, 21 nt, Salmonella enterica enterica serovar Typhi Ty2
gaugagcgugacgaccggcac

SEQ ID NO: 3741100 - RNA, 18 nt, Salmonella enterica enterica serovar Typhi Ty2
gaugagcucaaauaugau

SEQ ID NO: 3741101 - RNA, 17 nt, Salmonella enterica enterica serovar Typhi Ty2
gaugaguauauagcgcu

SEQ ID NO: 3741102 - RNA, 24 nt, Salmonella enterica enterica serovar Typhi Ty2
gaugauagccguugucauggcgcc

SEQ ID NO: 3741103 - RNA, 13 nt, Salmonella enterica enterica serovar Typhi Ty2
gaugauauccagc

SEQ ID NO: 3741104 - RNA, 15 nt, Salmonella enterica enterica serovar Typhi Ty2
gaugaucuucagccc

SEQ ID NO: 3741105 - RNA, 15 nt, Salmonella enterica enterica serovar Typhi Ty2
gaugaugaaaaagaa

SEQ ID NO: 3741106 - RNA, 15 nt, Salmonella enterica enterica serovar Typhi Ty2
gaugauguucaucgc

SEQ ID NO: 3741107 - RNA, 21 nt, Salmonella enterica enterica serovar Typhi Ty2
gaugauguuuaccugcaaaaa

SEQ ID NO: 3741108 - RNA, 13 nt, Salmonella enterica enterica serovar Typhi Ty2
gaugauucacccu

SEQ ID NO: 3741109 - RNA, 14 nt, Salmonella enterica enterica serovar Typhi Ty2
gaugauuuucaagc

SEQ ID NO: 3741110 - RNA, 15 nt, Salmonella enterica enterica serovar Typhi Ty2
gaugcaaugcagaug

SEQ ID NO: 3741111 - RNA, 16 nt, Salmonella enterica enterica serovar Typhi Ty2
gaugcaccuuucuccu

SEQ ID NO: 3741112 - RNA, 22 nt, Salmonella enterica enterica serovar Typhi Ty2
gaugcaccuuucuccugcgcuu

SEQ ID NO: 3741113 - RNA, 19 nt, Salmonella enterica enterica serovar Typhi Ty2
gaugcacggaugcaucaug

SEQ ID NO: 3741114 - RNA, 18 nt, Salmonella enterica enterica serovar Typhi Ty2
gaugcagacgggcgucca

SEQ ID NO: 3741115 - RNA, 18 nt, Salmonella enterica enterica serovar Typhi Ty2
gaugcagcggcgacacca

SEQ ID NO: 3741116 - RNA, 16 nt, Salmonella enterica enterica serovar Typhi Ty2
gaugcagcuugcaggc

SEQ ID NO: 3741117 - RNA, 14 nt, Salmonella enterica enterica serovar Typhi Ty2
gaugcaggcgccug

SEQ ID NO: 3741118 - RNA, 16 nt, Salmonella enterica enterica serovar Typhi Ty2
gaugcaucagaacaaa

SEQ ID NO: 3741119 - RNA, 11 nt, Salmonella enterica enterica serovar Typhi Ty2
gaugccagaug

SEQ ID NO: 3741120 - RNA, 13 nt, Salmonella enterica enterica serovar Typhi Ty2
gaugcccauacgg

SEQ ID NO: 3741121 - RNA, 15 nt, Salmonella enterica enterica serovar Typhi Ty2
gaugccccaucacgg

SEQ ID NO: 3741122 - RNA, 18 nt, Salmonella enterica enterica serovar Typhi Ty2
gaugccggauaauacgaa

SEQ ID NO: 3741123 - RNA, 11 nt, Salmonella enterica enterica serovar Typhi Ty2
gaugccguaag

SEQ ID NO: 3741124 - RNA, 17 nt, Salmonella enterica enterica serovar Typhi Ty2
gaugccguugaccauau

SEQ ID NO: 3741125 - RNA, 22 nt, Salmonella enterica enterica serovar Typhi Ty2
gaugccuggauaauaagacgcc

SEQ ID NO: 3741126 - RNA, 19 nt, Salmonella enterica enterica serovar Typhi Ty2
gaugcgaccgcgccacggc

SEQ ID NO: 3741127 - RNA, 20 nt, Salmonella enterica enterica serovar Typhi Ty2
gaugcgccagccagucgcca

SEQ ID NO: 3741128 - RNA, 16 nt, Salmonella enterica enterica serovar Typhi Ty2
gauuaaucgucauccc

SEQ ID NO: 3741129 - RNA, 17 nt, Salmonella enterica enterica serovar Typhi Ty2
gauuaaugauuugcuuu

SEQ ID NO: 3741130 - RNA, 21 nt, Salmonella enterica enterica serovar Typhi Ty2
gauuaaugauuugcuuuauuu

SEQ ID NO: 3741131 - RNA, 18 nt, Salmonella enterica enterica serovar Typhi Ty2
gauuaaugcuccaauaaa

SEQ ID NO: 3741132 - RNA, 23 nt, Salmonella enterica enterica serovar Typhi Ty2
gauuaccauugaucaggcaaaaa

SEQ ID NO: 3741133 - RNA, 15 nt, Salmonella enterica enterica serovar Typhi Ty2
gauuacccguuguua

SEQ ID NO: 3741134 - RNA, 18 nt, Salmonella enterica enterica serovar Typhi Ty2
gauuaccgggauuuccau

SEQ ID NO: 3741135 - RNA, 22 nt, Salmonella enterica enterica serovar Typhi Ty2
gauuaccgggauuuccauauua

SEQ ID NO: 3741136 - RNA, 16 nt, Salmonella enterica enterica serovar Typhi Ty2
gauuacgacccacaau

SEQ ID NO: 3741137 - RNA, 18 nt, Salmonella enterica enterica serovar Typhi Ty2
gauuacucucuugccagc

SEQ ID NO: 3741138 - RNA, 20 nt, Salmonella enterica enterica serovar Typhi Ty2
gauuacucucuugccagcgc

SEQ ID NO: 3741139 - RNA, 21 nt, Salmonella enterica enterica serovar Typhi Ty2
gauuacucucuugccagcgca

SEQ ID NO: 3741140 - RNA, 16 nt, Salmonella enterica enterica serovar Typhi Ty2
gauuagacuucuucca

SEQ ID NO: 3741141 - RNA, 13 nt, Salmonella enterica enterica serovar Typhi Ty2
gauuagccccagc

SEQ ID NO: 3741142 - RNA, 17 nt, Salmonella enterica enterica serovar Typhi Ty2
gauuagccccagcgcca

SEQ ID NO: 3741143 - RNA, 16 nt, Salmonella enterica enterica serovar Typhi Ty2
gauuagcucauacgcu

SEQ ID NO: 3741144 - RNA, 20 nt, Salmonella enterica enterica serovar Typhi Ty2
gauuagcuuuaauccguuac

SEQ ID NO: 3741145 - RNA, 12 nt, Salmonella enterica enterica serovar Typhi Ty2
gauuauagagag

SEQ ID NO: 3741146 - RNA, 23 nt, Salmonella enterica enterica serovar Typhi Ty2
gauuaucagaaggcuugauacug

SEQ ID NO: 3741147 - RNA, 20 nt, Salmonella enterica enterica serovar Typhi Ty2
gauuaucaggaugaauauga

SEQ ID NO: 3741148 - RNA, 17 nt, Salmonella enterica enterica serovar Typhi Ty2
gauuaucguccggcauc

SEQ ID NO: 3741149 - RNA, 20 nt, Salmonella enterica enterica serovar Typhi Ty2
gauuaugcgaaugcuggcug

SEQ ID NO: 3741150 - RNA, 20 nt, Salmonella enterica enterica serovar Typhi Ty2
gauuauuuuaucaucagcac

SEQ ID NO: 3741151 - RNA, 22 nt, Salmonella enterica enterica serovar Typhi Ty2
gauucaacguuucgcuaucgcc

SEQ ID NO: 3741152 - RNA, 14 nt, Salmonella enterica enterica serovar Typhi Ty2
gauucaccaccacc

SEQ ID NO: 3741153 - RNA, 16 nt, Salmonella enterica enterica serovar Typhi Ty2
gauucaggccgccagc

SEQ ID NO: 3741154 - RNA, 20 nt, Salmonella enterica enterica serovar Typhi Ty2
gauucagguuuugcugauca

SEQ ID NO: 3741155 - RNA, 13 nt, Salmonella enterica enterica serovar Typhi Ty2
gauucccauccgu

SEQ ID NO: 3741156 - RNA, 16 nt, Salmonella enterica enterica serovar Typhi Ty2
gauuccccaccaggaa

SEQ ID NO: 3741157 - RNA, 16 nt, Salmonella enterica enterica serovar Typhi Ty2
gauuccgucaugguga

SEQ ID NO: 3741158 - RNA, 14 nt, Salmonella enterica enterica serovar Typhi Ty2
gauucgaaccugcg

SEQ ID NO: 3741159 - RNA, 14 nt, Salmonella enterica enterica serovar Typhi Ty2
gauucgcccacgga

SEQ ID NO: 3741160 - RNA, 16 nt, Salmonella enterica enterica serovar Typhi Ty2
gauucgccguucuguu

SEQ ID NO: 3741161 - RNA, 14 nt, Salmonella enterica enterica serovar Typhi Ty2
gauucgggccgcac

SEQ ID NO: 3741162 - RNA, 20 nt, Salmonella enterica enterica serovar Typhi Ty2
gauucguuuuuacacugaag

SEQ ID NO: 3741163 - RNA, 13 nt, Salmonella enterica enterica serovar Typhi Ty2
gauucuucugccu

SEQ ID NO: 3741164 - RNA, 13 nt, Salmonella enterica enterica serovar Typhi Ty2
gauugaauaaugc

SEQ ID NO: 3741165 - RNA, 16 nt, Salmonella enterica enterica serovar Typhi Ty2
gauugacgguuugucu

SEQ ID NO: 3741166 - RNA, 17 nt, Salmonella enterica enterica serovar Typhi Ty2
gauugauuuuguaaucu

SEQ ID NO: 3741167 - RNA, 14 nt, Salmonella enterica enterica serovar Typhi Ty2
gauugcaagaauau

SEQ ID NO: 3741168 - RNA, 20 nt, Salmonella enterica enterica serovar Typhi Ty2
gauugcccuccagccauaau

SEQ ID NO: 3741169 - RNA, 12 nt, Salmonella enterica enterica serovar Typhi Ty2
gauuggcaaaau

SEQ ID NO: 3741170 - RNA, 16 nt, Salmonella enterica enterica serovar Typhi Ty2
gauuggccucuaccca

SEQ ID NO: 3741171 - RNA, 20 nt, Salmonella enterica enterica serovar Typhi Ty2
gauuggcuguuaguaagcug

SEQ ID NO: 3741172 - RNA, 13 nt, Salmonella enterica enterica serovar Typhi Ty2
gauuggucugauu

SEQ ID NO: 3741173 - RNA, 14 nt, Salmonella enterica enterica serovar Typhi Ty2
gauuuaaaacaagc

SEQ ID NO: 3741174 - RNA, 16 nt, Salmonella enterica enterica serovar Typhi Ty2
gauuuaagcuuaauuu

SEQ ID NO: 3741175 - RNA, 15 nt, Salmonella enterica enterica serovar Typhi Ty2
gauuuagcguaaaua

SEQ ID NO: 3741176 - RNA, 23 nt, Salmonella enterica enterica serovar Typhi Ty2
gauuuagcguuggcgucaucgac

SEQ ID NO: 3741177 - RNA, 15 nt, Salmonella enterica enterica serovar Typhi Ty2
gauuuauagagcagc

SEQ ID NO: 3741178 - RNA, 12 nt, Salmonella enterica enterica serovar Typhi Ty2
gauuuaugaaua

SEQ ID NO: 3741179 - RNA, 16 nt, Salmonella enterica enterica serovar Typhi Ty2
gauuuauucuuugucu

SEQ ID NO: 3741180 - RNA, 19 nt, Salmonella enterica enterica serovar Typhi Ty2
gauuucacgaucaucgcau

SEQ ID NO: 3741181 - RNA, 16 nt, Salmonella enterica enterica serovar Typhi Ty2
gauuucaucaggcuga

SEQ ID NO: 3741182 - RNA, 24 nt, Salmonella enterica enterica serovar Typhi Ty2
gauuucaugcggugcaugaauauc

SEQ ID NO: 3741183 - RNA, 16 nt, Salmonella enterica enterica serovar Typhi Ty2
gauuuccauauuaacg

SEQ ID NO: 3741184 - RNA, 20 nt, Salmonella enterica enterica serovar Typhi Ty2
gauuuccggaaugguauaaa

SEQ ID NO: 3741185 - RNA, 17 nt, Salmonella enterica enterica serovar Typhi Ty2
gauuucgccccacuggc

SEQ ID NO: 3741186 - RNA, 22 nt, Salmonella enterica enterica serovar Typhi Ty2
gauuucggcgcuguuuuccgcu

SEQ ID NO: 3741187 - RNA, 14 nt, Salmonella enterica enterica serovar Typhi Ty2
gauuucuucuggcu

SEQ ID NO: 3741188 - RNA, 17 nt, Salmonella enterica enterica serovar Typhi Ty2
gauuucuugagcggcau

SEQ ID NO: 3741189 - RNA, 18 nt, Salmonella enterica enterica serovar Typhi Ty2
gauuugcaaccgcucuuu

SEQ ID NO: 3741190 - RNA, 14 nt, Salmonella enterica enterica serovar Typhi Ty2
gauuugcccuucca

SEQ ID NO: 3741191 - RNA, 17 nt, Salmonella enterica enterica serovar Typhi Ty2
gauuugcccuuccagca

SEQ ID NO: 3741192 - RNA, 16 nt, Salmonella enterica enterica serovar Typhi Ty2
gauuugccgcgccuuc

SEQ ID NO: 3741193 - RNA, 19 nt, Salmonella enterica enterica serovar Typhi Ty2
gauuugcgaaucauguuuu

SEQ ID NO: 3741194 - RNA, 14 nt, Salmonella enterica enterica serovar Typhi Ty2
gauuugcguuguuu

SEQ ID NO: 3741195 - RNA, 21 nt, Salmonella enterica enterica serovar Typhi Ty2
gauuuggcguaaucgauaagc

SEQ ID NO: 3741196 - RNA, 23 nt, Salmonella enterica enterica serovar Typhi Ty2
gauuuguacguauuuacaaauga

SEQ ID NO: 3741197 - RNA, 15 nt, Salmonella enterica enterica serovar Typhi Ty2
gauuuguuucaucgc

SEQ ID NO: 3741198 - RNA, 16 nt, Salmonella enterica enterica serovar Typhi Ty2
gauuuguuucaucgcc

SEQ ID NO: 3741199 - RNA, 17 nt, Salmonella enterica enterica serovar Typhi Ty2
gauuuuaucaagucgcg

SEQ ID NO: 3741200 - RNA, 19 nt, Salmonella enterica enterica serovar Typhi Ty2
gauuuuaucaagucgcguu

SEQ ID NO: 3741201 - RNA, 21 nt, Salmonella enterica enterica serovar Typhi Ty2
gauuuucuuauuacaagaaag

SEQ ID NO: 3741202 - RNA, 13 nt, Salmonella enterica enterica serovar Typhi Ty2
gauuuucuuuaau

SEQ ID NO: 3741203 - RNA, 22 nt, Salmonella enterica enterica serovar Typhi Ty2
gauuuuuaccgccgguuuaucc

SEQ ID NO: 3741204 - RNA, 23 nt, Salmonella enterica enterica serovar Typhi Ty2
gauuuuuaccgccgguuuauccc

SEQ ID NO: 3741205 - RNA, 15 nt, Salmonella enterica enterica serovar Typhi Ty2
gauuuuucauugcaa

SEQ ID NO: 3741206 - RNA, 22 nt, Salmonella enterica enterica serovar Typhi Ty2
gauuuuucgcgucaaaacuuau

SEQ ID NO: 3741207 - RNA, 15 nt, Salmonella enterica enterica serovar Typhi Ty2
gauuuuuuugcccgg

SEQ ID NO: 3741208 - RNA, 20 nt, Salmonella enterica enterica serovar Typhi Ty2
gcaaaaaaauccccgcgcaa

SEQ ID NO: 3741209 - RNA, 14 nt, Salmonella enterica enterica serovar Typhi Ty2
gcaaaaaaggccag

SEQ ID NO: 3741210 - RNA, 16 nt, Salmonella enterica enterica serovar Typhi Ty2
gcaacagcaccagcag

SEQ ID NO: 3741211 - RNA, 17 nt, Salmonella enterica enterica serovar Typhi Ty2
gcaacagcaccagcagg

SEQ ID NO: 3741212 - RNA, 23 nt, Salmonella enterica enterica serovar Typhi Ty2
gcaacagcaccagcaggugguac

SEQ ID NO: 3741213 - RNA, 22 nt, Salmonella enterica enterica serovar Typhi Ty2
gcaacagccauuuuaaaaauau

SEQ ID NO: 3741214 - RNA, 22 nt, Salmonella enterica enterica serovar Typhi Ty2
gcaacagggugauuucgcccgc

SEQ ID NO: 3741215 - RNA, 19 nt, Salmonella enterica enterica serovar Typhi Ty2
gcaacagguaccccgccac

SEQ ID NO: 3741216 - RNA, 13 nt, Salmonella enterica enterica serovar Typhi Ty2
gcaacagucagcu

SEQ ID NO: 3741217 - RNA, 20 nt, Salmonella enterica enterica serovar Typhi Ty2
gcaacagugggcuaugaaga

SEQ ID NO: 3741218 - RNA, 18 nt, Salmonella enterica enterica serovar Typhi Ty2
gcaacaguugcuggagca

SEQ ID NO: 3741219 - RNA, 17 nt, Salmonella enterica enterica serovar Typhi Ty2
gcaacauaaauaaacag

SEQ ID NO: 3741220 - RNA, 14 nt, Salmonella enterica enterica serovar Typhi Ty2
gcaacauagcaucg

SEQ ID NO: 3741221 - RNA, 17 nt, Salmonella enterica enterica serovar Typhi Ty2
gcaacaugaccagcgca

SEQ ID NO: 3741222 - RNA, 13 nt, Salmonella enterica enterica serovar Typhi Ty2
gcaacaugcccac

SEQ ID NO: 3741223 - RNA, 16 nt, Salmonella enterica enterica serovar Typhi Ty2
gcaacaugcccaccgg

SEQ ID NO: 3741224 - RNA, 14 nt, Salmonella enterica enterica serovar Typhi Ty2
gcaacauggacacc

SEQ ID NO: 3741225 - RNA, 15 nt, Salmonella enterica enterica serovar Typhi Ty2
gcaacauuacugacc

SEQ ID NO: 3741226 - RNA, 17 nt, Salmonella enterica enterica serovar Typhi Ty2
gcaacauucugcuucca

SEQ ID NO: 3741227 - RNA, 19 nt, Salmonella enterica enterica serovar Typhi Ty2
gcaacauucugcuuccaga

SEQ ID NO: 3741228 - RNA, 13 nt, Salmonella enterica enterica serovar Typhi Ty2
gcaaccaggucac

SEQ ID NO: 3741229 - RNA, 13 nt, Salmonella enterica enterica serovar Typhi Ty2
gcaacccauacag

SEQ ID NO: 3741230 - RNA, 18 nt, Salmonella enterica enterica serovar Typhi Ty2
gcaaccccuugcggugca

SEQ ID NO: 3741231 - RNA, 15 nt, Salmonella enterica enterica serovar Typhi Ty2
gcaacccgcuccaga

SEQ ID NO: 3741232 - RNA, 21 nt, Salmonella enterica enterica serovar Typhi Ty2
gcaacccugccgucucaacca

SEQ ID NO: 3741233 - RNA, 19 nt, Salmonella enterica enterica serovar Typhi Ty2
gcaaccgacgggcgcuggu

SEQ ID NO: 3741234 - RNA, 22 nt, Salmonella enterica enterica serovar Typhi Ty2
gcaaccgauagcuaaugcgguu

SEQ ID NO: 3741235 - RNA, 20 nt, Salmonella enterica enterica serovar Typhi Ty2
gcaaccgcaucacgcgaagc

SEQ ID NO: 3741236 - RNA, 18 nt, Salmonella enterica enterica serovar Typhi Ty2
gcaaccgcucuccgcaau

SEQ ID NO: 3741237 - RNA, 19 nt, Salmonella enterica enterica serovar Typhi Ty2
gcaaccgguacucuuccag

SEQ ID NO: 3741238 - RNA, 18 nt, Salmonella enterica enterica serovar Typhi Ty2
gcaaccgucucaccaggc

SEQ ID NO: 3741239 - RNA, 17 nt, Salmonella enterica enterica serovar Typhi Ty2
gcaaccgugaccgcguu

SEQ ID NO: 3741240 - RNA, 14 nt, Salmonella enterica enterica serovar Typhi Ty2
gcaaccugagcgcg

SEQ ID NO: 3741241 - RNA, 17 nt, Salmonella enterica enterica serovar Typhi Ty2
gcaacgacgucuuucuu

SEQ ID NO: 3741242 - RNA, 19 nt, Salmonella enterica enterica serovar Typhi Ty2
gcaacgaucccuaauaaaa

SEQ ID NO: 3741243 - RNA, 21 nt, Salmonella enterica enterica serovar Typhi Ty2
gcaacgccaucagcaaaauac

SEQ ID NO: 3741244 - RNA, 18 nt, Salmonella enterica enterica serovar Typhi Ty2
gcaacgccguacuccagc

SEQ ID NO: 3741245 - RNA, 23 nt, Salmonella enterica enterica serovar Typhi Ty2
gcaacgccguacuccagcccauc

SEQ ID NO: 3741246 - RNA, 13 nt, Salmonella enterica enterica serovar Typhi Ty2
gcaacgcgccauc

SEQ ID NO: 3741247 - RNA, 17 nt, Salmonella enterica enterica serovar Typhi Ty2
gcaacgcugcauccugu

SEQ ID NO: 3741248 - RNA, 15 nt, Salmonella enterica enterica serovar Typhi Ty2
gcaacgcuuccaccu

SEQ ID NO: 3741249 - RNA, 20 nt, Salmonella enterica enterica serovar Typhi Ty2
gcaacgcuucugagaauuug

SEQ ID NO: 3741250 - RNA, 22 nt, Salmonella enterica enterica serovar Typhi Ty2
gcaacgcuuuagugccgccauu

SEQ ID NO: 3741251 - RNA, 18 nt, Salmonella enterica enterica serovar Typhi Ty2
gcaacggaaggaaauaac

SEQ ID NO: 3741252 - RNA, 17 nt, Salmonella enterica enterica serovar Typhi Ty2
gcaacggcaagccggua

SEQ ID NO: 3741253 - RNA, 14 nt, Salmonella enterica enterica serovar Typhi Ty2
gcaacggcagccag

SEQ ID NO: 3741254 - RNA, 19 nt, Salmonella enterica enterica serovar Typhi Ty2
gcaacggcauuccgcuggu

SEQ ID NO: 3741255 - RNA, 19 nt, Salmonella enterica enterica serovar Typhi Ty2
gcaacggccagcgcaggcu

SEQ ID NO: 3741256 - RNA, 16 nt, Salmonella enterica enterica serovar Typhi Ty2
gcaacgggacggcggc

SEQ ID NO: 3741257 - RNA, 23 nt, Salmonella enterica enterica serovar Typhi Ty2
gcaacgggcagucuggcggcagc

SEQ ID NO: 3741258 - RNA, 20 nt, Salmonella enterica enterica serovar Typhi Ty2
gcaacggugagaccauugca

SEQ ID NO: 3741259 - RNA, 15 nt, Salmonella enterica enterica serovar Typhi Ty2
gcaacguaaucccgc

SEQ ID NO: 3741260 - RNA, 12 nt, Salmonella enterica enterica serovar Typhi Ty2
gcaacgucagua

SEQ ID NO: 3741261 - RNA, 14 nt, Salmonella enterica enterica serovar Typhi Ty2
gcaacgugaacugc

SEQ ID NO: 3741262 - RNA, 21 nt, Salmonella enterica enterica serovar Typhi Ty2
gcaacgugaacugcgccugca

SEQ ID NO: 3741263 - RNA, 20 nt, Salmonella enterica enterica serovar Typhi Ty2
gcaacguuaaggccgcaaac

SEQ ID NO: 3741264 - RNA, 15 nt, Salmonella enterica enterica serovar Typhi Ty2
gcaacguuuccgcua

SEQ ID NO: 3741265 - RNA, 17 nt, Salmonella enterica enterica serovar Typhi Ty2
gcaacucacgccauucc

SEQ ID NO: 3741266 - RNA, 14 nt, Salmonella enterica enterica serovar Typhi Ty2
gcaacucgcacuga

SEQ ID NO: 3741267 - RNA, 19 nt, Salmonella enterica enterica serovar Typhi Ty2
gcaacucucccacuuugcu

SEQ ID NO: 3741268 - RNA, 16 nt, Salmonella enterica enterica serovar Typhi Ty2
gcaacucucgauaucg

SEQ ID NO: 3741269 - RNA, 18 nt, Salmonella enterica enterica serovar Typhi Ty2
gcaacugccaggcgugug

SEQ ID NO: 3741270 - RNA, 15 nt, Salmonella enterica enterica serovar Typhi Ty2
gcaacugccggcuua

SEQ ID NO: 3741271 - RNA, 13 nt, Salmonella enterica enterica serovar Typhi Ty2
gcaacugcugcgc

SEQ ID NO: 3741272 - RNA, 17 nt, Salmonella enterica enterica serovar Typhi Ty2
gcaacugcugcgcgugc

SEQ ID NO: 3741273 - RNA, 14 nt, Salmonella enterica enterica serovar Typhi Ty2
gcaacuguuuuacc

SEQ ID NO: 3741274 - RNA, 22 nt, Salmonella enterica enterica serovar Typhi Ty2
gcaacuguuuuaccaaaucaau

SEQ ID NO: 3741275 - RNA, 14 nt, Salmonella enterica enterica serovar Typhi Ty2
gcaacuuaauaaua

SEQ ID NO: 3741276 - RNA, 19 nt, Salmonella enterica enterica serovar Typhi Ty2
gcaacuucagaauccaggu

SEQ ID NO: 3741277 - RNA, 12 nt, Salmonella enterica enterica serovar Typhi Ty2
gcaagaauauga

SEQ ID NO: 3741278 - RNA, 16 nt, Salmonella enterica enterica serovar Typhi Ty2
gcaagaauuaaauaac

SEQ ID NO: 3741279 - RNA, 16 nt, Salmonella enterica enterica serovar Typhi Ty2
gcaagacacagcgucg

SEQ ID NO: 3741280 - RNA, 22 nt, Salmonella enterica enterica serovar Typhi Ty2
gcaagacacagcgucgcgcgau

SEQ ID NO: 3741281 - RNA, 15 nt, Salmonella enterica enterica serovar Typhi Ty2
gcaagacgaaaaaug

SEQ ID NO: 3741282 - RNA, 17 nt, Salmonella enterica enterica serovar Typhi Ty2
gcaagacgaaaaaugaa

SEQ ID NO: 3741283 - RNA, 14 nt, Salmonella enterica enterica serovar Typhi Ty2
gcaagagauucagg

SEQ ID NO: 3741284 - RNA, 16 nt, Salmonella enterica enterica serovar Typhi Ty2
gcaagaggugacucac

SEQ ID NO: 3741285 - RNA, 13 nt, Salmonella enterica enterica serovar Typhi Ty2
gcaagcagcacac

SEQ ID NO: 3741286 - RNA, 15 nt, Salmonella enterica enterica serovar Typhi Ty2
gcaagcagcauaaug

SEQ ID NO: 3741287 - RNA, 20 nt, Salmonella enterica enterica serovar Typhi Ty2
gcaagcauaaaaaacaucau

SEQ ID NO: 3741288 - RNA, 14 nt, Salmonella enterica enterica serovar Typhi Ty2
gcaagcgaagcgcc

SEQ ID NO: 3741289 - RNA, 17 nt, Salmonella enterica enterica serovar Typhi Ty2
gcaagcgcuaagcaaca

SEQ ID NO: 3741290 - RNA, 18 nt, Salmonella enterica enterica serovar Typhi Ty2
gcaagcgcugggcgauaa

SEQ ID NO: 3741291 - RNA, 19 nt, Salmonella enterica enterica serovar Typhi Ty2
gcaagcguaagagaacagg

SEQ ID NO: 3741292 - RNA, 21 nt, Salmonella enterica enterica serovar Typhi Ty2
gcaauuucucgcccgccagau

SEQ ID NO: 3741293 - RNA, 17 nt, Salmonella enterica enterica serovar Typhi Ty2
gcaauuugauagcgcca

SEQ ID NO: 3741294 - RNA, 23 nt, Salmonella enterica enterica serovar Typhi Ty2
gcaauuugauagcgccacgcuuc

SEQ ID NO: 3741295 - RNA, 23 nt, Salmonella enterica enterica serovar Typhi Ty2
gcaauuugguuagggaucaucuu

SEQ ID NO: 3741296 - RNA, 16 nt, Salmonella enterica enterica serovar Typhi Ty2
gcacaaaccgcgcggu

SEQ ID NO: 3741297 - RNA, 23 nt, Salmonella enterica enterica serovar Typhi Ty2
gcacaacacgcuuuucagcgcca

SEQ ID NO: 3741298 - RNA, 13 nt, Salmonella enterica enterica serovar Typhi Ty2
gcacaacaggggg

SEQ ID NO: 3741299 - RNA, 15 nt, Salmonella enterica enterica serovar Typhi Ty2
gcacaacccaaaggc

SEQ ID NO: 3741300 - RNA, 15 nt, Salmonella enterica enterica serovar Typhi Ty2
gcacaaccuggcuug

SEQ ID NO: 3741301 - RNA, 16 nt, Salmonella enterica enterica serovar Typhi Ty2
gcacaacgaguccccu

SEQ ID NO: 3741302 - RNA, 13 nt, Salmonella enterica enterica serovar Typhi Ty2
gcacaacggccag

SEQ ID NO: 3741303 - RNA, 16 nt, Salmonella enterica enterica serovar Typhi Ty2
gcacaacggccagcaa

SEQ ID NO: 3741304 - RNA, 22 nt, Salmonella enterica enterica serovar Typhi Ty2
gcacaauaacgucacgauagcg

SEQ ID NO: 3741305 - RNA, 23 nt, Salmonella enterica enterica serovar Typhi Ty2
gcacaauaacgucacgauagcgc

SEQ ID NO: 3741306 - RNA, 12 nt, Salmonella enterica enterica serovar Typhi Ty2
gcacaauaccaa

SEQ ID NO: 3741307 - RNA, 17 nt, Salmonella enterica enterica serovar Typhi Ty2
gcacaauaccaauaaga

SEQ ID NO: 3741308 - RNA, 20 nt, Salmonella enterica enterica serovar Typhi Ty2
gcacaauaccaauaagaacu

SEQ ID NO: 3741309 - RNA, 22 nt, Salmonella enterica enterica serovar Typhi Ty2
gcacaauacuuuuugacuccug

SEQ ID NO: 3741310 - RNA, 23 nt, Salmonella enterica enterica serovar Typhi Ty2
gcacaauagcgcuaaacagcgcc

SEQ ID NO: 3741311 - RNA, 13 nt, Salmonella enterica enterica serovar Typhi Ty2
gcacaauuccggc

SEQ ID NO: 3741312 - RNA, 13 nt, Salmonella enterica enterica serovar Typhi Ty2
gcacaccauuuca

SEQ ID NO: 3741313 - RNA, 15 nt, Salmonella enterica enterica serovar Typhi Ty2
gcacaccauuucaca

SEQ ID NO: 3741314 - RNA, 19 nt, Salmonella enterica enterica serovar Typhi Ty2
gcacaccgccguaaaggga

SEQ ID NO: 3741315 - RNA, 20 nt, Salmonella enterica enterica serovar Typhi Ty2
gcacaccggccauugccgcg

SEQ ID NO: 3741316 - RNA, 16 nt, Salmonella enterica enterica serovar Typhi Ty2
gcacacgcagcugaug

SEQ ID NO: 3741317 - RNA, 19 nt, Salmonella enterica enterica serovar Typhi Ty2
gcacacgcuggaagagaac

SEQ ID NO: 3741318 - RNA, 18 nt, Salmonella enterica enterica serovar Typhi Ty2
gcacacucauuuugccgu

SEQ ID NO: 3741319 - RNA, 18 nt, Salmonella enterica enterica serovar Typhi Ty2
gcacacuuucaucagccg

SEQ ID NO: 3741320 - RNA, 13 nt, Salmonella enterica enterica serovar Typhi Ty2
gcacagaagcgcc

SEQ ID NO: 3741321 - RNA, 21 nt, Salmonella enterica enterica serovar Typhi Ty2
gcacagccaguaagaacgaga

SEQ ID NO: 3741322 - RNA, 15 nt, Salmonella enterica enterica serovar Typhi Ty2
gcacagccccagcac

SEQ ID NO: 3741323 - RNA, 16 nt, Salmonella enterica enterica serovar Typhi Ty2
gcacagccccagcacc

SEQ ID NO: 3741324 - RNA, 17 nt, Salmonella enterica enterica serovar Typhi Ty2
gcacagccccagcacca

SEQ ID NO: 3741325 - RNA, 19 nt, Salmonella enterica enterica serovar Typhi Ty2
gcacagccccagcaccaac

SEQ ID NO: 3741326 - RNA, 16 nt, Salmonella enterica enterica serovar Typhi Ty2
gcacagcgcagcaacg

SEQ ID NO: 3741327 - RNA, 19 nt, Salmonella enterica enterica serovar Typhi Ty2
gcacagcgcuaucaggcac

SEQ ID NO: 3741328 - RNA, 20 nt, Salmonella enterica enterica serovar Typhi Ty2
gcacagcgcuaucaggcacu

SEQ ID NO: 3741329 - RNA, 16 nt, Salmonella enterica enterica serovar Typhi Ty2
gcacaggccuucauga

SEQ ID NO: 3741330 - RNA, 21 nt, Salmonella enterica enterica serovar Typhi Ty2
gcacaggcgcggagacgugac

SEQ ID NO: 3741331 - RNA, 18 nt, Salmonella enterica enterica serovar Typhi Ty2
gcacagggugaaaucacg

SEQ ID NO: 3741332 - RNA, 15 nt, Salmonella enterica enterica serovar Typhi Ty2
gcacagguacaggcc

SEQ ID NO: 3741333 - RNA, 16 nt, Salmonella enterica enterica serovar Typhi Ty2
gcacagguacaggccg

SEQ ID NO: 3741334 - RNA, 14 nt, Salmonella enterica enterica serovar Typhi Ty2
gcacaguacgcccg

SEQ ID NO: 3741335 - RNA, 18 nt, Salmonella enterica enterica serovar Typhi Ty2
gcacaguacgcccggcgg

SEQ ID NO: 3741336 - RNA, 16 nt, Salmonella enterica enterica serovar Typhi Ty2
gcacaguauuaccgcu

SEQ ID NO: 3741337 - RNA, 15 nt, Salmonella enterica enterica serovar Typhi Ty2
gcacauauuccggcg

SEQ ID NO: 3741338 - RNA, 12 nt, Salmonella enterica enterica serovar Typhi Ty2
gcacaucagcaa

SEQ ID NO: 3741339 - RNA, 23 nt, Salmonella enterica enterica serovar Typhi Ty2
gcacauccucaaugguuucacgc

SEQ ID NO: 3741340 - RNA, 17 nt, Salmonella enterica enterica serovar Typhi Ty2
gcacaucgccauuaaaa

SEQ ID NO: 3741341 - RNA, 18 nt, Salmonella enterica enterica serovar Typhi Ty2
gcacauguuucagcaccu

SEQ ID NO: 3741342 - RNA, 19 nt, Salmonella enterica enterica serovar Typhi Ty2
gcacauguuucagcaccuc

SEQ ID NO: 3741343 - RNA, 13 nt, Salmonella enterica enterica serovar Typhi Ty2
gcacauuacaggc

SEQ ID NO: 3741344 - RNA, 13 nt, Salmonella enterica enterica serovar Typhi Ty2
gcacauuagcaau

SEQ ID NO: 3741345 - RNA, 14 nt, Salmonella enterica enterica serovar Typhi Ty2
gcacauucagagcg

SEQ ID NO: 3741346 - RNA, 13 nt, Salmonella enterica enterica serovar Typhi Ty2
gcacauucagcag

SEQ ID NO: 3741347 - RNA, 18 nt, Salmonella enterica enterica serovar Typhi Ty2
gcacauucagcagcgccc

SEQ ID NO: 3741348 - RNA, 18 nt, Salmonella enterica enterica serovar Typhi Ty2
gcacauucagguggcuga

SEQ ID NO: 3741349 - RNA, 17 nt, Salmonella enterica enterica serovar Typhi Ty2
gcacauucgauaaccgc

SEQ ID NO: 3741350 - RNA, 18 nt, Salmonella enterica enterica serovar Typhi Ty2
gcacauuuacgccagcca

SEQ ID NO: 3741351 - RNA, 19 nt, Salmonella enterica enterica serovar Typhi Ty2
gcaccaacgauaaauuuuc

SEQ ID NO: 3741352 - RNA, 15 nt, Salmonella enterica enterica serovar Typhi Ty2
gcaccaccaggaacg

SEQ ID NO: 3741353 - RNA, 19 nt, Salmonella enterica enterica serovar Typhi Ty2
gcaccaccaggaacgccau

SEQ ID NO: 3741354 - RNA, 14 nt, Salmonella enterica enterica serovar Typhi Ty2
gcaccaccugguua

SEQ ID NO: 3741355 - RNA, 19 nt, Salmonella enterica enterica serovar Typhi Ty2
gcaccacgaccagacuggu

SEQ ID NO: 3741356 - RNA, 17 nt, Salmonella enterica enterica serovar Typhi Ty2
gcaccacgcaaaccgcu

SEQ ID NO: 3741357 - RNA, 12 nt, Salmonella enterica enterica serovar Typhi Ty2
gcaccagaccga

SEQ ID NO: 3741358 - RNA, 13 nt, Salmonella enterica enterica serovar Typhi Ty2
gcaccagcaacac

SEQ ID NO: 3741359 - RNA, 15 nt, Salmonella enterica enterica serovar Typhi Ty2
gcaccagcagguggu

SEQ ID NO: 3741360 - RNA, 17 nt, Salmonella enterica enterica serovar Typhi Ty2
gcaccagcaggugguac

SEQ ID NO: 3741361 - RNA, 15 nt, Salmonella enterica enterica serovar Typhi Ty2
gcaccagcauuagcg

SEQ ID NO: 3741362 - RNA, 13 nt, Salmonella enterica enterica serovar Typhi Ty2
gcaccagccaggc

SEQ ID NO: 3741363 - RNA, 20 nt, Salmonella enterica enterica serovar Typhi Ty2
gcaccagcucuacaucgccg

SEQ ID NO: 3741364 - RNA, 16 nt, Salmonella enterica enterica serovar Typhi Ty2
gcaccaguucacuccu

SEQ ID NO: 3741365 - RNA, 20 nt, Salmonella enterica enterica serovar Typhi Ty2
gcaccaguucacuccuaaga

SEQ ID NO: 3741366 - RNA, 15 nt, Salmonella enterica enterica serovar Typhi Ty2
gcaccaguuccccau

SEQ ID NO: 3741367 - RNA, 16 nt, Salmonella enterica enterica serovar Typhi Ty2
gcaccaguuccccaua

SEQ ID NO: 3741368 - RNA, 24 nt, Salmonella enterica enterica serovar Typhi Ty2
gcaccaucaacgccggugauuuua

SEQ ID NO: 3741369 - RNA, 18 nt, Salmonella enterica enterica serovar Typhi Ty2
gcaccaucuuuuccggca

SEQ ID NO: 3741370 - RNA, 22 nt, Salmonella enterica enterica serovar Typhi Ty2
gcaccaucuuuuccggcagggu

SEQ ID NO: 3741371 - RNA, 17 nt, Salmonella enterica enterica serovar Typhi Ty2
gcaccauguggcgcggc

SEQ ID NO: 3741372 - RNA, 18 nt, Salmonella enterica enterica serovar Typhi Ty2
gcaccauguggcgcggcc

SEQ ID NO: 3741373 - RNA, 13 nt, Salmonella enterica enterica serovar Typhi Ty2
gcaccauuaucgc

SEQ ID NO: 3741374 - RNA, 20 nt, Salmonella enterica enterica serovar Typhi Ty2
gcagaaauaaaauacuucca

SEQ ID NO: 3741375 - RNA, 18 nt, Salmonella enterica enterica serovar Typhi Ty2
gcagaacaaacagaccgc

SEQ ID NO: 3741376 - RNA, 15 nt, Salmonella enterica enterica serovar Typhi Ty2
gcagaagacagaagc

SEQ ID NO: 3741377 - RNA, 16 nt, Salmonella enterica enterica serovar Typhi Ty2
gcagaauauuuuucuc

SEQ ID NO: 3741378 - RNA, 21 nt, Salmonella enterica enterica serovar Typhi Ty2
gcagaauauuuuucucagcca

SEQ ID NO: 3741379 - RNA, 19 nt, Salmonella enterica enterica serovar Typhi Ty2
gcagaaucaggcacaaccc

SEQ ID NO: 3741380 - RNA, 18 nt, Salmonella enterica enterica serovar Typhi Ty2
gcagaaucauuaauacac

SEQ ID NO: 3741381 - RNA, 23 nt, Salmonella enterica enterica serovar Typhi Ty2
gcagaauuaacucaucacagcca

SEQ ID NO: 3741382 - RNA, 16 nt, Salmonella enterica enterica serovar Typhi Ty2
gcagaauuuauuucug

SEQ ID NO: 3741383 - RNA, 20 nt, Salmonella enterica enterica serovar Typhi Ty2
gcagacaaaaaaccggaggc

SEQ ID NO: 3741384 - RNA, 18 nt, Salmonella enterica enterica serovar Typhi Ty2
gcagacaauuuccgccgc

SEQ ID NO: 3741385 - RNA, 14 nt, Salmonella enterica enterica serovar Typhi Ty2
gcagacagccgauc

SEQ ID NO: 3741386 - RNA, 23 nt, Salmonella enterica enterica serovar Typhi Ty2
gcagacaugaccgcacagcagac

SEQ ID NO: 3741387 - RNA, 14 nt, Salmonella enterica enterica serovar Typhi Ty2
gcagacauucgcgc

SEQ ID NO: 3741388 - RNA, 21 nt, Salmonella enterica enterica serovar Typhi Ty2
gcagacccacuuucagcuccg

SEQ ID NO: 3741389 - RNA, 15 nt, Salmonella enterica enterica serovar Typhi Ty2
gcagaccgagcgcau

SEQ ID NO: 3741390 - RNA, 17 nt, Salmonella enterica enterica serovar Typhi Ty2
gcagaccggcagccugc

SEQ ID NO: 3741391 - RNA, 16 nt, Salmonella enterica enterica serovar Typhi Ty2
gcagaccguuuucaac

SEQ ID NO: 3741392 - RNA, 14 nt, Salmonella enterica enterica serovar Typhi Ty2
gcagaccuauaugg

SEQ ID NO: 3741393 - RNA, 19 nt, Salmonella enterica enterica serovar Typhi Ty2
gcagaccuauauggcgcaa

SEQ ID NO: 3741394 - RNA, 13 nt, Salmonella enterica enterica serovar Typhi Ty2
gcagacgccgcgg

SEQ ID NO: 3741395 - RNA, 14 nt, Salmonella enterica enterica serovar Typhi Ty2
gcagacgccugccg

SEQ ID NO: 3741396 - RNA, 15 nt, Salmonella enterica enterica serovar Typhi Ty2
gcagacggagaugau

SEQ ID NO: 3741397 - RNA, 13 nt, Salmonella enterica enterica serovar Typhi Ty2
gcagacuauaggu

SEQ ID NO: 3741398 - RNA, 18 nt, Salmonella enterica enterica serovar Typhi Ty2
gcagacucauggacaaaa

SEQ ID NO: 3741399 - RNA, 21 nt, Salmonella enterica enterica serovar Typhi Ty2
gcagacugguaaccuguuccu

SEQ ID NO: 3741400 - RNA, 18 nt, Salmonella enterica enterica serovar Typhi Ty2
gcagacuuuaaccauucc

SEQ ID NO: 3741401 - RNA, 14 nt, Salmonella enterica enterica serovar Typhi Ty2
gcagagccggaacc

SEQ ID NO: 3741402 - RNA, 16 nt, Salmonella enterica enterica serovar Typhi Ty2
gcagagcggggaaacu

SEQ ID NO: 3741403 - RNA, 14 nt, Salmonella enterica enterica serovar Typhi Ty2
gcagaggucucagg

SEQ ID NO: 3741404 - RNA, 19 nt, Salmonella enterica enterica serovar Typhi Ty2
gcagaguacgucgccuucc

SEQ ID NO: 3741405 - RNA, 16 nt, Salmonella enterica enterica serovar Typhi Ty2
gcagagucgcagcggc

SEQ ID NO: 3741406 - RNA, 19 nt, Salmonella enterica enterica serovar Typhi Ty2
gcagagucgcagcggcggu

SEQ ID NO: 3741407 - RNA, 14 nt, Salmonella enterica enterica serovar Typhi Ty2
gcagagugagcagg

SEQ ID NO: 3741408 - RNA, 18 nt, Salmonella enterica enterica serovar Typhi Ty2
gcagauaaccgucggcgc

SEQ ID NO: 3741409 - RNA, 15 nt, Salmonella enterica enterica serovar Typhi Ty2
gcagauacugguaaa

SEQ ID NO: 3741410 - RNA, 17 nt, Salmonella enterica enterica serovar Typhi Ty2
gcagauagcccgccagc

SEQ ID NO: 3741411 - RNA, 23 nt, Salmonella enterica enterica serovar Typhi Ty2
gcagauaguucguuugcgcgagg

SEQ ID NO: 3741412 - RNA, 14 nt, Salmonella enterica enterica serovar Typhi Ty2
gcagauaucuucca

SEQ ID NO: 3741413 - RNA, 13 nt, Salmonella enterica enterica serovar Typhi Ty2
gcagauccgcgau

SEQ ID NO: 3741414 - RNA, 20 nt, Salmonella enterica enterica serovar Typhi Ty2
gcagauccgcgauaucaauc

SEQ ID NO: 3741415 - RNA, 23 nt, Salmonella enterica enterica serovar Typhi Ty2
gcagauccuuaacgucaaagcua

SEQ ID NO: 3741416 - RNA, 19 nt, Salmonella enterica enterica serovar Typhi Ty2
gcagaucggccuguuuuuc

SEQ ID NO: 3741417 - RNA, 15 nt, Salmonella enterica enterica serovar Typhi Ty2
gcagaucguauccag

SEQ ID NO: 3741418 - RNA, 18 nt, Salmonella enterica enterica serovar Typhi Ty2
gcagaucguuuacgaccu

SEQ ID NO: 3741419 - RNA, 17 nt, Salmonella enterica enterica serovar Typhi Ty2
gcagaucugucgccaug

SEQ ID NO: 3741420 - RNA, 23 nt, Salmonella enterica enterica serovar Typhi Ty2
gcagaucugucgccaugaccugg

SEQ ID NO: 3741421 - RNA, 19 nt, Salmonella enterica enterica serovar Typhi Ty2
gcagaugcugcguuuuuuc

SEQ ID NO: 3741422 - RNA, 21 nt, Salmonella enterica enterica serovar Typhi Ty2
gcagauuccgaacucaugccg

SEQ ID NO: 3741423 - RNA, 13 nt, Salmonella enterica enterica serovar Typhi Ty2
gcagauugaggcu

SEQ ID NO: 3741424 - RNA, 16 nt, Salmonella enterica enterica serovar Typhi Ty2
gcagauuuuuauccgu

SEQ ID NO: 3741425 - RNA, 15 nt, Salmonella enterica enterica serovar Typhi Ty2
gcagcaaacgccaua

SEQ ID NO: 3741426 - RNA, 12 nt, Salmonella enterica enterica serovar Typhi Ty2
gcagcaaauaau

SEQ ID NO: 3741427 - RNA, 22 nt, Salmonella enterica enterica serovar Typhi Ty2
gcagcaaaucagcuacuuuaaa

SEQ ID NO: 3741428 - RNA, 20 nt, Salmonella enterica enterica serovar Typhi Ty2
gcagcaacugauucaaaagg

SEQ ID NO: 3741429 - RNA, 15 nt, Salmonella enterica enterica serovar Typhi Ty2
gcagcaagaacagag

SEQ ID NO: 3741430 - RNA, 16 nt, Salmonella enterica enterica serovar Typhi Ty2
gcagcacaaucagcgc

SEQ ID NO: 3741431 - RNA, 13 nt, Salmonella enterica enterica serovar Typhi Ty2
gcagcaccggcau

SEQ ID NO: 3741432 - RNA, 17 nt, Salmonella enterica enterica serovar Typhi Ty2
gcagcaccgguuuuucc

SEQ ID NO: 3741433 - RNA, 18 nt, Salmonella enterica enterica serovar Typhi Ty2
gcagcaccgguuuuuccg

SEQ ID NO: 3741434 - RNA, 20 nt, Salmonella enterica enterica serovar Typhi Ty2
gcagcacuucagaacggcua

SEQ ID NO: 3741435 - RNA, 13 nt, Salmonella enterica enterica serovar Typhi Ty2
gcagcagcaggcu

SEQ ID NO: 3741436 - RNA, 15 nt, Salmonella enterica enterica serovar Typhi Ty2
gcagcagcgcaaugc

SEQ ID NO: 3741437 - RNA, 22 nt, Salmonella enterica enterica serovar Typhi Ty2
gcagcagcgcuuucuucuucac

SEQ ID NO: 3741438 - RNA, 14 nt, Salmonella enterica enterica serovar Typhi Ty2
gcagcagcggaauc

SEQ ID NO: 3741439 - RNA, 21 nt, Salmonella enterica enterica serovar Typhi Ty2
gcagcagggauauacaaauau

SEQ ID NO: 3741440 - RNA, 22 nt, Salmonella enterica enterica serovar Typhi Ty2
gcagcaguuccccgccgcggcg

SEQ ID NO: 3741441 - RNA, 17 nt, Salmonella enterica enterica serovar Typhi Ty2
gcagcauaaacaucagc

SEQ ID NO: 3741442 - RNA, 20 nt, Salmonella enterica enterica serovar Typhi Ty2
gcagcauacgcaguaacguc

SEQ ID NO: 3741443 - RNA, 18 nt, Salmonella enterica enterica serovar Typhi Ty2
gcagcauaucgccguuca

SEQ ID NO: 3741444 - RNA, 13 nt, Salmonella enterica enterica serovar Typhi Ty2
gcagcaucccggc

SEQ ID NO: 3741445 - RNA, 19 nt, Salmonella enterica enterica serovar Typhi Ty2
gcagcaucccggcaaaaau

SEQ ID NO: 3741446 - RNA, 13 nt, Salmonella enterica enterica serovar Typhi Ty2
gcagcaucgccau

SEQ ID NO: 3741447 - RNA, 22 nt, Salmonella enterica enterica serovar Typhi Ty2
gcagcauugggucaugcggaug

SEQ ID NO: 3741448 - RNA, 16 nt, Salmonella enterica enterica serovar Typhi Ty2
gcagccaacaacaggc

SEQ ID NO: 3741449 - RNA, 20 nt, Salmonella enterica enterica serovar Typhi Ty2
gcagccaacaacaggccgcc

SEQ ID NO: 3741450 - RNA, 13 nt, Salmonella enterica enterica serovar Typhi Ty2
gcagccacgccga

SEQ ID NO: 3741451 - RNA, 14 nt, Salmonella enterica enterica serovar Typhi Ty2
gcagccacgccgau

SEQ ID NO: 3741452 - RNA, 23 nt, Salmonella enterica enterica serovar Typhi Ty2
gcagccagaaaaagggaaaagcc

SEQ ID NO: 3741453 - RNA, 16 nt, Salmonella enterica enterica serovar Typhi Ty2
gcagccagaacucauc

SEQ ID NO: 3741454 - RNA, 19 nt, Salmonella enterica enterica serovar Typhi Ty2
gcagccaggccauuuuuuc

SEQ ID NO: 3741455 - RNA, 17 nt, Salmonella enterica enterica serovar Typhi Ty2
gcagccauagcgcgccg

SEQ ID NO: 3741456 - RNA, 18 nt, Salmonella enterica enterica serovar Typhi Ty2
gcaggcgauagccccagu

SEQ ID NO: 3741457 - RNA, 21 nt, Salmonella enterica enterica serovar Typhi Ty2
gcaggcgauagccccaguaaa

SEQ ID NO: 3741458 - RNA, 23 nt, Salmonella enterica enterica serovar Typhi Ty2
gcaggcgcggcaaugccgcgcuu

SEQ ID NO: 3741459 - RNA, 18 nt, Salmonella enterica enterica serovar Typhi Ty2
gcaggcgggugcgcagcc

SEQ ID NO: 3741460 - RNA, 20 nt, Salmonella enterica enterica serovar Typhi Ty2
gcaggcgggugcgcagcccc

SEQ ID NO: 3741461 - RNA, 19 nt, Salmonella enterica enterica serovar Typhi Ty2
gcaggcgucauagccgcgc

SEQ ID NO: 3741462 - RNA, 20 nt, Salmonella enterica enterica serovar Typhi Ty2
gcaggcgucauagccgcgcg

SEQ ID NO: 3741463 - RNA, 20 nt, Salmonella enterica enterica serovar Typhi Ty2
gcaggcuaacgcgccccagg

SEQ ID NO: 3741464 - RNA, 14 nt, Salmonella enterica enterica serovar Typhi Ty2
gcaggcucaccagc

SEQ ID NO: 3741465 - RNA, 16 nt, Salmonella enterica enterica serovar Typhi Ty2
gcaggcucuuuuucuc

SEQ ID NO: 3741466 - RNA, 17 nt, Salmonella enterica enterica serovar Typhi Ty2
gcaggcuuccacgcacg

SEQ ID NO: 3741467 - RNA, 18 nt, Salmonella enterica enterica serovar Typhi Ty2
gcaggcuuugcugcugcg

SEQ ID NO: 3741468 - RNA, 21 nt, Salmonella enterica enterica serovar Typhi Ty2
gcagggauauacaaauauccc

SEQ ID NO: 3741469 - RNA, 18 nt, Salmonella enterica enterica serovar Typhi Ty2
gcagggaucguuuuucuu

SEQ ID NO: 3741470 - RNA, 17 nt, Salmonella enterica enterica serovar Typhi Ty2
gcagggaugacagaaag

SEQ ID NO: 3741471 - RNA, 15 nt, Salmonella enterica enterica serovar Typhi Ty2
gcagggcaugauuac

SEQ ID NO: 3741472 - RNA, 12 nt, Salmonella enterica enterica serovar Typhi Ty2
gcagggcugcug

SEQ ID NO: 3741473 - RNA, 22 nt, Salmonella enterica enterica serovar Typhi Ty2
gcaggggcuccugcgccggacg

SEQ ID NO: 3741474 - RNA, 20 nt, Salmonella enterica enterica serovar Typhi Ty2
gcaggggcucuaaaaaggaa

SEQ ID NO: 3741475 - RNA, 20 nt, Salmonella enterica enterica serovar Typhi Ty2
gcaggguauuugugcccgcg

SEQ ID NO: 3741476 - RNA, 14 nt, Salmonella enterica enterica serovar Typhi Ty2
gcagggugaagagu

SEQ ID NO: 3741477 - RNA, 15 nt, Salmonella enterica enterica serovar Typhi Ty2
gcaggguguaaucgc

SEQ ID NO: 3741478 - RNA, 18 nt, Salmonella enterica enterica serovar Typhi Ty2
gcaggguuugaccucauc

SEQ ID NO: 3741479 - RNA, 18 nt, Salmonella enterica enterica serovar Typhi Ty2
gcagguaguccaaauaag

SEQ ID NO: 3741480 - RNA, 16 nt, Salmonella enterica enterica serovar Typhi Ty2
gcagguaguugucggc

SEQ ID NO: 3741481 - RNA, 18 nt, Salmonella enterica enterica serovar Typhi Ty2
gcaggucgcguagcuuuu

SEQ ID NO: 3741482 - RNA, 17 nt, Salmonella enterica enterica serovar Typhi Ty2
gcaggugauggcggcuu

SEQ ID NO: 3741483 - RNA, 19 nt, Salmonella enterica enterica serovar Typhi Ty2
gcaggugcggcugggcgag

SEQ ID NO: 3741484 - RNA, 16 nt, Salmonella enterica enterica serovar Typhi Ty2
gcagguugagucugcu

SEQ ID NO: 3741485 - RNA, 20 nt, Salmonella enterica enterica serovar Typhi Ty2
gcagguugccgaugacuccc

SEQ ID NO: 3741486 - RNA, 19 nt, Salmonella enterica enterica serovar Typhi Ty2
gcaguaacgcacuuuucca

SEQ ID NO: 3741487 - RNA, 20 nt, Salmonella enterica enterica serovar Typhi Ty2
gcaguaacgcacuuuuccag

SEQ ID NO: 3741488 - RNA, 21 nt, Salmonella enterica enterica serovar Typhi Ty2
gcaguacgcgcaaccgcauca

SEQ ID NO: 3741489 - RNA, 13 nt, Salmonella enterica enterica serovar Typhi Ty2
gcaguacggcgca

SEQ ID NO: 3741490 - RNA, 12 nt, Salmonella enterica enterica serovar Typhi Ty2
gcaguagccaug

SEQ ID NO: 3741491 - RNA, 14 nt, Salmonella enterica enterica serovar Typhi Ty2
gcaguauuaccgaa

SEQ ID NO: 3741492 - RNA, 17 nt, Salmonella enterica enterica serovar Typhi Ty2
gcaguauugcaccagga

SEQ ID NO: 3741493 - RNA, 21 nt, Salmonella enterica enterica serovar Typhi Ty2
gcagucacuuucagauuuuua

SEQ ID NO: 3741494 - RNA, 13 nt, Salmonella enterica enterica serovar Typhi Ty2
gcaguccaacaag

SEQ ID NO: 3741495 - RNA, 16 nt, Salmonella enterica enterica serovar Typhi Ty2
gcaguccaacaaggau

SEQ ID NO: 3741496 - RNA, 15 nt, Salmonella enterica enterica serovar Typhi Ty2
gcagucccgccggga

SEQ ID NO: 3741497 - RNA, 14 nt, Salmonella enterica enterica serovar Typhi Ty2
gcaguccguccaga

SEQ ID NO: 3741498 - RNA, 18 nt, Salmonella enterica enterica serovar Typhi Ty2
gcagucguuuacgcgcuu

SEQ ID NO: 3741499 - RNA, 17 nt, Salmonella enterica enterica serovar Typhi Ty2
gcagugaagaauggcgc

SEQ ID NO: 3741500 - RNA, 21 nt, Salmonella enterica enterica serovar Typhi Ty2
gcagugaguaacguuaauaca

SEQ ID NO: 3741501 - RNA, 18 nt, Salmonella enterica enterica serovar Typhi Ty2
gcagugauuaugcucccg

SEQ ID NO: 3741502 - RNA, 18 nt, Salmonella enterica enterica serovar Typhi Ty2
gcagugauucguaguaag

SEQ ID NO: 3741503 - RNA, 12 nt, Salmonella enterica enterica serovar Typhi Ty2
gcagugauuuua

SEQ ID NO: 3741504 - RNA, 16 nt, Salmonella enterica enterica serovar Typhi Ty2
gcagugcgcuaacugg

SEQ ID NO: 3741505 - RNA, 17 nt, Salmonella enterica enterica serovar Typhi Ty2
gcagugcucgccaaaac

SEQ ID NO: 3741506 - RNA, 20 nt, Salmonella enterica enterica serovar Typhi Ty2
gcaguggcauguucccaugu

SEQ ID NO: 3741507 - RNA, 20 nt, Salmonella enterica enterica serovar Typhi Ty2
gcaguggccagaaugaucgc

SEQ ID NO: 3741508 - RNA, 15 nt, Salmonella enterica enterica serovar Typhi Ty2
gcaguggcucaguca

SEQ ID NO: 3741509 - RNA, 17 nt, Salmonella enterica enterica serovar Typhi Ty2
gcaguggcucagucagu

SEQ ID NO: 3741510 - RNA, 14 nt, Salmonella enterica enterica serovar Typhi Ty2
gcaguguuaaucuc

SEQ ID NO: 3741511 - RNA, 12 nt, Salmonella enterica enterica serovar Typhi Ty2
gcaguucaauau

SEQ ID NO: 3741512 - RNA, 12 nt, Salmonella enterica enterica serovar Typhi Ty2
gcaguucaucca

SEQ ID NO: 3741513 - RNA, 15 nt, Salmonella enterica enterica serovar Typhi Ty2
gcaguuccccgccgc

SEQ ID NO: 3741514 - RNA, 16 nt, Salmonella enterica enterica serovar Typhi Ty2
gcaguucccuacucuc

SEQ ID NO: 3741515 - RNA, 17 nt, Salmonella enterica enterica serovar Typhi Ty2
gcaguuccgcaauccug

SEQ ID NO: 3741516 - RNA, 20 nt, Salmonella enterica enterica serovar Typhi Ty2
gcaguucuucgccguuaucg

SEQ ID NO: 3741517 - RNA, 15 nt, Salmonella enterica enterica serovar Typhi Ty2
gcaguuuaaaucaca

SEQ ID NO: 3741518 - RNA, 23 nt, Salmonella enterica enterica serovar Typhi Ty2
gcaguuuuaccguaaaaugcugg

SEQ ID NO: 3741519 - RNA, 12 nt, Salmonella enterica enterica serovar Typhi Ty2
gcauaaaaaaac

SEQ ID NO: 3741520 - RNA, 16 nt, Salmonella enterica enterica serovar Typhi Ty2
gcauaaaaaacaucau

SEQ ID NO: 3741521 - RNA, 20 nt, Salmonella enterica enterica serovar Typhi Ty2
gcauaaaaaacaucaugccc

SEQ ID NO: 3741522 - RNA, 15 nt, Salmonella enterica enterica serovar Typhi Ty2
gcauaaaaaaggcuc

SEQ ID NO: 3741523 - RNA, 14 nt, Salmonella enterica enterica serovar Typhi Ty2
gcauaaaaaaugag

SEQ ID NO: 3741524 - RNA, 17 nt, Salmonella enterica enterica serovar Typhi Ty2
gcauaaaaccgccgccc

SEQ ID NO: 3741525 - RNA, 18 nt, Salmonella enterica enterica serovar Typhi Ty2
gcauaaccgcagcgcggc

SEQ ID NO: 3741526 - RNA, 13 nt, Salmonella enterica enterica serovar Typhi Ty2
gcauaacguacca

SEQ ID NO: 3741527 - RNA, 12 nt, Salmonella enterica enterica serovar Typhi Ty2
gcauaagcgcga

SEQ ID NO: 3741528 - RNA, 18 nt, Salmonella enterica enterica serovar Typhi Ty2
gcauaauaaagcagcggc

SEQ ID NO: 3741529 - RNA, 23 nt, Salmonella enterica enterica serovar Typhi Ty2
gcauaauacggggccauuauuua

SEQ ID NO: 3741530 - RNA, 17 nt, Salmonella enterica enterica serovar Typhi Ty2
gcauaauauccaggagc

SEQ ID NO: 3741531 - RNA, 10 nt, Salmonella enterica enterica serovar Typhi Ty2
gcauaauaug

SEQ ID NO: 3741532 - RNA, 16 nt, Salmonella enterica enterica serovar Typhi Ty2
gcauaaugcagccauc

SEQ ID NO: 3741533 - RNA, 18 nt, Salmonella enterica enterica serovar Typhi Ty2
gcauacacaucuucuaca

SEQ ID NO: 3741534 - RNA, 19 nt, Salmonella enterica enterica serovar Typhi Ty2
gcauacagaugccguccau

SEQ ID NO: 3741535 - RNA, 15 nt, Salmonella enterica enterica serovar Typhi Ty2
gcauacagcuuuuac

SEQ ID NO: 3741536 - RNA, 23 nt, Salmonella enterica enterica serovar Typhi Ty2
gcauacauucuguuuucgagccu

SEQ ID NO: 3741537 - RNA, 18 nt, Salmonella enterica enterica serovar Typhi Ty2
gcauaccaaguuuggcaa

SEQ ID NO: 3741538 - RNA, 23 nt, Salmonella enterica enterica serovar Typhi Ty2
gcaucgcguuauugaccaucgcc

SEQ ID NO: 3741539 - RNA, 15 nt, Salmonella enterica enterica serovar Typhi Ty2
gcaucgcuccccaac

SEQ ID NO: 3741540 - RNA, 13 nt, Salmonella enterica enterica serovar Typhi Ty2
gcaucggaaccgg

SEQ ID NO: 3741541 - RNA, 13 nt, Salmonella enterica enterica serovar Typhi Ty2
gcaucggcaucaa

SEQ ID NO: 3741542 - RNA, 22 nt, Salmonella enterica enterica serovar Typhi Ty2
gcaucgguaaagguuuucacgc

SEQ ID NO: 3741543 - RNA, 15 nt, Salmonella enterica enterica serovar Typhi Ty2
gcaucgguagaauga

SEQ ID NO: 3741544 - RNA, 12 nt, Salmonella enterica enterica serovar Typhi Ty2
gcaucguaccgu

SEQ ID NO: 3741545 - RNA, 14 nt, Salmonella enterica enterica serovar Typhi Ty2
gcaucguacgggca

SEQ ID NO: 3741546 - RNA, 22 nt, Salmonella enterica enterica serovar Typhi Ty2
gcaucguacgggcaaaaucuuc

SEQ ID NO: 3741547 - RNA, 14 nt, Salmonella enterica enterica serovar Typhi Ty2
gcaucguagucagg

SEQ ID NO: 3741548 - RNA, 13 nt, Salmonella enterica enterica serovar Typhi Ty2
gcaucgucugcac

SEQ ID NO: 3741549 - RNA, 19 nt, Salmonella enterica enterica serovar Typhi Ty2
gcaucugcauaauggcgac

SEQ ID NO: 3741550 - RNA, 13 nt, Salmonella enterica enterica serovar Typhi Ty2
gcaucugggcuga

SEQ ID NO: 3741551 - RNA, 19 nt, Salmonella enterica enterica serovar Typhi Ty2
gcaucugggcugagaaaaa

SEQ ID NO: 3741552 - RNA, 21 nt, Salmonella enterica enterica serovar Typhi Ty2
gcaucugggcugagaaaaauu

SEQ ID NO: 3741553 - RNA, 12 nt, Salmonella enterica enterica serovar Typhi Ty2
gcaucugucauc

SEQ ID NO: 3741554 - RNA, 16 nt, Salmonella enterica enterica serovar Typhi Ty2
gcaucugucaucgccg

SEQ ID NO: 3741555 - RNA, 17 nt, Salmonella enterica enterica serovar Typhi Ty2
gcaucuuacugaccggc

SEQ ID NO: 3741556 - RNA, 12 nt, Salmonella enterica enterica serovar Typhi Ty2
gcaucuuauauu

SEQ ID NO: 3741557 - RNA, 15 nt, Salmonella enterica enterica serovar Typhi Ty2
gcaucuuauauuuug

SEQ ID NO: 3741558 - RNA, 13 nt, Salmonella enterica enterica serovar Typhi Ty2
gcaucuucagaca

SEQ ID NO: 3741559 - RNA, 18 nt, Salmonella enterica enterica serovar Typhi Ty2
gcaucuuccucugugccg

SEQ ID NO: 3741560 - RNA, 14 nt, Salmonella enterica enterica serovar Typhi Ty2
gcaucuuuaaccgc

SEQ ID NO: 3741561 - RNA, 19 nt, Salmonella enterica enterica serovar Typhi Ty2
gcaucuuuccggaacgcgu

SEQ ID NO: 3741562 - RNA, 13 nt, Salmonella enterica enterica serovar Typhi Ty2
gcaucuuuugccg

SEQ ID NO: 3741563 - RNA, 20 nt, Salmonella enterica enterica serovar Typhi Ty2
gcaugaauaaccucccgccg

SEQ ID NO: 3741564 - RNA, 14 nt, Salmonella enterica enterica serovar Typhi Ty2
gcaugaauuucucg

SEQ ID NO: 3741565 - RNA, 19 nt, Salmonella enterica enterica serovar Typhi Ty2
gcaugacaauaacggccuc

SEQ ID NO: 3741566 - RNA, 14 nt, Salmonella enterica enterica serovar Typhi Ty2
gcaugacccaggca

SEQ ID NO: 3741567 - RNA, 19 nt, Salmonella enterica enterica serovar Typhi Ty2
gcaugacuacgaaucgcgu

SEQ ID NO: 3741568 - RNA, 17 nt, Salmonella enterica enterica serovar Typhi Ty2
gcaugagcacgcggaag

SEQ ID NO: 3741569 - RNA, 18 nt, Salmonella enterica enterica serovar Typhi Ty2
gcaugagcacgcggaaga

SEQ ID NO: 3741570 - RNA, 13 nt, Salmonella enterica enterica serovar Typhi Ty2
gcaugagccagcc

SEQ ID NO: 3741571 - RNA, 18 nt, Salmonella enterica enterica serovar Typhi Ty2
gcaugagguuaguaaugc

SEQ ID NO: 3741572 - RNA, 18 nt, Salmonella enterica enterica serovar Typhi Ty2
gcaugagugauagcgcca

SEQ ID NO: 3741573 - RNA, 21 nt, Salmonella enterica enterica serovar Typhi Ty2
gcaugaucauacugccgccgu

SEQ ID NO: 3741574 - RNA, 15 nt, Salmonella enterica enterica serovar Typhi Ty2
gcaugaucggcuggg

SEQ ID NO: 3741575 - RNA, 19 nt, Salmonella enterica enterica serovar Typhi Ty2
gcaugauggcgaacagccc

SEQ ID NO: 3741576 - RNA, 16 nt, Salmonella enterica enterica serovar Typhi Ty2
gcaugauuaagcuggg

SEQ ID NO: 3741577 - RNA, 13 nt, Salmonella enterica enterica serovar Typhi Ty2
gcaugauuacaga

SEQ ID NO: 3741578 - RNA, 20 nt, Salmonella enterica enterica serovar Typhi Ty2
gcaugcagcucaagcgccgc

SEQ ID NO: 3741579 - RNA, 16 nt, Salmonella enterica enterica serovar Typhi Ty2
gcaugcaucucuucaa

SEQ ID NO: 3741580 - RNA, 22 nt, Salmonella enterica enterica serovar Typhi Ty2
gcaugccccucgacaggaguau

SEQ ID NO: 3741581 - RNA, 20 nt, Salmonella enterica enterica serovar Typhi Ty2
gcaugcccgccagcgggccg

SEQ ID NO: 3741582 - RNA, 16 nt, Salmonella enterica enterica serovar Typhi Ty2
gcaugcggggggcaac

SEQ ID NO: 3741583 - RNA, 20 nt, Salmonella enterica enterica serovar Typhi Ty2
gcauggagcaucagcgccgg

SEQ ID NO: 3741584 - RNA, 14 nt, Salmonella enterica enterica serovar Typhi Ty2
gcauggcaauuaaa

SEQ ID NO: 3741585 - RNA, 23 nt, Salmonella enterica enterica serovar Typhi Ty2
gcauggcagccccggcauccagu

SEQ ID NO: 3741586 - RNA, 17 nt, Salmonella enterica enterica serovar Typhi Ty2
gcauggcgucggcgacu

SEQ ID NO: 3741587 - RNA, 16 nt, Salmonella enterica enterica serovar Typhi Ty2
gcauggcguugcugca

SEQ ID NO: 3741588 - RNA, 19 nt, Salmonella enterica enterica serovar Typhi Ty2
gcaugggcagcuugccgcc

SEQ ID NO: 3741589 - RNA, 22 nt, Salmonella enterica enterica serovar Typhi Ty2
gcauggggagaccccacacuac

SEQ ID NO: 3741590 - RNA, 19 nt, Salmonella enterica enterica serovar Typhi Ty2
gcauggugcagccgccauc

SEQ ID NO: 3741591 - RNA, 20 nt, Salmonella enterica enterica serovar Typhi Ty2
gcauguacaacuucaugagu

SEQ ID NO: 3741592 - RNA, 14 nt, Salmonella enterica enterica serovar Typhi Ty2
gcauguaguaagcc

SEQ ID NO: 3741593 - RNA, 18 nt, Salmonella enterica enterica serovar Typhi Ty2
gcaugucguauccccagu

SEQ ID NO: 3741594 - RNA, 17 nt, Salmonella enterica enterica serovar Typhi Ty2
gcauguuaugaauaguu

SEQ ID NO: 3741595 - RNA, 19 nt, Salmonella enterica enterica serovar Typhi Ty2
gcauguucucccugacacu

SEQ ID NO: 3741596 - RNA, 20 nt, Salmonella enterica enterica serovar Typhi Ty2
gcauuaaaucaucauaauca

SEQ ID NO: 3741597 - RNA, 17 nt, Salmonella enterica enterica serovar Typhi Ty2
gcauuaaaugcgcccag

SEQ ID NO: 3741598 - RNA, 15 nt, Salmonella enterica enterica serovar Typhi Ty2
gcauuaacaaaucau

SEQ ID NO: 3741599 - RNA, 15 nt, Salmonella enterica enterica serovar Typhi Ty2
gcauuaacguccaua

SEQ ID NO: 3741600 - RNA, 13 nt, Salmonella enterica enterica serovar Typhi Ty2
gcauuacauucau

SEQ ID NO: 3741601 - RNA, 15 nt, Salmonella enterica enterica serovar Typhi Ty2
gcauuaccgcuauuc

SEQ ID NO: 3741602 - RNA, 14 nt, Salmonella enterica enterica serovar Typhi Ty2
gcauuacgcuggcc

SEQ ID NO: 3741603 - RNA, 19 nt, Salmonella enterica enterica serovar Typhi Ty2
gcauuacgcuggccccuuu

SEQ ID NO: 3741604 - RNA, 19 nt, Salmonella enterica enterica serovar Typhi Ty2
gcauuagcaugggcuaaag

SEQ ID NO: 3741605 - RNA, 20 nt, Salmonella enterica enterica serovar Typhi Ty2
gcauuagcgcgauaaaacca

SEQ ID NO: 3741606 - RNA, 14 nt, Salmonella enterica enterica serovar Typhi Ty2
gcauuaggcuuuuc

SEQ ID NO: 3741607 - RNA, 20 nt, Salmonella enterica enterica serovar Typhi Ty2
gcauuauuuuuaaccgccuc

SEQ ID NO: 3741608 - RNA, 14 nt, Salmonella enterica enterica serovar Typhi Ty2
gcauucacgccacc

SEQ ID NO: 3741609 - RNA, 13 nt, Salmonella enterica enterica serovar Typhi Ty2
gcauucagccagc

SEQ ID NO: 3741610 - RNA, 17 nt, Salmonella enterica enterica serovar Typhi Ty2
gcauucgaauccuccug

SEQ ID NO: 3741611 - RNA, 14 nt, Salmonella enterica enterica serovar Typhi Ty2
gcauucgcuccuca

SEQ ID NO: 3741612 - RNA, 16 nt, Salmonella enterica enterica serovar Typhi Ty2
gcauucgcuccucagc

SEQ ID NO: 3741613 - RNA, 17 nt, Salmonella enterica enterica serovar Typhi Ty2
gcauucucgccgugacu

SEQ ID NO: 3741614 - RNA, 16 nt, Salmonella enterica enterica serovar Typhi Ty2
gcauugccggaaacca

SEQ ID NO: 3741615 - RNA, 17 nt, Salmonella enterica enterica serovar Typhi Ty2
gcauugcgauaugcugu

SEQ ID NO: 3741616 - RNA, 16 nt, Salmonella enterica enterica serovar Typhi Ty2
gcauugcucaacugga

SEQ ID NO: 3741617 - RNA, 17 nt, Salmonella enterica enterica serovar Typhi Ty2
gcauuggcaucugucau

SEQ ID NO: 3741618 - RNA, 19 nt, Salmonella enterica enterica serovar Typhi Ty2
gcauuggcguuaccggcag

SEQ ID NO: 3741619 - RNA, 21 nt, Salmonella enterica enterica serovar Typhi Ty2
gcauuggcguuaccggcaggc

SEQ ID NO: 3741620 - RNA, 14 nt, Salmonella enterica enterica serovar Typhi Ty2
gccacaacgccuga

SEQ ID NO: 3741621 - RNA, 17 nt, Salmonella enterica enterica serovar Typhi Ty2
gccacaauggcaggcag

SEQ ID NO: 3741622 - RNA, 21 nt, Salmonella enterica enterica serovar Typhi Ty2
gccacaaugggggcauaauac

SEQ ID NO: 3741623 - RNA, 16 nt, Salmonella enterica enterica serovar Typhi Ty2
gccacaauugccagca

SEQ ID NO: 3741624 - RNA, 18 nt, Salmonella enterica enterica serovar Typhi Ty2
gccacaauugccagcagg

SEQ ID NO: 3741625 - RNA, 16 nt, Salmonella enterica enterica serovar Typhi Ty2
gccacacucucuccag

SEQ ID NO: 3741626 - RNA, 21 nt, Salmonella enterica enterica serovar Typhi Ty2
gccacagauuaugcaguucuu

SEQ ID NO: 3741627 - RNA, 20 nt, Salmonella enterica enterica serovar Typhi Ty2
gccacagcgccagacacugg

SEQ ID NO: 3741628 - RNA, 13 nt, Salmonella enterica enterica serovar Typhi Ty2
gccacagcggaau

SEQ ID NO: 3741629 - RNA, 21 nt, Salmonella enterica enterica serovar Typhi Ty2
gccacaggaaccgguagccag

SEQ ID NO: 3741630 - RNA, 12 nt, Salmonella enterica enterica serovar Typhi Ty2
gccacauacugc

SEQ ID NO: 3741631 - RNA, 15 nt, Salmonella enterica enterica serovar Typhi Ty2
gccacauacugcuuu

SEQ ID NO: 3741632 - RNA, 17 nt, Salmonella enterica enterica serovar Typhi Ty2
gccacauagcauccaga

SEQ ID NO: 3741633 - RNA, 22 nt, Salmonella enterica enterica serovar Typhi Ty2
gccacaugauguuguucgucuu

SEQ ID NO: 3741634 - RNA, 13 nt, Salmonella enterica enterica serovar Typhi Ty2
gccacaugcggca

SEQ ID NO: 3741635 - RNA, 12 nt, Salmonella enterica enterica serovar Typhi Ty2
gccacauugacc

SEQ ID NO: 3741636 - RNA, 22 nt, Salmonella enterica enterica serovar Typhi Ty2
gccacauuucccgagccggguu

SEQ ID NO: 3741637 - RNA, 20 nt, Salmonella enterica enterica serovar Typhi Ty2
gccaccaaagccaggccgcc

SEQ ID NO: 3741638 - RNA, 23 nt, Salmonella enterica enterica serovar Typhi Ty2
gccaccaaagccaggccgccagc

SEQ ID NO: 3741639 - RNA, 19 nt, Salmonella enterica enterica serovar Typhi Ty2
gccaccacagucaucgcgc

SEQ ID NO: 3741640 - RNA, 15 nt, Salmonella enterica enterica serovar Typhi Ty2
gccaccacgcccaac

SEQ ID NO: 3741641 - RNA, 17 nt, Salmonella enterica enterica serovar Typhi Ty2
gccaccacgccgagaaa

SEQ ID NO: 3741642 - RNA, 19 nt, Salmonella enterica enterica serovar Typhi Ty2
gccaccacgccgagaaaca

SEQ ID NO: 3741643 - RNA, 13 nt, Salmonella enterica enterica serovar Typhi Ty2
gccaccacucggc

SEQ ID NO: 3741644 - RNA, 21 nt, Salmonella enterica enterica serovar Typhi Ty2
gccaccagcgccagcggcugc

SEQ ID NO: 3741645 - RNA, 15 nt, Salmonella enterica enterica serovar Typhi Ty2
gccaccagcgccaua

SEQ ID NO: 3741646 - RNA, 13 nt, Salmonella enterica enterica serovar Typhi Ty2
gccaccauaucuu

SEQ ID NO: 3741647 - RNA, 19 nt, Salmonella enterica enterica serovar Typhi Ty2
gccaccaucgucgccagac

SEQ ID NO: 3741648 - RNA, 21 nt, Salmonella enterica enterica serovar Typhi Ty2
gccaccaugauuaccugaagc

SEQ ID NO: 3741649 - RNA, 17 nt, Salmonella enterica enterica serovar Typhi Ty2
gccaccaugcugguugg

SEQ ID NO: 3741650 - RNA, 16 nt, Salmonella enterica enterica serovar Typhi Ty2
gccacccaaugauccg

SEQ ID NO: 3741651 - RNA, 17 nt, Salmonella enterica enterica serovar Typhi Ty2
gccacccacuucgccgg

SEQ ID NO: 3741652 - RNA, 15 nt, Salmonella enterica enterica serovar Typhi Ty2
gccaccccaaaucuc

SEQ ID NO: 3741653 - RNA, 21 nt, Salmonella enterica enterica serovar Typhi Ty2
gccacccggcuuuuuauuuac

SEQ ID NO: 3741654 - RNA, 16 nt, Salmonella enterica enterica serovar Typhi Ty2
gccaccgcauuuucag

SEQ ID NO: 3741655 - RNA, 13 nt, Salmonella enterica enterica serovar Typhi Ty2
gccaccgccagcc

SEQ ID NO: 3741656 - RNA, 16 nt, Salmonella enterica enterica serovar Typhi Ty2
gccaccgccagccaug

SEQ ID NO: 3741657 - RNA, 15 nt, Salmonella enterica enterica serovar Typhi Ty2
gccaccgcccagaga

SEQ ID NO: 3741658 - RNA, 14 nt, Salmonella enterica enterica serovar Typhi Ty2
gccaccgccgccac

SEQ ID NO: 3741659 - RNA, 17 nt, Salmonella enterica enterica serovar Typhi Ty2
gccaccgcuccgcgcau

SEQ ID NO: 3741660 - RNA, 17 nt, Salmonella enterica enterica serovar Typhi Ty2
gccaccggauugccuuc

SEQ ID NO: 3741661 - RNA, 21 nt, Salmonella enterica enterica serovar Typhi Ty2
gccaccgggcaacacacgcuu

SEQ ID NO: 3741662 - RNA, 15 nt, Salmonella enterica enterica serovar Typhi Ty2
gccaccgggcauggc

SEQ ID NO: 3741663 - RNA, 21 nt, Salmonella enterica enterica serovar Typhi Ty2
gccaccggguuaaagcccuga

SEQ ID NO: 3741664 - RNA, 23 nt, Salmonella enterica enterica serovar Typhi Ty2
gccaccugcacggcgucauucac

SEQ ID NO: 3741665 - RNA, 20 nt, Salmonella enterica enterica serovar Typhi Ty2
gccaccuguuucgccaggcc

SEQ ID NO: 3741666 - RNA, 15 nt, Salmonella enterica enterica serovar Typhi Ty2
gccaccuuucugcuc

SEQ ID NO: 3741667 - RNA, 16 nt, Salmonella enterica enterica serovar Typhi Ty2
gccacgaucggcaaug

SEQ ID NO: 3741668 - RNA, 16 nt, Salmonella enterica enterica serovar Typhi Ty2
gccacgcagcgcagac

SEQ ID NO: 3741669 - RNA, 11 nt, Salmonella enterica enterica serovar Typhi Ty2
gccacgccaau

SEQ ID NO: 3741670 - RNA, 17 nt, Salmonella enterica enterica serovar Typhi Ty2
gccacgccaccgggccg

SEQ ID NO: 3741671 - RNA, 23 nt, Salmonella enterica enterica serovar Typhi Ty2
gccacgccccuaaggcagcaagg

SEQ ID NO: 3741672 - RNA, 22 nt, Salmonella enterica enterica serovar Typhi Ty2
gccacgccgaggcauucagcca

SEQ ID NO: 3741673 - RNA, 14 nt, Salmonella enterica enterica serovar Typhi Ty2
gccacgccgccauc

SEQ ID NO: 3741674 - RNA, 14 nt, Salmonella enterica enterica serovar Typhi Ty2
gccacgccgcccgc

SEQ ID NO: 3741675 - RNA, 22 nt, Salmonella enterica enterica serovar Typhi Ty2
gccacgccgcuccacagcaaau

SEQ ID NO: 3741676 - RNA, 13 nt, Salmonella enterica enterica serovar Typhi Ty2
gccacgcgcguca

SEQ ID NO: 3741677 - RNA, 18 nt, Salmonella enterica enterica serovar Typhi Ty2
gccacgcggcaucaggca

SEQ ID NO: 3741678 - RNA, 17 nt, Salmonella enterica enterica serovar Typhi Ty2
gccacgcucgcuggugc

SEQ ID NO: 3741679 - RNA, 14 nt, Salmonella enterica enterica serovar Typhi Ty2
gccacgcuguucgc

SEQ ID NO: 3741680 - RNA, 20 nt, Salmonella enterica enterica serovar Typhi Ty2
gccacggagcauaauuuucc

SEQ ID NO: 3741681 - RNA, 22 nt, Salmonella enterica enterica serovar Typhi Ty2
gccacggcguguugaaauccuc

SEQ ID NO: 3741682 - RNA, 17 nt, Salmonella enterica enterica serovar Typhi Ty2
gccacgguuggcccagc

SEQ ID NO: 3741683 - RNA, 23 nt, Salmonella enterica enterica serovar Typhi Ty2
gccacgucugaugcguggcugaa

SEQ ID NO: 3741684 - RNA, 14 nt, Salmonella enterica enterica serovar Typhi Ty2
gccacguucuucca

SEQ ID NO: 3741685 - RNA, 14 nt, Salmonella enterica enterica serovar Typhi Ty2
gccacguugcgcgc

SEQ ID NO: 3741686 - RNA, 16 nt, Salmonella enterica enterica serovar Typhi Ty2
gccacguuuuccugcg

SEQ ID NO: 3741687 - RNA, 22 nt, Salmonella enterica enterica serovar Typhi Ty2
gccacuauuucggcacugacuc

SEQ ID NO: 3741688 - RNA, 19 nt, Salmonella enterica enterica serovar Typhi Ty2
gccacucacggcaaguaua

SEQ ID NO: 3741689 - RNA, 15 nt, Salmonella enterica enterica serovar Typhi Ty2
gccacuccuuacggu

SEQ ID NO: 3741690 - RNA, 12 nt, Salmonella enterica enterica serovar Typhi Ty2
gccacucuccag

SEQ ID NO: 3741691 - RNA, 19 nt, Salmonella enterica enterica serovar Typhi Ty2
gccacucuggcgacgccaa

SEQ ID NO: 3741692 - RNA, 15 nt, Salmonella enterica enterica serovar Typhi Ty2
gccacugcuggccca

SEQ ID NO: 3741693 - RNA, 21 nt, Salmonella enterica enterica serovar Typhi Ty2
gccacuuaccaaucgcggcga

SEQ ID NO: 3741694 - RNA, 18 nt, Salmonella enterica enterica serovar Typhi Ty2
gccacuuccagcgcgccg

SEQ ID NO: 3741695 - RNA, 23 nt, Salmonella enterica enterica serovar Typhi Ty2
gccacuuccagcgcgccgucauc

SEQ ID NO: 3741696 - RNA, 16 nt, Salmonella enterica enterica serovar Typhi Ty2
gccacuuuuccggcac

SEQ ID NO: 3741697 - RNA, 18 nt, Salmonella enterica enterica serovar Typhi Ty2
gccacuuuuccggcaccu

SEQ ID NO: 3741698 - RNA, 18 nt, Salmonella enterica enterica serovar Typhi Ty2
gccagaaaaaaaagcgcc

SEQ ID NO: 3741699 - RNA, 15 nt, Salmonella enterica enterica serovar Typhi Ty2
gccagaacgcuguug

SEQ ID NO: 3741700 - RNA, 20 nt, Salmonella enterica enterica serovar Typhi Ty2
gccagaauacaccgccuagc

SEQ ID NO: 3741701 - RNA, 17 nt, Salmonella enterica enterica serovar Typhi Ty2
gccagaaugcccagcaa

SEQ ID NO: 3741702 - RNA, 14 nt, Salmonella enterica enterica serovar Typhi Ty2
gccagcgccuuagg

SEQ ID NO: 3741703 - RNA, 22 nt, Salmonella enterica enterica serovar Typhi Ty2
gccagcgcguuuuccauuuuac

SEQ ID NO: 3741704 - RNA, 17 nt, Salmonella enterica enterica serovar Typhi Ty2
gccagcgcuacccgcug

SEQ ID NO: 3741705 - RNA, 18 nt, Salmonella enterica enterica serovar Typhi Ty2
gccagcgcugagaugacc

SEQ ID NO: 3741706 - RNA, 18 nt, Salmonella enterica enterica serovar Typhi Ty2
gccagcggaucgcgucca

SEQ ID NO: 3741707 - RNA, 14 nt, Salmonella enterica enterica serovar Typhi Ty2
gccagcggccagcc

SEQ ID NO: 3741708 - RNA, 16 nt, Salmonella enterica enterica serovar Typhi Ty2
gccagcggccagccau

SEQ ID NO: 3741709 - RNA, 13 nt, Salmonella enterica enterica serovar Typhi Ty2
gccagcggcgcca

SEQ ID NO: 3741710 - RNA, 13 nt, Salmonella enterica enterica serovar Typhi Ty2
gccagcggcggcu

SEQ ID NO: 3741711 - RNA, 19 nt, Salmonella enterica enterica serovar Typhi Ty2
gccagcggcugcuccccca

SEQ ID NO: 3741712 - RNA, 13 nt, Salmonella enterica enterica serovar Typhi Ty2
gccagcgggcgca

SEQ ID NO: 3741713 - RNA, 15 nt, Salmonella enterica enterica serovar Typhi Ty2
gccagcgggcgcagu

SEQ ID NO: 3741714 - RNA, 13 nt, Salmonella enterica enterica serovar Typhi Ty2
gccagcgucaccu

SEQ ID NO: 3741715 - RNA, 21 nt, Salmonella enterica enterica serovar Typhi Ty2
gccagcgucaccucuuucgcc

SEQ ID NO: 3741716 - RNA, 14 nt, Salmonella enterica enterica serovar Typhi Ty2
gccagcgucaucag

SEQ ID NO: 3741717 - RNA, 16 nt, Salmonella enterica enterica serovar Typhi Ty2
gccagcgucgcugauu

SEQ ID NO: 3741718 - RNA, 18 nt, Salmonella enterica enterica serovar Typhi Ty2
gccagcgucucagcaggc

SEQ ID NO: 3741719 - RNA, 16 nt, Salmonella enterica enterica serovar Typhi Ty2
gccagcgugacccaga

SEQ ID NO: 3741720 - RNA, 18 nt, Salmonella enterica enterica serovar Typhi Ty2
gccagcgugacccagaca

SEQ ID NO: 3741721 - RNA, 17 nt, Salmonella enterica enterica serovar Typhi Ty2
gccagcgugcgcagcgc

SEQ ID NO: 3741722 - RNA, 12 nt, Salmonella enterica enterica serovar Typhi Ty2
gccagcgugcuu

SEQ ID NO: 3741723 - RNA, 16 nt, Salmonella enterica enterica serovar Typhi Ty2
gccagcguugaccagc

SEQ ID NO: 3741724 - RNA, 18 nt, Salmonella enterica enterica serovar Typhi Ty2
gccagcuacaccugggcu

SEQ ID NO: 3741725 - RNA, 20 nt, Salmonella enterica enterica serovar Typhi Ty2
gccagcuacaccugggcuug

SEQ ID NO: 3741726 - RNA, 20 nt, Salmonella enterica enterica serovar Typhi Ty2
gccagcuacgacaagcuguu

SEQ ID NO: 3741727 - RNA, 18 nt, Salmonella enterica enterica serovar Typhi Ty2
gccagcucaugcgcggcg

SEQ ID NO: 3741728 - RNA, 17 nt, Salmonella enterica enterica serovar Typhi Ty2
gccagcuccugcgggcu

SEQ ID NO: 3741729 - RNA, 14 nt, Salmonella enterica enterica serovar Typhi Ty2
gccagcucuuuucu

SEQ ID NO: 3741730 - RNA, 16 nt, Salmonella enterica enterica serovar Typhi Ty2
gccagcucuuuucugg

SEQ ID NO: 3741731 - RNA, 16 nt, Salmonella enterica enterica serovar Typhi Ty2
gccagcuuaaaucgcg

SEQ ID NO: 3741732 - RNA, 20 nt, Salmonella enterica enterica serovar Typhi Ty2
gccagcuuaaaucgcggcgc

SEQ ID NO: 3741733 - RNA, 16 nt, Salmonella enterica enterica serovar Typhi Ty2
gccagcuucgcugcgc

SEQ ID NO: 3741734 - RNA, 18 nt, Salmonella enterica enterica serovar Typhi Ty2
gccagcuuucggcgagcu

SEQ ID NO: 3741735 - RNA, 17 nt, Salmonella enterica enterica serovar Typhi Ty2
gccaggaucgccgccgc

SEQ ID NO: 3741736 - RNA, 19 nt, Salmonella enterica enterica serovar Typhi Ty2
gccaggcaaagccccaguc

SEQ ID NO: 3741737 - RNA, 21 nt, Salmonella enterica enterica serovar Typhi Ty2
gccaggcauugauaaagcgcu

SEQ ID NO: 3741738 - RNA, 19 nt, Salmonella enterica enterica serovar Typhi Ty2
gccaggccagauggcuuua

SEQ ID NO: 3741739 - RNA, 19 nt, Salmonella enterica enterica serovar Typhi Ty2
gccaggccauugcugagga

SEQ ID NO: 3741740 - RNA, 15 nt, Salmonella enterica enterica serovar Typhi Ty2
gccaggcgauuguca

SEQ ID NO: 3741741 - RNA, 13 nt, Salmonella enterica enterica serovar Typhi Ty2
gccaggcgccacg

SEQ ID NO: 3741742 - RNA, 19 nt, Salmonella enterica enterica serovar Typhi Ty2
gccaggcgcuaucuucaau

SEQ ID NO: 3741743 - RNA, 14 nt, Salmonella enterica enterica serovar Typhi Ty2
gccaggcuuccugc

SEQ ID NO: 3741744 - RNA, 19 nt, Salmonella enterica enterica serovar Typhi Ty2
gccaggcuuuaaauucagc

SEQ ID NO: 3741745 - RNA, 13 nt, Salmonella enterica enterica serovar Typhi Ty2
gccagggcaggca

SEQ ID NO: 3741746 - RNA, 16 nt, Salmonella enterica enterica serovar Typhi Ty2
gccagggcaggcagug

SEQ ID NO: 3741747 - RNA, 22 nt, Salmonella enterica enterica serovar Typhi Ty2
gccagggcggcaaaaucuuuuu

SEQ ID NO: 3741748 - RNA, 21 nt, Salmonella enterica enterica serovar Typhi Ty2
gccagggcgggauccccugcu

SEQ ID NO: 3741749 - RNA, 21 nt, Salmonella enterica enterica serovar Typhi Ty2
gccaggggaugauuuucaggc

SEQ ID NO: 3741750 - RNA, 15 nt, Salmonella enterica enterica serovar Typhi Ty2
gccaggguucaaccu

SEQ ID NO: 3741751 - RNA, 16 nt, Salmonella enterica enterica serovar Typhi Ty2
gccagguacaucgcgc

SEQ ID NO: 3741752 - RNA, 17 nt, Salmonella enterica enterica serovar Typhi Ty2
gccagguauacagacaa

SEQ ID NO: 3741753 - RNA, 20 nt, Salmonella enterica enterica serovar Typhi Ty2
gccaggucucauagcgcccc

SEQ ID NO: 3741754 - RNA, 15 nt, Salmonella enterica enterica serovar Typhi Ty2
gccaggucugcacca

SEQ ID NO: 3741755 - RNA, 16 nt, Salmonella enterica enterica serovar Typhi Ty2
gccaggugccgagguu

SEQ ID NO: 3741756 - RNA, 23 nt, Salmonella enterica enterica serovar Typhi Ty2
gccagguuauuucgcgcaguuag

SEQ ID NO: 3741757 - RNA, 18 nt, Salmonella enterica enterica serovar Typhi Ty2
gccagguugcgcccggcg

SEQ ID NO: 3741758 - RNA, 20 nt, Salmonella enterica enterica serovar Typhi Ty2
gccagguugcgcccggcgca

SEQ ID NO: 3741759 - RNA, 15 nt, Salmonella enterica enterica serovar Typhi Ty2
gccaguaaucggcgc

SEQ ID NO: 3741760 - RNA, 17 nt, Salmonella enterica enterica serovar Typhi Ty2
gccaguaccgccgccgg

SEQ ID NO: 3741761 - RNA, 20 nt, Salmonella enterica enterica serovar Typhi Ty2
gccaguagauggcgcuaaaa

SEQ ID NO: 3741762 - RNA, 22 nt, Salmonella enterica enterica serovar Typhi Ty2
gccaguagcggaauaucuuccc

SEQ ID NO: 3741763 - RNA, 15 nt, Salmonella enterica enterica serovar Typhi Ty2
gccaguagcucgccg

SEQ ID NO: 3741764 - RNA, 14 nt, Salmonella enterica enterica serovar Typhi Ty2
gccaguagcugcuc

SEQ ID NO: 3741765 - RNA, 21 nt, Salmonella enterica enterica serovar Typhi Ty2
gccaguaucgcgccgccaaua

SEQ ID NO: 3741766 - RNA, 23 nt, Salmonella enterica enterica serovar Typhi Ty2
gccagucaauaagcuugcuuucc

SEQ ID NO: 3741767 - RNA, 13 nt, Salmonella enterica enterica serovar Typhi Ty2
gccaguccagguu

SEQ ID NO: 3741768 - RNA, 14 nt, Salmonella enterica enterica serovar Typhi Ty2
gccaguccgcccgc

SEQ ID NO: 3741769 - RNA, 23 nt, Salmonella enterica enterica serovar Typhi Ty2
gccaguccgguggcgaaaacgcu

SEQ ID NO: 3741770 - RNA, 16 nt, Salmonella enterica enterica serovar Typhi Ty2
gccaguccugccacca

SEQ ID NO: 3741771 - RNA, 18 nt, Salmonella enterica enterica serovar Typhi Ty2
gccaguccugccaccagc

SEQ ID NO: 3741772 - RNA, 19 nt, Salmonella enterica enterica serovar Typhi Ty2
gccaguccugccaccagcg

SEQ ID NO: 3741773 - RNA, 14 nt, Salmonella enterica enterica serovar Typhi Ty2
gccagucgcagaug

SEQ ID NO: 3741774 - RNA, 17 nt, Salmonella enterica enterica serovar Typhi Ty2
gccagucgcagcaaacg

SEQ ID NO: 3741775 - RNA, 15 nt, Salmonella enterica enterica serovar Typhi Ty2
gccagucgccaggca

SEQ ID NO: 3741776 - RNA, 16 nt, Salmonella enterica enterica serovar Typhi Ty2
gccagucgccaggcaa

SEQ ID NO: 3741777 - RNA, 18 nt, Salmonella enterica enterica serovar Typhi Ty2
gccagucuuauuguccug

SEQ ID NO: 3741778 - RNA, 18 nt, Salmonella enterica enterica serovar Typhi Ty2
gccagucuuccauuacaa

SEQ ID NO: 3741779 - RNA, 18 nt, Salmonella enterica enterica serovar Typhi Ty2
gccagucuuugcaggagg

SEQ ID NO: 3741780 - RNA, 22 nt, Salmonella enterica enterica serovar Typhi Ty2
gccagucuuugcaggaggcgcg

SEQ ID NO: 3741781 - RNA, 13 nt, Salmonella enterica enterica serovar Typhi Ty2
gccagugaaucca

SEQ ID NO: 3741782 - RNA, 21 nt, Salmonella enterica enterica serovar Typhi Ty2
gccaguuaagcaacugauuaa

SEQ ID NO: 3741783 - RNA, 15 nt, Salmonella enterica enterica serovar Typhi Ty2
gccaguucacgccgc

SEQ ID NO: 3741784 - RNA, 14 nt, Salmonella enterica enterica serovar Typhi Ty2
gccaugccaucggc

SEQ ID NO: 3741785 - RNA, 15 nt, Salmonella enterica enterica serovar Typhi Ty2
gccaugccaucggcc

SEQ ID NO: 3741786 - RNA, 19 nt, Salmonella enterica enterica serovar Typhi Ty2
gccaugccuaaaccgacaa

SEQ ID NO: 3741787 - RNA, 19 nt, Salmonella enterica enterica serovar Typhi Ty2
gccaugcuauucagcaguu

SEQ ID NO: 3741788 - RNA, 14 nt, Salmonella enterica enterica serovar Typhi Ty2
gccaugcucaucca

SEQ ID NO: 3741789 - RNA, 16 nt, Salmonella enterica enterica serovar Typhi Ty2
gccaugcucauccaac

SEQ ID NO: 3741790 - RNA, 19 nt, Salmonella enterica enterica serovar Typhi Ty2
gccaugcucauccaacugc

SEQ ID NO: 3741791 - RNA, 19 nt, Salmonella enterica enterica serovar Typhi Ty2
gccauggcccuuuugcccg

SEQ ID NO: 3741792 - RNA, 15 nt, Salmonella enterica enterica serovar Typhi Ty2
gccauggccgcagcc

SEQ ID NO: 3741793 - RNA, 21 nt, Salmonella enterica enterica serovar Typhi Ty2
gccaugguucacaauacagaa

SEQ ID NO: 3741794 - RNA, 16 nt, Salmonella enterica enterica serovar Typhi Ty2
gccaugucuucacucu

SEQ ID NO: 3741795 - RNA, 20 nt, Salmonella enterica enterica serovar Typhi Ty2
gccauguuaauaccagcgcc

SEQ ID NO: 3741796 - RNA, 15 nt, Salmonella enterica enterica serovar Typhi Ty2
gccauguuccucaca

SEQ ID NO: 3741797 - RNA, 13 nt, Salmonella enterica enterica serovar Typhi Ty2
gccauuaaccaga

SEQ ID NO: 3741798 - RNA, 19 nt, Salmonella enterica enterica serovar Typhi Ty2
gccauuaaugcaggcagca

SEQ ID NO: 3741799 - RNA, 20 nt, Salmonella enterica enterica serovar Typhi Ty2
gccauuaaugcaggcagcac

SEQ ID NO: 3741800 - RNA, 22 nt, Salmonella enterica enterica serovar Typhi Ty2
gccauuaucaccauucccagcg

SEQ ID NO: 3741801 - RNA, 17 nt, Salmonella enterica enterica serovar Typhi Ty2
gccauuauuguguucuc

SEQ ID NO: 3741802 - RNA, 18 nt, Salmonella enterica enterica serovar Typhi Ty2
gccauuauuguguucuca

SEQ ID NO: 3741803 - RNA, 14 nt, Salmonella enterica enterica serovar Typhi Ty2
gccauucauuaaaa

SEQ ID NO: 3741804 - RNA, 14 nt, Salmonella enterica enterica serovar Typhi Ty2
gccauuccagccgg

SEQ ID NO: 3741805 - RNA, 17 nt, Salmonella enterica enterica serovar Typhi Ty2
gccauuccgcagaagcc

SEQ ID NO: 3741806 - RNA, 18 nt, Salmonella enterica enterica serovar Typhi Ty2
gccauuccgcuucuucca

SEQ ID NO: 3741807 - RNA, 19 nt, Salmonella enterica enterica serovar Typhi Ty2
gccauucgcccagucauca

SEQ ID NO: 3741808 - RNA, 21 nt, Salmonella enterica enterica serovar Typhi Ty2
gccauugccaggacugacgga

SEQ ID NO: 3741809 - RNA, 18 nt, Salmonella enterica enterica serovar Typhi Ty2
gccauugccaguaccgac

SEQ ID NO: 3741810 - RNA, 12 nt, Salmonella enterica enterica serovar Typhi Ty2
gccauugccgcg

SEQ ID NO: 3741811 - RNA, 17 nt, Salmonella enterica enterica serovar Typhi Ty2
gccauugccgcgccgac

SEQ ID NO: 3741812 - RNA, 21 nt, Salmonella enterica enterica serovar Typhi Ty2
gccauugcuaggaacagugac

SEQ ID NO: 3741813 - RNA, 15 nt, Salmonella enterica enterica serovar Typhi Ty2
gccauuggcaaucag

SEQ ID NO: 3741814 - RNA, 18 nt, Salmonella enterica enterica serovar Typhi Ty2
gccauuggcaaucaguac

SEQ ID NO: 3741815 - RNA, 19 nt, Salmonella enterica enterica serovar Typhi Ty2
gccauuggcgauaaaguca

SEQ ID NO: 3741816 - RNA, 13 nt, Salmonella enterica enterica serovar Typhi Ty2
gccauuuacgcca

SEQ ID NO: 3741817 - RNA, 20 nt, Salmonella enterica enterica serovar Typhi Ty2
gccauuucaauaauauguuc

SEQ ID NO: 3741818 - RNA, 13 nt, Salmonella enterica enterica serovar Typhi Ty2
gccauuuccagcc

SEQ ID NO: 3741819 - RNA, 14 nt, Salmonella enterica enterica serovar Typhi Ty2
gccauuucugcuca

SEQ ID NO: 3741820 - RNA, 22 nt, Salmonella enterica enterica serovar Typhi Ty2
gccauuugcauccguagcuuca

SEQ ID NO: 3741821 - RNA, 19 nt, Salmonella enterica enterica serovar Typhi Ty2
gccauuuuauccaggccag

SEQ ID NO: 3741822 - RNA, 22 nt, Salmonella enterica enterica serovar Typhi Ty2
gcccaaaauagcguccagccgc

SEQ ID NO: 3741823 - RNA, 16 nt, Salmonella enterica enterica serovar Typhi Ty2
gcccaaauaguccagc

SEQ ID NO: 3741824 - RNA, 19 nt, Salmonella enterica enterica serovar Typhi Ty2
gcccaaauaguccagcagc

SEQ ID NO: 3741825 - RNA, 19 nt, Salmonella enterica enterica serovar Typhi Ty2
gcccaacagcaauguuuca

SEQ ID NO: 3741826 - RNA, 23 nt, Salmonella enterica enterica serovar Typhi Ty2
gcccaacgcggcuuuaaguuuuu

SEQ ID NO: 3741827 - RNA, 15 nt, Salmonella enterica enterica serovar Typhi Ty2
gcccaauagcgcuga

SEQ ID NO: 3741828 - RNA, 17 nt, Salmonella enterica enterica serovar Typhi Ty2
gcccacaaccgacgcac

SEQ ID NO: 3741829 - RNA, 19 nt, Salmonella enterica enterica serovar Typhi Ty2
gcccacaaugacagaaaug

SEQ ID NO: 3741830 - RNA, 14 nt, Salmonella enterica enterica serovar Typhi Ty2
gcccacaggcaggg

SEQ ID NO: 3741831 - RNA, 15 nt, Salmonella enterica enterica serovar Typhi Ty2
gcccaccaucagacc

SEQ ID NO: 3741832 - RNA, 18 nt, Salmonella enterica enterica serovar Typhi Ty2
gcccaccgccaaccgccc

SEQ ID NO: 3741833 - RNA, 23 nt, Salmonella enterica enterica serovar Typhi Ty2
gcccaccggagcggcguccgcca

SEQ ID NO: 3741834 - RNA, 18 nt, Salmonella enterica enterica serovar Typhi Ty2
gcccaccugaaaaagggu

SEQ ID NO: 3741835 - RNA, 15 nt, Salmonella enterica enterica serovar Typhi Ty2
gcccaccuucgcgga

SEQ ID NO: 3741836 - RNA, 12 nt, Salmonella enterica enterica serovar Typhi Ty2
gcccacgcccag

SEQ ID NO: 3741837 - RNA, 15 nt, Salmonella enterica enterica serovar Typhi Ty2
gcccacgcccagagc

SEQ ID NO: 3741838 - RNA, 19 nt, Salmonella enterica enterica serovar Typhi Ty2
gcccacggaugaucuucau

SEQ ID NO: 3741839 - RNA, 20 nt, Salmonella enterica enterica serovar Typhi Ty2
gcccacggaugaucuucaua

SEQ ID NO: 3741840 - RNA, 20 nt, Salmonella enterica enterica serovar Typhi Ty2
gcccacuauuuuucauggca

SEQ ID NO: 3741841 - RNA, 16 nt, Salmonella enterica enterica serovar Typhi Ty2
gcccacucauccagca

SEQ ID NO: 3741842 - RNA, 17 nt, Salmonella enterica enterica serovar Typhi Ty2
gcccacuguggcgccac

SEQ ID NO: 3741843 - RNA, 18 nt, Salmonella enterica enterica serovar Typhi Ty2
gcccagaaagaucagcag

SEQ ID NO: 3741844 - RNA, 14 nt, Salmonella enterica enterica serovar Typhi Ty2
gcccagaacggcag

SEQ ID NO: 3741845 - RNA, 21 nt, Salmonella enterica enterica serovar Typhi Ty2
gcccagacaaagggcacaccg

SEQ ID NO: 3741846 - RNA, 23 nt, Salmonella enterica enterica serovar Typhi Ty2
gcccagauaaugccgcuggcgua

SEQ ID NO: 3741847 - RNA, 14 nt, Salmonella enterica enterica serovar Typhi Ty2
gcccagaucaggcc

SEQ ID NO: 3741848 - RNA, 21 nt, Salmonella enterica enterica serovar Typhi Ty2
gcccagcacggcaagcgcggc

SEQ ID NO: 3741849 - RNA, 18 nt, Salmonella enterica enterica serovar Typhi Ty2
gcccagcacuaacagcag

SEQ ID NO: 3741850 - RNA, 10 nt, Salmonella enterica enterica serovar Typhi Ty2
gcccagcagc

SEQ ID NO: 3741851 - RNA, 15 nt, Salmonella enterica enterica serovar Typhi Ty2
gcccagcagcugcug

SEQ ID NO: 3741852 - RNA, 21 nt, Salmonella enterica enterica serovar Typhi Ty2
gcccagcauauuaacagugag

SEQ ID NO: 3741853 - RNA, 13 nt, Salmonella enterica enterica serovar Typhi Ty2
gcccagcauuacu

SEQ ID NO: 3741854 - RNA, 16 nt, Salmonella enterica enterica serovar Typhi Ty2
gcccagcccggaaaua

SEQ ID NO: 3741855 - RNA, 13 nt, Salmonella enterica enterica serovar Typhi Ty2
gcccagccugccu

SEQ ID NO: 3741856 - RNA, 15 nt, Salmonella enterica enterica serovar Typhi Ty2
gcccagcgccgcauc

SEQ ID NO: 3741857 - RNA, 13 nt, Salmonella enterica enterica serovar Typhi Ty2
gcccagcgccgga

SEQ ID NO: 3741858 - RNA, 16 nt, Salmonella enterica enterica serovar Typhi Ty2
gcccagcgccgucaua

SEQ ID NO: 3741859 - RNA, 23 nt, Salmonella enterica enterica serovar Typhi Ty2
gcccagcgccgugucaucauuac

SEQ ID NO: 3741860 - RNA, 19 nt, Salmonella enterica enterica serovar Typhi Ty2
gcccagcgcgaccugcauc

SEQ ID NO: 3741861 - RNA, 13 nt, Salmonella enterica enterica serovar Typhi Ty2
gcccagcgcggcc

SEQ ID NO: 3741862 - RNA, 20 nt, Salmonella enterica enterica serovar Typhi Ty2
gcccagcuaaaccacggaau

SEQ ID NO: 3741863 - RNA, 12 nt, Salmonella enterica enterica serovar Typhi Ty2
gcccagcuuagu

SEQ ID NO: 3741864 - RNA, 17 nt, Salmonella enterica enterica serovar Typhi Ty2
gcccagcuuaguaaccc

SEQ ID NO: 3741865 - RNA, 11 nt, Salmonella enterica enterica serovar Typhi Ty2
gcccaggccug

SEQ ID NO: 3741866 - RNA, 21 nt, Salmonella enterica enterica serovar Typhi Ty2
gcccgauaagcaagcgccauc

SEQ ID NO: 3741867 - RNA, 19 nt, Salmonella enterica enterica serovar Typhi Ty2
gcccgauagcguaaagaaa

SEQ ID NO: 3741868 - RNA, 23 nt, Salmonella enterica enterica serovar Typhi Ty2
gcccgauagugcaagcucaucgg

SEQ ID NO: 3741869 - RNA, 14 nt, Salmonella enterica enterica serovar Typhi Ty2
gcccgauggcgcug

SEQ ID NO: 3741870 - RNA, 15 nt, Salmonella enterica enterica serovar Typhi Ty2
gcccgauggcgcugc

SEQ ID NO: 3741871 - RNA, 20 nt, Salmonella enterica enterica serovar Typhi Ty2
gcccgauggcgcugcgcgca

SEQ ID NO: 3741872 - RNA, 21 nt, Salmonella enterica enterica serovar Typhi Ty2
gcccgauggcgcugcgcgcau

SEQ ID NO: 3741873 - RNA, 17 nt, Salmonella enterica enterica serovar Typhi Ty2
gcccgauggcgcugcgu

SEQ ID NO: 3741874 - RNA, 23 nt, Salmonella enterica enterica serovar Typhi Ty2
gcccgccaccagcacagcccagu

SEQ ID NO: 3741875 - RNA, 12 nt, Salmonella enterica enterica serovar Typhi Ty2
gcccgccagcac

SEQ ID NO: 3741876 - RNA, 14 nt, Salmonella enterica enterica serovar Typhi Ty2
gcccgccagcacag

SEQ ID NO: 3741877 - RNA, 16 nt, Salmonella enterica enterica serovar Typhi Ty2
gcccgccagcacagca

SEQ ID NO: 3741878 - RNA, 14 nt, Salmonella enterica enterica serovar Typhi Ty2
gcccgccagcacca

SEQ ID NO: 3741879 - RNA, 13 nt, Salmonella enterica enterica serovar Typhi Ty2
gcccgccagcggg

SEQ ID NO: 3741880 - RNA, 15 nt, Salmonella enterica enterica serovar Typhi Ty2
gcccgcccacaggcu

SEQ ID NO: 3741881 - RNA, 19 nt, Salmonella enterica enterica serovar Typhi Ty2
gcccgccgcgaccagcagc

SEQ ID NO: 3741882 - RNA, 14 nt, Salmonella enterica enterica serovar Typhi Ty2
gcccgccuccguca

SEQ ID NO: 3741883 - RNA, 16 nt, Salmonella enterica enterica serovar Typhi Ty2
gcccgccucgcugaua

SEQ ID NO: 3741884 - RNA, 15 nt, Salmonella enterica enterica serovar Typhi Ty2
gcccgcgcuaagcac

SEQ ID NO: 3741885 - RNA, 11 nt, Salmonella enterica enterica serovar Typhi Ty2
gcccgcggcga

SEQ ID NO: 3741886 - RNA, 17 nt, Salmonella enterica enterica serovar Typhi Ty2
gcccgcguaacagcggu

SEQ ID NO: 3741887 - RNA, 17 nt, Salmonella enterica enterica serovar Typhi Ty2
gcccgcuaacggcacca

SEQ ID NO: 3741888 - RNA, 21 nt, Salmonella enterica enterica serovar Typhi Ty2
gcccgcuaucaccgcccaaug

SEQ ID NO: 3741889 - RNA, 14 nt, Salmonella enterica enterica serovar Typhi Ty2
gcccgcucguuuca

SEQ ID NO: 3741890 - RNA, 22 nt, Salmonella enterica enterica serovar Typhi Ty2
gcccgcuucacgcgcggcuacu

SEQ ID NO: 3741891 - RNA, 22 nt, Salmonella enterica enterica serovar Typhi Ty2
gcccggaaauggguaucuucau

SEQ ID NO: 3741892 - RNA, 21 nt, Salmonella enterica enterica serovar Typhi Ty2
gcccggagggguuuucgccag

SEQ ID NO: 3741893 - RNA, 22 nt, Salmonella enterica enterica serovar Typhi Ty2
gcccggauaaccgcccgcggcg

SEQ ID NO: 3741894 - RNA, 15 nt, Salmonella enterica enterica serovar Typhi Ty2
gcccggcaugucgcc

SEQ ID NO: 3741895 - RNA, 17 nt, Salmonella enterica enterica serovar Typhi Ty2
gcccggccacagcgcca

SEQ ID NO: 3741896 - RNA, 14 nt, Salmonella enterica enterica serovar Typhi Ty2
gcccggccggugcu

SEQ ID NO: 3741897 - RNA, 17 nt, Salmonella enterica enterica serovar Typhi Ty2
gcccggcgcgacgccgc

SEQ ID NO: 3741898 - RNA, 20 nt, Salmonella enterica enterica serovar Typhi Ty2
gcccggcgcgacgccgcaua

SEQ ID NO: 3741899 - RNA, 18 nt, Salmonella enterica enterica serovar Typhi Ty2
gcccggcgcgcuggaggc

SEQ ID NO: 3741900 - RNA, 18 nt, Salmonella enterica enterica serovar Typhi Ty2
gcccggcggcacggcgcu

SEQ ID NO: 3741901 - RNA, 11 nt, Salmonella enterica enterica serovar Typhi Ty2
gcccggcggcg

SEQ ID NO: 3741902 - RNA, 17 nt, Salmonella enterica enterica serovar Typhi Ty2
gcccggcguaugccggg

SEQ ID NO: 3741903 - RNA, 14 nt, Salmonella enterica enterica serovar Typhi Ty2
gcccggcuucccau

SEQ ID NO: 3741904 - RNA, 15 nt, Salmonella enterica enterica serovar Typhi Ty2
gcccggcuuucuguu

SEQ ID NO: 3741905 - RNA, 22 nt, Salmonella enterica enterica serovar Typhi Ty2
gcccgggagaacgccgggccug

SEQ ID NO: 3741906 - RNA, 19 nt, Salmonella enterica enterica serovar Typhi Ty2
gcccgggcacgauggccug

SEQ ID NO: 3741907 - RNA, 16 nt, Salmonella enterica enterica serovar Typhi Ty2
gcccgguaagcgcagc

SEQ ID NO: 3741908 - RNA, 18 nt, Salmonella enterica enterica serovar Typhi Ty2
gcccgguaagcgcagcgc

SEQ ID NO: 3741909 - RNA, 20 nt, Salmonella enterica enterica serovar Typhi Ty2
gcccgguaagcgcagcgcca

SEQ ID NO: 3741910 - RNA, 23 nt, Salmonella enterica enterica serovar Typhi Ty2
gcccgguagcgcaaacuaccggg

SEQ ID NO: 3741911 - RNA, 14 nt, Salmonella enterica enterica serovar Typhi Ty2
gcccgguauuuuuu

SEQ ID NO: 3741912 - RNA, 23 nt, Salmonella enterica enterica serovar Typhi Ty2
gcccggugauggugcagccccgg

SEQ ID NO: 3741913 - RNA, 19 nt, Salmonella enterica enterica serovar Typhi Ty2
gcccgguggcgccacgcca

SEQ ID NO: 3741914 - RNA, 14 nt, Salmonella enterica enterica serovar Typhi Ty2
gcccgguggcgcug

SEQ ID NO: 3741915 - RNA, 15 nt, Salmonella enterica enterica serovar Typhi Ty2
gcccgguggcgcugc

SEQ ID NO: 3741916 - RNA, 22 nt, Salmonella enterica enterica serovar Typhi Ty2
gcccgguggcggcuggcgccuu

SEQ ID NO: 3741917 - RNA, 15 nt, Salmonella enterica enterica serovar Typhi Ty2
gcccgguuacgcuuc

SEQ ID NO: 3741918 - RNA, 13 nt, Salmonella enterica enterica serovar Typhi Ty2
gcccgguucaccg

SEQ ID NO: 3741919 - RNA, 20 nt, Salmonella enterica enterica serovar Typhi Ty2
gcccgguucgaacgacagaa

SEQ ID NO: 3741920 - RNA, 15 nt, Salmonella enterica enterica serovar Typhi Ty2
gcccguaaacaggcu

SEQ ID NO: 3741921 - RNA, 18 nt, Salmonella enterica enterica serovar Typhi Ty2
gcccguaaacaggcugcc

SEQ ID NO: 3741922 - RNA, 14 nt, Salmonella enterica enterica serovar Typhi Ty2
gcccguaaacgggc

SEQ ID NO: 3741923 - RNA, 17 nt, Salmonella enterica enterica serovar Typhi Ty2
gcccguagcgacgccau

SEQ ID NO: 3741924 - RNA, 16 nt, Salmonella enterica enterica serovar Typhi Ty2
gcccguagcucagcug

SEQ ID NO: 3741925 - RNA, 18 nt, Salmonella enterica enterica serovar Typhi Ty2
gcccgucccuuccgccac

SEQ ID NO: 3741926 - RNA, 20 nt, Salmonella enterica enterica serovar Typhi Ty2
gcccgucccuuccgccacca

SEQ ID NO: 3741927 - RNA, 21 nt, Salmonella enterica enterica serovar Typhi Ty2
gcccgucugggagccgcugcu

SEQ ID NO: 3741928 - RNA, 14 nt, Salmonella enterica enterica serovar Typhi Ty2
gcccgugacgccag

SEQ ID NO: 3741929 - RNA, 16 nt, Salmonella enterica enterica serovar Typhi Ty2
gcccgugacgccaggc

SEQ ID NO: 3741930 - RNA, 17 nt, Salmonella enterica enterica serovar Typhi Ty2
gcccguucucgccgcgu

SEQ ID NO: 3741931 - RNA, 17 nt, Salmonella enterica enterica serovar Typhi Ty2
gcccguugucacaggcu

SEQ ID NO: 3741932 - RNA, 19 nt, Salmonella enterica enterica serovar Typhi Ty2
gcccguuuuaaugaacagc

SEQ ID NO: 3741933 - RNA, 15 nt, Salmonella enterica enterica serovar Typhi Ty2
gcccguuuuuuccag

SEQ ID NO: 3741934 - RNA, 18 nt, Salmonella enterica enterica serovar Typhi Ty2
gcccguuuuuuccagcgc

SEQ ID NO: 3741935 - RNA, 19 nt, Salmonella enterica enterica serovar Typhi Ty2
gcccguuuuuuccagcgcc

SEQ ID NO: 3741936 - RNA, 16 nt, Salmonella enterica enterica serovar Typhi Ty2
gcccuauaacagcgcu

SEQ ID NO: 3741937 - RNA, 15 nt, Salmonella enterica enterica serovar Typhi Ty2
gcccucgcaaagcug

SEQ ID NO: 3741938 - RNA, 15 nt, Salmonella enterica enterica serovar Typhi Ty2
gcccucgccagcaac

SEQ ID NO: 3741939 - RNA, 21 nt, Salmonella enterica enterica serovar Typhi Ty2
gcccucgggucgaauuccagu

SEQ ID NO: 3741940 - RNA, 19 nt, Salmonella enterica enterica serovar Typhi Ty2
gcccucuaagcgcucaaau

SEQ ID NO: 3741941 - RNA, 12 nt, Salmonella enterica enterica serovar Typhi Ty2
gcccucugucca

SEQ ID NO: 3741942 - RNA, 20 nt, Salmonella enterica enterica serovar Typhi Ty2
gcccucuucuucuuccguca

SEQ ID NO: 3741943 - RNA, 17 nt, Salmonella enterica enterica serovar Typhi Ty2
gcccucuuuaucaaaca

SEQ ID NO: 3741944 - RNA, 22 nt, Salmonella enterica enterica serovar Typhi Ty2
gcccugaaagccgacccgcauc

SEQ ID NO: 3741945 - RNA, 19 nt, Salmonella enterica enterica serovar Typhi Ty2
gcccugaagggcggcugga

SEQ ID NO: 3741946 - RNA, 23 nt, Salmonella enterica enterica serovar Typhi Ty2
gcccugaagggcggcuggauaaa

SEQ ID NO: 3741947 - RNA, 15 nt, Salmonella enterica enterica serovar Typhi Ty2
gcccugacgccgcug

SEQ ID NO: 3741948 - RNA, 21 nt, Salmonella enterica enterica serovar Typhi Ty2
gccgauaacucuucaucgcgc

SEQ ID NO: 3741949 - RNA, 13 nt, Salmonella enterica enterica serovar Typhi Ty2
gccgauaagcgcu

SEQ ID NO: 3741950 - RNA, 19 nt, Salmonella enterica enterica serovar Typhi Ty2
gccgauaauaaacgcgcca

SEQ ID NO: 3741951 - RNA, 15 nt, Salmonella enterica enterica serovar Typhi Ty2
gccgauaauacgcgc

SEQ ID NO: 3741952 - RNA, 16 nt, Salmonella enterica enterica serovar Typhi Ty2
gccgauaaucgcgucu

SEQ ID NO: 3741953 - RNA, 13 nt, Salmonella enterica enterica serovar Typhi Ty2
gccgauacugccc

SEQ ID NO: 3741954 - RNA, 18 nt, Salmonella enterica enterica serovar Typhi Ty2
gccgauagcaucgcugau

SEQ ID NO: 3741955 - RNA, 20 nt, Salmonella enterica enterica serovar Typhi Ty2
gccgauaguggucgccacgc

SEQ ID NO: 3741956 - RNA, 17 nt, Salmonella enterica enterica serovar Typhi Ty2
gccgaucaccagcgcau

SEQ ID NO: 3741957 - RNA, 16 nt, Salmonella enterica enterica serovar Typhi Ty2
gccgaucagcgccauu

SEQ ID NO: 3741958 - RNA, 16 nt, Salmonella enterica enterica serovar Typhi Ty2
gccgaucaggccgcag

SEQ ID NO: 3741959 - RNA, 17 nt, Salmonella enterica enterica serovar Typhi Ty2
gccgaucaggccgcaga

SEQ ID NO: 3741960 - RNA, 20 nt, Salmonella enterica enterica serovar Typhi Ty2
gccgaucaucccgcccagca

SEQ ID NO: 3741961 - RNA, 19 nt, Salmonella enterica enterica serovar Typhi Ty2
gccgaucuuuaccucaggu

SEQ ID NO: 3741962 - RNA, 18 nt, Salmonella enterica enterica serovar Typhi Ty2
gccgaugacucccagucc

SEQ ID NO: 3741963 - RNA, 15 nt, Salmonella enterica enterica serovar Typhi Ty2
gccgaugagcugaug

SEQ ID NO: 3741964 - RNA, 14 nt, Salmonella enterica enterica serovar Typhi Ty2
gccgaugccgccga

SEQ ID NO: 3741965 - RNA, 12 nt, Salmonella enterica enterica serovar Typhi Ty2
gccgaugccugc

SEQ ID NO: 3741966 - RNA, 13 nt, Salmonella enterica enterica serovar Typhi Ty2
gccgauggcgcuc

SEQ ID NO: 3741967 - RNA, 13 nt, Salmonella enterica enterica serovar Typhi Ty2
gccgauuucacgc

SEQ ID NO: 3741968 - RNA, 13 nt, Salmonella enterica enterica serovar Typhi Ty2
gccgauuucauuc

SEQ ID NO: 3741969 - RNA, 14 nt, Salmonella enterica enterica serovar Typhi Ty2
gccgauuuuucggc

SEQ ID NO: 3741970 - RNA, 12 nt, Salmonella enterica enterica serovar Typhi Ty2
gccgcaaaagcc

SEQ ID NO: 3741971 - RNA, 15 nt, Salmonella enterica enterica serovar Typhi Ty2
gccgcaaacagcacg

SEQ ID NO: 3741972 - RNA, 21 nt, Salmonella enterica enterica serovar Typhi Ty2
gccgcaaacgccgaagccagc

SEQ ID NO: 3741973 - RNA, 19 nt, Salmonella enterica enterica serovar Typhi Ty2
gccgcaaacgccugcuccg

SEQ ID NO: 3741974 - RNA, 22 nt, Salmonella enterica enterica serovar Typhi Ty2
gccgcaaacgccugcuccgucc

SEQ ID NO: 3741975 - RNA, 19 nt, Salmonella enterica enterica serovar Typhi Ty2
gccgcaaacggaauagcgc

SEQ ID NO: 3741976 - RNA, 14 nt, Salmonella enterica enterica serovar Typhi Ty2
gccgcaacggucgg

SEQ ID NO: 3741977 - RNA, 15 nt, Salmonella enterica enterica serovar Typhi Ty2
gccgcaaggacgcca

SEQ ID NO: 3741978 - RNA, 20 nt, Salmonella enterica enterica serovar Typhi Ty2
gccgcaauaguuaauguuga

SEQ ID NO: 3741979 - RNA, 21 nt, Salmonella enterica enterica serovar Typhi Ty2
gccgcaaucacuucauacgaa

SEQ ID NO: 3741980 - RNA, 14 nt, Salmonella enterica enterica serovar Typhi Ty2
gccgcaaucagcgu

SEQ ID NO: 3741981 - RNA, 14 nt, Salmonella enterica enterica serovar Typhi Ty2
gccgcaaugaccac

SEQ ID NO: 3741982 - RNA, 18 nt, Salmonella enterica enterica serovar Typhi Ty2
gccgcaaugaccacaaau

SEQ ID NO: 3741983 - RNA, 21 nt, Salmonella enterica enterica serovar Typhi Ty2
gccgcaaugaccacaaauucu

SEQ ID NO: 3741984 - RNA, 21 nt, Salmonella enterica enterica serovar Typhi Ty2
gccgcaauuccugacugcgcg

SEQ ID NO: 3741985 - RNA, 16 nt, Salmonella enterica enterica serovar Typhi Ty2
gccgcacaaaauuuug

SEQ ID NO: 3741986 - RNA, 17 nt, Salmonella enterica enterica serovar Typhi Ty2
gccgcaccagucggcaa

SEQ ID NO: 3741987 - RNA, 21 nt, Salmonella enterica enterica serovar Typhi Ty2
gccgcaccagucggcaaagac

SEQ ID NO: 3741988 - RNA, 14 nt, Salmonella enterica enterica serovar Typhi Ty2
gccgcacuucacgc

SEQ ID NO: 3741989 - RNA, 14 nt, Salmonella enterica enterica serovar Typhi Ty2
gccgcagcccgccc

SEQ ID NO: 3741990 - RNA, 15 nt, Salmonella enterica enterica serovar Typhi Ty2
gccgcagcccgccca

SEQ ID NO: 3741991 - RNA, 18 nt, Salmonella enterica enterica serovar Typhi Ty2
gccgcagccgcucagggu

SEQ ID NO: 3741992 - RNA, 20 nt, Salmonella enterica enterica serovar Typhi Ty2
gccgcaggaaagugccuggg

SEQ ID NO: 3741993 - RNA, 22 nt, Salmonella enterica enterica serovar Typhi Ty2
gccgcaggaaagugccugggga

SEQ ID NO: 3741994 - RNA, 12 nt, Salmonella enterica enterica serovar Typhi Ty2
gccgcaggccau

SEQ ID NO: 3741995 - RNA, 23 nt, Salmonella enterica enterica serovar Typhi Ty2
gccgcauaauccagcaggugcgg

SEQ ID NO: 3741996 - RNA, 23 nt, Salmonella enterica enterica serovar Typhi Ty2
gccgcaucauaguuuuuccccau

SEQ ID NO: 3741997 - RNA, 21 nt, Salmonella enterica enterica serovar Typhi Ty2
gccgcauccccauagacagua

SEQ ID NO: 3741998 - RNA, 18 nt, Salmonella enterica enterica serovar Typhi Ty2
gccgcauccuguuuuuuc

SEQ ID NO: 3741999 - RNA, 19 nt, Salmonella enterica enterica serovar Typhi Ty2
gccgcauggagcaucagcg

SEQ ID NO: 3742000 - RNA, 22 nt, Salmonella enterica enterica serovar Typhi Ty2
gccgcauggagcaucagcgccg

SEQ ID NO: 3742001 - RNA, 19 nt, Salmonella enterica enterica serovar Typhi Ty2
gccgccaaacugcgcgccg

SEQ ID NO: 3742002 - RNA, 20 nt, Salmonella enterica enterica serovar Typhi Ty2
gccgccaaacugcgcgccgc

SEQ ID NO: 3742003 - RNA, 23 nt, Salmonella enterica enterica serovar Typhi Ty2
gccgccaaacugcgcgccgcccu

SEQ ID NO: 3742004 - RNA, 19 nt, Salmonella enterica enterica serovar Typhi Ty2
gccgccaaagcgauccggc

SEQ ID NO: 3742005 - RNA, 14 nt, Salmonella enterica enterica serovar Typhi Ty2
gccgccaaagcgcc

SEQ ID NO: 3742006 - RNA, 17 nt, Salmonella enterica enterica serovar Typhi Ty2
gccgccaacgccagcag

SEQ ID NO: 3742007 - RNA, 18 nt, Salmonella enterica enterica serovar Typhi Ty2
gccgccaacgccagcagc

SEQ ID NO: 3742008 - RNA, 17 nt, Salmonella enterica enterica serovar Typhi Ty2
gccgccaauaggggcgg

SEQ ID NO: 3742009 - RNA, 17 nt, Salmonella enterica enterica serovar Typhi Ty2
gccgccaccacaaagcg

SEQ ID NO: 3742010 - RNA, 14 nt, Salmonella enterica enterica serovar Typhi Ty2
gccgccaccgccuc

SEQ ID NO: 3742011 - RNA, 12 nt, Salmonella enterica enterica serovar Typhi Ty2
gccgccagaauc

SEQ ID NO: 3742012 - RNA, 24 nt, Salmonella enterica enterica serovar Typhi Ty2
gccgccagaaucaccucuuucucc

SEQ ID NO: 3742013 - RNA, 20 nt, Salmonella enterica enterica serovar Typhi Ty2
gccgccagauuauccagucc

SEQ ID NO: 3742014 - RNA, 14 nt, Salmonella enterica enterica serovar Typhi Ty2
gccgccagcaaacu

SEQ ID NO: 3742015 - RNA, 13 nt, Salmonella enterica enterica serovar Typhi Ty2
gccgccagcaaua

SEQ ID NO: 3742016 - RNA, 17 nt, Salmonella enterica enterica serovar Typhi Ty2
gccgccagcaccgccgc

SEQ ID NO: 3742017 - RNA, 19 nt, Salmonella enterica enterica serovar Typhi Ty2
gccgccagccauccccaua

SEQ ID NO: 3742018 - RNA, 12 nt, Salmonella enterica enterica serovar Typhi Ty2
gccgccagcgac

SEQ ID NO: 3742019 - RNA, 19 nt, Salmonella enterica enterica serovar Typhi Ty2
gccgccagcucaugcgcgg

SEQ ID NO: 3742020 - RNA, 17 nt, Salmonella enterica enterica serovar Typhi Ty2
gccgccaggcaaauucu

SEQ ID NO: 3742021 - RNA, 21 nt, Salmonella enterica enterica serovar Typhi Ty2
gccgccaggcauguuaugaau

SEQ ID NO: 3742022 - RNA, 20 nt, Salmonella enterica enterica serovar Typhi Ty2
gccgccaguugcucaacauu

SEQ ID NO: 3742023 - RNA, 20 nt, Salmonella enterica enterica serovar Typhi Ty2
gccgccauaacgccggcgcu

SEQ ID NO: 3742024 - RNA, 22 nt, Salmonella enterica enterica serovar Typhi Ty2
gccgccauccgacauuauuaca

SEQ ID NO: 3742025 - RNA, 12 nt, Salmonella enterica enterica serovar Typhi Ty2
gccgccauccgg

SEQ ID NO: 3742026 - RNA, 14 nt, Salmonella enterica enterica serovar Typhi Ty2
gccgccauccggca

SEQ ID NO: 3742027 - RNA, 16 nt, Salmonella enterica enterica serovar Typhi Ty2
gccgccauccggcaaa

SEQ ID NO: 3742028 - RNA, 15 nt, Salmonella enterica enterica serovar Typhi Ty2
gccgccauccggcac

SEQ ID NO: 3742029 - RNA, 16 nt, Salmonella enterica enterica serovar Typhi Ty2
gccgccauccggcauu

SEQ ID NO: 3742030 - RNA, 18 nt, Salmonella enterica enterica serovar Typhi Ty2
gccgcugucgccagaaug

SEQ ID NO: 3742031 - RNA, 14 nt, Salmonella enterica enterica serovar Typhi Ty2
gccgcuuauccggc

SEQ ID NO: 3742032 - RNA, 18 nt, Salmonella enterica enterica serovar Typhi Ty2
gccgcuuuugccgcgacu

SEQ ID NO: 3742033 - RNA, 19 nt, Salmonella enterica enterica serovar Typhi Ty2
gccgcuuuugccgcgacuu

SEQ ID NO: 3742034 - RNA, 18 nt, Salmonella enterica enterica serovar Typhi Ty2
gccgcuuuuuucagcggc

SEQ ID NO: 3742035 - RNA, 22 nt, Salmonella enterica enterica serovar Typhi Ty2
gccggaaaaaaugggcuggaaa

SEQ ID NO: 3742036 - RNA, 21 nt, Salmonella enterica enterica serovar Typhi Ty2
gccggaaaagcgcuggcuggc

SEQ ID NO: 3742037 - RNA, 22 nt, Salmonella enterica enterica serovar Typhi Ty2
gccggaaagaauaaucgccgcc

SEQ ID NO: 3742038 - RNA, 20 nt, Salmonella enterica enterica serovar Typhi Ty2
gccggaaaggcgcaacgucg

SEQ ID NO: 3742039 - RNA, 22 nt, Salmonella enterica enterica serovar Typhi Ty2
gccggaaauagagagggccgca

SEQ ID NO: 3742040 - RNA, 16 nt, Salmonella enterica enterica serovar Typhi Ty2
gccggaaaucgcggcg

SEQ ID NO: 3742041 - RNA, 15 nt, Salmonella enterica enterica serovar Typhi Ty2
gccggaagcgcgaau

SEQ ID NO: 3742042 - RNA, 13 nt, Salmonella enterica enterica serovar Typhi Ty2
gccggacagcagc

SEQ ID NO: 3742043 - RNA, 14 nt, Salmonella enterica enterica serovar Typhi Ty2
gccggacgccacca

SEQ ID NO: 3742044 - RNA, 21 nt, Salmonella enterica enterica serovar Typhi Ty2
gccggacgcggcuuauccggc

SEQ ID NO: 3742045 - RNA, 17 nt, Salmonella enterica enterica serovar Typhi Ty2
gccggacuguugaugau

SEQ ID NO: 3742046 - RNA, 13 nt, Salmonella enterica enterica serovar Typhi Ty2
gccggagaccggc

SEQ ID NO: 3742047 - RNA, 21 nt, Salmonella enterica enterica serovar Typhi Ty2
gccggaggaggacucuccgag

SEQ ID NO: 3742048 - RNA, 18 nt, Salmonella enterica enterica serovar Typhi Ty2
gccggauaaccuucgggc

SEQ ID NO: 3742049 - RNA, 15 nt, Salmonella enterica enterica serovar Typhi Ty2
gccggauaagacgcg

SEQ ID NO: 3742050 - RNA, 22 nt, Salmonella enterica enterica serovar Typhi Ty2
gccggauaagacgcgcagcggc

SEQ ID NO: 3742051 - RNA, 19 nt, Salmonella enterica enterica serovar Typhi Ty2
gccggauaagacgcuacgc

SEQ ID NO: 3742052 - RNA, 20 nt, Salmonella enterica enterica serovar Typhi Ty2
gccggauaagcguagcgcca

SEQ ID NO: 3742053 - RNA, 17 nt, Salmonella enterica enterica serovar Typhi Ty2
gccggauaagcguuagc

SEQ ID NO: 3742054 - RNA, 14 nt, Salmonella enterica enterica serovar Typhi Ty2
gccggauaaggcau

SEQ ID NO: 3742055 - RNA, 21 nt, Salmonella enterica enterica serovar Typhi Ty2
gccggauaaggcgcuugugau

SEQ ID NO: 3742056 - RNA, 22 nt, Salmonella enterica enterica serovar Typhi Ty2
gccggauaaggcggagccgcca

SEQ ID NO: 3742057 - RNA, 16 nt, Salmonella enterica enterica serovar Typhi Ty2
gccggauaagguguuu

SEQ ID NO: 3742058 - RNA, 23 nt, Salmonella enterica enterica serovar Typhi Ty2
gccggauacgucacgucagcguc

SEQ ID NO: 3742059 - RNA, 20 nt, Salmonella enterica enterica serovar Typhi Ty2
gccggauagacaugaccgga

SEQ ID NO: 3742060 - RNA, 23 nt, Salmonella enterica enterica serovar Typhi Ty2
gccggauagcggcuucgccagau

SEQ ID NO: 3742061 - RNA, 19 nt, Salmonella enterica enterica serovar Typhi Ty2
gccggauagcguagcgcca

SEQ ID NO: 3742062 - RNA, 20 nt, Salmonella enterica enterica serovar Typhi Ty2
gccggauaucgcuauccggc

SEQ ID NO: 3742063 - RNA, 21 nt, Salmonella enterica enterica serovar Typhi Ty2
gccggauauggcguccggcca

SEQ ID NO: 3742064 - RNA, 14 nt, Salmonella enterica enterica serovar Typhi Ty2
gccggaucaggcgu

SEQ ID NO: 3742065 - RNA, 17 nt, Salmonella enterica enterica serovar Typhi Ty2
gccggauggcaacgcca

SEQ ID NO: 3742066 - RNA, 12 nt, Salmonella enterica enterica serovar Typhi Ty2
gccggauggcgc

SEQ ID NO: 3742067 - RNA, 13 nt, Salmonella enterica enterica serovar Typhi Ty2
gccggauggcgcu

SEQ ID NO: 3742068 - RNA, 21 nt, Salmonella enterica enterica serovar Typhi Ty2
gccggauggcgcuuugcuuau

SEQ ID NO: 3742069 - RNA, 14 nt, Salmonella enterica enterica serovar Typhi Ty2
gccggauggcggcg

SEQ ID NO: 3742070 - RNA, 16 nt, Salmonella enterica enterica serovar Typhi Ty2
gccggauggcggcgca

SEQ ID NO: 3742071 - RNA, 13 nt, Salmonella enterica enterica serovar Typhi Ty2
gccggaugguggu

SEQ ID NO: 3742072 - RNA, 14 nt, Salmonella enterica enterica serovar Typhi Ty2
gccggauguaggcc

SEQ ID NO: 3742073 - RNA, 17 nt, Salmonella enterica enterica serovar Typhi Ty2
gccggaugugagcgcau

SEQ ID NO: 3742074 - RNA, 22 nt, Salmonella enterica enterica serovar Typhi Ty2
gccggaugugagcgcauccggc

SEQ ID NO: 3742075 - RNA, 13 nt, Salmonella enterica enterica serovar Typhi Ty2
gccggcaaagcca

SEQ ID NO: 3742076 - RNA, 14 nt, Salmonella enterica enterica serovar Typhi Ty2
gccggcaaagccau

SEQ ID NO: 3742077 - RNA, 16 nt, Salmonella enterica enterica serovar Typhi Ty2
gccggcaaagguugcc

SEQ ID NO: 3742078 - RNA, 20 nt, Salmonella enterica enterica serovar Typhi Ty2
gccggcaaagguugccgcaa

SEQ ID NO: 3742079 - RNA, 12 nt, Salmonella enterica enterica serovar Typhi Ty2
gccggcagcagc

SEQ ID NO: 3742080 - RNA, 13 nt, Salmonella enterica enterica serovar Typhi Ty2
gccggcagcagcu

SEQ ID NO: 3742081 - RNA, 15 nt, Salmonella enterica enterica serovar Typhi Ty2
gccggcagccgcuga

SEQ ID NO: 3742082 - RNA, 19 nt, Salmonella enterica enterica serovar Typhi Ty2
gccggcaucauucugcagg

SEQ ID NO: 3742083 - RNA, 23 nt, Salmonella enterica enterica serovar Typhi Ty2
gccggcaucauucugcaggcggg

SEQ ID NO: 3742084 - RNA, 15 nt, Salmonella enterica enterica serovar Typhi Ty2
gccggccugauaagc

SEQ ID NO: 3742085 - RNA, 16 nt, Salmonella enterica enterica serovar Typhi Ty2
gccggcgaccaugcca

SEQ ID NO: 3742086 - RNA, 18 nt, Salmonella enterica enterica serovar Typhi Ty2
gccggcgauaacccgcgc

SEQ ID NO: 3742087 - RNA, 12 nt, Salmonella enterica enterica serovar Typhi Ty2
gccggcgcagcg

SEQ ID NO: 3742088 - RNA, 21 nt, Salmonella enterica enterica serovar Typhi Ty2
gccggcggaaaaaagcagcau

SEQ ID NO: 3742089 - RNA, 19 nt, Salmonella enterica enterica serovar Typhi Ty2
gccggcgucaucggcgcca

SEQ ID NO: 3742090 - RNA, 21 nt, Salmonella enterica enterica serovar Typhi Ty2
gccggcgucaucggcgccagc

SEQ ID NO: 3742091 - RNA, 23 nt, Salmonella enterica enterica serovar Typhi Ty2
gccggcgucgaucagcgcguaga

SEQ ID NO: 3742092 - RNA, 17 nt, Salmonella enterica enterica serovar Typhi Ty2
gccgggaucugauacgg

SEQ ID NO: 3742093 - RNA, 18 nt, Salmonella enterica enterica serovar Typhi Ty2
gccgggcauaaacuaauc

SEQ ID NO: 3742094 - RNA, 15 nt, Salmonella enterica enterica serovar Typhi Ty2
gccgggccagacgcu

SEQ ID NO: 3742095 - RNA, 17 nt, Salmonella enterica enterica serovar Typhi Ty2
gccgggccugagcgcgc

SEQ ID NO: 3742096 - RNA, 20 nt, Salmonella enterica enterica serovar Typhi Ty2
gccgggcggcuguguccgcc

SEQ ID NO: 3742097 - RNA, 20 nt, Salmonella enterica enterica serovar Typhi Ty2
gccgggcgucacccgccggc

SEQ ID NO: 3742098 - RNA, 18 nt, Salmonella enterica enterica serovar Typhi Ty2
gccgggcuauccggcugu

SEQ ID NO: 3742099 - RNA, 15 nt, Salmonella enterica enterica serovar Typhi Ty2
gccgggcugaccgcu

SEQ ID NO: 3742100 - RNA, 16 nt, Salmonella enterica enterica serovar Typhi Ty2
gccgggcuucauaccg

SEQ ID NO: 3742101 - RNA, 13 nt, Salmonella enterica enterica serovar Typhi Ty2
gccggggcgcugg

SEQ ID NO: 3742102 - RNA, 15 nt, Salmonella enterica enterica serovar Typhi Ty2
gccggguaaacgcag

SEQ ID NO: 3742103 - RNA, 13 nt, Salmonella enterica enterica serovar Typhi Ty2
gccgguaagaaga

SEQ ID NO: 3742104 - RNA, 21 nt, Salmonella enterica enterica serovar Typhi Ty2
gccgguaagaagaaccagcgc

SEQ ID NO: 3742105 - RNA, 21 nt, Salmonella enterica enterica serovar Typhi Ty2
gccgguaaucgaucccgccgc

SEQ ID NO: 3742106 - RNA, 14 nt, Salmonella enterica enterica serovar Typhi Ty2
gccgguaaucgcgc

SEQ ID NO: 3742107 - RNA, 22 nt, Salmonella enterica enterica serovar Typhi Ty2
gccgguacgggaaauagcggaa

SEQ ID NO: 3742108 - RNA, 19 nt, Salmonella enterica enterica serovar Typhi Ty2
gccgguacuggagaccggc

SEQ ID NO: 3742109 - RNA, 17 nt, Salmonella enterica enterica serovar Typhi Ty2
gccgguagcuucagcgg

SEQ ID NO: 3742110 - RNA, 18 nt, Salmonella enterica enterica serovar Typhi Ty2
gccgguagcuucagcggc

SEQ ID NO: 3742111 - RNA, 13 nt, Salmonella enterica enterica serovar Typhi Ty2
gccgguauccagc

SEQ ID NO: 3742112 - RNA, 17 nt, Salmonella enterica enterica serovar Typhi Ty2
gccugauuucccaguug

SEQ ID NO: 3742113 - RNA, 13 nt, Salmonella enterica enterica serovar Typhi Ty2
gccugauuucuga

SEQ ID NO: 3742114 - RNA, 20 nt, Salmonella enterica enterica serovar Typhi Ty2
gccugcaaaccucucccccg

SEQ ID NO: 3742115 - RNA, 12 nt, Salmonella enterica enterica serovar Typhi Ty2
gccugcaaacga

SEQ ID NO: 3742116 - RNA, 12 nt, Salmonella enterica enterica serovar Typhi Ty2
gccugcagaccc

SEQ ID NO: 3742117 - RNA, 13 nt, Salmonella enterica enterica serovar Typhi Ty2
gccugcagaccca

SEQ ID NO: 3742118 - RNA, 22 nt, Salmonella enterica enterica serovar Typhi Ty2
gccugcauaaaggaguaacaga

SEQ ID NO: 3742119 - RNA, 18 nt, Salmonella enterica enterica serovar Typhi Ty2
gccugcauaauugcugac

SEQ ID NO: 3742120 - RNA, 19 nt, Salmonella enterica enterica serovar Typhi Ty2
gccugcaucaccucagaau

SEQ ID NO: 3742121 - RNA, 16 nt, Salmonella enterica enterica serovar Typhi Ty2
gccugcccugcggcag

SEQ ID NO: 3742122 - RNA, 16 nt, Salmonella enterica enterica serovar Typhi Ty2
gccugccgcaucugac

SEQ ID NO: 3742123 - RNA, 19 nt, Salmonella enterica enterica serovar Typhi Ty2
gccugccgcauguccccag

SEQ ID NO: 3742124 - RNA, 16 nt, Salmonella enterica enterica serovar Typhi Ty2
gccugccgcgccgccg

SEQ ID NO: 3742125 - RNA, 13 nt, Salmonella enterica enterica serovar Typhi Ty2
gccugccgggccu

SEQ ID NO: 3742126 - RNA, 18 nt, Salmonella enterica enterica serovar Typhi Ty2
gccugccgggccugcggc

SEQ ID NO: 3742127 - RNA, 21 nt, Salmonella enterica enterica serovar Typhi Ty2
gccugccgggccugcggcgac

SEQ ID NO: 3742128 - RNA, 16 nt, Salmonella enterica enterica serovar Typhi Ty2
gccugccgucgcggcu

SEQ ID NO: 3742129 - RNA, 22 nt, Salmonella enterica enterica serovar Typhi Ty2
gccugccgucuuuuagcaucag

SEQ ID NO: 3742130 - RNA, 18 nt, Salmonella enterica enterica serovar Typhi Ty2
gccugcgaaugcaggccg

SEQ ID NO: 3742131 - RNA, 16 nt, Salmonella enterica enterica serovar Typhi Ty2
gccugcgaucuguguc

SEQ ID NO: 3742132 - RNA, 12 nt, Salmonella enterica enterica serovar Typhi Ty2
gccugcgccagc

SEQ ID NO: 3742133 - RNA, 16 nt, Salmonella enterica enterica serovar Typhi Ty2
gccugcgccagcgccg

SEQ ID NO: 3742134 - RNA, 17 nt, Salmonella enterica enterica serovar Typhi Ty2
gccugcgccagcgccgg

SEQ ID NO: 3742135 - RNA, 14 nt, Salmonella enterica enterica serovar Typhi Ty2
gccugcgccgcagg

SEQ ID NO: 3742136 - RNA, 19 nt, Salmonella enterica enterica serovar Typhi Ty2
gccugcgccuauuguucca

SEQ ID NO: 3742137 - RNA, 23 nt, Salmonella enterica enterica serovar Typhi Ty2
gccugcgccuauuguuccaaugu

SEQ ID NO: 3742138 - RNA, 21 nt, Salmonella enterica enterica serovar Typhi Ty2
gccugcgcgccugacgcggac

SEQ ID NO: 3742139 - RNA, 12 nt, Salmonella enterica enterica serovar Typhi Ty2
gccugcgcggca

SEQ ID NO: 3742140 - RNA, 19 nt, Salmonella enterica enterica serovar Typhi Ty2
gccugcgcucauauacccu

SEQ ID NO: 3742141 - RNA, 21 nt, Salmonella enterica enterica serovar Typhi Ty2
gccugcgcucauauacccugc

SEQ ID NO: 3742142 - RNA, 21 nt, Salmonella enterica enterica serovar Typhi Ty2
gccugcggauucaggacgaga

SEQ ID NO: 3742143 - RNA, 20 nt, Salmonella enterica enterica serovar Typhi Ty2
gccugcgguaaucgccgcga

SEQ ID NO: 3742144 - RNA, 14 nt, Salmonella enterica enterica serovar Typhi Ty2
gccugcgugcgccg

SEQ ID NO: 3742145 - RNA, 20 nt, Salmonella enterica enterica serovar Typhi Ty2
gccugcucaauacuuuccgg

SEQ ID NO: 3742146 - RNA, 14 nt, Salmonella enterica enterica serovar Typhi Ty2
gccugcucaucagg

SEQ ID NO: 3742147 - RNA, 15 nt, Salmonella enterica enterica serovar Typhi Ty2
gccugcuccgccagg

SEQ ID NO: 3742148 - RNA, 16 nt, Salmonella enterica enterica serovar Typhi Ty2
gccugcucuugcggca

SEQ ID NO: 3742149 - RNA, 14 nt, Salmonella enterica enterica serovar Typhi Ty2
gccugcugccugca

SEQ ID NO: 3742150 - RNA, 20 nt, Salmonella enterica enterica serovar Typhi Ty2
gccugcugcgguaaggcagc

SEQ ID NO: 3742151 - RNA, 14 nt, Salmonella enterica enterica serovar Typhi Ty2
gccugcuggagccg

SEQ ID NO: 3742152 - RNA, 15 nt, Salmonella enterica enterica serovar Typhi Ty2
gccugcuggucugaa

SEQ ID NO: 3742153 - RNA, 20 nt, Salmonella enterica enterica serovar Typhi Ty2
gccugcuguaaccccugcgc

SEQ ID NO: 3742154 - RNA, 15 nt, Salmonella enterica enterica serovar Typhi Ty2
gccugcuucagacaa

SEQ ID NO: 3742155 - RNA, 18 nt, Salmonella enterica enterica serovar Typhi Ty2
gccuggagcguaagcgcg

SEQ ID NO: 3742156 - RNA, 16 nt, Salmonella enterica enterica serovar Typhi Ty2
gccuggcaacaugacc

SEQ ID NO: 3742157 - RNA, 18 nt, Salmonella enterica enterica serovar Typhi Ty2
gccuggcaacaugaccag

SEQ ID NO: 3742158 - RNA, 18 nt, Salmonella enterica enterica serovar Typhi Ty2
gccuggcauggugcagcc

SEQ ID NO: 3742159 - RNA, 15 nt, Salmonella enterica enterica serovar Typhi Ty2
gccuggcauuuuacu

SEQ ID NO: 3742160 - RNA, 21 nt, Salmonella enterica enterica serovar Typhi Ty2
gccuggcccggcaguugcugg

SEQ ID NO: 3742161 - RNA, 12 nt, Salmonella enterica enterica serovar Typhi Ty2
gccuggccuccg

SEQ ID NO: 3742162 - RNA, 15 nt, Salmonella enterica enterica serovar Typhi Ty2
gccuggcgcagcgcu

SEQ ID NO: 3742163 - RNA, 13 nt, Salmonella enterica enterica serovar Typhi Ty2
gccuggcgcuggg

SEQ ID NO: 3742164 - RNA, 14 nt, Salmonella enterica enterica serovar Typhi Ty2
gccuggcgcugggu

SEQ ID NO: 3742165 - RNA, 16 nt, Salmonella enterica enterica serovar Typhi Ty2
gccugggauaagcaga

SEQ ID NO: 3742166 - RNA, 18 nt, Salmonella enterica enterica serovar Typhi Ty2
gccugguaagcguagcgc

SEQ ID NO: 3742167 - RNA, 21 nt, Salmonella enterica enterica serovar Typhi Ty2
gccugguggcgacgcguggca

SEQ ID NO: 3742168 - RNA, 18 nt, Salmonella enterica enterica serovar Typhi Ty2
gccuguaaacguuccugc

SEQ ID NO: 3742169 - RNA, 20 nt, Salmonella enterica enterica serovar Typhi Ty2
gccuguaaggucucagcgac

SEQ ID NO: 3742170 - RNA, 21 nt, Salmonella enterica enterica serovar Typhi Ty2
gccuguaaggucucagcgacc

SEQ ID NO: 3742171 - RNA, 19 nt, Salmonella enterica enterica serovar Typhi Ty2
gccuguaccgggcagacau

SEQ ID NO: 3742172 - RNA, 17 nt, Salmonella enterica enterica serovar Typhi Ty2
gccuguacuugcgccgc

SEQ ID NO: 3742173 - RNA, 21 nt, Salmonella enterica enterica serovar Typhi Ty2
gccuguacuugcgccgccauc

SEQ ID NO: 3742174 - RNA, 16 nt, Salmonella enterica enterica serovar Typhi Ty2
gccuguagcagcgcca

SEQ ID NO: 3742175 - RNA, 22 nt, Salmonella enterica enterica serovar Typhi Ty2
gccuguagcagcgccagcgugc

SEQ ID NO: 3742176 - RNA, 17 nt, Salmonella enterica enterica serovar Typhi Ty2
gccuguaguacaugcca

SEQ ID NO: 3742177 - RNA, 19 nt, Salmonella enterica enterica serovar Typhi Ty2
gccugucacguaaaauuag

SEQ ID NO: 3742178 - RNA, 13 nt, Salmonella enterica enterica serovar Typhi Ty2
gccugucaggccu

SEQ ID NO: 3742179 - RNA, 13 nt, Salmonella enterica enterica serovar Typhi Ty2
gccuguccggccu

SEQ ID NO: 3742180 - RNA, 16 nt, Salmonella enterica enterica serovar Typhi Ty2
gccugucuccagcgcc

SEQ ID NO: 3742181 - RNA, 15 nt, Salmonella enterica enterica serovar Typhi Ty2
gccugucuccucagc

SEQ ID NO: 3742182 - RNA, 19 nt, Salmonella enterica enterica serovar Typhi Ty2
gccugugaucggagaaaua

SEQ ID NO: 3742183 - RNA, 15 nt, Salmonella enterica enterica serovar Typhi Ty2
gccugugcaaccagc

SEQ ID NO: 3742184 - RNA, 17 nt, Salmonella enterica enterica serovar Typhi Ty2
gccugugccagcucguu

SEQ ID NO: 3742185 - RNA, 14 nt, Salmonella enterica enterica serovar Typhi Ty2
gccuguguaaugaa

SEQ ID NO: 3742186 - RNA, 18 nt, Salmonella enterica enterica serovar Typhi Ty2
gccuguuagggcgcggcu

SEQ ID NO: 3742187 - RNA, 19 nt, Salmonella enterica enterica serovar Typhi Ty2
gccuguuagggcgcggcug

SEQ ID NO: 3742188 - RNA, 20 nt, Salmonella enterica enterica serovar Typhi Ty2
gccuguuccggcgaggacug

SEQ ID NO: 3742189 - RNA, 14 nt, Salmonella enterica enterica serovar Typhi Ty2
gccuguucuuuuuc

SEQ ID NO: 3742190 - RNA, 23 nt, Salmonella enterica enterica serovar Typhi Ty2
gccuguucuuuuucggcuggcag

SEQ ID NO: 3742191 - RNA, 23 nt, Salmonella enterica enterica serovar Typhi Ty2
gccuguuuaaugauucuguguuu

SEQ ID NO: 3742192 - RNA, 22 nt, Salmonella enterica enterica serovar Typhi Ty2
gccuuaaaaaggacaagcugau

SEQ ID NO: 3742193 - RNA, 12 nt, Salmonella enterica enterica serovar Typhi Ty2
gccuuacaggcg

SEQ ID NO: 3742194 - RNA, 14 nt, Salmonella enterica enterica serovar Typhi Ty2
gcgaacaggcguaa

SEQ ID NO: 3742195 - RNA, 22 nt, Salmonella enterica enterica serovar Typhi Ty2
gcgaacaguacggucaggcuca

SEQ ID NO: 3742196 - RNA, 20 nt, Salmonella enterica enterica serovar Typhi Ty2
gcgaacaguguaaacgccag

SEQ ID NO: 3742197 - RNA, 17 nt, Salmonella enterica enterica serovar Typhi Ty2
gcgaacauuucagcgcc

SEQ ID NO: 3742198 - RNA, 22 nt, Salmonella enterica enterica serovar Typhi Ty2
gcgaaccaccguuuaaucgccc

SEQ ID NO: 3742199 - RNA, 13 nt, Salmonella enterica enterica serovar Typhi Ty2
gcgaaccggacca

SEQ ID NO: 3742200 - RNA, 13 nt, Salmonella enterica enterica serovar Typhi Ty2
gcgaaccggcauc

SEQ ID NO: 3742201 - RNA, 18 nt, Salmonella enterica enterica serovar Typhi Ty2
gcgaaccuuccaucgcau

SEQ ID NO: 3742202 - RNA, 18 nt, Salmonella enterica enterica serovar Typhi Ty2
gcgaacgccuuauccggc

SEQ ID NO: 3742203 - RNA, 14 nt, Salmonella enterica enterica serovar Typhi Ty2
gcgaacguccagcg

SEQ ID NO: 3742204 - RNA, 20 nt, Salmonella enterica enterica serovar Typhi Ty2
gcgaacguuacccggccagc

SEQ ID NO: 3742205 - RNA, 23 nt, Salmonella enterica enterica serovar Typhi Ty2
gcgaacguuacccggccagccgu

SEQ ID NO: 3742206 - RNA, 13 nt, Salmonella enterica enterica serovar Typhi Ty2
gcgaacuacaggc

SEQ ID NO: 3742207 - RNA, 21 nt, Salmonella enterica enterica serovar Typhi Ty2
gcgaacugguuauacaguuca

SEQ ID NO: 3742208 - RNA, 21 nt, Salmonella enterica enterica serovar Typhi Ty2
gcgaagcggcgcuauccggca

SEQ ID NO: 3742209 - RNA, 17 nt, Salmonella enterica enterica serovar Typhi Ty2
gcgaagcgucauccggc

SEQ ID NO: 3742210 - RNA, 14 nt, Salmonella enterica enterica serovar Typhi Ty2
gcgaaggcggcggc

SEQ ID NO: 3742211 - RNA, 14 nt, Salmonella enterica enterica serovar Typhi Ty2
gcgaagugcagcgu

SEQ ID NO: 3742212 - RNA, 16 nt, Salmonella enterica enterica serovar Typhi Ty2
gcgaauaaaacugccg

SEQ ID NO: 3742213 - RNA, 14 nt, Salmonella enterica enterica serovar Typhi Ty2
gcgaauaaacacau

SEQ ID NO: 3742214 - RNA, 16 nt, Salmonella enterica enterica serovar Typhi Ty2
gcgaauaacaucaucc

SEQ ID NO: 3742215 - RNA, 16 nt, Salmonella enterica enterica serovar Typhi Ty2
gcgaauaaucccggcg

SEQ ID NO: 3742216 - RNA, 14 nt, Salmonella enterica enterica serovar Typhi Ty2
gcgaauaaucgccg

SEQ ID NO: 3742217 - RNA, 15 nt, Salmonella enterica enterica serovar Typhi Ty2
gcgaauaaucuguuu

SEQ ID NO: 3742218 - RNA, 15 nt, Salmonella enterica enterica serovar Typhi Ty2
gcgaauagccagaca

SEQ ID NO: 3742219 - RNA, 18 nt, Salmonella enterica enterica serovar Typhi Ty2
gcgaauagccagacagcc

SEQ ID NO: 3742220 - RNA, 13 nt, Salmonella enterica enterica serovar Typhi Ty2
gcgaauagcgcca

SEQ ID NO: 3742221 - RNA, 15 nt, Salmonella enterica enterica serovar Typhi Ty2
gcgaauauacgcacc

SEQ ID NO: 3742222 - RNA, 18 nt, Salmonella enterica enterica serovar Typhi Ty2
gcgaaucacauccgccag

SEQ ID NO: 3742223 - RNA, 23 nt, Salmonella enterica enterica serovar Typhi Ty2
gcgaaucacauccgccagcgccu

SEQ ID NO: 3742224 - RNA, 18 nt, Salmonella enterica enterica serovar Typhi Ty2
gcgaaucauguuuuucuc

SEQ ID NO: 3742225 - RNA, 15 nt, Salmonella enterica enterica serovar Typhi Ty2
gcgaauccagcgccg

SEQ ID NO: 3742226 - RNA, 23 nt, Salmonella enterica enterica serovar Typhi Ty2
gcgaauccgugcguaaaauauac

SEQ ID NO: 3742227 - RNA, 20 nt, Salmonella enterica enterica serovar Typhi Ty2
gcgaaucgacaauccgccac

SEQ ID NO: 3742228 - RNA, 20 nt, Salmonella enterica enterica serovar Typhi Ty2
gcgaaucgccaaucgccgcc

SEQ ID NO: 3742229 - RNA, 14 nt, Salmonella enterica enterica serovar Typhi Ty2
gcgaaucucaaugc

SEQ ID NO: 3742230 - RNA, 20 nt, Salmonella enterica enterica serovar Typhi Ty2
gcgaaucucgugaucgccaa

SEQ ID NO: 3742231 - RNA, 14 nt, Salmonella enterica enterica serovar Typhi Ty2
gcgaaugcgcgcca

SEQ ID NO: 3742232 - RNA, 18 nt, Salmonella enterica enterica serovar Typhi Ty2
gcgaauggagaagcgcgc

SEQ ID NO: 3742233 - RNA, 17 nt, Salmonella enterica enterica serovar Typhi Ty2
gcgaauuacuaaucugu

SEQ ID NO: 3742234 - RNA, 18 nt, Salmonella enterica enterica serovar Typhi Ty2
gcgaauugcgaguaaccu

SEQ ID NO: 3742235 - RNA, 23 nt, Salmonella enterica enterica serovar Typhi Ty2
gcgaauuuauaagccugagcgcg

SEQ ID NO: 3742236 - RNA, 14 nt, Salmonella enterica enterica serovar Typhi Ty2
gcgaauuucaacgc

SEQ ID NO: 3742237 - RNA, 20 nt, Salmonella enterica enterica serovar Typhi Ty2
gcgaauuuccugccagaccu

SEQ ID NO: 3742238 - RNA, 13 nt, Salmonella enterica enterica serovar Typhi Ty2
gcgaauuucggca

SEQ ID NO: 3742239 - RNA, 21 nt, Salmonella enterica enterica serovar Typhi Ty2
gcgaauuucggcaaugacggu

SEQ ID NO: 3742240 - RNA, 17 nt, Salmonella enterica enterica serovar Typhi Ty2
gcgaauuugccccagau

SEQ ID NO: 3742241 - RNA, 15 nt, Salmonella enterica enterica serovar Typhi Ty2
gcgacaaacagcgcc

SEQ ID NO: 3742242 - RNA, 16 nt, Salmonella enterica enterica serovar Typhi Ty2
gcgacaaacagcgccc

SEQ ID NO: 3742243 - RNA, 17 nt, Salmonella enterica enterica serovar Typhi Ty2
gcgacaaccuguaggcc

SEQ ID NO: 3742244 - RNA, 22 nt, Salmonella enterica enterica serovar Typhi Ty2
gcgacaccagcgucgcaugggu

SEQ ID NO: 3742245 - RNA, 19 nt, Salmonella enterica enterica serovar Typhi Ty2
gcgacacgcgcgcugcgcc

SEQ ID NO: 3742246 - RNA, 23 nt, Salmonella enterica enterica serovar Typhi Ty2
gcgacacgcgcgcugcgccugga

SEQ ID NO: 3742247 - RNA, 14 nt, Salmonella enterica enterica serovar Typhi Ty2
gcgacacuccgcgc

SEQ ID NO: 3742248 - RNA, 21 nt, Salmonella enterica enterica serovar Typhi Ty2
gcgacagagaaugcgccgccc

SEQ ID NO: 3742249 - RNA, 13 nt, Salmonella enterica enterica serovar Typhi Ty2
gcgacagcgcgcc

SEQ ID NO: 3742250 - RNA, 17 nt, Salmonella enterica enterica serovar Typhi Ty2
gcgacagucgcagagcc

SEQ ID NO: 3742251 - RNA, 14 nt, Salmonella enterica enterica serovar Typhi Ty2
gcgacaucagccag

SEQ ID NO: 3742252 - RNA, 16 nt, Salmonella enterica enterica serovar Typhi Ty2
gcgacaucagccagcc

SEQ ID NO: 3742253 - RNA, 24 nt, Salmonella enterica enterica serovar Typhi Ty2
gcgacauggcccauuucaugaccg

SEQ ID NO: 3742254 - RNA, 21 nt, Salmonella enterica enterica serovar Typhi Ty2
gcgacauuuuuguuaauauuc

SEQ ID NO: 3742255 - RNA, 21 nt, Salmonella enterica enterica serovar Typhi Ty2
gcgaccaauauccgcaggcga

SEQ ID NO: 3742256 - RNA, 18 nt, Salmonella enterica enterica serovar Typhi Ty2
gcgaccaccgucccagua

SEQ ID NO: 3742257 - RNA, 16 nt, Salmonella enterica enterica serovar Typhi Ty2
gcgaccacgacgccgg

SEQ ID NO: 3742258 - RNA, 14 nt, Salmonella enterica enterica serovar Typhi Ty2
gcgaccacgccacc

SEQ ID NO: 3742259 - RNA, 15 nt, Salmonella enterica enterica serovar Typhi Ty2
gcgaccacuccggca

SEQ ID NO: 3742260 - RNA, 17 nt, Salmonella enterica enterica serovar Typhi Ty2
gcgaccacuccggcaua

SEQ ID NO: 3742261 - RNA, 18 nt, Salmonella enterica enterica serovar Typhi Ty2
gcgaccagcagaugcagu

SEQ ID NO: 3742262 - RNA, 13 nt, Salmonella enterica enterica serovar Typhi Ty2
gcgaccagcgcgc

SEQ ID NO: 3742263 - RNA, 15 nt, Salmonella enterica enterica serovar Typhi Ty2
gcgaccagcgcgcca

SEQ ID NO: 3742264 - RNA, 13 nt, Salmonella enterica enterica serovar Typhi Ty2
gcgacccagcgca

SEQ ID NO: 3742265 - RNA, 20 nt, Salmonella enterica enterica serovar Typhi Ty2
gcgaccgaucaucauuccga

SEQ ID NO: 3742266 - RNA, 21 nt, Salmonella enterica enterica serovar Typhi Ty2
gcgaccgcaucaaugcccagc

SEQ ID NO: 3742267 - RNA, 11 nt, Salmonella enterica enterica serovar Typhi Ty2
gcgaccggcac

SEQ ID NO: 3742268 - RNA, 23 nt, Salmonella enterica enterica serovar Typhi Ty2
gcgaccggugaugugcuggcgga

SEQ ID NO: 3742269 - RNA, 24 nt, Salmonella enterica enterica serovar Typhi Ty2
gcgaccuguagaugaaacucgcug

SEQ ID NO: 3742270 - RNA, 16 nt, Salmonella enterica enterica serovar Typhi Ty2
gcgaccuuaccggcga

SEQ ID NO: 3742271 - RNA, 15 nt, Salmonella enterica enterica serovar Typhi Ty2
gcgacgaaucagcga

SEQ ID NO: 3742272 - RNA, 13 nt, Salmonella enterica enterica serovar Typhi Ty2
gcgacgacgccag

SEQ ID NO: 3742273 - RNA, 18 nt, Salmonella enterica enterica serovar Typhi Ty2
gcgacgacgccagccagc

SEQ ID NO: 3742274 - RNA, 19 nt, Salmonella enterica enterica serovar Typhi Ty2
gcgacgacuucacccgcgg

SEQ ID NO: 3742275 - RNA, 22 nt, Salmonella enterica enterica serovar Typhi Ty2
gcgacgacuucacccgcgggcg

SEQ ID NO: 3742276 - RNA, 17 nt, Salmonella enterica enterica serovar Typhi Ty2
gcgaucucuuuggccag

SEQ ID NO: 3742277 - RNA, 14 nt, Salmonella enterica enterica serovar Typhi Ty2
gcgaucugucgccg

SEQ ID NO: 3742278 - RNA, 20 nt, Salmonella enterica enterica serovar Typhi Ty2
gcgaucugugucguccaggc

SEQ ID NO: 3742279 - RNA, 22 nt, Salmonella enterica enterica serovar Typhi Ty2
gcgaucugugucguccaggccu

SEQ ID NO: 3742280 - RNA, 23 nt, Salmonella enterica enterica serovar Typhi Ty2
gcgaucuuuuguuuaccccaggc

SEQ ID NO: 3742281 - RNA, 12 nt, Salmonella enterica enterica serovar Typhi Ty2
gcgaugagcgcc

SEQ ID NO: 3742282 - RNA, 13 nt, Salmonella enterica enterica serovar Typhi Ty2
gcgaugagcgcca

SEQ ID NO: 3742283 - RNA, 14 nt, Salmonella enterica enterica serovar Typhi Ty2
gcgaugagcgccag

SEQ ID NO: 3742284 - RNA, 19 nt, Salmonella enterica enterica serovar Typhi Ty2
gcgaugagcgccagcaaca

SEQ ID NO: 3742285 - RNA, 19 nt, Salmonella enterica enterica serovar Typhi Ty2
gcgaugccaguagcucgcc

SEQ ID NO: 3742286 - RNA, 20 nt, Salmonella enterica enterica serovar Typhi Ty2
gcgaugccaguagcucgccg

SEQ ID NO: 3742287 - RNA, 14 nt, Salmonella enterica enterica serovar Typhi Ty2
gcgaugccugccgg

SEQ ID NO: 3742288 - RNA, 17 nt, Salmonella enterica enterica serovar Typhi Ty2
gcgaugccuuauccggc

SEQ ID NO: 3742289 - RNA, 19 nt, Salmonella enterica enterica serovar Typhi Ty2
gcgaugcgcuuuuccaggc

SEQ ID NO: 3742290 - RNA, 20 nt, Salmonella enterica enterica serovar Typhi Ty2
gcgauguucuugccgccauc

SEQ ID NO: 3742291 - RNA, 15 nt, Salmonella enterica enterica serovar Typhi Ty2
gcgauguuggcgccc

SEQ ID NO: 3742292 - RNA, 22 nt, Salmonella enterica enterica serovar Typhi Ty2
gcgauguuuucccucgccccgg

SEQ ID NO: 3742293 - RNA, 15 nt, Salmonella enterica enterica serovar Typhi Ty2
gcgauuacgccagac

SEQ ID NO: 3742294 - RNA, 17 nt, Salmonella enterica enterica serovar Typhi Ty2
gcgauucagcgcaggca

SEQ ID NO: 3742295 - RNA, 17 nt, Salmonella enterica enterica serovar Typhi Ty2
gcgauucauaugcgcca

SEQ ID NO: 3742296 - RNA, 18 nt, Salmonella enterica enterica serovar Typhi Ty2
gcgauuccggacaacgca

SEQ ID NO: 3742297 - RNA, 18 nt, Salmonella enterica enterica serovar Typhi Ty2
gcgauuccgguuccggcg

SEQ ID NO: 3742298 - RNA, 16 nt, Salmonella enterica enterica serovar Typhi Ty2
gcgauucgcccacgga

SEQ ID NO: 3742299 - RNA, 22 nt, Salmonella enterica enterica serovar Typhi Ty2
gcgauugucaucauucgcgaau

SEQ ID NO: 3742300 - RNA, 21 nt, Salmonella enterica enterica serovar Typhi Ty2
gcgauuguuauccccccgccg

SEQ ID NO: 3742301 - RNA, 18 nt, Salmonella enterica enterica serovar Typhi Ty2
gcgauuuucaccggcguu

SEQ ID NO: 3742302 - RNA, 16 nt, Salmonella enterica enterica serovar Typhi Ty2
gcgauuuucaucaagc

SEQ ID NO: 3742303 - RNA, 14 nt, Salmonella enterica enterica serovar Typhi Ty2
gcgauuuuuaggcc

SEQ ID NO: 3742304 - RNA, 24 nt, Salmonella enterica enterica serovar Typhi Ty2
gcgauuuuuuuccgcccgccuucu

SEQ ID NO: 3742305 - RNA, 14 nt, Salmonella enterica enterica serovar Typhi Ty2
gcgcaaaagcgcgc

SEQ ID NO: 3742306 - RNA, 18 nt, Salmonella enterica enterica serovar Typhi Ty2
gcgcaaaaucgcaaacgc

SEQ ID NO: 3742307 - RNA, 18 nt, Salmonella enterica enterica serovar Typhi Ty2
gcgcaaacggaucuucca

SEQ ID NO: 3742308 - RNA, 12 nt, Salmonella enterica enterica serovar Typhi Ty2
gcgcaaacggcg

SEQ ID NO: 3742309 - RNA, 13 nt, Salmonella enterica enterica serovar Typhi Ty2
gcgcaaauacuga

SEQ ID NO: 3742310 - RNA, 18 nt, Salmonella enterica enterica serovar Typhi Ty2
gcgcaaaucgccaucagc

SEQ ID NO: 3742311 - RNA, 14 nt, Salmonella enterica enterica serovar Typhi Ty2
gcgcaaaugccggu

SEQ ID NO: 3742312 - RNA, 13 nt, Salmonella enterica enterica serovar Typhi Ty2
gcgcaaccggcgu

SEQ ID NO: 3742313 - RNA, 19 nt, Salmonella enterica enterica serovar Typhi Ty2
gcgcaacgcgcaucaacgc

SEQ ID NO: 3742314 - RNA, 21 nt, Salmonella enterica enterica serovar Typhi Ty2
gcgcaacgucgccauccggca

SEQ ID NO: 3742315 - RNA, 17 nt, Salmonella enterica enterica serovar Typhi Ty2
gcgcaacuggcgccgga

SEQ ID NO: 3742316 - RNA, 14 nt, Salmonella enterica enterica serovar Typhi Ty2
gcgcaaggccgagc

SEQ ID NO: 3742317 - RNA, 21 nt, Salmonella enterica enterica serovar Typhi Ty2
gcgcaauaaauucgaaauaaa

SEQ ID NO: 3742318 - RNA, 16 nt, Salmonella enterica enterica serovar Typhi Ty2
gcgcaauaccuguaaa

SEQ ID NO: 3742319 - RNA, 22 nt, Salmonella enterica enterica serovar Typhi Ty2
gcgcaauaugcagaucgacggu

SEQ ID NO: 3742320 - RNA, 15 nt, Salmonella enterica enterica serovar Typhi Ty2
gcgcaauaugcggcg

SEQ ID NO: 3742321 - RNA, 16 nt, Salmonella enterica enterica serovar Typhi Ty2
gcgcaauaugcggcgc

SEQ ID NO: 3742322 - RNA, 14 nt, Salmonella enterica enterica serovar Typhi Ty2
gcgcaauaugguau

SEQ ID NO: 3742323 - RNA, 22 nt, Salmonella enterica enterica serovar Typhi Ty2
gcgcaauauuguuaaccaggcc

SEQ ID NO: 3742324 - RNA, 20 nt, Salmonella enterica enterica serovar Typhi Ty2
gcgcacaauaccgagaaugu

SEQ ID NO: 3742325 - RNA, 16 nt, Salmonella enterica enterica serovar Typhi Ty2
gcgcacaggccuucau

SEQ ID NO: 3742326 - RNA, 19 nt, Salmonella enterica enterica serovar Typhi Ty2
gcgcacauuuacgccagcc

SEQ ID NO: 3742327 - RNA, 22 nt, Salmonella enterica enterica serovar Typhi Ty2
gcgcaccuucaacagcucgcca

SEQ ID NO: 3742328 - RNA, 15 nt, Salmonella enterica enterica serovar Typhi Ty2
gcgcacggcgcgucc

SEQ ID NO: 3742329 - RNA, 15 nt, Salmonella enterica enterica serovar Typhi Ty2
gcgcacucagaaaau

SEQ ID NO: 3742330 - RNA, 23 nt, Salmonella enterica enterica serovar Typhi Ty2
gcgcacuuccucucccacugcga

SEQ ID NO: 3742331 - RNA, 15 nt, Salmonella enterica enterica serovar Typhi Ty2
gcgcagaagcuacuu

SEQ ID NO: 3742332 - RNA, 20 nt, Salmonella enterica enterica serovar Typhi Ty2
gcgcagaaucacuucauccg

SEQ ID NO: 3742333 - RNA, 22 nt, Salmonella enterica enterica serovar Typhi Ty2
gcgcagaaucacuucauccgga

SEQ ID NO: 3742334 - RNA, 12 nt, Salmonella enterica enterica serovar Typhi Ty2
gcgcagagugac

SEQ ID NO: 3742335 - RNA, 16 nt, Salmonella enterica enterica serovar Typhi Ty2
gcgcagagugagcagg

SEQ ID NO: 3742336 - RNA, 16 nt, Salmonella enterica enterica serovar Typhi Ty2
gcgcagcacuucagaa

SEQ ID NO: 3742337 - RNA, 15 nt, Salmonella enterica enterica serovar Typhi Ty2
gcgcagccagcgccc

SEQ ID NO: 3742338 - RNA, 16 nt, Salmonella enterica enterica serovar Typhi Ty2
gcgcagccagcgcccc

SEQ ID NO: 3742339 - RNA, 13 nt, Salmonella enterica enterica serovar Typhi Ty2
gcgcagccccagc

SEQ ID NO: 3742340 - RNA, 15 nt, Salmonella enterica enterica serovar Typhi Ty2
gcgcagccccagcgc

SEQ ID NO: 3742341 - RNA, 18 nt, Salmonella enterica enterica serovar Typhi Ty2
gcgcagcgccaucaggca

SEQ ID NO: 3742342 - RNA, 20 nt, Salmonella enterica enterica serovar Typhi Ty2
gcgcagcgccaucaggcacg

SEQ ID NO: 3742343 - RNA, 19 nt, Salmonella enterica enterica serovar Typhi Ty2
gcgcagcgccaucaggcau

SEQ ID NO: 3742344 - RNA, 18 nt, Salmonella enterica enterica serovar Typhi Ty2
gcgcagcgccauccggca

SEQ ID NO: 3742345 - RNA, 17 nt, Salmonella enterica enterica serovar Typhi Ty2
gcgcagcgcccagcagc

SEQ ID NO: 3742346 - RNA, 15 nt, Salmonella enterica enterica serovar Typhi Ty2
gcgcagcgucaucag

SEQ ID NO: 3742347 - RNA, 16 nt, Salmonella enterica enterica serovar Typhi Ty2
gcgcagcugggccugc

SEQ ID NO: 3742348 - RNA, 20 nt, Salmonella enterica enterica serovar Typhi Ty2
gcgcagcugggccugcuccg

SEQ ID NO: 3742349 - RNA, 15 nt, Salmonella enterica enterica serovar Typhi Ty2
gcgcaggcgggggcg

SEQ ID NO: 3742350 - RNA, 23 nt, Salmonella enterica enterica serovar Typhi Ty2
gcgcaggcucucggugguggcag

SEQ ID NO: 3742351 - RNA, 14 nt, Salmonella enterica enterica serovar Typhi Ty2
gcgcaggggcauuu

SEQ ID NO: 3742352 - RNA, 14 nt, Salmonella enterica enterica serovar Typhi Ty2
gcgcaggggcuauu

SEQ ID NO: 3742353 - RNA, 17 nt, Salmonella enterica enterica serovar Typhi Ty2
gcgcagggucugguggu

SEQ ID NO: 3742354 - RNA, 23 nt, Salmonella enterica enterica serovar Typhi Ty2
gcgcagguaguugucggcggucg

SEQ ID NO: 3742355 - RNA, 20 nt, Salmonella enterica enterica serovar Typhi Ty2
gcgcaguaaacuccucuucc

SEQ ID NO: 3742356 - RNA, 13 nt, Salmonella enterica enterica serovar Typhi Ty2
gcgcagucacaga

SEQ ID NO: 3742357 - RNA, 14 nt, Salmonella enterica enterica serovar Typhi Ty2
gcgcagucacagau

SEQ ID NO: 3742358 - RNA, 16 nt, Salmonella enterica enterica serovar Typhi Ty2
gcgccauccggcacac

SEQ ID NO: 3742359 - RNA, 16 nt, Salmonella enterica enterica serovar Typhi Ty2
gcgccauccggcacau

SEQ ID NO: 3742360 - RNA, 15 nt, Salmonella enterica enterica serovar Typhi Ty2
gcgccauccggcgcu

SEQ ID NO: 3742361 - RNA, 17 nt, Salmonella enterica enterica serovar Typhi Ty2
gcgccauccggcgcuga

SEQ ID NO: 3742362 - RNA, 21 nt, Salmonella enterica enterica serovar Typhi Ty2
gcgccauccugccgcaccagu

SEQ ID NO: 3742363 - RNA, 11 nt, Salmonella enterica enterica serovar Typhi Ty2
gcgccaucggc

SEQ ID NO: 3742364 - RNA, 20 nt, Salmonella enterica enterica serovar Typhi Ty2
gcgccaucggcgcugauugc

SEQ ID NO: 3742365 - RNA, 14 nt, Salmonella enterica enterica serovar Typhi Ty2
gcgccaucuccucc

SEQ ID NO: 3742366 - RNA, 17 nt, Salmonella enterica enterica serovar Typhi Ty2
gcgccaucuccuccuca

SEQ ID NO: 3742367 - RNA, 13 nt, Salmonella enterica enterica serovar Typhi Ty2
gcgccaugaagau

SEQ ID NO: 3742368 - RNA, 20 nt, Salmonella enterica enterica serovar Typhi Ty2
gcgccauggcuucuccuuca

SEQ ID NO: 3742369 - RNA, 19 nt, Salmonella enterica enterica serovar Typhi Ty2
gcgccauguucauaaagug

SEQ ID NO: 3742370 - RNA, 22 nt, Salmonella enterica enterica serovar Typhi Ty2
gcgccauguucauaaagugcca

SEQ ID NO: 3742371 - RNA, 23 nt, Salmonella enterica enterica serovar Typhi Ty2
gcgccauguugcguaaauaaaua

SEQ ID NO: 3742372 - RNA, 21 nt, Salmonella enterica enterica serovar Typhi Ty2
gcgccauuaacgccaugacgc

SEQ ID NO: 3742373 - RNA, 18 nt, Salmonella enterica enterica serovar Typhi Ty2
gcgccauuaacgcgguga

SEQ ID NO: 3742374 - RNA, 19 nt, Salmonella enterica enterica serovar Typhi Ty2
gcgccauuccugccgccgc

SEQ ID NO: 3742375 - RNA, 20 nt, Salmonella enterica enterica serovar Typhi Ty2
gcgccauuccugccgccgca

SEQ ID NO: 3742376 - RNA, 18 nt, Salmonella enterica enterica serovar Typhi Ty2
gcgccauugaggucgcgg

SEQ ID NO: 3742377 - RNA, 23 nt, Salmonella enterica enterica serovar Typhi Ty2
gcgccauugaggucgcggucggc

SEQ ID NO: 3742378 - RNA, 22 nt, Salmonella enterica enterica serovar Typhi Ty2
gcgcccaaugcuuagucagccu

SEQ ID NO: 3742379 - RNA, 15 nt, Salmonella enterica enterica serovar Typhi Ty2
gcgcccacgcgcggc

SEQ ID NO: 3742380 - RNA, 16 nt, Salmonella enterica enterica serovar Typhi Ty2
gcgcccagccaaagcg

SEQ ID NO: 3742381 - RNA, 12 nt, Salmonella enterica enterica serovar Typhi Ty2
gcgcccagcgcc

SEQ ID NO: 3742382 - RNA, 13 nt, Salmonella enterica enterica serovar Typhi Ty2
gcgcccagcgccg

SEQ ID NO: 3742383 - RNA, 12 nt, Salmonella enterica enterica serovar Typhi Ty2
gcgcccaggcca

SEQ ID NO: 3742384 - RNA, 19 nt, Salmonella enterica enterica serovar Typhi Ty2
gcgcccaguccuuccggcg

SEQ ID NO: 3742385 - RNA, 16 nt, Salmonella enterica enterica serovar Typhi Ty2
gcgcccauccgcccac

SEQ ID NO: 3742386 - RNA, 20 nt, Salmonella enterica enterica serovar Typhi Ty2
gcgcccauuccgccugccgc

SEQ ID NO: 3742387 - RNA, 15 nt, Salmonella enterica enterica serovar Typhi Ty2
gcgccccaguaacgu

SEQ ID NO: 3742388 - RNA, 12 nt, Salmonella enterica enterica serovar Typhi Ty2
gcgcccccagca

SEQ ID NO: 3742389 - RNA, 24 nt, Salmonella enterica enterica serovar Typhi Ty2
gcgcccccagcaaaccggcaugaa

SEQ ID NO: 3742390 - RNA, 18 nt, Salmonella enterica enterica serovar Typhi Ty2
gcgccccgccgcgcggcc

SEQ ID NO: 3742391 - RNA, 14 nt, Salmonella enterica enterica serovar Typhi Ty2
gcgccccggcggcg

SEQ ID NO: 3742392 - RNA, 19 nt, Salmonella enterica enterica serovar Typhi Ty2
gcgcccgaucguccgccuc

SEQ ID NO: 3742393 - RNA, 21 nt, Salmonella enterica enterica serovar Typhi Ty2
gcgcccgccaccagcacagcc

SEQ ID NO: 3742394 - RNA, 17 nt, Salmonella enterica enterica serovar Typhi Ty2
gcgcccgccaucgcccg

SEQ ID NO: 3742395 - RNA, 22 nt, Salmonella enterica enterica serovar Typhi Ty2
gcgcccgccugcuguaaccccu

SEQ ID NO: 3742396 - RNA, 16 nt, Salmonella enterica enterica serovar Typhi Ty2
gcgcccguccaugagu

SEQ ID NO: 3742397 - RNA, 13 nt, Salmonella enterica enterica serovar Typhi Ty2
gcgcccuauccag

SEQ ID NO: 3742398 - RNA, 23 nt, Salmonella enterica enterica serovar Typhi Ty2
gcgcccugggcuucgucgagcag

SEQ ID NO: 3742399 - RNA, 14 nt, Salmonella enterica enterica serovar Typhi Ty2
gcgcccuuccguca

SEQ ID NO: 3742400 - RNA, 21 nt, Salmonella enterica enterica serovar Typhi Ty2
gcgcccuuuuuuggucagaaa

SEQ ID NO: 3742401 - RNA, 18 nt, Salmonella enterica enterica serovar Typhi Ty2
gcgccgaagcaggcggag

SEQ ID NO: 3742402 - RNA, 21 nt, Salmonella enterica enterica serovar Typhi Ty2
gcgccgagaaaaucagugaac

SEQ ID NO: 3742403 - RNA, 20 nt, Salmonella enterica enterica serovar Typhi Ty2
gcgccgauaacacggcuggc

SEQ ID NO: 3742404 - RNA, 22 nt, Salmonella enterica enterica serovar Typhi Ty2
gcgccgcaaaggaucaucggcc

SEQ ID NO: 3742405 - RNA, 16 nt, Salmonella enterica enterica serovar Typhi Ty2
gcgccgcacuucacgc

SEQ ID NO: 3742406 - RNA, 15 nt, Salmonella enterica enterica serovar Typhi Ty2
gcgccgcagcgccga

SEQ ID NO: 3742407 - RNA, 20 nt, Salmonella enterica enterica serovar Typhi Ty2
gcgccgcaggccggauaaga

SEQ ID NO: 3742408 - RNA, 19 nt, Salmonella enterica enterica serovar Typhi Ty2
gcgccgccaacgauacagc

SEQ ID NO: 3742409 - RNA, 17 nt, Salmonella enterica enterica serovar Typhi Ty2
gcgccgccaacgccaac

SEQ ID NO: 3742410 - RNA, 16 nt, Salmonella enterica enterica serovar Typhi Ty2
gcgccgccauccggca

SEQ ID NO: 3742411 - RNA, 15 nt, Salmonella enterica enterica serovar Typhi Ty2
gcgccgccgaacaga

SEQ ID NO: 3742412 - RNA, 12 nt, Salmonella enterica enterica serovar Typhi Ty2
gcgccgccgccu

SEQ ID NO: 3742413 - RNA, 21 nt, Salmonella enterica enterica serovar Typhi Ty2
gcgccgccucgcgauccgcca

SEQ ID NO: 3742414 - RNA, 18 nt, Salmonella enterica enterica serovar Typhi Ty2
gcgccgcgacaacgccau

SEQ ID NO: 3742415 - RNA, 15 nt, Salmonella enterica enterica serovar Typhi Ty2
gcgccgcgauaaaga

SEQ ID NO: 3742416 - RNA, 13 nt, Salmonella enterica enterica serovar Typhi Ty2
gcgccgcggccuc

SEQ ID NO: 3742417 - RNA, 21 nt, Salmonella enterica enterica serovar Typhi Ty2
gcgccgcuacguaccgcuucc

SEQ ID NO: 3742418 - RNA, 21 nt, Salmonella enterica enterica serovar Typhi Ty2
gcgccgcucaucaccagcagc

SEQ ID NO: 3742419 - RNA, 14 nt, Salmonella enterica enterica serovar Typhi Ty2
gcgccgcuccaggg

SEQ ID NO: 3742420 - RNA, 14 nt, Salmonella enterica enterica serovar Typhi Ty2
gcgccgcuggcgau

SEQ ID NO: 3742421 - RNA, 15 nt, Salmonella enterica enterica serovar Typhi Ty2
gcgccggacagcagc

SEQ ID NO: 3742422 - RNA, 12 nt, Salmonella enterica enterica serovar Typhi Ty2
gcgccggcagca

SEQ ID NO: 3742423 - RNA, 15 nt, Salmonella enterica enterica serovar Typhi Ty2
gcgccggcagcaguu

SEQ ID NO: 3742424 - RNA, 20 nt, Salmonella enterica enterica serovar Typhi Ty2
gcgccggccgguuucaccau

SEQ ID NO: 3742425 - RNA, 23 nt, Salmonella enterica enterica serovar Typhi Ty2
gcgccggcugcgcugccagcugc

SEQ ID NO: 3742426 - RNA, 14 nt, Salmonella enterica enterica serovar Typhi Ty2
gcgccggggugcug

SEQ ID NO: 3742427 - RNA, 13 nt, Salmonella enterica enterica serovar Typhi Ty2
gcgccguaaacaa

SEQ ID NO: 3742428 - RNA, 22 nt, Salmonella enterica enterica serovar Typhi Ty2
gcgccguaacgcgaugccuggc

SEQ ID NO: 3742429 - RNA, 17 nt, Salmonella enterica enterica serovar Typhi Ty2
gcgccguaaggcgccuu

SEQ ID NO: 3742430 - RNA, 18 nt, Salmonella enterica enterica serovar Typhi Ty2
gcgccguagcggcaggga

SEQ ID NO: 3742431 - RNA, 21 nt, Salmonella enterica enterica serovar Typhi Ty2
gcgccgucaucgcucaucuca

SEQ ID NO: 3742432 - RNA, 20 nt, Salmonella enterica enterica serovar Typhi Ty2
gcgccguccauaaugacgcu

SEQ ID NO: 3742433 - RNA, 15 nt, Salmonella enterica enterica serovar Typhi Ty2
gcgccgugcccagca

SEQ ID NO: 3742434 - RNA, 17 nt, Salmonella enterica enterica serovar Typhi Ty2
gcgccgugcccagcauc

SEQ ID NO: 3742435 - RNA, 17 nt, Salmonella enterica enterica serovar Typhi Ty2
gcgccgugccuggcgcu

SEQ ID NO: 3742436 - RNA, 21 nt, Salmonella enterica enterica serovar Typhi Ty2
gcgccguucgggguugauggu

SEQ ID NO: 3742437 - RNA, 23 nt, Salmonella enterica enterica serovar Typhi Ty2
gcgccuaccagcgcuauccaggc

SEQ ID NO: 3742438 - RNA, 15 nt, Salmonella enterica enterica serovar Typhi Ty2
gcgccuaccgccaua

SEQ ID NO: 3742439 - RNA, 15 nt, Salmonella enterica enterica serovar Typhi Ty2
gcgccuagcgcgcgc

SEQ ID NO: 3742440 - RNA, 14 nt, Salmonella enterica enterica serovar Typhi Ty2
gcgcggaucgccau

SEQ ID NO: 3742441 - RNA, 23 nt, Salmonella enterica enterica serovar Typhi Ty2
gcgcggcacacaacacggcggcu

SEQ ID NO: 3742442 - RNA, 11 nt, Salmonella enterica enterica serovar Typhi Ty2
gcgcggcagca

SEQ ID NO: 3742443 - RNA, 14 nt, Salmonella enterica enterica serovar Typhi Ty2
gcgcggcagcgcgc

SEQ ID NO: 3742444 - RNA, 16 nt, Salmonella enterica enterica serovar Typhi Ty2
gcgcggcagcgcgcac

SEQ ID NO: 3742445 - RNA, 20 nt, Salmonella enterica enterica serovar Typhi Ty2
gcgcggcaggccuuucggca

SEQ ID NO: 3742446 - RNA, 16 nt, Salmonella enterica enterica serovar Typhi Ty2
gcgcggccccaucagc

SEQ ID NO: 3742447 - RNA, 21 nt, Salmonella enterica enterica serovar Typhi Ty2
gcgcggccucauggcggugcu

SEQ ID NO: 3742448 - RNA, 22 nt, Salmonella enterica enterica serovar Typhi Ty2
gcgcggcggacaacgcuccagc

SEQ ID NO: 3742449 - RNA, 17 nt, Salmonella enterica enterica serovar Typhi Ty2
gcgcggcguacacuuca

SEQ ID NO: 3742450 - RNA, 14 nt, Salmonella enterica enterica serovar Typhi Ty2
gcgcggggaacaca

SEQ ID NO: 3742451 - RNA, 15 nt, Salmonella enterica enterica serovar Typhi Ty2
gcgcggggaacacac

SEQ ID NO: 3742452 - RNA, 15 nt, Salmonella enterica enterica serovar Typhi Ty2
gcgcggggaacacau

SEQ ID NO: 3742453 - RNA, 12 nt, Salmonella enterica enterica serovar Typhi Ty2
gcgcggguugcc

SEQ ID NO: 3742454 - RNA, 20 nt, Salmonella enterica enterica serovar Typhi Ty2
gcgcgguauuucgccgccgc

SEQ ID NO: 3742455 - RNA, 13 nt, Salmonella enterica enterica serovar Typhi Ty2
gcgcggucaacgu

SEQ ID NO: 3742456 - RNA, 21 nt, Salmonella enterica enterica serovar Typhi Ty2
gcgcgguggcuuuuuccugcc

SEQ ID NO: 3742457 - RNA, 16 nt, Salmonella enterica enterica serovar Typhi Ty2
gcgcgguuaugcggga

SEQ ID NO: 3742458 - RNA, 15 nt, Salmonella enterica enterica serovar Typhi Ty2
gcgcgguuuccggua

SEQ ID NO: 3742459 - RNA, 15 nt, Salmonella enterica enterica serovar Typhi Ty2
gcgcguaaauaccuu

SEQ ID NO: 3742460 - RNA, 22 nt, Salmonella enterica enterica serovar Typhi Ty2
gcgcguaaauaccuucuggcgu

SEQ ID NO: 3742461 - RNA, 13 nt, Salmonella enterica enterica serovar Typhi Ty2
gcgcguauccgcc

SEQ ID NO: 3742462 - RNA, 14 nt, Salmonella enterica enterica serovar Typhi Ty2
gcgcguccacggcg

SEQ ID NO: 3742463 - RNA, 19 nt, Salmonella enterica enterica serovar Typhi Ty2
gcgcguccagccagcguuu

SEQ ID NO: 3742464 - RNA, 18 nt, Salmonella enterica enterica serovar Typhi Ty2
gcgcgucgcauccggcaa

SEQ ID NO: 3742465 - RNA, 18 nt, Salmonella enterica enterica serovar Typhi Ty2
gcgcgucuucccggcgcu

SEQ ID NO: 3742466 - RNA, 13 nt, Salmonella enterica enterica serovar Typhi Ty2
gcgcguggcaaau

SEQ ID NO: 3742467 - RNA, 14 nt, Salmonella enterica enterica serovar Typhi Ty2
gcgcgugucgggaa

SEQ ID NO: 3742468 - RNA, 14 nt, Salmonella enterica enterica serovar Typhi Ty2
gcgcguuaugccga

SEQ ID NO: 3742469 - RNA, 14 nt, Salmonella enterica enterica serovar Typhi Ty2
gcgcguucauccac

SEQ ID NO: 3742470 - RNA, 14 nt, Salmonella enterica enterica serovar Typhi Ty2
gcgcguucugcucc

SEQ ID NO: 3742471 - RNA, 22 nt, Salmonella enterica enterica serovar Typhi Ty2
gcgcguugccaucggcgggcgu

SEQ ID NO: 3742472 - RNA, 17 nt, Salmonella enterica enterica serovar Typhi Ty2
gcgcguuuaaucgagcc

SEQ ID NO: 3742473 - RNA, 22 nt, Salmonella enterica enterica serovar Typhi Ty2
gcgcguuuuccaucaucaggac

SEQ ID NO: 3742474 - RNA, 17 nt, Salmonella enterica enterica serovar Typhi Ty2
gcgcuaaaauccacguc

SEQ ID NO: 3742475 - RNA, 17 nt, Salmonella enterica enterica serovar Typhi Ty2
gcgcuaaacagcgccgc

SEQ ID NO: 3742476 - RNA, 17 nt, Salmonella enterica enterica serovar Typhi Ty2
gcgcuaaaugcauagcc

SEQ ID NO: 3742477 - RNA, 13 nt, Salmonella enterica enterica serovar Typhi Ty2
gcgcuaaccagcg

SEQ ID NO: 3742478 - RNA, 14 nt, Salmonella enterica enterica serovar Typhi Ty2
gcgcuaagccagcc

SEQ ID NO: 3742479 - RNA, 22 nt, Salmonella enterica enterica serovar Typhi Ty2
gcgcuaagcguuacggaaaaaa

SEQ ID NO: 3742480 - RNA, 21 nt, Salmonella enterica enterica serovar Typhi Ty2
gcgcuaauguacgccuaaaaa

SEQ ID NO: 3742481 - RNA, 20 nt, Salmonella enterica enterica serovar Typhi Ty2
gcgcuacauccgccagccgc

SEQ ID NO: 3742482 - RNA, 13 nt, Salmonella enterica enterica serovar Typhi Ty2
gcgcuaccagcgc

SEQ ID NO: 3742483 - RNA, 14 nt, Salmonella enterica enterica serovar Typhi Ty2
gcgcuaccagcgcg

SEQ ID NO: 3742484 - RNA, 18 nt, Salmonella enterica enterica serovar Typhi Ty2
gcgcuacgcuuaucaggc

SEQ ID NO: 3742485 - RNA, 20 nt, Salmonella enterica enterica serovar Typhi Ty2
gcgcuacgcuuaucgggccu

SEQ ID NO: 3742486 - RNA, 19 nt, Salmonella enterica enterica serovar Typhi Ty2
gcgcuagccgcauccggca

SEQ ID NO: 3742487 - RNA, 17 nt, Salmonella enterica enterica serovar Typhi Ty2
gcgcuagcuggcagggg

SEQ ID NO: 3742488 - RNA, 13 nt, Salmonella enterica enterica serovar Typhi Ty2
gcgcuaucaacgc

SEQ ID NO: 3742489 - RNA, 12 nt, Salmonella enterica enterica serovar Typhi Ty2
gcgcuaucaggc

SEQ ID NO: 3742490 - RNA, 15 nt, Salmonella enterica enterica serovar Typhi Ty2
gcgcuaucaggcacu

SEQ ID NO: 3742491 - RNA, 13 nt, Salmonella enterica enterica serovar Typhi Ty2
gcgcuauccggca

SEQ ID NO: 3742492 - RNA, 13 nt, Salmonella enterica enterica serovar Typhi Ty2
gcgcuauccggcc

SEQ ID NO: 3742493 - RNA, 17 nt, Salmonella enterica enterica serovar Typhi Ty2
gcgcuauucccaggcaa

SEQ ID NO: 3742494 - RNA, 17 nt, Salmonella enterica enterica serovar Typhi Ty2
gcgcuauugaucgccau

SEQ ID NO: 3742495 - RNA, 19 nt, Salmonella enterica enterica serovar Typhi Ty2
gcgcuauugaucgccauag

SEQ ID NO: 3742496 - RNA, 18 nt, Salmonella enterica enterica serovar Typhi Ty2
gcgcuauuuucaugguau

SEQ ID NO: 3742497 - RNA, 18 nt, Salmonella enterica enterica serovar Typhi Ty2
gcgcucaacacauaacgc

SEQ ID NO: 3742498 - RNA, 19 nt, Salmonella enterica enterica serovar Typhi Ty2
gcgcucaccuccgccacua

SEQ ID NO: 3742499 - RNA, 15 nt, Salmonella enterica enterica serovar Typhi Ty2
gcgcucacgcggcgc

SEQ ID NO: 3742500 - RNA, 14 nt, Salmonella enterica enterica serovar Typhi Ty2
gcgcucagcgccgu

SEQ ID NO: 3742501 - RNA, 11 nt, Salmonella enterica enterica serovar Typhi Ty2
gcgcucaggca

SEQ ID NO: 3742502 - RNA, 22 nt, Salmonella enterica enterica serovar Typhi Ty2
gcgcucagggucagaauacaga

SEQ ID NO: 3742503 - RNA, 16 nt, Salmonella enterica enterica serovar Typhi Ty2
gcgcucauaaccgcga

SEQ ID NO: 3742504 - RNA, 21 nt, Salmonella enterica enterica serovar Typhi Ty2
gcgcucauauacccugcggcg

SEQ ID NO: 3742505 - RNA, 13 nt, Salmonella enterica enterica serovar Typhi Ty2
gcgcucaucaggc

SEQ ID NO: 3742506 - RNA, 17 nt, Salmonella enterica enterica serovar Typhi Ty2
gcgcucaugcgccuggc

SEQ ID NO: 3742507 - RNA, 22 nt, Salmonella enterica enterica serovar Typhi Ty2
gcgcuccaccaaccaggcaaac

SEQ ID NO: 3742508 - RNA, 22 nt, Salmonella enterica enterica serovar Typhi Ty2
gcgcuccagaccaccagcgaca

SEQ ID NO: 3742509 - RNA, 22 nt, Salmonella enterica enterica serovar Typhi Ty2
gcgcuccaucauaucgcgcagc

SEQ ID NO: 3742510 - RNA, 22 nt, Salmonella enterica enterica serovar Typhi Ty2
gcgcuccgacugaaccuucacg

SEQ ID NO: 3742511 - RNA, 15 nt, Salmonella enterica enterica serovar Typhi Ty2
gcgcucgcucaucac

SEQ ID NO: 3742512 - RNA, 24 nt, Salmonella enterica enterica serovar Typhi Ty2
gcgcucgcucaucacaucgcgcag

SEQ ID NO: 3742513 - RNA, 23 nt, Salmonella enterica enterica serovar Typhi Ty2
gcgcucgcuuuuacucuuccugc

SEQ ID NO: 3742514 - RNA, 22 nt, Salmonella enterica enterica serovar Typhi Ty2
gcgcucuaucaccgcccgccgg

SEQ ID NO: 3742515 - RNA, 17 nt, Salmonella enterica enterica serovar Typhi Ty2
gcgcucuaucgccgccc

SEQ ID NO: 3742516 - RNA, 15 nt, Salmonella enterica enterica serovar Typhi Ty2
gcgcucucauagccg

SEQ ID NO: 3742517 - RNA, 13 nt, Salmonella enterica enterica serovar Typhi Ty2
gcgcucuccggca

SEQ ID NO: 3742518 - RNA, 16 nt, Salmonella enterica enterica serovar Typhi Ty2
gcgcucugccaguagc

SEQ ID NO: 3742519 - RNA, 14 nt, Salmonella enterica enterica serovar Typhi Ty2
gcgcugaaguccgc

SEQ ID NO: 3742520 - RNA, 14 nt, Salmonella enterica enterica serovar Typhi Ty2
gcgcugaccgcgcu

SEQ ID NO: 3742521 - RNA, 16 nt, Salmonella enterica enterica serovar Typhi Ty2
gcgcugagaugaccau

SEQ ID NO: 3742522 - RNA, 19 nt, Salmonella enterica enterica serovar Typhi Ty2
gcggaaucacgcauauccc

SEQ ID NO: 3742523 - RNA, 17 nt, Salmonella enterica enterica serovar Typhi Ty2
gcggaauccaucccccu

SEQ ID NO: 3742524 - RNA, 22 nt, Salmonella enterica enterica serovar Typhi Ty2
gcggaaugcugguuaacgccgc

SEQ ID NO: 3742525 - RNA, 19 nt, Salmonella enterica enterica serovar Typhi Ty2
gcggaauugguagacgcgc

SEQ ID NO: 3742526 - RNA, 15 nt, Salmonella enterica enterica serovar Typhi Ty2
gcggacacccgcagc

SEQ ID NO: 3742527 - RNA, 16 nt, Salmonella enterica enterica serovar Typhi Ty2
gcggacacccgcagcc

SEQ ID NO: 3742528 - RNA, 14 nt, Salmonella enterica enterica serovar Typhi Ty2
gcggacaugcgcau

SEQ ID NO: 3742529 - RNA, 17 nt, Salmonella enterica enterica serovar Typhi Ty2
gcggacauuaacgccgc

SEQ ID NO: 3742530 - RNA, 19 nt, Salmonella enterica enterica serovar Typhi Ty2
gcggacguagcggcgccgg

SEQ ID NO: 3742531 - RNA, 14 nt, Salmonella enterica enterica serovar Typhi Ty2
gcggacugggcuga

SEQ ID NO: 3742532 - RNA, 19 nt, Salmonella enterica enterica serovar Typhi Ty2
gcggagaagacgccgccgc

SEQ ID NO: 3742533 - RNA, 21 nt, Salmonella enterica enterica serovar Typhi Ty2
gcggagagaucgacagcgcgc

SEQ ID NO: 3742534 - RNA, 23 nt, Salmonella enterica enterica serovar Typhi Ty2
gcggagagaucgacagcgcgcgc

SEQ ID NO: 3742535 - RNA, 20 nt, Salmonella enterica enterica serovar Typhi Ty2
gcggaggccggcccugcggu

SEQ ID NO: 3742536 - RNA, 19 nt, Salmonella enterica enterica serovar Typhi Ty2
gcggagguuucuuuuucua

SEQ ID NO: 3742537 - RNA, 23 nt, Salmonella enterica enterica serovar Typhi Ty2
gcggaguaaacugugugagcgcc

SEQ ID NO: 3742538 - RNA, 18 nt, Salmonella enterica enterica serovar Typhi Ty2
gcggaguuauacagugcc

SEQ ID NO: 3742539 - RNA, 21 nt, Salmonella enterica enterica serovar Typhi Ty2
gcggauaaauagugacgccgc

SEQ ID NO: 3742540 - RNA, 18 nt, Salmonella enterica enterica serovar Typhi Ty2
gcggauaaccgacgccgg

SEQ ID NO: 3742541 - RNA, 23 nt, Salmonella enterica enterica serovar Typhi Ty2
gcggauaacgcggguuagcgccg

SEQ ID NO: 3742542 - RNA, 23 nt, Salmonella enterica enterica serovar Typhi Ty2
gcggauaacguucgugaauauga

SEQ ID NO: 3742543 - RNA, 19 nt, Salmonella enterica enterica serovar Typhi Ty2
gcggauaagauagcaggcg

SEQ ID NO: 3742544 - RNA, 21 nt, Salmonella enterica enterica serovar Typhi Ty2
gcggauaagauagcaggcgau

SEQ ID NO: 3742545 - RNA, 19 nt, Salmonella enterica enterica serovar Typhi Ty2
gcggauaagcccggcggag

SEQ ID NO: 3742546 - RNA, 20 nt, Salmonella enterica enterica serovar Typhi Ty2
gcggauaagcgcagcgccau

SEQ ID NO: 3742547 - RNA, 19 nt, Salmonella enterica enterica serovar Typhi Ty2
gcggauacagcggcgcgcc

SEQ ID NO: 3742548 - RNA, 16 nt, Salmonella enterica enterica serovar Typhi Ty2
gcggauaguccugcgc

SEQ ID NO: 3742549 - RNA, 22 nt, Salmonella enterica enterica serovar Typhi Ty2
gcggauauauggcgggaaauca

SEQ ID NO: 3742550 - RNA, 16 nt, Salmonella enterica enterica serovar Typhi Ty2
gcggauaugcagcagc

SEQ ID NO: 3742551 - RNA, 17 nt, Salmonella enterica enterica serovar Typhi Ty2
gcggauaugcagcagcc

SEQ ID NO: 3742552 - RNA, 18 nt, Salmonella enterica enterica serovar Typhi Ty2
gcggaucaaacuccgcgc

SEQ ID NO: 3742553 - RNA, 22 nt, Salmonella enterica enterica serovar Typhi Ty2
gcggaucaaacuccgcgcuggc

SEQ ID NO: 3742554 - RNA, 23 nt, Salmonella enterica enterica serovar Typhi Ty2
gcggaucaaacuccgcgcuggca

SEQ ID NO: 3742555 - RNA, 18 nt, Salmonella enterica enterica serovar Typhi Ty2
gcggaucagacggcugac

SEQ ID NO: 3742556 - RNA, 16 nt, Salmonella enterica enterica serovar Typhi Ty2
gcggaucgcguccauu

SEQ ID NO: 3742557 - RNA, 15 nt, Salmonella enterica enterica serovar Typhi Ty2
gcggaucggcgcaga

SEQ ID NO: 3742558 - RNA, 17 nt, Salmonella enterica enterica serovar Typhi Ty2
gcggaugaucgccucuu

SEQ ID NO: 3742559 - RNA, 19 nt, Salmonella enterica enterica serovar Typhi Ty2
gcggaugguggcguaaaua

SEQ ID NO: 3742560 - RNA, 19 nt, Salmonella enterica enterica serovar Typhi Ty2
gcggauuaucguccggcau

SEQ ID NO: 3742561 - RNA, 20 nt, Salmonella enterica enterica serovar Typhi Ty2
gcggauuccaguagcgcgcc

SEQ ID NO: 3742562 - RNA, 20 nt, Salmonella enterica enterica serovar Typhi Ty2
gcggcaaaaaauauagccau

SEQ ID NO: 3742563 - RNA, 19 nt, Salmonella enterica enterica serovar Typhi Ty2
gcggcaaaaucuuuuucgc

SEQ ID NO: 3742564 - RNA, 16 nt, Salmonella enterica enterica serovar Typhi Ty2
gcggcaacucgugcag

SEQ ID NO: 3742565 - RNA, 19 nt, Salmonella enterica enterica serovar Typhi Ty2
gcggcaagccgaucagcgu

SEQ ID NO: 3742566 - RNA, 23 nt, Salmonella enterica enterica serovar Typhi Ty2
gcggcaaugagcggccagcgggc

SEQ ID NO: 3742567 - RNA, 16 nt, Salmonella enterica enterica serovar Typhi Ty2
gcggcaaugccgccgu

SEQ ID NO: 3742568 - RNA, 14 nt, Salmonella enterica enterica serovar Typhi Ty2
gcggcaauggccgc

SEQ ID NO: 3742569 - RNA, 17 nt, Salmonella enterica enterica serovar Typhi Ty2
gcggcaauggccgcagc

SEQ ID NO: 3742570 - RNA, 21 nt, Salmonella enterica enterica serovar Typhi Ty2
gcggcacacaacacggcggcu

SEQ ID NO: 3742571 - RNA, 20 nt, Salmonella enterica enterica serovar Typhi Ty2
gcggcacagauacgaggugg

SEQ ID NO: 3742572 - RNA, 20 nt, Salmonella enterica enterica serovar Typhi Ty2
gcggcaccagcgaugcgcgc

SEQ ID NO: 3742573 - RNA, 20 nt, Salmonella enterica enterica serovar Typhi Ty2
gcggcacgccaaaaucaggc

SEQ ID NO: 3742574 - RNA, 21 nt, Salmonella enterica enterica serovar Typhi Ty2
gcggcagauaucgcugaccaa

SEQ ID NO: 3742575 - RNA, 14 nt, Salmonella enterica enterica serovar Typhi Ty2
gcggcagccaugcu

SEQ ID NO: 3742576 - RNA, 23 nt, Salmonella enterica enterica serovar Typhi Ty2
gcggcagccaugcuauucagcag

SEQ ID NO: 3742577 - RNA, 19 nt, Salmonella enterica enterica serovar Typhi Ty2
gcggcagcgccauccggca

SEQ ID NO: 3742578 - RNA, 16 nt, Salmonella enterica enterica serovar Typhi Ty2
gcggcagcucugccug

SEQ ID NO: 3742579 - RNA, 12 nt, Salmonella enterica enterica serovar Typhi Ty2
gcggcagcuuca

SEQ ID NO: 3742580 - RNA, 15 nt, Salmonella enterica enterica serovar Typhi Ty2
gcggcaggaucccca

SEQ ID NO: 3742581 - RNA, 16 nt, Salmonella enterica enterica serovar Typhi Ty2
gcggcaggauccccau

SEQ ID NO: 3742582 - RNA, 12 nt, Salmonella enterica enterica serovar Typhi Ty2
gcggcagggcag

SEQ ID NO: 3742583 - RNA, 21 nt, Salmonella enterica enterica serovar Typhi Ty2
gcggcagucccaaugcggaaa

SEQ ID NO: 3742584 - RNA, 18 nt, Salmonella enterica enterica serovar Typhi Ty2
gcggcagugggcuaugcu

SEQ ID NO: 3742585 - RNA, 20 nt, Salmonella enterica enterica serovar Typhi Ty2
gcggcaguucaggcucgcaa

SEQ ID NO: 3742586 - RNA, 16 nt, Salmonella enterica enterica serovar Typhi Ty2
gcggcaguuccggcgu

SEQ ID NO: 3742587 - RNA, 21 nt, Salmonella enterica enterica serovar Typhi Ty2
gcggcaguugaacucgauaac

SEQ ID NO: 3742588 - RNA, 19 nt, Salmonella enterica enterica serovar Typhi Ty2
gcggcaguugccggaacca

SEQ ID NO: 3742589 - RNA, 20 nt, Salmonella enterica enterica serovar Typhi Ty2
gcggcauacuuucgcgcggc

SEQ ID NO: 3742590 - RNA, 20 nt, Salmonella enterica enterica serovar Typhi Ty2
gcggcaucagauggcgauuc

SEQ ID NO: 3742591 - RNA, 13 nt, Salmonella enterica enterica serovar Typhi Ty2
gcggcaucaggca

SEQ ID NO: 3742592 - RNA, 14 nt, Salmonella enterica enterica serovar Typhi Ty2
gcggcaucaggcau

SEQ ID NO: 3742593 - RNA, 20 nt, Salmonella enterica enterica serovar Typhi Ty2
gcggcaucauaaaucgacau

SEQ ID NO: 3742594 - RNA, 19 nt, Salmonella enterica enterica serovar Typhi Ty2
gcggcaucgaacgggcgau

SEQ ID NO: 3742595 - RNA, 17 nt, Salmonella enterica enterica serovar Typhi Ty2
gcggcauuaaagccgcc

SEQ ID NO: 3742596 - RNA, 21 nt, Salmonella enterica enterica serovar Typhi Ty2
gcggcauuggcguuaccggca

SEQ ID NO: 3742597 - RNA, 22 nt, Salmonella enterica enterica serovar Typhi Ty2
gcggcauuggcguuaccggcag

SEQ ID NO: 3742598 - RNA, 18 nt, Salmonella enterica enterica serovar Typhi Ty2
gcggccaccgccaguucg

SEQ ID NO: 3742599 - RNA, 13 nt, Salmonella enterica enterica serovar Typhi Ty2
gcggccagcgggc

SEQ ID NO: 3742600 - RNA, 16 nt, Salmonella enterica enterica serovar Typhi Ty2
gcggccaugaucgccg

SEQ ID NO: 3742601 - RNA, 20 nt, Salmonella enterica enterica serovar Typhi Ty2
gcggccaugaucgccgccau

SEQ ID NO: 3742602 - RNA, 21 nt, Salmonella enterica enterica serovar Typhi Ty2
gcggccaugaucgccgccauc

SEQ ID NO: 3742603 - RNA, 21 nt, Salmonella enterica enterica serovar Typhi Ty2
gcgggcuuuuuuugcccgcuc

SEQ ID NO: 3742604 - RNA, 13 nt, Salmonella enterica enterica serovar Typhi Ty2
gcggggaaacucu

SEQ ID NO: 3742605 - RNA, 14 nt, Salmonella enterica enterica serovar Typhi Ty2
gcggggaacaccca

SEQ ID NO: 3742606 - RNA, 17 nt, Salmonella enterica enterica serovar Typhi Ty2
gcgggguaaacgguaau

SEQ ID NO: 3742607 - RNA, 19 nt, Salmonella enterica enterica serovar Typhi Ty2
gcggguaaacucacccagg

SEQ ID NO: 3742608 - RNA, 21 nt, Salmonella enterica enterica serovar Typhi Ty2
gcggguaaacucacccaggcg

SEQ ID NO: 3742609 - RNA, 17 nt, Salmonella enterica enterica serovar Typhi Ty2
gcgggugaugcgccagc

SEQ ID NO: 3742610 - RNA, 19 nt, Salmonella enterica enterica serovar Typhi Ty2
gcgggugcgcagccccagc

SEQ ID NO: 3742611 - RNA, 18 nt, Salmonella enterica enterica serovar Typhi Ty2
gcggguucccccacucuu

SEQ ID NO: 3742612 - RNA, 15 nt, Salmonella enterica enterica serovar Typhi Ty2
gcgguaaauuccgca

SEQ ID NO: 3742613 - RNA, 14 nt, Salmonella enterica enterica serovar Typhi Ty2
gcgguaacaggcac

SEQ ID NO: 3742614 - RNA, 16 nt, Salmonella enterica enterica serovar Typhi Ty2
gcgguaagagagugag

SEQ ID NO: 3742615 - RNA, 16 nt, Salmonella enterica enterica serovar Typhi Ty2
gcgguaaggcaccggu

SEQ ID NO: 3742616 - RNA, 17 nt, Salmonella enterica enterica serovar Typhi Ty2
gcgguaaggcaccgguu

SEQ ID NO: 3742617 - RNA, 18 nt, Salmonella enterica enterica serovar Typhi Ty2
gcgguaauaacugacaga

SEQ ID NO: 3742618 - RNA, 13 nt, Salmonella enterica enterica serovar Typhi Ty2
gcgguaaucgcga

SEQ ID NO: 3742619 - RNA, 16 nt, Salmonella enterica enterica serovar Typhi Ty2
gcgguaaucugccagc

SEQ ID NO: 3742620 - RNA, 21 nt, Salmonella enterica enterica serovar Typhi Ty2
gcgguaccggcauuacccagu

SEQ ID NO: 3742621 - RNA, 20 nt, Salmonella enterica enterica serovar Typhi Ty2
gcgguagaaaguacaucauu

SEQ ID NO: 3742622 - RNA, 15 nt, Salmonella enterica enterica serovar Typhi Ty2
gcgguauaacugccu

SEQ ID NO: 3742623 - RNA, 14 nt, Salmonella enterica enterica serovar Typhi Ty2
gcgguauacaccag

SEQ ID NO: 3742624 - RNA, 23 nt, Salmonella enterica enterica serovar Typhi Ty2
gcgguauacaccagcucccgcgu

SEQ ID NO: 3742625 - RNA, 15 nt, Salmonella enterica enterica serovar Typhi Ty2
gcgguaugauacagu

SEQ ID NO: 3742626 - RNA, 15 nt, Salmonella enterica enterica serovar Typhi Ty2
gcgguauuauccgcc

SEQ ID NO: 3742627 - RNA, 22 nt, Salmonella enterica enterica serovar Typhi Ty2
gcgguauugauacaggcgcugu

SEQ ID NO: 3742628 - RNA, 15 nt, Salmonella enterica enterica serovar Typhi Ty2
gcggucaaaagcugc

SEQ ID NO: 3742629 - RNA, 16 nt, Salmonella enterica enterica serovar Typhi Ty2
gcggucaaaagcugca

SEQ ID NO: 3742630 - RNA, 21 nt, Salmonella enterica enterica serovar Typhi Ty2
gcggucagcuuuucagcccag

SEQ ID NO: 3742631 - RNA, 12 nt, Salmonella enterica enterica serovar Typhi Ty2
gcggucaggaau

SEQ ID NO: 3742632 - RNA, 13 nt, Salmonella enterica enterica serovar Typhi Ty2
gcggucaggccag

SEQ ID NO: 3742633 - RNA, 15 nt, Salmonella enterica enterica serovar Typhi Ty2
gcggucaucgcccau

SEQ ID NO: 3742634 - RNA, 16 nt, Salmonella enterica enterica serovar Typhi Ty2
gcggucaucgcccauc

SEQ ID NO: 3742635 - RNA, 21 nt, Salmonella enterica enterica serovar Typhi Ty2
gcgguccaauaaacgccaggu

SEQ ID NO: 3742636 - RNA, 19 nt, Salmonella enterica enterica serovar Typhi Ty2
gcggucgccugccgcaugu

SEQ ID NO: 3742637 - RNA, 19 nt, Salmonella enterica enterica serovar Typhi Ty2
gcggucggcagcaccggaa

SEQ ID NO: 3742638 - RNA, 22 nt, Salmonella enterica enterica serovar Typhi Ty2
gcggucggccuuaacgacccuu

SEQ ID NO: 3742639 - RNA, 22 nt, Salmonella enterica enterica serovar Typhi Ty2
gcggucguauuuaccgcuggcg

SEQ ID NO: 3742640 - RNA, 13 nt, Salmonella enterica enterica serovar Typhi Ty2
gcggugaaagaga

SEQ ID NO: 3742641 - RNA, 22 nt, Salmonella enterica enterica serovar Typhi Ty2
gcggugaaaugcccgauggcgc

SEQ ID NO: 3742642 - RNA, 22 nt, Salmonella enterica enterica serovar Typhi Ty2
gcggugcaugaauaucaaacca

SEQ ID NO: 3742643 - RNA, 17 nt, Salmonella enterica enterica serovar Typhi Ty2
gcgguggguagcggcaa

SEQ ID NO: 3742644 - RNA, 18 nt, Salmonella enterica enterica serovar Typhi Ty2
gcgguggguagcggcaau

SEQ ID NO: 3742645 - RNA, 23 nt, Salmonella enterica enterica serovar Typhi Ty2
gcgguuacagucuuuggaguaga

SEQ ID NO: 3742646 - RNA, 13 nt, Salmonella enterica enterica serovar Typhi Ty2
gcgguuauccgcc

SEQ ID NO: 3742647 - RNA, 16 nt, Salmonella enterica enterica serovar Typhi Ty2
gcgguuauccgccagc

SEQ ID NO: 3742648 - RNA, 14 nt, Salmonella enterica enterica serovar Typhi Ty2
gcgguucucccggc

SEQ ID NO: 3742649 - RNA, 16 nt, Salmonella enterica enterica serovar Typhi Ty2
gcgguucucccggcau

SEQ ID NO: 3742650 - RNA, 20 nt, Salmonella enterica enterica serovar Typhi Ty2
gcgguugacgcugcuuuuuu

SEQ ID NO: 3742651 - RNA, 14 nt, Salmonella enterica enterica serovar Typhi Ty2
gcgguuuacgccau

SEQ ID NO: 3742652 - RNA, 18 nt, Salmonella enterica enterica serovar Typhi Ty2
gcgguuuacuucuucagu

SEQ ID NO: 3742653 - RNA, 15 nt, Salmonella enterica enterica serovar Typhi Ty2
gcgguuucaucgagc

SEQ ID NO: 3742654 - RNA, 19 nt, Salmonella enterica enterica serovar Typhi Ty2
gcgguuuucaauaauaaaa

SEQ ID NO: 3742655 - RNA, 18 nt, Salmonella enterica enterica serovar Typhi Ty2
gcgguuuuccugaugaua

SEQ ID NO: 3742656 - RNA, 20 nt, Salmonella enterica enterica serovar Typhi Ty2
gcguaaaaaguuucaguggu

SEQ ID NO: 3742657 - RNA, 22 nt, Salmonella enterica enterica serovar Typhi Ty2
gcguaaaccauuucuccugcau

SEQ ID NO: 3742658 - RNA, 12 nt, Salmonella enterica enterica serovar Typhi Ty2
gcguaaacuucc

SEQ ID NO: 3742659 - RNA, 12 nt, Salmonella enterica enterica serovar Typhi Ty2
gcguaaagaggg

SEQ ID NO: 3742660 - RNA, 12 nt, Salmonella enterica enterica serovar Typhi Ty2
gcguaaagcugu

SEQ ID NO: 3742661 - RNA, 15 nt, Salmonella enterica enterica serovar Typhi Ty2
gcguaaaucaggcca

SEQ ID NO: 3742662 - RNA, 22 nt, Salmonella enterica enterica serovar Typhi Ty2
gcguaacagcgcuaucaggaag

SEQ ID NO: 3742663 - RNA, 14 nt, Salmonella enterica enterica serovar Typhi Ty2
gcguaacgaacuga

SEQ ID NO: 3742664 - RNA, 18 nt, Salmonella enterica enterica serovar Typhi Ty2
gcguaacgccacauauaa

SEQ ID NO: 3742665 - RNA, 16 nt, Salmonella enterica enterica serovar Typhi Ty2
gcguaauacaggcgau

SEQ ID NO: 3742666 - RNA, 15 nt, Salmonella enterica enterica serovar Typhi Ty2
gcguaauauacgcca

SEQ ID NO: 3742667 - RNA, 16 nt, Salmonella enterica enterica serovar Typhi Ty2
gcguaaucagcuuuuc

SEQ ID NO: 3742668 - RNA, 16 nt, Salmonella enterica enterica serovar Typhi Ty2
gcguaaugagcgucgc

SEQ ID NO: 3742669 - RNA, 21 nt, Salmonella enterica enterica serovar Typhi Ty2
gcguaaugguggcaaccugac

SEQ ID NO: 3742670 - RNA, 13 nt, Salmonella enterica enterica serovar Typhi Ty2
gcguaauuauuac

SEQ ID NO: 3742671 - RNA, 22 nt, Salmonella enterica enterica serovar Typhi Ty2
gcguaauuuugccacccacuuc

SEQ ID NO: 3742672 - RNA, 23 nt, Salmonella enterica enterica serovar Typhi Ty2
gcguacaaucgcguuuuccagca

SEQ ID NO: 3742673 - RNA, 18 nt, Salmonella enterica enterica serovar Typhi Ty2
gcguacacuucauccggc

SEQ ID NO: 3742674 - RNA, 13 nt, Salmonella enterica enterica serovar Typhi Ty2
gcguacagcgcca

SEQ ID NO: 3742675 - RNA, 23 nt, Salmonella enterica enterica serovar Typhi Ty2
gcguacaggauguccaggcgaca

SEQ ID NO: 3742676 - RNA, 15 nt, Salmonella enterica enterica serovar Typhi Ty2
gcguacaggcggaaa

SEQ ID NO: 3742677 - RNA, 15 nt, Salmonella enterica enterica serovar Typhi Ty2
gcguacauugccgga

SEQ ID NO: 3742678 - RNA, 19 nt, Salmonella enterica enterica serovar Typhi Ty2
gcguacauugccggauggc

SEQ ID NO: 3742679 - RNA, 23 nt, Salmonella enterica enterica serovar Typhi Ty2
gcguacauugccggauggcggcg

SEQ ID NO: 3742680 - RNA, 13 nt, Salmonella enterica enterica serovar Typhi Ty2
gcguaccagcgcc

SEQ ID NO: 3742681 - RNA, 14 nt, Salmonella enterica enterica serovar Typhi Ty2
gcguaccagcguca

SEQ ID NO: 3742682 - RNA, 18 nt, Salmonella enterica enterica serovar Typhi Ty2
gcguaccgcuaucgccaa

SEQ ID NO: 3742683 - RNA, 21 nt, Salmonella enterica enterica serovar Typhi Ty2
gcguaccgcuaucgccaaacu

SEQ ID NO: 3742684 - RNA, 22 nt, Salmonella enterica enterica serovar Typhi Ty2
gcguaccggccacaauugccag

SEQ ID NO: 3742685 - RNA, 18 nt, Salmonella enterica enterica serovar Typhi Ty2
gcgucugagcaucccggu

SEQ ID NO: 3742686 - RNA, 15 nt, Salmonella enterica enterica serovar Typhi Ty2
gcgucugcaccggua

SEQ ID NO: 3742687 - RNA, 23 nt, Salmonella enterica enterica serovar Typhi Ty2
gcgucugcaccgguacacacgcg

SEQ ID NO: 3742688 - RNA, 18 nt, Salmonella enterica enterica serovar Typhi Ty2
gcgucugccccaaacgcu

SEQ ID NO: 3742689 - RNA, 17 nt, Salmonella enterica enterica serovar Typhi Ty2
gcgucugcgcgcuggug

SEQ ID NO: 3742690 - RNA, 14 nt, Salmonella enterica enterica serovar Typhi Ty2
gcgucugcggcuga

SEQ ID NO: 3742691 - RNA, 15 nt, Salmonella enterica enterica serovar Typhi Ty2
gcgucuggagcgugc

SEQ ID NO: 3742692 - RNA, 22 nt, Salmonella enterica enterica serovar Typhi Ty2
gcgucuggcgacuaaccagcgc

SEQ ID NO: 3742693 - RNA, 19 nt, Salmonella enterica enterica serovar Typhi Ty2
gcgucuggguuugcagcag

SEQ ID NO: 3742694 - RNA, 13 nt, Salmonella enterica enterica serovar Typhi Ty2
gcgucuuauccgg

SEQ ID NO: 3742695 - RNA, 21 nt, Salmonella enterica enterica serovar Typhi Ty2
gcgucuuauccggccuaccug

SEQ ID NO: 3742696 - RNA, 17 nt, Salmonella enterica enterica serovar Typhi Ty2
gcgucuucaucagccag

SEQ ID NO: 3742697 - RNA, 19 nt, Salmonella enterica enterica serovar Typhi Ty2
gcgucuucaucagccagca

SEQ ID NO: 3742698 - RNA, 23 nt, Salmonella enterica enterica serovar Typhi Ty2
gcgugaacgucuuauccggccug

SEQ ID NO: 3742699 - RNA, 13 nt, Salmonella enterica enterica serovar Typhi Ty2
gcgugaccgguaa

SEQ ID NO: 3742700 - RNA, 17 nt, Salmonella enterica enterica serovar Typhi Ty2
gcgugagccacuaucca

SEQ ID NO: 3742701 - RNA, 17 nt, Salmonella enterica enterica serovar Typhi Ty2
gcgugagcgcauccggc

SEQ ID NO: 3742702 - RNA, 18 nt, Salmonella enterica enterica serovar Typhi Ty2
gcgugauaaaggccggca

SEQ ID NO: 3742703 - RNA, 20 nt, Salmonella enterica enterica serovar Typhi Ty2
gcgugauuuuggccucaucc

SEQ ID NO: 3742704 - RNA, 22 nt, Salmonella enterica enterica serovar Typhi Ty2
gcgugauuuuggccucauccgc

SEQ ID NO: 3742705 - RNA, 21 nt, Salmonella enterica enterica serovar Typhi Ty2
gcgugcagaucaagcgggggc

SEQ ID NO: 3742706 - RNA, 15 nt, Salmonella enterica enterica serovar Typhi Ty2
gcgugcaugggcagc

SEQ ID NO: 3742707 - RNA, 12 nt, Salmonella enterica enterica serovar Typhi Ty2
gcgugccgagca

SEQ ID NO: 3742708 - RNA, 15 nt, Salmonella enterica enterica serovar Typhi Ty2
gcgugccgggcuggc

SEQ ID NO: 3742709 - RNA, 18 nt, Salmonella enterica enterica serovar Typhi Ty2
gcgugccuucaaauauau

SEQ ID NO: 3742710 - RNA, 14 nt, Salmonella enterica enterica serovar Typhi Ty2
gcgugcgacauggc

SEQ ID NO: 3742711 - RNA, 16 nt, Salmonella enterica enterica serovar Typhi Ty2
gcgugcgccauccggc

SEQ ID NO: 3742712 - RNA, 16 nt, Salmonella enterica enterica serovar Typhi Ty2
gcgugcguucauggcg

SEQ ID NO: 3742713 - RNA, 15 nt, Salmonella enterica enterica serovar Typhi Ty2
gcgugcuggcggccg

SEQ ID NO: 3742714 - RNA, 19 nt, Salmonella enterica enterica serovar Typhi Ty2
gcguggcaucuuaucaggc

SEQ ID NO: 3742715 - RNA, 15 nt, Salmonella enterica enterica serovar Typhi Ty2
gcguggcauuaacaa

SEQ ID NO: 3742716 - RNA, 20 nt, Salmonella enterica enterica serovar Typhi Ty2
gcguggcugcaggacuuacc

SEQ ID NO: 3742717 - RNA, 17 nt, Salmonella enterica enterica serovar Typhi Ty2
gcgugggguugcuucug

SEQ ID NO: 3742718 - RNA, 21 nt, Salmonella enterica enterica serovar Typhi Ty2
gcgugguauuacaagcaguua

SEQ ID NO: 3742719 - RNA, 18 nt, Salmonella enterica enterica serovar Typhi Ty2
gcgugguuuccggcagcu

SEQ ID NO: 3742720 - RNA, 20 nt, Salmonella enterica enterica serovar Typhi Ty2
gcgugucagggcggaacagc

SEQ ID NO: 3742721 - RNA, 17 nt, Salmonella enterica enterica serovar Typhi Ty2
gcgugucaucaaaauca

SEQ ID NO: 3742722 - RNA, 16 nt, Salmonella enterica enterica serovar Typhi Ty2
gcgugucgcccggcgg

SEQ ID NO: 3742723 - RNA, 20 nt, Salmonella enterica enterica serovar Typhi Ty2
gcguguuucaucucaucaau

SEQ ID NO: 3742724 - RNA, 22 nt, Salmonella enterica enterica serovar Typhi Ty2
gcguuaacccgcuuacaauuua

SEQ ID NO: 3742725 - RNA, 20 nt, Salmonella enterica enterica serovar Typhi Ty2
gcguuaacggcuucguuuca

SEQ ID NO: 3742726 - RNA, 20 nt, Salmonella enterica enterica serovar Typhi Ty2
gcguuaauauccuucagcgu

SEQ ID NO: 3742727 - RNA, 19 nt, Salmonella enterica enterica serovar Typhi Ty2
gcguuagcgucauccggca

SEQ ID NO: 3742728 - RNA, 16 nt, Salmonella enterica enterica serovar Typhi Ty2
gcguuaggaacaucga

SEQ ID NO: 3742729 - RNA, 22 nt, Salmonella enterica enterica serovar Typhi Ty2
gcguuaugugaguuagcggcaa

SEQ ID NO: 3742730 - RNA, 21 nt, Salmonella enterica enterica serovar Typhi Ty2
gcguucacaccgccgccagcc

SEQ ID NO: 3742731 - RNA, 15 nt, Salmonella enterica enterica serovar Typhi Ty2
gcguucacgccgcca

SEQ ID NO: 3742732 - RNA, 23 nt, Salmonella enterica enterica serovar Typhi Ty2
gcguucacgccgccauccggcaa

SEQ ID NO: 3742733 - RNA, 14 nt, Salmonella enterica enterica serovar Typhi Ty2
gcguucagcgccug

SEQ ID NO: 3742734 - RNA, 18 nt, Salmonella enterica enterica serovar Typhi Ty2
gcguucauccaccgcccg

SEQ ID NO: 3742735 - RNA, 23 nt, Salmonella enterica enterica serovar Typhi Ty2
gcguucauggcgcgacauggcga

SEQ ID NO: 3742736 - RNA, 19 nt, Salmonella enterica enterica serovar Typhi Ty2
gcguuccccaacagcgacc

SEQ ID NO: 3742737 - RNA, 13 nt, Salmonella enterica enterica serovar Typhi Ty2
gcguuccuuauca

SEQ ID NO: 3742738 - RNA, 20 nt, Salmonella enterica enterica serovar Typhi Ty2
gcguucgcgcaauucuucua

SEQ ID NO: 3742739 - RNA, 23 nt, Salmonella enterica enterica serovar Typhi Ty2
gcguucggaagacugcuccggca

SEQ ID NO: 3742740 - RNA, 21 nt, Salmonella enterica enterica serovar Typhi Ty2
gcguucuuccacuucagcagc

SEQ ID NO: 3742741 - RNA, 14 nt, Salmonella enterica enterica serovar Typhi Ty2
gcguucuuuccagu

SEQ ID NO: 3742742 - RNA, 17 nt, Salmonella enterica enterica serovar Typhi Ty2
gcguugaccagcgacgg

SEQ ID NO: 3742743 - RNA, 12 nt, Salmonella enterica enterica serovar Typhi Ty2
gcguugcagcca

SEQ ID NO: 3742744 - RNA, 18 nt, Salmonella enterica enterica serovar Typhi Ty2
gcguugccguaggcaacg

SEQ ID NO: 3742745 - RNA, 17 nt, Salmonella enterica enterica serovar Typhi Ty2
gcguugcgccgccaggc

SEQ ID NO: 3742746 - RNA, 12 nt, Salmonella enterica enterica serovar Typhi Ty2
gcguuggcggcu

SEQ ID NO: 3742747 - RNA, 14 nt, Salmonella enterica enterica serovar Typhi Ty2
gcguuggcgggcug

SEQ ID NO: 3742748 - RNA, 16 nt, Salmonella enterica enterica serovar Typhi Ty2
gcguugggcgugacgg

SEQ ID NO: 3742749 - RNA, 19 nt, Salmonella enterica enterica serovar Typhi Ty2
gcguugguuaaggcggcug

SEQ ID NO: 3742750 - RNA, 18 nt, Salmonella enterica enterica serovar Typhi Ty2
gcguuguacggauggggu

SEQ ID NO: 3742751 - RNA, 20 nt, Salmonella enterica enterica serovar Typhi Ty2
gcguuuaauuccaucggcau

SEQ ID NO: 3742752 - RNA, 20 nt, Salmonella enterica enterica serovar Typhi Ty2
gcguuuaucaggccuacaag

SEQ ID NO: 3742753 - RNA, 20 nt, Salmonella enterica enterica serovar Typhi Ty2
gcguuuauguuugcugauaa

SEQ ID NO: 3742754 - RNA, 22 nt, Salmonella enterica enterica serovar Typhi Ty2
gcguuuauguuugcugauaaga

SEQ ID NO: 3742755 - RNA, 22 nt, Salmonella enterica enterica serovar Typhi Ty2
gcguuuauuauaaacacuauca

SEQ ID NO: 3742756 - RNA, 19 nt, Salmonella enterica enterica serovar Typhi Ty2
gcguuuccacgcugacugc

SEQ ID NO: 3742757 - RNA, 21 nt, Salmonella enterica enterica serovar Typhi Ty2
gcguuuccagacuggucgccc

SEQ ID NO: 3742758 - RNA, 22 nt, Salmonella enterica enterica serovar Typhi Ty2
gcguuucguaauggccuacaca

SEQ ID NO: 3742759 - RNA, 18 nt, Salmonella enterica enterica serovar Typhi Ty2
gcguuucguuuagcgccu

SEQ ID NO: 3742760 - RNA, 18 nt, Salmonella enterica enterica serovar Typhi Ty2
gcguuucuagaugaugau

SEQ ID NO: 3742761 - RNA, 20 nt, Salmonella enterica enterica serovar Typhi Ty2
gcguuugauuugcgcgucgu

SEQ ID NO: 3742762 - RNA, 15 nt, Salmonella enterica enterica serovar Typhi Ty2
gcguuugcgccgcca

SEQ ID NO: 3742763 - RNA, 22 nt, Salmonella enterica enterica serovar Typhi Ty2
gcguuugucuucuuaguaacau

SEQ ID NO: 3742764 - RNA, 14 nt, Salmonella enterica enterica serovar Typhi Ty2
gcguuuuagcgcca

SEQ ID NO: 3742765 - RNA, 16 nt, Salmonella enterica enterica serovar Typhi Ty2
gcguuuuccagcaucc

SEQ ID NO: 3742766 - RNA, 16 nt, Salmonella enterica enterica serovar Typhi Ty2
gcguuuuggcagacag

SEQ ID NO: 3742767 - RNA, 16 nt, Salmonella enterica enterica serovar Typhi Ty2
gcuaaaaacagcgcaa

SEQ ID NO: 3742768 - RNA, 21 nt, Salmonella enterica enterica serovar Typhi Ty2
gcuaaaacacccgcaaacuaa

SEQ ID NO: 3742769 - RNA, 15 nt, Salmonella enterica enterica serovar Typhi Ty2
gcuaaaacagauaac

SEQ ID NO: 3742770 - RNA, 18 nt, Salmonella enterica enterica serovar Typhi Ty2
gcuaaaacccaccaccuc

SEQ ID NO: 3742771 - RNA, 17 nt, Salmonella enterica enterica serovar Typhi Ty2
gcuaaacaauuugccca

SEQ ID NO: 3742772 - RNA, 14 nt, Salmonella enterica enterica serovar Typhi Ty2
gcuaaacagcaaau

SEQ ID NO: 3742773 - RNA, 18 nt, Salmonella enterica enterica serovar Typhi Ty2
gcuaaaccaaacuuaucu

SEQ ID NO: 3742774 - RNA, 16 nt, Salmonella enterica enterica serovar Typhi Ty2
gcuaaaccggcggaau

SEQ ID NO: 3742775 - RNA, 19 nt, Salmonella enterica enterica serovar Typhi Ty2
gcuaaaccgucauuuacca

SEQ ID NO: 3742776 - RNA, 18 nt, Salmonella enterica enterica serovar Typhi Ty2
gcuaaacguagcauuucc

SEQ ID NO: 3742777 - RNA, 13 nt, Salmonella enterica enterica serovar Typhi Ty2
gcuaaagcacggg

SEQ ID NO: 3742778 - RNA, 14 nt, Salmonella enterica enterica serovar Typhi Ty2
gcuaaagcaucggg

SEQ ID NO: 3742779 - RNA, 19 nt, Salmonella enterica enterica serovar Typhi Ty2
gcuaaagcgacuuauccgg

SEQ ID NO: 3742780 - RNA, 14 nt, Salmonella enterica enterica serovar Typhi Ty2
gcuaaagcgcuggc

SEQ ID NO: 3742781 - RNA, 17 nt, Salmonella enterica enterica serovar Typhi Ty2
gcuaaagcgcuggcggc

SEQ ID NO: 3742782 - RNA, 19 nt, Salmonella enterica enterica serovar Typhi Ty2
gcuaaaucacgcaggucau

SEQ ID NO: 3742783 - RNA, 13 nt, Salmonella enterica enterica serovar Typhi Ty2
gcuaacagugaaa

SEQ ID NO: 3742784 - RNA, 16 nt, Salmonella enterica enterica serovar Typhi Ty2
gcuaaccuguaucugc

SEQ ID NO: 3742785 - RNA, 18 nt, Salmonella enterica enterica serovar Typhi Ty2
gcuaaccuguaucugcug

SEQ ID NO: 3742786 - RNA, 16 nt, Salmonella enterica enterica serovar Typhi Ty2
gcuaaccuguucagcc

SEQ ID NO: 3742787 - RNA, 22 nt, Salmonella enterica enterica serovar Typhi Ty2
gcuaacgccugauccggccuac

SEQ ID NO: 3742788 - RNA, 17 nt, Salmonella enterica enterica serovar Typhi Ty2
gcuaacgcgccccaggu

SEQ ID NO: 3742789 - RNA, 20 nt, Salmonella enterica enterica serovar Typhi Ty2
gcuaacgcguacccggcuua

SEQ ID NO: 3742790 - RNA, 18 nt, Salmonella enterica enterica serovar Typhi Ty2
gcuaacgcuuauccggcc

SEQ ID NO: 3742791 - RNA, 20 nt, Salmonella enterica enterica serovar Typhi Ty2
gcuaacgcuuauccggccua

SEQ ID NO: 3742792 - RNA, 21 nt, Salmonella enterica enterica serovar Typhi Ty2
gcuaacgcuuauccggccuac

SEQ ID NO: 3742793 - RNA, 15 nt, Salmonella enterica enterica serovar Typhi Ty2
gcuaagagugacggu

SEQ ID NO: 3742794 - RNA, 20 nt, Salmonella enterica enterica serovar Typhi Ty2
gcuaagcgcccguagcucag

SEQ ID NO: 3742795 - RNA, 19 nt, Salmonella enterica enterica serovar Typhi Ty2
gcuaaggccuuauugugcc

SEQ ID NO: 3742796 - RNA, 11 nt, Salmonella enterica enterica serovar Typhi Ty2
gcuaauaucca

SEQ ID NO: 3742797 - RNA, 16 nt, Salmonella enterica enterica serovar Typhi Ty2
gcuaauaugccaggcu

SEQ ID NO: 3742798 - RNA, 13 nt, Salmonella enterica enterica serovar Typhi Ty2
gcuaaucaccacc

SEQ ID NO: 3742799 - RNA, 20 nt, Salmonella enterica enterica serovar Typhi Ty2
gcuaaucaggacaucaaagg

SEQ ID NO: 3742800 - RNA, 18 nt, Salmonella enterica enterica serovar Typhi Ty2
gcuaaucccgcucgccag

SEQ ID NO: 3742801 - RNA, 18 nt, Salmonella enterica enterica serovar Typhi Ty2
gcuaaugaggaaaaagcc

SEQ ID NO: 3742802 - RNA, 14 nt, Salmonella enterica enterica serovar Typhi Ty2
gcuaaugauuaucu

SEQ ID NO: 3742803 - RNA, 18 nt, Salmonella enterica enterica serovar Typhi Ty2
gcuaaugauuaucuuuuu

SEQ ID NO: 3742804 - RNA, 20 nt, Salmonella enterica enterica serovar Typhi Ty2
gcuaaugcuuauccggccua

SEQ ID NO: 3742805 - RNA, 20 nt, Salmonella enterica enterica serovar Typhi Ty2
gcuaauguacgccuaaaaau

SEQ ID NO: 3742806 - RNA, 17 nt, Salmonella enterica enterica serovar Typhi Ty2
gcuaauuuucagggugg

SEQ ID NO: 3742807 - RNA, 13 nt, Salmonella enterica enterica serovar Typhi Ty2
gcuacacgcgaau

SEQ ID NO: 3742808 - RNA, 19 nt, Salmonella enterica enterica serovar Typhi Ty2
gcuacacgcguaaacuucc

SEQ ID NO: 3742809 - RNA, 22 nt, Salmonella enterica enterica serovar Typhi Ty2
gcuacagacaucuuugccaaac

SEQ ID NO: 3742810 - RNA, 14 nt, Salmonella enterica enterica serovar Typhi Ty2
gcuaccagcgcggc

SEQ ID NO: 3742811 - RNA, 23 nt, Salmonella enterica enterica serovar Typhi Ty2
gcuaccagcgcggcgccaguacu

SEQ ID NO: 3742812 - RNA, 12 nt, Salmonella enterica enterica serovar Typhi Ty2
gcuacccagaca

SEQ ID NO: 3742813 - RNA, 19 nt, Salmonella enterica enterica serovar Typhi Ty2
gcuacccgcugacgcugcc

SEQ ID NO: 3742814 - RNA, 14 nt, Salmonella enterica enterica serovar Typhi Ty2
gcuaccgcgcgaac

SEQ ID NO: 3742815 - RNA, 21 nt, Salmonella enterica enterica serovar Typhi Ty2
gcuaccgucgacgucuuucuu

SEQ ID NO: 3742816 - RNA, 16 nt, Salmonella enterica enterica serovar Typhi Ty2
gcuaccgucgccgaca

SEQ ID NO: 3742817 - RNA, 22 nt, Salmonella enterica enterica serovar Typhi Ty2
gcuaccucguaucccgccuggc

SEQ ID NO: 3742818 - RNA, 17 nt, Salmonella enterica enterica serovar Typhi Ty2
gcuaccuucuucccaua

SEQ ID NO: 3742819 - RNA, 22 nt, Salmonella enterica enterica serovar Typhi Ty2
gcuacgauaaagcugaguaagg

SEQ ID NO: 3742820 - RNA, 23 nt, Salmonella enterica enterica serovar Typhi Ty2
gcuacgauaaagcugaguaagga

SEQ ID NO: 3742821 - RNA, 21 nt, Salmonella enterica enterica serovar Typhi Ty2
gcuacgccaucaggcauggca

SEQ ID NO: 3742822 - RNA, 16 nt, Salmonella enterica enterica serovar Typhi Ty2
gcuacgccuuacccga

SEQ ID NO: 3742823 - RNA, 17 nt, Salmonella enterica enterica serovar Typhi Ty2
gcuacgccuuauccggc

SEQ ID NO: 3742824 - RNA, 21 nt, Salmonella enterica enterica serovar Typhi Ty2
gcuacgcgucgccauccggcg

SEQ ID NO: 3742825 - RNA, 16 nt, Salmonella enterica enterica serovar Typhi Ty2
gcuacgcuuaucaggc

SEQ ID NO: 3742826 - RNA, 17 nt, Salmonella enterica enterica serovar Typhi Ty2
gcuacgcuuaucaggcc

SEQ ID NO: 3742827 - RNA, 17 nt, Salmonella enterica enterica serovar Typhi Ty2
gcuacgcuuauccggcu

SEQ ID NO: 3742828 - RNA, 23 nt, Salmonella enterica enterica serovar Typhi Ty2
gcuacgcuuaucgggccuacgag

SEQ ID NO: 3742829 - RNA, 12 nt, Salmonella enterica enterica serovar Typhi Ty2
gcuacgggccgc

SEQ ID NO: 3742830 - RNA, 14 nt, Salmonella enterica enterica serovar Typhi Ty2
gcuacgguuuuaau

SEQ ID NO: 3742831 - RNA, 21 nt, Salmonella enterica enterica serovar Typhi Ty2
gcuacgucgucgaucgcgcca

SEQ ID NO: 3742832 - RNA, 15 nt, Salmonella enterica enterica serovar Typhi Ty2
gcuacguuuaucugg

SEQ ID NO: 3742833 - RNA, 18 nt, Salmonella enterica enterica serovar Typhi Ty2
gcuacucaggagaucggc

SEQ ID NO: 3742834 - RNA, 17 nt, Salmonella enterica enterica serovar Typhi Ty2
gcuacugagcgucacgc

SEQ ID NO: 3742835 - RNA, 13 nt, Salmonella enterica enterica serovar Typhi Ty2
gcuacugcaucug

SEQ ID NO: 3742836 - RNA, 21 nt, Salmonella enterica enterica serovar Typhi Ty2
gcuagcgccuuauccggccua

SEQ ID NO: 3742837 - RNA, 13 nt, Salmonella enterica enterica serovar Typhi Ty2
gcuagcugcagcg

SEQ ID NO: 3742838 - RNA, 23 nt, Salmonella enterica enterica serovar Typhi Ty2
gcuagcugugguugcccgcaggc

SEQ ID NO: 3742839 - RNA, 19 nt, Salmonella enterica enterica serovar Typhi Ty2
gcuagcuuaucgggccuac

SEQ ID NO: 3742840 - RNA, 13 nt, Salmonella enterica enterica serovar Typhi Ty2
gcuagcuucaggu

SEQ ID NO: 3742841 - RNA, 20 nt, Salmonella enterica enterica serovar Typhi Ty2
gcuaggcaaccugucaguac

SEQ ID NO: 3742842 - RNA, 15 nt, Salmonella enterica enterica serovar Typhi Ty2
gcuagggcaucagac

SEQ ID NO: 3742843 - RNA, 16 nt, Salmonella enterica enterica serovar Typhi Ty2
gcuauacgcggcguac

SEQ ID NO: 3742844 - RNA, 14 nt, Salmonella enterica enterica serovar Typhi Ty2
gcuauagaaugcaa

SEQ ID NO: 3742845 - RNA, 18 nt, Salmonella enterica enterica serovar Typhi Ty2
gcuauagaaugcaagcag

SEQ ID NO: 3742846 - RNA, 12 nt, Salmonella enterica enterica serovar Typhi Ty2
gcuauagcucag

SEQ ID NO: 3742847 - RNA, 22 nt, Salmonella enterica enterica serovar Typhi Ty2
gcuauaugauagaaguuaugca

SEQ ID NO: 3742848 - RNA, 16 nt, Salmonella enterica enterica serovar Typhi Ty2
gcucaugcgcggcggg

SEQ ID NO: 3742849 - RNA, 18 nt, Salmonella enterica enterica serovar Typhi Ty2
gcucauuaacgacaacuu

SEQ ID NO: 3742850 - RNA, 15 nt, Salmonella enterica enterica serovar Typhi Ty2
gcucauuauuuggau

SEQ ID NO: 3742851 - RNA, 17 nt, Salmonella enterica enterica serovar Typhi Ty2
gcucauuuuauccaaca

SEQ ID NO: 3742852 - RNA, 16 nt, Salmonella enterica enterica serovar Typhi Ty2
gcuccaaguauugaua

SEQ ID NO: 3742853 - RNA, 13 nt, Salmonella enterica enterica serovar Typhi Ty2
gcuccaauaaaua

SEQ ID NO: 3742854 - RNA, 19 nt, Salmonella enterica enterica serovar Typhi Ty2
gcuccagaccaccagcgac

SEQ ID NO: 3742855 - RNA, 20 nt, Salmonella enterica enterica serovar Typhi Ty2
gcuccagaccaccagcgaca

SEQ ID NO: 3742856 - RNA, 21 nt, Salmonella enterica enterica serovar Typhi Ty2
gcuccagaccaccagcgacau

SEQ ID NO: 3742857 - RNA, 9 nt, Salmonella enterica enterica serovar Typhi Ty2
gcuccagca

SEQ ID NO: 3742858 - RNA, 12 nt, Salmonella enterica enterica serovar Typhi Ty2
gcuccagcaguu

SEQ ID NO: 3742859 - RNA, 14 nt, Salmonella enterica enterica serovar Typhi Ty2
gcuccagcaucaca

SEQ ID NO: 3742860 - RNA, 15 nt, Salmonella enterica enterica serovar Typhi Ty2
gcuccagcaucacau

SEQ ID NO: 3742861 - RNA, 18 nt, Salmonella enterica enterica serovar Typhi Ty2
gcuccagcgccagcucca

SEQ ID NO: 3742862 - RNA, 22 nt, Salmonella enterica enterica serovar Typhi Ty2
gcuccagggauugauggccagc

SEQ ID NO: 3742863 - RNA, 23 nt, Salmonella enterica enterica serovar Typhi Ty2
gcuccaguggucguuagccagau

SEQ ID NO: 3742864 - RNA, 16 nt, Salmonella enterica enterica serovar Typhi Ty2
gcuccaguuguuccag

SEQ ID NO: 3742865 - RNA, 15 nt, Salmonella enterica enterica serovar Typhi Ty2
gcuccauagaaauca

SEQ ID NO: 3742866 - RNA, 20 nt, Salmonella enterica enterica serovar Typhi Ty2
gcuccaucacgguaaaccug

SEQ ID NO: 3742867 - RNA, 22 nt, Salmonella enterica enterica serovar Typhi Ty2
gcuccaucacgguaaaccuguu

SEQ ID NO: 3742868 - RNA, 17 nt, Salmonella enterica enterica serovar Typhi Ty2
gcuccaucuccggcagc

SEQ ID NO: 3742869 - RNA, 16 nt, Salmonella enterica enterica serovar Typhi Ty2
gcucccacucuuccag

SEQ ID NO: 3742870 - RNA, 21 nt, Salmonella enterica enterica serovar Typhi Ty2
gcucccagauuaaaucauccu

SEQ ID NO: 3742871 - RNA, 20 nt, Salmonella enterica enterica serovar Typhi Ty2
gcucccgcagccacucccga

SEQ ID NO: 3742872 - RNA, 22 nt, Salmonella enterica enterica serovar Typhi Ty2
gcucccgccagcgagaugaaaa

SEQ ID NO: 3742873 - RNA, 15 nt, Salmonella enterica enterica serovar Typhi Ty2
gcucccgcugcggcg

SEQ ID NO: 3742874 - RNA, 21 nt, Salmonella enterica enterica serovar Typhi Ty2
gcucccuucccccagaaugcc

SEQ ID NO: 3742875 - RNA, 13 nt, Salmonella enterica enterica serovar Typhi Ty2
gcuccgaauaauc

SEQ ID NO: 3742876 - RNA, 23 nt, Salmonella enterica enterica serovar Typhi Ty2
gcuccgaauaauccuucccgcua

SEQ ID NO: 3742877 - RNA, 20 nt, Salmonella enterica enterica serovar Typhi Ty2
gcuccgcaaagcccaucagc

SEQ ID NO: 3742878 - RNA, 14 nt, Salmonella enterica enterica serovar Typhi Ty2
gcuccgccagcaau

SEQ ID NO: 3742879 - RNA, 15 nt, Salmonella enterica enterica serovar Typhi Ty2
gcuccgccagcaaug

SEQ ID NO: 3742880 - RNA, 19 nt, Salmonella enterica enterica serovar Typhi Ty2
gcuccgccagggcggcaaa

SEQ ID NO: 3742881 - RNA, 19 nt, Salmonella enterica enterica serovar Typhi Ty2
gcuccgcgccgaaauuuuc

SEQ ID NO: 3742882 - RNA, 13 nt, Salmonella enterica enterica serovar Typhi Ty2
gcuccggcgcugg

SEQ ID NO: 3742883 - RNA, 23 nt, Salmonella enterica enterica serovar Typhi Ty2
gcuccggcgcuggcgcuggcugc

SEQ ID NO: 3742884 - RNA, 17 nt, Salmonella enterica enterica serovar Typhi Ty2
gcuccgggacauccgga

SEQ ID NO: 3742885 - RNA, 16 nt, Salmonella enterica enterica serovar Typhi Ty2
gcuccgggccaugauc

SEQ ID NO: 3742886 - RNA, 17 nt, Salmonella enterica enterica serovar Typhi Ty2
gcuccggguugccugau

SEQ ID NO: 3742887 - RNA, 17 nt, Salmonella enterica enterica serovar Typhi Ty2
gcuccgguuuuugcgcg

SEQ ID NO: 3742888 - RNA, 15 nt, Salmonella enterica enterica serovar Typhi Ty2
gcuccugccagauuu

SEQ ID NO: 3742889 - RNA, 15 nt, Salmonella enterica enterica serovar Typhi Ty2
gcuccugcgccggac

SEQ ID NO: 3742890 - RNA, 18 nt, Salmonella enterica enterica serovar Typhi Ty2
gcuccugcuccugcggcg

SEQ ID NO: 3742891 - RNA, 12 nt, Salmonella enterica enterica serovar Typhi Ty2
gcuccuggaacc

SEQ ID NO: 3742892 - RNA, 18 nt, Salmonella enterica enterica serovar Typhi Ty2
gcuccuugauugcaagaa

SEQ ID NO: 3742893 - RNA, 19 nt, Salmonella enterica enterica serovar Typhi Ty2
gcuccuuucggacuuccug

SEQ ID NO: 3742894 - RNA, 22 nt, Salmonella enterica enterica serovar Typhi Ty2
gcucgaguucuucacgcugaug

SEQ ID NO: 3742895 - RNA, 15 nt, Salmonella enterica enterica serovar Typhi Ty2
gcucgcaccguaggc

SEQ ID NO: 3742896 - RNA, 15 nt, Salmonella enterica enterica serovar Typhi Ty2
gcucgcagaugcccg

SEQ ID NO: 3742897 - RNA, 16 nt, Salmonella enterica enterica serovar Typhi Ty2
gcucgcauucgcgagc

SEQ ID NO: 3742898 - RNA, 20 nt, Salmonella enterica enterica serovar Typhi Ty2
gcucgccagcauacgucugc

SEQ ID NO: 3742899 - RNA, 21 nt, Salmonella enterica enterica serovar Typhi Ty2
gcucgcccagaauuuccuucg

SEQ ID NO: 3742900 - RNA, 13 nt, Salmonella enterica enterica serovar Typhi Ty2
gcucgcccgccgc

SEQ ID NO: 3742901 - RNA, 14 nt, Salmonella enterica enterica serovar Typhi Ty2
gcucgcccgccgca

SEQ ID NO: 3742902 - RNA, 23 nt, Salmonella enterica enterica serovar Typhi Ty2
gcucgcccgccgcaaaaaauacc

SEQ ID NO: 3742903 - RNA, 19 nt, Salmonella enterica enterica serovar Typhi Ty2
gcucgccgaccggcgcgcc

SEQ ID NO: 3742904 - RNA, 18 nt, Salmonella enterica enterica serovar Typhi Ty2
gcucgccgccucccccuc

SEQ ID NO: 3742905 - RNA, 11 nt, Salmonella enterica enterica serovar Typhi Ty2
gcucgcggcgg

SEQ ID NO: 3742906 - RNA, 12 nt, Salmonella enterica enterica serovar Typhi Ty2
gcucgcggcgga

SEQ ID NO: 3742907 - RNA, 20 nt, Salmonella enterica enterica serovar Typhi Ty2
gcucgcggcggaccgcaacg

SEQ ID NO: 3742908 - RNA, 22 nt, Salmonella enterica enterica serovar Typhi Ty2
gcucgcuaugaaaacgcagccc

SEQ ID NO: 3742909 - RNA, 23 nt, Salmonella enterica enterica serovar Typhi Ty2
gcucgcuaugaaaacgcagcccc

SEQ ID NO: 3742910 - RNA, 11 nt, Salmonella enterica enterica serovar Typhi Ty2
gcucgcuggug

SEQ ID NO: 3742911 - RNA, 20 nt, Salmonella enterica enterica serovar Typhi Ty2
gcucgcuuuuacucuuccug

SEQ ID NO: 3742912 - RNA, 22 nt, Salmonella enterica enterica serovar Typhi Ty2
gcucgcuuuuacucuuccugcu

SEQ ID NO: 3742913 - RNA, 16 nt, Salmonella enterica enterica serovar Typhi Ty2
gcucggaugugcauug

SEQ ID NO: 3742914 - RNA, 15 nt, Salmonella enterica enterica serovar Typhi Ty2
gcucggcaauuucuu

SEQ ID NO: 3742915 - RNA, 15 nt, Salmonella enterica enterica serovar Typhi Ty2
gcucggcgucauccc

SEQ ID NO: 3742916 - RNA, 18 nt, Salmonella enterica enterica serovar Typhi Ty2
gcucggucacuucaaccu

SEQ ID NO: 3742917 - RNA, 18 nt, Salmonella enterica enterica serovar Typhi Ty2
gcucguaaagcaucagac

SEQ ID NO: 3742918 - RNA, 19 nt, Salmonella enterica enterica serovar Typhi Ty2
gcucguaaagcaucagacu

SEQ ID NO: 3742919 - RNA, 21 nt, Salmonella enterica enterica serovar Typhi Ty2
gcucguagcguuuaaagacca

SEQ ID NO: 3742920 - RNA, 21 nt, Salmonella enterica enterica serovar Typhi Ty2
gcucgucgccuuccagcgacu

SEQ ID NO: 3742921 - RNA, 18 nt, Salmonella enterica enterica serovar Typhi Ty2
gcucguuaaauccuccca

SEQ ID NO: 3742922 - RNA, 18 nt, Salmonella enterica enterica serovar Typhi Ty2
gcucguuguuuaauacgc

SEQ ID NO: 3742923 - RNA, 23 nt, Salmonella enterica enterica serovar Typhi Ty2
gcucguuuuuguuuaaaaaccag

SEQ ID NO: 3742924 - RNA, 22 nt, Salmonella enterica enterica serovar Typhi Ty2
gcucuacguugaccucaucacc

SEQ ID NO: 3742925 - RNA, 20 nt, Salmonella enterica enterica serovar Typhi Ty2
gcucuaucaccgcccgccgg

SEQ ID NO: 3742926 - RNA, 22 nt, Salmonella enterica enterica serovar Typhi Ty2
gcucuaucgccuggagcugauc

SEQ ID NO: 3742927 - RNA, 15 nt, Salmonella enterica enterica serovar Typhi Ty2
gcucuauucggcgcu

SEQ ID NO: 3742928 - RNA, 13 nt, Salmonella enterica enterica serovar Typhi Ty2
gcucucccagcug

SEQ ID NO: 3742929 - RNA, 14 nt, Salmonella enterica enterica serovar Typhi Ty2
gcucucccagcuga

SEQ ID NO: 3742930 - RNA, 19 nt, Salmonella enterica enterica serovar Typhi Ty2
gcuggcgucgccaaagcag

SEQ ID NO: 3742931 - RNA, 22 nt, Salmonella enterica enterica serovar Typhi Ty2
gcuggcgugacguguggcgcug

SEQ ID NO: 3742932 - RNA, 19 nt, Salmonella enterica enterica serovar Typhi Ty2
gcuggcguuaucguccguc

SEQ ID NO: 3742933 - RNA, 15 nt, Salmonella enterica enterica serovar Typhi Ty2
gcuggcguugagcgu

SEQ ID NO: 3742934 - RNA, 21 nt, Salmonella enterica enterica serovar Typhi Ty2
gcuggcugccguuaaucuggc

SEQ ID NO: 3742935 - RNA, 16 nt, Salmonella enterica enterica serovar Typhi Ty2
gcuggcuggccagggc

SEQ ID NO: 3742936 - RNA, 17 nt, Salmonella enterica enterica serovar Typhi Ty2
gcuggcuggccagggca

SEQ ID NO: 3742937 - RNA, 13 nt, Salmonella enterica enterica serovar Typhi Ty2
gcuggcuggcggu

SEQ ID NO: 3742938 - RNA, 14 nt, Salmonella enterica enterica serovar Typhi Ty2
gcuggcuggcgguc

SEQ ID NO: 3742939 - RNA, 14 nt, Salmonella enterica enterica serovar Typhi Ty2
gcuggcuuaacuca

SEQ ID NO: 3742940 - RNA, 20 nt, Salmonella enterica enterica serovar Typhi Ty2
gcugggaaacuuaucaguaa

SEQ ID NO: 3742941 - RNA, 17 nt, Salmonella enterica enterica serovar Typhi Ty2
gcugggccugcuccgua

SEQ ID NO: 3742942 - RNA, 19 nt, Salmonella enterica enterica serovar Typhi Ty2
gcuggguaaaaucagcgcg

SEQ ID NO: 3742943 - RNA, 17 nt, Salmonella enterica enterica serovar Typhi Ty2
gcugggucauuaugagu

SEQ ID NO: 3742944 - RNA, 17 nt, Salmonella enterica enterica serovar Typhi Ty2
gcugggugagcgggcug

SEQ ID NO: 3742945 - RNA, 16 nt, Salmonella enterica enterica serovar Typhi Ty2
gcuggguucauccagc

SEQ ID NO: 3742946 - RNA, 22 nt, Salmonella enterica enterica serovar Typhi Ty2
gcugguaguccucuaucuuuuc

SEQ ID NO: 3742947 - RNA, 22 nt, Salmonella enterica enterica serovar Typhi Ty2
gcugguauaggccaggcuauag

SEQ ID NO: 3742948 - RNA, 19 nt, Salmonella enterica enterica serovar Typhi Ty2
gcuggucaccuggcuggug

SEQ ID NO: 3742949 - RNA, 21 nt, Salmonella enterica enterica serovar Typhi Ty2
gcuggucagcgcaaucugcuc

SEQ ID NO: 3742950 - RNA, 21 nt, Salmonella enterica enterica serovar Typhi Ty2
gcuggucagcguacccgcggu

SEQ ID NO: 3742951 - RNA, 16 nt, Salmonella enterica enterica serovar Typhi Ty2
gcuggucgccagcgcc

SEQ ID NO: 3742952 - RNA, 17 nt, Salmonella enterica enterica serovar Typhi Ty2
gcuggucgccgcccauc

SEQ ID NO: 3742953 - RNA, 18 nt, Salmonella enterica enterica serovar Typhi Ty2
gcuggucugaaucugcuc

SEQ ID NO: 3742954 - RNA, 22 nt, Salmonella enterica enterica serovar Typhi Ty2
gcuggugaaacguguuuauccc

SEQ ID NO: 3742955 - RNA, 15 nt, Salmonella enterica enterica serovar Typhi Ty2
gcuggugaagacgcu

SEQ ID NO: 3742956 - RNA, 15 nt, Salmonella enterica enterica serovar Typhi Ty2
gcuggugaucuggcc

SEQ ID NO: 3742957 - RNA, 21 nt, Salmonella enterica enterica serovar Typhi Ty2
gcuggugcagcccgucggcgu

SEQ ID NO: 3742958 - RNA, 22 nt, Salmonella enterica enterica serovar Typhi Ty2
gcuggugccaaucuccagcauc

SEQ ID NO: 3742959 - RNA, 15 nt, Salmonella enterica enterica serovar Typhi Ty2
gcugguggccuucgg

SEQ ID NO: 3742960 - RNA, 12 nt, Salmonella enterica enterica serovar Typhi Ty2
gcuggugguaaa

SEQ ID NO: 3742961 - RNA, 14 nt, Salmonella enterica enterica serovar Typhi Ty2
gcuggugucgccgu

SEQ ID NO: 3742962 - RNA, 19 nt, Salmonella enterica enterica serovar Typhi Ty2
gcugguuaacgccgccauc

SEQ ID NO: 3742963 - RNA, 22 nt, Salmonella enterica enterica serovar Typhi Ty2
gcugguuaauaauuuuacccgc

SEQ ID NO: 3742964 - RNA, 14 nt, Salmonella enterica enterica serovar Typhi Ty2
gcugguuauuccgc

SEQ ID NO: 3742965 - RNA, 16 nt, Salmonella enterica enterica serovar Typhi Ty2
gcugguuggcgcgcuu

SEQ ID NO: 3742966 - RNA, 19 nt, Salmonella enterica enterica serovar Typhi Ty2
gcugguuuuagcuuauccc

SEQ ID NO: 3742967 - RNA, 15 nt, Salmonella enterica enterica serovar Typhi Ty2
gcuguaaaccggccc

SEQ ID NO: 3742968 - RNA, 18 nt, Salmonella enterica enterica serovar Typhi Ty2
gcuguaaaucgcgcccga

SEQ ID NO: 3742969 - RNA, 23 nt, Salmonella enterica enterica serovar Typhi Ty2
gcuguaaauguuguuccagagug

SEQ ID NO: 3742970 - RNA, 15 nt, Salmonella enterica enterica serovar Typhi Ty2
gcuguaacccgccgc

SEQ ID NO: 3742971 - RNA, 17 nt, Salmonella enterica enterica serovar Typhi Ty2
gcuguaauagugcgcgg

SEQ ID NO: 3742972 - RNA, 23 nt, Salmonella enterica enterica serovar Typhi Ty2
gcuguaauuaaggauugccgccu

SEQ ID NO: 3742973 - RNA, 16 nt, Salmonella enterica enterica serovar Typhi Ty2
gcuguacauauccagu

SEQ ID NO: 3742974 - RNA, 13 nt, Salmonella enterica enterica serovar Typhi Ty2
gcuguagcugccc

SEQ ID NO: 3742975 - RNA, 22 nt, Salmonella enterica enterica serovar Typhi Ty2
gcuguaggcacuuuccagacca

SEQ ID NO: 3742976 - RNA, 22 nt, Salmonella enterica enterica serovar Typhi Ty2
gcuguaguuucagcccaaaagc

SEQ ID NO: 3742977 - RNA, 20 nt, Salmonella enterica enterica serovar Typhi Ty2
gcugucagugaaaaaccgau

SEQ ID NO: 3742978 - RNA, 22 nt, Salmonella enterica enterica serovar Typhi Ty2
gcuguccagauagggccaggcg

SEQ ID NO: 3742979 - RNA, 12 nt, Salmonella enterica enterica serovar Typhi Ty2
gcugucccagag

SEQ ID NO: 3742980 - RNA, 14 nt, Salmonella enterica enterica serovar Typhi Ty2
gcugucccagaguu

SEQ ID NO: 3742981 - RNA, 18 nt, Salmonella enterica enterica serovar Typhi Ty2
gcuguccuuaaccagcuc

SEQ ID NO: 3742982 - RNA, 20 nt, Salmonella enterica enterica serovar Typhi Ty2
gcugucgacaauaaauugcg

SEQ ID NO: 3742983 - RNA, 16 nt, Salmonella enterica enterica serovar Typhi Ty2
gcugucggucagauuc

SEQ ID NO: 3742984 - RNA, 20 nt, Salmonella enterica enterica serovar Typhi Ty2
gcugucuaauugacggccac

SEQ ID NO: 3742985 - RNA, 14 nt, Salmonella enterica enterica serovar Typhi Ty2
gcugucugccaugc

SEQ ID NO: 3742986 - RNA, 21 nt, Salmonella enterica enterica serovar Typhi Ty2
gcugucuuacacugauacccc

SEQ ID NO: 3742987 - RNA, 22 nt, Salmonella enterica enterica serovar Typhi Ty2
gcugugagaaggugguggguaa

SEQ ID NO: 3742988 - RNA, 15 nt, Salmonella enterica enterica serovar Typhi Ty2
gcugugcauaaauaa

SEQ ID NO: 3742989 - RNA, 18 nt, Salmonella enterica enterica serovar Typhi Ty2
gcugugcauaucuggcga

SEQ ID NO: 3742990 - RNA, 13 nt, Salmonella enterica enterica serovar Typhi Ty2
gcugugccaauaa

SEQ ID NO: 3742991 - RNA, 14 nt, Salmonella enterica enterica serovar Typhi Ty2
gcugugccugccug

SEQ ID NO: 3742992 - RNA, 18 nt, Salmonella enterica enterica serovar Typhi Ty2
gcugugcgagaccaucaa

SEQ ID NO: 3742993 - RNA, 16 nt, Salmonella enterica enterica serovar Typhi Ty2
gcugugcuaucaggcc

SEQ ID NO: 3742994 - RNA, 16 nt, Salmonella enterica enterica serovar Typhi Ty2
gcuguggaaacugugc

SEQ ID NO: 3742995 - RNA, 16 nt, Salmonella enterica enterica serovar Typhi Ty2
gcugugguuuauccgc

SEQ ID NO: 3742996 - RNA, 15 nt, Salmonella enterica enterica serovar Typhi Ty2
gcuguguccgccaug

SEQ ID NO: 3742997 - RNA, 17 nt, Salmonella enterica enterica serovar Typhi Ty2
gcuguuaaucucauaaa

SEQ ID NO: 3742998 - RNA, 21 nt, Salmonella enterica enterica serovar Typhi Ty2
gcuguuaauuugcaucaggcc

SEQ ID NO: 3742999 - RNA, 18 nt, Salmonella enterica enterica serovar Typhi Ty2
gcuguuacugucggcgau

SEQ ID NO: 3743000 - RNA, 15 nt, Salmonella enterica enterica serovar Typhi Ty2
gcuguuaguaagcug

SEQ ID NO: 3743001 - RNA, 15 nt, Salmonella enterica enterica serovar Typhi Ty2
gcuguucagcagaau

SEQ ID NO: 3743002 - RNA, 16 nt, Salmonella enterica enterica serovar Typhi Ty2
gcuguuccuucagaaa

SEQ ID NO: 3743003 - RNA, 19 nt, Salmonella enterica enterica serovar Typhi Ty2
gcuguuccuucagaaaauu

SEQ ID NO: 3743004 - RNA, 18 nt, Salmonella enterica enterica serovar Typhi Ty2
gcuguugaggaaauucug

SEQ ID NO: 3743005 - RNA, 22 nt, Salmonella enterica enterica serovar Typhi Ty2
gcuguugguuuauugauaggcc

SEQ ID NO: 3743006 - RNA, 18 nt, Salmonella enterica enterica serovar Typhi Ty2
gcuguugucgauauuaaa

SEQ ID NO: 3743007 - RNA, 15 nt, Salmonella enterica enterica serovar Typhi Ty2
gcuguuguuccagau

SEQ ID NO: 3743008 - RNA, 20 nt, Salmonella enterica enterica serovar Typhi Ty2
gcuguuuaaagguuauccgc

SEQ ID NO: 3743009 - RNA, 21 nt, Salmonella enterica enterica serovar Typhi Ty2
gcuguuuagccgucucgguuc

SEQ ID NO: 3743010 - RNA, 15 nt, Salmonella enterica enterica serovar Typhi Ty2
gcuguuuauggcgcu

SEQ ID NO: 3743011 - RNA, 15 nt, Salmonella enterica enterica serovar Typhi Ty2
gcuguuucuggucau

SEQ ID NO: 3743012 - RNA, 19 nt, Salmonella enterica enterica serovar Typhi Ty2
gcuuccugcgcugucacca

SEQ ID NO: 3743013 - RNA, 15 nt, Salmonella enterica enterica serovar Typhi Ty2
gcuuccuguuuauga

SEQ ID NO: 3743014 - RNA, 20 nt, Salmonella enterica enterica serovar Typhi Ty2
gcuuccuguuuaugacccug

SEQ ID NO: 3743015 - RNA, 18 nt, Salmonella enterica enterica serovar Typhi Ty2
gcuucgccaucuccauca

SEQ ID NO: 3743016 - RNA, 14 nt, Salmonella enterica enterica serovar Typhi Ty2
gcuucgcuuaccag

SEQ ID NO: 3743017 - RNA, 14 nt, Salmonella enterica enterica serovar Typhi Ty2
gcuucgucagcucc

SEQ ID NO: 3743018 - RNA, 18 nt, Salmonella enterica enterica serovar Typhi Ty2
gcuucgucaggcggcugc

SEQ ID NO: 3743019 - RNA, 19 nt, Salmonella enterica enterica serovar Typhi Ty2
gcuucgucaggcggcugcg

SEQ ID NO: 3743020 - RNA, 14 nt, Salmonella enterica enterica serovar Typhi Ty2
gcuucgucuuuauu

SEQ ID NO: 3743021 - RNA, 15 nt, Salmonella enterica enterica serovar Typhi Ty2
gcuucgugagaagua

SEQ ID NO: 3743022 - RNA, 21 nt, Salmonella enterica enterica serovar Typhi Ty2
gcuucguggcaaucagcaauu

SEQ ID NO: 3743023 - RNA, 20 nt, Salmonella enterica enterica serovar Typhi Ty2
gcuucguuaccgccuuuuuu

SEQ ID NO: 3743024 - RNA, 17 nt, Salmonella enterica enterica serovar Typhi Ty2
gcuucguuucagauaac

SEQ ID NO: 3743025 - RNA, 13 nt, Salmonella enterica enterica serovar Typhi Ty2
gcuucuauccacu

SEQ ID NO: 3743026 - RNA, 19 nt, Salmonella enterica enterica serovar Typhi Ty2
gcuucucuucaaacucgcu

SEQ ID NO: 3743027 - RNA, 20 nt, Salmonella enterica enterica serovar Typhi Ty2
gcuucugcaaaauuagcgac

SEQ ID NO: 3743028 - RNA, 15 nt, Salmonella enterica enterica serovar Typhi Ty2
gcuucuggcguaaug

SEQ ID NO: 3743029 - RNA, 20 nt, Salmonella enterica enterica serovar Typhi Ty2
gcuucuguccuuucugcugc

SEQ ID NO: 3743030 - RNA, 16 nt, Salmonella enterica enterica serovar Typhi Ty2
gcuucugucugcguga

SEQ ID NO: 3743031 - RNA, 21 nt, Salmonella enterica enterica serovar Typhi Ty2
gcuucuuaaaauagccaucgu

SEQ ID NO: 3743032 - RNA, 22 nt, Salmonella enterica enterica serovar Typhi Ty2
gcuucuucacuaauuugaugcc

SEQ ID NO: 3743033 - RNA, 23 nt, Salmonella enterica enterica serovar Typhi Ty2
gcuucuucacuaauuugaugccu

SEQ ID NO: 3743034 - RNA, 20 nt, Salmonella enterica enterica serovar Typhi Ty2
gcuucuuugaaauugaucac

SEQ ID NO: 3743035 - RNA, 21 nt, Salmonella enterica enterica serovar Typhi Ty2
gcuucuuugaagcguuccagu

SEQ ID NO: 3743036 - RNA, 14 nt, Salmonella enterica enterica serovar Typhi Ty2
gcuugacucugaag

SEQ ID NO: 3743037 - RNA, 15 nt, Salmonella enterica enterica serovar Typhi Ty2
gcuugacucugaagc

SEQ ID NO: 3743038 - RNA, 17 nt, Salmonella enterica enterica serovar Typhi Ty2
gcuugagacagaccaca

SEQ ID NO: 3743039 - RNA, 20 nt, Salmonella enterica enterica serovar Typhi Ty2
gcuugauacgccaucuuucu

SEQ ID NO: 3743040 - RNA, 17 nt, Salmonella enterica enterica serovar Typhi Ty2
gcuugcacuaucgggca

SEQ ID NO: 3743041 - RNA, 20 nt, Salmonella enterica enterica serovar Typhi Ty2
gcuugcaggaugucgauaau

SEQ ID NO: 3743042 - RNA, 14 nt, Salmonella enterica enterica serovar Typhi Ty2
gcuugcccggccgu

SEQ ID NO: 3743043 - RNA, 16 nt, Salmonella enterica enterica serovar Typhi Ty2
gcuugccgaccgcaac

SEQ ID NO: 3743044 - RNA, 19 nt, Salmonella enterica enterica serovar Typhi Ty2
gcuugccgggccguagugc

SEQ ID NO: 3743045 - RNA, 12 nt, Salmonella enterica enterica serovar Typhi Ty2
gcuugcgaucca

SEQ ID NO: 3743046 - RNA, 16 nt, Salmonella enterica enterica serovar Typhi Ty2
gcuugcgccaucaucc

SEQ ID NO: 3743047 - RNA, 22 nt, Salmonella enterica enterica serovar Typhi Ty2
gcuugcgccgccauccggccug

SEQ ID NO: 3743048 - RNA, 15 nt, Salmonella enterica enterica serovar Typhi Ty2
gcuugcgcuauccgc

SEQ ID NO: 3743049 - RNA, 14 nt, Salmonella enterica enterica serovar Typhi Ty2
gcuugcggguuuug

SEQ ID NO: 3743050 - RNA, 17 nt, Salmonella enterica enterica serovar Typhi Ty2
gcuuguaaauugcgcca

SEQ ID NO: 3743051 - RNA, 14 nt, Salmonella enterica enterica serovar Typhi Ty2
gcuugucacgaagc

SEQ ID NO: 3743052 - RNA, 15 nt, Salmonella enterica enterica serovar Typhi Ty2
gcuugucauccugcu

SEQ ID NO: 3743053 - RNA, 16 nt, Salmonella enterica enterica serovar Typhi Ty2
gcuugucgccaugcac

SEQ ID NO: 3743054 - RNA, 15 nt, Salmonella enterica enterica serovar Typhi Ty2
gcuugugaugagcuc

SEQ ID NO: 3743055 - RNA, 15 nt, Salmonella enterica enterica serovar Typhi Ty2
gcuuguuaucuggca

SEQ ID NO: 3743056 - RNA, 17 nt, Salmonella enterica enterica serovar Typhi Ty2
gcuuguuguaaagaaau

SEQ ID NO: 3743057 - RNA, 19 nt, Salmonella enterica enterica serovar Typhi Ty2
gcuuguuguuuauccugca

SEQ ID NO: 3743058 - RNA, 18 nt, Salmonella enterica enterica serovar Typhi Ty2
gcuuguuucacuguagcu

SEQ ID NO: 3743059 - RNA, 16 nt, Salmonella enterica enterica serovar Typhi Ty2
gcuuuaaauucagcac

SEQ ID NO: 3743060 - RNA, 13 nt, Salmonella enterica enterica serovar Typhi Ty2
gcuuuaagcgcug

SEQ ID NO: 3743061 - RNA, 18 nt, Salmonella enterica enterica serovar Typhi Ty2
gcuuuaauauucauucug

SEQ ID NO: 3743062 - RNA, 15 nt, Salmonella enterica enterica serovar Typhi Ty2
gcuuuaaucaccaug

SEQ ID NO: 3743063 - RNA, 23 nt, Salmonella enterica enterica serovar Typhi Ty2
gcuuuaaucacccgcgccagcag

SEQ ID NO: 3743064 - RNA, 21 nt, Salmonella enterica enterica serovar Typhi Ty2
gcuuuaaugcuuuaaaugccu

SEQ ID NO: 3743065 - RNA, 20 nt, Salmonella enterica enterica serovar Typhi Ty2
gcuuuacccggcgcaaacag

SEQ ID NO: 3743066 - RNA, 22 nt, Salmonella enterica enterica serovar Typhi Ty2
gcuuuacccgggccaucuuuuu

SEQ ID NO: 3743067 - RNA, 23 nt, Salmonella enterica enterica serovar Typhi Ty2
gcuuuacgaccgcagaaacagau

SEQ ID NO: 3743068 - RNA, 16 nt, Salmonella enterica enterica serovar Typhi Ty2
gcuuuagcuuuacucu

SEQ ID NO: 3743069 - RNA, 20 nt, Salmonella enterica enterica serovar Typhi Ty2
gcuuuaggguaucauuucca

SEQ ID NO: 3743070 - RNA, 16 nt, Salmonella enterica enterica serovar Typhi Ty2
gcuuuagugccgccau

SEQ ID NO: 3743071 - RNA, 12 nt, Salmonella enterica enterica serovar Typhi Ty2
gcuuuauauaaa

SEQ ID NO: 3743072 - RNA, 13 nt, Salmonella enterica enterica serovar Typhi Ty2
gcuuuaugcacgc

SEQ ID NO: 3743073 - RNA, 21 nt, Salmonella enterica enterica serovar Typhi Ty2
gcuuuauucugucgccaccac

SEQ ID NO: 3743074 - RNA, 22 nt, Salmonella enterica enterica serovar Typhi Ty2
gcuuuauucugucgccaccacu

SEQ ID NO: 3743075 - RNA, 16 nt, Salmonella enterica enterica serovar Typhi Ty2
gcuuuauuuuacaacu

SEQ ID NO: 3743076 - RNA, 18 nt, Salmonella enterica enterica serovar Typhi Ty2
gcuuucacaccguuaucc

SEQ ID NO: 3743077 - RNA, 20 nt, Salmonella enterica enterica serovar Typhi Ty2
gcuuucaguaauaauauaaa

SEQ ID NO: 3743078 - RNA, 21 nt, Salmonella enterica enterica serovar Typhi Ty2
gcuuucauccaauaacguaac

SEQ ID NO: 3743079 - RNA, 12 nt, Salmonella enterica enterica serovar Typhi Ty2
gcuuuccagcuc

SEQ ID NO: 3743080 - RNA, 15 nt, Salmonella enterica enterica serovar Typhi Ty2
gcuuucccuucagau

SEQ ID NO: 3743081 - RNA, 16 nt, Salmonella enterica enterica serovar Typhi Ty2
gcuuuccgccaugaaa

SEQ ID NO: 3743082 - RNA, 20 nt, Salmonella enterica enterica serovar Typhi Ty2
gcuuuccgccaugaaaaaaa

SEQ ID NO: 3743083 - RNA, 22 nt, Salmonella enterica enterica serovar Typhi Ty2
gcuuucggucguuugccgugca

SEQ ID NO: 3743084 - RNA, 20 nt, Salmonella enterica enterica serovar Typhi Ty2
gcuuucuguaggccggauaa

SEQ ID NO: 3743085 - RNA, 19 nt, Salmonella enterica enterica serovar Typhi Ty2
gcuuucuguugauacagua

SEQ ID NO: 3743086 - RNA, 23 nt, Salmonella enterica enterica serovar Typhi Ty2
gcuuucuuccagguuaacccaca

SEQ ID NO: 3743087 - RNA, 10 nt, Salmonella enterica enterica serovar Typhi Ty2
gcuuucuucu

SEQ ID NO: 3743088 - RNA, 13 nt, Salmonella enterica enterica serovar Typhi Ty2
gcuuucuucuuca

SEQ ID NO: 3743089 - RNA, 23 nt, Salmonella enterica enterica serovar Typhi Ty2
gcuuucuuucuccagcguacugc

SEQ ID NO: 3743090 - RNA, 22 nt, Salmonella enterica enterica serovar Typhi Ty2
gcuuugaacagcgucauccagu

SEQ ID NO: 3743091 - RNA, 11 nt, Salmonella enterica enterica serovar Typhi Ty2
gcuuugagcgu

SEQ ID NO: 3743092 - RNA, 17 nt, Salmonella enterica enterica serovar Typhi Ty2
gcuuugcaagcaugaua

SEQ ID NO: 3743093 - RNA, 19 nt, Salmonella enterica enterica serovar Typhi Ty2
gcuuugcaauguucaauau

SEQ ID NO: 3743094 - RNA, 18 nt, Salmonella enterica enterica serovar Typhi Ty2
ggaagccguauaugaaua

SEQ ID NO: 3743095 - RNA, 18 nt, Salmonella enterica enterica serovar Typhi Ty2
ggaagcgaccggcgucau

SEQ ID NO: 3743096 - RNA, 17 nt, Salmonella enterica enterica serovar Typhi Ty2
ggaagcgauguuuacug

SEQ ID NO: 3743097 - RNA, 22 nt, Salmonella enterica enterica serovar Typhi Ty2
ggaagcugcgcagcacuucaga

SEQ ID NO: 3743098 - RNA, 16 nt, Salmonella enterica enterica serovar Typhi Ty2
ggaaggaagggcgcug

SEQ ID NO: 3743099 - RNA, 15 nt, Salmonella enterica enterica serovar Typhi Ty2
ggaaggcgugcagcg

SEQ ID NO: 3743100 - RNA, 17 nt, Salmonella enterica enterica serovar Typhi Ty2
ggaaggcuaccgcuggg

SEQ ID NO: 3743101 - RNA, 23 nt, Salmonella enterica enterica serovar Typhi Ty2
ggaaggucgcauccgcguuagca

SEQ ID NO: 3743102 - RNA, 18 nt, Salmonella enterica enterica serovar Typhi Ty2
ggaaguauacauccacug

SEQ ID NO: 3743103 - RNA, 21 nt, Salmonella enterica enterica serovar Typhi Ty2
ggaaguaugccucgcgcacca

SEQ ID NO: 3743104 - RNA, 15 nt, Salmonella enterica enterica serovar Typhi Ty2
ggaagucagcuuccu

SEQ ID NO: 3743105 - RNA, 18 nt, Salmonella enterica enterica serovar Typhi Ty2
ggaagucagcuuccugca

SEQ ID NO: 3743106 - RNA, 20 nt, Salmonella enterica enterica serovar Typhi Ty2
ggaagucagcuuccugcacg

SEQ ID NO: 3743107 - RNA, 15 nt, Salmonella enterica enterica serovar Typhi Ty2
ggaaguccuucuccu

SEQ ID NO: 3743108 - RNA, 22 nt, Salmonella enterica enterica serovar Typhi Ty2
ggaagucggaaaucuguuccag

SEQ ID NO: 3743109 - RNA, 15 nt, Salmonella enterica enterica serovar Typhi Ty2
ggaauaaauauaaga

SEQ ID NO: 3743110 - RNA, 21 nt, Salmonella enterica enterica serovar Typhi Ty2
ggaauaagcgauacucucgca

SEQ ID NO: 3743111 - RNA, 20 nt, Salmonella enterica enterica serovar Typhi Ty2
ggaauaagggugagagggga

SEQ ID NO: 3743112 - RNA, 13 nt, Salmonella enterica enterica serovar Typhi Ty2
ggaauaccgucaa

SEQ ID NO: 3743113 - RNA, 18 nt, Salmonella enterica enterica serovar Typhi Ty2
ggaauagauaaguccuaa

SEQ ID NO: 3743114 - RNA, 22 nt, Salmonella enterica enterica serovar Typhi Ty2
ggaaucacgcauaucccacugc

SEQ ID NO: 3743115 - RNA, 22 nt, Salmonella enterica enterica serovar Typhi Ty2
ggaaucauggcuugaucgcgca

SEQ ID NO: 3743116 - RNA, 14 nt, Salmonella enterica enterica serovar Typhi Ty2
ggaauccccgccgc

SEQ ID NO: 3743117 - RNA, 12 nt, Salmonella enterica enterica serovar Typhi Ty2
ggaaucgaugcu

SEQ ID NO: 3743118 - RNA, 14 nt, Salmonella enterica enterica serovar Typhi Ty2
ggaaucgcgaucca

SEQ ID NO: 3743119 - RNA, 17 nt, Salmonella enterica enterica serovar Typhi Ty2
ggaaucgcgauuccgga

SEQ ID NO: 3743120 - RNA, 20 nt, Salmonella enterica enterica serovar Typhi Ty2
ggaaugccccagguuauaga

SEQ ID NO: 3743121 - RNA, 22 nt, Salmonella enterica enterica serovar Typhi Ty2
ggaaugccgugauaggagagca

SEQ ID NO: 3743122 - RNA, 19 nt, Salmonella enterica enterica serovar Typhi Ty2
ggaauggcacagcgcagca

SEQ ID NO: 3743123 - RNA, 17 nt, Salmonella enterica enterica serovar Typhi Ty2
ggaauucccacaucgcg

SEQ ID NO: 3743124 - RNA, 17 nt, Salmonella enterica enterica serovar Typhi Ty2
ggaauugguagacacgc

SEQ ID NO: 3743125 - RNA, 17 nt, Salmonella enterica enterica serovar Typhi Ty2
ggaauuuaccggugcgg

SEQ ID NO: 3743126 - RNA, 16 nt, Salmonella enterica enterica serovar Typhi Ty2
ggaauuuguugguuua

SEQ ID NO: 3743127 - RNA, 22 nt, Salmonella enterica enterica serovar Typhi Ty2
ggacaaggcgguacgccgccau

SEQ ID NO: 3743128 - RNA, 20 nt, Salmonella enterica enterica serovar Typhi Ty2
ggacacccggcuuuugcuuu

SEQ ID NO: 3743129 - RNA, 11 nt, Salmonella enterica enterica serovar Typhi Ty2
ggacagcgaca

SEQ ID NO: 3743130 - RNA, 20 nt, Salmonella enterica enterica serovar Typhi Ty2
ggacagcgacacuccgcgca

SEQ ID NO: 3743131 - RNA, 16 nt, Salmonella enterica enterica serovar Typhi Ty2
ggacaggcgaaauaag

SEQ ID NO: 3743132 - RNA, 17 nt, Salmonella enterica enterica serovar Typhi Ty2
ggacauaaacgccucau

SEQ ID NO: 3743133 - RNA, 14 nt, Salmonella enterica enterica serovar Typhi Ty2
ggacaucaaaggca

SEQ ID NO: 3743134 - RNA, 12 nt, Salmonella enterica enterica serovar Typhi Ty2
ggaccagcacaa

SEQ ID NO: 3743135 - RNA, 15 nt, Salmonella enterica enterica serovar Typhi Ty2
ggaccagcacaaaaa

SEQ ID NO: 3743136 - RNA, 18 nt, Salmonella enterica enterica serovar Typhi Ty2
ggaccaugauaucgccaa

SEQ ID NO: 3743137 - RNA, 17 nt, Salmonella enterica enterica serovar Typhi Ty2
ggaccggcaaucgccug

SEQ ID NO: 3743138 - RNA, 20 nt, Salmonella enterica enterica serovar Typhi Ty2
ggaccggcaaucgccugcaa

SEQ ID NO: 3743139 - RNA, 23 nt, Salmonella enterica enterica serovar Typhi Ty2
ggaccggcagcgucggcuucauc

SEQ ID NO: 3743140 - RNA, 17 nt, Salmonella enterica enterica serovar Typhi Ty2
ggaccguguucaugcag

SEQ ID NO: 3743141 - RNA, 19 nt, Salmonella enterica enterica serovar Typhi Ty2
ggacgcaagagcguccagu

SEQ ID NO: 3743142 - RNA, 13 nt, Salmonella enterica enterica serovar Typhi Ty2
ggacgcacccugu

SEQ ID NO: 3743143 - RNA, 18 nt, Salmonella enterica enterica serovar Typhi Ty2
ggacgcugacgccaggcc

SEQ ID NO: 3743144 - RNA, 15 nt, Salmonella enterica enterica serovar Typhi Ty2
ggacggcggccagca

SEQ ID NO: 3743145 - RNA, 12 nt, Salmonella enterica enterica serovar Typhi Ty2
ggacguugaaaa

SEQ ID NO: 3743146 - RNA, 23 nt, Salmonella enterica enterica serovar Typhi Ty2
ggacguugagcguuacgggaaca

SEQ ID NO: 3743147 - RNA, 14 nt, Salmonella enterica enterica serovar Typhi Ty2
ggacuauaggcaau

SEQ ID NO: 3743148 - RNA, 17 nt, Salmonella enterica enterica serovar Typhi Ty2
ggacuaucgaaagagca

SEQ ID NO: 3743149 - RNA, 15 nt, Salmonella enterica enterica serovar Typhi Ty2
ggacucccaggugug

SEQ ID NO: 3743150 - RNA, 16 nt, Salmonella enterica enterica serovar Typhi Ty2
ggacucgccuuucucc

SEQ ID NO: 3743151 - RNA, 13 nt, Salmonella enterica enterica serovar Typhi Ty2
ggacugauacagc

SEQ ID NO: 3743152 - RNA, 23 nt, Salmonella enterica enterica serovar Typhi Ty2
ggacugauacagccaaaucagca

SEQ ID NO: 3743153 - RNA, 22 nt, Salmonella enterica enterica serovar Typhi Ty2
ggacugaucccacuuaggcagc

SEQ ID NO: 3743154 - RNA, 13 nt, Salmonella enterica enterica serovar Typhi Ty2
ggacugccuaacu

SEQ ID NO: 3743155 - RNA, 16 nt, Salmonella enterica enterica serovar Typhi Ty2
ggacugcggccugcaa

SEQ ID NO: 3743156 - RNA, 15 nt, Salmonella enterica enterica serovar Typhi Ty2
ggacuguacaagaag

SEQ ID NO: 3743157 - RNA, 12 nt, Salmonella enterica enterica serovar Typhi Ty2
ggacuuucgcuu

SEQ ID NO: 3743158 - RNA, 17 nt, Salmonella enterica enterica serovar Typhi Ty2
ggacuuucgcuucacga

SEQ ID NO: 3743159 - RNA, 14 nt, Salmonella enterica enterica serovar Typhi Ty2
ggagaaaacgcggc

SEQ ID NO: 3743160 - RNA, 15 nt, Salmonella enterica enterica serovar Typhi Ty2
ggagaacgccgggcc

SEQ ID NO: 3743161 - RNA, 16 nt, Salmonella enterica enterica serovar Typhi Ty2
ggagaagacgccgccg

SEQ ID NO: 3743162 - RNA, 19 nt, Salmonella enterica enterica serovar Typhi Ty2
ggagaagacgccgccgcau

SEQ ID NO: 3743163 - RNA, 15 nt, Salmonella enterica enterica serovar Typhi Ty2
ggagacagaacagga

SEQ ID NO: 3743164 - RNA, 18 nt, Salmonella enterica enterica serovar Typhi Ty2
ggagaccccacacuacca

SEQ ID NO: 3743165 - RNA, 15 nt, Salmonella enterica enterica serovar Typhi Ty2
ggagagcaacgccau

SEQ ID NO: 3743166 - RNA, 16 nt, Salmonella enterica enterica serovar Typhi Ty2
ggagagcaguccuaaa

SEQ ID NO: 3743167 - RNA, 15 nt, Salmonella enterica enterica serovar Typhi Ty2
ggagagccagaagaa

SEQ ID NO: 3743168 - RNA, 19 nt, Salmonella enterica enterica serovar Typhi Ty2
ggagaggccaccagcgcca

SEQ ID NO: 3743169 - RNA, 18 nt, Salmonella enterica enterica serovar Typhi Ty2
ggagaggcguucaugccu

SEQ ID NO: 3743170 - RNA, 23 nt, Salmonella enterica enterica serovar Typhi Ty2
ggagaguucauaacgcacaacgu

SEQ ID NO: 3743171 - RNA, 23 nt, Salmonella enterica enterica serovar Typhi Ty2
ggagaguuuugccgucacagaga

SEQ ID NO: 3743172 - RNA, 19 nt, Salmonella enterica enterica serovar Typhi Ty2
ggagauauggcggggaggu

SEQ ID NO: 3743173 - RNA, 18 nt, Salmonella enterica enterica serovar Typhi Ty2
ggagcagacuguaaaucu

SEQ ID NO: 3743174 - RNA, 21 nt, Salmonella enterica enterica serovar Typhi Ty2
ggagcagugauuaugcucccg

SEQ ID NO: 3743175 - RNA, 19 nt, Salmonella enterica enterica serovar Typhi Ty2
ggagcauuggaaauucagg

SEQ ID NO: 3743176 - RNA, 13 nt, Salmonella enterica enterica serovar Typhi Ty2
ggagcccaguagc

SEQ ID NO: 3743177 - RNA, 17 nt, Salmonella enterica enterica serovar Typhi Ty2
ggagccgccauccggcg

SEQ ID NO: 3743178 - RNA, 19 nt, Salmonella enterica enterica serovar Typhi Ty2
ggagccucuucuggcuccc

SEQ ID NO: 3743179 - RNA, 21 nt, Salmonella enterica enterica serovar Typhi Ty2
ggagccugggauugcaucauc

SEQ ID NO: 3743180 - RNA, 22 nt, Salmonella enterica enterica serovar Typhi Ty2
ggagcgaagaauucgcaaugug

SEQ ID NO: 3743181 - RNA, 14 nt, Salmonella enterica enterica serovar Typhi Ty2
ggagcgcuucgcuu

SEQ ID NO: 3743182 - RNA, 14 nt, Salmonella enterica enterica serovar Typhi Ty2
ggagcggcguccgc

SEQ ID NO: 3743183 - RNA, 11 nt, Salmonella enterica enterica serovar Typhi Ty2
ggagcgugcuu

SEQ ID NO: 3743184 - RNA, 16 nt, Salmonella enterica enterica serovar Typhi Ty2
ggagcguucaugcugg

SEQ ID NO: 3743185 - RNA, 18 nt, Salmonella enterica enterica serovar Typhi Ty2
ggagcugacugcaaaucu

SEQ ID NO: 3743186 - RNA, 19 nt, Salmonella enterica enterica serovar Typhi Ty2
ggagcugacugcaaaucug

SEQ ID NO: 3743187 - RNA, 20 nt, Salmonella enterica enterica serovar Typhi Ty2
ggagcuuuacucaacgguca

SEQ ID NO: 3743188 - RNA, 15 nt, Salmonella enterica enterica serovar Typhi Ty2
ggaggaacagcgccg

SEQ ID NO: 3743189 - RNA, 22 nt, Salmonella enterica enterica serovar Typhi Ty2
ggaggaacagcgccgucacccg

SEQ ID NO: 3743190 - RNA, 16 nt, Salmonella enterica enterica serovar Typhi Ty2
ggaggccugaauaaug

SEQ ID NO: 3743191 - RNA, 23 nt, Salmonella enterica enterica serovar Typhi Ty2
ggaggcgugagcgaacaggucgc

SEQ ID NO: 3743192 - RNA, 15 nt, Salmonella enterica enterica serovar Typhi Ty2
ggaggucauuauuca

SEQ ID NO: 3743193 - RNA, 23 nt, Salmonella enterica enterica serovar Typhi Ty2
ggaggucauuauucaggccuccu

SEQ ID NO: 3743194 - RNA, 23 nt, Salmonella enterica enterica serovar Typhi Ty2
ggaguaguguaauaccacugccc

SEQ ID NO: 3743195 - RNA, 22 nt, Salmonella enterica enterica serovar Typhi Ty2
ggaguauuuaccuacuguggug

SEQ ID NO: 3743196 - RNA, 13 nt, Salmonella enterica enterica serovar Typhi Ty2
ggaguccagcaac

SEQ ID NO: 3743197 - RNA, 19 nt, Salmonella enterica enterica serovar Typhi Ty2
ggaguccagcaacugcgcg

SEQ ID NO: 3743198 - RNA, 17 nt, Salmonella enterica enterica serovar Typhi Ty2
ggagucugaaaauaauu

SEQ ID NO: 3743199 - RNA, 12 nt, Salmonella enterica enterica serovar Typhi Ty2
ggagugaacacg

SEQ ID NO: 3743200 - RNA, 16 nt, Salmonella enterica enterica serovar Typhi Ty2
ggaguggcgaaauugg

SEQ ID NO: 3743201 - RNA, 12 nt, Salmonella enterica enterica serovar Typhi Ty2
ggauaaaaaagc

SEQ ID NO: 3743202 - RNA, 12 nt, Salmonella enterica enterica serovar Typhi Ty2
ggauaaaacaga

SEQ ID NO: 3743203 - RNA, 16 nt, Salmonella enterica enterica serovar Typhi Ty2
ggauaaacaccggaau

SEQ ID NO: 3743204 - RNA, 14 nt, Salmonella enterica enterica serovar Typhi Ty2
ggauaaagaccggc

SEQ ID NO: 3743205 - RNA, 22 nt, Salmonella enterica enterica serovar Typhi Ty2
ggauaaauagugacgccgccau

SEQ ID NO: 3743206 - RNA, 20 nt, Salmonella enterica enterica serovar Typhi Ty2
ggauaacauguggcuggggc

SEQ ID NO: 3743207 - RNA, 20 nt, Salmonella enterica enterica serovar Typhi Ty2
ggauaacgcagaagacagaa

SEQ ID NO: 3743208 - RNA, 17 nt, Salmonella enterica enterica serovar Typhi Ty2
ggauaagcgcagcgcca

SEQ ID NO: 3743209 - RNA, 18 nt, Salmonella enterica enterica serovar Typhi Ty2
ggauaagcgcagcgccau

SEQ ID NO: 3743210 - RNA, 14 nt, Salmonella enterica enterica serovar Typhi Ty2
ggauaagcggcagc

SEQ ID NO: 3743211 - RNA, 18 nt, Salmonella enterica enterica serovar Typhi Ty2
ggauaagcggcagcgcca

SEQ ID NO: 3743212 - RNA, 19 nt, Salmonella enterica enterica serovar Typhi Ty2
ggauaagcggcagcgccau

SEQ ID NO: 3743213 - RNA, 18 nt, Salmonella enterica enterica serovar Typhi Ty2
ggauaagcguagcgccau

SEQ ID NO: 3743214 - RNA, 17 nt, Salmonella enterica enterica serovar Typhi Ty2
ggauaagcgugcgccau

SEQ ID NO: 3743215 - RNA, 15 nt, Salmonella enterica enterica serovar Typhi Ty2
ggauaaggcagcaau

SEQ ID NO: 3743216 - RNA, 23 nt, Salmonella enterica enterica serovar Typhi Ty2
ggauaaggcauucacgccaccau

SEQ ID NO: 3743217 - RNA, 20 nt, Salmonella enterica enterica serovar Typhi Ty2
ggauaaggccacgccgccau

SEQ ID NO: 3743218 - RNA, 14 nt, Salmonella enterica enterica serovar Typhi Ty2
ggauaaggcgcagc

SEQ ID NO: 3743219 - RNA, 20 nt, Salmonella enterica enterica serovar Typhi Ty2
ggauaaggcgcagccgccau

SEQ ID NO: 3743220 - RNA, 20 nt, Salmonella enterica enterica serovar Typhi Ty2
ggauaaggcgcuagccgcau

SEQ ID NO: 3743221 - RNA, 23 nt, Salmonella enterica enterica serovar Typhi Ty2
ggauaaggcgcuugcgccgccau

SEQ ID NO: 3743222 - RNA, 20 nt, Salmonella enterica enterica serovar Typhi Ty2
ggauaaggcguaaccgccau

SEQ ID NO: 3743223 - RNA, 14 nt, Salmonella enterica enterica serovar Typhi Ty2
ggauaaggcgugag

SEQ ID NO: 3743224 - RNA, 23 nt, Salmonella enterica enterica serovar Typhi Ty2
ggauaaggcguucacgccgccau

SEQ ID NO: 3743225 - RNA, 23 nt, Salmonella enterica enterica serovar Typhi Ty2
ggauaaggcguuuacgccgccau

SEQ ID NO: 3743226 - RNA, 23 nt, Salmonella enterica enterica serovar Typhi Ty2
ggauaagguguuuacgccgccau

SEQ ID NO: 3743227 - RNA, 22 nt, Salmonella enterica enterica serovar Typhi Ty2
ggauaaucacggcggaggccga

SEQ ID NO: 3743228 - RNA, 15 nt, Salmonella enterica enterica serovar Typhi Ty2
ggauaaucagcagcg

SEQ ID NO: 3743229 - RNA, 14 nt, Salmonella enterica enterica serovar Typhi Ty2
ggauaauuuaucca

SEQ ID NO: 3743230 - RNA, 13 nt, Salmonella enterica enterica serovar Typhi Ty2
ggauacagcgccg

SEQ ID NO: 3743231 - RNA, 15 nt, Salmonella enterica enterica serovar Typhi Ty2
ggauaccacgcacau

SEQ ID NO: 3743232 - RNA, 12 nt, Salmonella enterica enterica serovar Typhi Ty2
ggauaccgcacu

SEQ ID NO: 3743233 - RNA, 17 nt, Salmonella enterica enterica serovar Typhi Ty2
ggauacgccagcagaca

SEQ ID NO: 3743234 - RNA, 21 nt, Salmonella enterica enterica serovar Typhi Ty2
ggauacuaaagggaucuuccu

SEQ ID NO: 3743235 - RNA, 18 nt, Salmonella enterica enterica serovar Typhi Ty2
ggauacuguuuuugcuuu

SEQ ID NO: 3743236 - RNA, 16 nt, Salmonella enterica enterica serovar Typhi Ty2
ggauagagaucuuccg

SEQ ID NO: 3743237 - RNA, 15 nt, Salmonella enterica enterica serovar Typhi Ty2
ggauagaugaagaca

SEQ ID NO: 3743238 - RNA, 17 nt, Salmonella enterica enterica serovar Typhi Ty2
ggauagaugaagacaac

SEQ ID NO: 3743239 - RNA, 14 nt, Salmonella enterica enterica serovar Typhi Ty2
ggauagcgaccagc

SEQ ID NO: 3743240 - RNA, 17 nt, Salmonella enterica enterica serovar Typhi Ty2
ggauagcguagcgccau

SEQ ID NO: 3743241 - RNA, 14 nt, Salmonella enterica enterica serovar Typhi Ty2
ggauaguacugacc

SEQ ID NO: 3743242 - RNA, 12 nt, Salmonella enterica enterica serovar Typhi Ty2
ggauagucuuca

SEQ ID NO: 3743243 - RNA, 20 nt, Salmonella enterica enterica serovar Typhi Ty2
ggauagugauauagcgccau

SEQ ID NO: 3743244 - RNA, 19 nt, Salmonella enterica enterica serovar Typhi Ty2
ggauagugccugccgucgc

SEQ ID NO: 3743245 - RNA, 16 nt, Salmonella enterica enterica serovar Typhi Ty2
ggauauacuucaucag

SEQ ID NO: 3743246 - RNA, 22 nt, Salmonella enterica enterica serovar Typhi Ty2
ggauauccucuuuucgaacgcc

SEQ ID NO: 3743247 - RNA, 16 nt, Salmonella enterica enterica serovar Typhi Ty2
ggauaucuuccgggcg

SEQ ID NO: 3743248 - RNA, 19 nt, Salmonella enterica enterica serovar Typhi Ty2
ggauauguauuuguucucg

SEQ ID NO: 3743249 - RNA, 17 nt, Salmonella enterica enterica serovar Typhi Ty2
ggauauucaucaguuua

SEQ ID NO: 3743250 - RNA, 18 nt, Salmonella enterica enterica serovar Typhi Ty2
ggaucaauaugccagaua

SEQ ID NO: 3743251 - RNA, 21 nt, Salmonella enterica enterica serovar Typhi Ty2
ggaucaauaugccagauauuu

SEQ ID NO: 3743252 - RNA, 20 nt, Salmonella enterica enterica serovar Typhi Ty2
ggaucaccugaaugcaaaga

SEQ ID NO: 3743253 - RNA, 22 nt, Salmonella enterica enterica serovar Typhi Ty2
ggaucaccugaaugcaaagaag

SEQ ID NO: 3743254 - RNA, 17 nt, Salmonella enterica enterica serovar Typhi Ty2
ggaucagaaauucgcag

SEQ ID NO: 3743255 - RNA, 22 nt, Salmonella enterica enterica serovar Typhi Ty2
ggaucagaaauucgcagcgcag

SEQ ID NO: 3743256 - RNA, 21 nt, Salmonella enterica enterica serovar Typhi Ty2
ggaucaggcguuagccgccau

SEQ ID NO: 3743257 - RNA, 19 nt, Salmonella enterica enterica serovar Typhi Ty2
ggaucaucuuuuaccgccu

SEQ ID NO: 3743258 - RNA, 15 nt, Salmonella enterica enterica serovar Typhi Ty2
ggcaauauguuuaaa

SEQ ID NO: 3743259 - RNA, 17 nt, Salmonella enterica enterica serovar Typhi Ty2
ggcaauauuaaaugacg

SEQ ID NO: 3743260 - RNA, 16 nt, Salmonella enterica enterica serovar Typhi Ty2
ggcaauauuaauguca

SEQ ID NO: 3743261 - RNA, 13 nt, Salmonella enterica enterica serovar Typhi Ty2
ggcaaucaaaucc

SEQ ID NO: 3743262 - RNA, 12 nt, Salmonella enterica enterica serovar Typhi Ty2
ggcaaucaguac

SEQ ID NO: 3743263 - RNA, 15 nt, Salmonella enterica enterica serovar Typhi Ty2
ggcaaucuuuaacgc

SEQ ID NO: 3743264 - RNA, 17 nt, Salmonella enterica enterica serovar Typhi Ty2
ggcaaugacgguaagca

SEQ ID NO: 3743265 - RNA, 12 nt, Salmonella enterica enterica serovar Typhi Ty2
ggcaaugccacc

SEQ ID NO: 3743266 - RNA, 12 nt, Salmonella enterica enterica serovar Typhi Ty2
ggcaaugccccc

SEQ ID NO: 3743267 - RNA, 13 nt, Salmonella enterica enterica serovar Typhi Ty2
ggcaauuaacauu

SEQ ID NO: 3743268 - RNA, 21 nt, Salmonella enterica enterica serovar Typhi Ty2
ggcaauucgcguucagaaaug

SEQ ID NO: 3743269 - RNA, 13 nt, Salmonella enterica enterica serovar Typhi Ty2
ggcaauuucucgc

SEQ ID NO: 3743270 - RNA, 16 nt, Salmonella enterica enterica serovar Typhi Ty2
ggcaauuucucgcucg

SEQ ID NO: 3743271 - RNA, 22 nt, Salmonella enterica enterica serovar Typhi Ty2
ggcaauuugacuacaaagcugg

SEQ ID NO: 3743272 - RNA, 19 nt, Salmonella enterica enterica serovar Typhi Ty2
ggcaauuugauagcgccac

SEQ ID NO: 3743273 - RNA, 21 nt, Salmonella enterica enterica serovar Typhi Ty2
ggcaauuuuuacaaauuuaaa

SEQ ID NO: 3743274 - RNA, 14 nt, Salmonella enterica enterica serovar Typhi Ty2
ggcacaaccuggcu

SEQ ID NO: 3743275 - RNA, 21 nt, Salmonella enterica enterica serovar Typhi Ty2
ggcacaaccuggcuugccggg

SEQ ID NO: 3743276 - RNA, 17 nt, Salmonella enterica enterica serovar Typhi Ty2
ggcacaacggccagcaa

SEQ ID NO: 3743277 - RNA, 17 nt, Salmonella enterica enterica serovar Typhi Ty2
ggcacaauagcgcuaaa

SEQ ID NO: 3743278 - RNA, 19 nt, Salmonella enterica enterica serovar Typhi Ty2
ggcacaauagcgcuaaaca

SEQ ID NO: 3743279 - RNA, 11 nt, Salmonella enterica enterica serovar Typhi Ty2
ggcacagccag

SEQ ID NO: 3743280 - RNA, 21 nt, Salmonella enterica enterica serovar Typhi Ty2
ggcacauauuccggcgcuggc

SEQ ID NO: 3743281 - RNA, 13 nt, Salmonella enterica enterica serovar Typhi Ty2
ggcacaucaggca

SEQ ID NO: 3743282 - RNA, 19 nt, Salmonella enterica enterica serovar Typhi Ty2
ggcaccacgaccagacugg

SEQ ID NO: 3743283 - RNA, 12 nt, Salmonella enterica enterica serovar Typhi Ty2
ggcaccagcgua

SEQ ID NO: 3743284 - RNA, 15 nt, Salmonella enterica enterica serovar Typhi Ty2
ggcaccgguuuuuga

SEQ ID NO: 3743285 - RNA, 19 nt, Salmonella enterica enterica serovar Typhi Ty2
ggcaccucguccagauggg

SEQ ID NO: 3743286 - RNA, 19 nt, Salmonella enterica enterica serovar Typhi Ty2
ggcaccuggagcgccuccc

SEQ ID NO: 3743287 - RNA, 15 nt, Salmonella enterica enterica serovar Typhi Ty2
ggcacgauaaauugc

SEQ ID NO: 3743288 - RNA, 17 nt, Salmonella enterica enterica serovar Typhi Ty2
ggcacgauaaccagauc

SEQ ID NO: 3743289 - RNA, 23 nt, Salmonella enterica enterica serovar Typhi Ty2
ggcacgcuccugcuccugcggcg

SEQ ID NO: 3743290 - RNA, 18 nt, Salmonella enterica enterica serovar Typhi Ty2
ggcacugcgcuuauccgg

SEQ ID NO: 3743291 - RNA, 23 nt, Salmonella enterica enterica serovar Typhi Ty2
ggcacuuuccgguuuccauggca

SEQ ID NO: 3743292 - RNA, 10 nt, Salmonella enterica enterica serovar Typhi Ty2
ggcagaaccu

SEQ ID NO: 3743293 - RNA, 15 nt, Salmonella enterica enterica serovar Typhi Ty2
ggcagacaugaccgc

SEQ ID NO: 3743294 - RNA, 15 nt, Salmonella enterica enterica serovar Typhi Ty2
ggcagaccggcagcc

SEQ ID NO: 3743295 - RNA, 14 nt, Salmonella enterica enterica serovar Typhi Ty2
ggcagagcgcgcuc

SEQ ID NO: 3743296 - RNA, 19 nt, Salmonella enterica enterica serovar Typhi Ty2
ggcagagcgcgcucugccu

SEQ ID NO: 3743297 - RNA, 16 nt, Salmonella enterica enterica serovar Typhi Ty2
ggcagaguccagcggc

SEQ ID NO: 3743298 - RNA, 16 nt, Salmonella enterica enterica serovar Typhi Ty2
ggcagaucgcgcuccc

SEQ ID NO: 3743299 - RNA, 16 nt, Salmonella enterica enterica serovar Typhi Ty2
ggcagcaauacgcccg

SEQ ID NO: 3743300 - RNA, 14 nt, Salmonella enterica enterica serovar Typhi Ty2
ggcagcagcuucau

SEQ ID NO: 3743301 - RNA, 17 nt, Salmonella enterica enterica serovar Typhi Ty2
ggcagcaggaucuccag

SEQ ID NO: 3743302 - RNA, 17 nt, Salmonella enterica enterica serovar Typhi Ty2
ggcagcauuguauuuca

SEQ ID NO: 3743303 - RNA, 16 nt, Salmonella enterica enterica serovar Typhi Ty2
ggcagccaggcaaagc

SEQ ID NO: 3743304 - RNA, 19 nt, Salmonella enterica enterica serovar Typhi Ty2
ggcagcccggcguugaaau

SEQ ID NO: 3743305 - RNA, 15 nt, Salmonella enterica enterica serovar Typhi Ty2
ggcagccgacagcgu

SEQ ID NO: 3743306 - RNA, 22 nt, Salmonella enterica enterica serovar Typhi Ty2
ggcagccggauuuuaaauuggu

SEQ ID NO: 3743307 - RNA, 16 nt, Salmonella enterica enterica serovar Typhi Ty2
ggcagccguuuuccgg

SEQ ID NO: 3743308 - RNA, 18 nt, Salmonella enterica enterica serovar Typhi Ty2
ggcagcgccagugacgcc

SEQ ID NO: 3743309 - RNA, 19 nt, Salmonella enterica enterica serovar Typhi Ty2
ggcagcgccugacggcgcu

SEQ ID NO: 3743310 - RNA, 21 nt, Salmonella enterica enterica serovar Typhi Ty2
ggcagcgcgccgcccuguaac

SEQ ID NO: 3743311 - RNA, 15 nt, Salmonella enterica enterica serovar Typhi Ty2
ggcagcggcaagaca

SEQ ID NO: 3743312 - RNA, 22 nt, Salmonella enterica enterica serovar Typhi Ty2
ggcagcggcaagacagacgacu

SEQ ID NO: 3743313 - RNA, 12 nt, Salmonella enterica enterica serovar Typhi Ty2
ggcagcgucagg

SEQ ID NO: 3743314 - RNA, 20 nt, Salmonella enterica enterica serovar Typhi Ty2
ggcagcgucggcuucaucac

SEQ ID NO: 3743315 - RNA, 16 nt, Salmonella enterica enterica serovar Typhi Ty2
ggcagcguggcgagcu

SEQ ID NO: 3743316 - RNA, 16 nt, Salmonella enterica enterica serovar Typhi Ty2
ggcagcucucccgcca

SEQ ID NO: 3743317 - RNA, 20 nt, Salmonella enterica enterica serovar Typhi Ty2
ggcagcuuccagcaaaccuu

SEQ ID NO: 3743318 - RNA, 19 nt, Salmonella enterica enterica serovar Typhi Ty2
ggcaggaaauccagcagaa

SEQ ID NO: 3743319 - RNA, 14 nt, Salmonella enterica enterica serovar Typhi Ty2
ggcaggagcggaag

SEQ ID NO: 3743320 - RNA, 14 nt, Salmonella enterica enterica serovar Typhi Ty2
ggcaggcagcgcca

SEQ ID NO: 3743321 - RNA, 17 nt, Salmonella enterica enterica serovar Typhi Ty2
ggcaggcagugaacuac

SEQ ID NO: 3743322 - RNA, 11 nt, Salmonella enterica enterica serovar Typhi Ty2
ggcaggcggaa

SEQ ID NO: 3743323 - RNA, 14 nt, Salmonella enterica enterica serovar Typhi Ty2
ggcaggggaaagcu

SEQ ID NO: 3743324 - RNA, 23 nt, Salmonella enterica enterica serovar Typhi Ty2
ggcagguuuuuuuauaacauaaa

SEQ ID NO: 3743325 - RNA, 19 nt, Salmonella enterica enterica serovar Typhi Ty2
ggcaguaaagaucuggccg

SEQ ID NO: 3743326 - RNA, 21 nt, Salmonella enterica enterica serovar Typhi Ty2
ggcagucgcuacaaccagcgc

SEQ ID NO: 3743327 - RNA, 23 nt, Salmonella enterica enterica serovar Typhi Ty2
ggcagucgcuacaaccagcgcgg

SEQ ID NO: 3743328 - RNA, 18 nt, Salmonella enterica enterica serovar Typhi Ty2
ggcagucuggcggcagcc

SEQ ID NO: 3743329 - RNA, 24 nt, Salmonella enterica enterica serovar Typhi Ty2
ggcagugaguaacguuaauacauc

SEQ ID NO: 3743330 - RNA, 15 nt, Salmonella enterica enterica serovar Typhi Ty2
ggcaguguuucccaa

SEQ ID NO: 3743331 - RNA, 20 nt, Salmonella enterica enterica serovar Typhi Ty2
ggcaguuuaagcgccgauaa

SEQ ID NO: 3743332 - RNA, 18 nt, Salmonella enterica enterica serovar Typhi Ty2
ggcaguuuauccggcgcc

SEQ ID NO: 3743333 - RNA, 13 nt, Salmonella enterica enterica serovar Typhi Ty2
ggcauaaaaaaag

SEQ ID NO: 3743334 - RNA, 14 nt, Salmonella enterica enterica serovar Typhi Ty2
ggcauacacgccgg

SEQ ID NO: 3743335 - RNA, 17 nt, Salmonella enterica enterica serovar Typhi Ty2
ggcauacucuccuccau

SEQ ID NO: 3743336 - RNA, 13 nt, Salmonella enterica enterica serovar Typhi Ty2
ggcauaucgccau

SEQ ID NO: 3743337 - RNA, 16 nt, Salmonella enterica enterica serovar Typhi Ty2
ggcaucaauaaaauca

SEQ ID NO: 3743338 - RNA, 13 nt, Salmonella enterica enterica serovar Typhi Ty2
ggcaucacgccgg

SEQ ID NO: 3743339 - RNA, 17 nt, Salmonella enterica enterica serovar Typhi Ty2
ggcaucagacgguggcc

SEQ ID NO: 3743340 - RNA, 16 nt, Salmonella enterica enterica serovar Typhi Ty2
ggcaucauaaaaggca

SEQ ID NO: 3743341 - RNA, 15 nt, Salmonella enterica enterica serovar Typhi Ty2
ggccauuugucucuu

SEQ ID NO: 3743342 - RNA, 16 nt, Salmonella enterica enterica serovar Typhi Ty2
ggcccaggcaucgacg

SEQ ID NO: 3743343 - RNA, 17 nt, Salmonella enterica enterica serovar Typhi Ty2
ggcccaguguacugcca

SEQ ID NO: 3743344 - RNA, 21 nt, Salmonella enterica enterica serovar Typhi Ty2
ggcccgaagggcgagcguagc

SEQ ID NO: 3743345 - RNA, 22 nt, Salmonella enterica enterica serovar Typhi Ty2
ggcccgauacgcggaucggcac

SEQ ID NO: 3743346 - RNA, 17 nt, Salmonella enterica enterica serovar Typhi Ty2
ggcccgccagcacagca

SEQ ID NO: 3743347 - RNA, 18 nt, Salmonella enterica enterica serovar Typhi Ty2
ggcccgccagcacagcaa

SEQ ID NO: 3743348 - RNA, 18 nt, Salmonella enterica enterica serovar Typhi Ty2
ggcccgccgcuggcuggc

SEQ ID NO: 3743349 - RNA, 14 nt, Salmonella enterica enterica serovar Typhi Ty2
ggcccgcggcgacg

SEQ ID NO: 3743350 - RNA, 22 nt, Salmonella enterica enterica serovar Typhi Ty2
ggcccggacgccguccaggcuc

SEQ ID NO: 3743351 - RNA, 17 nt, Salmonella enterica enterica serovar Typhi Ty2
ggcccgguaagcgcagc

SEQ ID NO: 3743352 - RNA, 20 nt, Salmonella enterica enterica serovar Typhi Ty2
ggcccgguaagcgcagcgcc

SEQ ID NO: 3743353 - RNA, 15 nt, Salmonella enterica enterica serovar Typhi Ty2
ggcccgguggcgcca

SEQ ID NO: 3743354 - RNA, 20 nt, Salmonella enterica enterica serovar Typhi Ty2
ggcccgguggcguggcgcca

SEQ ID NO: 3743355 - RNA, 17 nt, Salmonella enterica enterica serovar Typhi Ty2
ggcccguggcccaggcc

SEQ ID NO: 3743356 - RNA, 16 nt, Salmonella enterica enterica serovar Typhi Ty2
ggcccguugucuucac

SEQ ID NO: 3743357 - RNA, 22 nt, Salmonella enterica enterica serovar Typhi Ty2
ggcccugcgguacugcuggccu

SEQ ID NO: 3743358 - RNA, 20 nt, Salmonella enterica enterica serovar Typhi Ty2
ggccgaaggaagauagcggg

SEQ ID NO: 3743359 - RNA, 17 nt, Salmonella enterica enterica serovar Typhi Ty2
ggccgacaggcggccgc

SEQ ID NO: 3743360 - RNA, 16 nt, Salmonella enterica enterica serovar Typhi Ty2
ggccgacgauaaacag

SEQ ID NO: 3743361 - RNA, 14 nt, Salmonella enterica enterica serovar Typhi Ty2
ggccgacggcauaa

SEQ ID NO: 3743362 - RNA, 14 nt, Salmonella enterica enterica serovar Typhi Ty2
ggccgagaggcuga

SEQ ID NO: 3743363 - RNA, 19 nt, Salmonella enterica enterica serovar Typhi Ty2
ggccgauauugcggccuuc

SEQ ID NO: 3743364 - RNA, 21 nt, Salmonella enterica enterica serovar Typhi Ty2
ggccgauauugcggccuuccu

SEQ ID NO: 3743365 - RNA, 17 nt, Salmonella enterica enterica serovar Typhi Ty2
ggccgauggucgcgcca

SEQ ID NO: 3743366 - RNA, 16 nt, Salmonella enterica enterica serovar Typhi Ty2
ggccgauuucauucag

SEQ ID NO: 3743367 - RNA, 21 nt, Salmonella enterica enterica serovar Typhi Ty2
ggccgauuuuuuaucucgccg

SEQ ID NO: 3743368 - RNA, 20 nt, Salmonella enterica enterica serovar Typhi Ty2
ggccgcaaacagcacgcccu

SEQ ID NO: 3743369 - RNA, 21 nt, Salmonella enterica enterica serovar Typhi Ty2
ggccgcaaaugauaauaugcu

SEQ ID NO: 3743370 - RNA, 18 nt, Salmonella enterica enterica serovar Typhi Ty2
ggccgcaaccgccaauaa

SEQ ID NO: 3743371 - RNA, 13 nt, Salmonella enterica enterica serovar Typhi Ty2
ggccgcagcgcca

SEQ ID NO: 3743372 - RNA, 12 nt, Salmonella enterica enterica serovar Typhi Ty2
ggccgcaucggg

SEQ ID NO: 3743373 - RNA, 18 nt, Salmonella enterica enterica serovar Typhi Ty2
ggccgccaaugacaauaa

SEQ ID NO: 3743374 - RNA, 12 nt, Salmonella enterica enterica serovar Typhi Ty2
ggccgccagcgc

SEQ ID NO: 3743375 - RNA, 12 nt, Salmonella enterica enterica serovar Typhi Ty2
ggccgccagggg

SEQ ID NO: 3743376 - RNA, 13 nt, Salmonella enterica enterica serovar Typhi Ty2
ggccgccgagcug

SEQ ID NO: 3743377 - RNA, 20 nt, Salmonella enterica enterica serovar Typhi Ty2
ggccgcgcugaugugcggcc

SEQ ID NO: 3743378 - RNA, 19 nt, Salmonella enterica enterica serovar Typhi Ty2
ggccgcguuaacgccguug

SEQ ID NO: 3743379 - RNA, 14 nt, Salmonella enterica enterica serovar Typhi Ty2
ggccgcguuaucgg

SEQ ID NO: 3743380 - RNA, 22 nt, Salmonella enterica enterica serovar Typhi Ty2
ggccgcucgccauaucuucuac

SEQ ID NO: 3743381 - RNA, 14 nt, Salmonella enterica enterica serovar Typhi Ty2
ggccgcucgccugc

SEQ ID NO: 3743382 - RNA, 21 nt, Salmonella enterica enterica serovar Typhi Ty2
ggccgcuuugcgaacagcgca

SEQ ID NO: 3743383 - RNA, 21 nt, Salmonella enterica enterica serovar Typhi Ty2
ggccggauaagcaacgcgcca

SEQ ID NO: 3743384 - RNA, 22 nt, Salmonella enterica enterica serovar Typhi Ty2
ggccggauaagcauuagcgcca

SEQ ID NO: 3743385 - RNA, 18 nt, Salmonella enterica enterica serovar Typhi Ty2
ggccggauaagcgcagcg

SEQ ID NO: 3743386 - RNA, 14 nt, Salmonella enterica enterica serovar Typhi Ty2
ggccggauaaggcc

SEQ ID NO: 3743387 - RNA, 21 nt, Salmonella enterica enterica serovar Typhi Ty2
ggccggauaaggcgcuagccg

SEQ ID NO: 3743388 - RNA, 18 nt, Salmonella enterica enterica serovar Typhi Ty2
ggccggauaaggcgcuug

SEQ ID NO: 3743389 - RNA, 19 nt, Salmonella enterica enterica serovar Typhi Ty2
ggccggauaaggcguaacc

SEQ ID NO: 3743390 - RNA, 16 nt, Salmonella enterica enterica serovar Typhi Ty2
ggccggauaaggcguu

SEQ ID NO: 3743391 - RNA, 20 nt, Salmonella enterica enterica serovar Typhi Ty2
ggccggauagggcguaacac

SEQ ID NO: 3743392 - RNA, 15 nt, Salmonella enterica enterica serovar Typhi Ty2
ggccggaugagcguu

SEQ ID NO: 3743393 - RNA, 16 nt, Salmonella enterica enterica serovar Typhi Ty2
ggccggaugaggcgca

SEQ ID NO: 3743394 - RNA, 22 nt, Salmonella enterica enterica serovar Typhi Ty2
ggccggauuagcgacagcgcua

SEQ ID NO: 3743395 - RNA, 23 nt, Salmonella enterica enterica serovar Typhi Ty2
ggccgggccugagcgcgcagcug

SEQ ID NO: 3743396 - RNA, 15 nt, Salmonella enterica enterica serovar Typhi Ty2
ggccggguucgcccg

SEQ ID NO: 3743397 - RNA, 17 nt, Salmonella enterica enterica serovar Typhi Ty2
ggccgguuggcuccagu

SEQ ID NO: 3743398 - RNA, 19 nt, Salmonella enterica enterica serovar Typhi Ty2
ggccgucaaaccggcgguc

SEQ ID NO: 3743399 - RNA, 21 nt, Salmonella enterica enterica serovar Typhi Ty2
ggccgucagacauauacucuu

SEQ ID NO: 3743400 - RNA, 21 nt, Salmonella enterica enterica serovar Typhi Ty2
ggccgucccacgcgccgccga

SEQ ID NO: 3743401 - RNA, 15 nt, Salmonella enterica enterica serovar Typhi Ty2
ggccguuaaaccaaa

SEQ ID NO: 3743402 - RNA, 23 nt, Salmonella enterica enterica serovar Typhi Ty2
ggccguuggcuuuaugcacgccg

SEQ ID NO: 3743403 - RNA, 23 nt, Salmonella enterica enterica serovar Typhi Ty2
ggccuacaaaaucgcccaggccu

SEQ ID NO: 3743404 - RNA, 18 nt, Salmonella enterica enterica serovar Typhi Ty2
ggccuacaaggcauucag

SEQ ID NO: 3743405 - RNA, 20 nt, Salmonella enterica enterica serovar Typhi Ty2
ggccuacacucugcgcgcga

SEQ ID NO: 3743406 - RNA, 17 nt, Salmonella enterica enterica serovar Typhi Ty2
ggccuacagaugaacgu

SEQ ID NO: 3743407 - RNA, 23 nt, Salmonella enterica enterica serovar Typhi Ty2
ggccuacauuuuuacaguuacca

SEQ ID NO: 3743408 - RNA, 23 nt, Salmonella enterica enterica serovar Typhi Ty2
ggccuacgcucgaaagcaucauu

SEQ ID NO: 3743409 - RNA, 12 nt, Salmonella enterica enterica serovar Typhi Ty2
ggccucaucggg

SEQ ID NO: 3743410 - RNA, 14 nt, Salmonella enterica enterica serovar Typhi Ty2
ggccuccggcgggu

SEQ ID NO: 3743411 - RNA, 18 nt, Salmonella enterica enterica serovar Typhi Ty2
ggccuccugacgaagggc

SEQ ID NO: 3743412 - RNA, 13 nt, Salmonella enterica enterica serovar Typhi Ty2
ggccuccuggcuu

SEQ ID NO: 3743413 - RNA, 18 nt, Salmonella enterica enterica serovar Typhi Ty2
ggccuccuuuccugugcu

SEQ ID NO: 3743414 - RNA, 17 nt, Salmonella enterica enterica serovar Typhi Ty2
ggccucuucacgcagcg

SEQ ID NO: 3743415 - RNA, 20 nt, Salmonella enterica enterica serovar Typhi Ty2
ggccucuucacgcagcgccu

SEQ ID NO: 3743416 - RNA, 20 nt, Salmonella enterica enterica serovar Typhi Ty2
ggccugaauaaugaccucca

SEQ ID NO: 3743417 - RNA, 22 nt, Salmonella enterica enterica serovar Typhi Ty2
ggccugaccauggaguuucagu

SEQ ID NO: 3743418 - RNA, 20 nt, Salmonella enterica enterica serovar Typhi Ty2
ggccugauaagcacaggcca

SEQ ID NO: 3743419 - RNA, 21 nt, Salmonella enterica enterica serovar Typhi Ty2
ggccugauaagcauagcgcca

SEQ ID NO: 3743420 - RNA, 20 nt, Salmonella enterica enterica serovar Typhi Ty2
ggccugauaagcgaagcgcc

SEQ ID NO: 3743421 - RNA, 18 nt, Salmonella enterica enterica serovar Typhi Ty2
ggccugauaagcgcagcg

SEQ ID NO: 3743422 - RNA, 19 nt, Salmonella enterica enterica serovar Typhi Ty2
ggcgcaaacaguacgcccg

SEQ ID NO: 3743423 - RNA, 19 nt, Salmonella enterica enterica serovar Typhi Ty2
ggcgcaaaggccuuauccg

SEQ ID NO: 3743424 - RNA, 15 nt, Salmonella enterica enterica serovar Typhi Ty2
ggcgcaaaucgccau

SEQ ID NO: 3743425 - RNA, 23 nt, Salmonella enterica enterica serovar Typhi Ty2
ggcgcaaaucgccaucagcgcga

SEQ ID NO: 3743426 - RNA, 16 nt, Salmonella enterica enterica serovar Typhi Ty2
ggcgcaaccgacgggc

SEQ ID NO: 3743427 - RNA, 20 nt, Salmonella enterica enterica serovar Typhi Ty2
ggcgcaacguuugccagcgu

SEQ ID NO: 3743428 - RNA, 21 nt, Salmonella enterica enterica serovar Typhi Ty2
ggcgcaauccgcgccgcaucu

SEQ ID NO: 3743429 - RNA, 19 nt, Salmonella enterica enterica serovar Typhi Ty2
ggcgcaaucuuugccgcaa

SEQ ID NO: 3743430 - RNA, 18 nt, Salmonella enterica enterica serovar Typhi Ty2
ggcgcacaauaccgagaa

SEQ ID NO: 3743431 - RNA, 13 nt, Salmonella enterica enterica serovar Typhi Ty2
ggcgcacagcgcc

SEQ ID NO: 3743432 - RNA, 14 nt, Salmonella enterica enterica serovar Typhi Ty2
ggcgcacagcgcca

SEQ ID NO: 3743433 - RNA, 23 nt, Salmonella enterica enterica serovar Typhi Ty2
ggcgcacauugcugccuuauccg

SEQ ID NO: 3743434 - RNA, 17 nt, Salmonella enterica enterica serovar Typhi Ty2
ggcgcacauuuacgcca

SEQ ID NO: 3743435 - RNA, 18 nt, Salmonella enterica enterica serovar Typhi Ty2
ggcgcaccaaagugcgcc

SEQ ID NO: 3743436 - RNA, 21 nt, Salmonella enterica enterica serovar Typhi Ty2
ggcgcacgcgucaucggcgcg

SEQ ID NO: 3743437 - RNA, 16 nt, Salmonella enterica enterica serovar Typhi Ty2
ggcgcagcgcccagca

SEQ ID NO: 3743438 - RNA, 13 nt, Salmonella enterica enterica serovar Typhi Ty2
ggcgcagcgcggg

SEQ ID NO: 3743439 - RNA, 20 nt, Salmonella enterica enterica serovar Typhi Ty2
ggcgcaggggcauuuuccgg

SEQ ID NO: 3743440 - RNA, 21 nt, Salmonella enterica enterica serovar Typhi Ty2
ggcgcaguauggcgaccagga

SEQ ID NO: 3743441 - RNA, 16 nt, Salmonella enterica enterica serovar Typhi Ty2
ggcgcaguucgccgcc

SEQ ID NO: 3743442 - RNA, 22 nt, Salmonella enterica enterica serovar Typhi Ty2
ggcgcaguuuacgcagcgccuu

SEQ ID NO: 3743443 - RNA, 19 nt, Salmonella enterica enterica serovar Typhi Ty2
ggcgcauaaugacguccag

SEQ ID NO: 3743444 - RNA, 21 nt, Salmonella enterica enterica serovar Typhi Ty2
ggcgcauaaugacguccaggc

SEQ ID NO: 3743445 - RNA, 23 nt, Salmonella enterica enterica serovar Typhi Ty2
ggcgcauaaugacguccaggccg

SEQ ID NO: 3743446 - RNA, 18 nt, Salmonella enterica enterica serovar Typhi Ty2
ggcgcauacgaucugaca

SEQ ID NO: 3743447 - RNA, 12 nt, Salmonella enterica enterica serovar Typhi Ty2
ggcgcaucagaa

SEQ ID NO: 3743448 - RNA, 14 nt, Salmonella enterica enterica serovar Typhi Ty2
ggcgcaucagaaaa

SEQ ID NO: 3743449 - RNA, 23 nt, Salmonella enterica enterica serovar Typhi Ty2
ggcgcaucagaaaaaccuccggc

SEQ ID NO: 3743450 - RNA, 21 nt, Salmonella enterica enterica serovar Typhi Ty2
ggcgcauuuucggcagcgcga

SEQ ID NO: 3743451 - RNA, 18 nt, Salmonella enterica enterica serovar Typhi Ty2
ggcgccagcgacaacgcu

SEQ ID NO: 3743452 - RNA, 15 nt, Salmonella enterica enterica serovar Typhi Ty2
ggcgccaucgccucc

SEQ ID NO: 3743453 - RNA, 17 nt, Salmonella enterica enterica serovar Typhi Ty2
ggcgccaucgccuccag

SEQ ID NO: 3743454 - RNA, 17 nt, Salmonella enterica enterica serovar Typhi Ty2
ggcgccgaagcaggcgg

SEQ ID NO: 3743455 - RNA, 13 nt, Salmonella enterica enterica serovar Typhi Ty2
ggcgccgaucauc

SEQ ID NO: 3743456 - RNA, 16 nt, Salmonella enterica enterica serovar Typhi Ty2
ggcgccgcaaaccaga

SEQ ID NO: 3743457 - RNA, 23 nt, Salmonella enterica enterica serovar Typhi Ty2
ggcgccggauggcggcugcgccu

SEQ ID NO: 3743458 - RNA, 15 nt, Salmonella enterica enterica serovar Typhi Ty2
ggcgccucgcgcggc

SEQ ID NO: 3743459 - RNA, 17 nt, Salmonella enterica enterica serovar Typhi Ty2
ggcgcgaaaacagcugg

SEQ ID NO: 3743460 - RNA, 18 nt, Salmonella enterica enterica serovar Typhi Ty2
ggcgcgaaacugcugccg

SEQ ID NO: 3743461 - RNA, 15 nt, Salmonella enterica enterica serovar Typhi Ty2
ggcgcgaaagcgccu

SEQ ID NO: 3743462 - RNA, 22 nt, Salmonella enterica enterica serovar Typhi Ty2
ggcgcgaacgccuuauccggcc

SEQ ID NO: 3743463 - RNA, 13 nt, Salmonella enterica enterica serovar Typhi Ty2
ggcgcgcagcugc

SEQ ID NO: 3743464 - RNA, 20 nt, Salmonella enterica enterica serovar Typhi Ty2
ggcgcgccaauaaagcuuga

SEQ ID NO: 3743465 - RNA, 12 nt, Salmonella enterica enterica serovar Typhi Ty2
ggcgcgcccggc

SEQ ID NO: 3743466 - RNA, 15 nt, Salmonella enterica enterica serovar Typhi Ty2
ggcgcgcguggcuuc

SEQ ID NO: 3743467 - RNA, 21 nt, Salmonella enterica enterica serovar Typhi Ty2
ggcgcgcucauuuuauugaua

SEQ ID NO: 3743468 - RNA, 14 nt, Salmonella enterica enterica serovar Typhi Ty2
ggcgcguucaugcg

SEQ ID NO: 3743469 - RNA, 22 nt, Salmonella enterica enterica serovar Typhi Ty2
ggcgcguuuacuggcgacgacc

SEQ ID NO: 3743470 - RNA, 21 nt, Salmonella enterica enterica serovar Typhi Ty2
ggcgcuaaaauccacucggcg

SEQ ID NO: 3743471 - RNA, 23 nt, Salmonella enterica enterica serovar Typhi Ty2
ggcgcuaaaccggcggaauagcu

SEQ ID NO: 3743472 - RNA, 18 nt, Salmonella enterica enterica serovar Typhi Ty2
ggcgcuaagccagccaaa

SEQ ID NO: 3743473 - RNA, 13 nt, Salmonella enterica enterica serovar Typhi Ty2
ggcgcuaaugcuu

SEQ ID NO: 3743474 - RNA, 18 nt, Salmonella enterica enterica serovar Typhi Ty2
ggcgcuacgcuuaucagg

SEQ ID NO: 3743475 - RNA, 19 nt, Salmonella enterica enterica serovar Typhi Ty2
ggcgcuacgcuuaucaggc

SEQ ID NO: 3743476 - RNA, 20 nt, Salmonella enterica enterica serovar Typhi Ty2
ggcgcuacgcuuaucaggcc

SEQ ID NO: 3743477 - RNA, 18 nt, Salmonella enterica enterica serovar Typhi Ty2
ggcgcuacguuuaucugg

SEQ ID NO: 3743478 - RNA, 18 nt, Salmonella enterica enterica serovar Typhi Ty2
ggcgcucacgcugacagg

SEQ ID NO: 3743479 - RNA, 21 nt, Salmonella enterica enterica serovar Typhi Ty2
ggcgcucagccagaaacgguc

SEQ ID NO: 3743480 - RNA, 13 nt, Salmonella enterica enterica serovar Typhi Ty2
ggcgcuccugaau

SEQ ID NO: 3743481 - RNA, 21 nt, Salmonella enterica enterica serovar Typhi Ty2
ggcgcugaacgcauacaggcu

SEQ ID NO: 3743482 - RNA, 14 nt, Salmonella enterica enterica serovar Typhi Ty2
ggcgcugaagccug

SEQ ID NO: 3743483 - RNA, 19 nt, Salmonella enterica enterica serovar Typhi Ty2
ggcgcugccgcuuauccgg

SEQ ID NO: 3743484 - RNA, 21 nt, Salmonella enterica enterica serovar Typhi Ty2
ggcgcugccgcuuauccggcc

SEQ ID NO: 3743485 - RNA, 18 nt, Salmonella enterica enterica serovar Typhi Ty2
ggcgcugcgcgcaucggg

SEQ ID NO: 3743486 - RNA, 23 nt, Salmonella enterica enterica serovar Typhi Ty2
ggcgcugcgcuuaccgggccuac

SEQ ID NO: 3743487 - RNA, 20 nt, Salmonella enterica enterica serovar Typhi Ty2
ggcgcugcgcuuaucagacc

SEQ ID NO: 3743488 - RNA, 18 nt, Salmonella enterica enterica serovar Typhi Ty2
ggcgcugcgcuuaucagg

SEQ ID NO: 3743489 - RNA, 19 nt, Salmonella enterica enterica serovar Typhi Ty2
ggcgcugcgcuuaucaggc

SEQ ID NO: 3743490 - RNA, 18 nt, Salmonella enterica enterica serovar Typhi Ty2
ggcgcugcguuuaucagg

SEQ ID NO: 3743491 - RNA, 20 nt, Salmonella enterica enterica serovar Typhi Ty2
ggcgcuggcagggacgcugc

SEQ ID NO: 3743492 - RNA, 19 nt, Salmonella enterica enterica serovar Typhi Ty2
ggcgcuggugacaucgccg

SEQ ID NO: 3743493 - RNA, 17 nt, Salmonella enterica enterica serovar Typhi Ty2
ggcgcugucgccgcgca

SEQ ID NO: 3743494 - RNA, 18 nt, Salmonella enterica enterica serovar Typhi Ty2
ggcgcugucgccgcgcac

SEQ ID NO: 3743495 - RNA, 18 nt, Salmonella enterica enterica serovar Typhi Ty2
ggcgcugucgcuuaccgg

SEQ ID NO: 3743496 - RNA, 12 nt, Salmonella enterica enterica serovar Typhi Ty2
ggcgcuuaucca

SEQ ID NO: 3743497 - RNA, 14 nt, Salmonella enterica enterica serovar Typhi Ty2
ggcgcuuccugcag

SEQ ID NO: 3743498 - RNA, 15 nt, Salmonella enterica enterica serovar Typhi Ty2
ggcgcuuccugcagu

SEQ ID NO: 3743499 - RNA, 17 nt, Salmonella enterica enterica serovar Typhi Ty2
ggcgcuuccugcagugg

SEQ ID NO: 3743500 - RNA, 16 nt, Salmonella enterica enterica serovar Typhi Ty2
ggcgcuucgcuuacca

SEQ ID NO: 3743501 - RNA, 20 nt, Salmonella enterica enterica serovar Typhi Ty2
ggcgcuucgcuuaucaggcc

SEQ ID NO: 3743502 - RNA, 23 nt, Salmonella enterica enterica serovar Typhi Ty2
ggcgcuuuacaugacgcucuccg

SEQ ID NO: 3743503 - RNA, 17 nt, Salmonella enterica enterica serovar Typhi Ty2
ggcguuaucuugacaug

SEQ ID NO: 3743504 - RNA, 18 nt, Salmonella enterica enterica serovar Typhi Ty2
ggcguuaucuugacauga

SEQ ID NO: 3743505 - RNA, 13 nt, Salmonella enterica enterica serovar Typhi Ty2
ggcguucacgccg

SEQ ID NO: 3743506 - RNA, 13 nt, Salmonella enterica enterica serovar Typhi Ty2
ggcguuccgcaca

SEQ ID NO: 3743507 - RNA, 17 nt, Salmonella enterica enterica serovar Typhi Ty2
ggcguuccuuaucagca

SEQ ID NO: 3743508 - RNA, 12 nt, Salmonella enterica enterica serovar Typhi Ty2
ggcguucucccg

SEQ ID NO: 3743509 - RNA, 19 nt, Salmonella enterica enterica serovar Typhi Ty2
ggcguucugcgccauuucc

SEQ ID NO: 3743510 - RNA, 19 nt, Salmonella enterica enterica serovar Typhi Ty2
ggcguugcgcccaggccaa

SEQ ID NO: 3743511 - RNA, 15 nt, Salmonella enterica enterica serovar Typhi Ty2
ggcguuggcuaucgc

SEQ ID NO: 3743512 - RNA, 21 nt, Salmonella enterica enterica serovar Typhi Ty2
ggcguuuacgcugcuauccgg

SEQ ID NO: 3743513 - RNA, 17 nt, Salmonella enterica enterica serovar Typhi Ty2
ggcuaagccaaaaauaa

SEQ ID NO: 3743514 - RNA, 17 nt, Salmonella enterica enterica serovar Typhi Ty2
ggcuaagccagaagaua

SEQ ID NO: 3743515 - RNA, 21 nt, Salmonella enterica enterica serovar Typhi Ty2
ggcuaauacgccagccgucau

SEQ ID NO: 3743516 - RNA, 17 nt, Salmonella enterica enterica serovar Typhi Ty2
ggcuaauaugccaggcu

SEQ ID NO: 3743517 - RNA, 21 nt, Salmonella enterica enterica serovar Typhi Ty2
ggcuaccgggcaaacauuagc

SEQ ID NO: 3743518 - RNA, 21 nt, Salmonella enterica enterica serovar Typhi Ty2
ggcuacguacacagucaaaca

SEQ ID NO: 3743519 - RNA, 18 nt, Salmonella enterica enterica serovar Typhi Ty2
ggcuagcgccuuauccgg

SEQ ID NO: 3743520 - RNA, 13 nt, Salmonella enterica enterica serovar Typhi Ty2
ggcuauagcucag

SEQ ID NO: 3743521 - RNA, 21 nt, Salmonella enterica enterica serovar Typhi Ty2
ggcuaucgcacuggcgccugc

SEQ ID NO: 3743522 - RNA, 17 nt, Salmonella enterica enterica serovar Typhi Ty2
ggcuauuaccggcugga

SEQ ID NO: 3743523 - RNA, 13 nt, Salmonella enterica enterica serovar Typhi Ty2
ggcuauuuuauuc

SEQ ID NO: 3743524 - RNA, 20 nt, Salmonella enterica enterica serovar Typhi Ty2
ggcuauuuuuugcuggcggc

SEQ ID NO: 3743525 - RNA, 21 nt, Salmonella enterica enterica serovar Typhi Ty2
ggcuauuuuuugcuggcggca

SEQ ID NO: 3743526 - RNA, 18 nt, Salmonella enterica enterica serovar Typhi Ty2
ggcucaaaguuaccggca

SEQ ID NO: 3743527 - RNA, 12 nt, Salmonella enterica enterica serovar Typhi Ty2
ggcucaaauugg

SEQ ID NO: 3743528 - RNA, 14 nt, Salmonella enterica enterica serovar Typhi Ty2
ggcucaauccaggu

SEQ ID NO: 3743529 - RNA, 12 nt, Salmonella enterica enterica serovar Typhi Ty2
ggcucaccagcc

SEQ ID NO: 3743530 - RNA, 18 nt, Salmonella enterica enterica serovar Typhi Ty2
ggcucagcauagcgcuga

SEQ ID NO: 3743531 - RNA, 21 nt, Salmonella enterica enterica serovar Typhi Ty2
ggcucaggaaaacaaauugca

SEQ ID NO: 3743532 - RNA, 13 nt, Salmonella enterica enterica serovar Typhi Ty2
ggcucauauuauc

SEQ ID NO: 3743533 - RNA, 22 nt, Salmonella enterica enterica serovar Typhi Ty2
ggcucaucaaacagcggcacuu

SEQ ID NO: 3743534 - RNA, 16 nt, Salmonella enterica enterica serovar Typhi Ty2
ggcucaucagcgccau

SEQ ID NO: 3743535 - RNA, 17 nt, Salmonella enterica enterica serovar Typhi Ty2
ggcuccaauauuucagc

SEQ ID NO: 3743536 - RNA, 14 nt, Salmonella enterica enterica serovar Typhi Ty2
ggcuccagcgccag

SEQ ID NO: 3743537 - RNA, 18 nt, Salmonella enterica enterica serovar Typhi Ty2
ggcuccagcgccagcucc

SEQ ID NO: 3743538 - RNA, 20 nt, Salmonella enterica enterica serovar Typhi Ty2
ggcuccagcgccagcuccau

SEQ ID NO: 3743539 - RNA, 16 nt, Salmonella enterica enterica serovar Typhi Ty2
ggcucccacucuucca

SEQ ID NO: 3743540 - RNA, 17 nt, Salmonella enterica enterica serovar Typhi Ty2
ggcucccacucuuccag

SEQ ID NO: 3743541 - RNA, 14 nt, Salmonella enterica enterica serovar Typhi Ty2
ggcucccgcagcca

SEQ ID NO: 3743542 - RNA, 18 nt, Salmonella enterica enterica serovar Typhi Ty2
ggcuccgaccaucgccgc

SEQ ID NO: 3743543 - RNA, 21 nt, Salmonella enterica enterica serovar Typhi Ty2
ggcuccgaccaucgccgcgaa

SEQ ID NO: 3743544 - RNA, 23 nt, Salmonella enterica enterica serovar Typhi Ty2
ggcuccgagacucaaagaaaaca

SEQ ID NO: 3743545 - RNA, 20 nt, Salmonella enterica enterica serovar Typhi Ty2
ggcuccuggugagguuucag

SEQ ID NO: 3743546 - RNA, 17 nt, Salmonella enterica enterica serovar Typhi Ty2
ggcucgcagaugcccgc

SEQ ID NO: 3743547 - RNA, 22 nt, Salmonella enterica enterica serovar Typhi Ty2
ggcucgucguugaaaucgucag

SEQ ID NO: 3743548 - RNA, 16 nt, Salmonella enterica enterica serovar Typhi Ty2
ggcucuaaaaaggaaa

SEQ ID NO: 3743549 - RNA, 19 nt, Salmonella enterica enterica serovar Typhi Ty2
ggcucuaaauuagcucccg

SEQ ID NO: 3743550 - RNA, 13 nt, Salmonella enterica enterica serovar Typhi Ty2
ggcugaacgccag

SEQ ID NO: 3743551 - RNA, 18 nt, Salmonella enterica enterica serovar Typhi Ty2
ggcugaccgcuuucccgg

SEQ ID NO: 3743552 - RNA, 22 nt, Salmonella enterica enterica serovar Typhi Ty2
ggcugacguuacgcggcgcgcc

SEQ ID NO: 3743553 - RNA, 22 nt, Salmonella enterica enterica serovar Typhi Ty2
ggcugacugaauuuucagccau

SEQ ID NO: 3743554 - RNA, 14 nt, Salmonella enterica enterica serovar Typhi Ty2
ggcugagaaaaaua

SEQ ID NO: 3743555 - RNA, 15 nt, Salmonella enterica enterica serovar Typhi Ty2
ggcugagaaaaauac

SEQ ID NO: 3743556 - RNA, 20 nt, Salmonella enterica enterica serovar Typhi Ty2
ggcugagcguagaccgccca

SEQ ID NO: 3743557 - RNA, 18 nt, Salmonella enterica enterica serovar Typhi Ty2
ggcugaggccgcucgcca

SEQ ID NO: 3743558 - RNA, 15 nt, Salmonella enterica enterica serovar Typhi Ty2
ggcugaguucaggca

SEQ ID NO: 3743559 - RNA, 13 nt, Salmonella enterica enterica serovar Typhi Ty2
ggcugauggcgaa

SEQ ID NO: 3743560 - RNA, 19 nt, Salmonella enterica enterica serovar Typhi Ty2
ggcugcacgccaucggcua

SEQ ID NO: 3743561 - RNA, 13 nt, Salmonella enterica enterica serovar Typhi Ty2
ggcugccacacgu

SEQ ID NO: 3743562 - RNA, 15 nt, Salmonella enterica enterica serovar Typhi Ty2
ggcugccacacguca

SEQ ID NO: 3743563 - RNA, 18 nt, Salmonella enterica enterica serovar Typhi Ty2
ggcugccauuaucaccau

SEQ ID NO: 3743564 - RNA, 19 nt, Salmonella enterica enterica serovar Typhi Ty2
ggcugccgacaacgccucc

SEQ ID NO: 3743565 - RNA, 12 nt, Salmonella enterica enterica serovar Typhi Ty2
ggcugccgccau

SEQ ID NO: 3743566 - RNA, 18 nt, Salmonella enterica enterica serovar Typhi Ty2
ggcugcgcgggagauggc

SEQ ID NO: 3743567 - RNA, 23 nt, Salmonella enterica enterica serovar Typhi Ty2
ggcugcgugauuuuggccucauc

SEQ ID NO: 3743568 - RNA, 22 nt, Salmonella enterica enterica serovar Typhi Ty2
ggcugcucguaaguuuccugcg

SEQ ID NO: 3743569 - RNA, 22 nt, Salmonella enterica enterica serovar Typhi Ty2
ggcugcugauggucuuaaugcu

SEQ ID NO: 3743570 - RNA, 19 nt, Salmonella enterica enterica serovar Typhi Ty2
ggcuggauaaccguacggc

SEQ ID NO: 3743571 - RNA, 16 nt, Salmonella enterica enterica serovar Typhi Ty2
ggcuggcaauuugaua

SEQ ID NO: 3743572 - RNA, 12 nt, Salmonella enterica enterica serovar Typhi Ty2
ggcuggccacug

SEQ ID NO: 3743573 - RNA, 14 nt, Salmonella enterica enterica serovar Typhi Ty2
ggcuggcgcaacug

SEQ ID NO: 3743574 - RNA, 14 nt, Salmonella enterica enterica serovar Typhi Ty2
ggcuggcugcugau

SEQ ID NO: 3743575 - RNA, 15 nt, Salmonella enterica enterica serovar Typhi Ty2
ggcugggcgaggcca

SEQ ID NO: 3743576 - RNA, 13 nt, Salmonella enterica enterica serovar Typhi Ty2
ggcuggggaaguu

SEQ ID NO: 3743577 - RNA, 16 nt, Salmonella enterica enterica serovar Typhi Ty2
ggcugguaagagagcc

SEQ ID NO: 3743578 - RNA, 16 nt, Salmonella enterica enterica serovar Typhi Ty2
ggcuguaccuuaaccg

SEQ ID NO: 3743579 - RNA, 13 nt, Salmonella enterica enterica serovar Typhi Ty2
ggcugucccagag

SEQ ID NO: 3743580 - RNA, 22 nt, Salmonella enterica enterica serovar Typhi Ty2
ggcuguccuugcgccaucggcg

SEQ ID NO: 3743581 - RNA, 21 nt, Salmonella enterica enterica serovar Typhi Ty2
ggcugucgauaacagcauaaa

SEQ ID NO: 3743582 - RNA, 16 nt, Salmonella enterica enterica serovar Typhi Ty2
ggcugucgcggcggca

SEQ ID NO: 3743583 - RNA, 18 nt, Salmonella enterica enterica serovar Typhi Ty2
ggcugucggcagaaccug

SEQ ID NO: 3743584 - RNA, 18 nt, Salmonella enterica enterica serovar Typhi Ty2
ggcugugcgugacccaca

SEQ ID NO: 3743585 - RNA, 17 nt, Salmonella enterica enterica serovar Typhi Ty2
gggcccguggcccaggc

SEQ ID NO: 3743586 - RNA, 10 nt, Salmonella enterica enterica serovar Typhi Ty2
gggccgccgc

SEQ ID NO: 3743587 - RNA, 14 nt, Salmonella enterica enterica serovar Typhi Ty2
gggccgccgcagca

SEQ ID NO: 3743588 - RNA, 17 nt, Salmonella enterica enterica serovar Typhi Ty2
gggccgcuagcugcagc

SEQ ID NO: 3743589 - RNA, 18 nt, Salmonella enterica enterica serovar Typhi Ty2
gggccggaagagcgcaga

SEQ ID NO: 3743590 - RNA, 20 nt, Salmonella enterica enterica serovar Typhi Ty2
gggccugagcgcgcagcugg

SEQ ID NO: 3743591 - RNA, 23 nt, Salmonella enterica enterica serovar Typhi Ty2
gggcgaaaacggcgcaggcaaau

SEQ ID NO: 3743592 - RNA, 21 nt, Salmonella enterica enterica serovar Typhi Ty2
gggcgaacccaucagggaaaa

SEQ ID NO: 3743593 - RNA, 18 nt, Salmonella enterica enterica serovar Typhi Ty2
gggcgacaccgcaaaccg

SEQ ID NO: 3743594 - RNA, 13 nt, Salmonella enterica enterica serovar Typhi Ty2
gggcgauaaacca

SEQ ID NO: 3743595 - RNA, 23 nt, Salmonella enterica enterica serovar Typhi Ty2
gggcgauaaaccagccccacggu

SEQ ID NO: 3743596 - RNA, 22 nt, Salmonella enterica enterica serovar Typhi Ty2
gggcgcaaaaucgcaaacgcca

SEQ ID NO: 3743597 - RNA, 14 nt, Salmonella enterica enterica serovar Typhi Ty2
gggcgcagaagcua

SEQ ID NO: 3743598 - RNA, 13 nt, Salmonella enterica enterica serovar Typhi Ty2
gggcgccucggcg

SEQ ID NO: 3743599 - RNA, 12 nt, Salmonella enterica enterica serovar Typhi Ty2
gggcgcgcgccg

SEQ ID NO: 3743600 - RNA, 13 nt, Salmonella enterica enterica serovar Typhi Ty2
gggcgcggcgcaa

SEQ ID NO: 3743601 - RNA, 12 nt, Salmonella enterica enterica serovar Typhi Ty2
gggcgcggcugg

SEQ ID NO: 3743602 - RNA, 18 nt, Salmonella enterica enterica serovar Typhi Ty2
gggcggacgaugaaccug

SEQ ID NO: 3743603 - RNA, 16 nt, Salmonella enterica enterica serovar Typhi Ty2
gggcguauagccaggc

SEQ ID NO: 3743604 - RNA, 17 nt, Salmonella enterica enterica serovar Typhi Ty2
gggcguauagccaggca

SEQ ID NO: 3743605 - RNA, 21 nt, Salmonella enterica enterica serovar Typhi Ty2
gggcgucaaaaucccggcugg

SEQ ID NO: 3743606 - RNA, 15 nt, Salmonella enterica enterica serovar Typhi Ty2
gggcguccacuuucu

SEQ ID NO: 3743607 - RNA, 13 nt, Salmonella enterica enterica serovar Typhi Ty2
gggcgugucccug

SEQ ID NO: 3743608 - RNA, 21 nt, Salmonella enterica enterica serovar Typhi Ty2
gggcgugucgccggggcgcug

SEQ ID NO: 3743609 - RNA, 21 nt, Salmonella enterica enterica serovar Typhi Ty2
gggcguugcugcacgucgcgc

SEQ ID NO: 3743610 - RNA, 22 nt, Salmonella enterica enterica serovar Typhi Ty2
gggcguuugcgcgcgccacgca

SEQ ID NO: 3743611 - RNA, 21 nt, Salmonella enterica enterica serovar Typhi Ty2
gggcuaaucgcaaacugcgcg

SEQ ID NO: 3743612 - RNA, 13 nt, Salmonella enterica enterica serovar Typhi Ty2
gggcuaugaagag

SEQ ID NO: 3743613 - RNA, 17 nt, Salmonella enterica enterica serovar Typhi Ty2
gggcuaugcuccaguug

SEQ ID NO: 3743614 - RNA, 23 nt, Salmonella enterica enterica serovar Typhi Ty2
gggcugauuuuuuugcuggccgu

SEQ ID NO: 3743615 - RNA, 17 nt, Salmonella enterica enterica serovar Typhi Ty2
gggcuggcggcgauggc

SEQ ID NO: 3743616 - RNA, 19 nt, Salmonella enterica enterica serovar Typhi Ty2
gggcuuauccccauucugc

SEQ ID NO: 3743617 - RNA, 16 nt, Salmonella enterica enterica serovar Typhi Ty2
gggcuucagauguuug

SEQ ID NO: 3743618 - RNA, 20 nt, Salmonella enterica enterica serovar Typhi Ty2
gggcuuccacccgggaagcc

SEQ ID NO: 3743619 - RNA, 13 nt, Salmonella enterica enterica serovar Typhi Ty2
gggcuuuauccug

SEQ ID NO: 3743620 - RNA, 23 nt, Salmonella enterica enterica serovar Typhi Ty2
gggcuuuugagucgcauccagug

SEQ ID NO: 3743621 - RNA, 22 nt, Salmonella enterica enterica serovar Typhi Ty2
ggggaaaauauuagcggcggca

SEQ ID NO: 3743622 - RNA, 17 nt, Salmonella enterica enterica serovar Typhi Ty2
ggggaauguuuggcgcc

SEQ ID NO: 3743623 - RNA, 15 nt, Salmonella enterica enterica serovar Typhi Ty2
ggggaucgguuuauc

SEQ ID NO: 3743624 - RNA, 18 nt, Salmonella enterica enterica serovar Typhi Ty2
ggggaugauuuucaggca

SEQ ID NO: 3743625 - RNA, 16 nt, Salmonella enterica enterica serovar Typhi Ty2
ggggcaagcucagcgg

SEQ ID NO: 3743626 - RNA, 13 nt, Salmonella enterica enterica serovar Typhi Ty2
ggggcaguaaauu

SEQ ID NO: 3743627 - RNA, 14 nt, Salmonella enterica enterica serovar Typhi Ty2
ggggcauuuuccgg

SEQ ID NO: 3743628 - RNA, 17 nt, Salmonella enterica enterica serovar Typhi Ty2
ggggcgacaaacagcgc

SEQ ID NO: 3743629 - RNA, 12 nt, Salmonella enterica enterica serovar Typhi Ty2
ggggcgcagaag

SEQ ID NO: 3743630 - RNA, 14 nt, Salmonella enterica enterica serovar Typhi Ty2
ggggcuuaacccac

SEQ ID NO: 3743631 - RNA, 19 nt, Salmonella enterica enterica serovar Typhi Ty2
gggggauagcgacggggcg

SEQ ID NO: 3743632 - RNA, 20 nt, Salmonella enterica enterica serovar Typhi Ty2
gggggccugauggcgcugcg

SEQ ID NO: 3743633 - RNA, 22 nt, Salmonella enterica enterica serovar Typhi Ty2
ggggguaacguuguccagcaga

SEQ ID NO: 3743634 - RNA, 24 nt, Salmonella enterica enterica serovar Typhi Ty2
gggguaaacaccggggcauuucca

SEQ ID NO: 3743635 - RNA, 18 nt, Salmonella enterica enterica serovar Typhi Ty2
gggguauucgcggccaga

SEQ ID NO: 3743636 - RNA, 19 nt, Salmonella enterica enterica serovar Typhi Ty2
ggggucggcgcuaaugugg

SEQ ID NO: 3743637 - RNA, 15 nt, Salmonella enterica enterica serovar Typhi Ty2
gggguguuacgccau

SEQ ID NO: 3743638 - RNA, 22 nt, Salmonella enterica enterica serovar Typhi Ty2
gggguugaugguuauuccuugu

SEQ ID NO: 3743639 - RNA, 16 nt, Salmonella enterica enterica serovar Typhi Ty2
gggguuuuggccggac

SEQ ID NO: 3743640 - RNA, 21 nt, Salmonella enterica enterica serovar Typhi Ty2
gggguuuuggccggaccugcg

SEQ ID NO: 3743641 - RNA, 19 nt, Salmonella enterica enterica serovar Typhi Ty2
ggguaaaaauauggcgggc

SEQ ID NO: 3743642 - RNA, 15 nt, Salmonella enterica enterica serovar Typhi Ty2
ggguaaaaucagcgc

SEQ ID NO: 3743643 - RNA, 21 nt, Salmonella enterica enterica serovar Typhi Ty2
ggguaaacaccggggcauuuc

SEQ ID NO: 3743644 - RNA, 18 nt, Salmonella enterica enterica serovar Typhi Ty2
ggguaauagaugcgucgc

SEQ ID NO: 3743645 - RNA, 20 nt, Salmonella enterica enterica serovar Typhi Ty2
ggguaccucaugccggcugg

SEQ ID NO: 3743646 - RNA, 14 nt, Salmonella enterica enterica serovar Typhi Ty2
ggguagaaaaaggu

SEQ ID NO: 3743647 - RNA, 20 nt, Salmonella enterica enterica serovar Typhi Ty2
ggguagccguuuaaaagcgg

SEQ ID NO: 3743648 - RNA, 13 nt, Salmonella enterica enterica serovar Typhi Ty2
ggguaggccggau

SEQ ID NO: 3743649 - RNA, 11 nt, Salmonella enterica enterica serovar Typhi Ty2
ggguaguuuug

SEQ ID NO: 3743650 - RNA, 23 nt, Salmonella enterica enterica serovar Typhi Ty2
ggguaucccgacgcacgagaucc

SEQ ID NO: 3743651 - RNA, 13 nt, Salmonella enterica enterica serovar Typhi Ty2
ggguaugcagugg

SEQ ID NO: 3743652 - RNA, 16 nt, Salmonella enterica enterica serovar Typhi Ty2
ggguauugaauccaua

SEQ ID NO: 3743653 - RNA, 20 nt, Salmonella enterica enterica serovar Typhi Ty2
ggguauugcuucguggcaau

SEQ ID NO: 3743654 - RNA, 24 nt, Salmonella enterica enterica serovar Typhi Ty2
gggucacauccagacagccgacgg

SEQ ID NO: 3743655 - RNA, 22 nt, Salmonella enterica enterica serovar Typhi Ty2
gggucagcgggguucagaccag

SEQ ID NO: 3743656 - RNA, 15 nt, Salmonella enterica enterica serovar Typhi Ty2
gggucagcguaucca

SEQ ID NO: 3743657 - RNA, 17 nt, Salmonella enterica enterica serovar Typhi Ty2
gggucaguacgcgcgua

SEQ ID NO: 3743658 - RNA, 17 nt, Salmonella enterica enterica serovar Typhi Ty2
gggucagugauaacgcg

SEQ ID NO: 3743659 - RNA, 20 nt, Salmonella enterica enterica serovar Typhi Ty2
gggugaugacgcgcaggccg

SEQ ID NO: 3743660 - RNA, 21 nt, Salmonella enterica enterica serovar Typhi Ty2
gggugaugacgggaucgaacc

SEQ ID NO: 3743661 - RNA, 22 nt, Salmonella enterica enterica serovar Typhi Ty2
gggugcaaauccaucucaggcc

SEQ ID NO: 3743662 - RNA, 14 nt, Salmonella enterica enterica serovar Typhi Ty2
gggugcgcagcccc

SEQ ID NO: 3743663 - RNA, 14 nt, Salmonella enterica enterica serovar Typhi Ty2
gggugcgcccagac

SEQ ID NO: 3743664 - RNA, 16 nt, Salmonella enterica enterica serovar Typhi Ty2
ggguggucacgccauu

SEQ ID NO: 3743665 - RNA, 18 nt, Salmonella enterica enterica serovar Typhi Ty2
ggguggugugcguaucgc

SEQ ID NO: 3743666 - RNA, 20 nt, Salmonella enterica enterica serovar Typhi Ty2
gggugguuucccugaccagu

SEQ ID NO: 3743667 - RNA, 14 nt, Salmonella enterica enterica serovar Typhi Ty2
ggucagcggcgcgc

SEQ ID NO: 3743668 - RNA, 19 nt, Salmonella enterica enterica serovar Typhi Ty2
ggucagcucacgcgccagc

SEQ ID NO: 3743669 - RNA, 21 nt, Salmonella enterica enterica serovar Typhi Ty2
ggucagcucacgcgccagcac

SEQ ID NO: 3743670 - RNA, 14 nt, Salmonella enterica enterica serovar Typhi Ty2
ggucaggaagacuu

SEQ ID NO: 3743671 - RNA, 13 nt, Salmonella enterica enterica serovar Typhi Ty2
ggucaggccagcc

SEQ ID NO: 3743672 - RNA, 21 nt, Salmonella enterica enterica serovar Typhi Ty2
ggucaggcucaggaaaacaaa

SEQ ID NO: 3743673 - RNA, 22 nt, Salmonella enterica enterica serovar Typhi Ty2
ggucagggugaauaccagcggc

SEQ ID NO: 3743674 - RNA, 21 nt, Salmonella enterica enterica serovar Typhi Ty2
ggucagggugaaucccgccau

SEQ ID NO: 3743675 - RNA, 23 nt, Salmonella enterica enterica serovar Typhi Ty2
ggucaguacgcgcguauccgccg

SEQ ID NO: 3743676 - RNA, 23 nt, Salmonella enterica enterica serovar Typhi Ty2
ggucaguaggcgaacuucaucca

SEQ ID NO: 3743677 - RNA, 13 nt, Salmonella enterica enterica serovar Typhi Ty2
ggucauacugugc

SEQ ID NO: 3743678 - RNA, 16 nt, Salmonella enterica enterica serovar Typhi Ty2
ggucauauugucgcgc

SEQ ID NO: 3743679 - RNA, 16 nt, Salmonella enterica enterica serovar Typhi Ty2
ggucaucaccuccagc

SEQ ID NO: 3743680 - RNA, 13 nt, Salmonella enterica enterica serovar Typhi Ty2
ggucaucugguca

SEQ ID NO: 3743681 - RNA, 18 nt, Salmonella enterica enterica serovar Typhi Ty2
ggucauucaggacggugg

SEQ ID NO: 3743682 - RNA, 19 nt, Salmonella enterica enterica serovar Typhi Ty2
ggucauucauugucuuuuu

SEQ ID NO: 3743683 - RNA, 17 nt, Salmonella enterica enterica serovar Typhi Ty2
ggucauuggggacgcgc

SEQ ID NO: 3743684 - RNA, 12 nt, Salmonella enterica enterica serovar Typhi Ty2
ggucccaucgcg

SEQ ID NO: 3743685 - RNA, 19 nt, Salmonella enterica enterica serovar Typhi Ty2
gguccggcgcuaaccagcg

SEQ ID NO: 3743686 - RNA, 17 nt, Salmonella enterica enterica serovar Typhi Ty2
ggucgaccaccugcugu

SEQ ID NO: 3743687 - RNA, 21 nt, Salmonella enterica enterica serovar Typhi Ty2
ggucgagcuuuugcugcgcca

SEQ ID NO: 3743688 - RNA, 12 nt, Salmonella enterica enterica serovar Typhi Ty2
ggucgccagcau

SEQ ID NO: 3743689 - RNA, 13 nt, Salmonella enterica enterica serovar Typhi Ty2
ggucgccagcgcc

SEQ ID NO: 3743690 - RNA, 17 nt, Salmonella enterica enterica serovar Typhi Ty2
ggucgcgacggccagca

SEQ ID NO: 3743691 - RNA, 16 nt, Salmonella enterica enterica serovar Typhi Ty2
ggucgcuaacccaggc

SEQ ID NO: 3743692 - RNA, 19 nt, Salmonella enterica enterica serovar Typhi Ty2
ggucgcuaacccaggccgg

SEQ ID NO: 3743693 - RNA, 18 nt, Salmonella enterica enterica serovar Typhi Ty2
ggucggcgcaguucgccg

SEQ ID NO: 3743694 - RNA, 16 nt, Salmonella enterica enterica serovar Typhi Ty2
ggucggcuccugguga

SEQ ID NO: 3743695 - RNA, 20 nt, Salmonella enterica enterica serovar Typhi Ty2
ggucguacuaaagagcgccu

SEQ ID NO: 3743696 - RNA, 21 nt, Salmonella enterica enterica serovar Typhi Ty2
ggucguacuaaagagcgccug

SEQ ID NO: 3743697 - RNA, 19 nt, Salmonella enterica enterica serovar Typhi Ty2
ggucuaaguugaccacauc

SEQ ID NO: 3743698 - RNA, 13 nt, Salmonella enterica enterica serovar Typhi Ty2
ggucuccaucaga

SEQ ID NO: 3743699 - RNA, 21 nt, Salmonella enterica enterica serovar Typhi Ty2
ggucucucgugcaggccggau

SEQ ID NO: 3743700 - RNA, 16 nt, Salmonella enterica enterica serovar Typhi Ty2
ggucucuuaaugccag

SEQ ID NO: 3743701 - RNA, 17 nt, Salmonella enterica enterica serovar Typhi Ty2
ggucucuuaaugccagc

SEQ ID NO: 3743702 - RNA, 20 nt, Salmonella enterica enterica serovar Typhi Ty2
ggucucuuaaugccagcggc

SEQ ID NO: 3743703 - RNA, 20 nt, Salmonella enterica enterica serovar Typhi Ty2
ggucucuucaugcauaaccg

SEQ ID NO: 3743704 - RNA, 17 nt, Salmonella enterica enterica serovar Typhi Ty2
ggucugacaacuauugc

SEQ ID NO: 3743705 - RNA, 20 nt, Salmonella enterica enterica serovar Typhi Ty2
ggucugcuucagccacuggc

SEQ ID NO: 3743706 - RNA, 20 nt, Salmonella enterica enterica serovar Typhi Ty2
ggugaaaaaucauuaucacu

SEQ ID NO: 3743707 - RNA, 16 nt, Salmonella enterica enterica serovar Typhi Ty2
ggugaaauaggggaga

SEQ ID NO: 3743708 - RNA, 13 nt, Salmonella enterica enterica serovar Typhi Ty2
ggugaaaucacgc

SEQ ID NO: 3743709 - RNA, 21 nt, Salmonella enterica enterica serovar Typhi Ty2
ggugaacaaaggcagccaaca

SEQ ID NO: 3743710 - RNA, 22 nt, Salmonella enterica enterica serovar Typhi Ty2
ggugaagcauccgggauauaaa

SEQ ID NO: 3743711 - RNA, 15 nt, Salmonella enterica enterica serovar Typhi Ty2
ggugaauaaauccuu

SEQ ID NO: 3743712 - RNA, 17 nt, Salmonella enterica enterica serovar Typhi Ty2
ggugaauaacuucacgc

SEQ ID NO: 3743713 - RNA, 16 nt, Salmonella enterica enterica serovar Typhi Ty2
ggugaauaccaaagcc

SEQ ID NO: 3743714 - RNA, 22 nt, Salmonella enterica enterica serovar Typhi Ty2
ggugaauaccagcggcaaacag

SEQ ID NO: 3743715 - RNA, 21 nt, Salmonella enterica enterica serovar Typhi Ty2
ggugaauagcauugccgucaa

SEQ ID NO: 3743716 - RNA, 22 nt, Salmonella enterica enterica serovar Typhi Ty2
ggugacaguccgggccgugaca

SEQ ID NO: 3743717 - RNA, 19 nt, Salmonella enterica enterica serovar Typhi Ty2
ggugacgccaugcaaaaaa

SEQ ID NO: 3743718 - RNA, 17 nt, Salmonella enterica enterica serovar Typhi Ty2
ggugacggaaaccagca

SEQ ID NO: 3743719 - RNA, 23 nt, Salmonella enterica enterica serovar Typhi Ty2
ggugagcuccagcccgccgcccu

SEQ ID NO: 3743720 - RNA, 12 nt, Salmonella enterica enterica serovar Typhi Ty2
ggugagcucuuu

SEQ ID NO: 3743721 - RNA, 22 nt, Salmonella enterica enterica serovar Typhi Ty2
ggugaguaauaacaaaaaacau

SEQ ID NO: 3743722 - RNA, 22 nt, Salmonella enterica enterica serovar Typhi Ty2
ggugauauuuuagccaucccgg

SEQ ID NO: 3743723 - RNA, 14 nt, Salmonella enterica enterica serovar Typhi Ty2
ggugaucugcgccg

SEQ ID NO: 3743724 - RNA, 23 nt, Salmonella enterica enterica serovar Typhi Ty2
ggugaugacgcgcaggccgucaa

SEQ ID NO: 3743725 - RNA, 15 nt, Salmonella enterica enterica serovar Typhi Ty2
ggugauggacgacga

SEQ ID NO: 3743726 - RNA, 23 nt, Salmonella enterica enterica serovar Typhi Ty2
ggugauuucgcccgcauucgcgg

SEQ ID NO: 3743727 - RNA, 18 nt, Salmonella enterica enterica serovar Typhi Ty2
ggugcaagcaccuuaucc

SEQ ID NO: 3743728 - RNA, 23 nt, Salmonella enterica enterica serovar Typhi Ty2
ggugcaagcaccuuauccggccu

SEQ ID NO: 3743729 - RNA, 15 nt, Salmonella enterica enterica serovar Typhi Ty2
ggugcagaacaucaa

SEQ ID NO: 3743730 - RNA, 16 nt, Salmonella enterica enterica serovar Typhi Ty2
ggugcagaccucugca

SEQ ID NO: 3743731 - RNA, 19 nt, Salmonella enterica enterica serovar Typhi Ty2
ggugcagcagacugguaac

SEQ ID NO: 3743732 - RNA, 17 nt, Salmonella enterica enterica serovar Typhi Ty2
ggugcagcccgucggcg

SEQ ID NO: 3743733 - RNA, 15 nt, Salmonella enterica enterica serovar Typhi Ty2
ggugcauuccgcgca

SEQ ID NO: 3743734 - RNA, 23 nt, Salmonella enterica enterica serovar Typhi Ty2
ggugcauuuuuaucaucugcaug

SEQ ID NO: 3743735 - RNA, 17 nt, Salmonella enterica enterica serovar Typhi Ty2
ggugccauuccagccgg

SEQ ID NO: 3743736 - RNA, 17 nt, Salmonella enterica enterica serovar Typhi Ty2
ggugcccgcaaaaccuu

SEQ ID NO: 3743737 - RNA, 17 nt, Salmonella enterica enterica serovar Typhi Ty2
ggugccuguugcgggcc

SEQ ID NO: 3743738 - RNA, 21 nt, Salmonella enterica enterica serovar Typhi Ty2
ggugccuguugcgggccagca

SEQ ID NO: 3743739 - RNA, 15 nt, Salmonella enterica enterica serovar Typhi Ty2
ggugcgacaccacgc

SEQ ID NO: 3743740 - RNA, 14 nt, Salmonella enterica enterica serovar Typhi Ty2
ggugcgacgccaga

SEQ ID NO: 3743741 - RNA, 20 nt, Salmonella enterica enterica serovar Typhi Ty2
ggugcgauacggcuuccucg

SEQ ID NO: 3743742 - RNA, 23 nt, Salmonella enterica enterica serovar Typhi Ty2
ggugcgcagccccagcgccagcc

SEQ ID NO: 3743743 - RNA, 16 nt, Salmonella enterica enterica serovar Typhi Ty2
ggugcgccccagcaug

SEQ ID NO: 3743744 - RNA, 21 nt, Salmonella enterica enterica serovar Typhi Ty2
ggugcgccccagcaugagcca

SEQ ID NO: 3743745 - RNA, 19 nt, Salmonella enterica enterica serovar Typhi Ty2
ggugcgguuacguccggca

SEQ ID NO: 3743746 - RNA, 14 nt, Salmonella enterica enterica serovar Typhi Ty2
ggugcguucugccg

SEQ ID NO: 3743747 - RNA, 17 nt, Salmonella enterica enterica serovar Typhi Ty2
ggugcucucccagcuga

SEQ ID NO: 3743748 - RNA, 17 nt, Salmonella enterica enterica serovar Typhi Ty2
guaaaauccggcaggca

SEQ ID NO: 3743749 - RNA, 15 nt, Salmonella enterica enterica serovar Typhi Ty2
guaaaaugcuggugc

SEQ ID NO: 3743750 - RNA, 16 nt, Salmonella enterica enterica serovar Typhi Ty2
guaaaauggacuuccg

SEQ ID NO: 3743751 - RNA, 14 nt, Salmonella enterica enterica serovar Typhi Ty2
guaaaauuagacaa

SEQ ID NO: 3743752 - RNA, 13 nt, Salmonella enterica enterica serovar Typhi Ty2
guaaacaccaccg

SEQ ID NO: 3743753 - RNA, 19 nt, Salmonella enterica enterica serovar Typhi Ty2
guaaacaccuuauccggcc

SEQ ID NO: 3743754 - RNA, 18 nt, Salmonella enterica enterica serovar Typhi Ty2
guaaacacgacgcugcca

SEQ ID NO: 3743755 - RNA, 16 nt, Salmonella enterica enterica serovar Typhi Ty2
guaaacacucaggcag

SEQ ID NO: 3743756 - RNA, 19 nt, Salmonella enterica enterica serovar Typhi Ty2
guaaaccauuucuccugca

SEQ ID NO: 3743757 - RNA, 17 nt, Salmonella enterica enterica serovar Typhi Ty2
guaaaccggucucuuaa

SEQ ID NO: 3743758 - RNA, 23 nt, Salmonella enterica enterica serovar Typhi Ty2
guaaaccucaaggcucagcagag

SEQ ID NO: 3743759 - RNA, 21 nt, Salmonella enterica enterica serovar Typhi Ty2
guaaaccucuuuggcgcgaac

SEQ ID NO: 3743760 - RNA, 22 nt, Salmonella enterica enterica serovar Typhi Ty2
guaaacgcaacaccaucccgcu

SEQ ID NO: 3743761 - RNA, 16 nt, Salmonella enterica enterica serovar Typhi Ty2
guaaacgccugcacca

SEQ ID NO: 3743762 - RNA, 12 nt, Salmonella enterica enterica serovar Typhi Ty2
guaaacgugcca

SEQ ID NO: 3743763 - RNA, 16 nt, Salmonella enterica enterica serovar Typhi Ty2
guaaacgugccacagu

SEQ ID NO: 3743764 - RNA, 16 nt, Salmonella enterica enterica serovar Typhi Ty2
guaaacguuccugcca

SEQ ID NO: 3743765 - RNA, 13 nt, Salmonella enterica enterica serovar Typhi Ty2
guaaagaucuggc

SEQ ID NO: 3743766 - RNA, 22 nt, Salmonella enterica enterica serovar Typhi Ty2
guaaagauuuguuucaucgccu

SEQ ID NO: 3743767 - RNA, 14 nt, Salmonella enterica enterica serovar Typhi Ty2
guaaagcagugcag

SEQ ID NO: 3743768 - RNA, 18 nt, Salmonella enterica enterica serovar Typhi Ty2
guaaagcagugcaguauu

SEQ ID NO: 3743769 - RNA, 16 nt, Salmonella enterica enterica serovar Typhi Ty2
guaaaggucgccgcau

SEQ ID NO: 3743770 - RNA, 15 nt, Salmonella enterica enterica serovar Typhi Ty2
guaaagguuuucacg

SEQ ID NO: 3743771 - RNA, 20 nt, Salmonella enterica enterica serovar Typhi Ty2
guaaauaaaucagcgcggca

SEQ ID NO: 3743772 - RNA, 20 nt, Salmonella enterica enterica serovar Typhi Ty2
guaaauaaugcgguucggca

SEQ ID NO: 3743773 - RNA, 11 nt, Salmonella enterica enterica serovar Typhi Ty2
guaaauaccag

SEQ ID NO: 3743774 - RNA, 17 nt, Salmonella enterica enterica serovar Typhi Ty2
guaaauagagaaaucaa

SEQ ID NO: 3743775 - RNA, 18 nt, Salmonella enterica enterica serovar Typhi Ty2
guaaauagagaaaucaac

SEQ ID NO: 3743776 - RNA, 18 nt, Salmonella enterica enterica serovar Typhi Ty2
guaaauauugauuaaucg

SEQ ID NO: 3743777 - RNA, 17 nt, Salmonella enterica enterica serovar Typhi Ty2
guaaaucagaauaccgc

SEQ ID NO: 3743778 - RNA, 12 nt, Salmonella enterica enterica serovar Typhi Ty2
guaaaucaggcc

SEQ ID NO: 3743779 - RNA, 19 nt, Salmonella enterica enterica serovar Typhi Ty2
guaaaucauuuguacaaaa

SEQ ID NO: 3743780 - RNA, 22 nt, Salmonella enterica enterica serovar Typhi Ty2
guaaaucauuuguacaaaaaau

SEQ ID NO: 3743781 - RNA, 19 nt, Salmonella enterica enterica serovar Typhi Ty2
guaaaucugccgucaucga

SEQ ID NO: 3743782 - RNA, 22 nt, Salmonella enterica enterica serovar Typhi Ty2
guaaaucugccgucaucgacuu

SEQ ID NO: 3743783 - RNA, 20 nt, Salmonella enterica enterica serovar Typhi Ty2
guaaaugccacuauagauga

SEQ ID NO: 3743784 - RNA, 19 nt, Salmonella enterica enterica serovar Typhi Ty2
guaaauuccgcaggcaaca

SEQ ID NO: 3743785 - RNA, 21 nt, Salmonella enterica enterica serovar Typhi Ty2
guaaauuccgcaggcaacaca

SEQ ID NO: 3743786 - RNA, 22 nt, Salmonella enterica enterica serovar Typhi Ty2
guaaauucucuauacugcugac

SEQ ID NO: 3743787 - RNA, 14 nt, Salmonella enterica enterica serovar Typhi Ty2
guaaauugacugga

SEQ ID NO: 3743788 - RNA, 23 nt, Salmonella enterica enterica serovar Typhi Ty2
guaaauuucaacccgaucgccau

SEQ ID NO: 3743789 - RNA, 14 nt, Salmonella enterica enterica serovar Typhi Ty2
guaacacaaucagg

SEQ ID NO: 3743790 - RNA, 16 nt, Salmonella enterica enterica serovar Typhi Ty2
guaacacaaucaggcg

SEQ ID NO: 3743791 - RNA, 22 nt, Salmonella enterica enterica serovar Typhi Ty2
guaacaccuguaacgucacauu

SEQ ID NO: 3743792 - RNA, 13 nt, Salmonella enterica enterica serovar Typhi Ty2
guaacagcaggac

SEQ ID NO: 3743793 - RNA, 17 nt, Salmonella enterica enterica serovar Typhi Ty2
guaacauacaaaaagua

SEQ ID NO: 3743794 - RNA, 14 nt, Salmonella enterica enterica serovar Typhi Ty2
guaacauauuuuua

SEQ ID NO: 3743795 - RNA, 20 nt, Salmonella enterica enterica serovar Typhi Ty2
guaacauccuggguuugcug

SEQ ID NO: 3743796 - RNA, 22 nt, Salmonella enterica enterica serovar Typhi Ty2
guaaccaaagcaccauucuuca

SEQ ID NO: 3743797 - RNA, 17 nt, Salmonella enterica enterica serovar Typhi Ty2
guaacccgauacccuga

SEQ ID NO: 3743798 - RNA, 18 nt, Salmonella enterica enterica serovar Typhi Ty2
guaaccgcaaaugccauc

SEQ ID NO: 3743799 - RNA, 19 nt, Salmonella enterica enterica serovar Typhi Ty2
guaaccgcuuuuuuaucgc

SEQ ID NO: 3743800 - RNA, 18 nt, Salmonella enterica enterica serovar Typhi Ty2
guaaccuuuuuauggccc

SEQ ID NO: 3743801 - RNA, 15 nt, Salmonella enterica enterica serovar Typhi Ty2
guaacgcauaagcgc

SEQ ID NO: 3743802 - RNA, 23 nt, Salmonella enterica enterica serovar Typhi Ty2
guaacgccaaaguuuuuaaacaa

SEQ ID NO: 3743803 - RNA, 20 nt, Salmonella enterica enterica serovar Typhi Ty2
guaacgccgugacggcguaa

SEQ ID NO: 3743804 - RNA, 16 nt, Salmonella enterica enterica serovar Typhi Ty2
guaacgccuuugcccg

SEQ ID NO: 3743805 - RNA, 16 nt, Salmonella enterica enterica serovar Typhi Ty2
guaacggacucaggcc

SEQ ID NO: 3743806 - RNA, 17 nt, Salmonella enterica enterica serovar Typhi Ty2
guaacguuguccagcag

SEQ ID NO: 3743807 - RNA, 20 nt, Salmonella enterica enterica serovar Typhi Ty2
guaacuauuucuaucaggua

SEQ ID NO: 3743808 - RNA, 19 nt, Salmonella enterica enterica serovar Typhi Ty2
guaacucggcagcgcgaca

SEQ ID NO: 3743809 - RNA, 21 nt, Salmonella enterica enterica serovar Typhi Ty2
guaacugcaccuuuuuuucca

SEQ ID NO: 3743810 - RNA, 17 nt, Salmonella enterica enterica serovar Typhi Ty2
guaacuggcuccacggg

SEQ ID NO: 3743811 - RNA, 14 nt, Salmonella enterica enterica serovar Typhi Ty2
guaacugucagauc

SEQ ID NO: 3743812 - RNA, 15 nt, Salmonella enterica enterica serovar Typhi Ty2
guaagagagccuuac

SEQ ID NO: 3743813 - RNA, 16 nt, Salmonella enterica enterica serovar Typhi Ty2
guaagagagccuuaca

SEQ ID NO: 3743814 - RNA, 19 nt, Salmonella enterica enterica serovar Typhi Ty2
guaagagcguuacccagac

SEQ ID NO: 3743815 - RNA, 23 nt, Salmonella enterica enterica serovar Typhi Ty2
guaagagcguuacccagacagca

SEQ ID NO: 3743816 - RNA, 22 nt, Salmonella enterica enterica serovar Typhi Ty2
guaagcaauauggcugcgauaa

SEQ ID NO: 3743817 - RNA, 14 nt, Salmonella enterica enterica serovar Typhi Ty2
guaagcacaacgca

SEQ ID NO: 3743818 - RNA, 22 nt, Salmonella enterica enterica serovar Typhi Ty2
guaagcgcagcgccaucaggca

SEQ ID NO: 3743819 - RNA, 22 nt, Salmonella enterica enterica serovar Typhi Ty2
guaagcgcccguccaugaguag

SEQ ID NO: 3743820 - RNA, 23 nt, Salmonella enterica enterica serovar Typhi Ty2
guaagcggguauacuuaacccug

SEQ ID NO: 3743821 - RNA, 16 nt, Salmonella enterica enterica serovar Typhi Ty2
guaagcuauuacaaaa

SEQ ID NO: 3743822 - RNA, 13 nt, Salmonella enterica enterica serovar Typhi Ty2
guaaggcagcgau

SEQ ID NO: 3743823 - RNA, 20 nt, Salmonella enterica enterica serovar Typhi Ty2
guaaggcauuaauauccagu

SEQ ID NO: 3743824 - RNA, 15 nt, Salmonella enterica enterica serovar Typhi Ty2
guaaguuuugcuccc

SEQ ID NO: 3743825 - RNA, 21 nt, Salmonella enterica enterica serovar Typhi Ty2
guaauaacaaaaaacauauau

SEQ ID NO: 3743826 - RNA, 17 nt, Salmonella enterica enterica serovar Typhi Ty2
guaauaacucaugacuu

SEQ ID NO: 3743827 - RNA, 20 nt, Salmonella enterica enterica serovar Typhi Ty2
guaauaacuuaaacgccgga

SEQ ID NO: 3743828 - RNA, 21 nt, Salmonella enterica enterica serovar Typhi Ty2
guaauaaggcggguugcugau

SEQ ID NO: 3743829 - RNA, 18 nt, Salmonella enterica enterica serovar Typhi Ty2
guaauacggagcaaaaaa

SEQ ID NO: 3743830 - RNA, 17 nt, Salmonella enterica enterica serovar Typhi Ty2
guacgcgcgcggcguca

SEQ ID NO: 3743831 - RNA, 22 nt, Salmonella enterica enterica serovar Typhi Ty2
guacgcgcgucguauaugccaa

SEQ ID NO: 3743832 - RNA, 14 nt, Salmonella enterica enterica serovar Typhi Ty2
guacgcggcgacca

SEQ ID NO: 3743833 - RNA, 15 nt, Salmonella enterica enterica serovar Typhi Ty2
guacgcuccagggcu

SEQ ID NO: 3743834 - RNA, 18 nt, Salmonella enterica enterica serovar Typhi Ty2
guacgcuuuggcaggccu

SEQ ID NO: 3743835 - RNA, 22 nt, Salmonella enterica enterica serovar Typhi Ty2
guacggaauaucccgcaagaaa

SEQ ID NO: 3743836 - RNA, 14 nt, Salmonella enterica enterica serovar Typhi Ty2
guacggauggcguc

SEQ ID NO: 3743837 - RNA, 12 nt, Salmonella enterica enterica serovar Typhi Ty2
guacggcauauu

SEQ ID NO: 3743838 - RNA, 13 nt, Salmonella enterica enterica serovar Typhi Ty2
guacggcgcgaau

SEQ ID NO: 3743839 - RNA, 13 nt, Salmonella enterica enterica serovar Typhi Ty2
guacggcgcgcca

SEQ ID NO: 3743840 - RNA, 16 nt, Salmonella enterica enterica serovar Typhi Ty2
guacgggcaaagcgac

SEQ ID NO: 3743841 - RNA, 17 nt, Salmonella enterica enterica serovar Typhi Ty2
guacggggcaucuauuu

SEQ ID NO: 3743842 - RNA, 18 nt, Salmonella enterica enterica serovar Typhi Ty2
guacggguauuccagggc

SEQ ID NO: 3743843 - RNA, 17 nt, Salmonella enterica enterica serovar Typhi Ty2
guacguccauccgccgg

SEQ ID NO: 3743844 - RNA, 15 nt, Salmonella enterica enterica serovar Typhi Ty2
guacgucgcauacuu

SEQ ID NO: 3743845 - RNA, 16 nt, Salmonella enterica enterica serovar Typhi Ty2
guacucuuccagcugc

SEQ ID NO: 3743846 - RNA, 20 nt, Salmonella enterica enterica serovar Typhi Ty2
guacugcccguggcggaggu

SEQ ID NO: 3743847 - RNA, 14 nt, Salmonella enterica enterica serovar Typhi Ty2
guacuucagagcug

SEQ ID NO: 3743848 - RNA, 16 nt, Salmonella enterica enterica serovar Typhi Ty2
guacuugcgccgccau

SEQ ID NO: 3743849 - RNA, 11 nt, Salmonella enterica enterica serovar Typhi Ty2
guacuuucaaa

SEQ ID NO: 3743850 - RNA, 13 nt, Salmonella enterica enterica serovar Typhi Ty2
guacuuucaaaua

SEQ ID NO: 3743851 - RNA, 22 nt, Salmonella enterica enterica serovar Typhi Ty2
guacuuucacuaccacuuucuu

SEQ ID NO: 3743852 - RNA, 15 nt, Salmonella enterica enterica serovar Typhi Ty2
guacuuuuaaaucau

SEQ ID NO: 3743853 - RNA, 21 nt, Salmonella enterica enterica serovar Typhi Ty2
guacuuuucauccacagcgcc

SEQ ID NO: 3743854 - RNA, 16 nt, Salmonella enterica enterica serovar Typhi Ty2
guagaaaaagguaacu

SEQ ID NO: 3743855 - RNA, 16 nt, Salmonella enterica enterica serovar Typhi Ty2
guagacaaacagcgcg

SEQ ID NO: 3743856 - RNA, 14 nt, Salmonella enterica enterica serovar Typhi Ty2
guagacacgcuacc

SEQ ID NO: 3743857 - RNA, 14 nt, Salmonella enterica enterica serovar Typhi Ty2
guagaccgcaucga

SEQ ID NO: 3743858 - RNA, 16 nt, Salmonella enterica enterica serovar Typhi Ty2
guagacucaggcgcau

SEQ ID NO: 3743859 - RNA, 21 nt, Salmonella enterica enterica serovar Typhi Ty2
guagacuggguaagcgcagcg

SEQ ID NO: 3743860 - RNA, 14 nt, Salmonella enterica enterica serovar Typhi Ty2
guagagaacagcau

SEQ ID NO: 3743861 - RNA, 20 nt, Salmonella enterica enterica serovar Typhi Ty2
guagagauucugcaggccaa

SEQ ID NO: 3743862 - RNA, 18 nt, Salmonella enterica enterica serovar Typhi Ty2
guagagcggauaagcgca

SEQ ID NO: 3743863 - RNA, 12 nt, Salmonella enterica enterica serovar Typhi Ty2
guagaucaccag

SEQ ID NO: 3743864 - RNA, 14 nt, Salmonella enterica enterica serovar Typhi Ty2
guagauggcgcuaa

SEQ ID NO: 3743865 - RNA, 15 nt, Salmonella enterica enterica serovar Typhi Ty2
guagauggcgcuaaa

SEQ ID NO: 3743866 - RNA, 23 nt, Salmonella enterica enterica serovar Typhi Ty2
guagcaacccuggcgcuuuaaac

SEQ ID NO: 3743867 - RNA, 14 nt, Salmonella enterica enterica serovar Typhi Ty2
guagcagcgccagc

SEQ ID NO: 3743868 - RNA, 17 nt, Salmonella enterica enterica serovar Typhi Ty2
guagcaguggagaggcc

SEQ ID NO: 3743869 - RNA, 14 nt, Salmonella enterica enterica serovar Typhi Ty2
guagcauaaucagg

SEQ ID NO: 3743870 - RNA, 19 nt, Salmonella enterica enterica serovar Typhi Ty2
guagccacgcccgccgccu

SEQ ID NO: 3743871 - RNA, 20 nt, Salmonella enterica enterica serovar Typhi Ty2
guagccagagcgcgcuggca

SEQ ID NO: 3743872 - RNA, 23 nt, Salmonella enterica enterica serovar Typhi Ty2
guagccagccaaacaauaucccg

SEQ ID NO: 3743873 - RNA, 17 nt, Salmonella enterica enterica serovar Typhi Ty2
guagccgacggccauaa

SEQ ID NO: 3743874 - RNA, 20 nt, Salmonella enterica enterica serovar Typhi Ty2
guagccgcagaaccauuucc

SEQ ID NO: 3743875 - RNA, 17 nt, Salmonella enterica enterica serovar Typhi Ty2
guagccgcgcgccgccu

SEQ ID NO: 3743876 - RNA, 14 nt, Salmonella enterica enterica serovar Typhi Ty2
guagcgccauccgg

SEQ ID NO: 3743877 - RNA, 21 nt, Salmonella enterica enterica serovar Typhi Ty2
guagcgccugugcuuucgcca

SEQ ID NO: 3743878 - RNA, 14 nt, Salmonella enterica enterica serovar Typhi Ty2
guagcgcggcagcg

SEQ ID NO: 3743879 - RNA, 21 nt, Salmonella enterica enterica serovar Typhi Ty2
guagcggaaccagccaugcca

SEQ ID NO: 3743880 - RNA, 21 nt, Salmonella enterica enterica serovar Typhi Ty2
guagcggcaacagcaccagaa

SEQ ID NO: 3743881 - RNA, 14 nt, Salmonella enterica enterica serovar Typhi Ty2
guagcggcgccggg

SEQ ID NO: 3743882 - RNA, 16 nt, Salmonella enterica enterica serovar Typhi Ty2
guagcgggggccggcu

SEQ ID NO: 3743883 - RNA, 16 nt, Salmonella enterica enterica serovar Typhi Ty2
guagcguacaggcgga

SEQ ID NO: 3743884 - RNA, 12 nt, Salmonella enterica enterica serovar Typhi Ty2
guagcguaucag

SEQ ID NO: 3743885 - RNA, 13 nt, Salmonella enterica enterica serovar Typhi Ty2
guagcgucaauga

SEQ ID NO: 3743886 - RNA, 14 nt, Salmonella enterica enterica serovar Typhi Ty2
guagcgucaaugau

SEQ ID NO: 3743887 - RNA, 20 nt, Salmonella enterica enterica serovar Typhi Ty2
guagcguuauccagucagag

SEQ ID NO: 3743888 - RNA, 23 nt, Salmonella enterica enterica serovar Typhi Ty2
guagcguuucacgcgcgccugcc

SEQ ID NO: 3743889 - RNA, 16 nt, Salmonella enterica enterica serovar Typhi Ty2
guagcucauaacucgc

SEQ ID NO: 3743890 - RNA, 17 nt, Salmonella enterica enterica serovar Typhi Ty2
guagcuccagacaggac

SEQ ID NO: 3743891 - RNA, 14 nt, Salmonella enterica enterica serovar Typhi Ty2
guagcuccagaccu

SEQ ID NO: 3743892 - RNA, 14 nt, Salmonella enterica enterica serovar Typhi Ty2
guagcugcgccagc

SEQ ID NO: 3743893 - RNA, 16 nt, Salmonella enterica enterica serovar Typhi Ty2
guagcugcgccugaaa

SEQ ID NO: 3743894 - RNA, 14 nt, Salmonella enterica enterica serovar Typhi Ty2
guagcuggcugccg

SEQ ID NO: 3743895 - RNA, 14 nt, Salmonella enterica enterica serovar Typhi Ty2
guagcuucugucug

SEQ ID NO: 3743896 - RNA, 17 nt, Salmonella enterica enterica serovar Typhi Ty2
guaggccgaauaagcca

SEQ ID NO: 3743897 - RNA, 19 nt, Salmonella enterica enterica serovar Typhi Ty2
guaggccggauaaggcauu

SEQ ID NO: 3743898 - RNA, 15 nt, Salmonella enterica enterica serovar Typhi Ty2
guaggccggaucagg

SEQ ID NO: 3743899 - RNA, 17 nt, Salmonella enterica enterica serovar Typhi Ty2
guaggccggaucaggcg

SEQ ID NO: 3743900 - RNA, 21 nt, Salmonella enterica enterica serovar Typhi Ty2
guaggccggauuaaggcguuu

SEQ ID NO: 3743901 - RNA, 20 nt, Salmonella enterica enterica serovar Typhi Ty2
guaggccugauaagacgcau

SEQ ID NO: 3743902 - RNA, 18 nt, Salmonella enterica enterica serovar Typhi Ty2
guaggccugauaagcgca

SEQ ID NO: 3743903 - RNA, 19 nt, Salmonella enterica enterica serovar Typhi Ty2
guaggccugauaagcguag

SEQ ID NO: 3743904 - RNA, 18 nt, Salmonella enterica enterica serovar Typhi Ty2
guaggcgaacuacaggcg

SEQ ID NO: 3743905 - RNA, 13 nt, Salmonella enterica enterica serovar Typhi Ty2
guaggcuucaacc

SEQ ID NO: 3743906 - RNA, 18 nt, Salmonella enterica enterica serovar Typhi Ty2
guagggcugccaucaggc

SEQ ID NO: 3743907 - RNA, 15 nt, Salmonella enterica enterica serovar Typhi Ty2
guaggguacagcgcg

SEQ ID NO: 3743908 - RNA, 18 nt, Salmonella enterica enterica serovar Typhi Ty2
guaguaaccccaguagcc

SEQ ID NO: 3743909 - RNA, 14 nt, Salmonella enterica enterica serovar Typhi Ty2
guaguaucauccau

SEQ ID NO: 3743910 - RNA, 14 nt, Salmonella enterica enterica serovar Typhi Ty2
guaguccaaauaag

SEQ ID NO: 3743911 - RNA, 17 nt, Salmonella enterica enterica serovar Typhi Ty2
guagucuuacacuuagc

SEQ ID NO: 3743912 - RNA, 22 nt, Salmonella enterica enterica serovar Typhi Ty2
guagugccggauggcggcgaaa

SEQ ID NO: 3743913 - RNA, 18 nt, Salmonella enterica enterica serovar Typhi Ty2
gucaacaaugcuuucacc

SEQ ID NO: 3743914 - RNA, 16 nt, Salmonella enterica enterica serovar Typhi Ty2
gucaacacgcagaccc

SEQ ID NO: 3743915 - RNA, 17 nt, Salmonella enterica enterica serovar Typhi Ty2
gucaacacgcagaccca

SEQ ID NO: 3743916 - RNA, 16 nt, Salmonella enterica enterica serovar Typhi Ty2
gucaaccaugaucacu

SEQ ID NO: 3743917 - RNA, 22 nt, Salmonella enterica enterica serovar Typhi Ty2
gucaacgaggugaauaaauccu

SEQ ID NO: 3743918 - RNA, 17 nt, Salmonella enterica enterica serovar Typhi Ty2
gucaacgccaagcgcgg

SEQ ID NO: 3743919 - RNA, 15 nt, Salmonella enterica enterica serovar Typhi Ty2
gucaacguuuuucag

SEQ ID NO: 3743920 - RNA, 19 nt, Salmonella enterica enterica serovar Typhi Ty2
gucaacucuuucaggcgag

SEQ ID NO: 3743921 - RNA, 19 nt, Salmonella enterica enterica serovar Typhi Ty2
gucaacugcgccugcucag

SEQ ID NO: 3743922 - RNA, 16 nt, Salmonella enterica enterica serovar Typhi Ty2
gucaagaucccucacc

SEQ ID NO: 3743923 - RNA, 17 nt, Salmonella enterica enterica serovar Typhi Ty2
gucaagaucgcgcagca

SEQ ID NO: 3743924 - RNA, 21 nt, Salmonella enterica enterica serovar Typhi Ty2
gucaagaucgcgcagcaggcc

SEQ ID NO: 3743925 - RNA, 14 nt, Salmonella enterica enterica serovar Typhi Ty2
gucaauaagccaga

SEQ ID NO: 3743926 - RNA, 14 nt, Salmonella enterica enterica serovar Typhi Ty2
gucaauaaucgcgc

SEQ ID NO: 3743927 - RNA, 16 nt, Salmonella enterica enterica serovar Typhi Ty2
gucaauauuaaugcug

SEQ ID NO: 3743928 - RNA, 12 nt, Salmonella enterica enterica serovar Typhi Ty2
gucaaucaucag

SEQ ID NO: 3743929 - RNA, 15 nt, Salmonella enterica enterica serovar Typhi Ty2
gucaaugaucaguuu

SEQ ID NO: 3743930 - RNA, 15 nt, Salmonella enterica enterica serovar Typhi Ty2
gucaauggcgcuguc

SEQ ID NO: 3743931 - RNA, 18 nt, Salmonella enterica enterica serovar Typhi Ty2
gucacaaagcccaccgcg

SEQ ID NO: 3743932 - RNA, 19 nt, Salmonella enterica enterica serovar Typhi Ty2
gucacaauaucgagaugac

SEQ ID NO: 3743933 - RNA, 14 nt, Salmonella enterica enterica serovar Typhi Ty2
gucacauccagaca

SEQ ID NO: 3743934 - RNA, 20 nt, Salmonella enterica enterica serovar Typhi Ty2
gucacauggcgaaaaucacu

SEQ ID NO: 3743935 - RNA, 17 nt, Salmonella enterica enterica serovar Typhi Ty2
gucacccgcguaucauu

SEQ ID NO: 3743936 - RNA, 18 nt, Salmonella enterica enterica serovar Typhi Ty2
gucaccgacacgcauaug

SEQ ID NO: 3743937 - RNA, 14 nt, Salmonella enterica enterica serovar Typhi Ty2
gucaccgggcgcug

SEQ ID NO: 3743938 - RNA, 15 nt, Salmonella enterica enterica serovar Typhi Ty2
gucaccgggcgcugg

SEQ ID NO: 3743939 - RNA, 17 nt, Salmonella enterica enterica serovar Typhi Ty2
gucaccucuuucgccgc

SEQ ID NO: 3743940 - RNA, 18 nt, Salmonella enterica enterica serovar Typhi Ty2
gucaccucuuucgccgcu

SEQ ID NO: 3743941 - RNA, 19 nt, Salmonella enterica enterica serovar Typhi Ty2
gucaccugauagcggguaa

SEQ ID NO: 3743942 - RNA, 16 nt, Salmonella enterica enterica serovar Typhi Ty2
gucacgauccgcaaau

SEQ ID NO: 3743943 - RNA, 22 nt, Salmonella enterica enterica serovar Typhi Ty2
gucacgcaugucguauccccag

SEQ ID NO: 3743944 - RNA, 18 nt, Salmonella enterica enterica serovar Typhi Ty2
gucacgcgcaaagcugcg

SEQ ID NO: 3743945 - RNA, 16 nt, Salmonella enterica enterica serovar Typhi Ty2
gucacuucaaccuuua

SEQ ID NO: 3743946 - RNA, 20 nt, Salmonella enterica enterica serovar Typhi Ty2
gucagacaccgggcuauuug

SEQ ID NO: 3743947 - RNA, 17 nt, Salmonella enterica enterica serovar Typhi Ty2
gucagaggaauucucca

SEQ ID NO: 3743948 - RNA, 17 nt, Salmonella enterica enterica serovar Typhi Ty2
gucagauccuucauuca

SEQ ID NO: 3743949 - RNA, 19 nt, Salmonella enterica enterica serovar Typhi Ty2
gucagaucguaugcgccug

SEQ ID NO: 3743950 - RNA, 17 nt, Salmonella enterica enterica serovar Typhi Ty2
gucagaugcguuuucug

SEQ ID NO: 3743951 - RNA, 19 nt, Salmonella enterica enterica serovar Typhi Ty2
gucagaugcguuuucugca

SEQ ID NO: 3743952 - RNA, 13 nt, Salmonella enterica enterica serovar Typhi Ty2
gucagcaagauua

SEQ ID NO: 3743953 - RNA, 15 nt, Salmonella enterica enterica serovar Typhi Ty2
gucagcaauuaacaa

SEQ ID NO: 3743954 - RNA, 14 nt, Salmonella enterica enterica serovar Typhi Ty2
gucagcagcaccgg

SEQ ID NO: 3743955 - RNA, 22 nt, Salmonella enterica enterica serovar Typhi Ty2
gucagccccguacaaggucggc

SEQ ID NO: 3743956 - RNA, 23 nt, Salmonella enterica enterica serovar Typhi Ty2
gucagcgcauaccggccacgagc

SEQ ID NO: 3743957 - RNA, 16 nt, Salmonella enterica enterica serovar Typhi Ty2
gucagcgcggcuucca

SEQ ID NO: 3743958 - RNA, 22 nt, Salmonella enterica enterica serovar Typhi Ty2
gucagcggcugacacucaucca

SEQ ID NO: 3743959 - RNA, 21 nt, Salmonella enterica enterica serovar Typhi Ty2
gucagcgggguucagaccaga

SEQ ID NO: 3743960 - RNA, 18 nt, Salmonella enterica enterica serovar Typhi Ty2
gucagcgucuauagauga

SEQ ID NO: 3743961 - RNA, 22 nt, Salmonella enterica enterica serovar Typhi Ty2
gucagcucgguggcgguaucaa

SEQ ID NO: 3743962 - RNA, 13 nt, Salmonella enterica enterica serovar Typhi Ty2
gucaggaacgcgg

SEQ ID NO: 3743963 - RNA, 19 nt, Salmonella enterica enterica serovar Typhi Ty2
gucaggaccaaaacaguac

SEQ ID NO: 3743964 - RNA, 19 nt, Salmonella enterica enterica serovar Typhi Ty2
gucaggauacagccgacua

SEQ ID NO: 3743965 - RNA, 21 nt, Salmonella enterica enterica serovar Typhi Ty2
gucaggauuuucgcgaucucc

SEQ ID NO: 3743966 - RNA, 21 nt, Salmonella enterica enterica serovar Typhi Ty2
gucaggcaacaggauguccug

SEQ ID NO: 3743967 - RNA, 19 nt, Salmonella enterica enterica serovar Typhi Ty2
gucaggccgccgcacaggc

SEQ ID NO: 3743968 - RNA, 16 nt, Salmonella enterica enterica serovar Typhi Ty2
gucaggcgagcgccuu

SEQ ID NO: 3743969 - RNA, 13 nt, Salmonella enterica enterica serovar Typhi Ty2
gucaggcggcugc

SEQ ID NO: 3743970 - RNA, 12 nt, Salmonella enterica enterica serovar Typhi Ty2
gucaggcuaaau

SEQ ID NO: 3743971 - RNA, 21 nt, Salmonella enterica enterica serovar Typhi Ty2
gucagggcgcggcgcaacuuu

SEQ ID NO: 3743972 - RNA, 21 nt, Salmonella enterica enterica serovar Typhi Ty2
gucagggugaauaccagcggc

SEQ ID NO: 3743973 - RNA, 18 nt, Salmonella enterica enterica serovar Typhi Ty2
gucaguaccagcgagaua

SEQ ID NO: 3743974 - RNA, 19 nt, Salmonella enterica enterica serovar Typhi Ty2
gucaguagcguucuuucca

SEQ ID NO: 3743975 - RNA, 14 nt, Salmonella enterica enterica serovar Typhi Ty2
gucaguccaccugu

SEQ ID NO: 3743976 - RNA, 19 nt, Salmonella enterica enterica serovar Typhi Ty2
gucagugagcccuccucca

SEQ ID NO: 3743977 - RNA, 14 nt, Salmonella enterica enterica serovar Typhi Ty2
gucaguggaaaaca

SEQ ID NO: 3743978 - RNA, 20 nt, Salmonella enterica enterica serovar Typhi Ty2
gucaguguuuccauacauuu

SEQ ID NO: 3743979 - RNA, 12 nt, Salmonella enterica enterica serovar Typhi Ty2
gucauaaaacug

SEQ ID NO: 3743980 - RNA, 13 nt, Salmonella enterica enterica serovar Typhi Ty2
gucauaauuaaaa

SEQ ID NO: 3743981 - RNA, 14 nt, Salmonella enterica enterica serovar Typhi Ty2
gucauaauuaaaaa

SEQ ID NO: 3743982 - RNA, 16 nt, Salmonella enterica enterica serovar Typhi Ty2
gucauacugugcguga

SEQ ID NO: 3743983 - RNA, 23 nt, Salmonella enterica enterica serovar Typhi Ty2
gucauacuucaaguugcaggugu

SEQ ID NO: 3743984 - RNA, 19 nt, Salmonella enterica enterica serovar Typhi Ty2
gucauagucggcgccaaag

SEQ ID NO: 3743985 - RNA, 19 nt, Salmonella enterica enterica serovar Typhi Ty2
gucauaucgaugguaauaa

SEQ ID NO: 3743986 - RNA, 20 nt, Salmonella enterica enterica serovar Typhi Ty2
gucauaucugaugcucgccg

SEQ ID NO: 3743987 - RNA, 20 nt, Salmonella enterica enterica serovar Typhi Ty2
gucauaugcacgcgauuugc

SEQ ID NO: 3743988 - RNA, 20 nt, Salmonella enterica enterica serovar Typhi Ty2
gucaucaaauuaucuguuga

SEQ ID NO: 3743989 - RNA, 22 nt, Salmonella enterica enterica serovar Typhi Ty2
gucaucaaauuaucuguugaua

SEQ ID NO: 3743990 - RNA, 22 nt, Salmonella enterica enterica serovar Typhi Ty2
gucaucaggcgguguuguuuua

SEQ ID NO: 3743991 - RNA, 13 nt, Salmonella enterica enterica serovar Typhi Ty2
gucaucauaauuc

SEQ ID NO: 3743992 - RNA, 12 nt, Salmonella enterica enterica serovar Typhi Ty2
gucaucccgaac

SEQ ID NO: 3743993 - RNA, 16 nt, Salmonella enterica enterica serovar Typhi Ty2
gucauccggcaaucag

SEQ ID NO: 3743994 - RNA, 16 nt, Salmonella enterica enterica serovar Typhi Ty2
gucauccggcauaaga

SEQ ID NO: 3743995 - RNA, 19 nt, Salmonella enterica enterica serovar Typhi Ty2
gucgucgauuuucugcuca

SEQ ID NO: 3743996 - RNA, 21 nt, Salmonella enterica enterica serovar Typhi Ty2
gucgucgauuuucugcucaau

SEQ ID NO: 3743997 - RNA, 23 nt, Salmonella enterica enterica serovar Typhi Ty2
gucgucugaaagcgacucaucca

SEQ ID NO: 3743998 - RNA, 19 nt, Salmonella enterica enterica serovar Typhi Ty2
gucgugagcaaccaacgcg

SEQ ID NO: 3743999 - RNA, 21 nt, Salmonella enterica enterica serovar Typhi Ty2
gucgugccugacguccacgga

SEQ ID NO: 3744000 - RNA, 14 nt, Salmonella enterica enterica serovar Typhi Ty2
gucgugccugcggu

SEQ ID NO: 3744001 - RNA, 14 nt, Salmonella enterica enterica serovar Typhi Ty2
gucguggcgaucag

SEQ ID NO: 3744002 - RNA, 15 nt, Salmonella enterica enterica serovar Typhi Ty2
gucguuaccgggcug

SEQ ID NO: 3744003 - RNA, 22 nt, Salmonella enterica enterica serovar Typhi Ty2
gucguuacugcucguagcguuu

SEQ ID NO: 3744004 - RNA, 16 nt, Salmonella enterica enterica serovar Typhi Ty2
gucguuagccagaugg

SEQ ID NO: 3744005 - RNA, 21 nt, Salmonella enterica enterica serovar Typhi Ty2
gucguuccacacguccauccg

SEQ ID NO: 3744006 - RNA, 16 nt, Salmonella enterica enterica serovar Typhi Ty2
gucguuccgccaggcg

SEQ ID NO: 3744007 - RNA, 21 nt, Salmonella enterica enterica serovar Typhi Ty2
gucguugccuuugcguaccgc

SEQ ID NO: 3744008 - RNA, 14 nt, Salmonella enterica enterica serovar Typhi Ty2
gucguuucuacaau

SEQ ID NO: 3744009 - RNA, 17 nt, Salmonella enterica enterica serovar Typhi Ty2
gucuaccguaggccgga

SEQ ID NO: 3744010 - RNA, 16 nt, Salmonella enterica enterica serovar Typhi Ty2
gucuaucgcuccuccc

SEQ ID NO: 3744011 - RNA, 14 nt, Salmonella enterica enterica serovar Typhi Ty2
gucuaugguacaca

SEQ ID NO: 3744012 - RNA, 15 nt, Salmonella enterica enterica serovar Typhi Ty2
gucuaugguacacau

SEQ ID NO: 3744013 - RNA, 14 nt, Salmonella enterica enterica serovar Typhi Ty2
gucucaaaaaauau

SEQ ID NO: 3744014 - RNA, 21 nt, Salmonella enterica enterica serovar Typhi Ty2
gucucacccguuuucuccuuc

SEQ ID NO: 3744015 - RNA, 19 nt, Salmonella enterica enterica serovar Typhi Ty2
gucucagauggaaaaaaag

SEQ ID NO: 3744016 - RNA, 20 nt, Salmonella enterica enterica serovar Typhi Ty2
gucucagauggaaaaaaaga

SEQ ID NO: 3744017 - RNA, 15 nt, Salmonella enterica enterica serovar Typhi Ty2
gucucagguucgaau

SEQ ID NO: 3744018 - RNA, 19 nt, Salmonella enterica enterica serovar Typhi Ty2
gucucaucggucgcaucca

SEQ ID NO: 3744019 - RNA, 18 nt, Salmonella enterica enterica serovar Typhi Ty2
gucucauuauuaaauuaa

SEQ ID NO: 3744020 - RNA, 20 nt, Salmonella enterica enterica serovar Typhi Ty2
gucuccagcucauuuuuaca

SEQ ID NO: 3744021 - RNA, 22 nt, Salmonella enterica enterica serovar Typhi Ty2
gucucccgugacguuuugcgcg

SEQ ID NO: 3744022 - RNA, 16 nt, Salmonella enterica enterica serovar Typhi Ty2
gucucccuccugcucc

SEQ ID NO: 3744023 - RNA, 15 nt, Salmonella enterica enterica serovar Typhi Ty2
gucuccucagcaggc

SEQ ID NO: 3744024 - RNA, 16 nt, Salmonella enterica enterica serovar Typhi Ty2
gucuccucagcaggcg

SEQ ID NO: 3744025 - RNA, 18 nt, Salmonella enterica enterica serovar Typhi Ty2
gucuccucgccagcuacc

SEQ ID NO: 3744026 - RNA, 19 nt, Salmonella enterica enterica serovar Typhi Ty2
gucuccugaacuuuuugca

SEQ ID NO: 3744027 - RNA, 19 nt, Salmonella enterica enterica serovar Typhi Ty2
gucuccugccaaugaaaua

SEQ ID NO: 3744028 - RNA, 14 nt, Salmonella enterica enterica serovar Typhi Ty2
gucucggccuggcc

SEQ ID NO: 3744029 - RNA, 18 nt, Salmonella enterica enterica serovar Typhi Ty2
gucucucccgaucuucug

SEQ ID NO: 3744030 - RNA, 20 nt, Salmonella enterica enterica serovar Typhi Ty2
gucucuucaugcauaaccgc

SEQ ID NO: 3744031 - RNA, 14 nt, Salmonella enterica enterica serovar Typhi Ty2
gucucuucuuccgc

SEQ ID NO: 3744032 - RNA, 16 nt, Salmonella enterica enterica serovar Typhi Ty2
gucugaaaacucacgc

SEQ ID NO: 3744033 - RNA, 19 nt, Salmonella enterica enterica serovar Typhi Ty2
gucugaagaaguucuucug

SEQ ID NO: 3744034 - RNA, 22 nt, Salmonella enterica enterica serovar Typhi Ty2
gucugaaggcguaugaaugaaa

SEQ ID NO: 3744035 - RNA, 14 nt, Salmonella enterica enterica serovar Typhi Ty2
gucugaaucugcuc

SEQ ID NO: 3744036 - RNA, 15 nt, Salmonella enterica enterica serovar Typhi Ty2
gucugaaucugcucc

SEQ ID NO: 3744037 - RNA, 16 nt, Salmonella enterica enterica serovar Typhi Ty2
gucugagcgcaaacau

SEQ ID NO: 3744038 - RNA, 14 nt, Salmonella enterica enterica serovar Typhi Ty2
gucugauaaacgca

SEQ ID NO: 3744039 - RNA, 23 nt, Salmonella enterica enterica serovar Typhi Ty2
gucugauugccggaugacgcuuc

SEQ ID NO: 3744040 - RNA, 16 nt, Salmonella enterica enterica serovar Typhi Ty2
gucugcaaaauuugug

SEQ ID NO: 3744041 - RNA, 22 nt, Salmonella enterica enterica serovar Typhi Ty2
gucugcaaaauuuguggugguc

SEQ ID NO: 3744042 - RNA, 18 nt, Salmonella enterica enterica serovar Typhi Ty2
gucugcgcccaccgggag

SEQ ID NO: 3744043 - RNA, 15 nt, Salmonella enterica enterica serovar Typhi Ty2
gucugcgcgccggaa

SEQ ID NO: 3744044 - RNA, 16 nt, Salmonella enterica enterica serovar Typhi Ty2
gucugcgcgcuggugu

SEQ ID NO: 3744045 - RNA, 15 nt, Salmonella enterica enterica serovar Typhi Ty2
gucugcgcugggccg

SEQ ID NO: 3744046 - RNA, 13 nt, Salmonella enterica enterica serovar Typhi Ty2
gucugcuggccaa

SEQ ID NO: 3744047 - RNA, 13 nt, Salmonella enterica enterica serovar Typhi Ty2
gucuggauauaaa

SEQ ID NO: 3744048 - RNA, 16 nt, Salmonella enterica enterica serovar Typhi Ty2
gucuggcgcuaaaauc

SEQ ID NO: 3744049 - RNA, 18 nt, Salmonella enterica enterica serovar Typhi Ty2
gucuggguuugcagcaga

SEQ ID NO: 3744050 - RNA, 20 nt, Salmonella enterica enterica serovar Typhi Ty2
gucugguaucugucaugcgg

SEQ ID NO: 3744051 - RNA, 11 nt, Salmonella enterica enterica serovar Typhi Ty2
gucuggucagc

SEQ ID NO: 3744052 - RNA, 20 nt, Salmonella enterica enterica serovar Typhi Ty2
gucugucggacucaggguga

SEQ ID NO: 3744053 - RNA, 14 nt, Salmonella enterica enterica serovar Typhi Ty2
gucuguguugaaua

SEQ ID NO: 3744054 - RNA, 17 nt, Salmonella enterica enterica serovar Typhi Ty2
gucuuaaagaaaaagaa

SEQ ID NO: 3744055 - RNA, 13 nt, Salmonella enterica enterica serovar Typhi Ty2
gucuuaaauauga

SEQ ID NO: 3744056 - RNA, 16 nt, Salmonella enterica enterica serovar Typhi Ty2
gucuuaaaugccgccg

SEQ ID NO: 3744057 - RNA, 17 nt, Salmonella enterica enterica serovar Typhi Ty2
gucuuaaaugccgccgg

SEQ ID NO: 3744058 - RNA, 17 nt, Salmonella enterica enterica serovar Typhi Ty2
gucuuauccggccucca

SEQ ID NO: 3744059 - RNA, 19 nt, Salmonella enterica enterica serovar Typhi Ty2
gucuuauccggccuccaaa

SEQ ID NO: 3744060 - RNA, 14 nt, Salmonella enterica enterica serovar Typhi Ty2
gucuuauuauuauu

SEQ ID NO: 3744061 - RNA, 19 nt, Salmonella enterica enterica serovar Typhi Ty2
gucuucaacguuccuucag

SEQ ID NO: 3744062 - RNA, 21 nt, Salmonella enterica enterica serovar Typhi Ty2
gucuucaacguuccuucagga

SEQ ID NO: 3744063 - RNA, 16 nt, Salmonella enterica enterica serovar Typhi Ty2
gucuucacucaccaca

SEQ ID NO: 3744064 - RNA, 23 nt, Salmonella enterica enterica serovar Typhi Ty2
gucuucacucugggauuugcgaa

SEQ ID NO: 3744065 - RNA, 18 nt, Salmonella enterica enterica serovar Typhi Ty2
gucuucaggucauucagg

SEQ ID NO: 3744066 - RNA, 19 nt, Salmonella enterica enterica serovar Typhi Ty2
gucuucaucagccagcauc

SEQ ID NO: 3744067 - RNA, 20 nt, Salmonella enterica enterica serovar Typhi Ty2
gucuucaucagccagcaucg

SEQ ID NO: 3744068 - RNA, 12 nt, Salmonella enterica enterica serovar Typhi Ty2
gucuucaucuau

SEQ ID NO: 3744069 - RNA, 11 nt, Salmonella enterica enterica serovar Typhi Ty2
gucuuccagca

SEQ ID NO: 3744070 - RNA, 13 nt, Salmonella enterica enterica serovar Typhi Ty2
gucuuccugcggu

SEQ ID NO: 3744071 - RNA, 16 nt, Salmonella enterica enterica serovar Typhi Ty2
gucuuccuucguuacu

SEQ ID NO: 3744072 - RNA, 18 nt, Salmonella enterica enterica serovar Typhi Ty2
gucuucuuaguaacauaa

SEQ ID NO: 3744073 - RNA, 23 nt, Salmonella enterica enterica serovar Typhi Ty2
gucuucuucuucgcgcauuucug

SEQ ID NO: 3744074 - RNA, 21 nt, Salmonella enterica enterica serovar Typhi Ty2
gucuugccaugugccgcgaaa

SEQ ID NO: 3744075 - RNA, 21 nt, Salmonella enterica enterica serovar Typhi Ty2
gucuugguauggauggcuggg

SEQ ID NO: 3744076 - RNA, 22 nt, Salmonella enterica enterica serovar Typhi Ty2
gucuugucaggcucuaauaacu

SEQ ID NO: 3744077 - RNA, 14 nt, Salmonella enterica enterica serovar Typhi Ty2
gugauagcgcgcca

SEQ ID NO: 3744078 - RNA, 22 nt, Salmonella enterica enterica serovar Typhi Ty2
gugauaguggcgucgccauaaa

SEQ ID NO: 3744079 - RNA, 14 nt, Salmonella enterica enterica serovar Typhi Ty2
gugauauagcgcca

SEQ ID NO: 3744080 - RNA, 17 nt, Salmonella enterica enterica serovar Typhi Ty2
gugauccaccaccagca

SEQ ID NO: 3744081 - RNA, 19 nt, Salmonella enterica enterica serovar Typhi Ty2
gugauccaccaccagcauc

SEQ ID NO: 3744082 - RNA, 23 nt, Salmonella enterica enterica serovar Typhi Ty2
gugauccaccaccagcaucacgu

SEQ ID NO: 3744083 - RNA, 13 nt, Salmonella enterica enterica serovar Typhi Ty2
gugauccguaauc

SEQ ID NO: 3744084 - RNA, 15 nt, Salmonella enterica enterica serovar Typhi Ty2
gugaugacuaaauca

SEQ ID NO: 3744085 - RNA, 18 nt, Salmonella enterica enterica serovar Typhi Ty2
gugaugagcucaaauaug

SEQ ID NO: 3744086 - RNA, 18 nt, Salmonella enterica enterica serovar Typhi Ty2
gugaugcaucagaacaaa

SEQ ID NO: 3744087 - RNA, 20 nt, Salmonella enterica enterica serovar Typhi Ty2
gugaugccagccauagccca

SEQ ID NO: 3744088 - RNA, 19 nt, Salmonella enterica enterica serovar Typhi Ty2
gugaugcgacgcgcucacc

SEQ ID NO: 3744089 - RNA, 14 nt, Salmonella enterica enterica serovar Typhi Ty2
gugauggcggucaa

SEQ ID NO: 3744090 - RNA, 16 nt, Salmonella enterica enterica serovar Typhi Ty2
gugauggguauuagaa

SEQ ID NO: 3744091 - RNA, 18 nt, Salmonella enterica enterica serovar Typhi Ty2
gugauggugcagccccgg

SEQ ID NO: 3744092 - RNA, 13 nt, Salmonella enterica enterica serovar Typhi Ty2
gugaugugccggu

SEQ ID NO: 3744093 - RNA, 12 nt, Salmonella enterica enterica serovar Typhi Ty2
gugaugugcugg

SEQ ID NO: 3744094 - RNA, 16 nt, Salmonella enterica enterica serovar Typhi Ty2
gugauuaacagcgcca

SEQ ID NO: 3744095 - RNA, 15 nt, Salmonella enterica enterica serovar Typhi Ty2
gugauuacaaaaugu

SEQ ID NO: 3744096 - RNA, 22 nt, Salmonella enterica enterica serovar Typhi Ty2
gugauuggcuggacauguuccg

SEQ ID NO: 3744097 - RNA, 14 nt, Salmonella enterica enterica serovar Typhi Ty2
gugauuguccaacu

SEQ ID NO: 3744098 - RNA, 21 nt, Salmonella enterica enterica serovar Typhi Ty2
gugcaaacgauaaaagcucug

SEQ ID NO: 3744099 - RNA, 13 nt, Salmonella enterica enterica serovar Typhi Ty2
gugcaaucagcga

SEQ ID NO: 3744100 - RNA, 23 nt, Salmonella enterica enterica serovar Typhi Ty2
gugcaaucccggaacagcggagc

SEQ ID NO: 3744101 - RNA, 20 nt, Salmonella enterica enterica serovar Typhi Ty2
gugcaaugucaugacugguu

SEQ ID NO: 3744102 - RNA, 17 nt, Salmonella enterica enterica serovar Typhi Ty2
gugcaccguaucggcag

SEQ ID NO: 3744103 - RNA, 11 nt, Salmonella enterica enterica serovar Typhi Ty2
gugcagaacau

SEQ ID NO: 3744104 - RNA, 16 nt, Salmonella enterica enterica serovar Typhi Ty2
gugcagcaagcggcug

SEQ ID NO: 3744105 - RNA, 17 nt, Salmonella enterica enterica serovar Typhi Ty2
gugcagcaagcggcugu

SEQ ID NO: 3744106 - RNA, 14 nt, Salmonella enterica enterica serovar Typhi Ty2
gugcagcgugccgg

SEQ ID NO: 3744107 - RNA, 17 nt, Salmonella enterica enterica serovar Typhi Ty2
gugcagcguuuccagcc

SEQ ID NO: 3744108 - RNA, 16 nt, Salmonella enterica enterica serovar Typhi Ty2
gugcaggaucaaccgg

SEQ ID NO: 3744109 - RNA, 20 nt, Salmonella enterica enterica serovar Typhi Ty2
gugcaggauuuguaucacaa

SEQ ID NO: 3744110 - RNA, 17 nt, Salmonella enterica enterica serovar Typhi Ty2
gugcagugacagaggaa

SEQ ID NO: 3744111 - RNA, 20 nt, Salmonella enterica enterica serovar Typhi Ty2
gugcaguucuguaggccgga

SEQ ID NO: 3744112 - RNA, 15 nt, Salmonella enterica enterica serovar Typhi Ty2
gugcauaaccgcgcc

SEQ ID NO: 3744113 - RNA, 20 nt, Salmonella enterica enterica serovar Typhi Ty2
gugcaucaggaaauccugga

SEQ ID NO: 3744114 - RNA, 20 nt, Salmonella enterica enterica serovar Typhi Ty2
gugcauccccugaaacaggu

SEQ ID NO: 3744115 - RNA, 20 nt, Salmonella enterica enterica serovar Typhi Ty2
gugcauccggacgccagugc

SEQ ID NO: 3744116 - RNA, 11 nt, Salmonella enterica enterica serovar Typhi Ty2
gugcaucggca

SEQ ID NO: 3744117 - RNA, 14 nt, Salmonella enterica enterica serovar Typhi Ty2
gugcaucuggggga

SEQ ID NO: 3744118 - RNA, 22 nt, Salmonella enterica enterica serovar Typhi Ty2
gugcaugggauacgccagcaga

SEQ ID NO: 3744119 - RNA, 22 nt, Salmonella enterica enterica serovar Typhi Ty2
gugcauguaaauaaggcugcgc

SEQ ID NO: 3744120 - RNA, 13 nt, Salmonella enterica enterica serovar Typhi Ty2
gugccaauaacgc

SEQ ID NO: 3744121 - RNA, 18 nt, Salmonella enterica enterica serovar Typhi Ty2
gugccaaucuccagcauc

SEQ ID NO: 3744122 - RNA, 21 nt, Salmonella enterica enterica serovar Typhi Ty2
gugccaauggcgauaaaaaua

SEQ ID NO: 3744123 - RNA, 17 nt, Salmonella enterica enterica serovar Typhi Ty2
gugccaccagccggagc

SEQ ID NO: 3744124 - RNA, 17 nt, Salmonella enterica enterica serovar Typhi Ty2
gugccacuccgccagua

SEQ ID NO: 3744125 - RNA, 22 nt, Salmonella enterica enterica serovar Typhi Ty2
gugccagaaacaagaagcacga

SEQ ID NO: 3744126 - RNA, 12 nt, Salmonella enterica enterica serovar Typhi Ty2
gugccaguaauc

SEQ ID NO: 3744127 - RNA, 19 nt, Salmonella enterica enterica serovar Typhi Ty2
gugcccauaaaaaucccaa

SEQ ID NO: 3744128 - RNA, 12 nt, Salmonella enterica enterica serovar Typhi Ty2
gugcccaucggc

SEQ ID NO: 3744129 - RNA, 23 nt, Salmonella enterica enterica serovar Typhi Ty2
gugccgaagucaaaggccaguaa

SEQ ID NO: 3744130 - RNA, 23 nt, Salmonella enterica enterica serovar Typhi Ty2
gugccgaccagcgguugcauaaa

SEQ ID NO: 3744131 - RNA, 15 nt, Salmonella enterica enterica serovar Typhi Ty2
gugccgacgccagcc

SEQ ID NO: 3744132 - RNA, 20 nt, Salmonella enterica enterica serovar Typhi Ty2
gugccgacgccagccauuaa

SEQ ID NO: 3744133 - RNA, 15 nt, Salmonella enterica enterica serovar Typhi Ty2
gugccggauggcguu

SEQ ID NO: 3744134 - RNA, 15 nt, Salmonella enterica enterica serovar Typhi Ty2
gugccugacagcaau

SEQ ID NO: 3744135 - RNA, 19 nt, Salmonella enterica enterica serovar Typhi Ty2
gugccugacagcaaugagc

SEQ ID NO: 3744136 - RNA, 14 nt, Salmonella enterica enterica serovar Typhi Ty2
gugccugccgccuc

SEQ ID NO: 3744137 - RNA, 17 nt, Salmonella enterica enterica serovar Typhi Ty2
gugccugccuguggcug

SEQ ID NO: 3744138 - RNA, 13 nt, Salmonella enterica enterica serovar Typhi Ty2
gugccugcuccgc

SEQ ID NO: 3744139 - RNA, 18 nt, Salmonella enterica enterica serovar Typhi Ty2
gugccugcuccgccaggg

SEQ ID NO: 3744140 - RNA, 11 nt, Salmonella enterica enterica serovar Typhi Ty2
gugccugcugg

SEQ ID NO: 3744141 - RNA, 14 nt, Salmonella enterica enterica serovar Typhi Ty2
gugccuggauaaau

SEQ ID NO: 3744142 - RNA, 14 nt, Salmonella enterica enterica serovar Typhi Ty2
gugccuuccgcaau

SEQ ID NO: 3744143 - RNA, 21 nt, Salmonella enterica enterica serovar Typhi Ty2
gugcgacaacaaugaaacggu

SEQ ID NO: 3744144 - RNA, 21 nt, Salmonella enterica enterica serovar Typhi Ty2
gugcgacaucgacaaaauagu

SEQ ID NO: 3744145 - RNA, 13 nt, Salmonella enterica enterica serovar Typhi Ty2
gugcgacguaggc

SEQ ID NO: 3744146 - RNA, 19 nt, Salmonella enterica enterica serovar Typhi Ty2
gugcgauucagcgcaggca

SEQ ID NO: 3744147 - RNA, 13 nt, Salmonella enterica enterica serovar Typhi Ty2
gugcgcauccgga

SEQ ID NO: 3744148 - RNA, 22 nt, Salmonella enterica enterica serovar Typhi Ty2
gugcgccagccuuaucccaucc

SEQ ID NO: 3744149 - RNA, 12 nt, Salmonella enterica enterica serovar Typhi Ty2
gugcgccccagc

SEQ ID NO: 3744150 - RNA, 13 nt, Salmonella enterica enterica serovar Typhi Ty2
gugcgccccaggu

SEQ ID NO: 3744151 - RNA, 20 nt, Salmonella enterica enterica serovar Typhi Ty2
gugcgccguccugcaaggca

SEQ ID NO: 3744152 - RNA, 13 nt, Salmonella enterica enterica serovar Typhi Ty2
gugcgccugcugc

SEQ ID NO: 3744153 - RNA, 13 nt, Salmonella enterica enterica serovar Typhi Ty2
gugcgcgcgggcg

SEQ ID NO: 3744154 - RNA, 20 nt, Salmonella enterica enterica serovar Typhi Ty2
gugcggcauauucaggagca

SEQ ID NO: 3744155 - RNA, 19 nt, Salmonella enterica enterica serovar Typhi Ty2
gugcggcugggcgaggcca

SEQ ID NO: 3744156 - RNA, 14 nt, Salmonella enterica enterica serovar Typhi Ty2
gugcggggaacacu

SEQ ID NO: 3744157 - RNA, 15 nt, Salmonella enterica enterica serovar Typhi Ty2
gugcggggaacacua

SEQ ID NO: 3744158 - RNA, 13 nt, Salmonella enterica enterica serovar Typhi Ty2
gugcguaaaauau

SEQ ID NO: 3744159 - RNA, 12 nt, Salmonella enterica enterica serovar Typhi Ty2
guguaauaaccg

SEQ ID NO: 3744160 - RNA, 16 nt, Salmonella enterica enterica serovar Typhi Ty2
guguauauauugcauu

SEQ ID NO: 3744161 - RNA, 20 nt, Salmonella enterica enterica serovar Typhi Ty2
guguauauauugcauuuuau

SEQ ID NO: 3744162 - RNA, 23 nt, Salmonella enterica enterica serovar Typhi Ty2
guguauuucauuucgaucuguuu

SEQ ID NO: 3744163 - RNA, 11 nt, Salmonella enterica enterica serovar Typhi Ty2
guguauuuuuu

SEQ ID NO: 3744164 - RNA, 14 nt, Salmonella enterica enterica serovar Typhi Ty2
gugucacucaucgg

SEQ ID NO: 3744165 - RNA, 20 nt, Salmonella enterica enterica serovar Typhi Ty2
gugucagacaccgggcuauu

SEQ ID NO: 3744166 - RNA, 16 nt, Salmonella enterica enterica serovar Typhi Ty2
gugucagauccuucau

SEQ ID NO: 3744167 - RNA, 19 nt, Salmonella enterica enterica serovar Typhi Ty2
gugucaugcgguuaaacca

SEQ ID NO: 3744168 - RNA, 14 nt, Salmonella enterica enterica serovar Typhi Ty2
guguccgccugcug

SEQ ID NO: 3744169 - RNA, 19 nt, Salmonella enterica enterica serovar Typhi Ty2
guguccggguucagcgaca

SEQ ID NO: 3744170 - RNA, 20 nt, Salmonella enterica enterica serovar Typhi Ty2
gugucgccggggcgcuggcg

SEQ ID NO: 3744171 - RNA, 17 nt, Salmonella enterica enterica serovar Typhi Ty2
gugucgguacgcugguu

SEQ ID NO: 3744172 - RNA, 19 nt, Salmonella enterica enterica serovar Typhi Ty2
gugucguuucauccugaca

SEQ ID NO: 3744173 - RNA, 19 nt, Salmonella enterica enterica serovar Typhi Ty2
gugucguuuucacuuguuc

SEQ ID NO: 3744174 - RNA, 15 nt, Salmonella enterica enterica serovar Typhi Ty2
gugucucgucgccag

SEQ ID NO: 3744175 - RNA, 13 nt, Salmonella enterica enterica serovar Typhi Ty2
gugugccagcaga

SEQ ID NO: 3744176 - RNA, 21 nt, Salmonella enterica enterica serovar Typhi Ty2
gugugccugcgcuuacggcca

SEQ ID NO: 3744177 - RNA, 15 nt, Salmonella enterica enterica serovar Typhi Ty2
guguggcuaucggcc

SEQ ID NO: 3744178 - RNA, 22 nt, Salmonella enterica enterica serovar Typhi Ty2
guguggcuaucggccugaccau

SEQ ID NO: 3744179 - RNA, 17 nt, Salmonella enterica enterica serovar Typhi Ty2
gugugguuucaagcggc

SEQ ID NO: 3744180 - RNA, 14 nt, Salmonella enterica enterica serovar Typhi Ty2
guguguaccagcag

SEQ ID NO: 3744181 - RNA, 21 nt, Salmonella enterica enterica serovar Typhi Ty2
guguguaccagcagcgccagc

SEQ ID NO: 3744182 - RNA, 18 nt, Salmonella enterica enterica serovar Typhi Ty2
guguguucccgcgccagc

SEQ ID NO: 3744183 - RNA, 21 nt, Salmonella enterica enterica serovar Typhi Ty2
guguuaccgccaccuuucugc

SEQ ID NO: 3744184 - RNA, 21 nt, Salmonella enterica enterica serovar Typhi Ty2
guguuauauucccgaaaggug

SEQ ID NO: 3744185 - RNA, 15 nt, Salmonella enterica enterica serovar Typhi Ty2
guguuccauugcugc

SEQ ID NO: 3744186 - RNA, 14 nt, Salmonella enterica enterica serovar Typhi Ty2
guguucguaaagca

SEQ ID NO: 3744187 - RNA, 17 nt, Salmonella enterica enterica serovar Typhi Ty2
guguucucccugcucgg

SEQ ID NO: 3744188 - RNA, 13 nt, Salmonella enterica enterica serovar Typhi Ty2
guguucuuaccca

SEQ ID NO: 3744189 - RNA, 21 nt, Salmonella enterica enterica serovar Typhi Ty2
guguugaaauaguuacuguuu

SEQ ID NO: 3744190 - RNA, 14 nt, Salmonella enterica enterica serovar Typhi Ty2
guguugauugaaac

SEQ ID NO: 3744191 - RNA, 22 nt, Salmonella enterica enterica serovar Typhi Ty2
guguuggaugaaccauaucaaa

SEQ ID NO: 3744192 - RNA, 20 nt, Salmonella enterica enterica serovar Typhi Ty2
guguuguacagcaauaaaag

SEQ ID NO: 3744193 - RNA, 17 nt, Salmonella enterica enterica serovar Typhi Ty2
guguuuacgccgccauc

SEQ ID NO: 3744194 - RNA, 13 nt, Salmonella enterica enterica serovar Typhi Ty2
guguuucagcagc

SEQ ID NO: 3744195 - RNA, 14 nt, Salmonella enterica enterica serovar Typhi Ty2
guguuucagcagcc

SEQ ID NO: 3744196 - RNA, 19 nt, Salmonella enterica enterica serovar Typhi Ty2
guguuucaucucaucaaug

SEQ ID NO: 3744197 - RNA, 18 nt, Salmonella enterica enterica serovar Typhi Ty2
guguuuucgauuucauuc

SEQ ID NO: 3744198 - RNA, 21 nt, Salmonella enterica enterica serovar Typhi Ty2
guuaaaaaucgcuauauugcu

SEQ ID NO: 3744199 - RNA, 22 nt, Salmonella enterica enterica serovar Typhi Ty2
guuaaacguaaguuaaaacgcc

SEQ ID NO: 3744200 - RNA, 18 nt, Salmonella enterica enterica serovar Typhi Ty2
guuaaagcccugacagaa

SEQ ID NO: 3744201 - RNA, 16 nt, Salmonella enterica enterica serovar Typhi Ty2
guuaaauauaucuguu

SEQ ID NO: 3744202 - RNA, 21 nt, Salmonella enterica enterica serovar Typhi Ty2
guuaaauccucccaucgagcc

SEQ ID NO: 3744203 - RNA, 23 nt, Salmonella enterica enterica serovar Typhi Ty2
guuaaaucgcgcaaauauuacaa

SEQ ID NO: 3744204 - RNA, 17 nt, Salmonella enterica enterica serovar Typhi Ty2
guuaaauucauauuuaa

SEQ ID NO: 3744205 - RNA, 15 nt, Salmonella enterica enterica serovar Typhi Ty2
guuaacagaaugcug

SEQ ID NO: 3744206 - RNA, 18 nt, Salmonella enterica enterica serovar Typhi Ty2
guuaacagaaugcugaac

SEQ ID NO: 3744207 - RNA, 14 nt, Salmonella enterica enterica serovar Typhi Ty2
guuaacccggcauu

SEQ ID NO: 3744208 - RNA, 17 nt, Salmonella enterica enterica serovar Typhi Ty2
guuaaccgucuggcugc

SEQ ID NO: 3744209 - RNA, 23 nt, Salmonella enterica enterica serovar Typhi Ty2
guuaacucaagcgaauccagauc

SEQ ID NO: 3744210 - RNA, 20 nt, Salmonella enterica enterica serovar Typhi Ty2
guuaacuucuccgccaucag

SEQ ID NO: 3744211 - RNA, 16 nt, Salmonella enterica enterica serovar Typhi Ty2
guuaagaagucuguga

SEQ ID NO: 3744212 - RNA, 19 nt, Salmonella enterica enterica serovar Typhi Ty2
guuaauacaguggaaagua

SEQ ID NO: 3744213 - RNA, 14 nt, Salmonella enterica enterica serovar Typhi Ty2
guuaaucaucgcuu

SEQ ID NO: 3744214 - RNA, 22 nt, Salmonella enterica enterica serovar Typhi Ty2
guuaaucauuuucuuugcagcu

SEQ ID NO: 3744215 - RNA, 17 nt, Salmonella enterica enterica serovar Typhi Ty2
guuaauccaaauccgca

SEQ ID NO: 3744216 - RNA, 21 nt, Salmonella enterica enterica serovar Typhi Ty2
guuaauccagagcggauaaau

SEQ ID NO: 3744217 - RNA, 20 nt, Salmonella enterica enterica serovar Typhi Ty2
guuaaugcuguccugcaaaa

SEQ ID NO: 3744218 - RNA, 13 nt, Salmonella enterica enterica serovar Typhi Ty2
guuaauggaggca

SEQ ID NO: 3744219 - RNA, 22 nt, Salmonella enterica enterica serovar Typhi Ty2
guuaauggccugaugacgcugc

SEQ ID NO: 3744220 - RNA, 11 nt, Salmonella enterica enterica serovar Typhi Ty2
guuaauuucuu

SEQ ID NO: 3744221 - RNA, 14 nt, Salmonella enterica enterica serovar Typhi Ty2
guuaauuugauuua

SEQ ID NO: 3744222 - RNA, 18 nt, Salmonella enterica enterica serovar Typhi Ty2
guuacaaauagcggcaca

SEQ ID NO: 3744223 - RNA, 13 nt, Salmonella enterica enterica serovar Typhi Ty2
guuaccagcauca

SEQ ID NO: 3744224 - RNA, 20 nt, Salmonella enterica enterica serovar Typhi Ty2
guuaccauccauuaaaaucu

SEQ ID NO: 3744225 - RNA, 23 nt, Salmonella enterica enterica serovar Typhi Ty2
guuacccaugagcgaaacuccag

SEQ ID NO: 3744226 - RNA, 16 nt, Salmonella enterica enterica serovar Typhi Ty2
guuaccccgcagcgaa

SEQ ID NO: 3744227 - RNA, 23 nt, Salmonella enterica enterica serovar Typhi Ty2
guuaccccuuuuucaauuuccag

SEQ ID NO: 3744228 - RNA, 14 nt, Salmonella enterica enterica serovar Typhi Ty2
guuaccgccgagca

SEQ ID NO: 3744229 - RNA, 21 nt, Salmonella enterica enterica serovar Typhi Ty2
guuaccgccggcuucgucuuu

SEQ ID NO: 3744230 - RNA, 23 nt, Salmonella enterica enterica serovar Typhi Ty2
guuaccucaaaaaccaguugcca

SEQ ID NO: 3744231 - RNA, 20 nt, Salmonella enterica enterica serovar Typhi Ty2
guuacgcacgccagauaaau

SEQ ID NO: 3744232 - RNA, 19 nt, Salmonella enterica enterica serovar Typhi Ty2
guuacgcauuucaagcagg

SEQ ID NO: 3744233 - RNA, 16 nt, Salmonella enterica enterica serovar Typhi Ty2
guuacgcgcugcaaau

SEQ ID NO: 3744234 - RNA, 24 nt, Salmonella enterica enterica serovar Typhi Ty2
guuacgcgcugcaaauacugcuuu

SEQ ID NO: 3744235 - RNA, 16 nt, Salmonella enterica enterica serovar Typhi Ty2
guuacggaaaaaauac

SEQ ID NO: 3744236 - RNA, 15 nt, Salmonella enterica enterica serovar Typhi Ty2
guuacuauuuuucac

SEQ ID NO: 3744237 - RNA, 14 nt, Salmonella enterica enterica serovar Typhi Ty2
guuacucgauggca

SEQ ID NO: 3744238 - RNA, 16 nt, Salmonella enterica enterica serovar Typhi Ty2
guuacucuuccaccau

SEQ ID NO: 3744239 - RNA, 20 nt, Salmonella enterica enterica serovar Typhi Ty2
guuacucuuccuccccaggc

SEQ ID NO: 3744240 - RNA, 22 nt, Salmonella enterica enterica serovar Typhi Ty2
guuacucuuccuccccaggcgc

SEQ ID NO: 3744241 - RNA, 13 nt, Salmonella enterica enterica serovar Typhi Ty2
guucaucucuucc

SEQ ID NO: 3744242 - RNA, 23 nt, Salmonella enterica enterica serovar Typhi Ty2
guucaucucuucccgucgcagca

SEQ ID NO: 3744243 - RNA, 22 nt, Salmonella enterica enterica serovar Typhi Ty2
guucaugcaauuccgcuuucuu

SEQ ID NO: 3744244 - RNA, 22 nt, Salmonella enterica enterica serovar Typhi Ty2
guucaugccgacgauuugcgcu

SEQ ID NO: 3744245 - RNA, 16 nt, Salmonella enterica enterica serovar Typhi Ty2
guucaugcuggucagc

SEQ ID NO: 3744246 - RNA, 14 nt, Salmonella enterica enterica serovar Typhi Ty2
guucauggcaaaag

SEQ ID NO: 3744247 - RNA, 12 nt, Salmonella enterica enterica serovar Typhi Ty2
guucauucgcca

SEQ ID NO: 3744248 - RNA, 15 nt, Salmonella enterica enterica serovar Typhi Ty2
guucauugcuuucuu

SEQ ID NO: 3744249 - RNA, 21 nt, Salmonella enterica enterica serovar Typhi Ty2
guucauuucaggcaaaggaau

SEQ ID NO: 3744250 - RNA, 22 nt, Salmonella enterica enterica serovar Typhi Ty2
guuccacaaucaaauggcuggc

SEQ ID NO: 3744251 - RNA, 18 nt, Salmonella enterica enterica serovar Typhi Ty2
guuccacacguccauccg

SEQ ID NO: 3744252 - RNA, 20 nt, Salmonella enterica enterica serovar Typhi Ty2
guuccaccgucuaucgugga

SEQ ID NO: 3744253 - RNA, 21 nt, Salmonella enterica enterica serovar Typhi Ty2
guuccacgggaucguuuuauc

SEQ ID NO: 3744254 - RNA, 17 nt, Salmonella enterica enterica serovar Typhi Ty2
guuccagaggcauuauu

SEQ ID NO: 3744255 - RNA, 20 nt, Salmonella enterica enterica serovar Typhi Ty2
guuccagauaauccagcguc

SEQ ID NO: 3744256 - RNA, 21 nt, Salmonella enterica enterica serovar Typhi Ty2
guuccagcagcgcaucauggu

SEQ ID NO: 3744257 - RNA, 17 nt, Salmonella enterica enterica serovar Typhi Ty2
guuccagccgccaggca

SEQ ID NO: 3744258 - RNA, 12 nt, Salmonella enterica enterica serovar Typhi Ty2
guuccagcuuga

SEQ ID NO: 3744259 - RNA, 22 nt, Salmonella enterica enterica serovar Typhi Ty2
guuccaggcgaaccauaauaaa

SEQ ID NO: 3744260 - RNA, 13 nt, Salmonella enterica enterica serovar Typhi Ty2
guuccaggcgcgc

SEQ ID NO: 3744261 - RNA, 17 nt, Salmonella enterica enterica serovar Typhi Ty2
guuccaucacuuccugu

SEQ ID NO: 3744262 - RNA, 18 nt, Salmonella enterica enterica serovar Typhi Ty2
guuccauuccagaacgaa

SEQ ID NO: 3744263 - RNA, 22 nt, Salmonella enterica enterica serovar Typhi Ty2
guuccauuccagaaucuggccg

SEQ ID NO: 3744264 - RNA, 23 nt, Salmonella enterica enterica serovar Typhi Ty2
guucccagcgggaacaucacgga

SEQ ID NO: 3744265 - RNA, 15 nt, Salmonella enterica enterica serovar Typhi Ty2
guucccaugcuucca

SEQ ID NO: 3744266 - RNA, 16 nt, Salmonella enterica enterica serovar Typhi Ty2
guuccccgugcccggc

SEQ ID NO: 3744267 - RNA, 14 nt, Salmonella enterica enterica serovar Typhi Ty2
guucccgaaaaucc

SEQ ID NO: 3744268 - RNA, 20 nt, Salmonella enterica enterica serovar Typhi Ty2
guucccgagcggccaaaggg

SEQ ID NO: 3744269 - RNA, 16 nt, Salmonella enterica enterica serovar Typhi Ty2
guuccgccagauacaa

SEQ ID NO: 3744270 - RNA, 20 nt, Salmonella enterica enterica serovar Typhi Ty2
guuccgccaggcgagcacac

SEQ ID NO: 3744271 - RNA, 21 nt, Salmonella enterica enterica serovar Typhi Ty2
guuccgccccgccuuccgcgg

SEQ ID NO: 3744272 - RNA, 17 nt, Salmonella enterica enterica serovar Typhi Ty2
guuccgcgauuuccugu

SEQ ID NO: 3744273 - RNA, 13 nt, Salmonella enterica enterica serovar Typhi Ty2
guuccgcuaccug

SEQ ID NO: 3744274 - RNA, 21 nt, Salmonella enterica enterica serovar Typhi Ty2
guuccucguccugauccggcu

SEQ ID NO: 3744275 - RNA, 14 nt, Salmonella enterica enterica serovar Typhi Ty2
guuccucuuacgcu

SEQ ID NO: 3744276 - RNA, 16 nt, Salmonella enterica enterica serovar Typhi Ty2
guuccugagcagacau

SEQ ID NO: 3744277 - RNA, 19 nt, Salmonella enterica enterica serovar Typhi Ty2
guuccugcacccgaauaaa

SEQ ID NO: 3744278 - RNA, 16 nt, Salmonella enterica enterica serovar Typhi Ty2
guuccugcuggcaaaa

SEQ ID NO: 3744279 - RNA, 16 nt, Salmonella enterica enterica serovar Typhi Ty2
guuccuuuacuucuuu

SEQ ID NO: 3744280 - RNA, 20 nt, Salmonella enterica enterica serovar Typhi Ty2
guucgaauccagguacccca

SEQ ID NO: 3744281 - RNA, 16 nt, Salmonella enterica enterica serovar Typhi Ty2
guucgauacuauaacg

SEQ ID NO: 3744282 - RNA, 22 nt, Salmonella enterica enterica serovar Typhi Ty2
guucgauuuuuucgacauuacc

SEQ ID NO: 3744283 - RNA, 19 nt, Salmonella enterica enterica serovar Typhi Ty2
guucgcauauucugcgaaa

SEQ ID NO: 3744284 - RNA, 15 nt, Salmonella enterica enterica serovar Typhi Ty2
guucgccagugacaa

SEQ ID NO: 3744285 - RNA, 15 nt, Salmonella enterica enterica serovar Typhi Ty2
guucgccgcgcgcau

SEQ ID NO: 3744286 - RNA, 19 nt, Salmonella enterica enterica serovar Typhi Ty2
guucgccuucguuauaagg

SEQ ID NO: 3744287 - RNA, 13 nt, Salmonella enterica enterica serovar Typhi Ty2
guucgcgacugau

SEQ ID NO: 3744288 - RNA, 18 nt, Salmonella enterica enterica serovar Typhi Ty2
guucgcgcaauucuucua

SEQ ID NO: 3744289 - RNA, 17 nt, Salmonella enterica enterica serovar Typhi Ty2
guucgcggggguuauuc

SEQ ID NO: 3744290 - RNA, 17 nt, Salmonella enterica enterica serovar Typhi Ty2
guucgcuucugccgcca

SEQ ID NO: 3744291 - RNA, 23 nt, Salmonella enterica enterica serovar Typhi Ty2
guucgcuuucauacgacgacggu

SEQ ID NO: 3744292 - RNA, 15 nt, Salmonella enterica enterica serovar Typhi Ty2
guucggaagacugcu

SEQ ID NO: 3744293 - RNA, 18 nt, Salmonella enterica enterica serovar Typhi Ty2
guucggagaucagcggau

SEQ ID NO: 3744294 - RNA, 17 nt, Salmonella enterica enterica serovar Typhi Ty2
guucggauaaacgcugc

SEQ ID NO: 3744295 - RNA, 16 nt, Salmonella enterica enterica serovar Typhi Ty2
guucggguuuuccugc

SEQ ID NO: 3744296 - RNA, 18 nt, Salmonella enterica enterica serovar Typhi Ty2
guucuaaacguucaucuu

SEQ ID NO: 3744297 - RNA, 14 nt, Salmonella enterica enterica serovar Typhi Ty2
guucuaacaggaag

SEQ ID NO: 3744298 - RNA, 21 nt, Salmonella enterica enterica serovar Typhi Ty2
guucuaucagguaucccgcca

SEQ ID NO: 3744299 - RNA, 20 nt, Salmonella enterica enterica serovar Typhi Ty2
guucucgcgccaccugcacg

SEQ ID NO: 3744300 - RNA, 21 nt, Salmonella enterica enterica serovar Typhi Ty2
guucucgcgccaccugcacgg

SEQ ID NO: 3744301 - RNA, 19 nt, Salmonella enterica enterica serovar Typhi Ty2
guucugagcggauucgacu

SEQ ID NO: 3744302 - RNA, 18 nt, Salmonella enterica enterica serovar Typhi Ty2
guucugaggcuauuguca

SEQ ID NO: 3744303 - RNA, 19 nt, Salmonella enterica enterica serovar Typhi Ty2
guucugcgccauuuccagc

SEQ ID NO: 3744304 - RNA, 20 nt, Salmonella enterica enterica serovar Typhi Ty2
guucugcgucgcgcauggca

SEQ ID NO: 3744305 - RNA, 22 nt, Salmonella enterica enterica serovar Typhi Ty2
guucugcugauaauacugccgc

SEQ ID NO: 3744306 - RNA, 15 nt, Salmonella enterica enterica serovar Typhi Ty2
guucuggcugcgcuu

SEQ ID NO: 3744307 - RNA, 17 nt, Salmonella enterica enterica serovar Typhi Ty2
guucuguaggcugugca

SEQ ID NO: 3744308 - RNA, 15 nt, Salmonella enterica enterica serovar Typhi Ty2
guucuugccgccauc

SEQ ID NO: 3744309 - RNA, 19 nt, Salmonella enterica enterica serovar Typhi Ty2
guucuugcugcugcugaug

SEQ ID NO: 3744310 - RNA, 13 nt, Salmonella enterica enterica serovar Typhi Ty2
guucuuucaccau

SEQ ID NO: 3744311 - RNA, 14 nt, Salmonella enterica enterica serovar Typhi Ty2
guucuuuccaguuc

SEQ ID NO: 3744312 - RNA, 16 nt, Salmonella enterica enterica serovar Typhi Ty2
guucuuuucuuucagc

SEQ ID NO: 3744313 - RNA, 14 nt, Salmonella enterica enterica serovar Typhi Ty2
guugaaagccccgg

SEQ ID NO: 3744314 - RNA, 14 nt, Salmonella enterica enterica serovar Typhi Ty2
guugaaauccucua

SEQ ID NO: 3744315 - RNA, 14 nt, Salmonella enterica enterica serovar Typhi Ty2
guugaacauuucau

SEQ ID NO: 3744316 - RNA, 17 nt, Salmonella enterica enterica serovar Typhi Ty2
guugaaccgucaucagc

SEQ ID NO: 3744317 - RNA, 20 nt, Salmonella enterica enterica serovar Typhi Ty2
guugaagcgaccagcgcgcc

SEQ ID NO: 3744318 - RNA, 18 nt, Salmonella enterica enterica serovar Typhi Ty2
guugaauaucgcuuuuuc

SEQ ID NO: 3744319 - RNA, 12 nt, Salmonella enterica enterica serovar Typhi Ty2
guugaccacauc

SEQ ID NO: 3744320 - RNA, 23 nt, Salmonella enterica enterica serovar Typhi Ty2
guugaccagccuaccugccgcca

SEQ ID NO: 3744321 - RNA, 23 nt, Salmonella enterica enterica serovar Typhi Ty2
guugaccaguccgcacgccugca

SEQ ID NO: 3744322 - RNA, 19 nt, Salmonella enterica enterica serovar Typhi Ty2
guugaccugaucggccagc

SEQ ID NO: 3744323 - RNA, 18 nt, Salmonella enterica enterica serovar Typhi Ty2
guuuagaaaaaauuaaaa

SEQ ID NO: 3744324 - RNA, 14 nt, Salmonella enterica enterica serovar Typhi Ty2
guuuagaaaauaua

SEQ ID NO: 3744325 - RNA, 14 nt, Salmonella enterica enterica serovar Typhi Ty2
guuuagcgccagca

SEQ ID NO: 3744326 - RNA, 17 nt, Salmonella enterica enterica serovar Typhi Ty2
guuuagcgccagcagca

SEQ ID NO: 3744327 - RNA, 17 nt, Salmonella enterica enterica serovar Typhi Ty2
guuuagcuguucaauca

SEQ ID NO: 3744328 - RNA, 17 nt, Salmonella enterica enterica serovar Typhi Ty2
guuuauauaaaaauagc

SEQ ID NO: 3744329 - RNA, 19 nt, Salmonella enterica enterica serovar Typhi Ty2
guuuauccagcacgguaaa

SEQ ID NO: 3744330 - RNA, 17 nt, Salmonella enterica enterica serovar Typhi Ty2
guuuauccccgcuggug

SEQ ID NO: 3744331 - RNA, 17 nt, Salmonella enterica enterica serovar Typhi Ty2
guuuaucgcgugguaug

SEQ ID NO: 3744332 - RNA, 21 nt, Salmonella enterica enterica serovar Typhi Ty2
guuuaucuggcuuacaggcac

SEQ ID NO: 3744333 - RNA, 22 nt, Salmonella enterica enterica serovar Typhi Ty2
guuuauggccgcguuucgcgau

SEQ ID NO: 3744334 - RNA, 14 nt, Salmonella enterica enterica serovar Typhi Ty2
guuuauguuugcug

SEQ ID NO: 3744335 - RNA, 15 nt, Salmonella enterica enterica serovar Typhi Ty2
guuuauuauaaacac

SEQ ID NO: 3744336 - RNA, 15 nt, Salmonella enterica enterica serovar Typhi Ty2
guuuauucagaaaau

SEQ ID NO: 3744337 - RNA, 13 nt, Salmonella enterica enterica serovar Typhi Ty2
guuuauucaucuc

SEQ ID NO: 3744338 - RNA, 18 nt, Salmonella enterica enterica serovar Typhi Ty2
guuuauucaucuccucuu

SEQ ID NO: 3744339 - RNA, 21 nt, Salmonella enterica enterica serovar Typhi Ty2
guuuauugccgcuucuuuauu

SEQ ID NO: 3744340 - RNA, 17 nt, Salmonella enterica enterica serovar Typhi Ty2
guuuauuuaagcuuacu

SEQ ID NO: 3744341 - RNA, 19 nt, Salmonella enterica enterica serovar Typhi Ty2
guuucaagcaguuccagca

SEQ ID NO: 3744342 - RNA, 15 nt, Salmonella enterica enterica serovar Typhi Ty2
guuucaauccaugua

SEQ ID NO: 3744343 - RNA, 19 nt, Salmonella enterica enterica serovar Typhi Ty2
guuucaaugcccaggcgcc

SEQ ID NO: 3744344 - RNA, 13 nt, Salmonella enterica enterica serovar Typhi Ty2
guuucaccagcac

SEQ ID NO: 3744345 - RNA, 14 nt, Salmonella enterica enterica serovar Typhi Ty2
guuucaccguuuuc

SEQ ID NO: 3744346 - RNA, 12 nt, Salmonella enterica enterica serovar Typhi Ty2
guuucaccuucu

SEQ ID NO: 3744347 - RNA, 17 nt, Salmonella enterica enterica serovar Typhi Ty2
guuucacgcucuucgcc

SEQ ID NO: 3744348 - RNA, 17 nt, Salmonella enterica enterica serovar Typhi Ty2
guuucacguccugguua

SEQ ID NO: 3744349 - RNA, 19 nt, Salmonella enterica enterica serovar Typhi Ty2
guuucagcaccuccagcgc

SEQ ID NO: 3744350 - RNA, 18 nt, Salmonella enterica enterica serovar Typhi Ty2
guuucaguaaaucccgca

SEQ ID NO: 3744351 - RNA, 14 nt, Salmonella enterica enterica serovar Typhi Ty2
guuucagugauaaa

SEQ ID NO: 3744352 - RNA, 21 nt, Salmonella enterica enterica serovar Typhi Ty2
guuucaguucggagaucagcg

SEQ ID NO: 3744353 - RNA, 17 nt, Salmonella enterica enterica serovar Typhi Ty2
guuuccacugagcuuca

SEQ ID NO: 3744354 - RNA, 14 nt, Salmonella enterica enterica serovar Typhi Ty2
guuuccagccaguc

SEQ ID NO: 3744355 - RNA, 14 nt, Salmonella enterica enterica serovar Typhi Ty2
guuuccagugcagc

SEQ ID NO: 3744356 - RNA, 13 nt, Salmonella enterica enterica serovar Typhi Ty2
guuucccagguuu

SEQ ID NO: 3744357 - RNA, 22 nt, Salmonella enterica enterica serovar Typhi Ty2
guuucccauugggccagcagcg

SEQ ID NO: 3744358 - RNA, 21 nt, Salmonella enterica enterica serovar Typhi Ty2
guuucccgcgcggaaggcgcc

SEQ ID NO: 3744359 - RNA, 12 nt, Salmonella enterica enterica serovar Typhi Ty2
guuucccugacc

SEQ ID NO: 3744360 - RNA, 17 nt, Salmonella enterica enterica serovar Typhi Ty2
guuuccgcuagggcauc

SEQ ID NO: 3744361 - RNA, 21 nt, Salmonella enterica enterica serovar Typhi Ty2
guuuccgcuagggcaucagac

SEQ ID NO: 3744362 - RNA, 19 nt, Salmonella enterica enterica serovar Typhi Ty2
guuuccggcauccagcgcu

SEQ ID NO: 3744363 - RNA, 14 nt, Salmonella enterica enterica serovar Typhi Ty2
guuuccggcgggag

SEQ ID NO: 3744364 - RNA, 22 nt, Salmonella enterica enterica serovar Typhi Ty2
guuuccguuuguaacauauuuu

SEQ ID NO: 3744365 - RNA, 18 nt, Salmonella enterica enterica serovar Typhi Ty2
guuucgacaguuucuucu

SEQ ID NO: 3744366 - RNA, 14 nt, Salmonella enterica enterica serovar Typhi Ty2
guuucggcauccca

SEQ ID NO: 3744367 - RNA, 21 nt, Salmonella enterica enterica serovar Typhi Ty2
guuucuacaccuucuucgcca

SEQ ID NO: 3744368 - RNA, 18 nt, Salmonella enterica enterica serovar Typhi Ty2
guuucuagaugaugauuu

SEQ ID NO: 3744369 - RNA, 19 nt, Salmonella enterica enterica serovar Typhi Ty2
guuucucuuccgccagcgc

SEQ ID NO: 3744370 - RNA, 19 nt, Salmonella enterica enterica serovar Typhi Ty2
guuucucuugugcuuccag

SEQ ID NO: 3744371 - RNA, 22 nt, Salmonella enterica enterica serovar Typhi Ty2
guuucucuugugcuuccagcuc

SEQ ID NO: 3744372 - RNA, 15 nt, Salmonella enterica enterica serovar Typhi Ty2
guuucuucgcuggcg

SEQ ID NO: 3744373 - RNA, 13 nt, Salmonella enterica enterica serovar Typhi Ty2
guuugacggcugc

SEQ ID NO: 3744374 - RNA, 19 nt, Salmonella enterica enterica serovar Typhi Ty2
guuugagaaaaacaucaug

SEQ ID NO: 3744375 - RNA, 21 nt, Salmonella enterica enterica serovar Typhi Ty2
guuugaggaaaccuuucuucu

SEQ ID NO: 3744376 - RNA, 23 nt, Salmonella enterica enterica serovar Typhi Ty2
guuugaggaaaccuuucuucucu

SEQ ID NO: 3744377 - RNA, 18 nt, Salmonella enterica enterica serovar Typhi Ty2
guuugauaaacugcgcca

SEQ ID NO: 3744378 - RNA, 18 nt, Salmonella enterica enterica serovar Typhi Ty2
guuugccagcaccagcag

SEQ ID NO: 3744379 - RNA, 19 nt, Salmonella enterica enterica serovar Typhi Ty2
guuugccccauuguucuuu

SEQ ID NO: 3744380 - RNA, 12 nt, Salmonella enterica enterica serovar Typhi Ty2
guuugcgcgucg

SEQ ID NO: 3744381 - RNA, 18 nt, Salmonella enterica enterica serovar Typhi Ty2
guuuggacuaccgguaaa

SEQ ID NO: 3744382 - RNA, 21 nt, Salmonella enterica enterica serovar Typhi Ty2
guuuggcaaucaaauccagcu

SEQ ID NO: 3744383 - RNA, 22 nt, Salmonella enterica enterica serovar Typhi Ty2
guuuggcaaucaaauccagcuc

SEQ ID NO: 3744384 - RNA, 15 nt, Salmonella enterica enterica serovar Typhi Ty2
guuuguaggccggau

SEQ ID NO: 3744385 - RNA, 14 nt, Salmonella enterica enterica serovar Typhi Ty2
guuugucauccaga

SEQ ID NO: 3744386 - RNA, 13 nt, Salmonella enterica enterica serovar Typhi Ty2
guuugucucaggu

SEQ ID NO: 3744387 - RNA, 18 nt, Salmonella enterica enterica serovar Typhi Ty2
guuugugguugguagccc

SEQ ID NO: 3744388 - RNA, 14 nt, Salmonella enterica enterica serovar Typhi Ty2
guuuuaaucuuuua

SEQ ID NO: 3744389 - RNA, 13 nt, Salmonella enterica enterica serovar Typhi Ty2
guuuuaauuccug

SEQ ID NO: 3744390 - RNA, 18 nt, Salmonella enterica enterica serovar Typhi Ty2
guuuuaccgcccgacgga

SEQ ID NO: 3744391 - RNA, 17 nt, Salmonella enterica enterica serovar Typhi Ty2
guuuuacuuccuguagc

SEQ ID NO: 3744392 - RNA, 11 nt, Salmonella enterica enterica serovar Typhi Ty2
guuuuaucaug

SEQ ID NO: 3744393 - RNA, 17 nt, Salmonella enterica enterica serovar Typhi Ty2
guuuuauccccuucagg

SEQ ID NO: 3744394 - RNA, 14 nt, Salmonella enterica enterica serovar Typhi Ty2
guuuuauccguuuc

SEQ ID NO: 3744395 - RNA, 14 nt, Salmonella enterica enterica serovar Typhi Ty2
guuuuaucgcccgg

SEQ ID NO: 3744396 - RNA, 22 nt, Salmonella enterica enterica serovar Typhi Ty2
guuuucaggccgcguaauuuuu

SEQ ID NO: 3744397 - RNA, 14 nt, Salmonella enterica enterica serovar Typhi Ty2
guuuucaggucaua

SEQ ID NO: 3744398 - RNA, 15 nt, Salmonella enterica enterica serovar Typhi Ty2
guuuucaucgguggc

SEQ ID NO: 3744399 - RNA, 13 nt, Salmonella enterica enterica serovar Typhi Ty2
guuuucauuagcc

SEQ ID NO: 3744400 - RNA, 17 nt, Salmonella enterica enterica serovar Typhi Ty2
guuuucauuagccgcca

SEQ ID NO: 3744401 - RNA, 12 nt, Salmonella enterica enterica serovar Typhi Ty2
guuuuccagcuc

SEQ ID NO: 3744402 - RNA, 22 nt, Salmonella enterica enterica serovar Typhi Ty2
guuuuccgguauuuauccagca

SEQ ID NO: 3744403 - RNA, 18 nt, Salmonella enterica enterica serovar Typhi Ty2
guuuuccguaggccggaa

SEQ ID NO: 3744404 - RNA, 14 nt, Salmonella enterica enterica serovar Typhi Ty2
guuuucgccuuugc

SEQ ID NO: 3744405 - RNA, 18 nt, Salmonella enterica enterica serovar Typhi Ty2
guuuucgucccagcgcac

SEQ ID NO: 3744406 - RNA, 19 nt, Salmonella enterica enterica serovar Typhi Ty2
guuuucgucccagcgcacc

SEQ ID NO: 3744407 - RNA, 23 nt, Salmonella enterica enterica serovar Typhi Ty2
guuuucuauuuucuccggcaguc

SEQ ID NO: 3744408 - RNA, 16 nt, Salmonella enterica enterica serovar Typhi Ty2
guuuucucauccagcu

SEQ ID NO: 3744409 - RNA, 17 nt, Salmonella enterica enterica serovar Typhi Ty2
guuuucuguacagcguc

SEQ ID NO: 3744410 - RNA, 12 nt, Salmonella enterica enterica serovar Typhi Ty2
guuuugcucagu

SEQ ID NO: 3744411 - RNA, 15 nt, Salmonella enterica enterica serovar Typhi Ty2
guuuugcucaguaac

SEQ ID NO: 3744412 - RNA, 18 nt, Salmonella enterica enterica serovar Typhi Ty2
guuuugcugauaugaaac

SEQ ID NO: 3744413 - RNA, 12 nt, Salmonella enterica enterica serovar Typhi Ty2
guuuugcugaug

SEQ ID NO: 3744414 - RNA, 15 nt, Salmonella enterica enterica serovar Typhi Ty2
guuuugcuggaauuu

SEQ ID NO: 3744415 - RNA, 16 nt, Salmonella enterica enterica serovar Typhi Ty2
guuuugcugucugggu

SEQ ID NO: 3744416 - RNA, 20 nt, Salmonella enterica enterica serovar Typhi Ty2
guuuugguaucuucugacgg

SEQ ID NO: 3744417 - RNA, 16 nt, Salmonella enterica enterica serovar Typhi Ty2
guuuuuaacgccggca

SEQ ID NO: 3744418 - RNA, 18 nt, Salmonella enterica enterica serovar Typhi Ty2
guuuuuacacugaagccu

SEQ ID NO: 3744419 - RNA, 15 nt, Salmonella enterica enterica serovar Typhi Ty2
guuuuuaucuuucuu

SEQ ID NO: 3744420 - RNA, 15 nt, Salmonella enterica enterica serovar Typhi Ty2
guuuuuauuuuucuu

SEQ ID NO: 3744421 - RNA, 14 nt, Salmonella enterica enterica serovar Typhi Ty2
guuuuucaucauca

SEQ ID NO: 3744422 - RNA, 18 nt, Salmonella enterica enterica serovar Typhi Ty2
guuuuuccuuucugcgcc

SEQ ID NO: 3744423 - RNA, 19 nt, Salmonella enterica enterica serovar Typhi Ty2
guuuuuccuuucugcgcca

SEQ ID NO: 3744424 - RNA, 17 nt, Salmonella enterica enterica serovar Typhi Ty2
guuuuucgaaaauuucg

SEQ ID NO: 3744425 - RNA, 14 nt, Salmonella enterica enterica serovar Typhi Ty2
guuuuucucaucaa

SEQ ID NO: 3744426 - RNA, 18 nt, Salmonella enterica enterica serovar Typhi Ty2
guuuuugcgccauugccg

SEQ ID NO: 3744427 - RNA, 17 nt, Salmonella enterica enterica serovar Typhi Ty2
guuuuugucuccucaug

SEQ ID NO: 3744428 - RNA, 13 nt, Salmonella enterica enterica serovar Typhi Ty2
guuuuuucaucuc

SEQ ID NO: 3744429 - RNA, 17 nt, Salmonella enterica enterica serovar Typhi Ty2
guuuuuuguugauuuua

SEQ ID NO: 3744430 - RNA, 21 nt, Salmonella enterica enterica serovar Typhi Ty2
uaaaaaaaccucuaccuacac

SEQ ID NO: 3744431 - RNA, 19 nt, Salmonella enterica enterica serovar Typhi Ty2
uaaaaaaauaaaaaaggca

SEQ ID NO: 3744432 - RNA, 18 nt, Salmonella enterica enterica serovar Typhi Ty2
uaaaaaacaccugucugu

SEQ ID NO: 3744433 - RNA, 11 nt, Salmonella enterica enterica serovar Typhi Ty2
uaaaaaacagg

SEQ ID NO: 3744434 - RNA, 16 nt, Salmonella enterica enterica serovar Typhi Ty2
uaaaaaacaggcgcag

SEQ ID NO: 3744435 - RNA, 12 nt, Salmonella enterica enterica serovar Typhi Ty2
uaaaaaacauca

SEQ ID NO: 3744436 - RNA, 19 nt, Salmonella enterica enterica serovar Typhi Ty2
uaaaaaacaucauaauaau

SEQ ID NO: 3744437 - RNA, 16 nt, Salmonella enterica enterica serovar Typhi Ty2
uaaaaaaccggaauuu

SEQ ID NO: 3744438 - RNA, 21 nt, Salmonella enterica enterica serovar Typhi Ty2
uaaaaaagccguauuuuauuu

SEQ ID NO: 3744439 - RNA, 20 nt, Salmonella enterica enterica serovar Typhi Ty2
uaaaaaaggcagaagaaucu

SEQ ID NO: 3744440 - RNA, 23 nt, Salmonella enterica enterica serovar Typhi Ty2
uaaaaaaggcagaagaaucugcc

SEQ ID NO: 3744441 - RNA, 21 nt, Salmonella enterica enterica serovar Typhi Ty2
uaaaaaaggccgcuuaauaau

SEQ ID NO: 3744442 - RNA, 22 nt, Salmonella enterica enterica serovar Typhi Ty2
uaaaaaaggccgcuuaauaaua

SEQ ID NO: 3744443 - RNA, 14 nt, Salmonella enterica enterica serovar Typhi Ty2
uaaaaaaggcucgc

SEQ ID NO: 3744444 - RNA, 17 nt, Salmonella enterica enterica serovar Typhi Ty2
uaaaaaauccugcacuu

SEQ ID NO: 3744445 - RNA, 15 nt, Salmonella enterica enterica serovar Typhi Ty2
uaaaaacaauaaaua

SEQ ID NO: 3744446 - RNA, 17 nt, Salmonella enterica enterica serovar Typhi Ty2
uaaaaaccagaauuucc

SEQ ID NO: 3744447 - RNA, 20 nt, Salmonella enterica enterica serovar Typhi Ty2
uaaaaaccagaauuuccaga

SEQ ID NO: 3744448 - RNA, 12 nt, Salmonella enterica enterica serovar Typhi Ty2
uaaaaaccaggc

SEQ ID NO: 3744449 - RNA, 15 nt, Salmonella enterica enterica serovar Typhi Ty2
uaaaaacccaccagc

SEQ ID NO: 3744450 - RNA, 16 nt, Salmonella enterica enterica serovar Typhi Ty2
uaaaaacccaccagcg

SEQ ID NO: 3744451 - RNA, 18 nt, Salmonella enterica enterica serovar Typhi Ty2
uaaaaacccuuucauucg

SEQ ID NO: 3744452 - RNA, 18 nt, Salmonella enterica enterica serovar Typhi Ty2
uaaaaacggguaggccgg

SEQ ID NO: 3744453 - RNA, 22 nt, Salmonella enterica enterica serovar Typhi Ty2
uaaaaagcacaucagcaaauga

SEQ ID NO: 3744454 - RNA, 17 nt, Salmonella enterica enterica serovar Typhi Ty2
uaaaaagcguacaaaaa

SEQ ID NO: 3744455 - RNA, 17 nt, Salmonella enterica enterica serovar Typhi Ty2
uaaaaagcgucaguaaa

SEQ ID NO: 3744456 - RNA, 10 nt, Salmonella enterica enterica serovar Typhi Ty2
uaaaaaggaa

SEQ ID NO: 3744457 - RNA, 11 nt, Salmonella enterica enterica serovar Typhi Ty2
uaaaaaggaca

SEQ ID NO: 3744458 - RNA, 21 nt, Salmonella enterica enterica serovar Typhi Ty2
uaaaaaggugagcgcaaugcu

SEQ ID NO: 3744459 - RNA, 22 nt, Salmonella enterica enterica serovar Typhi Ty2
uaaaaauaacgcgauaaucccc

SEQ ID NO: 3744460 - RNA, 16 nt, Salmonella enterica enterica serovar Typhi Ty2
uaaaaauauccgccau

SEQ ID NO: 3744461 - RNA, 21 nt, Salmonella enterica enterica serovar Typhi Ty2
uaaaaauauggcgggccugug

SEQ ID NO: 3744462 - RNA, 20 nt, Salmonella enterica enterica serovar Typhi Ty2
uaaaaauauggggguaaaca

SEQ ID NO: 3744463 - RNA, 17 nt, Salmonella enterica enterica serovar Typhi Ty2
uaaaaauauuucagcag

SEQ ID NO: 3744464 - RNA, 22 nt, Salmonella enterica enterica serovar Typhi Ty2
uaaaaaucauccuucgggcgau

SEQ ID NO: 3744465 - RNA, 18 nt, Salmonella enterica enterica serovar Typhi Ty2
uaaaaaugaggugaaaca

SEQ ID NO: 3744466 - RNA, 18 nt, Salmonella enterica enterica serovar Typhi Ty2
uaaaacauuccugacauu

SEQ ID NO: 3744467 - RNA, 18 nt, Salmonella enterica enterica serovar Typhi Ty2
uaaaaccagggaagcuac

SEQ ID NO: 3744468 - RNA, 17 nt, Salmonella enterica enterica serovar Typhi Ty2
uaaaaccggcacaucca

SEQ ID NO: 3744469 - RNA, 22 nt, Salmonella enterica enterica serovar Typhi Ty2
uaaaaccggucuggcucacuga

SEQ ID NO: 3744470 - RNA, 23 nt, Salmonella enterica enterica serovar Typhi Ty2
uaaaaccguagauuuucaucaua

SEQ ID NO: 3744471 - RNA, 16 nt, Salmonella enterica enterica serovar Typhi Ty2
uaaaacgacucaucag

SEQ ID NO: 3744472 - RNA, 22 nt, Salmonella enterica enterica serovar Typhi Ty2
uaaaacgcauacugagcaucca

SEQ ID NO: 3744473 - RNA, 20 nt, Salmonella enterica enterica serovar Typhi Ty2
uaaaacggcuuuucuucauc

SEQ ID NO: 3744474 - RNA, 22 nt, Salmonella enterica enterica serovar Typhi Ty2
uaaaacguuauuggcaggaugu

SEQ ID NO: 3744475 - RNA, 23 nt, Salmonella enterica enterica serovar Typhi Ty2
uaaaagaagaaaccgcagaaaaa

SEQ ID NO: 3744476 - RNA, 22 nt, Salmonella enterica enterica serovar Typhi Ty2
uaaaagcccuuaucgccccagc

SEQ ID NO: 3744477 - RNA, 13 nt, Salmonella enterica enterica serovar Typhi Ty2
uaaaaguuagccc

SEQ ID NO: 3744478 - RNA, 17 nt, Salmonella enterica enterica serovar Typhi Ty2
uaaaaguuagccccuua

SEQ ID NO: 3744479 - RNA, 13 nt, Salmonella enterica enterica serovar Typhi Ty2
uaaaauaaacacu

SEQ ID NO: 3744480 - RNA, 14 nt, Salmonella enterica enterica serovar Typhi Ty2
uaaaauaaacacua

SEQ ID NO: 3744481 - RNA, 20 nt, Salmonella enterica enterica serovar Typhi Ty2
uaaaauaaacacuaaaucau

SEQ ID NO: 3744482 - RNA, 21 nt, Salmonella enterica enterica serovar Typhi Ty2
uaaaauacgcucaauauacuu

SEQ ID NO: 3744483 - RNA, 13 nt, Salmonella enterica enterica serovar Typhi Ty2
uaaaauagccauc

SEQ ID NO: 3744484 - RNA, 14 nt, Salmonella enterica enterica serovar Typhi Ty2
uaaaaucaacgcuc

SEQ ID NO: 3744485 - RNA, 23 nt, Salmonella enterica enterica serovar Typhi Ty2
uaaaaucacuaagaccagcauca

SEQ ID NO: 3744486 - RNA, 23 nt, Salmonella enterica enterica serovar Typhi Ty2
uaaaauccggcaggcagccggau

SEQ ID NO: 3744487 - RNA, 15 nt, Salmonella enterica enterica serovar Typhi Ty2
uaaauuuuuuaacag

SEQ ID NO: 3744488 - RNA, 13 nt, Salmonella enterica enterica serovar Typhi Ty2
uaacaaaaaacau

SEQ ID NO: 3744489 - RNA, 20 nt, Salmonella enterica enterica serovar Typhi Ty2
uaacaaaccgguaaucccuu

SEQ ID NO: 3744490 - RNA, 15 nt, Salmonella enterica enterica serovar Typhi Ty2
uaacaaaucauuucc

SEQ ID NO: 3744491 - RNA, 20 nt, Salmonella enterica enterica serovar Typhi Ty2
uaacaaauuaaauccugaaa

SEQ ID NO: 3744492 - RNA, 21 nt, Salmonella enterica enterica serovar Typhi Ty2
uaacaaccgggaucuuuuuca

SEQ ID NO: 3744493 - RNA, 17 nt, Salmonella enterica enterica serovar Typhi Ty2
uaacaacuguuuuucac

SEQ ID NO: 3744494 - RNA, 17 nt, Salmonella enterica enterica serovar Typhi Ty2
uaacaauagaccugaaa

SEQ ID NO: 3744495 - RNA, 18 nt, Salmonella enterica enterica serovar Typhi Ty2
uaacaauauuaaauaaau

SEQ ID NO: 3744496 - RNA, 20 nt, Salmonella enterica enterica serovar Typhi Ty2
uaacaauccccgucacagcg

SEQ ID NO: 3744497 - RNA, 20 nt, Salmonella enterica enterica serovar Typhi Ty2
uaacaauccuaccguaacgu

SEQ ID NO: 3744498 - RNA, 15 nt, Salmonella enterica enterica serovar Typhi Ty2
uaacaauuuaucaga

SEQ ID NO: 3744499 - RNA, 18 nt, Salmonella enterica enterica serovar Typhi Ty2
uaacaauuuaucagacaa

SEQ ID NO: 3744500 - RNA, 14 nt, Salmonella enterica enterica serovar Typhi Ty2
uaacacaaucaggc

SEQ ID NO: 3744501 - RNA, 17 nt, Salmonella enterica enterica serovar Typhi Ty2
uaacacacuuucugcuu

SEQ ID NO: 3744502 - RNA, 12 nt, Salmonella enterica enterica serovar Typhi Ty2
uaacacaugcaa

SEQ ID NO: 3744503 - RNA, 19 nt, Salmonella enterica enterica serovar Typhi Ty2
uaacaccgcauggcuggca

SEQ ID NO: 3744504 - RNA, 23 nt, Salmonella enterica enterica serovar Typhi Ty2
uaacaccgcauggcuggcauauu

SEQ ID NO: 3744505 - RNA, 13 nt, Salmonella enterica enterica serovar Typhi Ty2
uaacacuaacuaa

SEQ ID NO: 3744506 - RNA, 13 nt, Salmonella enterica enterica serovar Typhi Ty2
uaacacugccgaa

SEQ ID NO: 3744507 - RNA, 21 nt, Salmonella enterica enterica serovar Typhi Ty2
uaacacuuugaacgagucuua

SEQ ID NO: 3744508 - RNA, 22 nt, Salmonella enterica enterica serovar Typhi Ty2
uaacagacgcaucuuuuucccg

SEQ ID NO: 3744509 - RNA, 20 nt, Salmonella enterica enterica serovar Typhi Ty2
uaacagagagggaaaaaaau

SEQ ID NO: 3744510 - RNA, 13 nt, Salmonella enterica enterica serovar Typhi Ty2
uaacagccagcgg

SEQ ID NO: 3744511 - RNA, 16 nt, Salmonella enterica enterica serovar Typhi Ty2
uaacagcgcgaccagc

SEQ ID NO: 3744512 - RNA, 19 nt, Salmonella enterica enterica serovar Typhi Ty2
uaacagcgcgaccaggaaa

SEQ ID NO: 3744513 - RNA, 21 nt, Salmonella enterica enterica serovar Typhi Ty2
uaacagcgcgaccaggaaacc

SEQ ID NO: 3744514 - RNA, 20 nt, Salmonella enterica enterica serovar Typhi Ty2
uaacagcgcggucgaacaaa

SEQ ID NO: 3744515 - RNA, 19 nt, Salmonella enterica enterica serovar Typhi Ty2
uaacagcgcuaucaggaag

SEQ ID NO: 3744516 - RNA, 21 nt, Salmonella enterica enterica serovar Typhi Ty2
uaacagcgcugguagcaccga

SEQ ID NO: 3744517 - RNA, 23 nt, Salmonella enterica enterica serovar Typhi Ty2
uaacagcuggcuugccagcagau

SEQ ID NO: 3744518 - RNA, 18 nt, Salmonella enterica enterica serovar Typhi Ty2
uaacagcuugaucaucag

SEQ ID NO: 3744519 - RNA, 19 nt, Salmonella enterica enterica serovar Typhi Ty2
uaacagcuugaucaucagg

SEQ ID NO: 3744520 - RNA, 19 nt, Salmonella enterica enterica serovar Typhi Ty2
uaacaggcgccggggcagc

SEQ ID NO: 3744521 - RNA, 21 nt, Salmonella enterica enterica serovar Typhi Ty2
uaacaggcgccggggcagcaa

SEQ ID NO: 3744522 - RNA, 17 nt, Salmonella enterica enterica serovar Typhi Ty2
uaacauaaauaguauua

SEQ ID NO: 3744523 - RNA, 23 nt, Salmonella enterica enterica serovar Typhi Ty2
uaacauaaauaguauuaguugau

SEQ ID NO: 3744524 - RNA, 12 nt, Salmonella enterica enterica serovar Typhi Ty2
uaacauaaccgg

SEQ ID NO: 3744525 - RNA, 14 nt, Salmonella enterica enterica serovar Typhi Ty2
uaacaucaaguaca

SEQ ID NO: 3744526 - RNA, 17 nt, Salmonella enterica enterica serovar Typhi Ty2
uaacaucaccuuucauu

SEQ ID NO: 3744527 - RNA, 14 nt, Salmonella enterica enterica serovar Typhi Ty2
uaacaucaucaggc

SEQ ID NO: 3744528 - RNA, 16 nt, Salmonella enterica enterica serovar Typhi Ty2
uaacaucguaaaucaa

SEQ ID NO: 3744529 - RNA, 18 nt, Salmonella enterica enterica serovar Typhi Ty2
uaacaucuuccaugccuu

SEQ ID NO: 3744530 - RNA, 13 nt, Salmonella enterica enterica serovar Typhi Ty2
uaaccaaaccaga

SEQ ID NO: 3744531 - RNA, 14 nt, Salmonella enterica enterica serovar Typhi Ty2
uaaccacagccuua

SEQ ID NO: 3744532 - RNA, 22 nt, Salmonella enterica enterica serovar Typhi Ty2
uaaccacgaaaauuauuuucga

SEQ ID NO: 3744533 - RNA, 17 nt, Salmonella enterica enterica serovar Typhi Ty2
uaaccagauaagccugu

SEQ ID NO: 3744534 - RNA, 12 nt, Salmonella enterica enterica serovar Typhi Ty2
uaaccagcaguc

SEQ ID NO: 3744535 - RNA, 20 nt, Salmonella enterica enterica serovar Typhi Ty2
uaaccagcgcgccgccaacg

SEQ ID NO: 3744536 - RNA, 21 nt, Salmonella enterica enterica serovar Typhi Ty2
uaaccagggaggacgcaagag

SEQ ID NO: 3744537 - RNA, 21 nt, Salmonella enterica enterica serovar Typhi Ty2
uaaccauacugacuuaauaac

SEQ ID NO: 3744538 - RNA, 22 nt, Salmonella enterica enterica serovar Typhi Ty2
uaacccacaagaaaugcaggcg

SEQ ID NO: 3744539 - RNA, 14 nt, Salmonella enterica enterica serovar Typhi Ty2
uaacccagugcaau

SEQ ID NO: 3744540 - RNA, 19 nt, Salmonella enterica enterica serovar Typhi Ty2
uaacccaguucaaaucgau

SEQ ID NO: 3744541 - RNA, 22 nt, Salmonella enterica enterica serovar Typhi Ty2
uaacccgcuuacaauuuaucug

SEQ ID NO: 3744542 - RNA, 17 nt, Salmonella enterica enterica serovar Typhi Ty2
uaacccggucauccagc

SEQ ID NO: 3744543 - RNA, 18 nt, Salmonella enterica enterica serovar Typhi Ty2
uaaccgauaacgcggccc

SEQ ID NO: 3744544 - RNA, 19 nt, Salmonella enterica enterica serovar Typhi Ty2
uaaccgauaacgcggcccg

SEQ ID NO: 3744545 - RNA, 16 nt, Salmonella enterica enterica serovar Typhi Ty2
uaaccgaugcaaccgc

SEQ ID NO: 3744546 - RNA, 17 nt, Salmonella enterica enterica serovar Typhi Ty2
uaaccgcagcgcggccu

SEQ ID NO: 3744547 - RNA, 15 nt, Salmonella enterica enterica serovar Typhi Ty2
uaaccgcccgcggcg

SEQ ID NO: 3744548 - RNA, 20 nt, Salmonella enterica enterica serovar Typhi Ty2
uaaccgcgcaaucaaaacau

SEQ ID NO: 3744549 - RNA, 19 nt, Salmonella enterica enterica serovar Typhi Ty2
uaaccgcgccgcuggcguc

SEQ ID NO: 3744550 - RNA, 12 nt, Salmonella enterica enterica serovar Typhi Ty2
uaaccgcuuuuu

SEQ ID NO: 3744551 - RNA, 22 nt, Salmonella enterica enterica serovar Typhi Ty2
uaaccggacgauuuaagcuuaa

SEQ ID NO: 3744552 - RNA, 16 nt, Salmonella enterica enterica serovar Typhi Ty2
uaaccggaucggccau

SEQ ID NO: 3744553 - RNA, 21 nt, Salmonella enterica enterica serovar Typhi Ty2
uaaccguucaucuaucgccag

SEQ ID NO: 3744554 - RNA, 18 nt, Salmonella enterica enterica serovar Typhi Ty2
uaaccuauuuuacaaaau

SEQ ID NO: 3744555 - RNA, 14 nt, Salmonella enterica enterica serovar Typhi Ty2
uaaccuauuuugca

SEQ ID NO: 3744556 - RNA, 14 nt, Salmonella enterica enterica serovar Typhi Ty2
uaaccucgcuacug

SEQ ID NO: 3744557 - RNA, 17 nt, Salmonella enterica enterica serovar Typhi Ty2
uaaccucuauaguaaau

SEQ ID NO: 3744558 - RNA, 18 nt, Salmonella enterica enterica serovar Typhi Ty2
uaaccucuauaguaaauu

SEQ ID NO: 3744559 - RNA, 19 nt, Salmonella enterica enterica serovar Typhi Ty2
uaaccuguaucugcugaca

SEQ ID NO: 3744560 - RNA, 19 nt, Salmonella enterica enterica serovar Typhi Ty2
uaaccuguuccucacugag

SEQ ID NO: 3744561 - RNA, 21 nt, Salmonella enterica enterica serovar Typhi Ty2
uaaccuucuucguuaugaaug

SEQ ID NO: 3744562 - RNA, 22 nt, Salmonella enterica enterica serovar Typhi Ty2
uaacgaaaagggucauaaccgg

SEQ ID NO: 3744563 - RNA, 23 nt, Salmonella enterica enterica serovar Typhi Ty2
uaacgacucauaauaucucccgu

SEQ ID NO: 3744564 - RNA, 19 nt, Salmonella enterica enterica serovar Typhi Ty2
uaacgaggccaccaucacu

SEQ ID NO: 3744565 - RNA, 12 nt, Salmonella enterica enterica serovar Typhi Ty2
uaacgauaaaau

SEQ ID NO: 3744566 - RNA, 20 nt, Salmonella enterica enterica serovar Typhi Ty2
uaacgauacccaccagcgug

SEQ ID NO: 3744567 - RNA, 15 nt, Salmonella enterica enterica serovar Typhi Ty2
uaacgaugaugaaaa

SEQ ID NO: 3744568 - RNA, 18 nt, Salmonella enterica enterica serovar Typhi Ty2
uaacgaugauuauuguua

SEQ ID NO: 3744569 - RNA, 20 nt, Salmonella enterica enterica serovar Typhi Ty2
uaagauauuuuguuuuaaau

SEQ ID NO: 3744570 - RNA, 18 nt, Salmonella enterica enterica serovar Typhi Ty2
uaagaucggguggccuaa

SEQ ID NO: 3744571 - RNA, 19 nt, Salmonella enterica enterica serovar Typhi Ty2
uaagaucggguggccuaac

SEQ ID NO: 3744572 - RNA, 23 nt, Salmonella enterica enterica serovar Typhi Ty2
uaagauucccccgcaugaaaugc

SEQ ID NO: 3744573 - RNA, 18 nt, Salmonella enterica enterica serovar Typhi Ty2
uaagauuuaaaacaagca

SEQ ID NO: 3744574 - RNA, 16 nt, Salmonella enterica enterica serovar Typhi Ty2
uaagauuuacaacaga

SEQ ID NO: 3744575 - RNA, 18 nt, Salmonella enterica enterica serovar Typhi Ty2
uaagcaacugauuaaucu

SEQ ID NO: 3744576 - RNA, 21 nt, Salmonella enterica enterica serovar Typhi Ty2
uaagcaacugauuaaucugcc

SEQ ID NO: 3744577 - RNA, 21 nt, Salmonella enterica enterica serovar Typhi Ty2
uaagcaauccauuuuaaauac

SEQ ID NO: 3744578 - RNA, 22 nt, Salmonella enterica enterica serovar Typhi Ty2
uaagcaauccauuuuaaauaca

SEQ ID NO: 3744579 - RNA, 14 nt, Salmonella enterica enterica serovar Typhi Ty2
uaagcaauuaauau

SEQ ID NO: 3744580 - RNA, 13 nt, Salmonella enterica enterica serovar Typhi Ty2
uaagcacaccauu

SEQ ID NO: 3744581 - RNA, 20 nt, Salmonella enterica enterica serovar Typhi Ty2
uaagcacgggcuugaauaac

SEQ ID NO: 3744582 - RNA, 19 nt, Salmonella enterica enterica serovar Typhi Ty2
uaagcacggggguuuugug

SEQ ID NO: 3744583 - RNA, 20 nt, Salmonella enterica enterica serovar Typhi Ty2
uaagcagcugcuuaacuucu

SEQ ID NO: 3744584 - RNA, 21 nt, Salmonella enterica enterica serovar Typhi Ty2
uaagcauccaggaaguaaauu

SEQ ID NO: 3744585 - RNA, 23 nt, Salmonella enterica enterica serovar Typhi Ty2
uaagcauuagcgccauccggcac

SEQ ID NO: 3744586 - RNA, 17 nt, Salmonella enterica enterica serovar Typhi Ty2
uaagccagacgcgcagc

SEQ ID NO: 3744587 - RNA, 21 nt, Salmonella enterica enterica serovar Typhi Ty2
uaagccaguccugccaccagc

SEQ ID NO: 3744588 - RNA, 20 nt, Salmonella enterica enterica serovar Typhi Ty2
uaagcccauggcaggcagca

SEQ ID NO: 3744589 - RNA, 16 nt, Salmonella enterica enterica serovar Typhi Ty2
uaagccgauugaauaa

SEQ ID NO: 3744590 - RNA, 20 nt, Salmonella enterica enterica serovar Typhi Ty2
uaagccggcaggcagcgcca

SEQ ID NO: 3744591 - RNA, 23 nt, Salmonella enterica enterica serovar Typhi Ty2
uaagccggcaggcagcgccagcg

SEQ ID NO: 3744592 - RNA, 22 nt, Salmonella enterica enterica serovar Typhi Ty2
uaagccggugaugaucaauaac

SEQ ID NO: 3744593 - RNA, 16 nt, Salmonella enterica enterica serovar Typhi Ty2
uaagccuccggaugac

SEQ ID NO: 3744594 - RNA, 14 nt, Salmonella enterica enterica serovar Typhi Ty2
uaagcgacgaaucc

SEQ ID NO: 3744595 - RNA, 18 nt, Salmonella enterica enterica serovar Typhi Ty2
uaagcgcaaacuuccaca

SEQ ID NO: 3744596 - RNA, 19 nt, Salmonella enterica enterica serovar Typhi Ty2
uaagcgcagcgcaucaggc

SEQ ID NO: 3744597 - RNA, 14 nt, Salmonella enterica enterica serovar Typhi Ty2
uaagcgcagcgcca

SEQ ID NO: 3744598 - RNA, 20 nt, Salmonella enterica enterica serovar Typhi Ty2
uaagcgcagcgccaucaggc

SEQ ID NO: 3744599 - RNA, 20 nt, Salmonella enterica enterica serovar Typhi Ty2
uaagcgcagcgccauugagc

SEQ ID NO: 3744600 - RNA, 20 nt, Salmonella enterica enterica serovar Typhi Ty2
uaagcgcagcgucaucaggc

SEQ ID NO: 3744601 - RNA, 14 nt, Salmonella enterica enterica serovar Typhi Ty2
uaagcgcccgucca

SEQ ID NO: 3744602 - RNA, 13 nt, Salmonella enterica enterica serovar Typhi Ty2
uaagcgccgcuga

SEQ ID NO: 3744603 - RNA, 16 nt, Salmonella enterica enterica serovar Typhi Ty2
uaagcgcgaaauuuau

SEQ ID NO: 3744604 - RNA, 14 nt, Salmonella enterica enterica serovar Typhi Ty2
uaagcgcuagcgcc

SEQ ID NO: 3744605 - RNA, 19 nt, Salmonella enterica enterica serovar Typhi Ty2
uaagcggcaagccgaucag

SEQ ID NO: 3744606 - RNA, 15 nt, Salmonella enterica enterica serovar Typhi Ty2
uaagcggcagcgcca

SEQ ID NO: 3744607 - RNA, 13 nt, Salmonella enterica enterica serovar Typhi Ty2
uaagcggccuaua

SEQ ID NO: 3744608 - RNA, 19 nt, Salmonella enterica enterica serovar Typhi Ty2
uaagcguagcgcauccggc

SEQ ID NO: 3744609 - RNA, 13 nt, Salmonella enterica enterica serovar Typhi Ty2
uaagcguagcgcc

SEQ ID NO: 3744610 - RNA, 21 nt, Salmonella enterica enterica serovar Typhi Ty2
uaagcgucacccggcaauuca

SEQ ID NO: 3744611 - RNA, 11 nt, Salmonella enterica enterica serovar Typhi Ty2
uaagcguucag

SEQ ID NO: 3744612 - RNA, 16 nt, Salmonella enterica enterica serovar Typhi Ty2
uaagcuaguaaagaaa

SEQ ID NO: 3744613 - RNA, 16 nt, Salmonella enterica enterica serovar Typhi Ty2
uaagcuauguuuuuau

SEQ ID NO: 3744614 - RNA, 19 nt, Salmonella enterica enterica serovar Typhi Ty2
uaagcuggaccgcagcuua

SEQ ID NO: 3744615 - RNA, 23 nt, Salmonella enterica enterica serovar Typhi Ty2
uaagcuggcguuaaauauaucug

SEQ ID NO: 3744616 - RNA, 18 nt, Salmonella enterica enterica serovar Typhi Ty2
uaagcuuaggauaagaau

SEQ ID NO: 3744617 - RNA, 20 nt, Salmonella enterica enterica serovar Typhi Ty2
uaagcuuccgccaugguugg

SEQ ID NO: 3744618 - RNA, 18 nt, Salmonella enterica enterica serovar Typhi Ty2
uaaggaaacgaaagcuca

SEQ ID NO: 3744619 - RNA, 22 nt, Salmonella enterica enterica serovar Typhi Ty2
uaaggauaucuugaugauucac

SEQ ID NO: 3744620 - RNA, 14 nt, Salmonella enterica enterica serovar Typhi Ty2
uaaggaucggaaga

SEQ ID NO: 3744621 - RNA, 23 nt, Salmonella enterica enterica serovar Typhi Ty2
uaaggaucggaagacuggcgcag

SEQ ID NO: 3744622 - RNA, 21 nt, Salmonella enterica enterica serovar Typhi Ty2
uaaggcaaguucuuguuucau

SEQ ID NO: 3744623 - RNA, 13 nt, Salmonella enterica enterica serovar Typhi Ty2
uaaggcaggcaaa

SEQ ID NO: 3744624 - RNA, 23 nt, Salmonella enterica enterica serovar Typhi Ty2
uaaggcaucguugagaaaaccau

SEQ ID NO: 3744625 - RNA, 18 nt, Salmonella enterica enterica serovar Typhi Ty2
uaaggcaugaugccacga

SEQ ID NO: 3744626 - RNA, 20 nt, Salmonella enterica enterica serovar Typhi Ty2
uaaggcauuuaugccgccau

SEQ ID NO: 3744627 - RNA, 17 nt, Salmonella enterica enterica serovar Typhi Ty2
uaaggccacgccgccau

SEQ ID NO: 3744628 - RNA, 16 nt, Salmonella enterica enterica serovar Typhi Ty2
uaaggccgcgaaagcg

SEQ ID NO: 3744629 - RNA, 21 nt, Salmonella enterica enterica serovar Typhi Ty2
uaaggcgauaccuaaucccug

SEQ ID NO: 3744630 - RNA, 21 nt, Salmonella enterica enterica serovar Typhi Ty2
uaaggcgauucaacagggcaa

SEQ ID NO: 3744631 - RNA, 15 nt, Salmonella enterica enterica serovar Typhi Ty2
uaaggcgcggccuca

SEQ ID NO: 3744632 - RNA, 22 nt, Salmonella enterica enterica serovar Typhi Ty2
uaaggcgcuagccgcauccggc

SEQ ID NO: 3744633 - RNA, 22 nt, Salmonella enterica enterica serovar Typhi Ty2
uaaggcggagccgccauccggc

SEQ ID NO: 3744634 - RNA, 16 nt, Salmonella enterica enterica serovar Typhi Ty2
uaaggcggauacagcg

SEQ ID NO: 3744635 - RNA, 18 nt, Salmonella enterica enterica serovar Typhi Ty2
uaaggcucucuuaccagc

SEQ ID NO: 3744636 - RNA, 16 nt, Salmonella enterica enterica serovar Typhi Ty2
uaaggcuggcacguuc

SEQ ID NO: 3744637 - RNA, 22 nt, Salmonella enterica enterica serovar Typhi Ty2
uaaggggcaggcgucaaaacag

SEQ ID NO: 3744638 - RNA, 19 nt, Salmonella enterica enterica serovar Typhi Ty2
uaagguauccuaaugccac

SEQ ID NO: 3744639 - RNA, 19 nt, Salmonella enterica enterica serovar Typhi Ty2
uaaggucgcuauccagcag

SEQ ID NO: 3744640 - RNA, 12 nt, Salmonella enterica enterica serovar Typhi Ty2
uaagguugucaa

SEQ ID NO: 3744641 - RNA, 14 nt, Salmonella enterica enterica serovar Typhi Ty2
uaaguaaguugauc

SEQ ID NO: 3744642 - RNA, 21 nt, Salmonella enterica enterica serovar Typhi Ty2
uaaguacaagagccgccgcca

SEQ ID NO: 3744643 - RNA, 19 nt, Salmonella enterica enterica serovar Typhi Ty2
uaaguacgccugaaaacag

SEQ ID NO: 3744644 - RNA, 20 nt, Salmonella enterica enterica serovar Typhi Ty2
uaaguacgccugaaaacaga

SEQ ID NO: 3744645 - RNA, 22 nt, Salmonella enterica enterica serovar Typhi Ty2
uaaguagccgucagguccgaca

SEQ ID NO: 3744646 - RNA, 20 nt, Salmonella enterica enterica serovar Typhi Ty2
uaaguaucagcgcgcuuuuu

SEQ ID NO: 3744647 - RNA, 13 nt, Salmonella enterica enterica serovar Typhi Ty2
uaaguaugccgca

SEQ ID NO: 3744648 - RNA, 18 nt, Salmonella enterica enterica serovar Typhi Ty2
uaagucaaccaugaucac

SEQ ID NO: 3744649 - RNA, 14 nt, Salmonella enterica enterica serovar Typhi Ty2
uaagucauccagac

SEQ ID NO: 3744650 - RNA, 21 nt, Salmonella enterica enterica serovar Typhi Ty2
uaaucggccaggauggcccgg

SEQ ID NO: 3744651 - RNA, 17 nt, Salmonella enterica enterica serovar Typhi Ty2
uaaucggcgucauuuuc

SEQ ID NO: 3744652 - RNA, 22 nt, Salmonella enterica enterica serovar Typhi Ty2
uaaucguauucauugccguaaa

SEQ ID NO: 3744653 - RNA, 23 nt, Salmonella enterica enterica serovar Typhi Ty2
uaaucguuagcgagguucccgcc

SEQ ID NO: 3744654 - RNA, 14 nt, Salmonella enterica enterica serovar Typhi Ty2
uaaucuaaaauuau

SEQ ID NO: 3744655 - RNA, 16 nt, Salmonella enterica enterica serovar Typhi Ty2
uaaucuaaaauuauuu

SEQ ID NO: 3744656 - RNA, 17 nt, Salmonella enterica enterica serovar Typhi Ty2
uaaucucaaacuuggcc

SEQ ID NO: 3744657 - RNA, 18 nt, Salmonella enterica enterica serovar Typhi Ty2
uaaucugaauaccuugau

SEQ ID NO: 3744658 - RNA, 22 nt, Salmonella enterica enterica serovar Typhi Ty2
uaaucugaauaccuugauaacu

SEQ ID NO: 3744659 - RNA, 15 nt, Salmonella enterica enterica serovar Typhi Ty2
uaaucugccagcuua

SEQ ID NO: 3744660 - RNA, 14 nt, Salmonella enterica enterica serovar Typhi Ty2
uaaucuggccuacg

SEQ ID NO: 3744661 - RNA, 19 nt, Salmonella enterica enterica serovar Typhi Ty2
uaaucugucgcuaaagcac

SEQ ID NO: 3744662 - RNA, 11 nt, Salmonella enterica enterica serovar Typhi Ty2
uaaucuuccac

SEQ ID NO: 3744663 - RNA, 14 nt, Salmonella enterica enterica serovar Typhi Ty2
uaaucuuuucauau

SEQ ID NO: 3744664 - RNA, 14 nt, Salmonella enterica enterica serovar Typhi Ty2
uaaugaacagcaaa

SEQ ID NO: 3744665 - RNA, 16 nt, Salmonella enterica enterica serovar Typhi Ty2
uaaugaagcauaaaaa

SEQ ID NO: 3744666 - RNA, 19 nt, Salmonella enterica enterica serovar Typhi Ty2
uaaugaagcauaaaaagac

SEQ ID NO: 3744667 - RNA, 15 nt, Salmonella enterica enterica serovar Typhi Ty2
uaaugaauuuaauau

SEQ ID NO: 3744668 - RNA, 16 nt, Salmonella enterica enterica serovar Typhi Ty2
uaaugacauagugcaa

SEQ ID NO: 3744669 - RNA, 15 nt, Salmonella enterica enterica serovar Typhi Ty2
uaaugacauccagag

SEQ ID NO: 3744670 - RNA, 18 nt, Salmonella enterica enterica serovar Typhi Ty2
uaaugacuuuuaaagacu

SEQ ID NO: 3744671 - RNA, 22 nt, Salmonella enterica enterica serovar Typhi Ty2
uaaugagcacuuuccacaucgg

SEQ ID NO: 3744672 - RNA, 23 nt, Salmonella enterica enterica serovar Typhi Ty2
uaaugagccagauggauaaccug

SEQ ID NO: 3744673 - RNA, 19 nt, Salmonella enterica enterica serovar Typhi Ty2
uaaugagcgucgccagacc

SEQ ID NO: 3744674 - RNA, 19 nt, Salmonella enterica enterica serovar Typhi Ty2
uaaugaguagaacguauua

SEQ ID NO: 3744675 - RNA, 21 nt, Salmonella enterica enterica serovar Typhi Ty2
uaaugaucagcaaaauagugu

SEQ ID NO: 3744676 - RNA, 16 nt, Salmonella enterica enterica serovar Typhi Ty2
uaaugauccacaccgg

SEQ ID NO: 3744677 - RNA, 20 nt, Salmonella enterica enterica serovar Typhi Ty2
uaaugaucguaugcagccag

SEQ ID NO: 3744678 - RNA, 16 nt, Salmonella enterica enterica serovar Typhi Ty2
uaaugauuaaaauaaa

SEQ ID NO: 3744679 - RNA, 23 nt, Salmonella enterica enterica serovar Typhi Ty2
uaaugauuaucuuuuuuagucuc

SEQ ID NO: 3744680 - RNA, 22 nt, Salmonella enterica enterica serovar Typhi Ty2
uaaugauucuguguuuuuucgu

SEQ ID NO: 3744681 - RNA, 21 nt, Salmonella enterica enterica serovar Typhi Ty2
uaaugcaauaaacuaaguaag

SEQ ID NO: 3744682 - RNA, 21 nt, Salmonella enterica enterica serovar Typhi Ty2
uaaugcagcgucugcccuccu

SEQ ID NO: 3744683 - RNA, 16 nt, Salmonella enterica enterica serovar Typhi Ty2
uaaugccgccgucgcg

SEQ ID NO: 3744684 - RNA, 16 nt, Salmonella enterica enterica serovar Typhi Ty2
uaaugccggaucaggc

SEQ ID NO: 3744685 - RNA, 18 nt, Salmonella enterica enterica serovar Typhi Ty2
uaaugccuaucuugauau

SEQ ID NO: 3744686 - RNA, 16 nt, Salmonella enterica enterica serovar Typhi Ty2
uaaugcgaugccgcac

SEQ ID NO: 3744687 - RNA, 18 nt, Salmonella enterica enterica serovar Typhi Ty2
uaaugcgccaggcagcac

SEQ ID NO: 3744688 - RNA, 16 nt, Salmonella enterica enterica serovar Typhi Ty2
uaaugcuaucccaggc

SEQ ID NO: 3744689 - RNA, 15 nt, Salmonella enterica enterica serovar Typhi Ty2
uaaugcuuuaaaugc

SEQ ID NO: 3744690 - RNA, 17 nt, Salmonella enterica enterica serovar Typhi Ty2
uaaugcuuuaaaugccu

SEQ ID NO: 3744691 - RNA, 21 nt, Salmonella enterica enterica serovar Typhi Ty2
uaauggauucucgcgccgggg

SEQ ID NO: 3744692 - RNA, 18 nt, Salmonella enterica enterica serovar Typhi Ty2
uaauggcagaauaaaaca

SEQ ID NO: 3744693 - RNA, 22 nt, Salmonella enterica enterica serovar Typhi Ty2
uaauggcgaagcccgccuccac

SEQ ID NO: 3744694 - RNA, 17 nt, Salmonella enterica enterica serovar Typhi Ty2
uaauggcgcgaaaacag

SEQ ID NO: 3744695 - RNA, 19 nt, Salmonella enterica enterica serovar Typhi Ty2
uaaugguggaaugccccag

SEQ ID NO: 3744696 - RNA, 16 nt, Salmonella enterica enterica serovar Typhi Ty2
uaaugguggcaaccug

SEQ ID NO: 3744697 - RNA, 20 nt, Salmonella enterica enterica serovar Typhi Ty2
uaauggugguugcaucaucg

SEQ ID NO: 3744698 - RNA, 20 nt, Salmonella enterica enterica serovar Typhi Ty2
uaaugguugugccaguaauc

SEQ ID NO: 3744699 - RNA, 17 nt, Salmonella enterica enterica serovar Typhi Ty2
uaauguaaaaaaauaaa

SEQ ID NO: 3744700 - RNA, 18 nt, Salmonella enterica enterica serovar Typhi Ty2
uaauguaaaaaaauaaaa

SEQ ID NO: 3744701 - RNA, 16 nt, Salmonella enterica enterica serovar Typhi Ty2
uaauguaaaacaagag

SEQ ID NO: 3744702 - RNA, 19 nt, Salmonella enterica enterica serovar Typhi Ty2
uaauguaaacgucaccuca

SEQ ID NO: 3744703 - RNA, 19 nt, Salmonella enterica enterica serovar Typhi Ty2
uaauguaaaggugagcucu

SEQ ID NO: 3744704 - RNA, 13 nt, Salmonella enterica enterica serovar Typhi Ty2
uaaugucaucauc

SEQ ID NO: 3744705 - RNA, 13 nt, Salmonella enterica enterica serovar Typhi Ty2
uaaugugaaaaac

SEQ ID NO: 3744706 - RNA, 17 nt, Salmonella enterica enterica serovar Typhi Ty2
uaaugugccgguaagaa

SEQ ID NO: 3744707 - RNA, 18 nt, Salmonella enterica enterica serovar Typhi Ty2
uaauguucaguuuuucca

SEQ ID NO: 3744708 - RNA, 19 nt, Salmonella enterica enterica serovar Typhi Ty2
uaauguugaaccgucauca

SEQ ID NO: 3744709 - RNA, 23 nt, Salmonella enterica enterica serovar Typhi Ty2
uaauguuucacguagcaaagcgu

SEQ ID NO: 3744710 - RNA, 14 nt, Salmonella enterica enterica serovar Typhi Ty2
uaauguuugcgcca

SEQ ID NO: 3744711 - RNA, 17 nt, Salmonella enterica enterica serovar Typhi Ty2
uaauguuuucugccagc

SEQ ID NO: 3744712 - RNA, 19 nt, Salmonella enterica enterica serovar Typhi Ty2
uaauuaacgccgcgaggau

SEQ ID NO: 3744713 - RNA, 22 nt, Salmonella enterica enterica serovar Typhi Ty2
uaauuaauucuaaauugggaug

SEQ ID NO: 3744714 - RNA, 18 nt, Salmonella enterica enterica serovar Typhi Ty2
uaauuacuccguuuuaau

SEQ ID NO: 3744715 - RNA, 22 nt, Salmonella enterica enterica serovar Typhi Ty2
uaauuacuccguuuuaaucuuu

SEQ ID NO: 3744716 - RNA, 16 nt, Salmonella enterica enterica serovar Typhi Ty2
uaauuagcauccagca

SEQ ID NO: 3744717 - RNA, 14 nt, Salmonella enterica enterica serovar Typhi Ty2
uaauuauaaauauu

SEQ ID NO: 3744718 - RNA, 19 nt, Salmonella enterica enterica serovar Typhi Ty2
uaauuaucugccagccgau

SEQ ID NO: 3744719 - RNA, 16 nt, Salmonella enterica enterica serovar Typhi Ty2
uaauuauuacagacag

SEQ ID NO: 3744720 - RNA, 18 nt, Salmonella enterica enterica serovar Typhi Ty2
uaauucauaacaccaaua

SEQ ID NO: 3744721 - RNA, 16 nt, Salmonella enterica enterica serovar Typhi Ty2
uaauuccgaauauuua

SEQ ID NO: 3744722 - RNA, 15 nt, Salmonella enterica enterica serovar Typhi Ty2
uaauuccgcaucauu

SEQ ID NO: 3744723 - RNA, 17 nt, Salmonella enterica enterica serovar Typhi Ty2
uaauuccgcaucauuca

SEQ ID NO: 3744724 - RNA, 16 nt, Salmonella enterica enterica serovar Typhi Ty2
uaauucuaaaaguaag

SEQ ID NO: 3744725 - RNA, 20 nt, Salmonella enterica enterica serovar Typhi Ty2
uaauucucacagaaucauca

SEQ ID NO: 3744726 - RNA, 21 nt, Salmonella enterica enterica serovar Typhi Ty2
uaauugcuuugcaauguucaa

SEQ ID NO: 3744727 - RNA, 18 nt, Salmonella enterica enterica serovar Typhi Ty2
uaauugcuuuuuuccaca

SEQ ID NO: 3744728 - RNA, 13 nt, Salmonella enterica enterica serovar Typhi Ty2
uaauuggcuuacc

SEQ ID NO: 3744729 - RNA, 17 nt, Salmonella enterica enterica serovar Typhi Ty2
uaauuuauauugugccu

SEQ ID NO: 3744730 - RNA, 15 nt, Salmonella enterica enterica serovar Typhi Ty2
uaauuuauccaguaa

SEQ ID NO: 3744731 - RNA, 17 nt, Salmonella enterica enterica serovar Typhi Ty2
uaauuucaauuuugccg

SEQ ID NO: 3744732 - RNA, 17 nt, Salmonella enterica enterica serovar Typhi Ty2
uacaggccgauauauug

SEQ ID NO: 3744733 - RNA, 14 nt, Salmonella enterica enterica serovar Typhi Ty2
uacaggcgcagggc

SEQ ID NO: 3744734 - RNA, 16 nt, Salmonella enterica enterica serovar Typhi Ty2
uacaggcggaaaucaa

SEQ ID NO: 3744735 - RNA, 13 nt, Salmonella enterica enterica serovar Typhi Ty2
uacaguagcaggg

SEQ ID NO: 3744736 - RNA, 16 nt, Salmonella enterica enterica serovar Typhi Ty2
uacaguaguuuucauc

SEQ ID NO: 3744737 - RNA, 13 nt, Salmonella enterica enterica serovar Typhi Ty2
uacaguuaccaca

SEQ ID NO: 3744738 - RNA, 16 nt, Salmonella enterica enterica serovar Typhi Ty2
uacaguuugucaucag

SEQ ID NO: 3744739 - RNA, 17 nt, Salmonella enterica enterica serovar Typhi Ty2
uacaguuugucaucagu

SEQ ID NO: 3744740 - RNA, 14 nt, Salmonella enterica enterica serovar Typhi Ty2
uacauacauaccac

SEQ ID NO: 3744741 - RNA, 20 nt, Salmonella enterica enterica serovar Typhi Ty2
uacauaccccgcauuuaaca

SEQ ID NO: 3744742 - RNA, 21 nt, Salmonella enterica enterica serovar Typhi Ty2
uacauagaaaauauaugacaa

SEQ ID NO: 3744743 - RNA, 15 nt, Salmonella enterica enterica serovar Typhi Ty2
uacauaucuauauuu

SEQ ID NO: 3744744 - RNA, 12 nt, Salmonella enterica enterica serovar Typhi Ty2
uacauauuguuu

SEQ ID NO: 3744745 - RNA, 16 nt, Salmonella enterica enterica serovar Typhi Ty2
uacaucagaaaacagc

SEQ ID NO: 3744746 - RNA, 18 nt, Salmonella enterica enterica serovar Typhi Ty2
uacauccaugccauccag

SEQ ID NO: 3744747 - RNA, 19 nt, Salmonella enterica enterica serovar Typhi Ty2
uacauccgccagccgccau

SEQ ID NO: 3744748 - RNA, 13 nt, Salmonella enterica enterica serovar Typhi Ty2
uacaucgcgcuga

SEQ ID NO: 3744749 - RNA, 14 nt, Salmonella enterica enterica serovar Typhi Ty2
uacaucuacuucag

SEQ ID NO: 3744750 - RNA, 12 nt, Salmonella enterica enterica serovar Typhi Ty2
uacaucuuccau

SEQ ID NO: 3744751 - RNA, 18 nt, Salmonella enterica enterica serovar Typhi Ty2
uacaucuuccauuuuggu

SEQ ID NO: 3744752 - RNA, 14 nt, Salmonella enterica enterica serovar Typhi Ty2
uacaugaauaauaa

SEQ ID NO: 3744753 - RNA, 15 nt, Salmonella enterica enterica serovar Typhi Ty2
uacaugaauaauaau

SEQ ID NO: 3744754 - RNA, 17 nt, Salmonella enterica enterica serovar Typhi Ty2
uacaugccguuaauaau

SEQ ID NO: 3744755 - RNA, 18 nt, Salmonella enterica enterica serovar Typhi Ty2
uacauucuguuugucuuu

SEQ ID NO: 3744756 - RNA, 22 nt, Salmonella enterica enterica serovar Typhi Ty2
uacauuucacccuauaagcugc

SEQ ID NO: 3744757 - RNA, 22 nt, Salmonella enterica enterica serovar Typhi Ty2
uacauuugaauaauucuguacc

SEQ ID NO: 3744758 - RNA, 22 nt, Salmonella enterica enterica serovar Typhi Ty2
uacauuuucguaaaauauauau

SEQ ID NO: 3744759 - RNA, 24 nt, Salmonella enterica enterica serovar Typhi Ty2
uacauuuucguaaaauauauauuu

SEQ ID NO: 3744760 - RNA, 22 nt, Salmonella enterica enterica serovar Typhi Ty2
uacauuuuguauucgcagggcu

SEQ ID NO: 3744761 - RNA, 19 nt, Salmonella enterica enterica serovar Typhi Ty2
uacauuuuuacaguuacca

SEQ ID NO: 3744762 - RNA, 21 nt, Salmonella enterica enterica serovar Typhi Ty2
uacauuuuuacaguuaccaca

SEQ ID NO: 3744763 - RNA, 14 nt, Salmonella enterica enterica serovar Typhi Ty2
uacauuuuuuucuu

SEQ ID NO: 3744764 - RNA, 14 nt, Salmonella enterica enterica serovar Typhi Ty2
uaccaaacagcaga

SEQ ID NO: 3744765 - RNA, 19 nt, Salmonella enterica enterica serovar Typhi Ty2
uaccaaacccuuuggcaaa

SEQ ID NO: 3744766 - RNA, 17 nt, Salmonella enterica enterica serovar Typhi Ty2
uaccaaagucaucaauu

SEQ ID NO: 3744767 - RNA, 19 nt, Salmonella enterica enterica serovar Typhi Ty2
uaccaaccgccagucaccc

SEQ ID NO: 3744768 - RNA, 20 nt, Salmonella enterica enterica serovar Typhi Ty2
uaccaaccgccagucacccu

SEQ ID NO: 3744769 - RNA, 14 nt, Salmonella enterica enterica serovar Typhi Ty2
uaccaacugagcua

SEQ ID NO: 3744770 - RNA, 15 nt, Salmonella enterica enterica serovar Typhi Ty2
uaccaauacccagcg

SEQ ID NO: 3744771 - RNA, 17 nt, Salmonella enterica enterica serovar Typhi Ty2
uaccaauacccagcgcc

SEQ ID NO: 3744772 - RNA, 18 nt, Salmonella enterica enterica serovar Typhi Ty2
uaccaauacccagcgcca

SEQ ID NO: 3744773 - RNA, 21 nt, Salmonella enterica enterica serovar Typhi Ty2
uaccaauagccuugacgcaau

SEQ ID NO: 3744774 - RNA, 17 nt, Salmonella enterica enterica serovar Typhi Ty2
uaccaauaucgccguua

SEQ ID NO: 3744775 - RNA, 15 nt, Salmonella enterica enterica serovar Typhi Ty2
uaccaaugccaaaaa

SEQ ID NO: 3744776 - RNA, 14 nt, Salmonella enterica enterica serovar Typhi Ty2
uaccaauuaccggc

SEQ ID NO: 3744777 - RNA, 18 nt, Salmonella enterica enterica serovar Typhi Ty2
uaccaauuccaccaccuc

SEQ ID NO: 3744778 - RNA, 18 nt, Salmonella enterica enterica serovar Typhi Ty2
uaccacacaugcaaaaaa

SEQ ID NO: 3744779 - RNA, 11 nt, Salmonella enterica enterica serovar Typhi Ty2
uaccacaucag

SEQ ID NO: 3744780 - RNA, 18 nt, Salmonella enterica enterica serovar Typhi Ty2
uaccaccagaaucgccag

SEQ ID NO: 3744781 - RNA, 19 nt, Salmonella enterica enterica serovar Typhi Ty2
uaccacgcacaugggcguc

SEQ ID NO: 3744782 - RNA, 19 nt, Salmonella enterica enterica serovar Typhi Ty2
uaccacgcccgccgccagc

SEQ ID NO: 3744783 - RNA, 18 nt, Salmonella enterica enterica serovar Typhi Ty2
uaccacgccgcacacagc

SEQ ID NO: 3744784 - RNA, 20 nt, Salmonella enterica enterica serovar Typhi Ty2
uaccacgucugaagaaguuc

SEQ ID NO: 3744785 - RNA, 16 nt, Salmonella enterica enterica serovar Typhi Ty2
uaccacuucggcagaa

SEQ ID NO: 3744786 - RNA, 22 nt, Salmonella enterica enterica serovar Typhi Ty2
uaccacuucggcagaaaaagua

SEQ ID NO: 3744787 - RNA, 14 nt, Salmonella enterica enterica serovar Typhi Ty2
uaccagaaccacuu

SEQ ID NO: 3744788 - RNA, 21 nt, Salmonella enterica enterica serovar Typhi Ty2
uaccagacgcgccugcauacu

SEQ ID NO: 3744789 - RNA, 17 nt, Salmonella enterica enterica serovar Typhi Ty2
uaccagauuaauaauag

SEQ ID NO: 3744790 - RNA, 11 nt, Salmonella enterica enterica serovar Typhi Ty2
uaccagcaccu

SEQ ID NO: 3744791 - RNA, 14 nt, Salmonella enterica enterica serovar Typhi Ty2
uaccagcagcgcca

SEQ ID NO: 3744792 - RNA, 16 nt, Salmonella enterica enterica serovar Typhi Ty2
uaccagcagcgccagc

SEQ ID NO: 3744793 - RNA, 17 nt, Salmonella enterica enterica serovar Typhi Ty2
uaccagcagcgccagcg

SEQ ID NO: 3744794 - RNA, 19 nt, Salmonella enterica enterica serovar Typhi Ty2
uaccagcaucaauagcagc

SEQ ID NO: 3744795 - RNA, 23 nt, Salmonella enterica enterica serovar Typhi Ty2
uaccagccuucggacugcuggua

SEQ ID NO: 3744796 - RNA, 15 nt, Salmonella enterica enterica serovar Typhi Ty2
uaccagcgcggcgcc

SEQ ID NO: 3744797 - RNA, 12 nt, Salmonella enterica enterica serovar Typhi Ty2
uaccagcggcaa

SEQ ID NO: 3744798 - RNA, 14 nt, Salmonella enterica enterica serovar Typhi Ty2
uaccagcggcagcu

SEQ ID NO: 3744799 - RNA, 17 nt, Salmonella enterica enterica serovar Typhi Ty2
uaccagcgucaucggau

SEQ ID NO: 3744800 - RNA, 17 nt, Salmonella enterica enterica serovar Typhi Ty2
uaccaggaauuuuaacg

SEQ ID NO: 3744801 - RNA, 15 nt, Salmonella enterica enterica serovar Typhi Ty2
uaccaggcagcgcgc

SEQ ID NO: 3744802 - RNA, 22 nt, Salmonella enterica enterica serovar Typhi Ty2
uaccaggcagcgcgccagcgcu

SEQ ID NO: 3744803 - RNA, 19 nt, Salmonella enterica enterica serovar Typhi Ty2
uaccaggcggcuuuuucau

SEQ ID NO: 3744804 - RNA, 20 nt, Salmonella enterica enterica serovar Typhi Ty2
uaccaggcggcuuuuucauc

SEQ ID NO: 3744805 - RNA, 23 nt, Salmonella enterica enterica serovar Typhi Ty2
uaccaggcggcuuuuucaucauc

SEQ ID NO: 3744806 - RNA, 17 nt, Salmonella enterica enterica serovar Typhi Ty2
uaccaguaccgaaacca

SEQ ID NO: 3744807 - RNA, 22 nt, Salmonella enterica enterica serovar Typhi Ty2
uaccauaccggugcgccccagc

SEQ ID NO: 3744808 - RNA, 13 nt, Salmonella enterica enterica serovar Typhi Ty2
uaccauucagcuu

SEQ ID NO: 3744809 - RNA, 14 nt, Salmonella enterica enterica serovar Typhi Ty2
uaccauucagcuua

SEQ ID NO: 3744810 - RNA, 14 nt, Salmonella enterica enterica serovar Typhi Ty2
uaccauuccucacg

SEQ ID NO: 3744811 - RNA, 13 nt, Salmonella enterica enterica serovar Typhi Ty2
uacccaaauuaau

SEQ ID NO: 3744812 - RNA, 18 nt, Salmonella enterica enterica serovar Typhi Ty2
uacccaaauuaauuuauu

SEQ ID NO: 3744813 - RNA, 19 nt, Salmonella enterica enterica serovar Typhi Ty2
uacccaacaccagacugau

SEQ ID NO: 3744814 - RNA, 18 nt, Salmonella enterica enterica serovar Typhi Ty2
uacccagcgaaugcugca

SEQ ID NO: 3744815 - RNA, 21 nt, Salmonella enterica enterica serovar Typhi Ty2
uacccagcgccaacgccacug

SEQ ID NO: 3744816 - RNA, 20 nt, Salmonella enterica enterica serovar Typhi Ty2
uacccaggugugcggucgcu

SEQ ID NO: 3744817 - RNA, 18 nt, Salmonella enterica enterica serovar Typhi Ty2
uacccaguaccauaccgg

SEQ ID NO: 3744818 - RNA, 18 nt, Salmonella enterica enterica serovar Typhi Ty2
uacccauaguagcuaaug

SEQ ID NO: 3744819 - RNA, 17 nt, Salmonella enterica enterica serovar Typhi Ty2
uaccccacgccauaaug

SEQ ID NO: 3744820 - RNA, 20 nt, Salmonella enterica enterica serovar Typhi Ty2
uaccccaucauugacuucaa

SEQ ID NO: 3744821 - RNA, 22 nt, Salmonella enterica enterica serovar Typhi Ty2
uacccccaaccguuucgccagu

SEQ ID NO: 3744822 - RNA, 22 nt, Salmonella enterica enterica serovar Typhi Ty2
uaccccgcacaaacgcuuuuuu

SEQ ID NO: 3744823 - RNA, 16 nt, Salmonella enterica enterica serovar Typhi Ty2
uaccccgccaccgccg

SEQ ID NO: 3744824 - RNA, 15 nt, Salmonella enterica enterica serovar Typhi Ty2
uaccccgccagcagg

SEQ ID NO: 3744825 - RNA, 23 nt, Salmonella enterica enterica serovar Typhi Ty2
uaccccuguucaaaauagcuuuc

SEQ ID NO: 3744826 - RNA, 21 nt, Salmonella enterica enterica serovar Typhi Ty2
uaccccuuuuucaauuuccag

SEQ ID NO: 3744827 - RNA, 16 nt, Salmonella enterica enterica serovar Typhi Ty2
uacccgauaccgccag

SEQ ID NO: 3744828 - RNA, 19 nt, Salmonella enterica enterica serovar Typhi Ty2
uacccgauaccgccagccc

SEQ ID NO: 3744829 - RNA, 19 nt, Salmonella enterica enterica serovar Typhi Ty2
uacccgcgcaucccacacc

SEQ ID NO: 3744830 - RNA, 16 nt, Salmonella enterica enterica serovar Typhi Ty2
uacccgcugcuucacg

SEQ ID NO: 3744831 - RNA, 20 nt, Salmonella enterica enterica serovar Typhi Ty2
uacccggcgcaaacuucaca

SEQ ID NO: 3744832 - RNA, 20 nt, Salmonella enterica enterica serovar Typhi Ty2
uacccuauuuacagagcaau

SEQ ID NO: 3744833 - RNA, 14 nt, Salmonella enterica enterica serovar Typhi Ty2
uacccuucagauau

SEQ ID NO: 3744834 - RNA, 12 nt, Salmonella enterica enterica serovar Typhi Ty2
uacccuuccagu

SEQ ID NO: 3744835 - RNA, 19 nt, Salmonella enterica enterica serovar Typhi Ty2
uacccuuuucuuuaaacaa

SEQ ID NO: 3744836 - RNA, 14 nt, Salmonella enterica enterica serovar Typhi Ty2
uaccgauagcgcgg

SEQ ID NO: 3744837 - RNA, 15 nt, Salmonella enterica enterica serovar Typhi Ty2
uaccgauagcgcgga

SEQ ID NO: 3744838 - RNA, 15 nt, Salmonella enterica enterica serovar Typhi Ty2
uaccgaugacggcaa

SEQ ID NO: 3744839 - RNA, 13 nt, Salmonella enterica enterica serovar Typhi Ty2
uaccgccaaucaa

SEQ ID NO: 3744840 - RNA, 19 nt, Salmonella enterica enterica serovar Typhi Ty2
uaccgccaaucaacgccgc

SEQ ID NO: 3744841 - RNA, 21 nt, Salmonella enterica enterica serovar Typhi Ty2
uaccgccaccuuucugcucca

SEQ ID NO: 3744842 - RNA, 18 nt, Salmonella enterica enterica serovar Typhi Ty2
uaccgccacuuugcuuug

SEQ ID NO: 3744843 - RNA, 16 nt, Salmonella enterica enterica serovar Typhi Ty2
uaccgccagcggcguu

SEQ ID NO: 3744844 - RNA, 17 nt, Salmonella enterica enterica serovar Typhi Ty2
uaccgccaucaaacgca

SEQ ID NO: 3744845 - RNA, 19 nt, Salmonella enterica enterica serovar Typhi Ty2
uaccgccaucaaacgcagc

SEQ ID NO: 3744846 - RNA, 14 nt, Salmonella enterica enterica serovar Typhi Ty2
uaccgccgagcauu

SEQ ID NO: 3744847 - RNA, 18 nt, Salmonella enterica enterica serovar Typhi Ty2
uaccgccgcaaccggagu

SEQ ID NO: 3744848 - RNA, 22 nt, Salmonella enterica enterica serovar Typhi Ty2
uaccgccgcuuuucaggggucc

SEQ ID NO: 3744849 - RNA, 13 nt, Salmonella enterica enterica serovar Typhi Ty2
uaccgccgguaau

SEQ ID NO: 3744850 - RNA, 22 nt, Salmonella enterica enterica serovar Typhi Ty2
uaccgccgguaaugaacaccag

SEQ ID NO: 3744851 - RNA, 14 nt, Salmonella enterica enterica serovar Typhi Ty2
uaccgccguagaaa

SEQ ID NO: 3744852 - RNA, 17 nt, Salmonella enterica enterica serovar Typhi Ty2
uaccgccuucagcgcgc

SEQ ID NO: 3744853 - RNA, 19 nt, Salmonella enterica enterica serovar Typhi Ty2
uaccgccuuguccggccua

SEQ ID NO: 3744854 - RNA, 13 nt, Salmonella enterica enterica serovar Typhi Ty2
uaccgcgccagcg

SEQ ID NO: 3744855 - RNA, 15 nt, Salmonella enterica enterica serovar Typhi Ty2
uaccgcgcgaaccau

SEQ ID NO: 3744856 - RNA, 14 nt, Salmonella enterica enterica serovar Typhi Ty2
uaccgcguaaugac

SEQ ID NO: 3744857 - RNA, 17 nt, Salmonella enterica enterica serovar Typhi Ty2
uaccgcguuuaacgcag

SEQ ID NO: 3744858 - RNA, 15 nt, Salmonella enterica enterica serovar Typhi Ty2
uaccgcuaaaauacc

SEQ ID NO: 3744859 - RNA, 18 nt, Salmonella enterica enterica serovar Typhi Ty2
uaccgcuacgcaggccau

SEQ ID NO: 3744860 - RNA, 23 nt, Salmonella enterica enterica serovar Typhi Ty2
uaccgcugggaugaccugaaauc

SEQ ID NO: 3744861 - RNA, 18 nt, Salmonella enterica enterica serovar Typhi Ty2
uaccgcuucgcgcgccag

SEQ ID NO: 3744862 - RNA, 20 nt, Salmonella enterica enterica serovar Typhi Ty2
uaccgcuugggccaccugcc

SEQ ID NO: 3744863 - RNA, 23 nt, Salmonella enterica enterica serovar Typhi Ty2
uaccgcuugggccaccugccagg

SEQ ID NO: 3744864 - RNA, 17 nt, Salmonella enterica enterica serovar Typhi Ty2
uaccgcuuugccgcgcu

SEQ ID NO: 3744865 - RNA, 22 nt, Salmonella enterica enterica serovar Typhi Ty2
uaccggacgacuguagauaccu

SEQ ID NO: 3744866 - RNA, 20 nt, Salmonella enterica enterica serovar Typhi Ty2
uaccggaucgaucccggcaa

SEQ ID NO: 3744867 - RNA, 12 nt, Salmonella enterica enterica serovar Typhi Ty2
uaccggcaacgc

SEQ ID NO: 3744868 - RNA, 14 nt, Salmonella enterica enterica serovar Typhi Ty2
uaccggcacaccgg

SEQ ID NO: 3744869 - RNA, 14 nt, Salmonella enterica enterica serovar Typhi Ty2
uaccggcaccagca

SEQ ID NO: 3744870 - RNA, 17 nt, Salmonella enterica enterica serovar Typhi Ty2
uaccggcaccagcaaug

SEQ ID NO: 3744871 - RNA, 23 nt, Salmonella enterica enterica serovar Typhi Ty2
uaccggcaggugauggcggcuug

SEQ ID NO: 3744872 - RNA, 16 nt, Salmonella enterica enterica serovar Typhi Ty2
uaccggcauuacccag

SEQ ID NO: 3744873 - RNA, 22 nt, Salmonella enterica enterica serovar Typhi Ty2
uaccggcgacgugacgcgccag

SEQ ID NO: 3744874 - RNA, 18 nt, Salmonella enterica enterica serovar Typhi Ty2
uaccggcgcucagccaga

SEQ ID NO: 3744875 - RNA, 22 nt, Salmonella enterica enterica serovar Typhi Ty2
uaccggcuaucagccgccggug

SEQ ID NO: 3744876 - RNA, 13 nt, Salmonella enterica enterica serovar Typhi Ty2
uaccgggcagcau

SEQ ID NO: 3744877 - RNA, 15 nt, Salmonella enterica enterica serovar Typhi Ty2
uaccgggccuacgga

SEQ ID NO: 3744878 - RNA, 16 nt, Salmonella enterica enterica serovar Typhi Ty2
uaccgggcuaaaccac

SEQ ID NO: 3744879 - RNA, 18 nt, Salmonella enterica enterica serovar Typhi Ty2
uaccggugcgauucagcg

SEQ ID NO: 3744880 - RNA, 20 nt, Salmonella enterica enterica serovar Typhi Ty2
uaccggugcgccccagcaug

SEQ ID NO: 3744881 - RNA, 22 nt, Salmonella enterica enterica serovar Typhi Ty2
uaccguaaaaugcuggugcauc

SEQ ID NO: 3744882 - RNA, 15 nt, Salmonella enterica enterica serovar Typhi Ty2
uaccguaaccgcagc

SEQ ID NO: 3744883 - RNA, 19 nt, Salmonella enterica enterica serovar Typhi Ty2
uaccguaagcuuucugaau

SEQ ID NO: 3744884 - RNA, 14 nt, Salmonella enterica enterica serovar Typhi Ty2
uaccguccagacuc

SEQ ID NO: 3744885 - RNA, 19 nt, Salmonella enterica enterica serovar Typhi Ty2
uaccguccagacuccuuuu

SEQ ID NO: 3744886 - RNA, 22 nt, Salmonella enterica enterica serovar Typhi Ty2
uaccguuucaacugccccuugu

SEQ ID NO: 3744887 - RNA, 20 nt, Salmonella enterica enterica serovar Typhi Ty2
uaccguuuggaucugucgcc

SEQ ID NO: 3744888 - RNA, 18 nt, Salmonella enterica enterica serovar Typhi Ty2
uaccuacaccaacggcga

SEQ ID NO: 3744889 - RNA, 21 nt, Salmonella enterica enterica serovar Typhi Ty2
uaccucaaaaaccaguugcca

SEQ ID NO: 3744890 - RNA, 17 nt, Salmonella enterica enterica serovar Typhi Ty2
uaccucgcgcuuauccg

SEQ ID NO: 3744891 - RNA, 14 nt, Salmonella enterica enterica serovar Typhi Ty2
uaccugauaaaauu

SEQ ID NO: 3744892 - RNA, 17 nt, Salmonella enterica enterica serovar Typhi Ty2
uaccugaugagcaggcc

SEQ ID NO: 3744893 - RNA, 21 nt, Salmonella enterica enterica serovar Typhi Ty2
uaccugcaaaaacgccagacc

SEQ ID NO: 3744894 - RNA, 22 nt, Salmonella enterica enterica serovar Typhi Ty2
uaccugcacuuuaagcggcagc

SEQ ID NO: 3744895 - RNA, 22 nt, Salmonella enterica enterica serovar Typhi Ty2
uaccugccagggugcaaagaaa

SEQ ID NO: 3744896 - RNA, 20 nt, Salmonella enterica enterica serovar Typhi Ty2
uacgcugaagauuuuuauuc

SEQ ID NO: 3744897 - RNA, 15 nt, Salmonella enterica enterica serovar Typhi Ty2
uacgcugcgucaggc

SEQ ID NO: 3744898 - RNA, 15 nt, Salmonella enterica enterica serovar Typhi Ty2
uacgcuggugcagcc

SEQ ID NO: 3744899 - RNA, 14 nt, Salmonella enterica enterica serovar Typhi Ty2
uacgcuguaacccg

SEQ ID NO: 3744900 - RNA, 18 nt, Salmonella enterica enterica serovar Typhi Ty2
uacgcuguagcuggcugc

SEQ ID NO: 3744901 - RNA, 23 nt, Salmonella enterica enterica serovar Typhi Ty2
uacgcuuauagguguaaaccguu

SEQ ID NO: 3744902 - RNA, 14 nt, Salmonella enterica enterica serovar Typhi Ty2
uacgcuuaucaggc

SEQ ID NO: 3744903 - RNA, 19 nt, Salmonella enterica enterica serovar Typhi Ty2
uacgcuuaucaggccuaca

SEQ ID NO: 3744904 - RNA, 20 nt, Salmonella enterica enterica serovar Typhi Ty2
uacgcuuaucaggccuacaa

SEQ ID NO: 3744905 - RNA, 18 nt, Salmonella enterica enterica serovar Typhi Ty2
uacgcuuauucggucuga

SEQ ID NO: 3744906 - RNA, 17 nt, Salmonella enterica enterica serovar Typhi Ty2
uacgcuucguugccccg

SEQ ID NO: 3744907 - RNA, 15 nt, Salmonella enterica enterica serovar Typhi Ty2
uacgcuucucuccau

SEQ ID NO: 3744908 - RNA, 19 nt, Salmonella enterica enterica serovar Typhi Ty2
uacgcuuuauucugucgcc

SEQ ID NO: 3744909 - RNA, 14 nt, Salmonella enterica enterica serovar Typhi Ty2
uacggaaaaaauac

SEQ ID NO: 3744910 - RNA, 15 nt, Salmonella enterica enterica serovar Typhi Ty2
uacggaaaaaauacu

SEQ ID NO: 3744911 - RNA, 12 nt, Salmonella enterica enterica serovar Typhi Ty2
uacggaaaaaug

SEQ ID NO: 3744912 - RNA, 20 nt, Salmonella enterica enterica serovar Typhi Ty2
uacggaaagcuguuguugcu

SEQ ID NO: 3744913 - RNA, 23 nt, Salmonella enterica enterica serovar Typhi Ty2
uacggacguggggguucaagucc

SEQ ID NO: 3744914 - RNA, 21 nt, Salmonella enterica enterica serovar Typhi Ty2
uacggaguuggaaccaaacac

SEQ ID NO: 3744915 - RNA, 20 nt, Salmonella enterica enterica serovar Typhi Ty2
uacggauggcccugccgggg

SEQ ID NO: 3744916 - RNA, 17 nt, Salmonella enterica enterica serovar Typhi Ty2
uacggcaaacgcuggug

SEQ ID NO: 3744917 - RNA, 11 nt, Salmonella enterica enterica serovar Typhi Ty2
uacggcaggcc

SEQ ID NO: 3744918 - RNA, 14 nt, Salmonella enterica enterica serovar Typhi Ty2
uacggcaucggaac

SEQ ID NO: 3744919 - RNA, 14 nt, Salmonella enterica enterica serovar Typhi Ty2
uacggcauggcguc

SEQ ID NO: 3744920 - RNA, 20 nt, Salmonella enterica enterica serovar Typhi Ty2
uacggccacaaaacaggauu

SEQ ID NO: 3744921 - RNA, 16 nt, Salmonella enterica enterica serovar Typhi Ty2
uacggccauggaacau

SEQ ID NO: 3744922 - RNA, 20 nt, Salmonella enterica enterica serovar Typhi Ty2
uacggcccauaucaaucaac

SEQ ID NO: 3744923 - RNA, 12 nt, Salmonella enterica enterica serovar Typhi Ty2
uacggcgugaug

SEQ ID NO: 3744924 - RNA, 23 nt, Salmonella enterica enterica serovar Typhi Ty2
uacggcuaauuaaucugucgaug

SEQ ID NO: 3744925 - RNA, 16 nt, Salmonella enterica enterica serovar Typhi Ty2
uacggcuccagcacau

SEQ ID NO: 3744926 - RNA, 23 nt, Salmonella enterica enterica serovar Typhi Ty2
uacggcugaaaaauccccccucc

SEQ ID NO: 3744927 - RNA, 13 nt, Salmonella enterica enterica serovar Typhi Ty2
uacggcuuccacu

SEQ ID NO: 3744928 - RNA, 20 nt, Salmonella enterica enterica serovar Typhi Ty2
uacggcuuucacaccguuau

SEQ ID NO: 3744929 - RNA, 16 nt, Salmonella enterica enterica serovar Typhi Ty2
uacgggaaugcgucgg

SEQ ID NO: 3744930 - RNA, 21 nt, Salmonella enterica enterica serovar Typhi Ty2
uacgggagagcguauccagca

SEQ ID NO: 3744931 - RNA, 14 nt, Salmonella enterica enterica serovar Typhi Ty2
uacgguaauaacuc

SEQ ID NO: 3744932 - RNA, 13 nt, Salmonella enterica enterica serovar Typhi Ty2
uacgguuuauccc

SEQ ID NO: 3744933 - RNA, 14 nt, Salmonella enterica enterica serovar Typhi Ty2
uacguaauaaaauu

SEQ ID NO: 3744934 - RNA, 17 nt, Salmonella enterica enterica serovar Typhi Ty2
uacguacggauggcguc

SEQ ID NO: 3744935 - RNA, 18 nt, Salmonella enterica enterica serovar Typhi Ty2
uacguaguccggcaauga

SEQ ID NO: 3744936 - RNA, 16 nt, Salmonella enterica enterica serovar Typhi Ty2
uacgucauaucaucca

SEQ ID NO: 3744937 - RNA, 17 nt, Salmonella enterica enterica serovar Typhi Ty2
uacgucauaucauccag

SEQ ID NO: 3744938 - RNA, 19 nt, Salmonella enterica enterica serovar Typhi Ty2
uacgucgcauacuuccuca

SEQ ID NO: 3744939 - RNA, 19 nt, Salmonella enterica enterica serovar Typhi Ty2
uacgucgcccucuuuggcg

SEQ ID NO: 3744940 - RNA, 19 nt, Salmonella enterica enterica serovar Typhi Ty2
uacgucucgaguaaucacu

SEQ ID NO: 3744941 - RNA, 20 nt, Salmonella enterica enterica serovar Typhi Ty2
uacguucaccccgucauauu

SEQ ID NO: 3744942 - RNA, 14 nt, Salmonella enterica enterica serovar Typhi Ty2
uacguucaucaggc

SEQ ID NO: 3744943 - RNA, 13 nt, Salmonella enterica enterica serovar Typhi Ty2
uacguuccagcag

SEQ ID NO: 3744944 - RNA, 20 nt, Salmonella enterica enterica serovar Typhi Ty2
uacguugauuggcugugaca

SEQ ID NO: 3744945 - RNA, 12 nt, Salmonella enterica enterica serovar Typhi Ty2
uacguuuauucu

SEQ ID NO: 3744946 - RNA, 19 nt, Salmonella enterica enterica serovar Typhi Ty2
uacuaacggcgucauccug

SEQ ID NO: 3744947 - RNA, 17 nt, Salmonella enterica enterica serovar Typhi Ty2
uacuaauaaaauucacu

SEQ ID NO: 3744948 - RNA, 13 nt, Salmonella enterica enterica serovar Typhi Ty2
uacuaauaaauau

SEQ ID NO: 3744949 - RNA, 14 nt, Salmonella enterica enterica serovar Typhi Ty2
uacuaauaaauauu

SEQ ID NO: 3744950 - RNA, 16 nt, Salmonella enterica enterica serovar Typhi Ty2
uacuaaugaauuuaau

SEQ ID NO: 3744951 - RNA, 17 nt, Salmonella enterica enterica serovar Typhi Ty2
uacuaaugaauuuaaua

SEQ ID NO: 3744952 - RNA, 20 nt, Salmonella enterica enterica serovar Typhi Ty2
uacuaaugaauuuaauauuu

SEQ ID NO: 3744953 - RNA, 13 nt, Salmonella enterica enterica serovar Typhi Ty2
uacuacaacuguc

SEQ ID NO: 3744954 - RNA, 15 nt, Salmonella enterica enterica serovar Typhi Ty2
uacuacagaaagcca

SEQ ID NO: 3744955 - RNA, 20 nt, Salmonella enterica enterica serovar Typhi Ty2
uacuacugguggaauaaaua

SEQ ID NO: 3744956 - RNA, 21 nt, Salmonella enterica enterica serovar Typhi Ty2
uacuacugguggaauaaauau

SEQ ID NO: 3744957 - RNA, 22 nt, Salmonella enterica enterica serovar Typhi Ty2
uacuaucuucaaagccacacug

SEQ ID NO: 3744958 - RNA, 17 nt, Salmonella enterica enterica serovar Typhi Ty2
uacuauuuuucacccua

SEQ ID NO: 3744959 - RNA, 17 nt, Salmonella enterica enterica serovar Typhi Ty2
uacucaauauccugcgg

SEQ ID NO: 3744960 - RNA, 16 nt, Salmonella enterica enterica serovar Typhi Ty2
uacucacauucauaaa

SEQ ID NO: 3744961 - RNA, 20 nt, Salmonella enterica enterica serovar Typhi Ty2
uacucacauucauaaaagau

SEQ ID NO: 3744962 - RNA, 19 nt, Salmonella enterica enterica serovar Typhi Ty2
uacucacgacuuucaccag

SEQ ID NO: 3744963 - RNA, 20 nt, Salmonella enterica enterica serovar Typhi Ty2
uacucacgacuuucaccaga

SEQ ID NO: 3744964 - RNA, 13 nt, Salmonella enterica enterica serovar Typhi Ty2
uacucacugccgc

SEQ ID NO: 3744965 - RNA, 20 nt, Salmonella enterica enterica serovar Typhi Ty2
uacucagcgacguaaucuau

SEQ ID NO: 3744966 - RNA, 14 nt, Salmonella enterica enterica serovar Typhi Ty2
uacucaguuugccg

SEQ ID NO: 3744967 - RNA, 16 nt, Salmonella enterica enterica serovar Typhi Ty2
uacucaucauaauccu

SEQ ID NO: 3744968 - RNA, 21 nt, Salmonella enterica enterica serovar Typhi Ty2
uacuccauucccagcucuuuc

SEQ ID NO: 3744969 - RNA, 16 nt, Salmonella enterica enterica serovar Typhi Ty2
uacucugcggagcaag

SEQ ID NO: 3744970 - RNA, 13 nt, Salmonella enterica enterica serovar Typhi Ty2
uacucuuccacca

SEQ ID NO: 3744971 - RNA, 12 nt, Salmonella enterica enterica serovar Typhi Ty2
uacucuuccucc

SEQ ID NO: 3744972 - RNA, 15 nt, Salmonella enterica enterica serovar Typhi Ty2
uacucuuccugcugc

SEQ ID NO: 3744973 - RNA, 19 nt, Salmonella enterica enterica serovar Typhi Ty2
uacucuuggagagcaucau

SEQ ID NO: 3744974 - RNA, 21 nt, Salmonella enterica enterica serovar Typhi Ty2
uacucuuggagagcaucaucu

SEQ ID NO: 3744975 - RNA, 19 nt, Salmonella enterica enterica serovar Typhi Ty2
uacucuuugaacagccaga

SEQ ID NO: 3744976 - RNA, 13 nt, Salmonella enterica enterica serovar Typhi Ty2
uacucuuuuuccg

SEQ ID NO: 3744977 - RNA, 20 nt, Salmonella enterica enterica serovar Typhi Ty2
uacugaaauuucuuuuccag

SEQ ID NO: 3744978 - RNA, 16 nt, Salmonella enterica enterica serovar Typhi Ty2
uagauaacuauaugcc

SEQ ID NO: 3744979 - RNA, 22 nt, Salmonella enterica enterica serovar Typhi Ty2
uagauauaacccaguucaaauc

SEQ ID NO: 3744980 - RNA, 17 nt, Salmonella enterica enterica serovar Typhi Ty2
uagauauagcuuuucaa

SEQ ID NO: 3744981 - RNA, 13 nt, Salmonella enterica enterica serovar Typhi Ty2
uagauauuaauau

SEQ ID NO: 3744982 - RNA, 12 nt, Salmonella enterica enterica serovar Typhi Ty2
uagaugcgucgc

SEQ ID NO: 3744983 - RNA, 19 nt, Salmonella enterica enterica serovar Typhi Ty2
uagauucuaacauaaugaa

SEQ ID NO: 3744984 - RNA, 15 nt, Salmonella enterica enterica serovar Typhi Ty2
uagauuuucaucaua

SEQ ID NO: 3744985 - RNA, 14 nt, Salmonella enterica enterica serovar Typhi Ty2
uagcaaaaaugccg

SEQ ID NO: 3744986 - RNA, 18 nt, Salmonella enterica enterica serovar Typhi Ty2
uagcaaauugcugauguu

SEQ ID NO: 3744987 - RNA, 13 nt, Salmonella enterica enterica serovar Typhi Ty2
uagcaacccacuu

SEQ ID NO: 3744988 - RNA, 22 nt, Salmonella enterica enterica serovar Typhi Ty2
uagcaacccacuuucggaaaaa

SEQ ID NO: 3744989 - RNA, 15 nt, Salmonella enterica enterica serovar Typhi Ty2
uagcaacuuaauaau

SEQ ID NO: 3744990 - RNA, 14 nt, Salmonella enterica enterica serovar Typhi Ty2
uagcaaucucgcca

SEQ ID NO: 3744991 - RNA, 15 nt, Salmonella enterica enterica serovar Typhi Ty2
uagcaaucucgccaa

SEQ ID NO: 3744992 - RNA, 18 nt, Salmonella enterica enterica serovar Typhi Ty2
uagcaauuaauaaacaau

SEQ ID NO: 3744993 - RNA, 23 nt, Salmonella enterica enterica serovar Typhi Ty2
uagcaauuauauugcguaaaaac

SEQ ID NO: 3744994 - RNA, 19 nt, Salmonella enterica enterica serovar Typhi Ty2
uagcacauuuuuaucaggc

SEQ ID NO: 3744995 - RNA, 12 nt, Salmonella enterica enterica serovar Typhi Ty2
uagcaccagacc

SEQ ID NO: 3744996 - RNA, 21 nt, Salmonella enterica enterica serovar Typhi Ty2
uagcacccuucgcuauccauc

SEQ ID NO: 3744997 - RNA, 23 nt, Salmonella enterica enterica serovar Typhi Ty2
uagcaccucgcaauauucaugcc

SEQ ID NO: 3744998 - RNA, 15 nt, Salmonella enterica enterica serovar Typhi Ty2
uagcagaccgguacg

SEQ ID NO: 3744999 - RNA, 19 nt, Salmonella enterica enterica serovar Typhi Ty2
uagcagcgaugacagcagg

SEQ ID NO: 3745000 - RNA, 14 nt, Salmonella enterica enterica serovar Typhi Ty2
uagcauaaaugcga

SEQ ID NO: 3745001 - RNA, 17 nt, Salmonella enterica enterica serovar Typhi Ty2
uagcauaacguuuccuu

SEQ ID NO: 3745002 - RNA, 17 nt, Salmonella enterica enterica serovar Typhi Ty2
uagcaucaggacauggu

SEQ ID NO: 3745003 - RNA, 14 nt, Salmonella enterica enterica serovar Typhi Ty2
uagcauccagaccc

SEQ ID NO: 3745004 - RNA, 20 nt, Salmonella enterica enterica serovar Typhi Ty2
uagcaucccgcaggcggcga

SEQ ID NO: 3745005 - RNA, 16 nt, Salmonella enterica enterica serovar Typhi Ty2
uagcaucucuucgaca

SEQ ID NO: 3745006 - RNA, 20 nt, Salmonella enterica enterica serovar Typhi Ty2
uagcauuaagcugauauuuu

SEQ ID NO: 3745007 - RNA, 23 nt, Salmonella enterica enterica serovar Typhi Ty2
uagcauuaagcugauauuuuacu

SEQ ID NO: 3745008 - RNA, 20 nt, Salmonella enterica enterica serovar Typhi Ty2
uagccaacacauaagccacu

SEQ ID NO: 3745009 - RNA, 17 nt, Salmonella enterica enterica serovar Typhi Ty2
uagccaauaacgucugg

SEQ ID NO: 3745010 - RNA, 18 nt, Salmonella enterica enterica serovar Typhi Ty2
uagccacagcgcgcgaca

SEQ ID NO: 3745011 - RNA, 12 nt, Salmonella enterica enterica serovar Typhi Ty2
uagccagaacgu

SEQ ID NO: 3745012 - RNA, 23 nt, Salmonella enterica enterica serovar Typhi Ty2
uagccagacagcccuauaacagc

SEQ ID NO: 3745013 - RNA, 20 nt, Salmonella enterica enterica serovar Typhi Ty2
uagccagccugaacgggugg

SEQ ID NO: 3745014 - RNA, 20 nt, Salmonella enterica enterica serovar Typhi Ty2
uagccaguaccgaaaucauc

SEQ ID NO: 3745015 - RNA, 16 nt, Salmonella enterica enterica serovar Typhi Ty2
uagccaguuuuccgcc

SEQ ID NO: 3745016 - RNA, 15 nt, Salmonella enterica enterica serovar Typhi Ty2
uagccauucauuaaa

SEQ ID NO: 3745017 - RNA, 21 nt, Salmonella enterica enterica serovar Typhi Ty2
uagcccauauaacguuuucag

SEQ ID NO: 3745018 - RNA, 21 nt, Salmonella enterica enterica serovar Typhi Ty2
uagccccagaccgauauuuug

SEQ ID NO: 3745019 - RNA, 23 nt, Salmonella enterica enterica serovar Typhi Ty2
uagcccgcuuuaccgaaaucggu

SEQ ID NO: 3745020 - RNA, 14 nt, Salmonella enterica enterica serovar Typhi Ty2
uagcccggcaggcu

SEQ ID NO: 3745021 - RNA, 16 nt, Salmonella enterica enterica serovar Typhi Ty2
uagcccggcaggcugg

SEQ ID NO: 3745022 - RNA, 17 nt, Salmonella enterica enterica serovar Typhi Ty2
uagcccggcaggcuggu

SEQ ID NO: 3745023 - RNA, 14 nt, Salmonella enterica enterica serovar Typhi Ty2
uagccgcauccggc

SEQ ID NO: 3745024 - RNA, 16 nt, Salmonella enterica enterica serovar Typhi Ty2
uagccgccccccguca

SEQ ID NO: 3745025 - RNA, 21 nt, Salmonella enterica enterica serovar Typhi Ty2
uagccgcgcgccgccucuuca

SEQ ID NO: 3745026 - RNA, 19 nt, Salmonella enterica enterica serovar Typhi Ty2
uagccgcgcucaagcuggg

SEQ ID NO: 3745027 - RNA, 16 nt, Salmonella enterica enterica serovar Typhi Ty2
uagccgcugcccugac

SEQ ID NO: 3745028 - RNA, 18 nt, Salmonella enterica enterica serovar Typhi Ty2
uagccgguaacuuucccg

SEQ ID NO: 3745029 - RNA, 22 nt, Salmonella enterica enterica serovar Typhi Ty2
uagccuucccggggaacagaag

SEQ ID NO: 3745030 - RNA, 24 nt, Salmonella enterica enterica serovar Typhi Ty2
uagccuugacgcaauagaguaaug

SEQ ID NO: 3745031 - RNA, 14 nt, Salmonella enterica enterica serovar Typhi Ty2
uagccuuuauugau

SEQ ID NO: 3745032 - RNA, 15 nt, Salmonella enterica enterica serovar Typhi Ty2
uagccuuuuucuuuc

SEQ ID NO: 3745033 - RNA, 20 nt, Salmonella enterica enterica serovar Typhi Ty2
uagccuuuuucuuucagacc

SEQ ID NO: 3745034 - RNA, 15 nt, Salmonella enterica enterica serovar Typhi Ty2
uagcgaaacaguugg

SEQ ID NO: 3745035 - RNA, 19 nt, Salmonella enterica enterica serovar Typhi Ty2
uagcgaaacugccuaaauu

SEQ ID NO: 3745036 - RNA, 20 nt, Salmonella enterica enterica serovar Typhi Ty2
uagcgaaacugccuaaauug

SEQ ID NO: 3745037 - RNA, 14 nt, Salmonella enterica enterica serovar Typhi Ty2
uagcgaccuuaccg

SEQ ID NO: 3745038 - RNA, 22 nt, Salmonella enterica enterica serovar Typhi Ty2
uagcgacggcgcgccaaacggc

SEQ ID NO: 3745039 - RNA, 22 nt, Salmonella enterica enterica serovar Typhi Ty2
uagcgagaagccgauggaagua

SEQ ID NO: 3745040 - RNA, 21 nt, Salmonella enterica enterica serovar Typhi Ty2
uagcgagucaaaccucacgua

SEQ ID NO: 3745041 - RNA, 17 nt, Salmonella enterica enterica serovar Typhi Ty2
uagcgcaaaagcgcgcc

SEQ ID NO: 3745042 - RNA, 18 nt, Salmonella enterica enterica serovar Typhi Ty2
uagcgcaaauauccuacc

SEQ ID NO: 3745043 - RNA, 19 nt, Salmonella enterica enterica serovar Typhi Ty2
uagcgcaggggggaaauga

SEQ ID NO: 3745044 - RNA, 20 nt, Salmonella enterica enterica serovar Typhi Ty2
uagcgcaggggggaaaugag

SEQ ID NO: 3745045 - RNA, 14 nt, Salmonella enterica enterica serovar Typhi Ty2
uagcgccagcagca

SEQ ID NO: 3745046 - RNA, 16 nt, Salmonella enterica enterica serovar Typhi Ty2
uagcgccagcagcaua

SEQ ID NO: 3745047 - RNA, 14 nt, Salmonella enterica enterica serovar Typhi Ty2
uagcgccauauaaa

SEQ ID NO: 3745048 - RNA, 14 nt, Salmonella enterica enterica serovar Typhi Ty2
uagcgccaucaggc

SEQ ID NO: 3745049 - RNA, 23 nt, Salmonella enterica enterica serovar Typhi Ty2
uagcgccccggugcuuucuccug

SEQ ID NO: 3745050 - RNA, 16 nt, Salmonella enterica enterica serovar Typhi Ty2
uagcgccuaugcuguc

SEQ ID NO: 3745051 - RNA, 22 nt, Salmonella enterica enterica serovar Typhi Ty2
uagcgccuccccuaaucgagga

SEQ ID NO: 3745052 - RNA, 12 nt, Salmonella enterica enterica serovar Typhi Ty2
uagcgccugcuc

SEQ ID NO: 3745053 - RNA, 13 nt, Salmonella enterica enterica serovar Typhi Ty2
uagcgccuuaucg

SEQ ID NO: 3745054 - RNA, 21 nt, Salmonella enterica enterica serovar Typhi Ty2
uagcgccuucaggcaucagau

SEQ ID NO: 3745055 - RNA, 21 nt, Salmonella enterica enterica serovar Typhi Ty2
uagcgcgcgcuaauuuucagg

SEQ ID NO: 3745056 - RNA, 12 nt, Salmonella enterica enterica serovar Typhi Ty2
uagcgcgcugcu

SEQ ID NO: 3745057 - RNA, 15 nt, Salmonella enterica enterica serovar Typhi Ty2
uagcgcgcuuccugc

SEQ ID NO: 3745058 - RNA, 13 nt, Salmonella enterica enterica serovar Typhi Ty2
uagcgcugcgcca

SEQ ID NO: 3745059 - RNA, 21 nt, Salmonella enterica enterica serovar Typhi Ty2
uagcgcugcgccagaucaggc

SEQ ID NO: 3745060 - RNA, 21 nt, Salmonella enterica enterica serovar Typhi Ty2
uauagacgccggucaugccau

SEQ ID NO: 3745061 - RNA, 15 nt, Salmonella enterica enterica serovar Typhi Ty2
uauagccauuuuuug

SEQ ID NO: 3745062 - RNA, 13 nt, Salmonella enterica enterica serovar Typhi Ty2
uauagcccacgca

SEQ ID NO: 3745063 - RNA, 12 nt, Salmonella enterica enterica serovar Typhi Ty2
uauaggccaggc

SEQ ID NO: 3745064 - RNA, 13 nt, Salmonella enterica enterica serovar Typhi Ty2
uauaguaaauuga

SEQ ID NO: 3745065 - RNA, 16 nt, Salmonella enterica enterica serovar Typhi Ty2
uauaguccacuuucug

SEQ ID NO: 3745066 - RNA, 22 nt, Salmonella enterica enterica serovar Typhi Ty2
uauaguucgcauagaauuucag

SEQ ID NO: 3745067 - RNA, 21 nt, Salmonella enterica enterica serovar Typhi Ty2
uauauaacauauagcagcagu

SEQ ID NO: 3745068 - RNA, 12 nt, Salmonella enterica enterica serovar Typhi Ty2
uauauaauucau

SEQ ID NO: 3745069 - RNA, 15 nt, Salmonella enterica enterica serovar Typhi Ty2
uauauauuuucucaa

SEQ ID NO: 3745070 - RNA, 13 nt, Salmonella enterica enterica serovar Typhi Ty2
uauaucaggcaaa

SEQ ID NO: 3745071 - RNA, 18 nt, Salmonella enterica enterica serovar Typhi Ty2
uauaucaugggaaaucac

SEQ ID NO: 3745072 - RNA, 20 nt, Salmonella enterica enterica serovar Typhi Ty2
uauaucgcgauaaacugaca

SEQ ID NO: 3745073 - RNA, 15 nt, Salmonella enterica enterica serovar Typhi Ty2
uauaugcaaaacugu

SEQ ID NO: 3745074 - RNA, 18 nt, Salmonella enterica enterica serovar Typhi Ty2
uauaugcaggcauaaaaa

SEQ ID NO: 3745075 - RNA, 19 nt, Salmonella enterica enterica serovar Typhi Ty2
uauaugcaggcauaaaaaa

SEQ ID NO: 3745076 - RNA, 14 nt, Salmonella enterica enterica serovar Typhi Ty2
uauaugccugccaa

SEQ ID NO: 3745077 - RNA, 22 nt, Salmonella enterica enterica serovar Typhi Ty2
uauaugcgacagaaauugaauu

SEQ ID NO: 3745078 - RNA, 21 nt, Salmonella enterica enterica serovar Typhi Ty2
uauauguccuuuacugcgcca

SEQ ID NO: 3745079 - RNA, 14 nt, Salmonella enterica enterica serovar Typhi Ty2
uauauguugaauau

SEQ ID NO: 3745080 - RNA, 13 nt, Salmonella enterica enterica serovar Typhi Ty2
uauauuaguguua

SEQ ID NO: 3745081 - RNA, 13 nt, Salmonella enterica enterica serovar Typhi Ty2
uauauucagaauu

SEQ ID NO: 3745082 - RNA, 15 nt, Salmonella enterica enterica serovar Typhi Ty2
uauauuccagccagg

SEQ ID NO: 3745083 - RNA, 19 nt, Salmonella enterica enterica serovar Typhi Ty2
uauauuccgcaggcaagaa

SEQ ID NO: 3745084 - RNA, 13 nt, Salmonella enterica enterica serovar Typhi Ty2
uauauuccgccuc

SEQ ID NO: 3745085 - RNA, 23 nt, Salmonella enterica enterica serovar Typhi Ty2
uauauucgcgaugcucaaccagu

SEQ ID NO: 3745086 - RNA, 23 nt, Salmonella enterica enterica serovar Typhi Ty2
uauauucugggcuuacuuuccaa

SEQ ID NO: 3745087 - RNA, 22 nt, Salmonella enterica enterica serovar Typhi Ty2
uauauucuucuuagaauagaau

SEQ ID NO: 3745088 - RNA, 15 nt, Salmonella enterica enterica serovar Typhi Ty2
uauauugaaaaggga

SEQ ID NO: 3745089 - RNA, 21 nt, Salmonella enterica enterica serovar Typhi Ty2
uauauuuacugaauaaauagu

SEQ ID NO: 3745090 - RNA, 11 nt, Salmonella enterica enterica serovar Typhi Ty2
uauauuuuuaa

SEQ ID NO: 3745091 - RNA, 18 nt, Salmonella enterica enterica serovar Typhi Ty2
uaucaaaaaaaaccagau

SEQ ID NO: 3745092 - RNA, 13 nt, Salmonella enterica enterica serovar Typhi Ty2
uaucaaaaagacu

SEQ ID NO: 3745093 - RNA, 22 nt, Salmonella enterica enterica serovar Typhi Ty2
uaucaaaaagacuccggcagca

SEQ ID NO: 3745094 - RNA, 13 nt, Salmonella enterica enterica serovar Typhi Ty2
uaucaaaccagcu

SEQ ID NO: 3745095 - RNA, 22 nt, Salmonella enterica enterica serovar Typhi Ty2
uaucaaacugaaaaucaaauaa

SEQ ID NO: 3745096 - RNA, 23 nt, Salmonella enterica enterica serovar Typhi Ty2
uaucaaacugaaaaucaaauaag

SEQ ID NO: 3745097 - RNA, 14 nt, Salmonella enterica enterica serovar Typhi Ty2
uaucaaauacgcua

SEQ ID NO: 3745098 - RNA, 18 nt, Salmonella enterica enterica serovar Typhi Ty2
uaucaaaucuucauuuca

SEQ ID NO: 3745099 - RNA, 14 nt, Salmonella enterica enterica serovar Typhi Ty2
uaucaagauaaaaa

SEQ ID NO: 3745100 - RNA, 12 nt, Salmonella enterica enterica serovar Typhi Ty2
uaucaagccuac

SEQ ID NO: 3745101 - RNA, 15 nt, Salmonella enterica enterica serovar Typhi Ty2
uaucaagccuacacc

SEQ ID NO: 3745102 - RNA, 20 nt, Salmonella enterica enterica serovar Typhi Ty2
uaucaauaaugcgcugcaca

SEQ ID NO: 3745103 - RNA, 17 nt, Salmonella enterica enterica serovar Typhi Ty2
uaucaaucaccucuucc

SEQ ID NO: 3745104 - RNA, 19 nt, Salmonella enterica enterica serovar Typhi Ty2
uaucaauguauuguucaug

SEQ ID NO: 3745105 - RNA, 16 nt, Salmonella enterica enterica serovar Typhi Ty2
uaucaauuucauauua

SEQ ID NO: 3745106 - RNA, 17 nt, Salmonella enterica enterica serovar Typhi Ty2
uaucaauuucauauuau

SEQ ID NO: 3745107 - RNA, 11 nt, Salmonella enterica enterica serovar Typhi Ty2
uaucacacccg

SEQ ID NO: 3745108 - RNA, 19 nt, Salmonella enterica enterica serovar Typhi Ty2
uaucaccaaguagacagag

SEQ ID NO: 3745109 - RNA, 12 nt, Salmonella enterica enterica serovar Typhi Ty2
uaucaccaucuu

SEQ ID NO: 3745110 - RNA, 14 nt, Salmonella enterica enterica serovar Typhi Ty2
uaucacugguuaua

SEQ ID NO: 3745111 - RNA, 15 nt, Salmonella enterica enterica serovar Typhi Ty2
uaucagacaaucugu

SEQ ID NO: 3745112 - RNA, 13 nt, Salmonella enterica enterica serovar Typhi Ty2
uaucagacucagg

SEQ ID NO: 3745113 - RNA, 16 nt, Salmonella enterica enterica serovar Typhi Ty2
uaucagcaagcgccag

SEQ ID NO: 3745114 - RNA, 18 nt, Salmonella enterica enterica serovar Typhi Ty2
uaucagcgcguuuuccau

SEQ ID NO: 3745115 - RNA, 19 nt, Salmonella enterica enterica serovar Typhi Ty2
uaucagcguccggagcagc

SEQ ID NO: 3745116 - RNA, 14 nt, Salmonella enterica enterica serovar Typhi Ty2
uaucagcuugccgu

SEQ ID NO: 3745117 - RNA, 20 nt, Salmonella enterica enterica serovar Typhi Ty2
uaucaggccgacaaaugacg

SEQ ID NO: 3745118 - RNA, 14 nt, Salmonella enterica enterica serovar Typhi Ty2
uaucaggccuacac

SEQ ID NO: 3745119 - RNA, 17 nt, Salmonella enterica enterica serovar Typhi Ty2
uaucaggccuaccaguc

SEQ ID NO: 3745120 - RNA, 23 nt, Salmonella enterica enterica serovar Typhi Ty2
uaucaggcugagcgacgguuuua

SEQ ID NO: 3745121 - RNA, 15 nt, Salmonella enterica enterica serovar Typhi Ty2
uaucagguaacauau

SEQ ID NO: 3745122 - RNA, 14 nt, Salmonella enterica enterica serovar Typhi Ty2
uaucauaaaaggcu

SEQ ID NO: 3745123 - RNA, 19 nt, Salmonella enterica enterica serovar Typhi Ty2
uaucauagacugcgcuuaa

SEQ ID NO: 3745124 - RNA, 16 nt, Salmonella enterica enterica serovar Typhi Ty2
uaucaugcugcgguua

SEQ ID NO: 3745125 - RNA, 12 nt, Salmonella enterica enterica serovar Typhi Ty2
uaucauuuccac

SEQ ID NO: 3745126 - RNA, 14 nt, Salmonella enterica enterica serovar Typhi Ty2
uauccacagcgaau

SEQ ID NO: 3745127 - RNA, 15 nt, Salmonella enterica enterica serovar Typhi Ty2
uauccaccgccagac

SEQ ID NO: 3745128 - RNA, 22 nt, Salmonella enterica enterica serovar Typhi Ty2
uauccacugucgggcaaaaugc

SEQ ID NO: 3745129 - RNA, 13 nt, Salmonella enterica enterica serovar Typhi Ty2
uauccagauagcg

SEQ ID NO: 3745130 - RNA, 21 nt, Salmonella enterica enterica serovar Typhi Ty2
uauccagcacgguaaaccucu

SEQ ID NO: 3745131 - RNA, 16 nt, Salmonella enterica enterica serovar Typhi Ty2
uauccagcaguaaaua

SEQ ID NO: 3745132 - RNA, 18 nt, Salmonella enterica enterica serovar Typhi Ty2
uauccagcgcccgcuuca

SEQ ID NO: 3745133 - RNA, 17 nt, Salmonella enterica enterica serovar Typhi Ty2
uauccagcggcaaaggc

SEQ ID NO: 3745134 - RNA, 19 nt, Salmonella enterica enterica serovar Typhi Ty2
uauccagcggcaaaggcau

SEQ ID NO: 3745135 - RNA, 19 nt, Salmonella enterica enterica serovar Typhi Ty2
uauccagucagcguuacug

SEQ ID NO: 3745136 - RNA, 14 nt, Salmonella enterica enterica serovar Typhi Ty2
uauccaguugcgcc

SEQ ID NO: 3745137 - RNA, 13 nt, Salmonella enterica enterica serovar Typhi Ty2
uauccaguuucug

SEQ ID NO: 3745138 - RNA, 19 nt, Salmonella enterica enterica serovar Typhi Ty2
uauccaguuucugacguaa

SEQ ID NO: 3745139 - RNA, 16 nt, Salmonella enterica enterica serovar Typhi Ty2
uauccauaauuuuccc

SEQ ID NO: 3745140 - RNA, 15 nt, Salmonella enterica enterica serovar Typhi Ty2
uauccauacaagcgu

SEQ ID NO: 3745141 - RNA, 23 nt, Salmonella enterica enterica serovar Typhi Ty2
uauccaucagccaggguuuaauc

SEQ ID NO: 3745142 - RNA, 16 nt, Salmonella enterica enterica serovar Typhi Ty2
uauccauuagcgccug

SEQ ID NO: 3745143 - RNA, 12 nt, Salmonella enterica enterica serovar Typhi Ty2
uaucuuccagcg

SEQ ID NO: 3745144 - RNA, 17 nt, Salmonella enterica enterica serovar Typhi Ty2
uaucuucccgauaacug

SEQ ID NO: 3745145 - RNA, 21 nt, Salmonella enterica enterica serovar Typhi Ty2
uaucuucccgauaacugaagg

SEQ ID NO: 3745146 - RNA, 18 nt, Salmonella enterica enterica serovar Typhi Ty2
uaucuucgccguauucuu

SEQ ID NO: 3745147 - RNA, 22 nt, Salmonella enterica enterica serovar Typhi Ty2
uaucuucggucgagcuuuugcu

SEQ ID NO: 3745148 - RNA, 20 nt, Salmonella enterica enterica serovar Typhi Ty2
uaucuucugcugcucccuca

SEQ ID NO: 3745149 - RNA, 13 nt, Salmonella enterica enterica serovar Typhi Ty2
uaucuugauauca

SEQ ID NO: 3745150 - RNA, 12 nt, Salmonella enterica enterica serovar Typhi Ty2
uaucuugcuuua

SEQ ID NO: 3745151 - RNA, 13 nt, Salmonella enterica enterica serovar Typhi Ty2
uaucuugcuuuau

SEQ ID NO: 3745152 - RNA, 17 nt, Salmonella enterica enterica serovar Typhi Ty2
uaucuuuaugucaguaa

SEQ ID NO: 3745153 - RNA, 22 nt, Salmonella enterica enterica serovar Typhi Ty2
uaucuuuauugaaaagcagcca

SEQ ID NO: 3745154 - RNA, 13 nt, Salmonella enterica enterica serovar Typhi Ty2
uaucuuuuuuagu

SEQ ID NO: 3745155 - RNA, 13 nt, Salmonella enterica enterica serovar Typhi Ty2
uaugaaagagaaa

SEQ ID NO: 3745156 - RNA, 16 nt, Salmonella enterica enterica serovar Typhi Ty2
uaugaaagccaucgcu

SEQ ID NO: 3745157 - RNA, 15 nt, Salmonella enterica enterica serovar Typhi Ty2
uaugaaauucuugcc

SEQ ID NO: 3745158 - RNA, 20 nt, Salmonella enterica enterica serovar Typhi Ty2
uaugaaauucuugcccgcug

SEQ ID NO: 3745159 - RNA, 20 nt, Salmonella enterica enterica serovar Typhi Ty2
uaugaacaggcagcguaaua

SEQ ID NO: 3745160 - RNA, 14 nt, Salmonella enterica enterica serovar Typhi Ty2
uaugaacugcauca

SEQ ID NO: 3745161 - RNA, 14 nt, Salmonella enterica enterica serovar Typhi Ty2
uaugaagcuggagc

SEQ ID NO: 3745162 - RNA, 17 nt, Salmonella enterica enterica serovar Typhi Ty2
uaugaaguuucauacgg

SEQ ID NO: 3745163 - RNA, 16 nt, Salmonella enterica enterica serovar Typhi Ty2
uaugaauaauuucggc

SEQ ID NO: 3745164 - RNA, 19 nt, Salmonella enterica enterica serovar Typhi Ty2
uaugaauuauuuucuaaaa

SEQ ID NO: 3745165 - RNA, 18 nt, Salmonella enterica enterica serovar Typhi Ty2
uaugacugcgaauuuccu

SEQ ID NO: 3745166 - RNA, 17 nt, Salmonella enterica enterica serovar Typhi Ty2
uaugaucgaaaaugcgc

SEQ ID NO: 3745167 - RNA, 20 nt, Salmonella enterica enterica serovar Typhi Ty2
uaugaucgacaaugaucaga

SEQ ID NO: 3745168 - RNA, 22 nt, Salmonella enterica enterica serovar Typhi Ty2
uaugaucgguuuuuuuagaacc

SEQ ID NO: 3745169 - RNA, 16 nt, Salmonella enterica enterica serovar Typhi Ty2
uaugauuauacuugcu

SEQ ID NO: 3745170 - RNA, 12 nt, Salmonella enterica enterica serovar Typhi Ty2
uaugauuuaaaa

SEQ ID NO: 3745171 - RNA, 15 nt, Salmonella enterica enterica serovar Typhi Ty2
uaugauuuuaacauc

SEQ ID NO: 3745172 - RNA, 16 nt, Salmonella enterica enterica serovar Typhi Ty2
uaugauuuucuuauua

SEQ ID NO: 3745173 - RNA, 14 nt, Salmonella enterica enterica serovar Typhi Ty2
uaugcaaaacguag

SEQ ID NO: 3745174 - RNA, 19 nt, Salmonella enterica enterica serovar Typhi Ty2
uaugcaacacgccgaacaa

SEQ ID NO: 3745175 - RNA, 18 nt, Salmonella enterica enterica serovar Typhi Ty2
uaugcagaaauggucagc

SEQ ID NO: 3745176 - RNA, 15 nt, Salmonella enterica enterica serovar Typhi Ty2
uaugcaguucaucau

SEQ ID NO: 3745177 - RNA, 13 nt, Salmonella enterica enterica serovar Typhi Ty2
uaugcauugcuga

SEQ ID NO: 3745178 - RNA, 21 nt, Salmonella enterica enterica serovar Typhi Ty2
uaugccagauauuuucggcau

SEQ ID NO: 3745179 - RNA, 21 nt, Salmonella enterica enterica serovar Typhi Ty2
uaugcccggaugauuaucauc

SEQ ID NO: 3745180 - RNA, 22 nt, Salmonella enterica enterica serovar Typhi Ty2
uaugcccggaugauuaucaucu

SEQ ID NO: 3745181 - RNA, 23 nt, Salmonella enterica enterica serovar Typhi Ty2
uaugcccggaugauuaucaucua

SEQ ID NO: 3745182 - RNA, 16 nt, Salmonella enterica enterica serovar Typhi Ty2
uaugccgcacaaaauu

SEQ ID NO: 3745183 - RNA, 13 nt, Salmonella enterica enterica serovar Typhi Ty2
uaugccgccaucc

SEQ ID NO: 3745184 - RNA, 20 nt, Salmonella enterica enterica serovar Typhi Ty2
uaugccgccauccggcaaac

SEQ ID NO: 3745185 - RNA, 15 nt, Salmonella enterica enterica serovar Typhi Ty2
uaugccggagcgcuu

SEQ ID NO: 3745186 - RNA, 22 nt, Salmonella enterica enterica serovar Typhi Ty2
uaugccugauggcgcuacgcuu

SEQ ID NO: 3745187 - RNA, 19 nt, Salmonella enterica enterica serovar Typhi Ty2
uaugccugcacuaaaccag

SEQ ID NO: 3745188 - RNA, 19 nt, Salmonella enterica enterica serovar Typhi Ty2
uaugccuggggucgucagc

SEQ ID NO: 3745189 - RNA, 13 nt, Salmonella enterica enterica serovar Typhi Ty2
uaugccuuccaga

SEQ ID NO: 3745190 - RNA, 19 nt, Salmonella enterica enterica serovar Typhi Ty2
uaugcgacugaaaaucaaa

SEQ ID NO: 3745191 - RNA, 19 nt, Salmonella enterica enterica serovar Typhi Ty2
uaugcgcaugggcauaauc

SEQ ID NO: 3745192 - RNA, 12 nt, Salmonella enterica enterica serovar Typhi Ty2
uaugcgccaacu

SEQ ID NO: 3745193 - RNA, 23 nt, Salmonella enterica enterica serovar Typhi Ty2
uaugcgccugguugacccgcauu

SEQ ID NO: 3745194 - RNA, 19 nt, Salmonella enterica enterica serovar Typhi Ty2
uaugcgccuucuucgcaau

SEQ ID NO: 3745195 - RNA, 14 nt, Salmonella enterica enterica serovar Typhi Ty2
uaugcgcuuccagc

SEQ ID NO: 3745196 - RNA, 16 nt, Salmonella enterica enterica serovar Typhi Ty2
uaugcggcgcuuccag

SEQ ID NO: 3745197 - RNA, 14 nt, Salmonella enterica enterica serovar Typhi Ty2
uaugcgguucuccc

SEQ ID NO: 3745198 - RNA, 18 nt, Salmonella enterica enterica serovar Typhi Ty2
uaugcguugacccgucca

SEQ ID NO: 3745199 - RNA, 17 nt, Salmonella enterica enterica serovar Typhi Ty2
uaugcucaacuuccaga

SEQ ID NO: 3745200 - RNA, 21 nt, Salmonella enterica enterica serovar Typhi Ty2
uaugcuccaguuguuccagca

SEQ ID NO: 3745201 - RNA, 14 nt, Salmonella enterica enterica serovar Typhi Ty2
uaugcuguuuaugg

SEQ ID NO: 3745202 - RNA, 18 nt, Salmonella enterica enterica serovar Typhi Ty2
uauggagucaugaauguc

SEQ ID NO: 3745203 - RNA, 15 nt, Salmonella enterica enterica serovar Typhi Ty2
uauggcacaucaggc

SEQ ID NO: 3745204 - RNA, 13 nt, Salmonella enterica enterica serovar Typhi Ty2
uauggcaggcgaa

SEQ ID NO: 3745205 - RNA, 22 nt, Salmonella enterica enterica serovar Typhi Ty2
uauggcgcaaguguauggcugg

SEQ ID NO: 3745206 - RNA, 14 nt, Salmonella enterica enterica serovar Typhi Ty2
uaugggauaacgca

SEQ ID NO: 3745207 - RNA, 16 nt, Salmonella enterica enterica serovar Typhi Ty2
uauggguguagcucau

SEQ ID NO: 3745208 - RNA, 21 nt, Salmonella enterica enterica serovar Typhi Ty2
uauggguuuccuccaucagcg

SEQ ID NO: 3745209 - RNA, 21 nt, Salmonella enterica enterica serovar Typhi Ty2
uauguaaacgcauuaauauuu

SEQ ID NO: 3745210 - RNA, 19 nt, Salmonella enterica enterica serovar Typhi Ty2
uauguaauuugcaaaccau

SEQ ID NO: 3745211 - RNA, 19 nt, Salmonella enterica enterica serovar Typhi Ty2
uaugugcaucggcacagcg

SEQ ID NO: 3745212 - RNA, 21 nt, Salmonella enterica enterica serovar Typhi Ty2
uaugugccgaugaacgacgcu

SEQ ID NO: 3745213 - RNA, 19 nt, Salmonella enterica enterica serovar Typhi Ty2
uauguuaacgccgauuaau

SEQ ID NO: 3745214 - RNA, 18 nt, Salmonella enterica enterica serovar Typhi Ty2
uauguuaggguagaaaaa

SEQ ID NO: 3745215 - RNA, 19 nt, Salmonella enterica enterica serovar Typhi Ty2
uauguuccuggauagauuu

SEQ ID NO: 3745216 - RNA, 16 nt, Salmonella enterica enterica serovar Typhi Ty2
uauguuguugagacgg

SEQ ID NO: 3745217 - RNA, 18 nt, Salmonella enterica enterica serovar Typhi Ty2
uauuaacagcuucuucuu

SEQ ID NO: 3745218 - RNA, 19 nt, Salmonella enterica enterica serovar Typhi Ty2
uauuaauuaaggaugaacu

SEQ ID NO: 3745219 - RNA, 12 nt, Salmonella enterica enterica serovar Typhi Ty2
uauuacaaaaau

SEQ ID NO: 3745220 - RNA, 13 nt, Salmonella enterica enterica serovar Typhi Ty2
uauuacaacguuc

SEQ ID NO: 3745221 - RNA, 14 nt, Salmonella enterica enterica serovar Typhi Ty2
uauuacaagaaagu

SEQ ID NO: 3745222 - RNA, 20 nt, Salmonella enterica enterica serovar Typhi Ty2
uauuacaaguaauaaaauaa

SEQ ID NO: 3745223 - RNA, 21 nt, Salmonella enterica enterica serovar Typhi Ty2
uauuacagaucuugugaguaa

SEQ ID NO: 3745224 - RNA, 16 nt, Salmonella enterica enterica serovar Typhi Ty2
uauuacauagaaaaua

SEQ ID NO: 3745225 - RNA, 20 nt, Salmonella enterica enterica serovar Typhi Ty2
uauugccacaauaucaucgu

SEQ ID NO: 3745226 - RNA, 16 nt, Salmonella enterica enterica serovar Typhi Ty2
uauugccauaaauaca

SEQ ID NO: 3745227 - RNA, 23 nt, Salmonella enterica enterica serovar Typhi Ty2
uauugcccguuuuaaugaacagc

SEQ ID NO: 3745228 - RNA, 15 nt, Salmonella enterica enterica serovar Typhi Ty2
uauugccgcacggua

SEQ ID NO: 3745229 - RNA, 21 nt, Salmonella enterica enterica serovar Typhi Ty2
uauugccgccauuauucugaa

SEQ ID NO: 3745230 - RNA, 23 nt, Salmonella enterica enterica serovar Typhi Ty2
uauugcucuuccggcauaaaaag

SEQ ID NO: 3745231 - RNA, 21 nt, Salmonella enterica enterica serovar Typhi Ty2
uauugcuguaggcacuuucca

SEQ ID NO: 3745232 - RNA, 20 nt, Salmonella enterica enterica serovar Typhi Ty2
uauugcugugcuaugauaag

SEQ ID NO: 3745233 - RNA, 20 nt, Salmonella enterica enterica serovar Typhi Ty2
uauugcuuucaauuuccgca

SEQ ID NO: 3745234 - RNA, 13 nt, Salmonella enterica enterica serovar Typhi Ty2
uauuggaaucgcu

SEQ ID NO: 3745235 - RNA, 18 nt, Salmonella enterica enterica serovar Typhi Ty2
uauugggcguaagaaaag

SEQ ID NO: 3745236 - RNA, 18 nt, Salmonella enterica enterica serovar Typhi Ty2
uauugguaaguuuuucuc

SEQ ID NO: 3745237 - RNA, 23 nt, Salmonella enterica enterica serovar Typhi Ty2
uauugucgaauuccgccugcugu

SEQ ID NO: 3745238 - RNA, 22 nt, Salmonella enterica enterica serovar Typhi Ty2
uauugucgccaccgcuauucuu

SEQ ID NO: 3745239 - RNA, 20 nt, Salmonella enterica enterica serovar Typhi Ty2
uauugugaaccauggcaaca

SEQ ID NO: 3745240 - RNA, 15 nt, Salmonella enterica enterica serovar Typhi Ty2
uauuguucaugcaau

SEQ ID NO: 3745241 - RNA, 17 nt, Salmonella enterica enterica serovar Typhi Ty2
uauuguucaugcaauuc

SEQ ID NO: 3745242 - RNA, 21 nt, Salmonella enterica enterica serovar Typhi Ty2
uauuguuuaacguuucaugga

SEQ ID NO: 3745243 - RNA, 13 nt, Salmonella enterica enterica serovar Typhi Ty2
uauuuaaaauucc

SEQ ID NO: 3745244 - RNA, 20 nt, Salmonella enterica enterica serovar Typhi Ty2
uauuuaaaauuccaauauuu

SEQ ID NO: 3745245 - RNA, 22 nt, Salmonella enterica enterica serovar Typhi Ty2
uauuuaacagagagggaaaaaa

SEQ ID NO: 3745246 - RNA, 18 nt, Salmonella enterica enterica serovar Typhi Ty2
uauuuaauaagcauauau

SEQ ID NO: 3745247 - RNA, 15 nt, Salmonella enterica enterica serovar Typhi Ty2
uauuuaauacaucag

SEQ ID NO: 3745248 - RNA, 15 nt, Salmonella enterica enterica serovar Typhi Ty2
uauuuaccgccgcuu

SEQ ID NO: 3745249 - RNA, 19 nt, Salmonella enterica enterica serovar Typhi Ty2
uauuuaccgcuggcgucug

SEQ ID NO: 3745250 - RNA, 15 nt, Salmonella enterica enterica serovar Typhi Ty2
uauuuaccuuuuccu

SEQ ID NO: 3745251 - RNA, 21 nt, Salmonella enterica enterica serovar Typhi Ty2
uauuuacugaauaaauaguau

SEQ ID NO: 3745252 - RNA, 20 nt, Salmonella enterica enterica serovar Typhi Ty2
uauuuagccguucaugcacu

SEQ ID NO: 3745253 - RNA, 16 nt, Salmonella enterica enterica serovar Typhi Ty2
uauuuauaucaggcaa

SEQ ID NO: 3745254 - RNA, 15 nt, Salmonella enterica enterica serovar Typhi Ty2
uauuuaucaaaaaga

SEQ ID NO: 3745255 - RNA, 12 nt, Salmonella enterica enterica serovar Typhi Ty2
uauuuauuuaaa

SEQ ID NO: 3745256 - RNA, 23 nt, Salmonella enterica enterica serovar Typhi Ty2
uauuuauuugguuucuagucgcc

SEQ ID NO: 3745257 - RNA, 14 nt, Salmonella enterica enterica serovar Typhi Ty2
uauuucaagcaaua

SEQ ID NO: 3745258 - RNA, 13 nt, Salmonella enterica enterica serovar Typhi Ty2
uauuucagacuua

SEQ ID NO: 3745259 - RNA, 18 nt, Salmonella enterica enterica serovar Typhi Ty2
uauuucauuaaucuauuu

SEQ ID NO: 3745260 - RNA, 15 nt, Salmonella enterica enterica serovar Typhi Ty2
uauuuccagaaauca

SEQ ID NO: 3745261 - RNA, 22 nt, Salmonella enterica enterica serovar Typhi Ty2
uauuucgacaagaagauuucuu

SEQ ID NO: 3745262 - RNA, 18 nt, Salmonella enterica enterica serovar Typhi Ty2
uauuucgacuuucuucgg

SEQ ID NO: 3745263 - RNA, 14 nt, Salmonella enterica enterica serovar Typhi Ty2
uauuucgccuauca

SEQ ID NO: 3745264 - RNA, 21 nt, Salmonella enterica enterica serovar Typhi Ty2
uauuucggcacugacucuucc

SEQ ID NO: 3745265 - RNA, 21 nt, Salmonella enterica enterica serovar Typhi Ty2
uauuucuaucagguaacauau

SEQ ID NO: 3745266 - RNA, 15 nt, Salmonella enterica enterica serovar Typhi Ty2
uauuucugaaaaacc

SEQ ID NO: 3745267 - RNA, 22 nt, Salmonella enterica enterica serovar Typhi Ty2
uauuucuuagcacccaccauca

SEQ ID NO: 3745268 - RNA, 13 nt, Salmonella enterica enterica serovar Typhi Ty2
uauuugaauuuua

SEQ ID NO: 3745269 - RNA, 14 nt, Salmonella enterica enterica serovar Typhi Ty2
uauuuggagagcau

SEQ ID NO: 3745270 - RNA, 19 nt, Salmonella enterica enterica serovar Typhi Ty2
uauuugguaccgccaucgg

SEQ ID NO: 3745271 - RNA, 15 nt, Salmonella enterica enterica serovar Typhi Ty2
uauuuguguauuuuu

SEQ ID NO: 3745272 - RNA, 17 nt, Salmonella enterica enterica serovar Typhi Ty2
uauuuguguauuuuuuu

SEQ ID NO: 3745273 - RNA, 22 nt, Salmonella enterica enterica serovar Typhi Ty2
uauuuguuuaccgcgauagaaa

SEQ ID NO: 3745274 - RNA, 15 nt, Salmonella enterica enterica serovar Typhi Ty2
uauuuuaaauuccca

SEQ ID NO: 3745275 - RNA, 12 nt, Salmonella enterica enterica serovar Typhi Ty2
uauuuuauuuuu

SEQ ID NO: 3745276 - RNA, 22 nt, Salmonella enterica enterica serovar Typhi Ty2
uauuuuccugaaaaaauucccg

SEQ ID NO: 3745277 - RNA, 12 nt, Salmonella enterica enterica serovar Typhi Ty2
uauuuuuaaaua

SEQ ID NO: 3745278 - RNA, 12 nt, Salmonella enterica enterica serovar Typhi Ty2
uauuuuucagcu

SEQ ID NO: 3745279 - RNA, 18 nt, Salmonella enterica enterica serovar Typhi Ty2
uauuuuucagcuucuguc

SEQ ID NO: 3745280 - RNA, 16 nt, Salmonella enterica enterica serovar Typhi Ty2
uauuuuucucagccag

SEQ ID NO: 3745281 - RNA, 19 nt, Salmonella enterica enterica serovar Typhi Ty2
uauuuuuuuuguuuucgau

SEQ ID NO: 3745282 - RNA, 14 nt, Salmonella enterica enterica serovar Typhi Ty2
ucaaaaaaaaccag

SEQ ID NO: 3745283 - RNA, 11 nt, Salmonella enterica enterica serovar Typhi Ty2
ucaaaaaagag

SEQ ID NO: 3745284 - RNA, 13 nt, Salmonella enterica enterica serovar Typhi Ty2
ucaaaaaagagaa

SEQ ID NO: 3745285 - RNA, 14 nt, Salmonella enterica enterica serovar Typhi Ty2
ucaaaaaagagaag

SEQ ID NO: 3745286 - RNA, 14 nt, Salmonella enterica enterica serovar Typhi Ty2
ucaaaaaaucagca

SEQ ID NO: 3745287 - RNA, 19 nt, Salmonella enterica enterica serovar Typhi Ty2
ucaaaaaaucgacucacgg

SEQ ID NO: 3745288 - RNA, 11 nt, Salmonella enterica enterica serovar Typhi Ty2
ucaaaacaggu

SEQ ID NO: 3745289 - RNA, 15 nt, Salmonella enterica enterica serovar Typhi Ty2
ucaaaacaggucugu

SEQ ID NO: 3745290 - RNA, 18 nt, Salmonella enterica enterica serovar Typhi Ty2
ucaaaaccgaccccgcuc

SEQ ID NO: 3745291 - RNA, 21 nt, Salmonella enterica enterica serovar Typhi Ty2
ucaaaaccgggcagggaauac

SEQ ID NO: 3745292 - RNA, 14 nt, Salmonella enterica enterica serovar Typhi Ty2
ucaaaacgacauaa

SEQ ID NO: 3745293 - RNA, 19 nt, Salmonella enterica enterica serovar Typhi Ty2
ucaaaacuacgccaaugaa

SEQ ID NO: 3745294 - RNA, 17 nt, Salmonella enterica enterica serovar Typhi Ty2
ucaaaagugaucauggu

SEQ ID NO: 3745295 - RNA, 14 nt, Salmonella enterica enterica serovar Typhi Ty2
ucaaaauaaaauua

SEQ ID NO: 3745296 - RNA, 18 nt, Salmonella enterica enterica serovar Typhi Ty2
ucaaaauaacgcuucacc

SEQ ID NO: 3745297 - RNA, 15 nt, Salmonella enterica enterica serovar Typhi Ty2
ucaaaaucgcgcccc

SEQ ID NO: 3745298 - RNA, 16 nt, Salmonella enterica enterica serovar Typhi Ty2
ucaaaauggaaaauaa

SEQ ID NO: 3745299 - RNA, 17 nt, Salmonella enterica enterica serovar Typhi Ty2
ucaaaauggaaaauaau

SEQ ID NO: 3745300 - RNA, 18 nt, Salmonella enterica enterica serovar Typhi Ty2
ucaaaauggaaaauaaua

SEQ ID NO: 3745301 - RNA, 19 nt, Salmonella enterica enterica serovar Typhi Ty2
ucaaaauggaaaauaauaa

SEQ ID NO: 3745302 - RNA, 21 nt, Salmonella enterica enterica serovar Typhi Ty2
ucaaaauggaaaauaauaauc

SEQ ID NO: 3745303 - RNA, 20 nt, Salmonella enterica enterica serovar Typhi Ty2
ucaaacacaaauuucgagca

SEQ ID NO: 3745304 - RNA, 14 nt, Salmonella enterica enterica serovar Typhi Ty2
ucaaacacuucuaa

SEQ ID NO: 3745305 - RNA, 14 nt, Salmonella enterica enterica serovar Typhi Ty2
ucaaaccagcuuuu

SEQ ID NO: 3745306 - RNA, 16 nt, Salmonella enterica enterica serovar Typhi Ty2
ucaaaccagcuuuuca

SEQ ID NO: 3745307 - RNA, 21 nt, Salmonella enterica enterica serovar Typhi Ty2
ucaagccauugcgcgccguuc

SEQ ID NO: 3745308 - RNA, 14 nt, Salmonella enterica enterica serovar Typhi Ty2
ucaagcccagcuca

SEQ ID NO: 3745309 - RNA, 21 nt, Salmonella enterica enterica serovar Typhi Ty2
ucaagccgggcggcugugucc

SEQ ID NO: 3745310 - RNA, 18 nt, Salmonella enterica enterica serovar Typhi Ty2
ucaagccguuuuggcagc

SEQ ID NO: 3745311 - RNA, 23 nt, Salmonella enterica enterica serovar Typhi Ty2
ucaagccguuuuggcagcgcccg

SEQ ID NO: 3745312 - RNA, 12 nt, Salmonella enterica enterica serovar Typhi Ty2
ucaagcgauacg

SEQ ID NO: 3745313 - RNA, 16 nt, Salmonella enterica enterica serovar Typhi Ty2
ucaagcggcaccacau

SEQ ID NO: 3745314 - RNA, 13 nt, Salmonella enterica enterica serovar Typhi Ty2
ucaagcgguagcg

SEQ ID NO: 3745315 - RNA, 23 nt, Salmonella enterica enterica serovar Typhi Ty2
ucaagcgguuugaaaauggcguu

SEQ ID NO: 3745316 - RNA, 22 nt, Salmonella enterica enterica serovar Typhi Ty2
ucaagcugauugauuuuguaau

SEQ ID NO: 3745317 - RNA, 20 nt, Salmonella enterica enterica serovar Typhi Ty2
ucaagcuggacgguaaccau

SEQ ID NO: 3745318 - RNA, 16 nt, Salmonella enterica enterica serovar Typhi Ty2
ucaagcuggugcuuua

SEQ ID NO: 3745319 - RNA, 14 nt, Salmonella enterica enterica serovar Typhi Ty2
ucaagcuugccgcu

SEQ ID NO: 3745320 - RNA, 16 nt, Salmonella enterica enterica serovar Typhi Ty2
ucaagcuuugcguaaa

SEQ ID NO: 3745321 - RNA, 21 nt, Salmonella enterica enterica serovar Typhi Ty2
ucaagcuuugcguaaaaaaca

SEQ ID NO: 3745322 - RNA, 16 nt, Salmonella enterica enterica serovar Typhi Ty2
ucaaggcauccagcag

SEQ ID NO: 3745323 - RNA, 19 nt, Salmonella enterica enterica serovar Typhi Ty2
ucaaggcauccagcagucg

SEQ ID NO: 3745324 - RNA, 15 nt, Salmonella enterica enterica serovar Typhi Ty2
ucaaggcgcaaaacc

SEQ ID NO: 3745325 - RNA, 19 nt, Salmonella enterica enterica serovar Typhi Ty2
ucaagguagcgugucuacc

SEQ ID NO: 3745326 - RNA, 14 nt, Salmonella enterica enterica serovar Typhi Ty2
ucaagucccccccc

SEQ ID NO: 3745327 - RNA, 15 nt, Salmonella enterica enterica serovar Typhi Ty2
ucaaguuuagaaaaa

SEQ ID NO: 3745328 - RNA, 17 nt, Salmonella enterica enterica serovar Typhi Ty2
ucaaguuuagaaaaaau

SEQ ID NO: 3745329 - RNA, 22 nt, Salmonella enterica enterica serovar Typhi Ty2
ucaaguuuagaaaaaauuaaaa

SEQ ID NO: 3745330 - RNA, 16 nt, Salmonella enterica enterica serovar Typhi Ty2
ucaauaaaucaacaua

SEQ ID NO: 3745331 - RNA, 14 nt, Salmonella enterica enterica serovar Typhi Ty2
ucaauaaccgccag

SEQ ID NO: 3745332 - RNA, 16 nt, Salmonella enterica enterica serovar Typhi Ty2
ucaauaaccgccagca

SEQ ID NO: 3745333 - RNA, 12 nt, Salmonella enterica enterica serovar Typhi Ty2
ucaauaacgaag

SEQ ID NO: 3745334 - RNA, 14 nt, Salmonella enterica enterica serovar Typhi Ty2
ucaauaagauaucc

SEQ ID NO: 3745335 - RNA, 22 nt, Salmonella enterica enterica serovar Typhi Ty2
ucaauaagcgaauugccgucgc

SEQ ID NO: 3745336 - RNA, 13 nt, Salmonella enterica enterica serovar Typhi Ty2
ucaauaauauuau

SEQ ID NO: 3745337 - RNA, 15 nt, Salmonella enterica enterica serovar Typhi Ty2
ucaauaaucccuucu

SEQ ID NO: 3745338 - RNA, 20 nt, Salmonella enterica enterica serovar Typhi Ty2
ucaauacgagugacauuauu

SEQ ID NO: 3745339 - RNA, 18 nt, Salmonella enterica enterica serovar Typhi Ty2
ucaauagagcgcagcaaa

SEQ ID NO: 3745340 - RNA, 15 nt, Salmonella enterica enterica serovar Typhi Ty2
ucaauagcacaucag

SEQ ID NO: 3745341 - RNA, 15 nt, Salmonella enterica enterica serovar Typhi Ty2
ucaauaguuaauuaa

SEQ ID NO: 3745342 - RNA, 16 nt, Salmonella enterica enterica serovar Typhi Ty2
ucaauaguuaauuaaa

SEQ ID NO: 3745343 - RNA, 13 nt, Salmonella enterica enterica serovar Typhi Ty2
ucaauauccugcg

SEQ ID NO: 3745344 - RNA, 16 nt, Salmonella enterica enterica serovar Typhi Ty2
ucaauauuaucguaau

SEQ ID NO: 3745345 - RNA, 22 nt, Salmonella enterica enterica serovar Typhi Ty2
ucaauauuccuggcgccaccca

SEQ ID NO: 3745346 - RNA, 18 nt, Salmonella enterica enterica serovar Typhi Ty2
ucaauauugaacauuuuu

SEQ ID NO: 3745347 - RNA, 18 nt, Salmonella enterica enterica serovar Typhi Ty2
ucaaucacaaaauggcug

SEQ ID NO: 3745348 - RNA, 14 nt, Salmonella enterica enterica serovar Typhi Ty2
ucaaucacuuauca

SEQ ID NO: 3745349 - RNA, 15 nt, Salmonella enterica enterica serovar Typhi Ty2
ucaaucacuuaucaa

SEQ ID NO: 3745350 - RNA, 22 nt, Salmonella enterica enterica serovar Typhi Ty2
ucaaucacuugaagccuuucug

SEQ ID NO: 3745351 - RNA, 14 nt, Salmonella enterica enterica serovar Typhi Ty2
ucaaucacuuucag

SEQ ID NO: 3745352 - RNA, 16 nt, Salmonella enterica enterica serovar Typhi Ty2
ucaaucaucagaagaa

SEQ ID NO: 3745353 - RNA, 16 nt, Salmonella enterica enterica serovar Typhi Ty2
ucaaucgccugcugua

SEQ ID NO: 3745354 - RNA, 18 nt, Salmonella enterica enterica serovar Typhi Ty2
ucaaucgucguuccgcca

SEQ ID NO: 3745355 - RNA, 19 nt, Salmonella enterica enterica serovar Typhi Ty2
ucaaucgucguuccgccag

SEQ ID NO: 3745356 - RNA, 15 nt, Salmonella enterica enterica serovar Typhi Ty2
ucaaucgugguuggc

SEQ ID NO: 3745357 - RNA, 14 nt, Salmonella enterica enterica serovar Typhi Ty2
ucaaucuucccgca

SEQ ID NO: 3745358 - RNA, 14 nt, Salmonella enterica enterica serovar Typhi Ty2
ucaaugcacgccac

SEQ ID NO: 3745359 - RNA, 24 nt, Salmonella enterica enterica serovar Typhi Ty2
ucaaugcccaggcgccgcucauca

SEQ ID NO: 3745360 - RNA, 17 nt, Salmonella enterica enterica serovar Typhi Ty2
ucaaugccgucggcaau

SEQ ID NO: 3745361 - RNA, 23 nt, Salmonella enterica enterica serovar Typhi Ty2
ucaaugccgucggcaauuaacau

SEQ ID NO: 3745362 - RNA, 15 nt, Salmonella enterica enterica serovar Typhi Ty2
ucaaugccuggcaga

SEQ ID NO: 3745363 - RNA, 16 nt, Salmonella enterica enterica serovar Typhi Ty2
ucaauggguuaugggu

SEQ ID NO: 3745364 - RNA, 24 nt, Salmonella enterica enterica serovar Typhi Ty2
ucaauguauuguucaugcaauucc

SEQ ID NO: 3745365 - RNA, 19 nt, Salmonella enterica enterica serovar Typhi Ty2
ucaauguuagcauuauuuu

SEQ ID NO: 3745366 - RNA, 13 nt, Salmonella enterica enterica serovar Typhi Ty2
ucaauuauguauu

SEQ ID NO: 3745367 - RNA, 18 nt, Salmonella enterica enterica serovar Typhi Ty2
ucaauucuggaaucaauu

SEQ ID NO: 3745368 - RNA, 19 nt, Salmonella enterica enterica serovar Typhi Ty2
ucaauugugugcacugcac

SEQ ID NO: 3745369 - RNA, 15 nt, Salmonella enterica enterica serovar Typhi Ty2
ucaauuucauauuau

SEQ ID NO: 3745370 - RNA, 12 nt, Salmonella enterica enterica serovar Typhi Ty2
ucaauuuccagu

SEQ ID NO: 3745371 - RNA, 18 nt, Salmonella enterica enterica serovar Typhi Ty2
ucaauuuuucgcccggcu

SEQ ID NO: 3745372 - RNA, 13 nt, Salmonella enterica enterica serovar Typhi Ty2
ucacaaaaucauu

SEQ ID NO: 3745373 - RNA, 19 nt, Salmonella enterica enterica serovar Typhi Ty2
ucacaaaauggcugauaaa

SEQ ID NO: 3745374 - RNA, 14 nt, Salmonella enterica enterica serovar Typhi Ty2
ucacaaauuaaaaa

SEQ ID NO: 3745375 - RNA, 16 nt, Salmonella enterica enterica serovar Typhi Ty2
ucacaacgucaucccg

SEQ ID NO: 3745376 - RNA, 15 nt, Salmonella enterica enterica serovar Typhi Ty2
ucacaagcuguuucu

SEQ ID NO: 3745377 - RNA, 20 nt, Salmonella enterica enterica serovar Typhi Ty2
ucacaagcuguuucuccguu

SEQ ID NO: 3745378 - RNA, 19 nt, Salmonella enterica enterica serovar Typhi Ty2
ucacaaggaaugacacauu

SEQ ID NO: 3745379 - RNA, 15 nt, Salmonella enterica enterica serovar Typhi Ty2
ucacaauaacgccgg

SEQ ID NO: 3745380 - RNA, 14 nt, Salmonella enterica enterica serovar Typhi Ty2
ucacaaucagccac

SEQ ID NO: 3745381 - RNA, 17 nt, Salmonella enterica enterica serovar Typhi Ty2
ucacaaucagccacggc

SEQ ID NO: 3745382 - RNA, 17 nt, Salmonella enterica enterica serovar Typhi Ty2
ucacaaucguucucagg

SEQ ID NO: 3745383 - RNA, 23 nt, Salmonella enterica enterica serovar Typhi Ty2
ucacaauguuuuuguaccaggcc

SEQ ID NO: 3745384 - RNA, 14 nt, Salmonella enterica enterica serovar Typhi Ty2
ucacacauaucgcc

SEQ ID NO: 3745385 - RNA, 19 nt, Salmonella enterica enterica serovar Typhi Ty2
ucacaccaacgcuggcccg

SEQ ID NO: 3745386 - RNA, 21 nt, Salmonella enterica enterica serovar Typhi Ty2
ucacacugcgccgccagcgac

SEQ ID NO: 3745387 - RNA, 22 nt, Salmonella enterica enterica serovar Typhi Ty2
ucacagacaucggagauuucau

SEQ ID NO: 3745388 - RNA, 22 nt, Salmonella enterica enterica serovar Typhi Ty2
ucacagcgguuacgcuauagcu

SEQ ID NO: 3745389 - RNA, 20 nt, Salmonella enterica enterica serovar Typhi Ty2
ucaccuucggugaaaucacg

SEQ ID NO: 3745390 - RNA, 21 nt, Salmonella enterica enterica serovar Typhi Ty2
ucaccuucggugaaaucacga

SEQ ID NO: 3745391 - RNA, 18 nt, Salmonella enterica enterica serovar Typhi Ty2
ucaccuucugcgcaggag

SEQ ID NO: 3745392 - RNA, 22 nt, Salmonella enterica enterica serovar Typhi Ty2
ucaccuucugugaaaguuucag

SEQ ID NO: 3745393 - RNA, 22 nt, Salmonella enterica enterica serovar Typhi Ty2
ucaccuugcccuggaauuuuuc

SEQ ID NO: 3745394 - RNA, 13 nt, Salmonella enterica enterica serovar Typhi Ty2
ucaccuugcugcg

SEQ ID NO: 3745395 - RNA, 21 nt, Salmonella enterica enterica serovar Typhi Ty2
ucaccuugcugcgcaggggcu

SEQ ID NO: 3745396 - RNA, 19 nt, Salmonella enterica enterica serovar Typhi Ty2
ucaccuuguaccuccugau

SEQ ID NO: 3745397 - RNA, 21 nt, Salmonella enterica enterica serovar Typhi Ty2
ucaccuuuacuuaauucugcu

SEQ ID NO: 3745398 - RNA, 15 nt, Salmonella enterica enterica serovar Typhi Ty2
ucaccuuucauuuua

SEQ ID NO: 3745399 - RNA, 12 nt, Salmonella enterica enterica serovar Typhi Ty2
ucaccuuucugc

SEQ ID NO: 3745400 - RNA, 17 nt, Salmonella enterica enterica serovar Typhi Ty2
ucaccuuucugccaggu

SEQ ID NO: 3745401 - RNA, 17 nt, Salmonella enterica enterica serovar Typhi Ty2
ucacgaccaaccaacag

SEQ ID NO: 3745402 - RNA, 23 nt, Salmonella enterica enterica serovar Typhi Ty2
ucacgaccggcgaacguuggcug

SEQ ID NO: 3745403 - RNA, 14 nt, Salmonella enterica enterica serovar Typhi Ty2
ucacgauaauguuu

SEQ ID NO: 3745404 - RNA, 18 nt, Salmonella enterica enterica serovar Typhi Ty2
ucacgauacuguugcagu

SEQ ID NO: 3745405 - RNA, 19 nt, Salmonella enterica enterica serovar Typhi Ty2
ucacgauaguuugccagag

SEQ ID NO: 3745406 - RNA, 17 nt, Salmonella enterica enterica serovar Typhi Ty2
ucacgcaaaugcagcgg

SEQ ID NO: 3745407 - RNA, 19 nt, Salmonella enterica enterica serovar Typhi Ty2
ucacgcaaaugcagcggaa

SEQ ID NO: 3745408 - RNA, 20 nt, Salmonella enterica enterica serovar Typhi Ty2
ucacgcagcgugaagcugcc

SEQ ID NO: 3745409 - RNA, 19 nt, Salmonella enterica enterica serovar Typhi Ty2
ucacgcauggcguugcugc

SEQ ID NO: 3745410 - RNA, 18 nt, Salmonella enterica enterica serovar Typhi Ty2
ucacgccaucagggacga

SEQ ID NO: 3745411 - RNA, 20 nt, Salmonella enterica enterica serovar Typhi Ty2
ucacgccaucgacaaaggca

SEQ ID NO: 3745412 - RNA, 18 nt, Salmonella enterica enterica serovar Typhi Ty2
ucacgcccagcgcggccc

SEQ ID NO: 3745413 - RNA, 18 nt, Salmonella enterica enterica serovar Typhi Ty2
ucacgccgauaaugcguu

SEQ ID NO: 3745414 - RNA, 15 nt, Salmonella enterica enterica serovar Typhi Ty2
ucacgccguccagca

SEQ ID NO: 3745415 - RNA, 21 nt, Salmonella enterica enterica serovar Typhi Ty2
ucacgccgugaauuucugcug

SEQ ID NO: 3745416 - RNA, 16 nt, Salmonella enterica enterica serovar Typhi Ty2
ucacgcgccagcacca

SEQ ID NO: 3745417 - RNA, 17 nt, Salmonella enterica enterica serovar Typhi Ty2
ucacgcgccagcaccac

SEQ ID NO: 3745418 - RNA, 23 nt, Salmonella enterica enterica serovar Typhi Ty2
ucacgcgcgcgaaacgcacccgc

SEQ ID NO: 3745419 - RNA, 18 nt, Salmonella enterica enterica serovar Typhi Ty2
ucacgcggauugccgccc

SEQ ID NO: 3745420 - RNA, 21 nt, Salmonella enterica enterica serovar Typhi Ty2
ucacgcuauguuugcugagaa

SEQ ID NO: 3745421 - RNA, 20 nt, Salmonella enterica enterica serovar Typhi Ty2
ucacgcucacgcagauauuc

SEQ ID NO: 3745422 - RNA, 20 nt, Salmonella enterica enterica serovar Typhi Ty2
ucacgcucgaguucuucacg

SEQ ID NO: 3745423 - RNA, 17 nt, Salmonella enterica enterica serovar Typhi Ty2
ucacgcucgcggaagcg

SEQ ID NO: 3745424 - RNA, 12 nt, Salmonella enterica enterica serovar Typhi Ty2
ucacgcuggaua

SEQ ID NO: 3745425 - RNA, 21 nt, Salmonella enterica enterica serovar Typhi Ty2
ucacgcuuaucgccaaaccag

SEQ ID NO: 3745426 - RNA, 19 nt, Salmonella enterica enterica serovar Typhi Ty2
ucacggagagucgcaccgc

SEQ ID NO: 3745427 - RNA, 16 nt, Salmonella enterica enterica serovar Typhi Ty2
ucacggauccagaacu

SEQ ID NO: 3745428 - RNA, 18 nt, Salmonella enterica enterica serovar Typhi Ty2
ucacggcacgcccuucgu

SEQ ID NO: 3745429 - RNA, 23 nt, Salmonella enterica enterica serovar Typhi Ty2
ucacggccuucgcagaucgccug

SEQ ID NO: 3745430 - RNA, 17 nt, Salmonella enterica enterica serovar Typhi Ty2
ucacggcgaaucgccug

SEQ ID NO: 3745431 - RNA, 21 nt, Salmonella enterica enterica serovar Typhi Ty2
ucacggcgauaaaugucagga

SEQ ID NO: 3745432 - RNA, 17 nt, Salmonella enterica enterica serovar Typhi Ty2
ucacgggcguagucagc

SEQ ID NO: 3745433 - RNA, 18 nt, Salmonella enterica enterica serovar Typhi Ty2
ucacgguagaccaaaugg

SEQ ID NO: 3745434 - RNA, 18 nt, Salmonella enterica enterica serovar Typhi Ty2
ucacgguauucguuacca

SEQ ID NO: 3745435 - RNA, 16 nt, Salmonella enterica enterica serovar Typhi Ty2
ucacgguucgcaauca

SEQ ID NO: 3745436 - RNA, 15 nt, Salmonella enterica enterica serovar Typhi Ty2
ucacgguuucaacuu

SEQ ID NO: 3745437 - RNA, 17 nt, Salmonella enterica enterica serovar Typhi Ty2
ucacgucgcccaccgca

SEQ ID NO: 3745438 - RNA, 18 nt, Salmonella enterica enterica serovar Typhi Ty2
ucacgucgcgcgccgccu

SEQ ID NO: 3745439 - RNA, 13 nt, Salmonella enterica enterica serovar Typhi Ty2
ucacguuccccag

SEQ ID NO: 3745440 - RNA, 15 nt, Salmonella enterica enterica serovar Typhi Ty2
ucacguuccccagca

SEQ ID NO: 3745441 - RNA, 14 nt, Salmonella enterica enterica serovar Typhi Ty2
ucacguucgguacg

SEQ ID NO: 3745442 - RNA, 18 nt, Salmonella enterica enterica serovar Typhi Ty2
ucacguuuugcagcgcca

SEQ ID NO: 3745443 - RNA, 19 nt, Salmonella enterica enterica serovar Typhi Ty2
ucacguuuugcagcgccau

SEQ ID NO: 3745444 - RNA, 20 nt, Salmonella enterica enterica serovar Typhi Ty2
ucacguuuugcagcgccauc

SEQ ID NO: 3745445 - RNA, 15 nt, Salmonella enterica enterica serovar Typhi Ty2
ucacuaacgcggcau

SEQ ID NO: 3745446 - RNA, 12 nt, Salmonella enterica enterica serovar Typhi Ty2
ucacuaauuuga

SEQ ID NO: 3745447 - RNA, 14 nt, Salmonella enterica enterica serovar Typhi Ty2
ucacuaccgccauc

SEQ ID NO: 3745448 - RNA, 22 nt, Salmonella enterica enterica serovar Typhi Ty2
ucacuaugcuaauccgcugauu

SEQ ID NO: 3745449 - RNA, 13 nt, Salmonella enterica enterica serovar Typhi Ty2
ucacuauuugugc

SEQ ID NO: 3745450 - RNA, 17 nt, Salmonella enterica enterica serovar Typhi Ty2
ucacuccuaagagaaaa

SEQ ID NO: 3745451 - RNA, 21 nt, Salmonella enterica enterica serovar Typhi Ty2
ucacugaacccaaacagauaa

SEQ ID NO: 3745452 - RNA, 15 nt, Salmonella enterica enterica serovar Typhi Ty2
ucacugaaccugccu

SEQ ID NO: 3745453 - RNA, 16 nt, Salmonella enterica enterica serovar Typhi Ty2
ucacugaaccugccuu

SEQ ID NO: 3745454 - RNA, 19 nt, Salmonella enterica enterica serovar Typhi Ty2
ucacugacuauccacagcg

SEQ ID NO: 3745455 - RNA, 18 nt, Salmonella enterica enterica serovar Typhi Ty2
ucacugccgacgcccuca

SEQ ID NO: 3745456 - RNA, 21 nt, Salmonella enterica enterica serovar Typhi Ty2
ucacugguuauaugaauaaac

SEQ ID NO: 3745457 - RNA, 14 nt, Salmonella enterica enterica serovar Typhi Ty2
ucacuguaaaaggg

SEQ ID NO: 3745458 - RNA, 17 nt, Salmonella enterica enterica serovar Typhi Ty2
ucacuguuaucgccauu

SEQ ID NO: 3745459 - RNA, 12 nt, Salmonella enterica enterica serovar Typhi Ty2
ucacuuauaaau

SEQ ID NO: 3745460 - RNA, 24 nt, Salmonella enterica enterica serovar Typhi Ty2
ucacuuaucaaaccagcuuuucau

SEQ ID NO: 3745461 - RNA, 14 nt, Salmonella enterica enterica serovar Typhi Ty2
ucacuucaucauca

SEQ ID NO: 3745462 - RNA, 15 nt, Salmonella enterica enterica serovar Typhi Ty2
ucacuucaucaucau

SEQ ID NO: 3745463 - RNA, 13 nt, Salmonella enterica enterica serovar Typhi Ty2
ucacuucauccgg

SEQ ID NO: 3745464 - RNA, 13 nt, Salmonella enterica enterica serovar Typhi Ty2
ucacuuguucaau

SEQ ID NO: 3745465 - RNA, 15 nt, Salmonella enterica enterica serovar Typhi Ty2
ucacuuguucaauau

SEQ ID NO: 3745466 - RNA, 17 nt, Salmonella enterica enterica serovar Typhi Ty2
ucacuuguucuucuguu

SEQ ID NO: 3745467 - RNA, 15 nt, Salmonella enterica enterica serovar Typhi Ty2
ucacuuuaccaggca

SEQ ID NO: 3745468 - RNA, 19 nt, Salmonella enterica enterica serovar Typhi Ty2
ucacuuucagauuuuuaau

SEQ ID NO: 3745469 - RNA, 15 nt, Salmonella enterica enterica serovar Typhi Ty2
ucacuuuuaccggcg

SEQ ID NO: 3745470 - RNA, 18 nt, Salmonella enterica enterica serovar Typhi Ty2
ucacuuuucuuuccugca

SEQ ID NO: 3745471 - RNA, 15 nt, Salmonella enterica enterica serovar Typhi Ty2
ucagccagccgccaa

SEQ ID NO: 3745472 - RNA, 15 nt, Salmonella enterica enterica serovar Typhi Ty2
ucagccagcgaucag

SEQ ID NO: 3745473 - RNA, 21 nt, Salmonella enterica enterica serovar Typhi Ty2
ucagccauuaaccagauuacc

SEQ ID NO: 3745474 - RNA, 18 nt, Salmonella enterica enterica serovar Typhi Ty2
ucagcccggacaucaucc

SEQ ID NO: 3745475 - RNA, 15 nt, Salmonella enterica enterica serovar Typhi Ty2
ucagcccuacaaagg

SEQ ID NO: 3745476 - RNA, 15 nt, Salmonella enterica enterica serovar Typhi Ty2
ucagcccuuauauca

SEQ ID NO: 3745477 - RNA, 15 nt, Salmonella enterica enterica serovar Typhi Ty2
ucagccgccggugac

SEQ ID NO: 3745478 - RNA, 22 nt, Salmonella enterica enterica serovar Typhi Ty2
ucagccgcgcuaucaaaaugca

SEQ ID NO: 3745479 - RNA, 16 nt, Salmonella enterica enterica serovar Typhi Ty2
ucagccgggcgggaac

SEQ ID NO: 3745480 - RNA, 12 nt, Salmonella enterica enterica serovar Typhi Ty2
ucagccugugca

SEQ ID NO: 3745481 - RNA, 21 nt, Salmonella enterica enterica serovar Typhi Ty2
ucagccugugcaaccagcucu

SEQ ID NO: 3745482 - RNA, 23 nt, Salmonella enterica enterica serovar Typhi Ty2
ucagccuugaccgccugaucguu

SEQ ID NO: 3745483 - RNA, 16 nt, Salmonella enterica enterica serovar Typhi Ty2
ucagccuuuucauaug

SEQ ID NO: 3745484 - RNA, 17 nt, Salmonella enterica enterica serovar Typhi Ty2
ucagcgacgguccuggc

SEQ ID NO: 3745485 - RNA, 21 nt, Salmonella enterica enterica serovar Typhi Ty2
ucagcgaucugucgccgcgua

SEQ ID NO: 3745486 - RNA, 22 nt, Salmonella enterica enterica serovar Typhi Ty2
ucagcgaucugucgccgcguaa

SEQ ID NO: 3745487 - RNA, 16 nt, Salmonella enterica enterica serovar Typhi Ty2
ucagcgauugcgccag

SEQ ID NO: 3745488 - RNA, 17 nt, Salmonella enterica enterica serovar Typhi Ty2
ucagcgccaccacaaac

SEQ ID NO: 3745489 - RNA, 22 nt, Salmonella enterica enterica serovar Typhi Ty2
ucagcgccacgcccaacauaaa

SEQ ID NO: 3745490 - RNA, 18 nt, Salmonella enterica enterica serovar Typhi Ty2
ucagcgcgccgcgcagca

SEQ ID NO: 3745491 - RNA, 12 nt, Salmonella enterica enterica serovar Typhi Ty2
ucagcgcgcgcu

SEQ ID NO: 3745492 - RNA, 12 nt, Salmonella enterica enterica serovar Typhi Ty2
ucagcgcgcucc

SEQ ID NO: 3745493 - RNA, 19 nt, Salmonella enterica enterica serovar Typhi Ty2
ucagcgcguuuuccaucau

SEQ ID NO: 3745494 - RNA, 14 nt, Salmonella enterica enterica serovar Typhi Ty2
ucagcggcaauagc

SEQ ID NO: 3745495 - RNA, 16 nt, Salmonella enterica enterica serovar Typhi Ty2
ucagcggcagcucugc

SEQ ID NO: 3745496 - RNA, 18 nt, Salmonella enterica enterica serovar Typhi Ty2
ucagcggcgcaggggcau

SEQ ID NO: 3745497 - RNA, 21 nt, Salmonella enterica enterica serovar Typhi Ty2
ucagcggcuugucauccugcu

SEQ ID NO: 3745498 - RNA, 23 nt, Salmonella enterica enterica serovar Typhi Ty2
ucagcgguccaauaaacgccagg

SEQ ID NO: 3745499 - RNA, 22 nt, Salmonella enterica enterica serovar Typhi Ty2
ucagcguaaaacuuuucugcgu

SEQ ID NO: 3745500 - RNA, 18 nt, Salmonella enterica enterica serovar Typhi Ty2
ucagcguaccgaagaaca

SEQ ID NO: 3745501 - RNA, 20 nt, Salmonella enterica enterica serovar Typhi Ty2
ucagcguuucgccguaaaac

SEQ ID NO: 3745502 - RNA, 19 nt, Salmonella enterica enterica serovar Typhi Ty2
ucagcuaaaaacagcgcaa

SEQ ID NO: 3745503 - RNA, 20 nt, Salmonella enterica enterica serovar Typhi Ty2
ucagcuaaaaacagcgcaau

SEQ ID NO: 3745504 - RNA, 14 nt, Salmonella enterica enterica serovar Typhi Ty2
ucagcuacuuuaaa

SEQ ID NO: 3745505 - RNA, 18 nt, Salmonella enterica enterica serovar Typhi Ty2
ucagcuauuagcguuuuu

SEQ ID NO: 3745506 - RNA, 21 nt, Salmonella enterica enterica serovar Typhi Ty2
ucagcuccuuauuacauaccc

SEQ ID NO: 3745507 - RNA, 16 nt, Salmonella enterica enterica serovar Typhi Ty2
ucagcucgauccggca

SEQ ID NO: 3745508 - RNA, 20 nt, Salmonella enterica enterica serovar Typhi Ty2
ucagcucgcugccgaucaga

SEQ ID NO: 3745509 - RNA, 20 nt, Salmonella enterica enterica serovar Typhi Ty2
ucagcucuucaauuuccauc

SEQ ID NO: 3745510 - RNA, 12 nt, Salmonella enterica enterica serovar Typhi Ty2
ucagcuggcuuu

SEQ ID NO: 3745511 - RNA, 19 nt, Salmonella enterica enterica serovar Typhi Ty2
ucagcuucugucagccuug

SEQ ID NO: 3745512 - RNA, 21 nt, Salmonella enterica enterica serovar Typhi Ty2
ucaggaaaaagggaauaauac

SEQ ID NO: 3745513 - RNA, 15 nt, Salmonella enterica enterica serovar Typhi Ty2
ucaggaaaacaaauu

SEQ ID NO: 3745514 - RNA, 18 nt, Salmonella enterica enterica serovar Typhi Ty2
ucaggaaaacgcuuucca

SEQ ID NO: 3745515 - RNA, 16 nt, Salmonella enterica enterica serovar Typhi Ty2
ucaggaaaucuuccag

SEQ ID NO: 3745516 - RNA, 21 nt, Salmonella enterica enterica serovar Typhi Ty2
ucaggaaauucucagaaacaa

SEQ ID NO: 3745517 - RNA, 17 nt, Salmonella enterica enterica serovar Typhi Ty2
ucaggaaugccacgauc

SEQ ID NO: 3745518 - RNA, 13 nt, Salmonella enterica enterica serovar Typhi Ty2
ucaggaggccuga

SEQ ID NO: 3745519 - RNA, 15 nt, Salmonella enterica enterica serovar Typhi Ty2
ucaggaggccugaau

SEQ ID NO: 3745520 - RNA, 22 nt, Salmonella enterica enterica serovar Typhi Ty2
ucaggaggccugaauaaugacc

SEQ ID NO: 3745521 - RNA, 16 nt, Salmonella enterica enterica serovar Typhi Ty2
ucaggaucaauucuga

SEQ ID NO: 3745522 - RNA, 23 nt, Salmonella enterica enterica serovar Typhi Ty2
ucaggcaaaaaucgucaucagau

SEQ ID NO: 3745523 - RNA, 22 nt, Salmonella enterica enterica serovar Typhi Ty2
ucaggcaaagcauaggccacga

SEQ ID NO: 3745524 - RNA, 23 nt, Salmonella enterica enterica serovar Typhi Ty2
ucaggcaacaggauguccugcgg

SEQ ID NO: 3745525 - RNA, 22 nt, Salmonella enterica enterica serovar Typhi Ty2
ucaggcaauaaaaaaggcagag

SEQ ID NO: 3745526 - RNA, 14 nt, Salmonella enterica enterica serovar Typhi Ty2
ucaggcaaugucug

SEQ ID NO: 3745527 - RNA, 15 nt, Salmonella enterica enterica serovar Typhi Ty2
ucaggcagaaauaac

SEQ ID NO: 3745528 - RNA, 16 nt, Salmonella enterica enterica serovar Typhi Ty2
ucaggcaucagauaaa

SEQ ID NO: 3745529 - RNA, 17 nt, Salmonella enterica enterica serovar Typhi Ty2
ucaggcauccugcccug

SEQ ID NO: 3745530 - RNA, 16 nt, Salmonella enterica enterica serovar Typhi Ty2
ucaggcaucugaaaug

SEQ ID NO: 3745531 - RNA, 19 nt, Salmonella enterica enterica serovar Typhi Ty2
ucaggcaucugaaaugcuc

SEQ ID NO: 3745532 - RNA, 13 nt, Salmonella enterica enterica serovar Typhi Ty2
ucaggcauguugc

SEQ ID NO: 3745533 - RNA, 17 nt, Salmonella enterica enterica serovar Typhi Ty2
ucaggcauuguugcguu

SEQ ID NO: 3745534 - RNA, 21 nt, Salmonella enterica enterica serovar Typhi Ty2
ucaggccagccaaaacgucgu

SEQ ID NO: 3745535 - RNA, 20 nt, Salmonella enterica enterica serovar Typhi Ty2
ucaggccgacaaaugacguc

SEQ ID NO: 3745536 - RNA, 15 nt, Salmonella enterica enterica serovar Typhi Ty2
ucaggccgauuucau

SEQ ID NO: 3745537 - RNA, 18 nt, Salmonella enterica enterica serovar Typhi Ty2
ucaggccgauuucauuca

SEQ ID NO: 3745538 - RNA, 19 nt, Salmonella enterica enterica serovar Typhi Ty2
ucaggccuacacucugcgc

SEQ ID NO: 3745539 - RNA, 16 nt, Salmonella enterica enterica serovar Typhi Ty2
ucaggccuaccaucgc

SEQ ID NO: 3745540 - RNA, 17 nt, Salmonella enterica enterica serovar Typhi Ty2
ucaggccuaccaucgcg

SEQ ID NO: 3745541 - RNA, 17 nt, Salmonella enterica enterica serovar Typhi Ty2
ucaggccuauagacacc

SEQ ID NO: 3745542 - RNA, 19 nt, Salmonella enterica enterica serovar Typhi Ty2
ucaggccuauagacaccuu

SEQ ID NO: 3745543 - RNA, 22 nt, Salmonella enterica enterica serovar Typhi Ty2
ucaggccuauagacaccuuaua

SEQ ID NO: 3745544 - RNA, 16 nt, Salmonella enterica enterica serovar Typhi Ty2
ucaggcgagacgcgcc

SEQ ID NO: 3745545 - RNA, 16 nt, Salmonella enterica enterica serovar Typhi Ty2
ucaggcgaucccggcc

SEQ ID NO: 3745546 - RNA, 22 nt, Salmonella enterica enterica serovar Typhi Ty2
ucaggcguagagaggcauccgc

SEQ ID NO: 3745547 - RNA, 12 nt, Salmonella enterica enterica serovar Typhi Ty2
ucaggcgugaug

SEQ ID NO: 3745548 - RNA, 15 nt, Salmonella enterica enterica serovar Typhi Ty2
ucaggcgugaugacu

SEQ ID NO: 3745549 - RNA, 21 nt, Salmonella enterica enterica serovar Typhi Ty2
ucaggcguuacagacgcugcg

SEQ ID NO: 3745550 - RNA, 14 nt, Salmonella enterica enterica serovar Typhi Ty2
ucaggcuaaauggc

SEQ ID NO: 3745551 - RNA, 14 nt, Salmonella enterica enterica serovar Typhi Ty2
ucaggcucaucagc

SEQ ID NO: 3745552 - RNA, 21 nt, Salmonella enterica enterica serovar Typhi Ty2
ucaggcucgucgccuuccagc

SEQ ID NO: 3745553 - RNA, 14 nt, Salmonella enterica enterica serovar Typhi Ty2
ucaucagccgacca

SEQ ID NO: 3745554 - RNA, 21 nt, Salmonella enterica enterica serovar Typhi Ty2
ucaucagccgaccaauugcag

SEQ ID NO: 3745555 - RNA, 15 nt, Salmonella enterica enterica serovar Typhi Ty2
ucaucaggccugcaa

SEQ ID NO: 3745556 - RNA, 18 nt, Salmonella enterica enterica serovar Typhi Ty2
ucaucaguuugcgauaag

SEQ ID NO: 3745557 - RNA, 13 nt, Salmonella enterica enterica serovar Typhi Ty2
ucaucauaaucaa

SEQ ID NO: 3745558 - RNA, 15 nt, Salmonella enterica enterica serovar Typhi Ty2
ucaucauaauucagc

SEQ ID NO: 3745559 - RNA, 19 nt, Salmonella enterica enterica serovar Typhi Ty2
ucaucauacugaagauaaa

SEQ ID NO: 3745560 - RNA, 15 nt, Salmonella enterica enterica serovar Typhi Ty2
ucaucaucauccaga

SEQ ID NO: 3745561 - RNA, 16 nt, Salmonella enterica enterica serovar Typhi Ty2
ucaucaucggcacagc

SEQ ID NO: 3745562 - RNA, 22 nt, Salmonella enterica enterica serovar Typhi Ty2
ucaucaucuuguccucaucauu

SEQ ID NO: 3745563 - RNA, 21 nt, Salmonella enterica enterica serovar Typhi Ty2
ucaucaugaaaaacaguaccg

SEQ ID NO: 3745564 - RNA, 16 nt, Salmonella enterica enterica serovar Typhi Ty2
ucaucaugauauaauu

SEQ ID NO: 3745565 - RNA, 16 nt, Salmonella enterica enterica serovar Typhi Ty2
ucaucauuacaggcga

SEQ ID NO: 3745566 - RNA, 22 nt, Salmonella enterica enterica serovar Typhi Ty2
ucaucauugaggcgcgaaaaau

SEQ ID NO: 3745567 - RNA, 23 nt, Salmonella enterica enterica serovar Typhi Ty2
ucaucauugaggcgcgaaaaaua

SEQ ID NO: 3745568 - RNA, 19 nt, Salmonella enterica enterica serovar Typhi Ty2
ucauccaauaacguaaccg

SEQ ID NO: 3745569 - RNA, 16 nt, Salmonella enterica enterica serovar Typhi Ty2
ucauccacagcgccag

SEQ ID NO: 3745570 - RNA, 16 nt, Salmonella enterica enterica serovar Typhi Ty2
ucauccagcaaaauaa

SEQ ID NO: 3745571 - RNA, 21 nt, Salmonella enterica enterica serovar Typhi Ty2
ucauccagcaauaacaccggc

SEQ ID NO: 3745572 - RNA, 13 nt, Salmonella enterica enterica serovar Typhi Ty2
ucauccagcagca

SEQ ID NO: 3745573 - RNA, 16 nt, Salmonella enterica enterica serovar Typhi Ty2
ucauccagcagcagca

SEQ ID NO: 3745574 - RNA, 19 nt, Salmonella enterica enterica serovar Typhi Ty2
ucauccagcguuucaugaa

SEQ ID NO: 3745575 - RNA, 19 nt, Salmonella enterica enterica serovar Typhi Ty2
ucaucccacuccaucgccu

SEQ ID NO: 3745576 - RNA, 17 nt, Salmonella enterica enterica serovar Typhi Ty2
ucaucccgcugugaucc

SEQ ID NO: 3745577 - RNA, 22 nt, Salmonella enterica enterica serovar Typhi Ty2
ucaucccggcuuaaauuuuuaa

SEQ ID NO: 3745578 - RNA, 23 nt, Salmonella enterica enterica serovar Typhi Ty2
ucaucccgguuucccgcgugaac

SEQ ID NO: 3745579 - RNA, 23 nt, Salmonella enterica enterica serovar Typhi Ty2
ucaucccgguuugggcgcgaaac

SEQ ID NO: 3745580 - RNA, 23 nt, Salmonella enterica enterica serovar Typhi Ty2
ucauccgaccacggccacagcca

SEQ ID NO: 3745581 - RNA, 18 nt, Salmonella enterica enterica serovar Typhi Ty2
ucauccgccaaaacaucu

SEQ ID NO: 3745582 - RNA, 22 nt, Salmonella enterica enterica serovar Typhi Ty2
ucauccgcugugggucaauggc

SEQ ID NO: 3745583 - RNA, 12 nt, Salmonella enterica enterica serovar Typhi Ty2
ucauccgcuucg

SEQ ID NO: 3745584 - RNA, 15 nt, Salmonella enterica enterica serovar Typhi Ty2
ucauccggcaagcgc

SEQ ID NO: 3745585 - RNA, 17 nt, Salmonella enterica enterica serovar Typhi Ty2
ucauccugauuuuacug

SEQ ID NO: 3745586 - RNA, 12 nt, Salmonella enterica enterica serovar Typhi Ty2
ucauccuucccc

SEQ ID NO: 3745587 - RNA, 16 nt, Salmonella enterica enterica serovar Typhi Ty2
ucaucgaacgccgccu

SEQ ID NO: 3745588 - RNA, 23 nt, Salmonella enterica enterica serovar Typhi Ty2
ucaucgaacgccgccugcgccag

SEQ ID NO: 3745589 - RNA, 16 nt, Salmonella enterica enterica serovar Typhi Ty2
ucaucgauggcgccag

SEQ ID NO: 3745590 - RNA, 17 nt, Salmonella enterica enterica serovar Typhi Ty2
ucaucgauuuccugaug

SEQ ID NO: 3745591 - RNA, 16 nt, Salmonella enterica enterica serovar Typhi Ty2
ucaucgcaaauucugu

SEQ ID NO: 3745592 - RNA, 17 nt, Salmonella enterica enterica serovar Typhi Ty2
ucaucgcaaauucugua

SEQ ID NO: 3745593 - RNA, 14 nt, Salmonella enterica enterica serovar Typhi Ty2
ucaucgcauccagg

SEQ ID NO: 3745594 - RNA, 18 nt, Salmonella enterica enterica serovar Typhi Ty2
ucaucgccuuaacucuua

SEQ ID NO: 3745595 - RNA, 12 nt, Salmonella enterica enterica serovar Typhi Ty2
ucaucgcgcuga

SEQ ID NO: 3745596 - RNA, 23 nt, Salmonella enterica enterica serovar Typhi Ty2
ucaucgcuuaacggcccaggcau

SEQ ID NO: 3745597 - RNA, 14 nt, Salmonella enterica enterica serovar Typhi Ty2
ucaucggccagaua

SEQ ID NO: 3745598 - RNA, 16 nt, Salmonella enterica enterica serovar Typhi Ty2
ucaucgguguucacaa

SEQ ID NO: 3745599 - RNA, 23 nt, Salmonella enterica enterica serovar Typhi Ty2
ucaucguaaaaucaacagcaaaa

SEQ ID NO: 3745600 - RNA, 20 nt, Salmonella enterica enterica serovar Typhi Ty2
ucaucgucauuaaugccuaa

SEQ ID NO: 3745601 - RNA, 22 nt, Salmonella enterica enterica serovar Typhi Ty2
ucaucguuugcgcuacgcugcg

SEQ ID NO: 3745602 - RNA, 13 nt, Salmonella enterica enterica serovar Typhi Ty2
ucaucuacacgca

SEQ ID NO: 3745603 - RNA, 15 nt, Salmonella enterica enterica serovar Typhi Ty2
ucaucucccaggccg

SEQ ID NO: 3745604 - RNA, 16 nt, Salmonella enterica enterica serovar Typhi Ty2
ucaucuccucuucagu

SEQ ID NO: 3745605 - RNA, 11 nt, Salmonella enterica enterica serovar Typhi Ty2
ucaucugcuuc

SEQ ID NO: 3745606 - RNA, 17 nt, Salmonella enterica enterica serovar Typhi Ty2
ucaucuucaccuuucca

SEQ ID NO: 3745607 - RNA, 18 nt, Salmonella enterica enterica serovar Typhi Ty2
ucaucuucaccuuuccag

SEQ ID NO: 3745608 - RNA, 15 nt, Salmonella enterica enterica serovar Typhi Ty2
ucaucuucacuucac

SEQ ID NO: 3745609 - RNA, 17 nt, Salmonella enterica enterica serovar Typhi Ty2
ucaucuucacuucacaa

SEQ ID NO: 3745610 - RNA, 22 nt, Salmonella enterica enterica serovar Typhi Ty2
ucaucuucccgcagauauccgc

SEQ ID NO: 3745611 - RNA, 11 nt, Salmonella enterica enterica serovar Typhi Ty2
ucaucuucuuu

SEQ ID NO: 3745612 - RNA, 16 nt, Salmonella enterica enterica serovar Typhi Ty2
ucaugaaaaauauaaa

SEQ ID NO: 3745613 - RNA, 14 nt, Salmonella enterica enterica serovar Typhi Ty2
ucaugaaccacgcc

SEQ ID NO: 3745614 - RNA, 16 nt, Salmonella enterica enterica serovar Typhi Ty2
ucaugaaguuaccaga

SEQ ID NO: 3745615 - RNA, 20 nt, Salmonella enterica enterica serovar Typhi Ty2
ucaugacauagcauaauaau

SEQ ID NO: 3745616 - RNA, 19 nt, Salmonella enterica enterica serovar Typhi Ty2
ucaugacaucgcccugggu

SEQ ID NO: 3745617 - RNA, 14 nt, Salmonella enterica enterica serovar Typhi Ty2
ucaugacgcgauau

SEQ ID NO: 3745618 - RNA, 17 nt, Salmonella enterica enterica serovar Typhi Ty2
ucaugacucuuguuucu

SEQ ID NO: 3745619 - RNA, 18 nt, Salmonella enterica enterica serovar Typhi Ty2
ucaugacugguuuuucgc

SEQ ID NO: 3745620 - RNA, 21 nt, Salmonella enterica enterica serovar Typhi Ty2
ucaugacuuuuuucaaccuca

SEQ ID NO: 3745621 - RNA, 19 nt, Salmonella enterica enterica serovar Typhi Ty2
ucaugaguaaaugaacguu

SEQ ID NO: 3745622 - RNA, 20 nt, Salmonella enterica enterica serovar Typhi Ty2
ucaugagucgcgcgcgccag

SEQ ID NO: 3745623 - RNA, 22 nt, Salmonella enterica enterica serovar Typhi Ty2
ucaugagucgcgcgcgccaguc

SEQ ID NO: 3745624 - RNA, 17 nt, Salmonella enterica enterica serovar Typhi Ty2
ucaugauacccagcguc

SEQ ID NO: 3745625 - RNA, 18 nt, Salmonella enterica enterica serovar Typhi Ty2
ucaugaucgauccgcauc

SEQ ID NO: 3745626 - RNA, 19 nt, Salmonella enterica enterica serovar Typhi Ty2
ucaugaucuuuccuuuuuc

SEQ ID NO: 3745627 - RNA, 22 nt, Salmonella enterica enterica serovar Typhi Ty2
ucaugaugaucuucagcccguu

SEQ ID NO: 3745628 - RNA, 13 nt, Salmonella enterica enterica serovar Typhi Ty2
ucaugauguuugu

SEQ ID NO: 3745629 - RNA, 23 nt, Salmonella enterica enterica serovar Typhi Ty2
ucaugauuucuugagcggcauca

SEQ ID NO: 3745630 - RNA, 17 nt, Salmonella enterica enterica serovar Typhi Ty2
ucaugcaauaaucacug

SEQ ID NO: 3745631 - RNA, 21 nt, Salmonella enterica enterica serovar Typhi Ty2
ucaugcauuaaugggcgaaaa

SEQ ID NO: 3745632 - RNA, 19 nt, Salmonella enterica enterica serovar Typhi Ty2
ucaugccgaccagggcauc

SEQ ID NO: 3745633 - RNA, 22 nt, Salmonella enterica enterica serovar Typhi Ty2
ucaugccuucuuugccuuuuuc

SEQ ID NO: 3745634 - RNA, 22 nt, Salmonella enterica enterica serovar Typhi Ty2
ucaugcgcggucauucauuguc

SEQ ID NO: 3745635 - RNA, 23 nt, Salmonella enterica enterica serovar Typhi Ty2
uccaacagaaggcuucacgccac

SEQ ID NO: 3745636 - RNA, 12 nt, Salmonella enterica enterica serovar Typhi Ty2
uccaacauagcu

SEQ ID NO: 3745637 - RNA, 13 nt, Salmonella enterica enterica serovar Typhi Ty2
uccaacccuugcu

SEQ ID NO: 3745638 - RNA, 14 nt, Salmonella enterica enterica serovar Typhi Ty2
uccaacgugcagau

SEQ ID NO: 3745639 - RNA, 18 nt, Salmonella enterica enterica serovar Typhi Ty2
uccaacuguuaucauaga

SEQ ID NO: 3745640 - RNA, 13 nt, Salmonella enterica enterica serovar Typhi Ty2
uccaaguauugau

SEQ ID NO: 3745641 - RNA, 19 nt, Salmonella enterica enterica serovar Typhi Ty2
uccaauaacguaaccgcuu

SEQ ID NO: 3745642 - RNA, 15 nt, Salmonella enterica enterica serovar Typhi Ty2
uccaauagacuucac

SEQ ID NO: 3745643 - RNA, 20 nt, Salmonella enterica enterica serovar Typhi Ty2
uccaauagacuucacuuucc

SEQ ID NO: 3745644 - RNA, 13 nt, Salmonella enterica enterica serovar Typhi Ty2
uccaauauuuauu

SEQ ID NO: 3745645 - RNA, 21 nt, Salmonella enterica enterica serovar Typhi Ty2
uccaauauuuauuuaauguuu

SEQ ID NO: 3745646 - RNA, 17 nt, Salmonella enterica enterica serovar Typhi Ty2
uccaaucucuuuugcgg

SEQ ID NO: 3745647 - RNA, 16 nt, Salmonella enterica enterica serovar Typhi Ty2
uccaaugcggcaucuc

SEQ ID NO: 3745648 - RNA, 22 nt, Salmonella enterica enterica serovar Typhi Ty2
uccacaaaaggauacagcgccg

SEQ ID NO: 3745649 - RNA, 15 nt, Salmonella enterica enterica serovar Typhi Ty2
uccacaaucccggca

SEQ ID NO: 3745650 - RNA, 20 nt, Salmonella enterica enterica serovar Typhi Ty2
uccacacguccauccgggua

SEQ ID NO: 3745651 - RNA, 17 nt, Salmonella enterica enterica serovar Typhi Ty2
uccacaguaaccccaua

SEQ ID NO: 3745652 - RNA, 23 nt, Salmonella enterica enterica serovar Typhi Ty2
uccacauaggcguugauggcgua

SEQ ID NO: 3745653 - RNA, 12 nt, Salmonella enterica enterica serovar Typhi Ty2
uccacauccagc

SEQ ID NO: 3745654 - RNA, 21 nt, Salmonella enterica enterica serovar Typhi Ty2
uccacauccagcgccagcgcc

SEQ ID NO: 3745655 - RNA, 21 nt, Salmonella enterica enterica serovar Typhi Ty2
uccacauugguuuugccauuc

SEQ ID NO: 3745656 - RNA, 12 nt, Salmonella enterica enterica serovar Typhi Ty2
uccaccaccucc

SEQ ID NO: 3745657 - RNA, 22 nt, Salmonella enterica enterica serovar Typhi Ty2
uccaccagauuucgcagcagca

SEQ ID NO: 3745658 - RNA, 19 nt, Salmonella enterica enterica serovar Typhi Ty2
uccaccagcccaucuuucg

SEQ ID NO: 3745659 - RNA, 18 nt, Salmonella enterica enterica serovar Typhi Ty2
uccaccagcuuaucugac

SEQ ID NO: 3745660 - RNA, 14 nt, Salmonella enterica enterica serovar Typhi Ty2
uccaccagcuucau

SEQ ID NO: 3745661 - RNA, 17 nt, Salmonella enterica enterica serovar Typhi Ty2
uccaccaggcaugcagc

SEQ ID NO: 3745662 - RNA, 21 nt, Salmonella enterica enterica serovar Typhi Ty2
uccaccguaugugcgccgugc

SEQ ID NO: 3745663 - RNA, 12 nt, Salmonella enterica enterica serovar Typhi Ty2
uccaccuggccc

SEQ ID NO: 3745664 - RNA, 21 nt, Salmonella enterica enterica serovar Typhi Ty2
uccaccuggcccugcaucagc

SEQ ID NO: 3745665 - RNA, 22 nt, Salmonella enterica enterica serovar Typhi Ty2
uccaccuggcccugcaucagcu

SEQ ID NO: 3745666 - RNA, 20 nt, Salmonella enterica enterica serovar Typhi Ty2
uccaccuuaucaagcgauac

SEQ ID NO: 3745667 - RNA, 13 nt, Salmonella enterica enterica serovar Typhi Ty2
uccaccuuauccu

SEQ ID NO: 3745668 - RNA, 19 nt, Salmonella enterica enterica serovar Typhi Ty2
uccacgacaauauccucgc

SEQ ID NO: 3745669 - RNA, 23 nt, Salmonella enterica enterica serovar Typhi Ty2
uccacgccgucgaugauggcggc

SEQ ID NO: 3745670 - RNA, 14 nt, Salmonella enterica enterica serovar Typhi Ty2
uccacgcgcaccau

SEQ ID NO: 3745671 - RNA, 17 nt, Salmonella enterica enterica serovar Typhi Ty2
uccacggacaucggccu

SEQ ID NO: 3745672 - RNA, 19 nt, Salmonella enterica enterica serovar Typhi Ty2
uccacggaucgacauuaug

SEQ ID NO: 3745673 - RNA, 22 nt, Salmonella enterica enterica serovar Typhi Ty2
uccacgguaaaacacgccucca

SEQ ID NO: 3745674 - RNA, 17 nt, Salmonella enterica enterica serovar Typhi Ty2
uccacgguucucaccgu

SEQ ID NO: 3745675 - RNA, 17 nt, Salmonella enterica enterica serovar Typhi Ty2
uccacgucgcacgccau

SEQ ID NO: 3745676 - RNA, 16 nt, Salmonella enterica enterica serovar Typhi Ty2
uccacguuuuacuucc

SEQ ID NO: 3745677 - RNA, 18 nt, Salmonella enterica enterica serovar Typhi Ty2
uccacucgcucauuugcg

SEQ ID NO: 3745678 - RNA, 18 nt, Salmonella enterica enterica serovar Typhi Ty2
uccacucggcgcugucgu

SEQ ID NO: 3745679 - RNA, 23 nt, Salmonella enterica enterica serovar Typhi Ty2
uccacucguaacgcauauccagc

SEQ ID NO: 3745680 - RNA, 16 nt, Salmonella enterica enterica serovar Typhi Ty2
uccacugagcgcgcca

SEQ ID NO: 3745681 - RNA, 21 nt, Salmonella enterica enterica serovar Typhi Ty2
uccacugagcuucaccgccag

SEQ ID NO: 3745682 - RNA, 22 nt, Salmonella enterica enterica serovar Typhi Ty2
uccacuguucguccauaaaggc

SEQ ID NO: 3745683 - RNA, 14 nt, Salmonella enterica enterica serovar Typhi Ty2
uccacuucagcagc

SEQ ID NO: 3745684 - RNA, 17 nt, Salmonella enterica enterica serovar Typhi Ty2
uccacuuucucggcuuu

SEQ ID NO: 3745685 - RNA, 17 nt, Salmonella enterica enterica serovar Typhi Ty2
uccacuuugccuuuauu

SEQ ID NO: 3745686 - RNA, 18 nt, Salmonella enterica enterica serovar Typhi Ty2
uccacuuuugucggccug

SEQ ID NO: 3745687 - RNA, 19 nt, Salmonella enterica enterica serovar Typhi Ty2
uccacuuuugucggccugu

SEQ ID NO: 3745688 - RNA, 21 nt, Salmonella enterica enterica serovar Typhi Ty2
uccagaaggcaaaaugccagc

SEQ ID NO: 3745689 - RNA, 17 nt, Salmonella enterica enterica serovar Typhi Ty2
uccagaauacgaauauu

SEQ ID NO: 3745690 - RNA, 15 nt, Salmonella enterica enterica serovar Typhi Ty2
uccagaauacgccgc

SEQ ID NO: 3745691 - RNA, 17 nt, Salmonella enterica enterica serovar Typhi Ty2
uccagaauacgccgccg

SEQ ID NO: 3745692 - RNA, 16 nt, Salmonella enterica enterica serovar Typhi Ty2
uccagacaauccgcgg

SEQ ID NO: 3745693 - RNA, 16 nt, Salmonella enterica enterica serovar Typhi Ty2
uccagacagccgacgg

SEQ ID NO: 3745694 - RNA, 12 nt, Salmonella enterica enterica serovar Typhi Ty2
uccagacagcuu

SEQ ID NO: 3745695 - RNA, 18 nt, Salmonella enterica enterica serovar Typhi Ty2
uccagacccagacaaccg

SEQ ID NO: 3745696 - RNA, 22 nt, Salmonella enterica enterica serovar Typhi Ty2
uccagaggaucuggacgccaau

SEQ ID NO: 3745697 - RNA, 15 nt, Salmonella enterica enterica serovar Typhi Ty2
uccagaguacauucu

SEQ ID NO: 3745698 - RNA, 16 nt, Salmonella enterica enterica serovar Typhi Ty2
uccagauagcgcugcg

SEQ ID NO: 3745699 - RNA, 18 nt, Salmonella enterica enterica serovar Typhi Ty2
uccagauagggccaggcg

SEQ ID NO: 3745700 - RNA, 13 nt, Salmonella enterica enterica serovar Typhi Ty2
uccagaucgccac

SEQ ID NO: 3745701 - RNA, 14 nt, Salmonella enterica enterica serovar Typhi Ty2
uccagaucuucaga

SEQ ID NO: 3745702 - RNA, 20 nt, Salmonella enterica enterica serovar Typhi Ty2
uccagaugcggcgccaacgc

SEQ ID NO: 3745703 - RNA, 22 nt, Salmonella enterica enterica serovar Typhi Ty2
uccagauuacuaugaggauuau

SEQ ID NO: 3745704 - RNA, 16 nt, Salmonella enterica enterica serovar Typhi Ty2
uccagauugagacaaa

SEQ ID NO: 3745705 - RNA, 21 nt, Salmonella enterica enterica serovar Typhi Ty2
uccagauugagacaaauaacu

SEQ ID NO: 3745706 - RNA, 20 nt, Salmonella enterica enterica serovar Typhi Ty2
uccagcaaaccuuccgccag

SEQ ID NO: 3745707 - RNA, 14 nt, Salmonella enterica enterica serovar Typhi Ty2
uccagcaacagaag

SEQ ID NO: 3745708 - RNA, 21 nt, Salmonella enterica enterica serovar Typhi Ty2
uccagcaacagugggcuauga

SEQ ID NO: 3745709 - RNA, 16 nt, Salmonella enterica enterica serovar Typhi Ty2
uccagcaaugauuuua

SEQ ID NO: 3745710 - RNA, 22 nt, Salmonella enterica enterica serovar Typhi Ty2
uccagcaccgcgaccaguucac

SEQ ID NO: 3745711 - RNA, 22 nt, Salmonella enterica enterica serovar Typhi Ty2
uccagcacgauauccagcaccu

SEQ ID NO: 3745712 - RNA, 13 nt, Salmonella enterica enterica serovar Typhi Ty2
uccagcacgccca

SEQ ID NO: 3745713 - RNA, 20 nt, Salmonella enterica enterica serovar Typhi Ty2
uccagcacgcgcugcgccgc

SEQ ID NO: 3745714 - RNA, 12 nt, Salmonella enterica enterica serovar Typhi Ty2
uccagcacggca

SEQ ID NO: 3745715 - RNA, 20 nt, Salmonella enterica enterica serovar Typhi Ty2
uccagcacggcauaagccuc

SEQ ID NO: 3745716 - RNA, 13 nt, Salmonella enterica enterica serovar Typhi Ty2
uccagcagcacuu

SEQ ID NO: 3745717 - RNA, 20 nt, Salmonella enterica enterica serovar Typhi Ty2
uccagcagcagagccggaac

SEQ ID NO: 3745718 - RNA, 19 nt, Salmonella enterica enterica serovar Typhi Ty2
uccagcagcagcaccggcu

SEQ ID NO: 3745719 - RNA, 20 nt, Salmonella enterica enterica serovar Typhi Ty2
uccagcagccaugccagcgc

SEQ ID NO: 3745720 - RNA, 20 nt, Salmonella enterica enterica serovar Typhi Ty2
uccagcagguggaucugaau

SEQ ID NO: 3745721 - RNA, 12 nt, Salmonella enterica enterica serovar Typhi Ty2
uccagcaguguc

SEQ ID NO: 3745722 - RNA, 22 nt, Salmonella enterica enterica serovar Typhi Ty2
uccagcauaauaugaugcagac

SEQ ID NO: 3745723 - RNA, 18 nt, Salmonella enterica enterica serovar Typhi Ty2
uccagccccuucgcuguc

SEQ ID NO: 3745724 - RNA, 22 nt, Salmonella enterica enterica serovar Typhi Ty2
uccagcccgccaauauccggca

SEQ ID NO: 3745725 - RNA, 15 nt, Salmonella enterica enterica serovar Typhi Ty2
uccagcccgccgccc

SEQ ID NO: 3745726 - RNA, 23 nt, Salmonella enterica enterica serovar Typhi Ty2
uccagccgcccgcgauaaaaauc

SEQ ID NO: 3745727 - RNA, 18 nt, Salmonella enterica enterica serovar Typhi Ty2
uccagccgcuuuucgcuu

SEQ ID NO: 3745728 - RNA, 16 nt, Salmonella enterica enterica serovar Typhi Ty2
uccagccgguguuaac

SEQ ID NO: 3745729 - RNA, 17 nt, Salmonella enterica enterica serovar Typhi Ty2
uccagccgguguuaacc

SEQ ID NO: 3745730 - RNA, 18 nt, Salmonella enterica enterica serovar Typhi Ty2
uccagccguaccacccgg

SEQ ID NO: 3745731 - RNA, 22 nt, Salmonella enterica enterica serovar Typhi Ty2
uccagccguuuaaucucuucau

SEQ ID NO: 3745732 - RNA, 14 nt, Salmonella enterica enterica serovar Typhi Ty2
uccagcgauaaacg

SEQ ID NO: 3745733 - RNA, 22 nt, Salmonella enterica enterica serovar Typhi Ty2
uccagcgcauggaagaaaauau

SEQ ID NO: 3745734 - RNA, 15 nt, Salmonella enterica enterica serovar Typhi Ty2
uccagcgccagcgcc

SEQ ID NO: 3745735 - RNA, 23 nt, Salmonella enterica enterica serovar Typhi Ty2
uccagcgccugcuguaaaauauc

SEQ ID NO: 3745736 - RNA, 17 nt, Salmonella enterica enterica serovar Typhi Ty2
uccagcgcgacgccuuc

SEQ ID NO: 3745737 - RNA, 15 nt, Salmonella enterica enterica serovar Typhi Ty2
uccagcgcguccagc

SEQ ID NO: 3745738 - RNA, 16 nt, Salmonella enterica enterica serovar Typhi Ty2
uccagcgcguccuuau

SEQ ID NO: 3745739 - RNA, 17 nt, Salmonella enterica enterica serovar Typhi Ty2
uccagcgcucaaucagc

SEQ ID NO: 3745740 - RNA, 12 nt, Salmonella enterica enterica serovar Typhi Ty2
uccagcggcgcg

SEQ ID NO: 3745741 - RNA, 15 nt, Salmonella enterica enterica serovar Typhi Ty2
uccagcgggccgacg

SEQ ID NO: 3745742 - RNA, 16 nt, Salmonella enterica enterica serovar Typhi Ty2
uccagcgggccgacga

SEQ ID NO: 3745743 - RNA, 15 nt, Salmonella enterica enterica serovar Typhi Ty2
uccagcgucgggccg

SEQ ID NO: 3745744 - RNA, 23 nt, Salmonella enterica enterica serovar Typhi Ty2
uccagcguuucaugaaugccggg

SEQ ID NO: 3745745 - RNA, 20 nt, Salmonella enterica enterica serovar Typhi Ty2
uccagcuaaguuuguaaaau

SEQ ID NO: 3745746 - RNA, 14 nt, Salmonella enterica enterica serovar Typhi Ty2
uccagcuacuggcc

SEQ ID NO: 3745747 - RNA, 16 nt, Salmonella enterica enterica serovar Typhi Ty2
uccagcuacuggccac

SEQ ID NO: 3745748 - RNA, 15 nt, Salmonella enterica enterica serovar Typhi Ty2
uccagcucagggucc

SEQ ID NO: 3745749 - RNA, 18 nt, Salmonella enterica enterica serovar Typhi Ty2
uccagcucagggucccca

SEQ ID NO: 3745750 - RNA, 14 nt, Salmonella enterica enterica serovar Typhi Ty2
uccagcucaguuuc

SEQ ID NO: 3745751 - RNA, 18 nt, Salmonella enterica enterica serovar Typhi Ty2
uccagcucaguuuccagc

SEQ ID NO: 3745752 - RNA, 15 nt, Salmonella enterica enterica serovar Typhi Ty2
uccagcuccauccac

SEQ ID NO: 3745753 - RNA, 19 nt, Salmonella enterica enterica serovar Typhi Ty2
uccagcugcgacagcgaac

SEQ ID NO: 3745754 - RNA, 19 nt, Salmonella enterica enterica serovar Typhi Ty2
uccagcuguuuaagcgccu

SEQ ID NO: 3745755 - RNA, 20 nt, Salmonella enterica enterica serovar Typhi Ty2
uccagcuguuuaagcgccuc

SEQ ID NO: 3745756 - RNA, 23 nt, Salmonella enterica enterica serovar Typhi Ty2
uccagcuugccgucacaggcggc

SEQ ID NO: 3745757 - RNA, 22 nt, Salmonella enterica enterica serovar Typhi Ty2
uccaggaaguaaauuauuccuu

SEQ ID NO: 3745758 - RNA, 23 nt, Salmonella enterica enterica serovar Typhi Ty2
uccaggccaagcgccuguucaac

SEQ ID NO: 3745759 - RNA, 16 nt, Salmonella enterica enterica serovar Typhi Ty2
uccaggccgccagcgu

SEQ ID NO: 3745760 - RNA, 21 nt, Salmonella enterica enterica serovar Typhi Ty2
uccaggccgucggcgccagcc

SEQ ID NO: 3745761 - RNA, 24 nt, Salmonella enterica enterica serovar Typhi Ty2
uccaggcucgauaaucaucacgcu

SEQ ID NO: 3745762 - RNA, 19 nt, Salmonella enterica enterica serovar Typhi Ty2
uccagggaaaccauguuga

SEQ ID NO: 3745763 - RNA, 20 nt, Salmonella enterica enterica serovar Typhi Ty2
uccagggauugauggccagc

SEQ ID NO: 3745764 - RNA, 16 nt, Salmonella enterica enterica serovar Typhi Ty2
uccagguaacauacaa

SEQ ID NO: 3745765 - RNA, 17 nt, Salmonella enterica enterica serovar Typhi Ty2
uccagguaacauacaaa

SEQ ID NO: 3745766 - RNA, 20 nt, Salmonella enterica enterica serovar Typhi Ty2
uccaggucaucaccuccagc

SEQ ID NO: 3745767 - RNA, 15 nt, Salmonella enterica enterica serovar Typhi Ty2
uccagguuaacccac

SEQ ID NO: 3745768 - RNA, 20 nt, Salmonella enterica enterica serovar Typhi Ty2
uccagguucaucacuuucac

SEQ ID NO: 3745769 - RNA, 18 nt, Salmonella enterica enterica serovar Typhi Ty2
uccagguuuuaguuucac

SEQ ID NO: 3745770 - RNA, 21 nt, Salmonella enterica enterica serovar Typhi Ty2
uccaguaaaaucggaccuccg

SEQ ID NO: 3745771 - RNA, 18 nt, Salmonella enterica enterica serovar Typhi Ty2
uccaguaauucccggcag

SEQ ID NO: 3745772 - RNA, 19 nt, Salmonella enterica enterica serovar Typhi Ty2
uccaguacuuucuuuugau

SEQ ID NO: 3745773 - RNA, 15 nt, Salmonella enterica enterica serovar Typhi Ty2
uccaguagcagcgau

SEQ ID NO: 3745774 - RNA, 16 nt, Salmonella enterica enterica serovar Typhi Ty2
uccagucagcaauuaa

SEQ ID NO: 3745775 - RNA, 16 nt, Salmonella enterica enterica serovar Typhi Ty2
uccaguguuguucucu

SEQ ID NO: 3745776 - RNA, 21 nt, Salmonella enterica enterica serovar Typhi Ty2
uccaguucauaagucauccag

SEQ ID NO: 3745777 - RNA, 22 nt, Salmonella enterica enterica serovar Typhi Ty2
uccaguucauaagucauccaga

SEQ ID NO: 3745778 - RNA, 13 nt, Salmonella enterica enterica serovar Typhi Ty2
uccaguucgagcc

SEQ ID NO: 3745779 - RNA, 20 nt, Salmonella enterica enterica serovar Typhi Ty2
uccaguucguucugcgucgc

SEQ ID NO: 3745780 - RNA, 22 nt, Salmonella enterica enterica serovar Typhi Ty2
uccaguugaaaaccacaaucac

SEQ ID NO: 3745781 - RNA, 15 nt, Salmonella enterica enterica serovar Typhi Ty2
uccaguugcggcauc

SEQ ID NO: 3745782 - RNA, 16 nt, Salmonella enterica enterica serovar Typhi Ty2
uccaguugcuuaccuu

SEQ ID NO: 3745783 - RNA, 18 nt, Salmonella enterica enterica serovar Typhi Ty2
uccaguugcuuaccuugu

SEQ ID NO: 3745784 - RNA, 15 nt, Salmonella enterica enterica serovar Typhi Ty2
uccaguugucaucgu

SEQ ID NO: 3745785 - RNA, 21 nt, Salmonella enterica enterica serovar Typhi Ty2
uccaguuugcgggaaauacca

SEQ ID NO: 3745786 - RNA, 19 nt, Salmonella enterica enterica serovar Typhi Ty2
uccaguuugcguucacagc

SEQ ID NO: 3745787 - RNA, 21 nt, Salmonella enterica enterica serovar Typhi Ty2
uccauaaaauaaagucagcaa

SEQ ID NO: 3745788 - RNA, 12 nt, Salmonella enterica enterica serovar Typhi Ty2
uccauaaaauga

SEQ ID NO: 3745789 - RNA, 21 nt, Salmonella enterica enterica serovar Typhi Ty2
uccauaccggacuccaggcaa

SEQ ID NO: 3745790 - RNA, 18 nt, Salmonella enterica enterica serovar Typhi Ty2
uccauaccguuucaacug

SEQ ID NO: 3745791 - RNA, 17 nt, Salmonella enterica enterica serovar Typhi Ty2
uccauagaaaucagcag

SEQ ID NO: 3745792 - RNA, 14 nt, Salmonella enterica enterica serovar Typhi Ty2
uccauagaacgcuu

SEQ ID NO: 3745793 - RNA, 19 nt, Salmonella enterica enterica serovar Typhi Ty2
uccauauaacagaauaagc

SEQ ID NO: 3745794 - RNA, 22 nt, Salmonella enterica enterica serovar Typhi Ty2
uccauauaaucaaacccuuccg

SEQ ID NO: 3745795 - RNA, 18 nt, Salmonella enterica enterica serovar Typhi Ty2
uccaucacgguaaaccug

SEQ ID NO: 3745796 - RNA, 23 nt, Salmonella enterica enterica serovar Typhi Ty2
uccaucacgguaaaccuguuugu

SEQ ID NO: 3745797 - RNA, 22 nt, Salmonella enterica enterica serovar Typhi Ty2
uccaucacguuggggaauaaau

SEQ ID NO: 3745798 - RNA, 19 nt, Salmonella enterica enterica serovar Typhi Ty2
uccccauaucccgaaaagc

SEQ ID NO: 3745799 - RNA, 14 nt, Salmonella enterica enterica serovar Typhi Ty2
uccccaucuccaga

SEQ ID NO: 3745800 - RNA, 23 nt, Salmonella enterica enterica serovar Typhi Ty2
uccccaucugaacucuuccagau

SEQ ID NO: 3745801 - RNA, 12 nt, Salmonella enterica enterica serovar Typhi Ty2
uccccauguuga

SEQ ID NO: 3745802 - RNA, 12 nt, Salmonella enterica enterica serovar Typhi Ty2
ucccccacuucu

SEQ ID NO: 3745803 - RNA, 17 nt, Salmonella enterica enterica serovar Typhi Ty2
uccccccuuuuuugcug

SEQ ID NO: 3745804 - RNA, 21 nt, Salmonella enterica enterica serovar Typhi Ty2
ucccccggcaccacgcacagu

SEQ ID NO: 3745805 - RNA, 19 nt, Salmonella enterica enterica serovar Typhi Ty2
ucccccucuugccccacau

SEQ ID NO: 3745806 - RNA, 12 nt, Salmonella enterica enterica serovar Typhi Ty2
ucccccuggccc

SEQ ID NO: 3745807 - RNA, 19 nt, Salmonella enterica enterica serovar Typhi Ty2
uccccgauucgcaugaauu

SEQ ID NO: 3745808 - RNA, 12 nt, Salmonella enterica enterica serovar Typhi Ty2
uccccgccgcca

SEQ ID NO: 3745809 - RNA, 17 nt, Salmonella enterica enterica serovar Typhi Ty2
uccccgccgccaucacc

SEQ ID NO: 3745810 - RNA, 14 nt, Salmonella enterica enterica serovar Typhi Ty2
uccccgccgcggcg

SEQ ID NO: 3745811 - RNA, 20 nt, Salmonella enterica enterica serovar Typhi Ty2
uccccgcuggcgcggggaac

SEQ ID NO: 3745812 - RNA, 22 nt, Salmonella enterica enterica serovar Typhi Ty2
uccccgcugucgggagccucuu

SEQ ID NO: 3745813 - RNA, 22 nt, Salmonella enterica enterica serovar Typhi Ty2
uccccggcaaccuuaaacaucg

SEQ ID NO: 3745814 - RNA, 13 nt, Salmonella enterica enterica serovar Typhi Ty2
uccccggcagccu

SEQ ID NO: 3745815 - RNA, 13 nt, Salmonella enterica enterica serovar Typhi Ty2
uccccggcuucca

SEQ ID NO: 3745816 - RNA, 12 nt, Salmonella enterica enterica serovar Typhi Ty2
uccccgggaaca

SEQ ID NO: 3745817 - RNA, 21 nt, Salmonella enterica enterica serovar Typhi Ty2
uccccggggugcagaacauca

SEQ ID NO: 3745818 - RNA, 21 nt, Salmonella enterica enterica serovar Typhi Ty2
uccccucaugacuuuuuucaa

SEQ ID NO: 3745819 - RNA, 15 nt, Salmonella enterica enterica serovar Typhi Ty2
uccccucuuccauca

SEQ ID NO: 3745820 - RNA, 12 nt, Salmonella enterica enterica serovar Typhi Ty2
uccccugcuccu

SEQ ID NO: 3745821 - RNA, 15 nt, Salmonella enterica enterica serovar Typhi Ty2
uccccugcuccugcc

SEQ ID NO: 3745822 - RNA, 19 nt, Salmonella enterica enterica serovar Typhi Ty2
uccccugcuccugccagau

SEQ ID NO: 3745823 - RNA, 14 nt, Salmonella enterica enterica serovar Typhi Ty2
uccccuucaggaau

SEQ ID NO: 3745824 - RNA, 15 nt, Salmonella enterica enterica serovar Typhi Ty2
uccccuucugguagc

SEQ ID NO: 3745825 - RNA, 19 nt, Salmonella enterica enterica serovar Typhi Ty2
uccccuucuguaagcaauu

SEQ ID NO: 3745826 - RNA, 21 nt, Salmonella enterica enterica serovar Typhi Ty2
uccccuuuucacccaacauuu

SEQ ID NO: 3745827 - RNA, 16 nt, Salmonella enterica enterica serovar Typhi Ty2
uccccuuuuuucuguu

SEQ ID NO: 3745828 - RNA, 21 nt, Salmonella enterica enterica serovar Typhi Ty2
ucccgaacugucugaaucagu

SEQ ID NO: 3745829 - RNA, 20 nt, Salmonella enterica enterica serovar Typhi Ty2
ucccgaaucacuuacuaagg

SEQ ID NO: 3745830 - RNA, 18 nt, Salmonella enterica enterica serovar Typhi Ty2
ucccgacaccagccguuc

SEQ ID NO: 3745831 - RNA, 22 nt, Salmonella enterica enterica serovar Typhi Ty2
ucccgagccggguuauagccuu

SEQ ID NO: 3745832 - RNA, 15 nt, Salmonella enterica enterica serovar Typhi Ty2
ucccgauacgguugc

SEQ ID NO: 3745833 - RNA, 13 nt, Salmonella enterica enterica serovar Typhi Ty2
ucccgaucuucau

SEQ ID NO: 3745834 - RNA, 21 nt, Salmonella enterica enterica serovar Typhi Ty2
ucccgaugguauuuauucuau

SEQ ID NO: 3745835 - RNA, 20 nt, Salmonella enterica enterica serovar Typhi Ty2
ucccgcaaaaugaggacaca

SEQ ID NO: 3745836 - RNA, 23 nt, Salmonella enterica enterica serovar Typhi Ty2
ucccgcacccgggaaagcggauc

SEQ ID NO: 3745837 - RNA, 20 nt, Salmonella enterica enterica serovar Typhi Ty2
ucccgcacgcgacgcgccag

SEQ ID NO: 3745838 - RNA, 13 nt, Salmonella enterica enterica serovar Typhi Ty2
ucccgcagccacu

SEQ ID NO: 3745839 - RNA, 13 nt, Salmonella enterica enterica serovar Typhi Ty2
ucccgccagcugc

SEQ ID NO: 3745840 - RNA, 17 nt, Salmonella enterica enterica serovar Typhi Ty2
ucccgccaucguccagc

SEQ ID NO: 3745841 - RNA, 14 nt, Salmonella enterica enterica serovar Typhi Ty2
ucccgcccagcaac

SEQ ID NO: 3745842 - RNA, 13 nt, Salmonella enterica enterica serovar Typhi Ty2
ucccgcccgcgua

SEQ ID NO: 3745843 - RNA, 15 nt, Salmonella enterica enterica serovar Typhi Ty2
ucccgccgguucaau

SEQ ID NO: 3745844 - RNA, 14 nt, Salmonella enterica enterica serovar Typhi Ty2
ucccgccugcugca

SEQ ID NO: 3745845 - RNA, 19 nt, Salmonella enterica enterica serovar Typhi Ty2
ucccgccuugcggcgccag

SEQ ID NO: 3745846 - RNA, 20 nt, Salmonella enterica enterica serovar Typhi Ty2
ucccgcgcagugcagcggau

SEQ ID NO: 3745847 - RNA, 13 nt, Salmonella enterica enterica serovar Typhi Ty2
ucccgcgccguuc

SEQ ID NO: 3745848 - RNA, 13 nt, Salmonella enterica enterica serovar Typhi Ty2
ucccgcgcggucg

SEQ ID NO: 3745849 - RNA, 17 nt, Salmonella enterica enterica serovar Typhi Ty2
ucccgcgcuucauccga

SEQ ID NO: 3745850 - RNA, 18 nt, Salmonella enterica enterica serovar Typhi Ty2
ucccgcggcggacagcgg

SEQ ID NO: 3745851 - RNA, 22 nt, Salmonella enterica enterica serovar Typhi Ty2
ucccgcguucgcgcaguucauc

SEQ ID NO: 3745852 - RNA, 12 nt, Salmonella enterica enterica serovar Typhi Ty2
ucccgcuggcug

SEQ ID NO: 3745853 - RNA, 18 nt, Salmonella enterica enterica serovar Typhi Ty2
ucccgcugugauccaugu

SEQ ID NO: 3745854 - RNA, 22 nt, Salmonella enterica enterica serovar Typhi Ty2
ucccgcugugauccauguugcc

SEQ ID NO: 3745855 - RNA, 21 nt, Salmonella enterica enterica serovar Typhi Ty2
ucccggaacaaaagaaagcaa

SEQ ID NO: 3745856 - RNA, 21 nt, Salmonella enterica enterica serovar Typhi Ty2
ucccggcaauuaccgccagcg

SEQ ID NO: 3745857 - RNA, 17 nt, Salmonella enterica enterica serovar Typhi Ty2
ucccggcgauuaauaaa

SEQ ID NO: 3745858 - RNA, 22 nt, Salmonella enterica enterica serovar Typhi Ty2
ucccggcgccaaucaccgccag

SEQ ID NO: 3745859 - RNA, 21 nt, Salmonella enterica enterica serovar Typhi Ty2
ucccggcgccgaucaucccgc

SEQ ID NO: 3745860 - RNA, 18 nt, Salmonella enterica enterica serovar Typhi Ty2
ucccggcguagcgcguuc

SEQ ID NO: 3745861 - RNA, 12 nt, Salmonella enterica enterica serovar Typhi Ty2
ucccggcgugug

SEQ ID NO: 3745862 - RNA, 19 nt, Salmonella enterica enterica serovar Typhi Ty2
ucccggcuuaaauggcgcu

SEQ ID NO: 3745863 - RNA, 22 nt, Salmonella enterica enterica serovar Typhi Ty2
ucccggcuuaaauuuuuaauaa

SEQ ID NO: 3745864 - RNA, 16 nt, Salmonella enterica enterica serovar Typhi Ty2
ucccgggcgauaaacc

SEQ ID NO: 3745865 - RNA, 23 nt, Salmonella enterica enterica serovar Typhi Ty2
ucccgggcgauaaaccagcccca

SEQ ID NO: 3745866 - RNA, 15 nt, Salmonella enterica enterica serovar Typhi Ty2
ucccgggugcgcagc

SEQ ID NO: 3745867 - RNA, 23 nt, Salmonella enterica enterica serovar Typhi Ty2
ucccgguuaucgaacagcuuacc

SEQ ID NO: 3745868 - RNA, 22 nt, Salmonella enterica enterica serovar Typhi Ty2
ucccgguuuaugcgguucuccc

SEQ ID NO: 3745869 - RNA, 14 nt, Salmonella enterica enterica serovar Typhi Ty2
ucccguaaaagaag

SEQ ID NO: 3745870 - RNA, 17 nt, Salmonella enterica enterica serovar Typhi Ty2
ucccguaaaagaagaaa

SEQ ID NO: 3745871 - RNA, 22 nt, Salmonella enterica enterica serovar Typhi Ty2
ucccgucccaccacgcagccau

SEQ ID NO: 3745872 - RNA, 17 nt, Salmonella enterica enterica serovar Typhi Ty2
ucccguuucagccccuu

SEQ ID NO: 3745873 - RNA, 23 nt, Salmonella enterica enterica serovar Typhi Ty2
ucccuacugcuuagcucaucagc

SEQ ID NO: 3745874 - RNA, 23 nt, Salmonella enterica enterica serovar Typhi Ty2
ucccuauguaaagaaugaaaaaa

SEQ ID NO: 3745875 - RNA, 17 nt, Salmonella enterica enterica serovar Typhi Ty2
ucccucacgcgucacaa

SEQ ID NO: 3745876 - RNA, 17 nt, Salmonella enterica enterica serovar Typhi Ty2
ucccucauauuuguauc

SEQ ID NO: 3745877 - RNA, 14 nt, Salmonella enterica enterica serovar Typhi Ty2
ucccuccugcucca

SEQ ID NO: 3745878 - RNA, 17 nt, Salmonella enterica enterica serovar Typhi Ty2
ucccucgacaauuucac

SEQ ID NO: 3745879 - RNA, 11 nt, Salmonella enterica enterica serovar Typhi Ty2
ucccucuccag

SEQ ID NO: 3745880 - RNA, 15 nt, Salmonella enterica enterica serovar Typhi Ty2
uccgcuguuaugcac

SEQ ID NO: 3745881 - RNA, 14 nt, Salmonella enterica enterica serovar Typhi Ty2
uccgcuuccagaau

SEQ ID NO: 3745882 - RNA, 19 nt, Salmonella enterica enterica serovar Typhi Ty2
uccgcuucgcgggaccaaa

SEQ ID NO: 3745883 - RNA, 21 nt, Salmonella enterica enterica serovar Typhi Ty2
uccgcuucggacuccugacgc

SEQ ID NO: 3745884 - RNA, 15 nt, Salmonella enterica enterica serovar Typhi Ty2
uccgcuuuuccugcc

SEQ ID NO: 3745885 - RNA, 19 nt, Salmonella enterica enterica serovar Typhi Ty2
uccgcuuuuccugccagca

SEQ ID NO: 3745886 - RNA, 16 nt, Salmonella enterica enterica serovar Typhi Ty2
uccgcuuuucuggcuu

SEQ ID NO: 3745887 - RNA, 16 nt, Salmonella enterica enterica serovar Typhi Ty2
uccgcuuuugguuuuu

SEQ ID NO: 3745888 - RNA, 20 nt, Salmonella enterica enterica serovar Typhi Ty2
uccgcuuuuuuauuguuucu

SEQ ID NO: 3745889 - RNA, 20 nt, Salmonella enterica enterica serovar Typhi Ty2
uccggaaucagugcugaaaa

SEQ ID NO: 3745890 - RNA, 13 nt, Salmonella enterica enterica serovar Typhi Ty2
uccggacgccagu

SEQ ID NO: 3745891 - RNA, 15 nt, Salmonella enterica enterica serovar Typhi Ty2
uccggaucaucuuuu

SEQ ID NO: 3745892 - RNA, 21 nt, Salmonella enterica enterica serovar Typhi Ty2
uccggaucaucuuuuaccgcc

SEQ ID NO: 3745893 - RNA, 19 nt, Salmonella enterica enterica serovar Typhi Ty2
uccggaucgccgaagcggc

SEQ ID NO: 3745894 - RNA, 21 nt, Salmonella enterica enterica serovar Typhi Ty2
uccggauggaacgcauccagc

SEQ ID NO: 3745895 - RNA, 21 nt, Salmonella enterica enterica serovar Typhi Ty2
uccggauggcaguacagggcg

SEQ ID NO: 3745896 - RNA, 20 nt, Salmonella enterica enterica serovar Typhi Ty2
uccggauucgcggcaaacac

SEQ ID NO: 3745897 - RNA, 14 nt, Salmonella enterica enterica serovar Typhi Ty2
uccggcaaacucag

SEQ ID NO: 3745898 - RNA, 13 nt, Salmonella enterica enterica serovar Typhi Ty2
uccggcaaugauu

SEQ ID NO: 3745899 - RNA, 19 nt, Salmonella enterica enterica serovar Typhi Ty2
uccggcacauugucagcug

SEQ ID NO: 3745900 - RNA, 19 nt, Salmonella enterica enterica serovar Typhi Ty2
uccggcaccucguccagau

SEQ ID NO: 3745901 - RNA, 21 nt, Salmonella enterica enterica serovar Typhi Ty2
uccggcacgccagcgccguug

SEQ ID NO: 3745902 - RNA, 16 nt, Salmonella enterica enterica serovar Typhi Ty2
uccggcauccagcgcu

SEQ ID NO: 3745903 - RNA, 18 nt, Salmonella enterica enterica serovar Typhi Ty2
uccggcaucucaaggucu

SEQ ID NO: 3745904 - RNA, 19 nt, Salmonella enterica enterica serovar Typhi Ty2
uccggcauucgcacacuac

SEQ ID NO: 3745905 - RNA, 12 nt, Salmonella enterica enterica serovar Typhi Ty2
uccggcauuuuu

SEQ ID NO: 3745906 - RNA, 23 nt, Salmonella enterica enterica serovar Typhi Ty2
uccggcccggagguaaauuaacg

SEQ ID NO: 3745907 - RNA, 17 nt, Salmonella enterica enterica serovar Typhi Ty2
uccggcccgugccagcu

SEQ ID NO: 3745908 - RNA, 12 nt, Salmonella enterica enterica serovar Typhi Ty2
uccggccuacag

SEQ ID NO: 3745909 - RNA, 22 nt, Salmonella enterica enterica serovar Typhi Ty2
uccggccuacggucgguuucau

SEQ ID NO: 3745910 - RNA, 21 nt, Salmonella enterica enterica serovar Typhi Ty2
uccggccuauagcuaauggcu

SEQ ID NO: 3745911 - RNA, 16 nt, Salmonella enterica enterica serovar Typhi Ty2
uccggccugcagggaa

SEQ ID NO: 3745912 - RNA, 13 nt, Salmonella enterica enterica serovar Typhi Ty2
uccggccugcaug

SEQ ID NO: 3745913 - RNA, 18 nt, Salmonella enterica enterica serovar Typhi Ty2
uccggccuguaaggucuc

SEQ ID NO: 3745914 - RNA, 14 nt, Salmonella enterica enterica serovar Typhi Ty2
uccggcgauagcgg

SEQ ID NO: 3745915 - RNA, 20 nt, Salmonella enterica enterica serovar Typhi Ty2
uccggcgcgaucaucgcauu

SEQ ID NO: 3745916 - RNA, 19 nt, Salmonella enterica enterica serovar Typhi Ty2
uccggcgcggcgcgcaugc

SEQ ID NO: 3745917 - RNA, 23 nt, Salmonella enterica enterica serovar Typhi Ty2
uccggcgcgguauuucgccgccg

SEQ ID NO: 3745918 - RNA, 21 nt, Salmonella enterica enterica serovar Typhi Ty2
uccggcgcugaugacgcgccg

SEQ ID NO: 3745919 - RNA, 17 nt, Salmonella enterica enterica serovar Typhi Ty2
uccggcgcugcgcggcg

SEQ ID NO: 3745920 - RNA, 16 nt, Salmonella enterica enterica serovar Typhi Ty2
uccggcgcuuccugca

SEQ ID NO: 3745921 - RNA, 19 nt, Salmonella enterica enterica serovar Typhi Ty2
uccggcgggagcucuacca

SEQ ID NO: 3745922 - RNA, 17 nt, Salmonella enterica enterica serovar Typhi Ty2
uccggcggucagccagc

SEQ ID NO: 3745923 - RNA, 15 nt, Salmonella enterica enterica serovar Typhi Ty2
uccggcggugaagca

SEQ ID NO: 3745924 - RNA, 23 nt, Salmonella enterica enterica serovar Typhi Ty2
uccggcgucuggguuugcagcag

SEQ ID NO: 3745925 - RNA, 14 nt, Salmonella enterica enterica serovar Typhi Ty2
uccggcgugacuca

SEQ ID NO: 3745926 - RNA, 21 nt, Salmonella enterica enterica serovar Typhi Ty2
uccggcgugucagggcggaac

SEQ ID NO: 3745927 - RNA, 18 nt, Salmonella enterica enterica serovar Typhi Ty2
uccggcuacgguuuuaau

SEQ ID NO: 3745928 - RNA, 11 nt, Salmonella enterica enterica serovar Typhi Ty2
uccggcugccu

SEQ ID NO: 3745929 - RNA, 22 nt, Salmonella enterica enterica serovar Typhi Ty2
uccggcuuaaugcauggcagau

SEQ ID NO: 3745930 - RNA, 19 nt, Salmonella enterica enterica serovar Typhi Ty2
uccggcuuauccggccugc

SEQ ID NO: 3745931 - RNA, 20 nt, Salmonella enterica enterica serovar Typhi Ty2
uccgggaaggacgccaccgg

SEQ ID NO: 3745932 - RNA, 19 nt, Salmonella enterica enterica serovar Typhi Ty2
uccgggauguuaauuucau

SEQ ID NO: 3745933 - RNA, 16 nt, Salmonella enterica enterica serovar Typhi Ty2
uccgggguucgaaucc

SEQ ID NO: 3745934 - RNA, 13 nt, Salmonella enterica enterica serovar Typhi Ty2
uccggguaauuuu

SEQ ID NO: 3745935 - RNA, 19 nt, Salmonella enterica enterica serovar Typhi Ty2
uccgggucaguuuuuugac

SEQ ID NO: 3745936 - RNA, 18 nt, Salmonella enterica enterica serovar Typhi Ty2
uccgguaaacgagcgcaa

SEQ ID NO: 3745937 - RNA, 16 nt, Salmonella enterica enterica serovar Typhi Ty2
uccgguagagaacgaa

SEQ ID NO: 3745938 - RNA, 15 nt, Salmonella enterica enterica serovar Typhi Ty2
uccgguagcgccugu

SEQ ID NO: 3745939 - RNA, 22 nt, Salmonella enterica enterica serovar Typhi Ty2
uccgguagguuuaaaccacucc

SEQ ID NO: 3745940 - RNA, 21 nt, Salmonella enterica enterica serovar Typhi Ty2
uccgguaucaugcugaugacu

SEQ ID NO: 3745941 - RNA, 15 nt, Salmonella enterica enterica serovar Typhi Ty2
uccggucuacaagug

SEQ ID NO: 3745942 - RNA, 14 nt, Salmonella enterica enterica serovar Typhi Ty2
uccggucugcgcgc

SEQ ID NO: 3745943 - RNA, 22 nt, Salmonella enterica enterica serovar Typhi Ty2
uccgguggcgcaguauggcgac

SEQ ID NO: 3745944 - RNA, 16 nt, Salmonella enterica enterica serovar Typhi Ty2
uccgguugaccgcaua

SEQ ID NO: 3745945 - RNA, 12 nt, Salmonella enterica enterica serovar Typhi Ty2
uccgguuucaac

SEQ ID NO: 3745946 - RNA, 11 nt, Salmonella enterica enterica serovar Typhi Ty2
uccgguuuuug

SEQ ID NO: 3745947 - RNA, 20 nt, Salmonella enterica enterica serovar Typhi Ty2
uccguacauaacagcagcag

SEQ ID NO: 3745948 - RNA, 22 nt, Salmonella enterica enterica serovar Typhi Ty2
uccguagcggauugccgcgcuc

SEQ ID NO: 3745949 - RNA, 19 nt, Salmonella enterica enterica serovar Typhi Ty2
uccguaggcggcuaccgcc

SEQ ID NO: 3745950 - RNA, 22 nt, Salmonella enterica enterica serovar Typhi Ty2
uccguaggcggcuaccgccgua

SEQ ID NO: 3745951 - RNA, 19 nt, Salmonella enterica enterica serovar Typhi Ty2
uccguauuauccacccccg

SEQ ID NO: 3745952 - RNA, 16 nt, Salmonella enterica enterica serovar Typhi Ty2
uccguauugcaaugcg

SEQ ID NO: 3745953 - RNA, 13 nt, Salmonella enterica enterica serovar Typhi Ty2
uccgucaggaugg

SEQ ID NO: 3745954 - RNA, 13 nt, Salmonella enterica enterica serovar Typhi Ty2
uccguccagaccg

SEQ ID NO: 3745955 - RNA, 13 nt, Salmonella enterica enterica serovar Typhi Ty2
uccguccucuuuc

SEQ ID NO: 3745956 - RNA, 16 nt, Salmonella enterica enterica serovar Typhi Ty2
uccgucuccggacguu

SEQ ID NO: 3745957 - RNA, 19 nt, Salmonella enterica enterica serovar Typhi Ty2
uccgucucuuuauugaaaa

SEQ ID NO: 3745958 - RNA, 21 nt, Salmonella enterica enterica serovar Typhi Ty2
uccgugaaugccaagcgcaua

SEQ ID NO: 3745959 - RNA, 17 nt, Salmonella enterica enterica serovar Typhi Ty2
uccgugccgccgcgaaa

SEQ ID NO: 3745960 - RNA, 15 nt, Salmonella enterica enterica serovar Typhi Ty2
uccguuaagcccuga

SEQ ID NO: 3745961 - RNA, 13 nt, Salmonella enterica enterica serovar Typhi Ty2
uccguuauuucac

SEQ ID NO: 3745962 - RNA, 18 nt, Salmonella enterica enterica serovar Typhi Ty2
uccugguuuguccagggc

SEQ ID NO: 3745963 - RNA, 19 nt, Salmonella enterica enterica serovar Typhi Ty2
uccuguacaaaaucaucau

SEQ ID NO: 3745964 - RNA, 18 nt, Salmonella enterica enterica serovar Typhi Ty2
uccugucgucaccagcag

SEQ ID NO: 3745965 - RNA, 15 nt, Salmonella enterica enterica serovar Typhi Ty2
uccugugcuuugauu

SEQ ID NO: 3745966 - RNA, 12 nt, Salmonella enterica enterica serovar Typhi Ty2
uccuguuccuga

SEQ ID NO: 3745967 - RNA, 22 nt, Salmonella enterica enterica serovar Typhi Ty2
uccuguugaugauggcuccugu

SEQ ID NO: 3745968 - RNA, 13 nt, Salmonella enterica enterica serovar Typhi Ty2
uccuuaaucagcu

SEQ ID NO: 3745969 - RNA, 16 nt, Salmonella enterica enterica serovar Typhi Ty2
uccuuaugaccgaguc

SEQ ID NO: 3745970 - RNA, 22 nt, Salmonella enterica enterica serovar Typhi Ty2
uccuuaugggucacauccagac

SEQ ID NO: 3745971 - RNA, 18 nt, Salmonella enterica enterica serovar Typhi Ty2
uccuuauuaaagccccuu

SEQ ID NO: 3745972 - RNA, 21 nt, Salmonella enterica enterica serovar Typhi Ty2
uccuuauuuaauacaucagaa

SEQ ID NO: 3745973 - RNA, 14 nt, Salmonella enterica enterica serovar Typhi Ty2
uccuucaauuuuac

SEQ ID NO: 3745974 - RNA, 18 nt, Salmonella enterica enterica serovar Typhi Ty2
uccuucagcguuugcgcc

SEQ ID NO: 3745975 - RNA, 17 nt, Salmonella enterica enterica serovar Typhi Ty2
uccuuccagcccguucu

SEQ ID NO: 3745976 - RNA, 21 nt, Salmonella enterica enterica serovar Typhi Ty2
uccuuccgccggggagggaug

SEQ ID NO: 3745977 - RNA, 15 nt, Salmonella enterica enterica serovar Typhi Ty2
uccuucgcuuccugg

SEQ ID NO: 3745978 - RNA, 17 nt, Salmonella enterica enterica serovar Typhi Ty2
uccuucggugccauauu

SEQ ID NO: 3745979 - RNA, 14 nt, Salmonella enterica enterica serovar Typhi Ty2
uccuucuucccccu

SEQ ID NO: 3745980 - RNA, 14 nt, Salmonella enterica enterica serovar Typhi Ty2
uccuucuucgccgu

SEQ ID NO: 3745981 - RNA, 14 nt, Salmonella enterica enterica serovar Typhi Ty2
uccuugagugguuu

SEQ ID NO: 3745982 - RNA, 15 nt, Salmonella enterica enterica serovar Typhi Ty2
uccuugauuucauug

SEQ ID NO: 3745983 - RNA, 22 nt, Salmonella enterica enterica serovar Typhi Ty2
uccuugcagccagaacucaucu

SEQ ID NO: 3745984 - RNA, 20 nt, Salmonella enterica enterica serovar Typhi Ty2
uccuugccagugaaaaaaag

SEQ ID NO: 3745985 - RNA, 23 nt, Salmonella enterica enterica serovar Typhi Ty2
uccuugcccuguuucgcaggccg

SEQ ID NO: 3745986 - RNA, 21 nt, Salmonella enterica enterica serovar Typhi Ty2
uccuugcggugagaaacgcgc

SEQ ID NO: 3745987 - RNA, 20 nt, Salmonella enterica enterica serovar Typhi Ty2
uccuuuaggguugacugcca

SEQ ID NO: 3745988 - RNA, 22 nt, Salmonella enterica enterica serovar Typhi Ty2
uccuuuccugugcucgauauau

SEQ ID NO: 3745989 - RNA, 18 nt, Salmonella enterica enterica serovar Typhi Ty2
uccuuucgagaagcccag

SEQ ID NO: 3745990 - RNA, 14 nt, Salmonella enterica enterica serovar Typhi Ty2
uccuuugccuuucu

SEQ ID NO: 3745991 - RNA, 15 nt, Salmonella enterica enterica serovar Typhi Ty2
uccuuugccuuucuu

SEQ ID NO: 3745992 - RNA, 23 nt, Salmonella enterica enterica serovar Typhi Ty2
uccuuuguuugccgcgaccacgc

SEQ ID NO: 3745993 - RNA, 19 nt, Salmonella enterica enterica serovar Typhi Ty2
uccuuuuaauaaagaaagc

SEQ ID NO: 3745994 - RNA, 21 nt, Salmonella enterica enterica serovar Typhi Ty2
uccuuuuaccggcgaagucgc

SEQ ID NO: 3745995 - RNA, 13 nt, Salmonella enterica enterica serovar Typhi Ty2
uccuuuuucaggc

SEQ ID NO: 3745996 - RNA, 15 nt, Salmonella enterica enterica serovar Typhi Ty2
uccuuuuucaggcac

SEQ ID NO: 3745997 - RNA, 15 nt, Salmonella enterica enterica serovar Typhi Ty2
uccuuuuuccgccac

SEQ ID NO: 3745998 - RNA, 20 nt, Salmonella enterica enterica serovar Typhi Ty2
ucgaaacuggcauugugagc

SEQ ID NO: 3745999 - RNA, 21 nt, Salmonella enterica enterica serovar Typhi Ty2
ucgaaauguccauccauugcg

SEQ ID NO: 3746000 - RNA, 17 nt, Salmonella enterica enterica serovar Typhi Ty2
ucgaacagcggcaggcg

SEQ ID NO: 3746001 - RNA, 19 nt, Salmonella enterica enterica serovar Typhi Ty2
ucgaacgccgccugcgcca

SEQ ID NO: 3746002 - RNA, 16 nt, Salmonella enterica enterica serovar Typhi Ty2
ucgaacgguaacagga

SEQ ID NO: 3746003 - RNA, 17 nt, Salmonella enterica enterica serovar Typhi Ty2
ucgaacgguaacaggaa

SEQ ID NO: 3746004 - RNA, 14 nt, Salmonella enterica enterica serovar Typhi Ty2
ucgaacugaaaugg

SEQ ID NO: 3746005 - RNA, 16 nt, Salmonella enterica enterica serovar Typhi Ty2
ucgaagagcacuuugg

SEQ ID NO: 3746006 - RNA, 19 nt, Salmonella enterica enterica serovar Typhi Ty2
ucgaagccgaccaccaucc

SEQ ID NO: 3746007 - RNA, 22 nt, Salmonella enterica enterica serovar Typhi Ty2
ucgaagccgaccaccauccggc

SEQ ID NO: 3746008 - RNA, 16 nt, Salmonella enterica enterica serovar Typhi Ty2
ucgaaucgccucaacc

SEQ ID NO: 3746009 - RNA, 21 nt, Salmonella enterica enterica serovar Typhi Ty2
ucgaaugaggacggcccgcug

SEQ ID NO: 3746010 - RNA, 23 nt, Salmonella enterica enterica serovar Typhi Ty2
ucgacaacgcguuuauuauaaac

SEQ ID NO: 3746011 - RNA, 11 nt, Salmonella enterica enterica serovar Typhi Ty2
ucgacaagcua

SEQ ID NO: 3746012 - RNA, 19 nt, Salmonella enterica enterica serovar Typhi Ty2
ucgacaauaaauugcgacc

SEQ ID NO: 3746013 - RNA, 16 nt, Salmonella enterica enterica serovar Typhi Ty2
ucgacaauguccgcca

SEQ ID NO: 3746014 - RNA, 13 nt, Salmonella enterica enterica serovar Typhi Ty2
ucgacaauuucac

SEQ ID NO: 3746015 - RNA, 18 nt, Salmonella enterica enterica serovar Typhi Ty2
ucgacagauuggucagca

SEQ ID NO: 3746016 - RNA, 21 nt, Salmonella enterica enterica serovar Typhi Ty2
ucgacagccagcauuuccagc

SEQ ID NO: 3746017 - RNA, 22 nt, Salmonella enterica enterica serovar Typhi Ty2
ucgacagccagcauuuccagcu

SEQ ID NO: 3746018 - RNA, 16 nt, Salmonella enterica enterica serovar Typhi Ty2
ucgacaguucccggca

SEQ ID NO: 3746019 - RNA, 17 nt, Salmonella enterica enterica serovar Typhi Ty2
ucgacaguucccggcaa

SEQ ID NO: 3746020 - RNA, 22 nt, Salmonella enterica enterica serovar Typhi Ty2
ucgacauaauuuccggccagua

SEQ ID NO: 3746021 - RNA, 19 nt, Salmonella enterica enterica serovar Typhi Ty2
ucgacauaguacccucugc

SEQ ID NO: 3746022 - RNA, 22 nt, Salmonella enterica enterica serovar Typhi Ty2
ucgacaucuucaccgaugccca

SEQ ID NO: 3746023 - RNA, 19 nt, Salmonella enterica enterica serovar Typhi Ty2
ucgacaucuuggcgcugcc

SEQ ID NO: 3746024 - RNA, 17 nt, Salmonella enterica enterica serovar Typhi Ty2
ucgacaugcagaucgcg

SEQ ID NO: 3746025 - RNA, 15 nt, Salmonella enterica enterica serovar Typhi Ty2
ucgacaugggcggga

SEQ ID NO: 3746026 - RNA, 23 nt, Salmonella enterica enterica serovar Typhi Ty2
ucgacaugggcgggauccugcaa

SEQ ID NO: 3746027 - RNA, 18 nt, Salmonella enterica enterica serovar Typhi Ty2
ucgacaugguuggccacc

SEQ ID NO: 3746028 - RNA, 20 nt, Salmonella enterica enterica serovar Typhi Ty2
ucgacauuaacaaugccuua

SEQ ID NO: 3746029 - RNA, 17 nt, Salmonella enterica enterica serovar Typhi Ty2
ucgaccagcagcgggcu

SEQ ID NO: 3746030 - RNA, 21 nt, Salmonella enterica enterica serovar Typhi Ty2
ucgaccccaaugauccacagg

SEQ ID NO: 3746031 - RNA, 22 nt, Salmonella enterica enterica serovar Typhi Ty2
ucgacccgcaaugugcagcagg

SEQ ID NO: 3746032 - RNA, 11 nt, Salmonella enterica enterica serovar Typhi Ty2
ucgaccgcaga

SEQ ID NO: 3746033 - RNA, 17 nt, Salmonella enterica enterica serovar Typhi Ty2
ucgaccgucagcagcac

SEQ ID NO: 3746034 - RNA, 20 nt, Salmonella enterica enterica serovar Typhi Ty2
ucgacgacaacgcccacauc

SEQ ID NO: 3746035 - RNA, 19 nt, Salmonella enterica enterica serovar Typhi Ty2
ucgacgauaaaaaaaguau

SEQ ID NO: 3746036 - RNA, 13 nt, Salmonella enterica enterica serovar Typhi Ty2
ucgacgccagcgg

SEQ ID NO: 3746037 - RNA, 20 nt, Salmonella enterica enterica serovar Typhi Ty2
ucgacgcgcaucacaaugac

SEQ ID NO: 3746038 - RNA, 16 nt, Salmonella enterica enterica serovar Typhi Ty2
ucgacggccagcgcgc

SEQ ID NO: 3746039 - RNA, 20 nt, Salmonella enterica enterica serovar Typhi Ty2
ucgacgggacgaauuuccag

SEQ ID NO: 3746040 - RNA, 22 nt, Salmonella enterica enterica serovar Typhi Ty2
ucgacgggacgaauuuccagcg

SEQ ID NO: 3746041 - RNA, 22 nt, Salmonella enterica enterica serovar Typhi Ty2
ucgacgucaacgguaaaauggc

SEQ ID NO: 3746042 - RNA, 16 nt, Salmonella enterica enterica serovar Typhi Ty2
ucgacguccagcgcgu

SEQ ID NO: 3746043 - RNA, 15 nt, Salmonella enterica enterica serovar Typhi Ty2
ucgccaguaagggga

SEQ ID NO: 3746044 - RNA, 20 nt, Salmonella enterica enterica serovar Typhi Ty2
ucgccauaaagcuguaccug

SEQ ID NO: 3746045 - RNA, 16 nt, Salmonella enterica enterica serovar Typhi Ty2
ucgccauacaucgcgu

SEQ ID NO: 3746046 - RNA, 18 nt, Salmonella enterica enterica serovar Typhi Ty2
ucgccauauccaagcccc

SEQ ID NO: 3746047 - RNA, 12 nt, Salmonella enterica enterica serovar Typhi Ty2
ucgccauaucuu

SEQ ID NO: 3746048 - RNA, 19 nt, Salmonella enterica enterica serovar Typhi Ty2
ucgccauaucuucgcgcgu

SEQ ID NO: 3746049 - RNA, 13 nt, Salmonella enterica enterica serovar Typhi Ty2
ucgccaucaccag

SEQ ID NO: 3746050 - RNA, 14 nt, Salmonella enterica enterica serovar Typhi Ty2
ucgccauccggcaa

SEQ ID NO: 3746051 - RNA, 22 nt, Salmonella enterica enterica serovar Typhi Ty2
ucgccauccggcaaugauuaga

SEQ ID NO: 3746052 - RNA, 14 nt, Salmonella enterica enterica serovar Typhi Ty2
ucgccauccugcac

SEQ ID NO: 3746053 - RNA, 20 nt, Salmonella enterica enterica serovar Typhi Ty2
ucgccaucgauagcagcgcu

SEQ ID NO: 3746054 - RNA, 15 nt, Salmonella enterica enterica serovar Typhi Ty2
ucgccaugucaaaug

SEQ ID NO: 3746055 - RNA, 15 nt, Salmonella enterica enterica serovar Typhi Ty2
ucgccauucccgcga

SEQ ID NO: 3746056 - RNA, 22 nt, Salmonella enterica enterica serovar Typhi Ty2
ucgcccaccgcauagacgugcg

SEQ ID NO: 3746057 - RNA, 22 nt, Salmonella enterica enterica serovar Typhi Ty2
ucgcccacgcccagagcgcggc

SEQ ID NO: 3746058 - RNA, 14 nt, Salmonella enterica enterica serovar Typhi Ty2
ucgccccagcauau

SEQ ID NO: 3746059 - RNA, 19 nt, Salmonella enterica enterica serovar Typhi Ty2
ucgccccggcgagugccug

SEQ ID NO: 3746060 - RNA, 13 nt, Salmonella enterica enterica serovar Typhi Ty2
ucgcccgccagau

SEQ ID NO: 3746061 - RNA, 20 nt, Salmonella enterica enterica serovar Typhi Ty2
ucgcccgccgcaaaaaauac

SEQ ID NO: 3746062 - RNA, 20 nt, Salmonella enterica enterica serovar Typhi Ty2
ucgcccgcguuguccccuca

SEQ ID NO: 3746063 - RNA, 14 nt, Salmonella enterica enterica serovar Typhi Ty2
ucgcccggaaaugg

SEQ ID NO: 3746064 - RNA, 16 nt, Salmonella enterica enterica serovar Typhi Ty2
ucgcccggcaugacau

SEQ ID NO: 3746065 - RNA, 18 nt, Salmonella enterica enterica serovar Typhi Ty2
ucgcccggcguaacgcca

SEQ ID NO: 3746066 - RNA, 14 nt, Salmonella enterica enterica serovar Typhi Ty2
ucgcccguuuuacc

SEQ ID NO: 3746067 - RNA, 20 nt, Salmonella enterica enterica serovar Typhi Ty2
ucgcccucgccagcaacagg

SEQ ID NO: 3746068 - RNA, 14 nt, Salmonella enterica enterica serovar Typhi Ty2
ucgcccugauggcg

SEQ ID NO: 3746069 - RNA, 18 nt, Salmonella enterica enterica serovar Typhi Ty2
ucgcccugcgccagacgc

SEQ ID NO: 3746070 - RNA, 13 nt, Salmonella enterica enterica serovar Typhi Ty2
ucgcccugcggua

SEQ ID NO: 3746071 - RNA, 15 nt, Salmonella enterica enterica serovar Typhi Ty2
ucgcccugcgguagc

SEQ ID NO: 3746072 - RNA, 18 nt, Salmonella enterica enterica serovar Typhi Ty2
ucgcccuucaucuuccag

SEQ ID NO: 3746073 - RNA, 14 nt, Salmonella enterica enterica serovar Typhi Ty2
ucgcccuuuucgca

SEQ ID NO: 3746074 - RNA, 16 nt, Salmonella enterica enterica serovar Typhi Ty2
ucgccgaccauccaga

SEQ ID NO: 3746075 - RNA, 18 nt, Salmonella enterica enterica serovar Typhi Ty2
ucgccgccaaagcgcccg

SEQ ID NO: 3746076 - RNA, 15 nt, Salmonella enterica enterica serovar Typhi Ty2
ucgccgccaggaacg

SEQ ID NO: 3746077 - RNA, 14 nt, Salmonella enterica enterica serovar Typhi Ty2
ucgccgccauccgg

SEQ ID NO: 3746078 - RNA, 15 nt, Salmonella enterica enterica serovar Typhi Ty2
ucgccgccauccggc

SEQ ID NO: 3746079 - RNA, 19 nt, Salmonella enterica enterica serovar Typhi Ty2
ucgccgccaucggcgcgua

SEQ ID NO: 3746080 - RNA, 18 nt, Salmonella enterica enterica serovar Typhi Ty2
ucgccgcccaaccagccc

SEQ ID NO: 3746081 - RNA, 22 nt, Salmonella enterica enterica serovar Typhi Ty2
ucgccgccgccagauuauccag

SEQ ID NO: 3746082 - RNA, 19 nt, Salmonella enterica enterica serovar Typhi Ty2
ucgccgccgccgcgaccgc

SEQ ID NO: 3746083 - RNA, 13 nt, Salmonella enterica enterica serovar Typhi Ty2
ucgccgccgcgag

SEQ ID NO: 3746084 - RNA, 17 nt, Salmonella enterica enterica serovar Typhi Ty2
ucgccgccgcgagcagc

SEQ ID NO: 3746085 - RNA, 12 nt, Salmonella enterica enterica serovar Typhi Ty2
ucgccgcgcgca

SEQ ID NO: 3746086 - RNA, 21 nt, Salmonella enterica enterica serovar Typhi Ty2
ucgccgcgcggaucgccaucg

SEQ ID NO: 3746087 - RNA, 19 nt, Salmonella enterica enterica serovar Typhi Ty2
ucgccgcggcgcuggccuu

SEQ ID NO: 3746088 - RNA, 22 nt, Salmonella enterica enterica serovar Typhi Ty2
ucgccgcguuuaagucccuggc

SEQ ID NO: 3746089 - RNA, 18 nt, Salmonella enterica enterica serovar Typhi Ty2
ucgccgcugccgcuauug

SEQ ID NO: 3746090 - RNA, 20 nt, Salmonella enterica enterica serovar Typhi Ty2
ucgccggaaagaaacgccgc

SEQ ID NO: 3746091 - RNA, 23 nt, Salmonella enterica enterica serovar Typhi Ty2
ucgccggagaauccuuccaguag

SEQ ID NO: 3746092 - RNA, 21 nt, Salmonella enterica enterica serovar Typhi Ty2
ucgccggagccgccuggccug

SEQ ID NO: 3746093 - RNA, 13 nt, Salmonella enterica enterica serovar Typhi Ty2
ucgccggauggcg

SEQ ID NO: 3746094 - RNA, 23 nt, Salmonella enterica enterica serovar Typhi Ty2
ucgccggcagacgauagcgggug

SEQ ID NO: 3746095 - RNA, 18 nt, Salmonella enterica enterica serovar Typhi Ty2
ucgccggggaaaauauua

SEQ ID NO: 3746096 - RNA, 23 nt, Salmonella enterica enterica serovar Typhi Ty2
ucgccgguagcuucagcggcgcg

SEQ ID NO: 3746097 - RNA, 16 nt, Salmonella enterica enterica serovar Typhi Ty2
ucgccgguuuugguau

SEQ ID NO: 3746098 - RNA, 21 nt, Salmonella enterica enterica serovar Typhi Ty2
ucgccguaggcgugggugaag

SEQ ID NO: 3746099 - RNA, 14 nt, Salmonella enterica enterica serovar Typhi Ty2
ucgccguccauuuc

SEQ ID NO: 3746100 - RNA, 18 nt, Salmonella enterica enterica serovar Typhi Ty2
ucgccgucguucagccag

SEQ ID NO: 3746101 - RNA, 17 nt, Salmonella enterica enterica serovar Typhi Ty2
ucgccguguaagagcug

SEQ ID NO: 3746102 - RNA, 14 nt, Salmonella enterica enterica serovar Typhi Ty2
ucgccuaaaugacc

SEQ ID NO: 3746103 - RNA, 16 nt, Salmonella enterica enterica serovar Typhi Ty2
ucgccuauuuucucuu

SEQ ID NO: 3746104 - RNA, 14 nt, Salmonella enterica enterica serovar Typhi Ty2
ucgccuccagcgau

SEQ ID NO: 3746105 - RNA, 14 nt, Salmonella enterica enterica serovar Typhi Ty2
ucgccucccugccu

SEQ ID NO: 3746106 - RNA, 15 nt, Salmonella enterica enterica serovar Typhi Ty2
ucgccugccagcgcu

SEQ ID NO: 3746107 - RNA, 23 nt, Salmonella enterica enterica serovar Typhi Ty2
ucgccugcgcucauauacccugc

SEQ ID NO: 3746108 - RNA, 18 nt, Salmonella enterica enterica serovar Typhi Ty2
ucgccugcgucgccccaa

SEQ ID NO: 3746109 - RNA, 21 nt, Salmonella enterica enterica serovar Typhi Ty2
ucgccuggagcugaucgaccc

SEQ ID NO: 3746110 - RNA, 22 nt, Salmonella enterica enterica serovar Typhi Ty2
ucgccuggauaauggcuaugcc

SEQ ID NO: 3746111 - RNA, 17 nt, Salmonella enterica enterica serovar Typhi Ty2
ucgccuguaccgggcag

SEQ ID NO: 3746112 - RNA, 21 nt, Salmonella enterica enterica serovar Typhi Ty2
ucgccugucugucgcgggcga

SEQ ID NO: 3746113 - RNA, 22 nt, Salmonella enterica enterica serovar Typhi Ty2
ucgccuuaacucuuaaaucaug

SEQ ID NO: 3746114 - RNA, 16 nt, Salmonella enterica enterica serovar Typhi Ty2
ucgccuuacccggccu

SEQ ID NO: 3746115 - RNA, 16 nt, Salmonella enterica enterica serovar Typhi Ty2
ucgccuuauccggccu

SEQ ID NO: 3746116 - RNA, 14 nt, Salmonella enterica enterica serovar Typhi Ty2
ucgccuucauccgc

SEQ ID NO: 3746117 - RNA, 15 nt, Salmonella enterica enterica serovar Typhi Ty2
ucgccuuccagcgac

SEQ ID NO: 3746118 - RNA, 19 nt, Salmonella enterica enterica serovar Typhi Ty2
ucgccuucgcccauaucca

SEQ ID NO: 3746119 - RNA, 17 nt, Salmonella enterica enterica serovar Typhi Ty2
ucgccuucuucaucuuc

SEQ ID NO: 3746120 - RNA, 15 nt, Salmonella enterica enterica serovar Typhi Ty2
ucgcgaauaauuauu

SEQ ID NO: 3746121 - RNA, 17 nt, Salmonella enterica enterica serovar Typhi Ty2
ucgcgaaucgcuucacg

SEQ ID NO: 3746122 - RNA, 20 nt, Salmonella enterica enterica serovar Typhi Ty2
ucgcgaaucgcuucacggcg

SEQ ID NO: 3746123 - RNA, 13 nt, Salmonella enterica enterica serovar Typhi Ty2
ucgcgaauuucaa

SEQ ID NO: 3746124 - RNA, 13 nt, Salmonella enterica enterica serovar Typhi Ty2
ucgcgacagcgcu

SEQ ID NO: 3746125 - RNA, 21 nt, Salmonella enterica enterica serovar Typhi Ty2
ucggguacggaauaucccgca

SEQ ID NO: 3746126 - RNA, 17 nt, Salmonella enterica enterica serovar Typhi Ty2
ucgggucgaauuccagu

SEQ ID NO: 3746127 - RNA, 17 nt, Salmonella enterica enterica serovar Typhi Ty2
ucggguucggcggugcc

SEQ ID NO: 3746128 - RNA, 16 nt, Salmonella enterica enterica serovar Typhi Ty2
ucggguuuuccugaau

SEQ ID NO: 3746129 - RNA, 21 nt, Salmonella enterica enterica serovar Typhi Ty2
  misc_feature (5)..(5): n is a, c, g or u
ucggnuaagcgcuagcgccac

SEQ ID NO: 3746130 - RNA, 14 nt, Salmonella enterica enterica serovar Typhi Ty2
ucgguaaagaaacc

SEQ ID NO: 3746131 - RNA, 20 nt, Salmonella enterica enterica serovar Typhi Ty2
ucgguaagucugauaacggc

SEQ ID NO: 3746132 - RNA, 23 nt, Salmonella enterica enterica serovar Typhi Ty2
ucgguacuucacaauaagaaauu

SEQ ID NO: 3746133 - RNA, 18 nt, Salmonella enterica enterica serovar Typhi Ty2
ucgguagaaugaauguag

SEQ ID NO: 3746134 - RNA, 22 nt, Salmonella enterica enterica serovar Typhi Ty2
ucgguagcuguaccagaucgcc

SEQ ID NO: 3746135 - RNA, 23 nt, Salmonella enterica enterica serovar Typhi Ty2
ucgguauaaauuuccgcagccag

SEQ ID NO: 3746136 - RNA, 22 nt, Salmonella enterica enterica serovar Typhi Ty2
ucgguauaugaaucaucagaau

SEQ ID NO: 3746137 - RNA, 16 nt, Salmonella enterica enterica serovar Typhi Ty2
ucgguaugccuuccag

SEQ ID NO: 3746138 - RNA, 16 nt, Salmonella enterica enterica serovar Typhi Ty2
ucggucaacauuccgu

SEQ ID NO: 3746139 - RNA, 20 nt, Salmonella enterica enterica serovar Typhi Ty2
ucggucagauaaauaacgcc

SEQ ID NO: 3746140 - RNA, 15 nt, Salmonella enterica enterica serovar Typhi Ty2
ucggucagauucaga

SEQ ID NO: 3746141 - RNA, 14 nt, Salmonella enterica enterica serovar Typhi Ty2
ucggucaggcugcg

SEQ ID NO: 3746142 - RNA, 15 nt, Salmonella enterica enterica serovar Typhi Ty2
ucggucaguuugccc

SEQ ID NO: 3746143 - RNA, 17 nt, Salmonella enterica enterica serovar Typhi Ty2
ucggucgagcuuuugcu

SEQ ID NO: 3746144 - RNA, 15 nt, Salmonella enterica enterica serovar Typhi Ty2
ucggucuuuuucgca

SEQ ID NO: 3746145 - RNA, 17 nt, Salmonella enterica enterica serovar Typhi Ty2
ucggugacggaaaccag

SEQ ID NO: 3746146 - RNA, 23 nt, Salmonella enterica enterica serovar Typhi Ty2
ucggugcgguuacguccggcauu

SEQ ID NO: 3746147 - RNA, 17 nt, Salmonella enterica enterica serovar Typhi Ty2
ucgguggcgguaucaau

SEQ ID NO: 3746148 - RNA, 23 nt, Salmonella enterica enterica serovar Typhi Ty2
ucgguguucacaauuguggucgu

SEQ ID NO: 3746149 - RNA, 21 nt, Salmonella enterica enterica serovar Typhi Ty2
ucgguuauucggucagauaaa

SEQ ID NO: 3746150 - RNA, 12 nt, Salmonella enterica enterica serovar Typhi Ty2
ucgguugaacca

SEQ ID NO: 3746151 - RNA, 21 nt, Salmonella enterica enterica serovar Typhi Ty2
ucgguuuauccccgcuggcgc

SEQ ID NO: 3746152 - RNA, 16 nt, Salmonella enterica enterica serovar Typhi Ty2
ucgguuuguaagugcc

SEQ ID NO: 3746153 - RNA, 17 nt, Salmonella enterica enterica serovar Typhi Ty2
ucguaaaucaaaugaga

SEQ ID NO: 3746154 - RNA, 21 nt, Salmonella enterica enterica serovar Typhi Ty2
ucguaagaauuauuaccaaug

SEQ ID NO: 3746155 - RNA, 22 nt, Salmonella enterica enterica serovar Typhi Ty2
ucguaagccgcauuacaaacag

SEQ ID NO: 3746156 - RNA, 16 nt, Salmonella enterica enterica serovar Typhi Ty2
ucguaauggccuacac

SEQ ID NO: 3746157 - RNA, 12 nt, Salmonella enterica enterica serovar Typhi Ty2
ucguaauucagc

SEQ ID NO: 3746158 - RNA, 21 nt, Salmonella enterica enterica serovar Typhi Ty2
ucguacacgcgcccgccgcca

SEQ ID NO: 3746159 - RNA, 16 nt, Salmonella enterica enterica serovar Typhi Ty2
ucguacauguccagau

SEQ ID NO: 3746160 - RNA, 22 nt, Salmonella enterica enterica serovar Typhi Ty2
ucguacauguccagaucuucac

SEQ ID NO: 3746161 - RNA, 18 nt, Salmonella enterica enterica serovar Typhi Ty2
ucguacgccuaaaugaac

SEQ ID NO: 3746162 - RNA, 14 nt, Salmonella enterica enterica serovar Typhi Ty2
ucguagaacaccac

SEQ ID NO: 3746163 - RNA, 15 nt, Salmonella enterica enterica serovar Typhi Ty2
ucguagacucaggcg

SEQ ID NO: 3746164 - RNA, 16 nt, Salmonella enterica enterica serovar Typhi Ty2
ucguagccaccaucuu

SEQ ID NO: 3746165 - RNA, 18 nt, Salmonella enterica enterica serovar Typhi Ty2
ucguagccaccaucuuuu

SEQ ID NO: 3746166 - RNA, 15 nt, Salmonella enterica enterica serovar Typhi Ty2
ucguauccccagucu

SEQ ID NO: 3746167 - RNA, 20 nt, Salmonella enterica enterica serovar Typhi Ty2
ucguauccccagucuuccug

SEQ ID NO: 3746168 - RNA, 18 nt, Salmonella enterica enterica serovar Typhi Ty2
ucguauccggucaauaca

SEQ ID NO: 3746169 - RNA, 21 nt, Salmonella enterica enterica serovar Typhi Ty2
ucgucaaaaccaaacagcgac

SEQ ID NO: 3746170 - RNA, 21 nt, Salmonella enterica enterica serovar Typhi Ty2
ucgucaaacaguucagacacc

SEQ ID NO: 3746171 - RNA, 22 nt, Salmonella enterica enterica serovar Typhi Ty2
ucgucacaauaugguuauccag

SEQ ID NO: 3746172 - RNA, 21 nt, Salmonella enterica enterica serovar Typhi Ty2
ucgucacgacggcgaccggca

SEQ ID NO: 3746173 - RNA, 21 nt, Salmonella enterica enterica serovar Typhi Ty2
ucgucagacggacaucagagg

SEQ ID NO: 3746174 - RNA, 21 nt, Salmonella enterica enterica serovar Typhi Ty2
ucgucagaugcguuuucugca

SEQ ID NO: 3746175 - RNA, 18 nt, Salmonella enterica enterica serovar Typhi Ty2
ucgucaggcggcugcgca

SEQ ID NO: 3746176 - RNA, 19 nt, Salmonella enterica enterica serovar Typhi Ty2
ucgucauuaacgggaaacu

SEQ ID NO: 3746177 - RNA, 15 nt, Salmonella enterica enterica serovar Typhi Ty2
ucguccaguaaaauc

SEQ ID NO: 3746178 - RNA, 12 nt, Salmonella enterica enterica serovar Typhi Ty2
ucgucccagcgc

SEQ ID NO: 3746179 - RNA, 12 nt, Salmonella enterica enterica serovar Typhi Ty2
ucgucccaggcc

SEQ ID NO: 3746180 - RNA, 12 nt, Salmonella enterica enterica serovar Typhi Ty2
ucguccggugau

SEQ ID NO: 3746181 - RNA, 13 nt, Salmonella enterica enterica serovar Typhi Ty2
ucguccguugcca

SEQ ID NO: 3746182 - RNA, 23 nt, Salmonella enterica enterica serovar Typhi Ty2
ucguccguuucccaagucacgcc

SEQ ID NO: 3746183 - RNA, 18 nt, Salmonella enterica enterica serovar Typhi Ty2
ucgucgcgaucgcgccag

SEQ ID NO: 3746184 - RNA, 14 nt, Salmonella enterica enterica serovar Typhi Ty2
ucgucgcuaagcgu

SEQ ID NO: 3746185 - RNA, 15 nt, Salmonella enterica enterica serovar Typhi Ty2
ucgucgggauaagcg

SEQ ID NO: 3746186 - RNA, 20 nt, Salmonella enterica enterica serovar Typhi Ty2
ucgucugguaucugucaugc

SEQ ID NO: 3746187 - RNA, 22 nt, Salmonella enterica enterica serovar Typhi Ty2
ucgucuguuauuugugauuuuc

SEQ ID NO: 3746188 - RNA, 14 nt, Salmonella enterica enterica serovar Typhi Ty2
ucgucuuauuucgu

SEQ ID NO: 3746189 - RNA, 20 nt, Salmonella enterica enterica serovar Typhi Ty2
ucgucuuccggauaacgcgc

SEQ ID NO: 3746190 - RNA, 13 nt, Salmonella enterica enterica serovar Typhi Ty2
ucgucuucggcga

SEQ ID NO: 3746191 - RNA, 23 nt, Salmonella enterica enterica serovar Typhi Ty2
ucgugacaucaagcccacacauc

SEQ ID NO: 3746192 - RNA, 12 nt, Salmonella enterica enterica serovar Typhi Ty2
ucgugacccgcc

SEQ ID NO: 3746193 - RNA, 17 nt, Salmonella enterica enterica serovar Typhi Ty2
ucgugacccgccagcau

SEQ ID NO: 3746194 - RNA, 17 nt, Salmonella enterica enterica serovar Typhi Ty2
ucgugaggauaauccau

SEQ ID NO: 3746195 - RNA, 12 nt, Salmonella enterica enterica serovar Typhi Ty2
ucgugauaaacg

SEQ ID NO: 3746196 - RNA, 17 nt, Salmonella enterica enterica serovar Typhi Ty2
ucgugauaaagcugacg

SEQ ID NO: 3746197 - RNA, 14 nt, Salmonella enterica enterica serovar Typhi Ty2
ucgugauagacggc

SEQ ID NO: 3746198 - RNA, 18 nt, Salmonella enterica enterica serovar Typhi Ty2
ucgugcaaccgccugcac

SEQ ID NO: 3746199 - RNA, 15 nt, Salmonella enterica enterica serovar Typhi Ty2
ucgugcagcgccgcc

SEQ ID NO: 3746200 - RNA, 23 nt, Salmonella enterica enterica serovar Typhi Ty2
ucgugcauccggacgccagugcg

SEQ ID NO: 3746201 - RNA, 19 nt, Salmonella enterica enterica serovar Typhi Ty2
ucgugccagugaugcgcgg

SEQ ID NO: 3746202 - RNA, 14 nt, Salmonella enterica enterica serovar Typhi Ty2
ucgugcgccccagg

SEQ ID NO: 3746203 - RNA, 20 nt, Salmonella enterica enterica serovar Typhi Ty2
ucguggacgagcauaccgua

SEQ ID NO: 3746204 - RNA, 19 nt, Salmonella enterica enterica serovar Typhi Ty2
ucguggcgcuguucuugcu

SEQ ID NO: 3746205 - RNA, 16 nt, Salmonella enterica enterica serovar Typhi Ty2
ucguggguucgaaucc

SEQ ID NO: 3746206 - RNA, 20 nt, Salmonella enterica enterica serovar Typhi Ty2
ucguguggcggaaugaccug

SEQ ID NO: 3746207 - RNA, 13 nt, Salmonella enterica enterica serovar Typhi Ty2
ucucaucagacug

SEQ ID NO: 3746208 - RNA, 16 nt, Salmonella enterica enterica serovar Typhi Ty2
ucucauccgccaaaac

SEQ ID NO: 3746209 - RNA, 15 nt, Salmonella enterica enterica serovar Typhi Ty2
ucucaucgacgauaa

SEQ ID NO: 3746210 - RNA, 22 nt, Salmonella enterica enterica serovar Typhi Ty2
ucucaucugcaaaauauauaau

SEQ ID NO: 3746211 - RNA, 16 nt, Salmonella enterica enterica serovar Typhi Ty2
ucucaugcaacuggca

SEQ ID NO: 3746212 - RNA, 17 nt, Salmonella enterica enterica serovar Typhi Ty2
ucucauuauuaaauuaa

SEQ ID NO: 3746213 - RNA, 18 nt, Salmonella enterica enterica serovar Typhi Ty2
ucucauuguguacaucca

SEQ ID NO: 3746214 - RNA, 19 nt, Salmonella enterica enterica serovar Typhi Ty2
ucucauuuucuuuacgcua

SEQ ID NO: 3746215 - RNA, 14 nt, Salmonella enterica enterica serovar Typhi Ty2
ucuccaguaucagc

SEQ ID NO: 3746216 - RNA, 14 nt, Salmonella enterica enterica serovar Typhi Ty2
ucuccaguuugcgu

SEQ ID NO: 3746217 - RNA, 20 nt, Salmonella enterica enterica serovar Typhi Ty2
ucuccaucgggcucggcgcu

SEQ ID NO: 3746218 - RNA, 22 nt, Salmonella enterica enterica serovar Typhi Ty2
ucuccaugucacuggcggcggu

SEQ ID NO: 3746219 - RNA, 17 nt, Salmonella enterica enterica serovar Typhi Ty2
ucucccaaaugaaaaau

SEQ ID NO: 3746220 - RNA, 20 nt, Salmonella enterica enterica serovar Typhi Ty2
ucucccagccgggcaggaaa

SEQ ID NO: 3746221 - RNA, 12 nt, Salmonella enterica enterica serovar Typhi Ty2
ucucccagcuga

SEQ ID NO: 3746222 - RNA, 15 nt, Salmonella enterica enterica serovar Typhi Ty2
ucucccagcugagcu

SEQ ID NO: 3746223 - RNA, 14 nt, Salmonella enterica enterica serovar Typhi Ty2
ucucccaucaauaa

SEQ ID NO: 3746224 - RNA, 22 nt, Salmonella enterica enterica serovar Typhi Ty2
ucuccccaucugaacucuucca

SEQ ID NO: 3746225 - RNA, 13 nt, Salmonella enterica enterica serovar Typhi Ty2
ucucccgggccgc

SEQ ID NO: 3746226 - RNA, 19 nt, Salmonella enterica enterica serovar Typhi Ty2
ucucccguuuguauaaauu

SEQ ID NO: 3746227 - RNA, 22 nt, Salmonella enterica enterica serovar Typhi Ty2
ucucccuacugcuuagcucauc

SEQ ID NO: 3746228 - RNA, 19 nt, Salmonella enterica enterica serovar Typhi Ty2
ucucccucuaauucccagu

SEQ ID NO: 3746229 - RNA, 16 nt, Salmonella enterica enterica serovar Typhi Ty2
ucucccugccagugaa

SEQ ID NO: 3746230 - RNA, 14 nt, Salmonella enterica enterica serovar Typhi Ty2
ucuccggcaucuca

SEQ ID NO: 3746231 - RNA, 20 nt, Salmonella enterica enterica serovar Typhi Ty2
ucuccgggauagcaaucucg

SEQ ID NO: 3746232 - RNA, 20 nt, Salmonella enterica enterica serovar Typhi Ty2
ucuccgucucucauuuucuu

SEQ ID NO: 3746233 - RNA, 15 nt, Salmonella enterica enterica serovar Typhi Ty2
ucuccguuguugcac

SEQ ID NO: 3746234 - RNA, 22 nt, Salmonella enterica enterica serovar Typhi Ty2
ucuccucacgcccugaagggcg

SEQ ID NO: 3746235 - RNA, 17 nt, Salmonella enterica enterica serovar Typhi Ty2
ucuccucgccagcuacc

SEQ ID NO: 3746236 - RNA, 17 nt, Salmonella enterica enterica serovar Typhi Ty2
ucuccugaacgcccggc

SEQ ID NO: 3746237 - RNA, 18 nt, Salmonella enterica enterica serovar Typhi Ty2
ucuccugaagccagugcc

SEQ ID NO: 3746238 - RNA, 14 nt, Salmonella enterica enterica serovar Typhi Ty2
ucuccugccagcga

SEQ ID NO: 3746239 - RNA, 15 nt, Salmonella enterica enterica serovar Typhi Ty2
ucuccugcgccagcc

SEQ ID NO: 3746240 - RNA, 19 nt, Salmonella enterica enterica serovar Typhi Ty2
ucuccuggcgcagcgcggg

SEQ ID NO: 3746241 - RNA, 18 nt, Salmonella enterica enterica serovar Typhi Ty2
ucuccuugagugguuuau

SEQ ID NO: 3746242 - RNA, 15 nt, Salmonella enterica enterica serovar Typhi Ty2
ucuccuuucggccac

SEQ ID NO: 3746243 - RNA, 15 nt, Salmonella enterica enterica serovar Typhi Ty2
ucucgaaacaauagc

SEQ ID NO: 3746244 - RNA, 13 nt, Salmonella enterica enterica serovar Typhi Ty2
ucucgcacaucau

SEQ ID NO: 3746245 - RNA, 12 nt, Salmonella enterica enterica serovar Typhi Ty2
ucucgcaggcca

SEQ ID NO: 3746246 - RNA, 22 nt, Salmonella enterica enterica serovar Typhi Ty2
ucucgccauaauuguucagcua

SEQ ID NO: 3746247 - RNA, 21 nt, Salmonella enterica enterica serovar Typhi Ty2
ucucgcuauauacccccugca

SEQ ID NO: 3746248 - RNA, 14 nt, Salmonella enterica enterica serovar Typhi Ty2
ucucgcucuuccag

SEQ ID NO: 3746249 - RNA, 21 nt, Salmonella enterica enterica serovar Typhi Ty2
ucucggccuggcccggcaguu

SEQ ID NO: 3746250 - RNA, 14 nt, Salmonella enterica enterica serovar Typhi Ty2
ucucgucgccaggg

SEQ ID NO: 3746251 - RNA, 21 nt, Salmonella enterica enterica serovar Typhi Ty2
ucucguuuuugucuccucaug

SEQ ID NO: 3746252 - RNA, 14 nt, Salmonella enterica enterica serovar Typhi Ty2
ucucuacgccggcg

SEQ ID NO: 3746253 - RNA, 13 nt, Salmonella enterica enterica serovar Typhi Ty2
ucucuauuaaccg

SEQ ID NO: 3746254 - RNA, 14 nt, Salmonella enterica enterica serovar Typhi Ty2
ucucucauccgcca

SEQ ID NO: 3746255 - RNA, 20 nt, Salmonella enterica enterica serovar Typhi Ty2
ucucucucguucccgccugc

SEQ ID NO: 3746256 - RNA, 15 nt, Salmonella enterica enterica serovar Typhi Ty2
ucucugagaucaaac

SEQ ID NO: 3746257 - RNA, 15 nt, Salmonella enterica enterica serovar Typhi Ty2
ucucugccaucaucc

SEQ ID NO: 3746258 - RNA, 20 nt, Salmonella enterica enterica serovar Typhi Ty2
ucucuggcgcgggcuucacg

SEQ ID NO: 3746259 - RNA, 18 nt, Salmonella enterica enterica serovar Typhi Ty2
ucucugguuucccugccu

SEQ ID NO: 3746260 - RNA, 17 nt, Salmonella enterica enterica serovar Typhi Ty2
ucucuuaaugccagcgg

SEQ ID NO: 3746261 - RNA, 19 nt, Salmonella enterica enterica serovar Typhi Ty2
ucucuuaugccgcuuuugc

SEQ ID NO: 3746262 - RNA, 14 nt, Salmonella enterica enterica serovar Typhi Ty2
ucucuucccagcgc

SEQ ID NO: 3746263 - RNA, 21 nt, Salmonella enterica enterica serovar Typhi Ty2
ucucuucguguaacgcauaca

SEQ ID NO: 3746264 - RNA, 13 nt, Salmonella enterica enterica serovar Typhi Ty2
ucucuucuaucug

SEQ ID NO: 3746265 - RNA, 20 nt, Salmonella enterica enterica serovar Typhi Ty2
ucucuugcagacagcgccug

SEQ ID NO: 3746266 - RNA, 14 nt, Salmonella enterica enterica serovar Typhi Ty2
ucucuugccagcgc

SEQ ID NO: 3746267 - RNA, 21 nt, Salmonella enterica enterica serovar Typhi Ty2
ucucuugccagcgcauccacc

SEQ ID NO: 3746268 - RNA, 12 nt, Salmonella enterica enterica serovar Typhi Ty2
ucucuugccugc

SEQ ID NO: 3746269 - RNA, 13 nt, Salmonella enterica enterica serovar Typhi Ty2
ucucuuuauugaa

SEQ ID NO: 3746270 - RNA, 13 nt, Salmonella enterica enterica serovar Typhi Ty2
ucucuuucagaau

SEQ ID NO: 3746271 - RNA, 17 nt, Salmonella enterica enterica serovar Typhi Ty2
ucucuuucugccuacag

SEQ ID NO: 3746272 - RNA, 13 nt, Salmonella enterica enterica serovar Typhi Ty2
ucucuuuuaauuu

SEQ ID NO: 3746273 - RNA, 14 nt, Salmonella enterica enterica serovar Typhi Ty2
ucucuuuugcuuca

SEQ ID NO: 3746274 - RNA, 14 nt, Salmonella enterica enterica serovar Typhi Ty2
ucucuuuuuuaggc

SEQ ID NO: 3746275 - RNA, 14 nt, Salmonella enterica enterica serovar Typhi Ty2
ucugaaaagaguag

SEQ ID NO: 3746276 - RNA, 19 nt, Salmonella enterica enterica serovar Typhi Ty2
ucugaaaaggggauaacaa

SEQ ID NO: 3746277 - RNA, 13 nt, Salmonella enterica enterica serovar Typhi Ty2
ucugaaacgcuuc

SEQ ID NO: 3746278 - RNA, 22 nt, Salmonella enterica enterica serovar Typhi Ty2
ucugaaaguaagcuauuccugu

SEQ ID NO: 3746279 - RNA, 12 nt, Salmonella enterica enterica serovar Typhi Ty2
ucugaaaguuug

SEQ ID NO: 3746280 - RNA, 22 nt, Salmonella enterica enterica serovar Typhi Ty2
ucugaaucagugcaucuucacu

SEQ ID NO: 3746281 - RNA, 15 nt, Salmonella enterica enterica serovar Typhi Ty2
ucugaaucuugcgca

SEQ ID NO: 3746282 - RNA, 13 nt, Salmonella enterica enterica serovar Typhi Ty2
ucugaaugguucc

SEQ ID NO: 3746283 - RNA, 13 nt, Salmonella enterica enterica serovar Typhi Ty2
ucugacagccaaa

SEQ ID NO: 3746284 - RNA, 17 nt, Salmonella enterica enterica serovar Typhi Ty2
ucugacaggucggcguu

SEQ ID NO: 3746285 - RNA, 13 nt, Salmonella enterica enterica serovar Typhi Ty2
ucugacccgcgaa

SEQ ID NO: 3746286 - RNA, 23 nt, Salmonella enterica enterica serovar Typhi Ty2
ucugagaauuuggguuuauguag

SEQ ID NO: 3746287 - RNA, 14 nt, Salmonella enterica enterica serovar Typhi Ty2
ucugagaucaaaca

SEQ ID NO: 3746288 - RNA, 24 nt, Salmonella enterica enterica serovar Typhi Ty2
ucugagccgcccggcgcgcuggag

SEQ ID NO: 3746289 - RNA, 15 nt, Salmonella enterica enterica serovar Typhi Ty2
ucugaguauguuagg

SEQ ID NO: 3746290 - RNA, 18 nt, Salmonella enterica enterica serovar Typhi Ty2
ucugugaaaguuucagga

SEQ ID NO: 3746291 - RNA, 13 nt, Salmonella enterica enterica serovar Typhi Ty2
ucugugaugaugc

SEQ ID NO: 3746292 - RNA, 15 nt, Salmonella enterica enterica serovar Typhi Ty2
ucugugauuauccca

SEQ ID NO: 3746293 - RNA, 22 nt, Salmonella enterica enterica serovar Typhi Ty2
ucuguuaaaaaauuuauaacgu

SEQ ID NO: 3746294 - RNA, 12 nt, Salmonella enterica enterica serovar Typhi Ty2
ucuguuaucugg

SEQ ID NO: 3746295 - RNA, 15 nt, Salmonella enterica enterica serovar Typhi Ty2
ucuguucaacuuuuc

SEQ ID NO: 3746296 - RNA, 18 nt, Salmonella enterica enterica serovar Typhi Ty2
ucuguucuacuacagaaa

SEQ ID NO: 3746297 - RNA, 21 nt, Salmonella enterica enterica serovar Typhi Ty2
ucuguuucauggagauccagu

SEQ ID NO: 3746298 - RNA, 17 nt, Salmonella enterica enterica serovar Typhi Ty2
ucuguuuuagcaugaca

SEQ ID NO: 3746299 - RNA, 23 nt, Salmonella enterica enterica serovar Typhi Ty2
ucuguuuuuggaaacuaugcaaa

SEQ ID NO: 3746300 - RNA, 15 nt, Salmonella enterica enterica serovar Typhi Ty2
ucuuaaaauagccau

SEQ ID NO: 3746301 - RNA, 16 nt, Salmonella enterica enterica serovar Typhi Ty2
ucuuaaugccagcggc

SEQ ID NO: 3746302 - RNA, 15 nt, Salmonella enterica enterica serovar Typhi Ty2
ucuuaauuauaaagc

SEQ ID NO: 3746303 - RNA, 17 nt, Salmonella enterica enterica serovar Typhi Ty2
ucuuacacuuagcacaa

SEQ ID NO: 3746304 - RNA, 12 nt, Salmonella enterica enterica serovar Typhi Ty2
ucuuacauaaga

SEQ ID NO: 3746305 - RNA, 18 nt, Salmonella enterica enterica serovar Typhi Ty2
ucuuaccgcuaaaauacc

SEQ ID NO: 3746306 - RNA, 23 nt, Salmonella enterica enterica serovar Typhi Ty2
ucuuaccgcuaaaauacccgacc

SEQ ID NO: 3746307 - RNA, 21 nt, Salmonella enterica enterica serovar Typhi Ty2
ucuuaccggugcgauucagcg

SEQ ID NO: 3746308 - RNA, 14 nt, Salmonella enterica enterica serovar Typhi Ty2
ucuuaccucuccug

SEQ ID NO: 3746309 - RNA, 16 nt, Salmonella enterica enterica serovar Typhi Ty2
ucuuacgagaggcuuu

SEQ ID NO: 3746310 - RNA, 19 nt, Salmonella enterica enterica serovar Typhi Ty2
ucuuacuaauaaauauuca

SEQ ID NO: 3746311 - RNA, 23 nt, Salmonella enterica enterica serovar Typhi Ty2
ucuuacuaauaaauauucaucaa

SEQ ID NO: 3746312 - RNA, 15 nt, Salmonella enterica enterica serovar Typhi Ty2
ucuuaguaucccuuu

SEQ ID NO: 3746313 - RNA, 22 nt, Salmonella enterica enterica serovar Typhi Ty2
ucuuaucaggccuacacucugc

SEQ ID NO: 3746314 - RNA, 17 nt, Salmonella enterica enterica serovar Typhi Ty2
ucuuauccggccuaccu

SEQ ID NO: 3746315 - RNA, 18 nt, Salmonella enterica enterica serovar Typhi Ty2
ucuuauccggccugcaug

SEQ ID NO: 3746316 - RNA, 16 nt, Salmonella enterica enterica serovar Typhi Ty2
ucuuaucgugcgcgua

SEQ ID NO: 3746317 - RNA, 14 nt, Salmonella enterica enterica serovar Typhi Ty2
ucuuauuacaagaa

SEQ ID NO: 3746318 - RNA, 11 nt, Salmonella enterica enterica serovar Typhi Ty2
ucuuauuuucc

SEQ ID NO: 3746319 - RNA, 12 nt, Salmonella enterica enterica serovar Typhi Ty2
ucuuauuuuccg

SEQ ID NO: 3746320 - RNA, 12 nt, Salmonella enterica enterica serovar Typhi Ty2
ucuucaaagcca

SEQ ID NO: 3746321 - RNA, 13 nt, Salmonella enterica enterica serovar Typhi Ty2
ucuucaacgugca

SEQ ID NO: 3746322 - RNA, 14 nt, Salmonella enterica enterica serovar Typhi Ty2
ucuucaacgugcau

SEQ ID NO: 3746323 - RNA, 22 nt, Salmonella enterica enterica serovar Typhi Ty2
ucuucaccuuuccagucaacga

SEQ ID NO: 3746324 - RNA, 15 nt, Salmonella enterica enterica serovar Typhi Ty2
ucuucacuaaaaaca

SEQ ID NO: 3746325 - RNA, 18 nt, Salmonella enterica enterica serovar Typhi Ty2
ucuucacuaaaaacaggc

SEQ ID NO: 3746326 - RNA, 15 nt, Salmonella enterica enterica serovar Typhi Ty2
ucuucaggcguauau

SEQ ID NO: 3746327 - RNA, 14 nt, Salmonella enterica enterica serovar Typhi Ty2
ucuucaguaaccag

SEQ ID NO: 3746328 - RNA, 22 nt, Salmonella enterica enterica serovar Typhi Ty2
ucuucaguaauuucgaugauga

SEQ ID NO: 3746329 - RNA, 20 nt, Salmonella enterica enterica serovar Typhi Ty2
ucuucaguuccgccagacuc

SEQ ID NO: 3746330 - RNA, 21 nt, Salmonella enterica enterica serovar Typhi Ty2
ucuucauaaauagccagcauc

SEQ ID NO: 3746331 - RNA, 11 nt, Salmonella enterica enterica serovar Typhi Ty2
ucuucaucaaa

SEQ ID NO: 3746332 - RNA, 18 nt, Salmonella enterica enterica serovar Typhi Ty2
ucuucaucaaccaugauc

SEQ ID NO: 3746333 - RNA, 18 nt, Salmonella enterica enterica serovar Typhi Ty2
ucuucaucagccagcauc

SEQ ID NO: 3746334 - RNA, 15 nt, Salmonella enterica enterica serovar Typhi Ty2
ucuucaucguuucug

SEQ ID NO: 3746335 - RNA, 22 nt, Salmonella enterica enterica serovar Typhi Ty2
ucuucaugguaaaauccuuuuu

SEQ ID NO: 3746336 - RNA, 11 nt, Salmonella enterica enterica serovar Typhi Ty2
ucuucaugguc

SEQ ID NO: 3746337 - RNA, 23 nt, Salmonella enterica enterica serovar Typhi Ty2
ucuucauggucggacgggcccug

SEQ ID NO: 3746338 - RNA, 18 nt, Salmonella enterica enterica serovar Typhi Ty2
ucuuccacgccgucgaug

SEQ ID NO: 3746339 - RNA, 17 nt, Salmonella enterica enterica serovar Typhi Ty2
ucuuccacuucagcagc

SEQ ID NO: 3746340 - RNA, 23 nt, Salmonella enterica enterica serovar Typhi Ty2
ucuuccagcacgauauccagcac

SEQ ID NO: 3746341 - RNA, 12 nt, Salmonella enterica enterica serovar Typhi Ty2
ucuuccagcauc

SEQ ID NO: 3746342 - RNA, 14 nt, Salmonella enterica enterica serovar Typhi Ty2
ucuuccagcaucag

SEQ ID NO: 3746343 - RNA, 14 nt, Salmonella enterica enterica serovar Typhi Ty2
ucuuccagcggcag

SEQ ID NO: 3746344 - RNA, 17 nt, Salmonella enterica enterica serovar Typhi Ty2
ucuuccagcggcagacc

SEQ ID NO: 3746345 - RNA, 19 nt, Salmonella enterica enterica serovar Typhi Ty2
ucuuccagcgucuccagac

SEQ ID NO: 3746346 - RNA, 14 nt, Salmonella enterica enterica serovar Typhi Ty2
ucuuccagcugcuc

SEQ ID NO: 3746347 - RNA, 23 nt, Salmonella enterica enterica serovar Typhi Ty2
ucuuccaguuguaacgccuggcg

SEQ ID NO: 3746348 - RNA, 14 nt, Salmonella enterica enterica serovar Typhi Ty2
ucuuccaucagcca

SEQ ID NO: 3746349 - RNA, 15 nt, Salmonella enterica enterica serovar Typhi Ty2
ucuuccaucagccag

SEQ ID NO: 3746350 - RNA, 17 nt, Salmonella enterica enterica serovar Typhi Ty2
ucuuccccgaucagaaa

SEQ ID NO: 3746351 - RNA, 14 nt, Salmonella enterica enterica serovar Typhi Ty2
ucuucccgcagaua

SEQ ID NO: 3746352 - RNA, 15 nt, Salmonella enterica enterica serovar Typhi Ty2
ucuucccgcagauau

SEQ ID NO: 3746353 - RNA, 23 nt, Salmonella enterica enterica serovar Typhi Ty2
ucuuccgccauacccggcuccca

SEQ ID NO: 3746354 - RNA, 18 nt, Salmonella enterica enterica serovar Typhi Ty2
ucuuccgccugauaaaac

SEQ ID NO: 3746355 - RNA, 16 nt, Salmonella enterica enterica serovar Typhi Ty2
ucuuccgggucaguuu

SEQ ID NO: 3746356 - RNA, 21 nt, Salmonella enterica enterica serovar Typhi Ty2
ucuuccggugugaccagcgcg

SEQ ID NO: 3746357 - RNA, 18 nt, Salmonella enterica enterica serovar Typhi Ty2
ucuuccgucagcgaaucg

SEQ ID NO: 3746358 - RNA, 15 nt, Salmonella enterica enterica serovar Typhi Ty2
ucuuccucugugccg

SEQ ID NO: 3746359 - RNA, 14 nt, Salmonella enterica enterica serovar Typhi Ty2
ucuuccugcgguaa

SEQ ID NO: 3746360 - RNA, 17 nt, Salmonella enterica enterica serovar Typhi Ty2
ucuuccugcugcgccag

SEQ ID NO: 3746361 - RNA, 14 nt, Salmonella enterica enterica serovar Typhi Ty2
ucuucgauaaaggg

SEQ ID NO: 3746362 - RNA, 15 nt, Salmonella enterica enterica serovar Typhi Ty2
ucuucgcaaccggua

SEQ ID NO: 3746363 - RNA, 15 nt, Salmonella enterica enterica serovar Typhi Ty2
ucuucgcaaucuccg

SEQ ID NO: 3746364 - RNA, 22 nt, Salmonella enterica enterica serovar Typhi Ty2
ucuucgccgaagugugccagca

SEQ ID NO: 3746365 - RNA, 15 nt, Salmonella enterica enterica serovar Typhi Ty2
ucuucgccgucauaa

SEQ ID NO: 3746366 - RNA, 18 nt, Salmonella enterica enterica serovar Typhi Ty2
ucuucgccgucauaaaac

SEQ ID NO: 3746367 - RNA, 22 nt, Salmonella enterica enterica serovar Typhi Ty2
ucuucgcuggcggaaagaagca

SEQ ID NO: 3746368 - RNA, 16 nt, Salmonella enterica enterica serovar Typhi Ty2
ucuucggcaaaauauu

SEQ ID NO: 3746369 - RNA, 18 nt, Salmonella enterica enterica serovar Typhi Ty2
ucuucggcaaaauauuca

SEQ ID NO: 3746370 - RNA, 22 nt, Salmonella enterica enterica serovar Typhi Ty2
ucuucggcgggaucuccagaag

SEQ ID NO: 3746371 - RNA, 20 nt, Salmonella enterica enterica serovar Typhi Ty2
ucuucgggaucaauuuugcu

SEQ ID NO: 3746372 - RNA, 20 nt, Salmonella enterica enterica serovar Typhi Ty2
ugaaacccauaauaaugacu

SEQ ID NO: 3746373 - RNA, 19 nt, Salmonella enterica enterica serovar Typhi Ty2
ugaaacccgccaccgccag

SEQ ID NO: 3746374 - RNA, 23 nt, Salmonella enterica enterica serovar Typhi Ty2
ugaaaccggcgcgccuuccagca

SEQ ID NO: 3746375 - RNA, 18 nt, Salmonella enterica enterica serovar Typhi Ty2
ugaaacgaaaacugggca

SEQ ID NO: 3746376 - RNA, 11 nt, Salmonella enterica enterica serovar Typhi Ty2
ugaaacgccga

SEQ ID NO: 3746377 - RNA, 18 nt, Salmonella enterica enterica serovar Typhi Ty2
ugaaacgccguuuguuua

SEQ ID NO: 3746378 - RNA, 21 nt, Salmonella enterica enterica serovar Typhi Ty2
ugaaacguguuuauccccgcu

SEQ ID NO: 3746379 - RNA, 18 nt, Salmonella enterica enterica serovar Typhi Ty2
ugaaacucgacacacuca

SEQ ID NO: 3746380 - RNA, 12 nt, Salmonella enterica enterica serovar Typhi Ty2
ugaaacucgcca

SEQ ID NO: 3746381 - RNA, 20 nt, Salmonella enterica enterica serovar Typhi Ty2
ugaaagauuauuuuaucauc

SEQ ID NO: 3746382 - RNA, 23 nt, Salmonella enterica enterica serovar Typhi Ty2
ugaaagauuauuuuaucaucagc

SEQ ID NO: 3746383 - RNA, 14 nt, Salmonella enterica enterica serovar Typhi Ty2
ugaaagccaucgcu

SEQ ID NO: 3746384 - RNA, 14 nt, Salmonella enterica enterica serovar Typhi Ty2
ugaaaggccuaaac

SEQ ID NO: 3746385 - RNA, 21 nt, Salmonella enterica enterica serovar Typhi Ty2
ugaaagucuucccgcaaacug

SEQ ID NO: 3746386 - RNA, 16 nt, Salmonella enterica enterica serovar Typhi Ty2
ugaaaguuucaggaua

SEQ ID NO: 3746387 - RNA, 22 nt, Salmonella enterica enterica serovar Typhi Ty2
ugaaaguuugaaguguuccuga

SEQ ID NO: 3746388 - RNA, 20 nt, Salmonella enterica enterica serovar Typhi Ty2
ugaaauaauuguguaaucuu

SEQ ID NO: 3746389 - RNA, 22 nt, Salmonella enterica enterica serovar Typhi Ty2
ugaaauaccaggcggcuuuuuc

SEQ ID NO: 3746390 - RNA, 18 nt, Salmonella enterica enterica serovar Typhi Ty2
ugaaauauuugaucacau

SEQ ID NO: 3746391 - RNA, 19 nt, Salmonella enterica enterica serovar Typhi Ty2
ugaaauccucuauuuuuua

SEQ ID NO: 3746392 - RNA, 22 nt, Salmonella enterica enterica serovar Typhi Ty2
ugaaaucgucagacggcuccag

SEQ ID NO: 3746393 - RNA, 18 nt, Salmonella enterica enterica serovar Typhi Ty2
ugaaaugacacccucuuu

SEQ ID NO: 3746394 - RNA, 17 nt, Salmonella enterica enterica serovar Typhi Ty2
ugaaauggccccaaauc

SEQ ID NO: 3746395 - RNA, 18 nt, Salmonella enterica enterica serovar Typhi Ty2
ugaaauuaaucaggcauc

SEQ ID NO: 3746396 - RNA, 19 nt, Salmonella enterica enterica serovar Typhi Ty2
ugaaauuacgccauaaaaa

SEQ ID NO: 3746397 - RNA, 16 nt, Salmonella enterica enterica serovar Typhi Ty2
ugaaauucgacgggac

SEQ ID NO: 3746398 - RNA, 19 nt, Salmonella enterica enterica serovar Typhi Ty2
ugaaauucuaugccaggcg

SEQ ID NO: 3746399 - RNA, 16 nt, Salmonella enterica enterica serovar Typhi Ty2
ugaaauuucuuuucca

SEQ ID NO: 3746400 - RNA, 17 nt, Salmonella enterica enterica serovar Typhi Ty2
ugaaauuucuuuuccag

SEQ ID NO: 3746401 - RNA, 21 nt, Salmonella enterica enterica serovar Typhi Ty2
ugaacaccacugaaaaauaau

SEQ ID NO: 3746402 - RNA, 14 nt, Salmonella enterica enterica serovar Typhi Ty2
ugaacacccugccc

SEQ ID NO: 3746403 - RNA, 22 nt, Salmonella enterica enterica serovar Typhi Ty2
ugaacagcgucauccaguguua

SEQ ID NO: 3746404 - RNA, 14 nt, Salmonella enterica enterica serovar Typhi Ty2
ugaacaucuuccag

SEQ ID NO: 3746405 - RNA, 15 nt, Salmonella enterica enterica serovar Typhi Ty2
ugaacaugcgcagaa

SEQ ID NO: 3746406 - RNA, 21 nt, Salmonella enterica enterica serovar Typhi Ty2
ugaacauggguuucuugccgg

SEQ ID NO: 3746407 - RNA, 15 nt, Salmonella enterica enterica serovar Typhi Ty2
ugaacauugccccuc

SEQ ID NO: 3746408 - RNA, 15 nt, Salmonella enterica enterica serovar Typhi Ty2
ugaacauuuuuucag

SEQ ID NO: 3746409 - RNA, 20 nt, Salmonella enterica enterica serovar Typhi Ty2
ugaaccagcaucccacgaau

SEQ ID NO: 3746410 - RNA, 21 nt, Salmonella enterica enterica serovar Typhi Ty2
ugaaccagcggcaccagcacg

SEQ ID NO: 3746411 - RNA, 22 nt, Salmonella enterica enterica serovar Typhi Ty2
ugaacccguaagcccuauuagg

SEQ ID NO: 3746412 - RNA, 17 nt, Salmonella enterica enterica serovar Typhi Ty2
ugaaccggguaguuuug

SEQ ID NO: 3746413 - RNA, 14 nt, Salmonella enterica enterica serovar Typhi Ty2
ugaacgaagcauuu

SEQ ID NO: 3746414 - RNA, 18 nt, Salmonella enterica enterica serovar Typhi Ty2
ugaacggcucaaaauaau

SEQ ID NO: 3746415 - RNA, 14 nt, Salmonella enterica enterica serovar Typhi Ty2
ugaacguaguuagu

SEQ ID NO: 3746416 - RNA, 24 nt, Salmonella enterica enterica serovar Typhi Ty2
ugaacuacccuucaaggagaaaau

SEQ ID NO: 3746417 - RNA, 22 nt, Salmonella enterica enterica serovar Typhi Ty2
ugaacuacgccccggcgcgcca

SEQ ID NO: 3746418 - RNA, 20 nt, Salmonella enterica enterica serovar Typhi Ty2
ugaacucuaugcaaaagaaa

SEQ ID NO: 3746419 - RNA, 12 nt, Salmonella enterica enterica serovar Typhi Ty2
ugaagaacagcg

SEQ ID NO: 3746420 - RNA, 12 nt, Salmonella enterica enterica serovar Typhi Ty2
ugaagacaacgu

SEQ ID NO: 3746421 - RNA, 19 nt, Salmonella enterica enterica serovar Typhi Ty2
ugaagaguauuauuuugau

SEQ ID NO: 3746422 - RNA, 17 nt, Salmonella enterica enterica serovar Typhi Ty2
ugaagaguuugaucaug

SEQ ID NO: 3746423 - RNA, 18 nt, Salmonella enterica enterica serovar Typhi Ty2
ugaagauaaacagcagcg

SEQ ID NO: 3746424 - RNA, 15 nt, Salmonella enterica enterica serovar Typhi Ty2
ugaagauguagacca

SEQ ID NO: 3746425 - RNA, 13 nt, Salmonella enterica enterica serovar Typhi Ty2
ugaagcagaagug

SEQ ID NO: 3746426 - RNA, 16 nt, Salmonella enterica enterica serovar Typhi Ty2
ugaagcauaaaaagac

SEQ ID NO: 3746427 - RNA, 19 nt, Salmonella enterica enterica serovar Typhi Ty2
ugaagccaucaaauuugau

SEQ ID NO: 3746428 - RNA, 22 nt, Salmonella enterica enterica serovar Typhi Ty2
ugaagccaucaaauuugauagu

SEQ ID NO: 3746429 - RNA, 11 nt, Salmonella enterica enterica serovar Typhi Ty2
ugaagccccaa

SEQ ID NO: 3746430 - RNA, 22 nt, Salmonella enterica enterica serovar Typhi Ty2
ugaagccuggucaccugucuuu

SEQ ID NO: 3746431 - RNA, 17 nt, Salmonella enterica enterica serovar Typhi Ty2
ugaagccuggugcccaa

SEQ ID NO: 3746432 - RNA, 20 nt, Salmonella enterica enterica serovar Typhi Ty2
ugaagccuuagcgggaggug

SEQ ID NO: 3746433 - RNA, 22 nt, Salmonella enterica enterica serovar Typhi Ty2
ugaagcgauuuauccaccgcca

SEQ ID NO: 3746434 - RNA, 17 nt, Salmonella enterica enterica serovar Typhi Ty2
ugaagcgcguucguccc

SEQ ID NO: 3746435 - RNA, 15 nt, Salmonella enterica enterica serovar Typhi Ty2
ugaagcgggaaagcg

SEQ ID NO: 3746436 - RNA, 15 nt, Salmonella enterica enterica serovar Typhi Ty2
ugaagcguaacagcg

SEQ ID NO: 3746437 - RNA, 13 nt, Salmonella enterica enterica serovar Typhi Ty2
ugaagcugcaggg

SEQ ID NO: 3746438 - RNA, 14 nt, Salmonella enterica enterica serovar Typhi Ty2
ugaagcugccguag

SEQ ID NO: 3746439 - RNA, 18 nt, Salmonella enterica enterica serovar Typhi Ty2
ugaagcugccgucccagc

SEQ ID NO: 3746440 - RNA, 23 nt, Salmonella enterica enterica serovar Typhi Ty2
ugaaggagcaaugagauccacug

SEQ ID NO: 3746441 - RNA, 17 nt, Salmonella enterica enterica serovar Typhi Ty2
ugaaggcaaaacaccau

SEQ ID NO: 3746442 - RNA, 19 nt, Salmonella enterica enterica serovar Typhi Ty2
ugaaggccaaguuuagaaa

SEQ ID NO: 3746443 - RNA, 16 nt, Salmonella enterica enterica serovar Typhi Ty2
ugaaggcgccgcgcag

SEQ ID NO: 3746444 - RNA, 19 nt, Salmonella enterica enterica serovar Typhi Ty2
ugaaggcgcuaugcuuacc

SEQ ID NO: 3746445 - RNA, 21 nt, Salmonella enterica enterica serovar Typhi Ty2
ugaagggcggcuggauaaaag

SEQ ID NO: 3746446 - RNA, 15 nt, Salmonella enterica enterica serovar Typhi Ty2
ugaagguuuuucccg

SEQ ID NO: 3746447 - RNA, 19 nt, Salmonella enterica enterica serovar Typhi Ty2
ugaaguaauucuucgaaug

SEQ ID NO: 3746448 - RNA, 19 nt, Salmonella enterica enterica serovar Typhi Ty2
ugaagugguggcgaacagg

SEQ ID NO: 3746449 - RNA, 22 nt, Salmonella enterica enterica serovar Typhi Ty2
ugaagugugcaaacgauaaaag

SEQ ID NO: 3746450 - RNA, 15 nt, Salmonella enterica enterica serovar Typhi Ty2
ugaauaaaaccggca

SEQ ID NO: 3746451 - RNA, 11 nt, Salmonella enterica enterica serovar Typhi Ty2
ugaauaaaaua

SEQ ID NO: 3746452 - RNA, 14 nt, Salmonella enterica enterica serovar Typhi Ty2
ugaauaaaggguuu

SEQ ID NO: 3746453 - RNA, 13 nt, Salmonella enterica enterica serovar Typhi Ty2
ugaauaaauccuu

SEQ ID NO: 3746454 - RNA, 18 nt, Salmonella enterica enterica serovar Typhi Ty2
ugaccagcgcccacacca

SEQ ID NO: 3746455 - RNA, 22 nt, Salmonella enterica enterica serovar Typhi Ty2
ugaccaguaagggcagccgaga

SEQ ID NO: 3746456 - RNA, 22 nt, Salmonella enterica enterica serovar Typhi Ty2
ugaccaguuguuccgcgcugau

SEQ ID NO: 3746457 - RNA, 17 nt, Salmonella enterica enterica serovar Typhi Ty2
ugaccaucaaauaauac

SEQ ID NO: 3746458 - RNA, 17 nt, Salmonella enterica enterica serovar Typhi Ty2
ugaccauccgcagguua

SEQ ID NO: 3746459 - RNA, 13 nt, Salmonella enterica enterica serovar Typhi Ty2
ugacccagacaaa

SEQ ID NO: 3746460 - RNA, 19 nt, Salmonella enterica enterica serovar Typhi Ty2
ugacccgccgccagcaccg

SEQ ID NO: 3746461 - RNA, 14 nt, Salmonella enterica enterica serovar Typhi Ty2
ugacccucccugcg

SEQ ID NO: 3746462 - RNA, 20 nt, Salmonella enterica enterica serovar Typhi Ty2
ugaccgaaccgcuguagucu

SEQ ID NO: 3746463 - RNA, 22 nt, Salmonella enterica enterica serovar Typhi Ty2
ugaccgaacuuacgcacaaacc

SEQ ID NO: 3746464 - RNA, 15 nt, Salmonella enterica enterica serovar Typhi Ty2
ugaccgaagcaggcg

SEQ ID NO: 3746465 - RNA, 14 nt, Salmonella enterica enterica serovar Typhi Ty2
ugaccgaggaaauc

SEQ ID NO: 3746466 - RNA, 17 nt, Salmonella enterica enterica serovar Typhi Ty2
ugaccgauauagccacu

SEQ ID NO: 3746467 - RNA, 16 nt, Salmonella enterica enterica serovar Typhi Ty2
ugaccgaucacggcuu

SEQ ID NO: 3746468 - RNA, 14 nt, Salmonella enterica enterica serovar Typhi Ty2
ugaccgccgcgcgu

SEQ ID NO: 3746469 - RNA, 21 nt, Salmonella enterica enterica serovar Typhi Ty2
ugaccgccgcgcgucagcacg

SEQ ID NO: 3746470 - RNA, 17 nt, Salmonella enterica enterica serovar Typhi Ty2
ugaccgccgucauagca

SEQ ID NO: 3746471 - RNA, 19 nt, Salmonella enterica enterica serovar Typhi Ty2
ugaccgguaagcccauggc

SEQ ID NO: 3746472 - RNA, 15 nt, Salmonella enterica enterica serovar Typhi Ty2
ugaccgucagccccg

SEQ ID NO: 3746473 - RNA, 14 nt, Salmonella enterica enterica serovar Typhi Ty2
ugaccguccccagc

SEQ ID NO: 3746474 - RNA, 17 nt, Salmonella enterica enterica serovar Typhi Ty2
ugaccgugccggauggc

SEQ ID NO: 3746475 - RNA, 14 nt, Salmonella enterica enterica serovar Typhi Ty2
ugaccuacaggccg

SEQ ID NO: 3746476 - RNA, 13 nt, Salmonella enterica enterica serovar Typhi Ty2
ugaccucauccau

SEQ ID NO: 3746477 - RNA, 12 nt, Salmonella enterica enterica serovar Typhi Ty2
ugaccucgccua

SEQ ID NO: 3746478 - RNA, 18 nt, Salmonella enterica enterica serovar Typhi Ty2
ugaccugcagcuccgcaa

SEQ ID NO: 3746479 - RNA, 12 nt, Salmonella enterica enterica serovar Typhi Ty2
ugacgaaaagau

SEQ ID NO: 3746480 - RNA, 14 nt, Salmonella enterica enterica serovar Typhi Ty2
ugacgaccacagcc

SEQ ID NO: 3746481 - RNA, 23 nt, Salmonella enterica enterica serovar Typhi Ty2
ugacgagcagguuacucuuccac

SEQ ID NO: 3746482 - RNA, 16 nt, Salmonella enterica enterica serovar Typhi Ty2
ugacgaggccuguccc

SEQ ID NO: 3746483 - RNA, 17 nt, Salmonella enterica enterica serovar Typhi Ty2
ugacgagggaaggggau

SEQ ID NO: 3746484 - RNA, 17 nt, Salmonella enterica enterica serovar Typhi Ty2
ugacgagguuaucaggc

SEQ ID NO: 3746485 - RNA, 23 nt, Salmonella enterica enterica serovar Typhi Ty2
ugacgaucaacagaccgacgaug

SEQ ID NO: 3746486 - RNA, 21 nt, Salmonella enterica enterica serovar Typhi Ty2
ugacgaucaugccgcccaggc

SEQ ID NO: 3746487 - RNA, 18 nt, Salmonella enterica enterica serovar Typhi Ty2
ugacgauguucgucccug

SEQ ID NO: 3746488 - RNA, 18 nt, Salmonella enterica enterica serovar Typhi Ty2
ugacgcaaacugccaggc

SEQ ID NO: 3746489 - RNA, 14 nt, Salmonella enterica enterica serovar Typhi Ty2
ugacgcacaguguu

SEQ ID NO: 3746490 - RNA, 21 nt, Salmonella enterica enterica serovar Typhi Ty2
ugacgcaguaauacgccgccg

SEQ ID NO: 3746491 - RNA, 18 nt, Salmonella enterica enterica serovar Typhi Ty2
ugacgccaagcugcagaa

SEQ ID NO: 3746492 - RNA, 12 nt, Salmonella enterica enterica serovar Typhi Ty2
ugacgccaggca

SEQ ID NO: 3746493 - RNA, 20 nt, Salmonella enterica enterica serovar Typhi Ty2
ugacgccaguucccacagcu

SEQ ID NO: 3746494 - RNA, 15 nt, Salmonella enterica enterica serovar Typhi Ty2
ugacgccaugcaaaa

SEQ ID NO: 3746495 - RNA, 16 nt, Salmonella enterica enterica serovar Typhi Ty2
ugacgccaugcaaaaa

SEQ ID NO: 3746496 - RNA, 11 nt, Salmonella enterica enterica serovar Typhi Ty2
ugacgccgcca

SEQ ID NO: 3746497 - RNA, 18 nt, Salmonella enterica enterica serovar Typhi Ty2
ugacgccgcuguuuucac

SEQ ID NO: 3746498 - RNA, 19 nt, Salmonella enterica enterica serovar Typhi Ty2
ugacgccgcuguuuucacu

SEQ ID NO: 3746499 - RNA, 20 nt, Salmonella enterica enterica serovar Typhi Ty2
ugacgcgauauuacuccagc

SEQ ID NO: 3746500 - RNA, 12 nt, Salmonella enterica enterica serovar Typhi Ty2
ugacgcgcauac

SEQ ID NO: 3746501 - RNA, 15 nt, Salmonella enterica enterica serovar Typhi Ty2
ugacgcgucauaaug

SEQ ID NO: 3746502 - RNA, 20 nt, Salmonella enterica enterica serovar Typhi Ty2
ugacgcgucauaaugcccag

SEQ ID NO: 3746503 - RNA, 22 nt, Salmonella enterica enterica serovar Typhi Ty2
ugacgcguuaauauccuucagc

SEQ ID NO: 3746504 - RNA, 19 nt, Salmonella enterica enterica serovar Typhi Ty2
ugacgcuaacgcuuauccg

SEQ ID NO: 3746505 - RNA, 16 nt, Salmonella enterica enterica serovar Typhi Ty2
ugacgcugaugaaaac

SEQ ID NO: 3746506 - RNA, 11 nt, Salmonella enterica enterica serovar Typhi Ty2
ugacgcugccc

SEQ ID NO: 3746507 - RNA, 19 nt, Salmonella enterica enterica serovar Typhi Ty2
ugacgcuugcaugaccauc

SEQ ID NO: 3746508 - RNA, 14 nt, Salmonella enterica enterica serovar Typhi Ty2
ugacgcuuugcauu

SEQ ID NO: 3746509 - RNA, 14 nt, Salmonella enterica enterica serovar Typhi Ty2
ugacggaaaccagc

SEQ ID NO: 3746510 - RNA, 21 nt, Salmonella enterica enterica serovar Typhi Ty2
ugacggcaaagcccacgcccu

SEQ ID NO: 3746511 - RNA, 23 nt, Salmonella enterica enterica serovar Typhi Ty2
ugacggcaacugaaaacaggccu

SEQ ID NO: 3746512 - RNA, 15 nt, Salmonella enterica enterica serovar Typhi Ty2
ugacggccaccagcg

SEQ ID NO: 3746513 - RNA, 19 nt, Salmonella enterica enterica serovar Typhi Ty2
ugacggccugucuccucag

SEQ ID NO: 3746514 - RNA, 20 nt, Salmonella enterica enterica serovar Typhi Ty2
ugacgggaaaucucccuggc

SEQ ID NO: 3746515 - RNA, 22 nt, Salmonella enterica enterica serovar Typhi Ty2
ugacgggaaaucucccuggcag

SEQ ID NO: 3746516 - RNA, 21 nt, Salmonella enterica enterica serovar Typhi Ty2
ugacgggcauuguuaauccag

SEQ ID NO: 3746517 - RNA, 19 nt, Salmonella enterica enterica serovar Typhi Ty2
ugacggggggaauguuugg

SEQ ID NO: 3746518 - RNA, 20 nt, Salmonella enterica enterica serovar Typhi Ty2
ugacggggggaauguuuggc

SEQ ID NO: 3746519 - RNA, 22 nt, Salmonella enterica enterica serovar Typhi Ty2
ugacgguggccgccagcgcggu

SEQ ID NO: 3746520 - RNA, 15 nt, Salmonella enterica enterica serovar Typhi Ty2
ugacgguuuauaugc

SEQ ID NO: 3746521 - RNA, 22 nt, Salmonella enterica enterica serovar Typhi Ty2
ugacguacaaacaguuuuuccu

SEQ ID NO: 3746522 - RNA, 16 nt, Salmonella enterica enterica serovar Typhi Ty2
ugacguagauucugau

SEQ ID NO: 3746523 - RNA, 18 nt, Salmonella enterica enterica serovar Typhi Ty2
ugacguuaacgcagcauc

SEQ ID NO: 3746524 - RNA, 16 nt, Salmonella enterica enterica serovar Typhi Ty2
ugacguuauccaguau

SEQ ID NO: 3746525 - RNA, 15 nt, Salmonella enterica enterica serovar Typhi Ty2
ugacuaaaagacgcc

SEQ ID NO: 3746526 - RNA, 21 nt, Salmonella enterica enterica serovar Typhi Ty2
ugacuauacccaaaauaauuc

SEQ ID NO: 3746527 - RNA, 19 nt, Salmonella enterica enterica serovar Typhi Ty2
ugacuaucuggauacgaua

SEQ ID NO: 3746528 - RNA, 21 nt, Salmonella enterica enterica serovar Typhi Ty2
ugacucacauaacaaaaccag

SEQ ID NO: 3746529 - RNA, 18 nt, Salmonella enterica enterica serovar Typhi Ty2
ugacucagcggccauuga

SEQ ID NO: 3746530 - RNA, 15 nt, Salmonella enterica enterica serovar Typhi Ty2
ugacucauuaaaaaa

SEQ ID NO: 3746531 - RNA, 19 nt, Salmonella enterica enterica serovar Typhi Ty2
ugacucauuaaaaaaacau

SEQ ID NO: 3746532 - RNA, 16 nt, Salmonella enterica enterica serovar Typhi Ty2
ugacucuguggccgcg

SEQ ID NO: 3746533 - RNA, 22 nt, Salmonella enterica enterica serovar Typhi Ty2
ugacucuuguuucucguauuau

SEQ ID NO: 3746534 - RNA, 16 nt, Salmonella enterica enterica serovar Typhi Ty2
ugacugaauuaucagg

SEQ ID NO: 3746535 - RNA, 17 nt, Salmonella enterica enterica serovar Typhi Ty2
ugacugaauuuucagcc

SEQ ID NO: 3746536 - RNA, 13 nt, Salmonella enterica enterica serovar Typhi Ty2
ugauaagagaaaa

SEQ ID NO: 3746537 - RNA, 14 nt, Salmonella enterica enterica serovar Typhi Ty2
ugauaagagaaaau

SEQ ID NO: 3746538 - RNA, 21 nt, Salmonella enterica enterica serovar Typhi Ty2
ugauaagcauagcgccaucag

SEQ ID NO: 3746539 - RNA, 21 nt, Salmonella enterica enterica serovar Typhi Ty2
ugauaauaauuguaggcagga

SEQ ID NO: 3746540 - RNA, 12 nt, Salmonella enterica enterica serovar Typhi Ty2
ugauaauacugc

SEQ ID NO: 3746541 - RNA, 23 nt, Salmonella enterica enterica serovar Typhi Ty2
ugauaauaguggugcgcauccgg

SEQ ID NO: 3746542 - RNA, 14 nt, Salmonella enterica enterica serovar Typhi Ty2
ugauaauaugcuca

SEQ ID NO: 3746543 - RNA, 12 nt, Salmonella enterica enterica serovar Typhi Ty2
ugauaaucagcg

SEQ ID NO: 3746544 - RNA, 23 nt, Salmonella enterica enterica serovar Typhi Ty2
ugauaaugguuuacccaggaaga

SEQ ID NO: 3746545 - RNA, 17 nt, Salmonella enterica enterica serovar Typhi Ty2
ugauaaugucaacuuaa

SEQ ID NO: 3746546 - RNA, 18 nt, Salmonella enterica enterica serovar Typhi Ty2
ugauacagaaaaccggca

SEQ ID NO: 3746547 - RNA, 14 nt, Salmonella enterica enterica serovar Typhi Ty2
ugauacagcagcac

SEQ ID NO: 3746548 - RNA, 23 nt, Salmonella enterica enterica serovar Typhi Ty2
ugauacagccaaaucagcaggac

SEQ ID NO: 3746549 - RNA, 16 nt, Salmonella enterica enterica serovar Typhi Ty2
ugauacaggaauaacc

SEQ ID NO: 3746550 - RNA, 19 nt, Salmonella enterica enterica serovar Typhi Ty2
ugauacaugcuacaggcaa

SEQ ID NO: 3746551 - RNA, 17 nt, Salmonella enterica enterica serovar Typhi Ty2
ugauaccacaucaauag

SEQ ID NO: 3746552 - RNA, 15 nt, Salmonella enterica enterica serovar Typhi Ty2
ugauaccuauuuaau

SEQ ID NO: 3746553 - RNA, 17 nt, Salmonella enterica enterica serovar Typhi Ty2
ugauaccuauuuaauaa

SEQ ID NO: 3746554 - RNA, 20 nt, Salmonella enterica enterica serovar Typhi Ty2
ugauaccuuuaaccucuuuu

SEQ ID NO: 3746555 - RNA, 19 nt, Salmonella enterica enterica serovar Typhi Ty2
ugauacgggaagucauuag

SEQ ID NO: 3746556 - RNA, 18 nt, Salmonella enterica enterica serovar Typhi Ty2
ugauagccguucuccagc

SEQ ID NO: 3746557 - RNA, 18 nt, Salmonella enterica enterica serovar Typhi Ty2
ugauagcgaggcagcagg

SEQ ID NO: 3746558 - RNA, 13 nt, Salmonella enterica enterica serovar Typhi Ty2
ugauagggcagca

SEQ ID NO: 3746559 - RNA, 14 nt, Salmonella enterica enterica serovar Typhi Ty2
ugauagggcagcag

SEQ ID NO: 3746560 - RNA, 18 nt, Salmonella enterica enterica serovar Typhi Ty2
ugauagggcgccuguuua

SEQ ID NO: 3746561 - RNA, 23 nt, Salmonella enterica enterica serovar Typhi Ty2
ugauagguucaauaugccaggca

SEQ ID NO: 3746562 - RNA, 13 nt, Salmonella enterica enterica serovar Typhi Ty2
ugauaguccauca

SEQ ID NO: 3746563 - RNA, 19 nt, Salmonella enterica enterica serovar Typhi Ty2
ugauauaaaauggcgcaca

SEQ ID NO: 3746564 - RNA, 20 nt, Salmonella enterica enterica serovar Typhi Ty2
ugauauaccguccagacucc

SEQ ID NO: 3746565 - RNA, 23 nt, Salmonella enterica enterica serovar Typhi Ty2
ugauaucgcugugguuuauccgc

SEQ ID NO: 3746566 - RNA, 20 nt, Salmonella enterica enterica serovar Typhi Ty2
ugauaugcaguucaucaucc

SEQ ID NO: 3746567 - RNA, 19 nt, Salmonella enterica enterica serovar Typhi Ty2
ugauaugcucgacaauaaa

SEQ ID NO: 3746568 - RNA, 17 nt, Salmonella enterica enterica serovar Typhi Ty2
ugauauggaaagugguu

SEQ ID NO: 3746569 - RNA, 23 nt, Salmonella enterica enterica serovar Typhi Ty2
ugauauuacuaauaaaauucacu

SEQ ID NO: 3746570 - RNA, 21 nt, Salmonella enterica enterica serovar Typhi Ty2
ugauauuagaaagcugcacca

SEQ ID NO: 3746571 - RNA, 19 nt, Salmonella enterica enterica serovar Typhi Ty2
ugauauucuuugguauuga

SEQ ID NO: 3746572 - RNA, 21 nt, Salmonella enterica enterica serovar Typhi Ty2
ugauauugaccaucucuuccg

SEQ ID NO: 3746573 - RNA, 22 nt, Salmonella enterica enterica serovar Typhi Ty2
ugauauugcguaagcagcugcu

SEQ ID NO: 3746574 - RNA, 20 nt, Salmonella enterica enterica serovar Typhi Ty2
ugauauuucuuagcacccac

SEQ ID NO: 3746575 - RNA, 17 nt, Salmonella enterica enterica serovar Typhi Ty2
ugauauuuuuacugauu

SEQ ID NO: 3746576 - RNA, 18 nt, Salmonella enterica enterica serovar Typhi Ty2
ugaucaccaucuucacau

SEQ ID NO: 3746577 - RNA, 23 nt, Salmonella enterica enterica serovar Typhi Ty2
ugaucacgguacgcaucaccagg

SEQ ID NO: 3746578 - RNA, 16 nt, Salmonella enterica enterica serovar Typhi Ty2
ugaucacuuccgccac

SEQ ID NO: 3746579 - RNA, 21 nt, Salmonella enterica enterica serovar Typhi Ty2
ugaucacuuuugggccgcgua

SEQ ID NO: 3746580 - RNA, 17 nt, Salmonella enterica enterica serovar Typhi Ty2
ugaucagaccaucggcc

SEQ ID NO: 3746581 - RNA, 23 nt, Salmonella enterica enterica serovar Typhi Ty2
ugaucagacgcacaaucgccgug

SEQ ID NO: 3746582 - RNA, 23 nt, Salmonella enterica enterica serovar Typhi Ty2
ugaucagcaaaauaguguugaau

SEQ ID NO: 3746583 - RNA, 18 nt, Salmonella enterica enterica serovar Typhi Ty2
ugaucaggaaaucuucca

SEQ ID NO: 3746584 - RNA, 20 nt, Salmonella enterica enterica serovar Typhi Ty2
ugaucaggaaaucuuccagu

SEQ ID NO: 3746585 - RNA, 14 nt, Salmonella enterica enterica serovar Typhi Ty2
ugaucaggcuaaag

SEQ ID NO: 3746586 - RNA, 14 nt, Salmonella enterica enterica serovar Typhi Ty2
ugaucauacugccg

SEQ ID NO: 3746587 - RNA, 15 nt, Salmonella enterica enterica serovar Typhi Ty2
ugaucauacugccgc

SEQ ID NO: 3746588 - RNA, 15 nt, Salmonella enterica enterica serovar Typhi Ty2
ugaucauccuuacuu

SEQ ID NO: 3746589 - RNA, 20 nt, Salmonella enterica enterica serovar Typhi Ty2
ugaucaucggcgcgucgcug

SEQ ID NO: 3746590 - RNA, 15 nt, Salmonella enterica enterica serovar Typhi Ty2
ugaucauggcucaga

SEQ ID NO: 3746591 - RNA, 22 nt, Salmonella enterica enterica serovar Typhi Ty2
ugauccacagguuaucgccgcc

SEQ ID NO: 3746592 - RNA, 18 nt, Salmonella enterica enterica serovar Typhi Ty2
ugauccaccaccagcauc

SEQ ID NO: 3746593 - RNA, 22 nt, Salmonella enterica enterica serovar Typhi Ty2
ugauccaccaccaguacauggc

SEQ ID NO: 3746594 - RNA, 12 nt, Salmonella enterica enterica serovar Typhi Ty2
ugaucccaccag

SEQ ID NO: 3746595 - RNA, 23 nt, Salmonella enterica enterica serovar Typhi Ty2
ugauccgcccccuccaguagcag

SEQ ID NO: 3746596 - RNA, 17 nt, Salmonella enterica enterica serovar Typhi Ty2
ugauccguuucagaaag

SEQ ID NO: 3746597 - RNA, 22 nt, Salmonella enterica enterica serovar Typhi Ty2
ugauccugcaacagcaccagca

SEQ ID NO: 3746598 - RNA, 16 nt, Salmonella enterica enterica serovar Typhi Ty2
ugaucgaauucauuac

SEQ ID NO: 3746599 - RNA, 22 nt, Salmonella enterica enterica serovar Typhi Ty2
ugaucgaggucgccaaauuuag

SEQ ID NO: 3746600 - RNA, 17 nt, Salmonella enterica enterica serovar Typhi Ty2
ugaucgauccgcaucag

SEQ ID NO: 3746601 - RNA, 21 nt, Salmonella enterica enterica serovar Typhi Ty2
ugaucgccacgccuaaacuga

SEQ ID NO: 3746602 - RNA, 14 nt, Salmonella enterica enterica serovar Typhi Ty2
ugaucgccgccauc

SEQ ID NO: 3746603 - RNA, 20 nt, Salmonella enterica enterica serovar Typhi Ty2
ugaucgcgagaguaagccca

SEQ ID NO: 3746604 - RNA, 13 nt, Salmonella enterica enterica serovar Typhi Ty2
ugaucgcgcagac

SEQ ID NO: 3746605 - RNA, 22 nt, Salmonella enterica enterica serovar Typhi Ty2
ugaucggccagauaguggcuga

SEQ ID NO: 3746606 - RNA, 13 nt, Salmonella enterica enterica serovar Typhi Ty2
ugaucggcuggcg

SEQ ID NO: 3746607 - RNA, 23 nt, Salmonella enterica enterica serovar Typhi Ty2
ugaucggcuggcgcaacuggcgc

SEQ ID NO: 3746608 - RNA, 17 nt, Salmonella enterica enterica serovar Typhi Ty2
ugaucguaggcggcgga

SEQ ID NO: 3746609 - RNA, 17 nt, Salmonella enterica enterica serovar Typhi Ty2
ugaucgucgcgaucgcg

SEQ ID NO: 3746610 - RNA, 13 nt, Salmonella enterica enterica serovar Typhi Ty2
ugaucgugcccac

SEQ ID NO: 3746611 - RNA, 12 nt, Salmonella enterica enterica serovar Typhi Ty2
ugaucugcacaa

SEQ ID NO: 3746612 - RNA, 13 nt, Salmonella enterica enterica serovar Typhi Ty2
ugaucugcgcaac

SEQ ID NO: 3746613 - RNA, 13 nt, Salmonella enterica enterica serovar Typhi Ty2
ugaucuggccaau

SEQ ID NO: 3746614 - RNA, 19 nt, Salmonella enterica enterica serovar Typhi Ty2
ugaucuggccaauuuuuca

SEQ ID NO: 3746615 - RNA, 20 nt, Salmonella enterica enterica serovar Typhi Ty2
ugaucuggccaauuuuucac

SEQ ID NO: 3746616 - RNA, 18 nt, Salmonella enterica enterica serovar Typhi Ty2
ugaugacuaaaucagcau

SEQ ID NO: 3746617 - RNA, 23 nt, Salmonella enterica enterica serovar Typhi Ty2
ugcaacccauauucgucuucauc

SEQ ID NO: 3746618 - RNA, 19 nt, Salmonella enterica enterica serovar Typhi Ty2
ugcaaccccuugcggugca

SEQ ID NO: 3746619 - RNA, 17 nt, Salmonella enterica enterica serovar Typhi Ty2
ugcaaccgcucuuuugc

SEQ ID NO: 3746620 - RNA, 21 nt, Salmonella enterica enterica serovar Typhi Ty2
ugcaacgaucccuaauaaaau

SEQ ID NO: 3746621 - RNA, 23 nt, Salmonella enterica enterica serovar Typhi Ty2
ugcaacgaucccuaauaaaauaa

SEQ ID NO: 3746622 - RNA, 18 nt, Salmonella enterica enterica serovar Typhi Ty2
ugcaacgccgaugcuuuu

SEQ ID NO: 3746623 - RNA, 16 nt, Salmonella enterica enterica serovar Typhi Ty2
ugcaacuauuaauucu

SEQ ID NO: 3746624 - RNA, 15 nt, Salmonella enterica enterica serovar Typhi Ty2
ugcaacuccacaaau

SEQ ID NO: 3746625 - RNA, 17 nt, Salmonella enterica enterica serovar Typhi Ty2
ugcaacuccugggcaaa

SEQ ID NO: 3746626 - RNA, 16 nt, Salmonella enterica enterica serovar Typhi Ty2
ugcaacuucaccucag

SEQ ID NO: 3746627 - RNA, 19 nt, Salmonella enterica enterica serovar Typhi Ty2
ugcaacuucaccuucggug

SEQ ID NO: 3746628 - RNA, 20 nt, Salmonella enterica enterica serovar Typhi Ty2
ugcaagaaauguccauaaau

SEQ ID NO: 3746629 - RNA, 19 nt, Salmonella enterica enterica serovar Typhi Ty2
ugcaaguugcaagucacca

SEQ ID NO: 3746630 - RNA, 16 nt, Salmonella enterica enterica serovar Typhi Ty2
ugcaauaucgcggcaa

SEQ ID NO: 3746631 - RNA, 13 nt, Salmonella enterica enterica serovar Typhi Ty2
ugcaaucacacua

SEQ ID NO: 3746632 - RNA, 15 nt, Salmonella enterica enterica serovar Typhi Ty2
ugcaaucacacuaca

SEQ ID NO: 3746633 - RNA, 22 nt, Salmonella enterica enterica serovar Typhi Ty2
ugcaaucaguuccaaucucuuu

SEQ ID NO: 3746634 - RNA, 21 nt, Salmonella enterica enterica serovar Typhi Ty2
ugcaaucguucuugcacaaua

SEQ ID NO: 3746635 - RNA, 21 nt, Salmonella enterica enterica serovar Typhi Ty2
ugcaaugcggcguguggcugu

SEQ ID NO: 3746636 - RNA, 15 nt, Salmonella enterica enterica serovar Typhi Ty2
ugcaauguucaauau

SEQ ID NO: 3746637 - RNA, 21 nt, Salmonella enterica enterica serovar Typhi Ty2
ugcaauguucaauaucaaauu

SEQ ID NO: 3746638 - RNA, 22 nt, Salmonella enterica enterica serovar Typhi Ty2
ugcaauguucaauaucaaauug

SEQ ID NO: 3746639 - RNA, 17 nt, Salmonella enterica enterica serovar Typhi Ty2
ugcaauuccggcgaaaa

SEQ ID NO: 3746640 - RNA, 23 nt, Salmonella enterica enterica serovar Typhi Ty2
ugcaauucgagauuuuucugcgc

SEQ ID NO: 3746641 - RNA, 15 nt, Salmonella enterica enterica serovar Typhi Ty2
ugcacaaaauacugu

SEQ ID NO: 3746642 - RNA, 22 nt, Salmonella enterica enterica serovar Typhi Ty2
ugcacaagaaacauguuguguc

SEQ ID NO: 3746643 - RNA, 15 nt, Salmonella enterica enterica serovar Typhi Ty2
ugcacaauaccaaua

SEQ ID NO: 3746644 - RNA, 16 nt, Salmonella enterica enterica serovar Typhi Ty2
ugcacaauaccaauaa

SEQ ID NO: 3746645 - RNA, 16 nt, Salmonella enterica enterica serovar Typhi Ty2
ugcacaaucgccagcc

SEQ ID NO: 3746646 - RNA, 18 nt, Salmonella enterica enterica serovar Typhi Ty2
ugcacagucugcagaccu

SEQ ID NO: 3746647 - RNA, 19 nt, Salmonella enterica enterica serovar Typhi Ty2
ugcacauaacgugccaucu

SEQ ID NO: 3746648 - RNA, 15 nt, Salmonella enterica enterica serovar Typhi Ty2
ugcacauguuucagc

SEQ ID NO: 3746649 - RNA, 16 nt, Salmonella enterica enterica serovar Typhi Ty2
ugcacauugucgggca

SEQ ID NO: 3746650 - RNA, 17 nt, Salmonella enterica enterica serovar Typhi Ty2
ugcaccacuuuguuuuu

SEQ ID NO: 3746651 - RNA, 20 nt, Salmonella enterica enterica serovar Typhi Ty2
ugcaccaggugaaugaggug

SEQ ID NO: 3746652 - RNA, 17 nt, Salmonella enterica enterica serovar Typhi Ty2
ugcacccggagagaaac

SEQ ID NO: 3746653 - RNA, 12 nt, Salmonella enterica enterica serovar Typhi Ty2
ugcaccucuuua

SEQ ID NO: 3746654 - RNA, 20 nt, Salmonella enterica enterica serovar Typhi Ty2
ugcacgcacgacagugcuau

SEQ ID NO: 3746655 - RNA, 15 nt, Salmonella enterica enterica serovar Typhi Ty2
ugcacgccaggguaa

SEQ ID NO: 3746656 - RNA, 21 nt, Salmonella enterica enterica serovar Typhi Ty2
ugcacgccaggguaauacugg

SEQ ID NO: 3746657 - RNA, 16 nt, Salmonella enterica enterica serovar Typhi Ty2
ugcacgcgauuugcag

SEQ ID NO: 3746658 - RNA, 11 nt, Salmonella enterica enterica serovar Typhi Ty2
ugcacgcuguu

SEQ ID NO: 3746659 - RNA, 18 nt, Salmonella enterica enterica serovar Typhi Ty2
ugcacgcuguuucucgau

SEQ ID NO: 3746660 - RNA, 17 nt, Salmonella enterica enterica serovar Typhi Ty2
ugcacgguugaagcgac

SEQ ID NO: 3746661 - RNA, 17 nt, Salmonella enterica enterica serovar Typhi Ty2
ugcacguaccugcucca

SEQ ID NO: 3746662 - RNA, 22 nt, Salmonella enterica enterica serovar Typhi Ty2
ugcacgucgagacgguguuuag

SEQ ID NO: 3746663 - RNA, 23 nt, Salmonella enterica enterica serovar Typhi Ty2
ugcacgucgcgcucgcucaucac

SEQ ID NO: 3746664 - RNA, 17 nt, Salmonella enterica enterica serovar Typhi Ty2
ugcacugacuuacaggc

SEQ ID NO: 3746665 - RNA, 12 nt, Salmonella enterica enterica serovar Typhi Ty2
ugcacugcaccu

SEQ ID NO: 3746666 - RNA, 14 nt, Salmonella enterica enterica serovar Typhi Ty2
ugcacugcaccugg

SEQ ID NO: 3746667 - RNA, 21 nt, Salmonella enterica enterica serovar Typhi Ty2
ugcacugcgcccauuauugau

SEQ ID NO: 3746668 - RNA, 12 nt, Salmonella enterica enterica serovar Typhi Ty2
ugcacuuccugc

SEQ ID NO: 3746669 - RNA, 14 nt, Salmonella enterica enterica serovar Typhi Ty2
ugcagaaucauuaa

SEQ ID NO: 3746670 - RNA, 16 nt, Salmonella enterica enterica serovar Typhi Ty2
ugcagaccucugcaaa

SEQ ID NO: 3746671 - RNA, 16 nt, Salmonella enterica enterica serovar Typhi Ty2
ugcagaccucugcuuu

SEQ ID NO: 3746672 - RNA, 21 nt, Salmonella enterica enterica serovar Typhi Ty2
ugcagacgcucguauccgagc

SEQ ID NO: 3746673 - RNA, 20 nt, Salmonella enterica enterica serovar Typhi Ty2
ugcagagcggcaaauucagc

SEQ ID NO: 3746674 - RNA, 14 nt, Salmonella enterica enterica serovar Typhi Ty2
ugcagauaccagcg

SEQ ID NO: 3746675 - RNA, 20 nt, Salmonella enterica enterica serovar Typhi Ty2
ugcagauccgcgauaucaau

SEQ ID NO: 3746676 - RNA, 20 nt, Salmonella enterica enterica serovar Typhi Ty2
ugcagaucgcgggcaaucaa

SEQ ID NO: 3746677 - RNA, 18 nt, Salmonella enterica enterica serovar Typhi Ty2
ugcagaucggccuguuuu

SEQ ID NO: 3746678 - RNA, 14 nt, Salmonella enterica enterica serovar Typhi Ty2
ugcagaugcucagg

SEQ ID NO: 3746679 - RNA, 15 nt, Salmonella enterica enterica serovar Typhi Ty2
ugcagauuaugccgu

SEQ ID NO: 3746680 - RNA, 13 nt, Salmonella enterica enterica serovar Typhi Ty2
ugcagauuuugcu

SEQ ID NO: 3746681 - RNA, 15 nt, Salmonella enterica enterica serovar Typhi Ty2
ugcagauuuugcucc

SEQ ID NO: 3746682 - RNA, 18 nt, Salmonella enterica enterica serovar Typhi Ty2
ugcagcaggacgcgcacu

SEQ ID NO: 3746683 - RNA, 21 nt, Salmonella enterica enterica serovar Typhi Ty2
ugcagcgccuggcgguaugaa

SEQ ID NO: 3746684 - RNA, 18 nt, Salmonella enterica enterica serovar Typhi Ty2
ugcagcgcggcggcaacu

SEQ ID NO: 3746685 - RNA, 22 nt, Salmonella enterica enterica serovar Typhi Ty2
ugcagcgcguccaauagccccu

SEQ ID NO: 3746686 - RNA, 23 nt, Salmonella enterica enterica serovar Typhi Ty2
ugcagcggaugcucuuuacggac

SEQ ID NO: 3746687 - RNA, 18 nt, Salmonella enterica enterica serovar Typhi Ty2
ugcagcgucaggaacgcg

SEQ ID NO: 3746688 - RNA, 18 nt, Salmonella enterica enterica serovar Typhi Ty2
ugcagcgugaaaagcuua

SEQ ID NO: 3746689 - RNA, 15 nt, Salmonella enterica enterica serovar Typhi Ty2
ugcagcguuuccagc

SEQ ID NO: 3746690 - RNA, 13 nt, Salmonella enterica enterica serovar Typhi Ty2
ugcaggaaggucu

SEQ ID NO: 3746691 - RNA, 16 nt, Salmonella enterica enterica serovar Typhi Ty2
ugcaggaaguuuucug

SEQ ID NO: 3746692 - RNA, 20 nt, Salmonella enterica enterica serovar Typhi Ty2
ugcaggacagacagacguug

SEQ ID NO: 3746693 - RNA, 19 nt, Salmonella enterica enterica serovar Typhi Ty2
ugcaggacuuaccuugagu

SEQ ID NO: 3746694 - RNA, 22 nt, Salmonella enterica enterica serovar Typhi Ty2
ugcaggaugucgauaauacagc

SEQ ID NO: 3746695 - RNA, 17 nt, Salmonella enterica enterica serovar Typhi Ty2
ugcaggauucgaaccug

SEQ ID NO: 3746696 - RNA, 16 nt, Salmonella enterica enterica serovar Typhi Ty2
ugcaggcaaaacgggc

SEQ ID NO: 3746697 - RNA, 19 nt, Salmonella enterica enterica serovar Typhi Ty2
ugcaggcaaaacgggcggc

SEQ ID NO: 3746698 - RNA, 21 nt, Salmonella enterica enterica serovar Typhi Ty2
ugcaggccaaauagaacgcuc

SEQ ID NO: 3746699 - RNA, 15 nt, Salmonella enterica enterica serovar Typhi Ty2
ugccagcgcucugca

SEQ ID NO: 3746700 - RNA, 14 nt, Salmonella enterica enterica serovar Typhi Ty2
ugccagcgcugaga

SEQ ID NO: 3746701 - RNA, 14 nt, Salmonella enterica enterica serovar Typhi Ty2
ugccagcggccagg

SEQ ID NO: 3746702 - RNA, 18 nt, Salmonella enterica enterica serovar Typhi Ty2
ugccagcggccagggcgu

SEQ ID NO: 3746703 - RNA, 19 nt, Salmonella enterica enterica serovar Typhi Ty2
ugccagcguaagucugaua

SEQ ID NO: 3746704 - RNA, 19 nt, Salmonella enterica enterica serovar Typhi Ty2
ugccagcgucgcugauugc

SEQ ID NO: 3746705 - RNA, 23 nt, Salmonella enterica enterica serovar Typhi Ty2
ugccagcgucgcugauugccgcc

SEQ ID NO: 3746706 - RNA, 17 nt, Salmonella enterica enterica serovar Typhi Ty2
ugccagcucguuauuuc

SEQ ID NO: 3746707 - RNA, 19 nt, Salmonella enterica enterica serovar Typhi Ty2
ugccagcucguuauuuccg

SEQ ID NO: 3746708 - RNA, 18 nt, Salmonella enterica enterica serovar Typhi Ty2
ugccagcuuaaaucgcgg

SEQ ID NO: 3746709 - RNA, 20 nt, Salmonella enterica enterica serovar Typhi Ty2
ugccagcuuaaaucgcggcg

SEQ ID NO: 3746710 - RNA, 18 nt, Salmonella enterica enterica serovar Typhi Ty2
ugccaggaagucagcuuc

SEQ ID NO: 3746711 - RNA, 23 nt, Salmonella enterica enterica serovar Typhi Ty2
ugccaggaagucagcuuccugca

SEQ ID NO: 3746712 - RNA, 11 nt, Salmonella enterica enterica serovar Typhi Ty2
ugccaggcauu

SEQ ID NO: 3746713 - RNA, 19 nt, Salmonella enterica enterica serovar Typhi Ty2
ugccaggcgcuaucuucaa

SEQ ID NO: 3746714 - RNA, 16 nt, Salmonella enterica enterica serovar Typhi Ty2
ugccaggcuuccugcg

SEQ ID NO: 3746715 - RNA, 19 nt, Salmonella enterica enterica serovar Typhi Ty2
ugccagggcggaagcagau

SEQ ID NO: 3746716 - RNA, 21 nt, Salmonella enterica enterica serovar Typhi Ty2
ugccaguaacguucuucgaua

SEQ ID NO: 3746717 - RNA, 16 nt, Salmonella enterica enterica serovar Typhi Ty2
ugccaguacagcagcg

SEQ ID NO: 3746718 - RNA, 23 nt, Salmonella enterica enterica serovar Typhi Ty2
ugccaguaguugaauaaccucaa

SEQ ID NO: 3746719 - RNA, 23 nt, Salmonella enterica enterica serovar Typhi Ty2
ugccagucaauaagcuugcuuuc

SEQ ID NO: 3746720 - RNA, 13 nt, Salmonella enterica enterica serovar Typhi Ty2
ugccagugaaaaa

SEQ ID NO: 3746721 - RNA, 17 nt, Salmonella enterica enterica serovar Typhi Ty2
ugccaguucauuccgcc

SEQ ID NO: 3746722 - RNA, 19 nt, Salmonella enterica enterica serovar Typhi Ty2
ugccaguuucucaaagcug

SEQ ID NO: 3746723 - RNA, 17 nt, Salmonella enterica enterica serovar Typhi Ty2
ugccauaaaaacaauaa

SEQ ID NO: 3746724 - RNA, 20 nt, Salmonella enterica enterica serovar Typhi Ty2
ugccauaaagcggacugccu

SEQ ID NO: 3746725 - RNA, 19 nt, Salmonella enterica enterica serovar Typhi Ty2
ugccauaaucgauauaauu

SEQ ID NO: 3746726 - RNA, 17 nt, Salmonella enterica enterica serovar Typhi Ty2
ugccauacacgcggcga

SEQ ID NO: 3746727 - RNA, 17 nt, Salmonella enterica enterica serovar Typhi Ty2
ugccauacuccugccug

SEQ ID NO: 3746728 - RNA, 18 nt, Salmonella enterica enterica serovar Typhi Ty2
ugccauauuguucaguuu

SEQ ID NO: 3746729 - RNA, 19 nt, Salmonella enterica enterica serovar Typhi Ty2
ugccauauuuuuccagcgc

SEQ ID NO: 3746730 - RNA, 21 nt, Salmonella enterica enterica serovar Typhi Ty2
ugccauauuuuuccagcgccu

SEQ ID NO: 3746731 - RNA, 14 nt, Salmonella enterica enterica serovar Typhi Ty2
ugccaucagcaccu

SEQ ID NO: 3746732 - RNA, 12 nt, Salmonella enterica enterica serovar Typhi Ty2
ugccaucaucag

SEQ ID NO: 3746733 - RNA, 16 nt, Salmonella enterica enterica serovar Typhi Ty2
ugccaucaucaguaac

SEQ ID NO: 3746734 - RNA, 13 nt, Salmonella enterica enterica serovar Typhi Ty2
ugccaucauccag

SEQ ID NO: 3746735 - RNA, 22 nt, Salmonella enterica enterica serovar Typhi Ty2
ugccaucauuaauuuacugaua

SEQ ID NO: 3746736 - RNA, 18 nt, Salmonella enterica enterica serovar Typhi Ty2
ugccaucgaccgauuggg

SEQ ID NO: 3746737 - RNA, 20 nt, Salmonella enterica enterica serovar Typhi Ty2
ugccaucgcuuaacccugcc

SEQ ID NO: 3746738 - RNA, 17 nt, Salmonella enterica enterica serovar Typhi Ty2
ugccaucgcuucuacag

SEQ ID NO: 3746739 - RNA, 17 nt, Salmonella enterica enterica serovar Typhi Ty2
ugccaucggauauauuu

SEQ ID NO: 3746740 - RNA, 17 nt, Salmonella enterica enterica serovar Typhi Ty2
ugccaucuccugcgaua

SEQ ID NO: 3746741 - RNA, 16 nt, Salmonella enterica enterica serovar Typhi Ty2
ugccaugaguaaugac

SEQ ID NO: 3746742 - RNA, 11 nt, Salmonella enterica enterica serovar Typhi Ty2
ugccaugcugg

SEQ ID NO: 3746743 - RNA, 13 nt, Salmonella enterica enterica serovar Typhi Ty2
ugccauguuucuu

SEQ ID NO: 3746744 - RNA, 18 nt, Salmonella enterica enterica serovar Typhi Ty2
ugccauucccagccgagc

SEQ ID NO: 3746745 - RNA, 18 nt, Salmonella enterica enterica serovar Typhi Ty2
ugccauuguuccggcgac

SEQ ID NO: 3746746 - RNA, 17 nt, Salmonella enterica enterica serovar Typhi Ty2
ugccauuguucgcgcgu

SEQ ID NO: 3746747 - RNA, 15 nt, Salmonella enterica enterica serovar Typhi Ty2
ugcccaaccugcgca

SEQ ID NO: 3746748 - RNA, 17 nt, Salmonella enterica enterica serovar Typhi Ty2
ugcccaauagcgcugag

SEQ ID NO: 3746749 - RNA, 20 nt, Salmonella enterica enterica serovar Typhi Ty2
ugcccaccggcccacgcagu

SEQ ID NO: 3746750 - RNA, 15 nt, Salmonella enterica enterica serovar Typhi Ty2
ugcccaccugaaaaa

SEQ ID NO: 3746751 - RNA, 20 nt, Salmonella enterica enterica serovar Typhi Ty2
ugcccaccugaaaaagggua

SEQ ID NO: 3746752 - RNA, 14 nt, Salmonella enterica enterica serovar Typhi Ty2
ugcccagccuucuc

SEQ ID NO: 3746753 - RNA, 19 nt, Salmonella enterica enterica serovar Typhi Ty2
ugcccagcgccuucuucac

SEQ ID NO: 3746754 - RNA, 18 nt, Salmonella enterica enterica serovar Typhi Ty2
ugcccaguuuacccagcg

SEQ ID NO: 3746755 - RNA, 23 nt, Salmonella enterica enterica serovar Typhi Ty2
ugcccaguuuacccagcgaaugc

SEQ ID NO: 3746756 - RNA, 18 nt, Salmonella enterica enterica serovar Typhi Ty2
ugcccaucauucaacgca

SEQ ID NO: 3746757 - RNA, 19 nt, Salmonella enterica enterica serovar Typhi Ty2
ugcccaucgcgccaugauu

SEQ ID NO: 3746758 - RNA, 23 nt, Salmonella enterica enterica serovar Typhi Ty2
ugcccaucgcgccaugauucauc

SEQ ID NO: 3746759 - RNA, 22 nt, Salmonella enterica enterica serovar Typhi Ty2
ugcccaucuaaccgggccugau

SEQ ID NO: 3746760 - RNA, 22 nt, Salmonella enterica enterica serovar Typhi Ty2
ugcccaucugacgugcgauagc

SEQ ID NO: 3746761 - RNA, 14 nt, Salmonella enterica enterica serovar Typhi Ty2
ugcccaugaagcga

SEQ ID NO: 3746762 - RNA, 20 nt, Salmonella enterica enterica serovar Typhi Ty2
ugcccauguuuaccaucgcg

SEQ ID NO: 3746763 - RNA, 22 nt, Salmonella enterica enterica serovar Typhi Ty2
ugccccacgauacgccccugcu

SEQ ID NO: 3746764 - RNA, 15 nt, Salmonella enterica enterica serovar Typhi Ty2
ugccccauuguucuu

SEQ ID NO: 3746765 - RNA, 23 nt, Salmonella enterica enterica serovar Typhi Ty2
ugcccccaucacuuuacccacau

SEQ ID NO: 3746766 - RNA, 15 nt, Salmonella enterica enterica serovar Typhi Ty2
ugcccccgagccaga

SEQ ID NO: 3746767 - RNA, 19 nt, Salmonella enterica enterica serovar Typhi Ty2
ugcccccgaucacggcgaa

SEQ ID NO: 3746768 - RNA, 15 nt, Salmonella enterica enterica serovar Typhi Ty2
ugccccucccugaau

SEQ ID NO: 3746769 - RNA, 14 nt, Salmonella enterica enterica serovar Typhi Ty2
ugccccugaccgaa

SEQ ID NO: 3746770 - RNA, 21 nt, Salmonella enterica enterica serovar Typhi Ty2
ugccccugaccgaagguuacc

SEQ ID NO: 3746771 - RNA, 17 nt, Salmonella enterica enterica serovar Typhi Ty2
ugcccgagugacugaca

SEQ ID NO: 3746772 - RNA, 18 nt, Salmonella enterica enterica serovar Typhi Ty2
ugcccgauagugcaagcu

SEQ ID NO: 3746773 - RNA, 20 nt, Salmonella enterica enterica serovar Typhi Ty2
ugcccgcaaucucuggccag

SEQ ID NO: 3746774 - RNA, 13 nt, Salmonella enterica enterica serovar Typhi Ty2
ugcccgccagcgg

SEQ ID NO: 3746775 - RNA, 17 nt, Salmonella enterica enterica serovar Typhi Ty2
ugcccgccagcgggccg

SEQ ID NO: 3746776 - RNA, 18 nt, Salmonella enterica enterica serovar Typhi Ty2
ugcccgccguuaaaucau

SEQ ID NO: 3746777 - RNA, 19 nt, Salmonella enterica enterica serovar Typhi Ty2
ugcccggcgcggcaucauc

SEQ ID NO: 3746778 - RNA, 17 nt, Salmonella enterica enterica serovar Typhi Ty2
ugcccggggugaacaaa

SEQ ID NO: 3746779 - RNA, 16 nt, Salmonella enterica enterica serovar Typhi Ty2
ugcccgguggcgcugc

SEQ ID NO: 3746780 - RNA, 19 nt, Salmonella enterica enterica serovar Typhi Ty2
ugcccgguggcgcugcgcu

SEQ ID NO: 3746781 - RNA, 18 nt, Salmonella enterica enterica serovar Typhi Ty2
ugccguaggcgacgccaa

SEQ ID NO: 3746782 - RNA, 20 nt, Salmonella enterica enterica serovar Typhi Ty2
ugccgucaaacaagccgcca

SEQ ID NO: 3746783 - RNA, 21 nt, Salmonella enterica enterica serovar Typhi Ty2
ugccgucaaacaagccgccaa

SEQ ID NO: 3746784 - RNA, 13 nt, Salmonella enterica enterica serovar Typhi Ty2
ugccgucaucgac

SEQ ID NO: 3746785 - RNA, 21 nt, Salmonella enterica enterica serovar Typhi Ty2
ugccguccggucuacaaguga

SEQ ID NO: 3746786 - RNA, 20 nt, Salmonella enterica enterica serovar Typhi Ty2
ugccgucgaugucgccgccg

SEQ ID NO: 3746787 - RNA, 19 nt, Salmonella enterica enterica serovar Typhi Ty2
ugccgucgcggcuuucagc

SEQ ID NO: 3746788 - RNA, 13 nt, Salmonella enterica enterica serovar Typhi Ty2
ugccgucguacuc

SEQ ID NO: 3746789 - RNA, 16 nt, Salmonella enterica enterica serovar Typhi Ty2
ugccgugaaaacgaau

SEQ ID NO: 3746790 - RNA, 20 nt, Salmonella enterica enterica serovar Typhi Ty2
ugccgugaauauucagaucg

SEQ ID NO: 3746791 - RNA, 18 nt, Salmonella enterica enterica serovar Typhi Ty2
ugccgugcauguccagac

SEQ ID NO: 3746792 - RNA, 14 nt, Salmonella enterica enterica serovar Typhi Ty2
ugccguuaauaaug

SEQ ID NO: 3746793 - RNA, 19 nt, Salmonella enterica enterica serovar Typhi Ty2
ugccguuggcgcgaaucca

SEQ ID NO: 3746794 - RNA, 16 nt, Salmonella enterica enterica serovar Typhi Ty2
ugccguuuaugcagga

SEQ ID NO: 3746795 - RNA, 21 nt, Salmonella enterica enterica serovar Typhi Ty2
ugccguuugcgccagcccggc

SEQ ID NO: 3746796 - RNA, 12 nt, Salmonella enterica enterica serovar Typhi Ty2
ugccguuuucaa

SEQ ID NO: 3746797 - RNA, 19 nt, Salmonella enterica enterica serovar Typhi Ty2
ugccguuuuucucaucaag

SEQ ID NO: 3746798 - RNA, 15 nt, Salmonella enterica enterica serovar Typhi Ty2
ugccuaaagaaaaac

SEQ ID NO: 3746799 - RNA, 20 nt, Salmonella enterica enterica serovar Typhi Ty2
ugccuaagauggcgccuugc

SEQ ID NO: 3746800 - RNA, 12 nt, Salmonella enterica enterica serovar Typhi Ty2
ugccuaccgggc

SEQ ID NO: 3746801 - RNA, 14 nt, Salmonella enterica enterica serovar Typhi Ty2
ugccuacgcggcca

SEQ ID NO: 3746802 - RNA, 19 nt, Salmonella enterica enterica serovar Typhi Ty2
ugccucaacaaguccuucu

SEQ ID NO: 3746803 - RNA, 19 nt, Salmonella enterica enterica serovar Typhi Ty2
ugccucaccccauggcguc

SEQ ID NO: 3746804 - RNA, 17 nt, Salmonella enterica enterica serovar Typhi Ty2
ugccucccguuucagug

SEQ ID NO: 3746805 - RNA, 15 nt, Salmonella enterica enterica serovar Typhi Ty2
ugccucgcgcaccau

SEQ ID NO: 3746806 - RNA, 17 nt, Salmonella enterica enterica serovar Typhi Ty2
ugccucguuucccucau

SEQ ID NO: 3746807 - RNA, 19 nt, Salmonella enterica enterica serovar Typhi Ty2
ugccucguuucccucauau

SEQ ID NO: 3746808 - RNA, 18 nt, Salmonella enterica enterica serovar Typhi Ty2
ugccucuggccaguuuca

SEQ ID NO: 3746809 - RNA, 14 nt, Salmonella enterica enterica serovar Typhi Ty2
ugccucuuccggua

SEQ ID NO: 3746810 - RNA, 14 nt, Salmonella enterica enterica serovar Typhi Ty2
ugccugaaccggug

SEQ ID NO: 3746811 - RNA, 23 nt, Salmonella enterica enterica serovar Typhi Ty2
ugccugaaggcgcuaugcuuacc

SEQ ID NO: 3746812 - RNA, 20 nt, Salmonella enterica enterica serovar Typhi Ty2
ugccugacaaugacgcuucg

SEQ ID NO: 3746813 - RNA, 14 nt, Salmonella enterica enterica serovar Typhi Ty2
ugccugaucgccac

SEQ ID NO: 3746814 - RNA, 17 nt, Salmonella enterica enterica serovar Typhi Ty2
ugccugauuucccaguu

SEQ ID NO: 3746815 - RNA, 15 nt, Salmonella enterica enterica serovar Typhi Ty2
ugccugccgccucca

SEQ ID NO: 3746816 - RNA, 22 nt, Salmonella enterica enterica serovar Typhi Ty2
ugccugccguuuuuaacgccgg

SEQ ID NO: 3746817 - RNA, 14 nt, Salmonella enterica enterica serovar Typhi Ty2
ugccugcuccgcca

SEQ ID NO: 3746818 - RNA, 23 nt, Salmonella enterica enterica serovar Typhi Ty2
ugccuggauaauaagacgccagu

SEQ ID NO: 3746819 - RNA, 21 nt, Salmonella enterica enterica serovar Typhi Ty2
ugccuggcaacaugaccagcg

SEQ ID NO: 3746820 - RNA, 15 nt, Salmonella enterica enterica serovar Typhi Ty2
ugccuggccuccggc

SEQ ID NO: 3746821 - RNA, 15 nt, Salmonella enterica enterica serovar Typhi Ty2
ugccuggcucauucu

SEQ ID NO: 3746822 - RNA, 16 nt, Salmonella enterica enterica serovar Typhi Ty2
ugccuggguuccaggc

SEQ ID NO: 3746823 - RNA, 13 nt, Salmonella enterica enterica serovar Typhi Ty2
ugccuguccggag

SEQ ID NO: 3746824 - RNA, 18 nt, Salmonella enterica enterica serovar Typhi Ty2
ugccugucgucaccugua

SEQ ID NO: 3746825 - RNA, 18 nt, Salmonella enterica enterica serovar Typhi Ty2
ugccuguugcgggccagc

SEQ ID NO: 3746826 - RNA, 18 nt, Salmonella enterica enterica serovar Typhi Ty2
ugccuguuuacggcaggc

SEQ ID NO: 3746827 - RNA, 14 nt, Salmonella enterica enterica serovar Typhi Ty2
ugccuuauccggcc

SEQ ID NO: 3746828 - RNA, 18 nt, Salmonella enterica enterica serovar Typhi Ty2
ugccuucaaauauauuga

SEQ ID NO: 3746829 - RNA, 16 nt, Salmonella enterica enterica serovar Typhi Ty2
ugccuucauccgcacg

SEQ ID NO: 3746830 - RNA, 23 nt, Salmonella enterica enterica serovar Typhi Ty2
ugccuuccgggcggcugucccag

SEQ ID NO: 3746831 - RNA, 17 nt, Salmonella enterica enterica serovar Typhi Ty2
ugccuucggcgcuggga

SEQ ID NO: 3746832 - RNA, 22 nt, Salmonella enterica enterica serovar Typhi Ty2
ugccuucuuuggugcgacgcca

SEQ ID NO: 3746833 - RNA, 17 nt, Salmonella enterica enterica serovar Typhi Ty2
ugccuuguaggccugau

SEQ ID NO: 3746834 - RNA, 22 nt, Salmonella enterica enterica serovar Typhi Ty2
ugccuugugucacauuuucuug

SEQ ID NO: 3746835 - RNA, 18 nt, Salmonella enterica enterica serovar Typhi Ty2
ugccuuuaacaaauuaaa

SEQ ID NO: 3746836 - RNA, 19 nt, Salmonella enterica enterica serovar Typhi Ty2
ugccuuuaacaaauuaaau

SEQ ID NO: 3746837 - RNA, 23 nt, Salmonella enterica enterica serovar Typhi Ty2
ugccuuuaacaaauuaaauccug

SEQ ID NO: 3746838 - RNA, 14 nt, Salmonella enterica enterica serovar Typhi Ty2
ugccuuuacuguug

SEQ ID NO: 3746839 - RNA, 16 nt, Salmonella enterica enterica serovar Typhi Ty2
ugccuuuauuucaagc

SEQ ID NO: 3746840 - RNA, 12 nt, Salmonella enterica enterica serovar Typhi Ty2
ugccuuucagau

SEQ ID NO: 3746841 - RNA, 19 nt, Salmonella enterica enterica serovar Typhi Ty2
ugccuuuuucccacugcgc

SEQ ID NO: 3746842 - RNA, 17 nt, Salmonella enterica enterica serovar Typhi Ty2
ugccuuuuuuaccaauu

SEQ ID NO: 3746843 - RNA, 18 nt, Salmonella enterica enterica serovar Typhi Ty2
ugcgaaaauacucccggc

SEQ ID NO: 3746844 - RNA, 14 nt, Salmonella enterica enterica serovar Typhi Ty2
ugcgaaagccucuu

SEQ ID NO: 3746845 - RNA, 19 nt, Salmonella enterica enterica serovar Typhi Ty2
ugcgaaagccucuuccgcc

SEQ ID NO: 3746846 - RNA, 20 nt, Salmonella enterica enterica serovar Typhi Ty2
ugcgaacagcgcuccacgcg

SEQ ID NO: 3746847 - RNA, 16 nt, Salmonella enterica enterica serovar Typhi Ty2
ugcgaauaaacacaua

SEQ ID NO: 3746848 - RNA, 15 nt, Salmonella enterica enterica serovar Typhi Ty2
ugcgaaugcuggcug

SEQ ID NO: 3746849 - RNA, 14 nt, Salmonella enterica enterica serovar Typhi Ty2
ugcgaauuucggca

SEQ ID NO: 3746850 - RNA, 22 nt, Salmonella enterica enterica serovar Typhi Ty2
ugcgacaacaaguccaaguaug

SEQ ID NO: 3746851 - RNA, 18 nt, Salmonella enterica enterica serovar Typhi Ty2
ugcgacaacaaugaaacg

SEQ ID NO: 3746852 - RNA, 14 nt, Salmonella enterica enterica serovar Typhi Ty2
ugcgacaagcucau

SEQ ID NO: 3746853 - RNA, 19 nt, Salmonella enterica enterica serovar Typhi Ty2
ugcgacacgcugcauauaa

SEQ ID NO: 3746854 - RNA, 15 nt, Salmonella enterica enterica serovar Typhi Ty2
ugcgaccacuccggc

SEQ ID NO: 3746855 - RNA, 18 nt, Salmonella enterica enterica serovar Typhi Ty2
ugcgaccgcgccacggcc

SEQ ID NO: 3746856 - RNA, 20 nt, Salmonella enterica enterica serovar Typhi Ty2
ugcgacgccaggcgccacga

SEQ ID NO: 3746857 - RNA, 11 nt, Salmonella enterica enterica serovar Typhi Ty2
ugcgagaaaaa

SEQ ID NO: 3746858 - RNA, 12 nt, Salmonella enterica enterica serovar Typhi Ty2
ugcgagaccauc

SEQ ID NO: 3746859 - RNA, 18 nt, Salmonella enterica enterica serovar Typhi Ty2
ugcgagcaguucagcagc

SEQ ID NO: 3746860 - RNA, 17 nt, Salmonella enterica enterica serovar Typhi Ty2
ugcgagcuuuccaccag

SEQ ID NO: 3746861 - RNA, 11 nt, Salmonella enterica enterica serovar Typhi Ty2
ugcgaggcgcg

SEQ ID NO: 3746862 - RNA, 23 nt, Salmonella enterica enterica serovar Typhi Ty2
ugcgaggcgcgcucauuuuauug

SEQ ID NO: 3746863 - RNA, 12 nt, Salmonella enterica enterica serovar Typhi Ty2
ugcgcgcuauuc

SEQ ID NO: 3746864 - RNA, 21 nt, Salmonella enterica enterica serovar Typhi Ty2
ugcgcggauuaagcgaaucca

SEQ ID NO: 3746865 - RNA, 22 nt, Salmonella enterica enterica serovar Typhi Ty2
ugcgcggcacacuuucaucagc

SEQ ID NO: 3746866 - RNA, 23 nt, Salmonella enterica enterica serovar Typhi Ty2
ugcgcggcacacuuucaucagcc

SEQ ID NO: 3746867 - RNA, 22 nt, Salmonella enterica enterica serovar Typhi Ty2
ugcgcggcgacgcgaggcuuuu

SEQ ID NO: 3746868 - RNA, 20 nt, Salmonella enterica enterica serovar Typhi Ty2
ugcgcgggcguauagccagg

SEQ ID NO: 3746869 - RNA, 16 nt, Salmonella enterica enterica serovar Typhi Ty2
ugcgcgguccacaggc

SEQ ID NO: 3746870 - RNA, 17 nt, Salmonella enterica enterica serovar Typhi Ty2
ugcgcgguccacaggcc

SEQ ID NO: 3746871 - RNA, 16 nt, Salmonella enterica enterica serovar Typhi Ty2
ugcgcguaaauuucac

SEQ ID NO: 3746872 - RNA, 20 nt, Salmonella enterica enterica serovar Typhi Ty2
ugcgcguagcccacagguag

SEQ ID NO: 3746873 - RNA, 14 nt, Salmonella enterica enterica serovar Typhi Ty2
ugcgcgucccucuc

SEQ ID NO: 3746874 - RNA, 15 nt, Salmonella enterica enterica serovar Typhi Ty2
ugcgcgucccucucc

SEQ ID NO: 3746875 - RNA, 17 nt, Salmonella enterica enterica serovar Typhi Ty2
ugcgcgucccucuccag

SEQ ID NO: 3746876 - RNA, 21 nt, Salmonella enterica enterica serovar Typhi Ty2
ugcgcgucccucuccagggca

SEQ ID NO: 3746877 - RNA, 21 nt, Salmonella enterica enterica serovar Typhi Ty2
ugcgcgugcgguuuuccugau

SEQ ID NO: 3746878 - RNA, 16 nt, Salmonella enterica enterica serovar Typhi Ty2
ugcgcguucugcucca

SEQ ID NO: 3746879 - RNA, 17 nt, Salmonella enterica enterica serovar Typhi Ty2
ugcgcguucugcuccag

SEQ ID NO: 3746880 - RNA, 17 nt, Salmonella enterica enterica serovar Typhi Ty2
ugcgcguuuagcgccag

SEQ ID NO: 3746881 - RNA, 21 nt, Salmonella enterica enterica serovar Typhi Ty2
ugcgcguuuagcgccagcagc

SEQ ID NO: 3746882 - RNA, 23 nt, Salmonella enterica enterica serovar Typhi Ty2
ugcgcguuuagcgccagcagcau

SEQ ID NO: 3746883 - RNA, 14 nt, Salmonella enterica enterica serovar Typhi Ty2
ugcgcguuuucauc

SEQ ID NO: 3746884 - RNA, 17 nt, Salmonella enterica enterica serovar Typhi Ty2
ugcgcguuuuccaccag

SEQ ID NO: 3746885 - RNA, 12 nt, Salmonella enterica enterica serovar Typhi Ty2
ugcgcuaagcgu

SEQ ID NO: 3746886 - RNA, 15 nt, Salmonella enterica enterica serovar Typhi Ty2
ugcgcuauccgcgcu

SEQ ID NO: 3746887 - RNA, 20 nt, Salmonella enterica enterica serovar Typhi Ty2
ugcgcuauccgcgcucgcca

SEQ ID NO: 3746888 - RNA, 23 nt, Salmonella enterica enterica serovar Typhi Ty2
ugcgcuauguaagguucccugcg

SEQ ID NO: 3746889 - RNA, 18 nt, Salmonella enterica enterica serovar Typhi Ty2
ugcgcucaugcgccuggc

SEQ ID NO: 3746890 - RNA, 17 nt, Salmonella enterica enterica serovar Typhi Ty2
ugcgcucucauagccga

SEQ ID NO: 3746891 - RNA, 22 nt, Salmonella enterica enterica serovar Typhi Ty2
ugcgcugaauagcgcugcggcu

SEQ ID NO: 3746892 - RNA, 14 nt, Salmonella enterica enterica serovar Typhi Ty2
ugcgcugcaaaaag

SEQ ID NO: 3746893 - RNA, 15 nt, Salmonella enterica enterica serovar Typhi Ty2
ugcgcugucaccagc

SEQ ID NO: 3746894 - RNA, 20 nt, Salmonella enterica enterica serovar Typhi Ty2
ugcgcuuaccgggccuacaa

SEQ ID NO: 3746895 - RNA, 20 nt, Salmonella enterica enterica serovar Typhi Ty2
ugcgcuuaccgggccuacag

SEQ ID NO: 3746896 - RNA, 14 nt, Salmonella enterica enterica serovar Typhi Ty2
ugcgcuuaucaggc

SEQ ID NO: 3746897 - RNA, 19 nt, Salmonella enterica enterica serovar Typhi Ty2
ugcgcuuaucaggccuaca

SEQ ID NO: 3746898 - RNA, 16 nt, Salmonella enterica enterica serovar Typhi Ty2
ugcgcuucggccacgg

SEQ ID NO: 3746899 - RNA, 13 nt, Salmonella enterica enterica serovar Typhi Ty2
ugcgcuucggcga

SEQ ID NO: 3746900 - RNA, 18 nt, Salmonella enterica enterica serovar Typhi Ty2
ugcgcuuuuagccaguug

SEQ ID NO: 3746901 - RNA, 16 nt, Salmonella enterica enterica serovar Typhi Ty2
ugcgcuuuuccaggcg

SEQ ID NO: 3746902 - RNA, 14 nt, Salmonella enterica enterica serovar Typhi Ty2
ugcggaacaccagc

SEQ ID NO: 3746903 - RNA, 15 nt, Salmonella enterica enterica serovar Typhi Ty2
ugcggaacaccagcg

SEQ ID NO: 3746904 - RNA, 17 nt, Salmonella enterica enterica serovar Typhi Ty2
ugcggaacaccagcgcc

SEQ ID NO: 3746905 - RNA, 18 nt, Salmonella enterica enterica serovar Typhi Ty2
ugcggaacaccagcgccg

SEQ ID NO: 3746906 - RNA, 21 nt, Salmonella enterica enterica serovar Typhi Ty2
ugcggaacaccagcgccgcgg

SEQ ID NO: 3746907 - RNA, 17 nt, Salmonella enterica enterica serovar Typhi Ty2
ugcggaauacacgaaca

SEQ ID NO: 3746908 - RNA, 13 nt, Salmonella enterica enterica serovar Typhi Ty2
ugcggacauuaac

SEQ ID NO: 3746909 - RNA, 21 nt, Salmonella enterica enterica serovar Typhi Ty2
ugcggacggcgucuggugaaa

SEQ ID NO: 3746910 - RNA, 19 nt, Salmonella enterica enterica serovar Typhi Ty2
ugcggagaagacgccgccg

SEQ ID NO: 3746911 - RNA, 21 nt, Salmonella enterica enterica serovar Typhi Ty2
ugcggagagagcaauggcgug

SEQ ID NO: 3746912 - RNA, 13 nt, Salmonella enterica enterica serovar Typhi Ty2
ugcggaggccggc

SEQ ID NO: 3746913 - RNA, 16 nt, Salmonella enterica enterica serovar Typhi Ty2
ugcggauuacgaauac

SEQ ID NO: 3746914 - RNA, 17 nt, Salmonella enterica enterica serovar Typhi Ty2
ugcggauuacgaauacc

SEQ ID NO: 3746915 - RNA, 18 nt, Salmonella enterica enterica serovar Typhi Ty2
ugcggcaaaaauccuucu

SEQ ID NO: 3746916 - RNA, 14 nt, Salmonella enterica enterica serovar Typhi Ty2
ugcggcaagcgcgc

SEQ ID NO: 3746917 - RNA, 23 nt, Salmonella enterica enterica serovar Typhi Ty2
ugcggcaauggccgcagcgccau

SEQ ID NO: 3746918 - RNA, 19 nt, Salmonella enterica enterica serovar Typhi Ty2
ugcggcacacagccaaaau

SEQ ID NO: 3746919 - RNA, 18 nt, Salmonella enterica enterica serovar Typhi Ty2
ugcggcagggcggucugg

SEQ ID NO: 3746920 - RNA, 19 nt, Salmonella enterica enterica serovar Typhi Ty2
ugcggcaucagauggcgau

SEQ ID NO: 3746921 - RNA, 16 nt, Salmonella enterica enterica serovar Typhi Ty2
ugcggcaucgaacggg

SEQ ID NO: 3746922 - RNA, 21 nt, Salmonella enterica enterica serovar Typhi Ty2
ugcggccagacaauacuuaaa

SEQ ID NO: 3746923 - RNA, 15 nt, Salmonella enterica enterica serovar Typhi Ty2
ugcggccauccugcg

SEQ ID NO: 3746924 - RNA, 21 nt, Salmonella enterica enterica serovar Typhi Ty2
ugcggccaugaucgccgccau

SEQ ID NO: 3746925 - RNA, 18 nt, Salmonella enterica enterica serovar Typhi Ty2
ugcggccgaugccguaag

SEQ ID NO: 3746926 - RNA, 20 nt, Salmonella enterica enterica serovar Typhi Ty2
ugcggccuugccgccagcgc

SEQ ID NO: 3746927 - RNA, 16 nt, Salmonella enterica enterica serovar Typhi Ty2
ugcggcggccucuuug

SEQ ID NO: 3746928 - RNA, 23 nt, Salmonella enterica enterica serovar Typhi Ty2
ugcggcggggauaaucagcagcg

SEQ ID NO: 3746929 - RNA, 18 nt, Salmonella enterica enterica serovar Typhi Ty2
ugcggcuaauacgccagc

SEQ ID NO: 3746930 - RNA, 17 nt, Salmonella enterica enterica serovar Typhi Ty2
ugcggcuauauaaaauc

SEQ ID NO: 3746931 - RNA, 20 nt, Salmonella enterica enterica serovar Typhi Ty2
ugcggcuauauaaaaucggg

SEQ ID NO: 3746932 - RNA, 18 nt, Salmonella enterica enterica serovar Typhi Ty2
ugcgggaacagauaaaug

SEQ ID NO: 3746933 - RNA, 22 nt, Salmonella enterica enterica serovar Typhi Ty2
ugcgggaguggcgaaauuggua

SEQ ID NO: 3746934 - RNA, 19 nt, Salmonella enterica enterica serovar Typhi Ty2
ugcgggccagcagccaggc

SEQ ID NO: 3746935 - RNA, 22 nt, Salmonella enterica enterica serovar Typhi Ty2
ugcgggccguaaaguucccagc

SEQ ID NO: 3746936 - RNA, 16 nt, Salmonella enterica enterica serovar Typhi Ty2
ugcgggcgaucggcug

SEQ ID NO: 3746937 - RNA, 12 nt, Salmonella enterica enterica serovar Typhi Ty2
ugcggggaacac

SEQ ID NO: 3746938 - RNA, 18 nt, Salmonella enterica enterica serovar Typhi Ty2
ugcggggaacacuaaaac

SEQ ID NO: 3746939 - RNA, 19 nt, Salmonella enterica enterica serovar Typhi Ty2
ugcggggagcgaaaaggcc

SEQ ID NO: 3746940 - RNA, 20 nt, Salmonella enterica enterica serovar Typhi Ty2
ugcggguguccguuccugcc

SEQ ID NO: 3746941 - RNA, 15 nt, Salmonella enterica enterica serovar Typhi Ty2
ugcgguaaauaaugc

SEQ ID NO: 3746942 - RNA, 13 nt, Salmonella enterica enterica serovar Typhi Ty2
ugcgguaccgcgu

SEQ ID NO: 3746943 - RNA, 14 nt, Salmonella enterica enterica serovar Typhi Ty2
ugcgguagcgccga

SEQ ID NO: 3746944 - RNA, 17 nt, Salmonella enterica enterica serovar Typhi Ty2
ugcgguagcuccagaca

SEQ ID NO: 3746945 - RNA, 23 nt, Salmonella enterica enterica serovar Typhi Ty2
ugcugaucgugauaggccagacg

SEQ ID NO: 3746946 - RNA, 19 nt, Salmonella enterica enterica serovar Typhi Ty2
ugcugaucuggcugcguaa

SEQ ID NO: 3746947 - RNA, 22 nt, Salmonella enterica enterica serovar Typhi Ty2
ugcugaugacuaauggcauuuc

SEQ ID NO: 3746948 - RNA, 13 nt, Salmonella enterica enterica serovar Typhi Ty2
ugcugaugcugua

SEQ ID NO: 3746949 - RNA, 17 nt, Salmonella enterica enterica serovar Typhi Ty2
ugcugauggccuuugug

SEQ ID NO: 3746950 - RNA, 21 nt, Salmonella enterica enterica serovar Typhi Ty2
ugcugauguccgcagccgcau

SEQ ID NO: 3746951 - RNA, 15 nt, Salmonella enterica enterica serovar Typhi Ty2
ugcugauuuuggcuu

SEQ ID NO: 3746952 - RNA, 16 nt, Salmonella enterica enterica serovar Typhi Ty2
ugcugcacgucgcgcu

SEQ ID NO: 3746953 - RNA, 14 nt, Salmonella enterica enterica serovar Typhi Ty2
ugcugccagcgccg

SEQ ID NO: 3746954 - RNA, 16 nt, Salmonella enterica enterica serovar Typhi Ty2
ugcugccagucugccc

SEQ ID NO: 3746955 - RNA, 15 nt, Salmonella enterica enterica serovar Typhi Ty2
ugcugccauuuuauc

SEQ ID NO: 3746956 - RNA, 15 nt, Salmonella enterica enterica serovar Typhi Ty2
ugcugcccgccgccg

SEQ ID NO: 3746957 - RNA, 20 nt, Salmonella enterica enterica serovar Typhi Ty2
ugcugccgcagcacccgcuc

SEQ ID NO: 3746958 - RNA, 15 nt, Salmonella enterica enterica serovar Typhi Ty2
ugcugccuacugccc

SEQ ID NO: 3746959 - RNA, 13 nt, Salmonella enterica enterica serovar Typhi Ty2
ugcugcgccagcc

SEQ ID NO: 3746960 - RNA, 14 nt, Salmonella enterica enterica serovar Typhi Ty2
ugcugcgcuuuguc

SEQ ID NO: 3746961 - RNA, 18 nt, Salmonella enterica enterica serovar Typhi Ty2
ugcugcuuuaaccuggcg

SEQ ID NO: 3746962 - RNA, 22 nt, Salmonella enterica enterica serovar Typhi Ty2
ugcugcuuuaaccuggcgcaca

SEQ ID NO: 3746963 - RNA, 11 nt, Salmonella enterica enterica serovar Typhi Ty2
ugcuggcagau

SEQ ID NO: 3746964 - RNA, 20 nt, Salmonella enterica enterica serovar Typhi Ty2
ugcuggccgucauggagacg

SEQ ID NO: 3746965 - RNA, 21 nt, Salmonella enterica enterica serovar Typhi Ty2
ugcuggcgcgucacaacagcc

SEQ ID NO: 3746966 - RNA, 16 nt, Salmonella enterica enterica serovar Typhi Ty2
ugcuggcuuaacucac

SEQ ID NO: 3746967 - RNA, 21 nt, Salmonella enterica enterica serovar Typhi Ty2
ugcugguaccuuuguggcagg

SEQ ID NO: 3746968 - RNA, 20 nt, Salmonella enterica enterica serovar Typhi Ty2
ugcuggucagcaacgccucc

SEQ ID NO: 3746969 - RNA, 18 nt, Salmonella enterica enterica serovar Typhi Ty2
ugcuggucauaacgcuuu

SEQ ID NO: 3746970 - RNA, 14 nt, Salmonella enterica enterica serovar Typhi Ty2
ugcuggugcaucug

SEQ ID NO: 3746971 - RNA, 13 nt, Salmonella enterica enterica serovar Typhi Ty2
ugcuggugguggg

SEQ ID NO: 3746972 - RNA, 15 nt, Salmonella enterica enterica serovar Typhi Ty2
ugcugguugucucaa

SEQ ID NO: 3746973 - RNA, 13 nt, Salmonella enterica enterica serovar Typhi Ty2
ugcuguaaaauau

SEQ ID NO: 3746974 - RNA, 14 nt, Salmonella enterica enterica serovar Typhi Ty2
ugcuguaaaauauc

SEQ ID NO: 3746975 - RNA, 14 nt, Salmonella enterica enterica serovar Typhi Ty2
ugcuguaaccccug

SEQ ID NO: 3746976 - RNA, 16 nt, Salmonella enterica enterica serovar Typhi Ty2
ugcuguaauuuauaaa

SEQ ID NO: 3746977 - RNA, 15 nt, Salmonella enterica enterica serovar Typhi Ty2
ugcuguacauaucca

SEQ ID NO: 3746978 - RNA, 19 nt, Salmonella enterica enterica serovar Typhi Ty2
ugcuguagcgucucaucaa

SEQ ID NO: 3746979 - RNA, 18 nt, Salmonella enterica enterica serovar Typhi Ty2
ugcuguagcugcccggau

SEQ ID NO: 3746980 - RNA, 16 nt, Salmonella enterica enterica serovar Typhi Ty2
ugcuguccgccagcaa

SEQ ID NO: 3746981 - RNA, 23 nt, Salmonella enterica enterica serovar Typhi Ty2
ugcugucgcaauuuaccuauuuc

SEQ ID NO: 3746982 - RNA, 16 nt, Salmonella enterica enterica serovar Typhi Ty2
ugcugucuuagugaaa

SEQ ID NO: 3746983 - RNA, 21 nt, Salmonella enterica enterica serovar Typhi Ty2
ugcugugcagacugcacuucc

SEQ ID NO: 3746984 - RNA, 20 nt, Salmonella enterica enterica serovar Typhi Ty2
ugcugugccaguaccgccgc

SEQ ID NO: 3746985 - RNA, 23 nt, Salmonella enterica enterica serovar Typhi Ty2
ugcuguuaccguaagcgggaugg

SEQ ID NO: 3746986 - RNA, 21 nt, Salmonella enterica enterica serovar Typhi Ty2
ugcuguuucaguaaaucccgc

SEQ ID NO: 3746987 - RNA, 17 nt, Salmonella enterica enterica serovar Typhi Ty2
ugcuuaaugcucugcug

SEQ ID NO: 3746988 - RNA, 20 nt, Salmonella enterica enterica serovar Typhi Ty2
ugcuuaccuuguucuuccau

SEQ ID NO: 3746989 - RNA, 19 nt, Salmonella enterica enterica serovar Typhi Ty2
ugcuuacggcaaacugaaa

SEQ ID NO: 3746990 - RNA, 22 nt, Salmonella enterica enterica serovar Typhi Ty2
ugcuuagcuggccaaucagcgg

SEQ ID NO: 3746991 - RNA, 18 nt, Salmonella enterica enterica serovar Typhi Ty2
ugcuuauguaggccugau

SEQ ID NO: 3746992 - RNA, 22 nt, Salmonella enterica enterica serovar Typhi Ty2
ugcuucacguuuuccaggugcu

SEQ ID NO: 3746993 - RNA, 13 nt, Salmonella enterica enterica serovar Typhi Ty2
ugcuucagccaga

SEQ ID NO: 3746994 - RNA, 14 nt, Salmonella enterica enterica serovar Typhi Ty2
ugcuuccagcucca

SEQ ID NO: 3746995 - RNA, 16 nt, Salmonella enterica enterica serovar Typhi Ty2
ugcuuccaguagccua

SEQ ID NO: 3746996 - RNA, 17 nt, Salmonella enterica enterica serovar Typhi Ty2
ugcuucuugaguuggca

SEQ ID NO: 3746997 - RNA, 15 nt, Salmonella enterica enterica serovar Typhi Ty2
ugcuugagcaggcag

SEQ ID NO: 3746998 - RNA, 14 nt, Salmonella enterica enterica serovar Typhi Ty2
ugcuuuaaaugccu

SEQ ID NO: 3746999 - RNA, 14 nt, Salmonella enterica enterica serovar Typhi Ty2
ugcuuuaauauuca

SEQ ID NO: 3747000 - RNA, 16 nt, Salmonella enterica enterica serovar Typhi Ty2
ugcuuucaauaaauca

SEQ ID NO: 3747001 - RNA, 19 nt, Salmonella enterica enterica serovar Typhi Ty2
ugcuuucgcgauaaucaac

SEQ ID NO: 3747002 - RNA, 16 nt, Salmonella enterica enterica serovar Typhi Ty2
ugcuuucucgggccug

SEQ ID NO: 3747003 - RNA, 22 nt, Salmonella enterica enterica serovar Typhi Ty2
ugcuuugaucacccacaccaca

SEQ ID NO: 3747004 - RNA, 19 nt, Salmonella enterica enterica serovar Typhi Ty2
ugcuuugcaauguucaaua

SEQ ID NO: 3747005 - RNA, 21 nt, Salmonella enterica enterica serovar Typhi Ty2
ugcuuuggccgguucggccag

SEQ ID NO: 3747006 - RNA, 18 nt, Salmonella enterica enterica serovar Typhi Ty2
ugcuuuuggcaacggcag

SEQ ID NO: 3747007 - RNA, 20 nt, Salmonella enterica enterica serovar Typhi Ty2
ugcuuuuuauuuuucuggcu

SEQ ID NO: 3747008 - RNA, 22 nt, Salmonella enterica enterica serovar Typhi Ty2
ugcuuuuugauacagcagcacc

SEQ ID NO: 3747009 - RNA, 23 nt, Salmonella enterica enterica serovar Typhi Ty2
ugcuuuuuuuauuugugauaaag

SEQ ID NO: 3747010 - RNA, 17 nt, Salmonella enterica enterica serovar Typhi Ty2
uggaaaaagaccaauac

SEQ ID NO: 3747011 - RNA, 13 nt, Salmonella enterica enterica serovar Typhi Ty2
uggaaaagaaaac

SEQ ID NO: 3747012 - RNA, 16 nt, Salmonella enterica enterica serovar Typhi Ty2
uggaaaauaauaaucg

SEQ ID NO: 3747013 - RNA, 18 nt, Salmonella enterica enterica serovar Typhi Ty2
uggaaaauaauaaucguu

SEQ ID NO: 3747014 - RNA, 21 nt, Salmonella enterica enterica serovar Typhi Ty2
uggaaacagccaaucauaaac

SEQ ID NO: 3747015 - RNA, 18 nt, Salmonella enterica enterica serovar Typhi Ty2
uggaaaccgcagaagguc

SEQ ID NO: 3747016 - RNA, 19 nt, Salmonella enterica enterica serovar Typhi Ty2
uggaaaccgcagaagguca

SEQ ID NO: 3747017 - RNA, 16 nt, Salmonella enterica enterica serovar Typhi Ty2
uggaaauaaagguuca

SEQ ID NO: 3747018 - RNA, 21 nt, Salmonella enterica enterica serovar Typhi Ty2
uggaaauaccgguaaucaagc

SEQ ID NO: 3747019 - RNA, 19 nt, Salmonella enterica enterica serovar Typhi Ty2
uggaaaugcguggcauuaa

SEQ ID NO: 3747020 - RNA, 19 nt, Salmonella enterica enterica serovar Typhi Ty2
uggaacauccucuccugaa

SEQ ID NO: 3747021 - RNA, 21 nt, Salmonella enterica enterica serovar Typhi Ty2
uggaacuuuaucgcgcggcga

SEQ ID NO: 3747022 - RNA, 14 nt, Salmonella enterica enterica serovar Typhi Ty2
uggaagaaaauaua

SEQ ID NO: 3747023 - RNA, 19 nt, Salmonella enterica enterica serovar Typhi Ty2
uggaagaacuuccccauca

SEQ ID NO: 3747024 - RNA, 19 nt, Salmonella enterica enterica serovar Typhi Ty2
uggaagcguuacuggccuu

SEQ ID NO: 3747025 - RNA, 14 nt, Salmonella enterica enterica serovar Typhi Ty2
uggaagcuguuaau

SEQ ID NO: 3747026 - RNA, 14 nt, Salmonella enterica enterica serovar Typhi Ty2
uggaaguacuggau

SEQ ID NO: 3747027 - RNA, 23 nt, Salmonella enterica enterica serovar Typhi Ty2
uggaaguagucgcgaaugcgcaa

SEQ ID NO: 3747028 - RNA, 20 nt, Salmonella enterica enterica serovar Typhi Ty2
uggaaguugaagaaaaaccc

SEQ ID NO: 3747029 - RNA, 14 nt, Salmonella enterica enterica serovar Typhi Ty2
uggaauaaauauaa

SEQ ID NO: 3747030 - RNA, 13 nt, Salmonella enterica enterica serovar Typhi Ty2
uggaauucuucau

SEQ ID NO: 3747031 - RNA, 12 nt, Salmonella enterica enterica serovar Typhi Ty2
uggaauuuugca

SEQ ID NO: 3747032 - RNA, 15 nt, Salmonella enterica enterica serovar Typhi Ty2
uggacaaaaaaggaa

SEQ ID NO: 3747033 - RNA, 22 nt, Salmonella enterica enterica serovar Typhi Ty2
uggacaaaaaaggaaaaugacg

SEQ ID NO: 3747034 - RNA, 19 nt, Salmonella enterica enterica serovar Typhi Ty2
uggacaaaauuuuuuauca

SEQ ID NO: 3747035 - RNA, 17 nt, Salmonella enterica enterica serovar Typhi Ty2
uggacaaggaucguuac

SEQ ID NO: 3747036 - RNA, 15 nt, Salmonella enterica enterica serovar Typhi Ty2
uggacagauuuccac

SEQ ID NO: 3747037 - RNA, 19 nt, Salmonella enterica enterica serovar Typhi Ty2
uggacagguaaaccgguca

SEQ ID NO: 3747038 - RNA, 14 nt, Salmonella enterica enterica serovar Typhi Ty2
uggaccagccaggc

SEQ ID NO: 3747039 - RNA, 15 nt, Salmonella enterica enterica serovar Typhi Ty2
uggaccgcagcuuau

SEQ ID NO: 3747040 - RNA, 20 nt, Salmonella enterica enterica serovar Typhi Ty2
uggaccgcagcuuauuccag

SEQ ID NO: 3747041 - RNA, 15 nt, Salmonella enterica enterica serovar Typhi Ty2
uggacgaggaaaaau

SEQ ID NO: 3747042 - RNA, 19 nt, Salmonella enterica enterica serovar Typhi Ty2
uggacgcgaaugucauccg

SEQ ID NO: 3747043 - RNA, 13 nt, Salmonella enterica enterica serovar Typhi Ty2
uggacgucaugcc

SEQ ID NO: 3747044 - RNA, 21 nt, Salmonella enterica enterica serovar Typhi Ty2
uggacguggguuucaauauag

SEQ ID NO: 3747045 - RNA, 18 nt, Salmonella enterica enterica serovar Typhi Ty2
uggacuuccauucggcga

SEQ ID NO: 3747046 - RNA, 20 nt, Salmonella enterica enterica serovar Typhi Ty2
uggagagcaucaucugccau

SEQ ID NO: 3747047 - RNA, 19 nt, Salmonella enterica enterica serovar Typhi Ty2
uggagaggccaccagcgcc

SEQ ID NO: 3747048 - RNA, 14 nt, Salmonella enterica enterica serovar Typhi Ty2
uggagcgagcuggu

SEQ ID NO: 3747049 - RNA, 15 nt, Salmonella enterica enterica serovar Typhi Ty2
uggaggaacagcgcc

SEQ ID NO: 3747050 - RNA, 17 nt, Salmonella enterica enterica serovar Typhi Ty2
uggaggaacagcgccgu

SEQ ID NO: 3747051 - RNA, 12 nt, Salmonella enterica enterica serovar Typhi Ty2
uggaggccaaua

SEQ ID NO: 3747052 - RNA, 22 nt, Salmonella enterica enterica serovar Typhi Ty2
uggaggccaauauugccgccau

SEQ ID NO: 3747053 - RNA, 19 nt, Salmonella enterica enterica serovar Typhi Ty2
uggagguuauccugaaagg

SEQ ID NO: 3747054 - RNA, 19 nt, Salmonella enterica enterica serovar Typhi Ty2
uggagguuucuucaucaaa

SEQ ID NO: 3747055 - RNA, 22 nt, Salmonella enterica enterica serovar Typhi Ty2
uggaguacgggcagauggucgc

SEQ ID NO: 3747056 - RNA, 17 nt, Salmonella enterica enterica serovar Typhi Ty2
uggaguagauguagcug

SEQ ID NO: 3747057 - RNA, 18 nt, Salmonella enterica enterica serovar Typhi Ty2
uggagucugaaaauaauu

SEQ ID NO: 3747058 - RNA, 15 nt, Salmonella enterica enterica serovar Typhi Ty2
uggaguuaucauuau

SEQ ID NO: 3747059 - RNA, 23 nt, Salmonella enterica enterica serovar Typhi Ty2
uggaguuuaaacacucuccacca

SEQ ID NO: 3747060 - RNA, 17 nt, Salmonella enterica enterica serovar Typhi Ty2
uggaguuucaucagcac

SEQ ID NO: 3747061 - RNA, 15 nt, Salmonella enterica enterica serovar Typhi Ty2
uggauaaauaggcug

SEQ ID NO: 3747062 - RNA, 15 nt, Salmonella enterica enterica serovar Typhi Ty2
uggauaaaucgguca

SEQ ID NO: 3747063 - RNA, 13 nt, Salmonella enterica enterica serovar Typhi Ty2
uggauaaccugcc

SEQ ID NO: 3747064 - RNA, 14 nt, Salmonella enterica enterica serovar Typhi Ty2
uggauaaccugccg

SEQ ID NO: 3747065 - RNA, 17 nt, Salmonella enterica enterica serovar Typhi Ty2
uggauaacgaaaagggu

SEQ ID NO: 3747066 - RNA, 13 nt, Salmonella enterica enterica serovar Typhi Ty2
uggauaaggcgug

SEQ ID NO: 3747067 - RNA, 18 nt, Salmonella enterica enterica serovar Typhi Ty2
uggauaaggcgugagcca

SEQ ID NO: 3747068 - RNA, 14 nt, Salmonella enterica enterica serovar Typhi Ty2
uggauaccgcacug

SEQ ID NO: 3747069 - RNA, 16 nt, Salmonella enterica enterica serovar Typhi Ty2
uggauacguuccagca

SEQ ID NO: 3747070 - RNA, 16 nt, Salmonella enterica enterica serovar Typhi Ty2
uggauagcaauuucag

SEQ ID NO: 3747071 - RNA, 17 nt, Salmonella enterica enterica serovar Typhi Ty2
uggauagcaauuucagc

SEQ ID NO: 3747072 - RNA, 21 nt, Salmonella enterica enterica serovar Typhi Ty2
uggauagcaccauaaacggca

SEQ ID NO: 3747073 - RNA, 17 nt, Salmonella enterica enterica serovar Typhi Ty2
uggauagucaggcgaug

SEQ ID NO: 3747074 - RNA, 15 nt, Salmonella enterica enterica serovar Typhi Ty2
uggauagucuucaag

SEQ ID NO: 3747075 - RNA, 15 nt, Salmonella enterica enterica serovar Typhi Ty2
uggaucagaagcuuc

SEQ ID NO: 3747076 - RNA, 14 nt, Salmonella enterica enterica serovar Typhi Ty2
uggaucgcuccauu

SEQ ID NO: 3747077 - RNA, 16 nt, Salmonella enterica enterica serovar Typhi Ty2
uggaucggaaaucaaa

SEQ ID NO: 3747078 - RNA, 14 nt, Salmonella enterica enterica serovar Typhi Ty2
uggaugaacucaau

SEQ ID NO: 3747079 - RNA, 13 nt, Salmonella enterica enterica serovar Typhi Ty2
uggaugcguucaa

SEQ ID NO: 3747080 - RNA, 15 nt, Salmonella enterica enterica serovar Typhi Ty2
uggaugguuucuucg

SEQ ID NO: 3747081 - RNA, 17 nt, Salmonella enterica enterica serovar Typhi Ty2
uggauuacaaaaauaga

SEQ ID NO: 3747082 - RNA, 22 nt, Salmonella enterica enterica serovar Typhi Ty2
uggauuaucgaaauagcgguga

SEQ ID NO: 3747083 - RNA, 20 nt, Salmonella enterica enterica serovar Typhi Ty2
uggauucaugaucuuuccuu

SEQ ID NO: 3747084 - RNA, 22 nt, Salmonella enterica enterica serovar Typhi Ty2
uggauuuauggcacaucaggca

SEQ ID NO: 3747085 - RNA, 13 nt, Salmonella enterica enterica serovar Typhi Ty2
uggauuuauggcg

SEQ ID NO: 3747086 - RNA, 15 nt, Salmonella enterica enterica serovar Typhi Ty2
uggauuuauggcguc

SEQ ID NO: 3747087 - RNA, 21 nt, Salmonella enterica enterica serovar Typhi Ty2
uggauuuuccguuaagcugga

SEQ ID NO: 3747088 - RNA, 22 nt, Salmonella enterica enterica serovar Typhi Ty2
uggcaaaaaaggccagacucau

SEQ ID NO: 3747089 - RNA, 15 nt, Salmonella enterica enterica serovar Typhi Ty2
uggcaaaccccugcu

SEQ ID NO: 3747090 - RNA, 22 nt, Salmonella enterica enterica serovar Typhi Ty2
uggcaaaugaagcgacgcuggc

SEQ ID NO: 3747091 - RNA, 18 nt, Salmonella enterica enterica serovar Typhi Ty2
uggcaacaaagccugcug

SEQ ID NO: 3747092 - RNA, 13 nt, Salmonella enterica enterica serovar Typhi Ty2
uggcaacagccau

SEQ ID NO: 3747093 - RNA, 16 nt, Salmonella enterica enterica serovar Typhi Ty2
uggcaacaugaccagc

SEQ ID NO: 3747094 - RNA, 20 nt, Salmonella enterica enterica serovar Typhi Ty2
uggcaagaaccgcuuuuccu

SEQ ID NO: 3747095 - RNA, 21 nt, Salmonella enterica enterica serovar Typhi Ty2
uggcaagaccgauagagacug

SEQ ID NO: 3747096 - RNA, 15 nt, Salmonella enterica enterica serovar Typhi Ty2
uggcaaucauaccgu

SEQ ID NO: 3747097 - RNA, 21 nt, Salmonella enterica enterica serovar Typhi Ty2
uggcaaucauaccgucagauu

SEQ ID NO: 3747098 - RNA, 23 nt, Salmonella enterica enterica serovar Typhi Ty2
uggcaaucauaccgucagauucu

SEQ ID NO: 3747099 - RNA, 13 nt, Salmonella enterica enterica serovar Typhi Ty2
uggcaaucgacgu

SEQ ID NO: 3747100 - RNA, 16 nt, Salmonella enterica enterica serovar Typhi Ty2
uggcacagggcaauaa

SEQ ID NO: 3747101 - RNA, 16 nt, Salmonella enterica enterica serovar Typhi Ty2
uggcacgauaaccaga

SEQ ID NO: 3747102 - RNA, 20 nt, Salmonella enterica enterica serovar Typhi Ty2
uggcacuuuccgguuuccau

SEQ ID NO: 3747103 - RNA, 14 nt, Salmonella enterica enterica serovar Typhi Ty2
uggcagacagccau

SEQ ID NO: 3747104 - RNA, 15 nt, Salmonella enterica enterica serovar Typhi Ty2
uggcagaugaacaua

SEQ ID NO: 3747105 - RNA, 23 nt, Salmonella enterica enterica serovar Typhi Ty2
uggcagcgccugacggcgcuguc

SEQ ID NO: 3747106 - RNA, 18 nt, Salmonella enterica enterica serovar Typhi Ty2
uggcagcggcaguaaauu

SEQ ID NO: 3747107 - RNA, 20 nt, Salmonella enterica enterica serovar Typhi Ty2
uggcaguacagggcgauuuc

SEQ ID NO: 3747108 - RNA, 15 nt, Salmonella enterica enterica serovar Typhi Ty2
uggcagugauggaug

SEQ ID NO: 3747109 - RNA, 16 nt, Salmonella enterica enterica serovar Typhi Ty2
uggcggauacgcuucc

SEQ ID NO: 3747110 - RNA, 12 nt, Salmonella enterica enterica serovar Typhi Ty2
uggcggcaaaaa

SEQ ID NO: 3747111 - RNA, 23 nt, Salmonella enterica enterica serovar Typhi Ty2
uggcggcauaaaugccuuauccg

SEQ ID NO: 3747112 - RNA, 23 nt, Salmonella enterica enterica serovar Typhi Ty2
uggcggcguccggcacgcgcagc

SEQ ID NO: 3747113 - RNA, 21 nt, Salmonella enterica enterica serovar Typhi Ty2
uggcggcuaacgccugauccg

SEQ ID NO: 3747114 - RNA, 23 nt, Salmonella enterica enterica serovar Typhi Ty2
uggcggggagguuauugcucuuu

SEQ ID NO: 3747115 - RNA, 17 nt, Salmonella enterica enterica serovar Typhi Ty2
uggcgguauaacugccu

SEQ ID NO: 3747116 - RNA, 15 nt, Salmonella enterica enterica serovar Typhi Ty2
uggcggugacgucaa

SEQ ID NO: 3747117 - RNA, 21 nt, Salmonella enterica enterica serovar Typhi Ty2
uggcguaaaugugcgccagcc

SEQ ID NO: 3747118 - RNA, 20 nt, Salmonella enterica enterica serovar Typhi Ty2
uggcguaaugcgaugccgca

SEQ ID NO: 3747119 - RNA, 20 nt, Salmonella enterica enterica serovar Typhi Ty2
uggcguaauuaaccgcgccg

SEQ ID NO: 3747120 - RNA, 17 nt, Salmonella enterica enterica serovar Typhi Ty2
uggcguacgcauccgcg

SEQ ID NO: 3747121 - RNA, 17 nt, Salmonella enterica enterica serovar Typhi Ty2
uggcguagauauucccc

SEQ ID NO: 3747122 - RNA, 16 nt, Salmonella enterica enterica serovar Typhi Ty2
uggcguagucucccuc

SEQ ID NO: 3747123 - RNA, 18 nt, Salmonella enterica enterica serovar Typhi Ty2
uggcgucagaccggcaau

SEQ ID NO: 3747124 - RNA, 15 nt, Salmonella enterica enterica serovar Typhi Ty2
uggcguccagcccgu

SEQ ID NO: 3747125 - RNA, 16 nt, Salmonella enterica enterica serovar Typhi Ty2
uggcguccggccacua

SEQ ID NO: 3747126 - RNA, 22 nt, Salmonella enterica enterica serovar Typhi Ty2
uggcguccggccacuauuucgg

SEQ ID NO: 3747127 - RNA, 23 nt, Salmonella enterica enterica serovar Typhi Ty2
uggcguccggccacuauuucggc

SEQ ID NO: 3747128 - RNA, 21 nt, Salmonella enterica enterica serovar Typhi Ty2
uggcgucgccaaagcagcugc

SEQ ID NO: 3747129 - RNA, 17 nt, Salmonella enterica enterica serovar Typhi Ty2
uggcgugaaccgguaaa

SEQ ID NO: 3747130 - RNA, 20 nt, Salmonella enterica enterica serovar Typhi Ty2
uggcguguggcugucgaccg

SEQ ID NO: 3747131 - RNA, 19 nt, Salmonella enterica enterica serovar Typhi Ty2
uggcguuaccucgccgacg

SEQ ID NO: 3747132 - RNA, 19 nt, Salmonella enterica enterica serovar Typhi Ty2
uggcguuccacccaguuca

SEQ ID NO: 3747133 - RNA, 15 nt, Salmonella enterica enterica serovar Typhi Ty2
uggcuaauuucaauu

SEQ ID NO: 3747134 - RNA, 14 nt, Salmonella enterica enterica serovar Typhi Ty2
uggcuagggaaacg

SEQ ID NO: 3747135 - RNA, 17 nt, Salmonella enterica enterica serovar Typhi Ty2
uggcuauacgcggcgua

SEQ ID NO: 3747136 - RNA, 14 nt, Salmonella enterica enterica serovar Typhi Ty2
uggcuaucgccgua

SEQ ID NO: 3747137 - RNA, 17 nt, Salmonella enterica enterica serovar Typhi Ty2
uggcuaucuuuauguca

SEQ ID NO: 3747138 - RNA, 16 nt, Salmonella enterica enterica serovar Typhi Ty2
uggcucaauccaggug

SEQ ID NO: 3747139 - RNA, 18 nt, Salmonella enterica enterica serovar Typhi Ty2
uggcucagauugaacgcu

SEQ ID NO: 3747140 - RNA, 19 nt, Salmonella enterica enterica serovar Typhi Ty2
uggcuccuguugguuauac

SEQ ID NO: 3747141 - RNA, 18 nt, Salmonella enterica enterica serovar Typhi Ty2
uggcucgcuguccgggua

SEQ ID NO: 3747142 - RNA, 14 nt, Salmonella enterica enterica serovar Typhi Ty2
uggcucggccuguc

SEQ ID NO: 3747143 - RNA, 16 nt, Salmonella enterica enterica serovar Typhi Ty2
uggcucggcgucaucc

SEQ ID NO: 3747144 - RNA, 13 nt, Salmonella enterica enterica serovar Typhi Ty2
uggcucuccggua

SEQ ID NO: 3747145 - RNA, 13 nt, Salmonella enterica enterica serovar Typhi Ty2
uggcucugggcca

SEQ ID NO: 3747146 - RNA, 23 nt, Salmonella enterica enterica serovar Typhi Ty2
uggcucuuagcagcauaaacauc

SEQ ID NO: 3747147 - RNA, 15 nt, Salmonella enterica enterica serovar Typhi Ty2
uggcucuugguuuua

SEQ ID NO: 3747148 - RNA, 14 nt, Salmonella enterica enterica serovar Typhi Ty2
uggcugagaaaaau

SEQ ID NO: 3747149 - RNA, 17 nt, Salmonella enterica enterica serovar Typhi Ty2
uggcugagaaaaauacg

SEQ ID NO: 3747150 - RNA, 20 nt, Salmonella enterica enterica serovar Typhi Ty2
uggcugaggccgcucgccau

SEQ ID NO: 3747151 - RNA, 14 nt, Salmonella enterica enterica serovar Typhi Ty2
uggcuggcauauug

SEQ ID NO: 3747152 - RNA, 15 nt, Salmonella enterica enterica serovar Typhi Ty2
uggcuggccagggca

SEQ ID NO: 3747153 - RNA, 13 nt, Salmonella enterica enterica serovar Typhi Ty2
uggcuggcgcuga

SEQ ID NO: 3747154 - RNA, 16 nt, Salmonella enterica enterica serovar Typhi Ty2
uggcuggggcguuauc

SEQ ID NO: 3747155 - RNA, 16 nt, Salmonella enterica enterica serovar Typhi Ty2
uggcuggguaaaauca

SEQ ID NO: 3747156 - RNA, 13 nt, Salmonella enterica enterica serovar Typhi Ty2
uggcugguggccu

SEQ ID NO: 3747157 - RNA, 23 nt, Salmonella enterica enterica serovar Typhi Ty2
uggcuguagauacugaccaagcg

SEQ ID NO: 3747158 - RNA, 15 nt, Salmonella enterica enterica serovar Typhi Ty2
uggcugucguuucau

SEQ ID NO: 3747159 - RNA, 19 nt, Salmonella enterica enterica serovar Typhi Ty2
uggcugucguuucauguaa

SEQ ID NO: 3747160 - RNA, 13 nt, Salmonella enterica enterica serovar Typhi Ty2
uggcugucuuccg

SEQ ID NO: 3747161 - RNA, 15 nt, Salmonella enterica enterica serovar Typhi Ty2
uggcugugccaauaa

SEQ ID NO: 3747162 - RNA, 18 nt, Salmonella enterica enterica serovar Typhi Ty2
uggcuuaaucauugcuca

SEQ ID NO: 3747163 - RNA, 23 nt, Salmonella enterica enterica serovar Typhi Ty2
uggcuuaccguaugcaaaaggca

SEQ ID NO: 3747164 - RNA, 14 nt, Salmonella enterica enterica serovar Typhi Ty2
uggcuugcggguuu

SEQ ID NO: 3747165 - RNA, 17 nt, Salmonella enterica enterica serovar Typhi Ty2
uggcuuuauauaaaaaa

SEQ ID NO: 3747166 - RNA, 14 nt, Salmonella enterica enterica serovar Typhi Ty2
uggcuuucauccaa

SEQ ID NO: 3747167 - RNA, 16 nt, Salmonella enterica enterica serovar Typhi Ty2
uggcuuucuacuacaa

SEQ ID NO: 3747168 - RNA, 18 nt, Salmonella enterica enterica serovar Typhi Ty2
uggcuuuguuaaacguaa

SEQ ID NO: 3747169 - RNA, 18 nt, Salmonella enterica enterica serovar Typhi Ty2
uggcuuuuaagguuaauu

SEQ ID NO: 3747170 - RNA, 21 nt, Salmonella enterica enterica serovar Typhi Ty2
ugggaaaauuaaucccaaccc

SEQ ID NO: 3747171 - RNA, 19 nt, Salmonella enterica enterica serovar Typhi Ty2
ugggaaauaacguuacauu

SEQ ID NO: 3747172 - RNA, 14 nt, Salmonella enterica enterica serovar Typhi Ty2
ugggaauaggccgc

SEQ ID NO: 3747173 - RNA, 16 nt, Salmonella enterica enterica serovar Typhi Ty2
ugggaauuagcgaauc

SEQ ID NO: 3747174 - RNA, 22 nt, Salmonella enterica enterica serovar Typhi Ty2
ugggauaggcucuuauucaauc

SEQ ID NO: 3747175 - RNA, 14 nt, Salmonella enterica enterica serovar Typhi Ty2
ugggauauuacaga

SEQ ID NO: 3747176 - RNA, 15 nt, Salmonella enterica enterica serovar Typhi Ty2
ugggauugcaaaaaa

SEQ ID NO: 3747177 - RNA, 17 nt, Salmonella enterica enterica serovar Typhi Ty2
ugggauuugaugcccaa

SEQ ID NO: 3747178 - RNA, 16 nt, Salmonella enterica enterica serovar Typhi Ty2
ugggcacucgaagaua

SEQ ID NO: 3747179 - RNA, 12 nt, Salmonella enterica enterica serovar Typhi Ty2
ugggcagaaacg

SEQ ID NO: 3747180 - RNA, 17 nt, Salmonella enterica enterica serovar Typhi Ty2
ugggcaggaacagauac

SEQ ID NO: 3747181 - RNA, 13 nt, Salmonella enterica enterica serovar Typhi Ty2
ugggccagcagcg

SEQ ID NO: 3747182 - RNA, 20 nt, Salmonella enterica enterica serovar Typhi Ty2
ugggccggguauaccaucgg

SEQ ID NO: 3747183 - RNA, 15 nt, Salmonella enterica enterica serovar Typhi Ty2
ugggcguaagaaaag

SEQ ID NO: 3747184 - RNA, 16 nt, Salmonella enterica enterica serovar Typhi Ty2
ugggcguaagaaaagu

SEQ ID NO: 3747185 - RNA, 17 nt, Salmonella enterica enterica serovar Typhi Ty2
ugggcgugcugacggag

SEQ ID NO: 3747186 - RNA, 23 nt, Salmonella enterica enterica serovar Typhi Ty2
ugggcgugucgccggggcgcugg

SEQ ID NO: 3747187 - RNA, 21 nt, Salmonella enterica enterica serovar Typhi Ty2
ugggcucaucaaacagcggca

SEQ ID NO: 3747188 - RNA, 15 nt, Salmonella enterica enterica serovar Typhi Ty2
ugggcugagaaaaau

SEQ ID NO: 3747189 - RNA, 14 nt, Salmonella enterica enterica serovar Typhi Ty2
ugggcuuaaugcgc

SEQ ID NO: 3747190 - RNA, 21 nt, Salmonella enterica enterica serovar Typhi Ty2
ugggcuuuuaaccacgcaauc

SEQ ID NO: 3747191 - RNA, 15 nt, Salmonella enterica enterica serovar Typhi Ty2
uggugugcauggugu

SEQ ID NO: 3747192 - RNA, 23 nt, Salmonella enterica enterica serovar Typhi Ty2
ugguguuaagguagacgcgguga

SEQ ID NO: 3747193 - RNA, 16 nt, Salmonella enterica enterica serovar Typhi Ty2
ugguguuaguuucuau

SEQ ID NO: 3747194 - RNA, 15 nt, Salmonella enterica enterica serovar Typhi Ty2
ugguguugguacaca

SEQ ID NO: 3747195 - RNA, 13 nt, Salmonella enterica enterica serovar Typhi Ty2
ugguguuuuccag

SEQ ID NO: 3747196 - RNA, 22 nt, Salmonella enterica enterica serovar Typhi Ty2
ugguuaaauucauauuuaaaua

SEQ ID NO: 3747197 - RNA, 21 nt, Salmonella enterica enterica serovar Typhi Ty2
ugguuaacaauauugcgcuua

SEQ ID NO: 3747198 - RNA, 18 nt, Salmonella enterica enterica serovar Typhi Ty2
ugguuaaccaccucauua

SEQ ID NO: 3747199 - RNA, 21 nt, Salmonella enterica enterica serovar Typhi Ty2
ugguuaacgccguuaccagca

SEQ ID NO: 3747200 - RNA, 14 nt, Salmonella enterica enterica serovar Typhi Ty2
ugguuaauucaaaa

SEQ ID NO: 3747201 - RNA, 15 nt, Salmonella enterica enterica serovar Typhi Ty2
ugguuaauuccgcau

SEQ ID NO: 3747202 - RNA, 16 nt, Salmonella enterica enterica serovar Typhi Ty2
ugguuacuauuuuuca

SEQ ID NO: 3747203 - RNA, 19 nt, Salmonella enterica enterica serovar Typhi Ty2
ugguuagcguaucgacaaa

SEQ ID NO: 3747204 - RNA, 13 nt, Salmonella enterica enterica serovar Typhi Ty2
ugguuauacggua

SEQ ID NO: 3747205 - RNA, 19 nt, Salmonella enterica enterica serovar Typhi Ty2
ugguuauacgguaauaacu

SEQ ID NO: 3747206 - RNA, 18 nt, Salmonella enterica enterica serovar Typhi Ty2
ugguuaucgaauccagca

SEQ ID NO: 3747207 - RNA, 22 nt, Salmonella enterica enterica serovar Typhi Ty2
ugguuauuccgcuggaggccaa

SEQ ID NO: 3747208 - RNA, 14 nt, Salmonella enterica enterica serovar Typhi Ty2
ugguuauuuucaga

SEQ ID NO: 3747209 - RNA, 18 nt, Salmonella enterica enterica serovar Typhi Ty2
ugguucaacaucagcgcu

SEQ ID NO: 3747210 - RNA, 13 nt, Salmonella enterica enterica serovar Typhi Ty2
ugguuccauucca

SEQ ID NO: 3747211 - RNA, 23 nt, Salmonella enterica enterica serovar Typhi Ty2
ugguucccugaccuuccauccac

SEQ ID NO: 3747212 - RNA, 17 nt, Salmonella enterica enterica serovar Typhi Ty2
ugguugaaugaagccuu

SEQ ID NO: 3747213 - RNA, 21 nt, Salmonella enterica enterica serovar Typhi Ty2
ugguugccgcaaaugaccaga

SEQ ID NO: 3747214 - RNA, 15 nt, Salmonella enterica enterica serovar Typhi Ty2
ugguuguagcacagc

SEQ ID NO: 3747215 - RNA, 16 nt, Salmonella enterica enterica serovar Typhi Ty2
ugguuguagcacagcc

SEQ ID NO: 3747216 - RNA, 18 nt, Salmonella enterica enterica serovar Typhi Ty2
ugguuuaaacucugcaaa

SEQ ID NO: 3747217 - RNA, 23 nt, Salmonella enterica enterica serovar Typhi Ty2
ugguuuaauaccgcguaaaaagu

SEQ ID NO: 3747218 - RNA, 21 nt, Salmonella enterica enterica serovar Typhi Ty2
ugguuuaucgccgauugaggg

SEQ ID NO: 3747219 - RNA, 13 nt, Salmonella enterica enterica serovar Typhi Ty2
ugguuucccugcc

SEQ ID NO: 3747220 - RNA, 16 nt, Salmonella enterica enterica serovar Typhi Ty2
ugguuucccugccuca

SEQ ID NO: 3747221 - RNA, 17 nt, Salmonella enterica enterica serovar Typhi Ty2
ugguuucccugccucaa

SEQ ID NO: 3747222 - RNA, 14 nt, Salmonella enterica enterica serovar Typhi Ty2
ugguuucgcgguga

SEQ ID NO: 3747223 - RNA, 19 nt, Salmonella enterica enterica serovar Typhi Ty2
ugguuucggcaugccacug

SEQ ID NO: 3747224 - RNA, 23 nt, Salmonella enterica enterica serovar Typhi Ty2
ugguuugccgcauacaucgcaga

SEQ ID NO: 3747225 - RNA, 11 nt, Salmonella enterica enterica serovar Typhi Ty2
uguaaaaaaau

SEQ ID NO: 3747226 - RNA, 21 nt, Salmonella enterica enterica serovar Typhi Ty2
uguaaaaaaauaaaaaaggca

SEQ ID NO: 3747227 - RNA, 16 nt, Salmonella enterica enterica serovar Typhi Ty2
uguaaaaaauccagcg

SEQ ID NO: 3747228 - RNA, 12 nt, Salmonella enterica enterica serovar Typhi Ty2
uguaaaagccag

SEQ ID NO: 3747229 - RNA, 22 nt, Salmonella enterica enterica serovar Typhi Ty2
uguaaaagggauacgguuuuuu

SEQ ID NO: 3747230 - RNA, 20 nt, Salmonella enterica enterica serovar Typhi Ty2
uguaaaauccggcaggcagc

SEQ ID NO: 3747231 - RNA, 16 nt, Salmonella enterica enterica serovar Typhi Ty2
uguaaaccguuuuucc

SEQ ID NO: 3747232 - RNA, 18 nt, Salmonella enterica enterica serovar Typhi Ty2
uguaaacgcuucugcgcc

SEQ ID NO: 3747233 - RNA, 16 nt, Salmonella enterica enterica serovar Typhi Ty2
uguaaacguuccugcc

SEQ ID NO: 3747234 - RNA, 20 nt, Salmonella enterica enterica serovar Typhi Ty2
uguaaagaaauuuaaagaua

SEQ ID NO: 3747235 - RNA, 15 nt, Salmonella enterica enterica serovar Typhi Ty2
uguaaagaaugaaaa

SEQ ID NO: 3747236 - RNA, 20 nt, Salmonella enterica enterica serovar Typhi Ty2
uguaacagcaggacccgaga

SEQ ID NO: 3747237 - RNA, 17 nt, Salmonella enterica enterica serovar Typhi Ty2
uguaacccgccgccauc

SEQ ID NO: 3747238 - RNA, 20 nt, Salmonella enterica enterica serovar Typhi Ty2
uguaacuucggccagcgagu

SEQ ID NO: 3747239 - RNA, 18 nt, Salmonella enterica enterica serovar Typhi Ty2
uguaagagguauccugaa

SEQ ID NO: 3747240 - RNA, 20 nt, Salmonella enterica enterica serovar Typhi Ty2
uguaagcaauuaauauuuaa

SEQ ID NO: 3747241 - RNA, 22 nt, Salmonella enterica enterica serovar Typhi Ty2
uguaagggaggugcucucccag

SEQ ID NO: 3747242 - RNA, 19 nt, Salmonella enterica enterica serovar Typhi Ty2
uguaaugaaagaaaucacc

SEQ ID NO: 3747243 - RNA, 22 nt, Salmonella enterica enterica serovar Typhi Ty2
uguaauggugggacacugccgg

SEQ ID NO: 3747244 - RNA, 22 nt, Salmonella enterica enterica serovar Typhi Ty2
uguaauuaaggauugccgccuu

SEQ ID NO: 3747245 - RNA, 15 nt, Salmonella enterica enterica serovar Typhi Ty2
uguaauuauaaauau

SEQ ID NO: 3747246 - RNA, 22 nt, Salmonella enterica enterica serovar Typhi Ty2
uguaauucucacagaaucauca

SEQ ID NO: 3747247 - RNA, 14 nt, Salmonella enterica enterica serovar Typhi Ty2
uguaauugacaugg

SEQ ID NO: 3747248 - RNA, 15 nt, Salmonella enterica enterica serovar Typhi Ty2
uguaauugcgccagg

SEQ ID NO: 3747249 - RNA, 17 nt, Salmonella enterica enterica serovar Typhi Ty2
uguaauugcgccaggcc

SEQ ID NO: 3747250 - RNA, 17 nt, Salmonella enterica enterica serovar Typhi Ty2
uguaauuuauaaaguaa

SEQ ID NO: 3747251 - RNA, 15 nt, Salmonella enterica enterica serovar Typhi Ty2
uguacaagaagggua

SEQ ID NO: 3747252 - RNA, 17 nt, Salmonella enterica enterica serovar Typhi Ty2
uguaccagcagcgccag

SEQ ID NO: 3747253 - RNA, 13 nt, Salmonella enterica enterica serovar Typhi Ty2
uguacgcccagcc

SEQ ID NO: 3747254 - RNA, 22 nt, Salmonella enterica enterica serovar Typhi Ty2
uguacggcgucagccacgguuc

SEQ ID NO: 3747255 - RNA, 15 nt, Salmonella enterica enterica serovar Typhi Ty2
uguacuccugauagg

SEQ ID NO: 3747256 - RNA, 15 nt, Salmonella enterica enterica serovar Typhi Ty2
uguacuuuugcuucc

SEQ ID NO: 3747257 - RNA, 18 nt, Salmonella enterica enterica serovar Typhi Ty2
uguacuuuugcuuccagu

SEQ ID NO: 3747258 - RNA, 20 nt, Salmonella enterica enterica serovar Typhi Ty2
uguagaaaagaaggggcugg

SEQ ID NO: 3747259 - RNA, 13 nt, Salmonella enterica enterica serovar Typhi Ty2
uguagcaaauuuc

SEQ ID NO: 3747260 - RNA, 23 nt, Salmonella enterica enterica serovar Typhi Ty2
uguagcaaccucggcuugcuuca

SEQ ID NO: 3747261 - RNA, 16 nt, Salmonella enterica enterica serovar Typhi Ty2
uguagcaacugccagg

SEQ ID NO: 3747262 - RNA, 16 nt, Salmonella enterica enterica serovar Typhi Ty2
uguagcagauagauaa

SEQ ID NO: 3747263 - RNA, 17 nt, Salmonella enterica enterica serovar Typhi Ty2
uguagcagcgccagcgu

SEQ ID NO: 3747264 - RNA, 17 nt, Salmonella enterica enterica serovar Typhi Ty2
uguagcgccaaccggcu

SEQ ID NO: 3747265 - RNA, 18 nt, Salmonella enterica enterica serovar Typhi Ty2
uguagcucauaacucgcu

SEQ ID NO: 3747266 - RNA, 23 nt, Salmonella enterica enterica serovar Typhi Ty2
uguagcugucccagugucaacug

SEQ ID NO: 3747267 - RNA, 19 nt, Salmonella enterica enterica serovar Typhi Ty2
uguaggcccgguaagcgca

SEQ ID NO: 3747268 - RNA, 14 nt, Salmonella enterica enterica serovar Typhi Ty2
uguaggccgaauaa

SEQ ID NO: 3747269 - RNA, 20 nt, Salmonella enterica enterica serovar Typhi Ty2
uguaggccggauaagcauua

SEQ ID NO: 3747270 - RNA, 20 nt, Salmonella enterica enterica serovar Typhi Ty2
uguaggccggauaagcggca

SEQ ID NO: 3747271 - RNA, 20 nt, Salmonella enterica enterica serovar Typhi Ty2
uguaggccggguaagcguaa

SEQ ID NO: 3747272 - RNA, 20 nt, Salmonella enterica enterica serovar Typhi Ty2
uguaggccugauaagcgaag

SEQ ID NO: 3747273 - RNA, 14 nt, Salmonella enterica enterica serovar Typhi Ty2
ugucuauuuauuga

SEQ ID NO: 3747274 - RNA, 21 nt, Salmonella enterica enterica serovar Typhi Ty2
ugucuauuuauugaagaugua

SEQ ID NO: 3747275 - RNA, 17 nt, Salmonella enterica enterica serovar Typhi Ty2
ugucucgucgccagggc

SEQ ID NO: 3747276 - RNA, 23 nt, Salmonella enterica enterica serovar Typhi Ty2
ugucugccucggguggcaucuga

SEQ ID NO: 3747277 - RNA, 13 nt, Salmonella enterica enterica serovar Typhi Ty2
ugucuuaaauaug

SEQ ID NO: 3747278 - RNA, 15 nt, Salmonella enterica enterica serovar Typhi Ty2
ugucuuauccggccu

SEQ ID NO: 3747279 - RNA, 20 nt, Salmonella enterica enterica serovar Typhi Ty2
ugucuucccugaccagcgac

SEQ ID NO: 3747280 - RNA, 18 nt, Salmonella enterica enterica serovar Typhi Ty2
ugucuucgcacugcccuu

SEQ ID NO: 3747281 - RNA, 18 nt, Salmonella enterica enterica serovar Typhi Ty2
ugucuucgucaaugcugc

SEQ ID NO: 3747282 - RNA, 15 nt, Salmonella enterica enterica serovar Typhi Ty2
ugucuugcuaucaaa

SEQ ID NO: 3747283 - RNA, 13 nt, Salmonella enterica enterica serovar Typhi Ty2
ugucuuuauuacg

SEQ ID NO: 3747284 - RNA, 12 nt, Salmonella enterica enterica serovar Typhi Ty2
ugucuuuuucuc

SEQ ID NO: 3747285 - RNA, 12 nt, Salmonella enterica enterica serovar Typhi Ty2
ugugaaacgcga

SEQ ID NO: 3747286 - RNA, 22 nt, Salmonella enterica enterica serovar Typhi Ty2
ugugaacaucacguccucccgu

SEQ ID NO: 3747287 - RNA, 14 nt, Salmonella enterica enterica serovar Typhi Ty2
ugugaaguccguau

SEQ ID NO: 3747288 - RNA, 17 nt, Salmonella enterica enterica serovar Typhi Ty2
ugugacaaucacucucu

SEQ ID NO: 3747289 - RNA, 16 nt, Salmonella enterica enterica serovar Typhi Ty2
ugugaccaacaucauu

SEQ ID NO: 3747290 - RNA, 14 nt, Salmonella enterica enterica serovar Typhi Ty2
ugugaccccggccu

SEQ ID NO: 3747291 - RNA, 20 nt, Salmonella enterica enterica serovar Typhi Ty2
ugugacuucccauucacgua

SEQ ID NO: 3747292 - RNA, 20 nt, Salmonella enterica enterica serovar Typhi Ty2
ugugagauaaaaaagcugcg

SEQ ID NO: 3747293 - RNA, 23 nt, Salmonella enterica enterica serovar Typhi Ty2
ugugagccauaacaacuauuuuu

SEQ ID NO: 3747294 - RNA, 20 nt, Salmonella enterica enterica serovar Typhi Ty2
ugugagcgcccgccgcgaac

SEQ ID NO: 3747295 - RNA, 16 nt, Salmonella enterica enterica serovar Typhi Ty2
ugugauacgcuuuagg

SEQ ID NO: 3747296 - RNA, 15 nt, Salmonella enterica enterica serovar Typhi Ty2
ugugaucaccgcccu

SEQ ID NO: 3747297 - RNA, 16 nt, Salmonella enterica enterica serovar Typhi Ty2
ugugaucaccgcccug

SEQ ID NO: 3747298 - RNA, 21 nt, Salmonella enterica enterica serovar Typhi Ty2
ugugauccgcccccuccagua

SEQ ID NO: 3747299 - RNA, 22 nt, Salmonella enterica enterica serovar Typhi Ty2
ugugaucgccgcgaggaaaauc

SEQ ID NO: 3747300 - RNA, 17 nt, Salmonella enterica enterica serovar Typhi Ty2
ugugaucugguuuggua

SEQ ID NO: 3747301 - RNA, 19 nt, Salmonella enterica enterica serovar Typhi Ty2
ugugauugaauucaccgca

SEQ ID NO: 3747302 - RNA, 12 nt, Salmonella enterica enterica serovar Typhi Ty2
ugugcaggagca

SEQ ID NO: 3747303 - RNA, 18 nt, Salmonella enterica enterica serovar Typhi Ty2
ugugcauaucuggcgagg

SEQ ID NO: 3747304 - RNA, 21 nt, Salmonella enterica enterica serovar Typhi Ty2
ugugccagcucguuauuuccg

SEQ ID NO: 3747305 - RNA, 17 nt, Salmonella enterica enterica serovar Typhi Ty2
ugugccaguaaucccgg

SEQ ID NO: 3747306 - RNA, 20 nt, Salmonella enterica enterica serovar Typhi Ty2
ugugccaguaccgccgccgg

SEQ ID NO: 3747307 - RNA, 15 nt, Salmonella enterica enterica serovar Typhi Ty2
ugugccauacuguuu

SEQ ID NO: 3747308 - RNA, 17 nt, Salmonella enterica enterica serovar Typhi Ty2
ugugccggaaaucgcgg

SEQ ID NO: 3747309 - RNA, 21 nt, Salmonella enterica enterica serovar Typhi Ty2
ugugccgguaagaagaaccag

SEQ ID NO: 3747310 - RNA, 18 nt, Salmonella enterica enterica serovar Typhi Ty2
ugugcgccagccuuaucc

SEQ ID NO: 3747311 - RNA, 19 nt, Salmonella enterica enterica serovar Typhi Ty2
ugugcguauugagcgcagu

SEQ ID NO: 3747312 - RNA, 20 nt, Salmonella enterica enterica serovar Typhi Ty2
ugugcgucgcguucgcauau

SEQ ID NO: 3747313 - RNA, 21 nt, Salmonella enterica enterica serovar Typhi Ty2
ugugcgugacccacaguuuca

SEQ ID NO: 3747314 - RNA, 14 nt, Salmonella enterica enterica serovar Typhi Ty2
ugugcgugaugggc

SEQ ID NO: 3747315 - RNA, 18 nt, Salmonella enterica enterica serovar Typhi Ty2
ugugcuaucaggccuaca

SEQ ID NO: 3747316 - RNA, 15 nt, Salmonella enterica enterica serovar Typhi Ty2
ugugcuuaccgggcc

SEQ ID NO: 3747317 - RNA, 18 nt, Salmonella enterica enterica serovar Typhi Ty2
ugugcuuccagcuccauc

SEQ ID NO: 3747318 - RNA, 21 nt, Salmonella enterica enterica serovar Typhi Ty2
ugugcuuuuuauuuuucuggc

SEQ ID NO: 3747319 - RNA, 17 nt, Salmonella enterica enterica serovar Typhi Ty2
uguggaaacuccagcgg

SEQ ID NO: 3747320 - RNA, 18 nt, Salmonella enterica enterica serovar Typhi Ty2
uguggccaggcacguuaa

SEQ ID NO: 3747321 - RNA, 15 nt, Salmonella enterica enterica serovar Typhi Ty2
uguggcugucgaccg

SEQ ID NO: 3747322 - RNA, 22 nt, Salmonella enterica enterica serovar Typhi Ty2
uguggggggaacggcagacagc

SEQ ID NO: 3747323 - RNA, 16 nt, Salmonella enterica enterica serovar Typhi Ty2
ugugguccaaucguau

SEQ ID NO: 3747324 - RNA, 20 nt, Salmonella enterica enterica serovar Typhi Ty2
uguggucgcggcucaccagc

SEQ ID NO: 3747325 - RNA, 13 nt, Salmonella enterica enterica serovar Typhi Ty2
uguggugcggcuu

SEQ ID NO: 3747326 - RNA, 13 nt, Salmonella enterica enterica serovar Typhi Ty2
ugugguucugcca

SEQ ID NO: 3747327 - RNA, 18 nt, Salmonella enterica enterica serovar Typhi Ty2
ugugguugugguaaucaa

SEQ ID NO: 3747328 - RNA, 13 nt, Salmonella enterica enterica serovar Typhi Ty2
uguguacaaccau

SEQ ID NO: 3747329 - RNA, 15 nt, Salmonella enterica enterica serovar Typhi Ty2
uguguacaaccauca

SEQ ID NO: 3747330 - RNA, 21 nt, Salmonella enterica enterica serovar Typhi Ty2
uguguacauccagaaggcaaa

SEQ ID NO: 3747331 - RNA, 22 nt, Salmonella enterica enterica serovar Typhi Ty2
uguguagagauucugcaggcca

SEQ ID NO: 3747332 - RNA, 14 nt, Salmonella enterica enterica serovar Typhi Ty2
uguguauauauugc

SEQ ID NO: 3747333 - RNA, 14 nt, Salmonella enterica enterica serovar Typhi Ty2
ugugucaaaaaguu

SEQ ID NO: 3747334 - RNA, 18 nt, Salmonella enterica enterica serovar Typhi Ty2
uguguggagguuucuuca

SEQ ID NO: 3747335 - RNA, 14 nt, Salmonella enterica enterica serovar Typhi Ty2
uguguuucagcagc

SEQ ID NO: 3747336 - RNA, 14 nt, Salmonella enterica enterica serovar Typhi Ty2
uguguuuuuuaaua

SEQ ID NO: 3747337 - RNA, 19 nt, Salmonella enterica enterica serovar Typhi Ty2
uguuaaaaagaccaugaac

SEQ ID NO: 3747338 - RNA, 14 nt, Salmonella enterica enterica serovar Typhi Ty2
uguuaaaaccggcu

SEQ ID NO: 3747339 - RNA, 22 nt, Salmonella enterica enterica serovar Typhi Ty2
uguuaaccagauaagccugugc

SEQ ID NO: 3747340 - RNA, 15 nt, Salmonella enterica enterica serovar Typhi Ty2
uguuaauaagcagaa

SEQ ID NO: 3747341 - RNA, 20 nt, Salmonella enterica enterica serovar Typhi Ty2
uguuaaucauuuucuuugca

SEQ ID NO: 3747342 - RNA, 16 nt, Salmonella enterica enterica serovar Typhi Ty2
uguuaaugguaccaau

SEQ ID NO: 3747343 - RNA, 12 nt, Salmonella enterica enterica serovar Typhi Ty2
uguuaccaaugc

SEQ ID NO: 3747344 - RNA, 15 nt, Salmonella enterica enterica serovar Typhi Ty2
uguuacgccaauaau

SEQ ID NO: 3747345 - RNA, 17 nt, Salmonella enterica enterica serovar Typhi Ty2
uguuacucaauaaaagu

SEQ ID NO: 3747346 - RNA, 18 nt, Salmonella enterica enterica serovar Typhi Ty2
uguuauauauuuuucagc

SEQ ID NO: 3747347 - RNA, 16 nt, Salmonella enterica enterica serovar Typhi Ty2
uguuauccuaaaucug

SEQ ID NO: 3747348 - RNA, 17 nt, Salmonella enterica enterica serovar Typhi Ty2
uguuaucuacaguguaa

SEQ ID NO: 3747349 - RNA, 14 nt, Salmonella enterica enterica serovar Typhi Ty2
uguuauuuucaaaa

SEQ ID NO: 3747350 - RNA, 18 nt, Salmonella enterica enterica serovar Typhi Ty2
uguuauuuucaaaaacaa

SEQ ID NO: 3747351 - RNA, 16 nt, Salmonella enterica enterica serovar Typhi Ty2
uguucaagcaauaaug

SEQ ID NO: 3747352 - RNA, 16 nt, Salmonella enterica enterica serovar Typhi Ty2
uguucaagcugguuaa

SEQ ID NO: 3747353 - RNA, 13 nt, Salmonella enterica enterica serovar Typhi Ty2
uguucaauauucc

SEQ ID NO: 3747354 - RNA, 16 nt, Salmonella enterica enterica serovar Typhi Ty2
uguucacaucgcucag

SEQ ID NO: 3747355 - RNA, 12 nt, Salmonella enterica enterica serovar Typhi Ty2
uguuuuucucuu

SEQ ID NO: 3747356 - RNA, 16 nt, Salmonella enterica enterica serovar Typhi Ty2
uguuuuugaaaaugug

SEQ ID NO: 3747357 - RNA, 16 nt, Salmonella enterica enterica serovar Typhi Ty2
uguuuuugcuuuaaua

SEQ ID NO: 3747358 - RNA, 18 nt, Salmonella enterica enterica serovar Typhi Ty2
uguuuuugcuuuaauauu

SEQ ID NO: 3747359 - RNA, 14 nt, Salmonella enterica enterica serovar Typhi Ty2
uguuuuuguaccag

SEQ ID NO: 3747360 - RNA, 16 nt, Salmonella enterica enterica serovar Typhi Ty2
uguuuuuuaauauauu

SEQ ID NO: 3747361 - RNA, 23 nt, Salmonella enterica enterica serovar Typhi Ty2
uguuuuuucaucuccgauaaaua

SEQ ID NO: 3747362 - RNA, 16 nt, Salmonella enterica enterica serovar Typhi Ty2
uguuuuuuguaggccg

SEQ ID NO: 3747363 - RNA, 22 nt, Salmonella enterica enterica serovar Typhi Ty2
uguuuuuuguugauuuuaugau

SEQ ID NO: 3747364 - RNA, 11 nt, Salmonella enterica enterica serovar Typhi Ty2
uuaaaaaaacg

SEQ ID NO: 3747365 - RNA, 15 nt, Salmonella enterica enterica serovar Typhi Ty2
uuaaaaaauccugca

SEQ ID NO: 3747366 - RNA, 22 nt, Salmonella enterica enterica serovar Typhi Ty2
uuaaaaacagguugcguaacgc

SEQ ID NO: 3747367 - RNA, 13 nt, Salmonella enterica enterica serovar Typhi Ty2
uuaaaaagcugca

SEQ ID NO: 3747368 - RNA, 14 nt, Salmonella enterica enterica serovar Typhi Ty2
uuaaaaagcugcau

SEQ ID NO: 3747369 - RNA, 21 nt, Salmonella enterica enterica serovar Typhi Ty2
uuaaaagcgccuuaaaccguc

SEQ ID NO: 3747370 - RNA, 22 nt, Salmonella enterica enterica serovar Typhi Ty2
uuaaaaucggggucuuccagca

SEQ ID NO: 3747371 - RNA, 16 nt, Salmonella enterica enterica serovar Typhi Ty2
uuaaaauugaacggac

SEQ ID NO: 3747372 - RNA, 14 nt, Salmonella enterica enterica serovar Typhi Ty2
uuaaacaguauuua

SEQ ID NO: 3747373 - RNA, 17 nt, Salmonella enterica enterica serovar Typhi Ty2
uuaaacgccugaucauc

SEQ ID NO: 3747374 - RNA, 22 nt, Salmonella enterica enterica serovar Typhi Ty2
uuaaacuggccccgcauuuuac

SEQ ID NO: 3747375 - RNA, 15 nt, Salmonella enterica enterica serovar Typhi Ty2
uuaaagcacaagaac

SEQ ID NO: 3747376 - RNA, 23 nt, Salmonella enterica enterica serovar Typhi Ty2
uuaaagcacaagaacuuaaauua

SEQ ID NO: 3747377 - RNA, 11 nt, Salmonella enterica enterica serovar Typhi Ty2
uuaaagccacg

SEQ ID NO: 3747378 - RNA, 17 nt, Salmonella enterica enterica serovar Typhi Ty2
uuaaagcccugacagaa

SEQ ID NO: 3747379 - RNA, 23 nt, Salmonella enterica enterica serovar Typhi Ty2
uuaaagccgaccaucgcgccgcu

SEQ ID NO: 3747380 - RNA, 13 nt, Salmonella enterica enterica serovar Typhi Ty2
uuaaagccuucau

SEQ ID NO: 3747381 - RNA, 14 nt, Salmonella enterica enterica serovar Typhi Ty2
uuaaauaaacaaaa

SEQ ID NO: 3747382 - RNA, 15 nt, Salmonella enterica enterica serovar Typhi Ty2
uuaaauaacaaauga

SEQ ID NO: 3747383 - RNA, 23 nt, Salmonella enterica enterica serovar Typhi Ty2
uuaaauacugcaacggcgaggug

SEQ ID NO: 3747384 - RNA, 16 nt, Salmonella enterica enterica serovar Typhi Ty2
uuaaauagcaggcaau

SEQ ID NO: 3747385 - RNA, 17 nt, Salmonella enterica enterica serovar Typhi Ty2
uuaaauaugaaagagaa

SEQ ID NO: 3747386 - RNA, 17 nt, Salmonella enterica enterica serovar Typhi Ty2
uuaaaucgcgcaaauau

SEQ ID NO: 3747387 - RNA, 17 nt, Salmonella enterica enterica serovar Typhi Ty2
uuaaaucgcuaagcaga

SEQ ID NO: 3747388 - RNA, 13 nt, Salmonella enterica enterica serovar Typhi Ty2
uuaaaugcgccca

SEQ ID NO: 3747389 - RNA, 23 nt, Salmonella enterica enterica serovar Typhi Ty2
uuaaauguuuuuucaucuccgau

SEQ ID NO: 3747390 - RNA, 21 nt, Salmonella enterica enterica serovar Typhi Ty2
uuaaauuaaugauuaaaauaa

SEQ ID NO: 3747391 - RNA, 19 nt, Salmonella enterica enterica serovar Typhi Ty2
uuaaauucauauuuaaaua

SEQ ID NO: 3747392 - RNA, 17 nt, Salmonella enterica enterica serovar Typhi Ty2
uuaaauugguuauauua

SEQ ID NO: 3747393 - RNA, 15 nt, Salmonella enterica enterica serovar Typhi Ty2
uuaaauuuuuaauaa

SEQ ID NO: 3747394 - RNA, 12 nt, Salmonella enterica enterica serovar Typhi Ty2
uuaacaaaucau

SEQ ID NO: 3747395 - RNA, 20 nt, Salmonella enterica enterica serovar Typhi Ty2
uuaacaauccccgucacagc

SEQ ID NO: 3747396 - RNA, 15 nt, Salmonella enterica enterica serovar Typhi Ty2
uuaacacgauaaaac

SEQ ID NO: 3747397 - RNA, 12 nt, Salmonella enterica enterica serovar Typhi Ty2
uuaacagaauug

SEQ ID NO: 3747398 - RNA, 18 nt, Salmonella enterica enterica serovar Typhi Ty2
uuaacagaauugcgccac

SEQ ID NO: 3747399 - RNA, 16 nt, Salmonella enterica enterica serovar Typhi Ty2
uuaacaucaccuuuca

SEQ ID NO: 3747400 - RNA, 13 nt, Salmonella enterica enterica serovar Typhi Ty2
uuaacaucagaaa

SEQ ID NO: 3747401 - RNA, 17 nt, Salmonella enterica enterica serovar Typhi Ty2
uuaacaucaucaggccu

SEQ ID NO: 3747402 - RNA, 15 nt, Salmonella enterica enterica serovar Typhi Ty2
uuaaccagcaguccu

SEQ ID NO: 3747403 - RNA, 22 nt, Salmonella enterica enterica serovar Typhi Ty2
uuaacccgcuuacaauuuaucu

SEQ ID NO: 3747404 - RNA, 16 nt, Salmonella enterica enterica serovar Typhi Ty2
uuaaccguucuuccug

SEQ ID NO: 3747405 - RNA, 20 nt, Salmonella enterica enterica serovar Typhi Ty2
uuaaccucgcuacuggcaaa

SEQ ID NO: 3747406 - RNA, 16 nt, Salmonella enterica enterica serovar Typhi Ty2
uuaacgaagguaaacg

SEQ ID NO: 3747407 - RNA, 15 nt, Salmonella enterica enterica serovar Typhi Ty2
uuaacgacaaaaaua

SEQ ID NO: 3747408 - RNA, 16 nt, Salmonella enterica enterica serovar Typhi Ty2
uuaacgauaauguugg

SEQ ID NO: 3747409 - RNA, 17 nt, Salmonella enterica enterica serovar Typhi Ty2
uuaacgauaauguuggu

SEQ ID NO: 3747410 - RNA, 16 nt, Salmonella enterica enterica serovar Typhi Ty2
uuaacgauuuccccug

SEQ ID NO: 3747411 - RNA, 13 nt, Salmonella enterica enterica serovar Typhi Ty2
uuaacgcagaaua

SEQ ID NO: 3747412 - RNA, 17 nt, Salmonella enterica enterica serovar Typhi Ty2
uuaacgccggcaaauag

SEQ ID NO: 3747413 - RNA, 22 nt, Salmonella enterica enterica serovar Typhi Ty2
uuaacgcgaaauaaucagguga

SEQ ID NO: 3747414 - RNA, 17 nt, Salmonella enterica enterica serovar Typhi Ty2
uuaacgcgccaucuuuc

SEQ ID NO: 3747415 - RNA, 21 nt, Salmonella enterica enterica serovar Typhi Ty2
uuaacgcguaaucuuccaccc

SEQ ID NO: 3747416 - RNA, 16 nt, Salmonella enterica enterica serovar Typhi Ty2
uuaacggcaaaaacgu

SEQ ID NO: 3747417 - RNA, 15 nt, Salmonella enterica enterica serovar Typhi Ty2
uuaacucaucacagc

SEQ ID NO: 3747418 - RNA, 23 nt, Salmonella enterica enterica serovar Typhi Ty2
uuaacuccgcuggcguuggcuau

SEQ ID NO: 3747419 - RNA, 22 nt, Salmonella enterica enterica serovar Typhi Ty2
uuaacuccuucuaauuccagga

SEQ ID NO: 3747420 - RNA, 22 nt, Salmonella enterica enterica serovar Typhi Ty2
uuaacucuuuuucagcaaauac

SEQ ID NO: 3747421 - RNA, 22 nt, Salmonella enterica enterica serovar Typhi Ty2
uuaacuggcgacgacuucaccc

SEQ ID NO: 3747422 - RNA, 16 nt, Salmonella enterica enterica serovar Typhi Ty2
uuaacuucuccgccau

SEQ ID NO: 3747423 - RNA, 12 nt, Salmonella enterica enterica serovar Typhi Ty2
uuaagaaaguag

SEQ ID NO: 3747424 - RNA, 13 nt, Salmonella enterica enterica serovar Typhi Ty2
uuaagaagucugu

SEQ ID NO: 3747425 - RNA, 23 nt, Salmonella enterica enterica serovar Typhi Ty2
uuaagacgcuucauaucgcccag

SEQ ID NO: 3747426 - RNA, 16 nt, Salmonella enterica enterica serovar Typhi Ty2
uuaagauuuaaaacaa

SEQ ID NO: 3747427 - RNA, 19 nt, Salmonella enterica enterica serovar Typhi Ty2
uuaagcaacguuuccgcua

SEQ ID NO: 3747428 - RNA, 16 nt, Salmonella enterica enterica serovar Typhi Ty2
uuaagcaccgcuuugg

SEQ ID NO: 3747429 - RNA, 21 nt, Salmonella enterica enterica serovar Typhi Ty2
uuaagcauccaggaaguaaau

SEQ ID NO: 3747430 - RNA, 21 nt, Salmonella enterica enterica serovar Typhi Ty2
uuaagcauuaccccguggugg

SEQ ID NO: 3747431 - RNA, 12 nt, Salmonella enterica enterica serovar Typhi Ty2
uuaagcgaaccu

SEQ ID NO: 3747432 - RNA, 22 nt, Salmonella enterica enterica serovar Typhi Ty2
uuaagcggauuuuuucgcuuuu

SEQ ID NO: 3747433 - RNA, 18 nt, Salmonella enterica enterica serovar Typhi Ty2
uuaagcgggucccagaag

SEQ ID NO: 3747434 - RNA, 18 nt, Salmonella enterica enterica serovar Typhi Ty2
uuaagcuuaaugauaauu

SEQ ID NO: 3747435 - RNA, 21 nt, Salmonella enterica enterica serovar Typhi Ty2
uuaagcuuugcaccacuuugu

SEQ ID NO: 3747436 - RNA, 17 nt, Salmonella enterica enterica serovar Typhi Ty2
uuaaggaugaacucuau

SEQ ID NO: 3747437 - RNA, 15 nt, Salmonella enterica enterica serovar Typhi Ty2
uuaccauccauuaaa

SEQ ID NO: 3747438 - RNA, 14 nt, Salmonella enterica enterica serovar Typhi Ty2
uuaccauuacgcua

SEQ ID NO: 3747439 - RNA, 22 nt, Salmonella enterica enterica serovar Typhi Ty2
uuaccauuccucacgaaguuua

SEQ ID NO: 3747440 - RNA, 22 nt, Salmonella enterica enterica serovar Typhi Ty2
uuacccagcaauaguggacaca

SEQ ID NO: 3747441 - RNA, 15 nt, Salmonella enterica enterica serovar Typhi Ty2
uuaccccaggcgaua

SEQ ID NO: 3747442 - RNA, 20 nt, Salmonella enterica enterica serovar Typhi Ty2
uuacccggcguauugguaca

SEQ ID NO: 3747443 - RNA, 22 nt, Salmonella enterica enterica serovar Typhi Ty2
uuacccuuccccggcagccuca

SEQ ID NO: 3747444 - RNA, 14 nt, Salmonella enterica enterica serovar Typhi Ty2
uuaccgcccgcuuc

SEQ ID NO: 3747445 - RNA, 19 nt, Salmonella enterica enterica serovar Typhi Ty2
uuaccgcccuguccuccau

SEQ ID NO: 3747446 - RNA, 16 nt, Salmonella enterica enterica serovar Typhi Ty2
uuaccgcgcucaaaug

SEQ ID NO: 3747447 - RNA, 21 nt, Salmonella enterica enterica serovar Typhi Ty2
uuaccggacggucggcguaau

SEQ ID NO: 3747448 - RNA, 20 nt, Salmonella enterica enterica serovar Typhi Ty2
uuaccgggaaaugucuggcg

SEQ ID NO: 3747449 - RNA, 15 nt, Salmonella enterica enterica serovar Typhi Ty2
uuaccggugcagacc

SEQ ID NO: 3747450 - RNA, 21 nt, Salmonella enterica enterica serovar Typhi Ty2
uuaccuacuguggugugccug

SEQ ID NO: 3747451 - RNA, 19 nt, Salmonella enterica enterica serovar Typhi Ty2
uuaccuauuuguuccggca

SEQ ID NO: 3747452 - RNA, 13 nt, Salmonella enterica enterica serovar Typhi Ty2
uuaccucacggug

SEQ ID NO: 3747453 - RNA, 22 nt, Salmonella enterica enterica serovar Typhi Ty2
uuaccugcgcaaucaugacaga

SEQ ID NO: 3747454 - RNA, 17 nt, Salmonella enterica enterica serovar Typhi Ty2
uuaccuggguagcuucu

SEQ ID NO: 3747455 - RNA, 15 nt, Salmonella enterica enterica serovar Typhi Ty2
uuaccuucugccgcg

SEQ ID NO: 3747456 - RNA, 15 nt, Salmonella enterica enterica serovar Typhi Ty2
uuaccuuuuccggcg

SEQ ID NO: 3747457 - RNA, 13 nt, Salmonella enterica enterica serovar Typhi Ty2
uuacgaaaagguc

SEQ ID NO: 3747458 - RNA, 22 nt, Salmonella enterica enterica serovar Typhi Ty2
uuacgacgggucagauucagca

SEQ ID NO: 3747459 - RNA, 21 nt, Salmonella enterica enterica serovar Typhi Ty2
uuacgauacguuuaaaaugaa

SEQ ID NO: 3747460 - RNA, 19 nt, Salmonella enterica enterica serovar Typhi Ty2
uuacgaucguuugcccauu

SEQ ID NO: 3747461 - RNA, 13 nt, Salmonella enterica enterica serovar Typhi Ty2
uuacgcacaaacc

SEQ ID NO: 3747462 - RNA, 20 nt, Salmonella enterica enterica serovar Typhi Ty2
uuacgcacgccagauaaauc

SEQ ID NO: 3747463 - RNA, 22 nt, Salmonella enterica enterica serovar Typhi Ty2
uuacgcagcaagaacagagcaa

SEQ ID NO: 3747464 - RNA, 23 nt, Salmonella enterica enterica serovar Typhi Ty2
uuacgcccuguggaaacuccagc

SEQ ID NO: 3747465 - RNA, 21 nt, Salmonella enterica enterica serovar Typhi Ty2
uuacgccgcaaucacuucaua

SEQ ID NO: 3747466 - RNA, 12 nt, Salmonella enterica enterica serovar Typhi Ty2
uuacgccgccau

SEQ ID NO: 3747467 - RNA, 18 nt, Salmonella enterica enterica serovar Typhi Ty2
uuacgcucgcugauggcg

SEQ ID NO: 3747468 - RNA, 11 nt, Salmonella enterica enterica serovar Typhi Ty2
uuacgcugccg

SEQ ID NO: 3747469 - RNA, 20 nt, Salmonella enterica enterica serovar Typhi Ty2
uuacgcuuacccggccuaca

SEQ ID NO: 3747470 - RNA, 22 nt, Salmonella enterica enterica serovar Typhi Ty2
uuacggaaaaaauacugauaaa

SEQ ID NO: 3747471 - RNA, 16 nt, Salmonella enterica enterica serovar Typhi Ty2
uuacggaaaaaugucg

SEQ ID NO: 3747472 - RNA, 22 nt, Salmonella enterica enterica serovar Typhi Ty2
uuacggacugcggccugcaaag

SEQ ID NO: 3747473 - RNA, 16 nt, Salmonella enterica enterica serovar Typhi Ty2
uuacggauaaaaaccc

SEQ ID NO: 3747474 - RNA, 21 nt, Salmonella enterica enterica serovar Typhi Ty2
uuacggcacauaggcaaacac

SEQ ID NO: 3747475 - RNA, 15 nt, Salmonella enterica enterica serovar Typhi Ty2
uuacgggaacagaau

SEQ ID NO: 3747476 - RNA, 23 nt, Salmonella enterica enterica serovar Typhi Ty2
uuacguguaguuauaaauuuauu

SEQ ID NO: 3747477 - RNA, 23 nt, Salmonella enterica enterica serovar Typhi Ty2
uuacguugguauucaacgccauc

SEQ ID NO: 3747478 - RNA, 17 nt, Salmonella enterica enterica serovar Typhi Ty2
uuacuaauaaauauuca

SEQ ID NO: 3747479 - RNA, 13 nt, Salmonella enterica enterica serovar Typhi Ty2
uuacuaucuucaa

SEQ ID NO: 3747480 - RNA, 13 nt, Salmonella enterica enterica serovar Typhi Ty2
uuacuauuuuuca

SEQ ID NO: 3747481 - RNA, 14 nt, Salmonella enterica enterica serovar Typhi Ty2
uuacucacugccgc

SEQ ID NO: 3747482 - RNA, 15 nt, Salmonella enterica enterica serovar Typhi Ty2
uuacucacugccgcc

SEQ ID NO: 3747483 - RNA, 15 nt, Salmonella enterica enterica serovar Typhi Ty2
uuacucaguuugccg

SEQ ID NO: 3747484 - RNA, 15 nt, Salmonella enterica enterica serovar Typhi Ty2
uuacuccaaaaauaa

SEQ ID NO: 3747485 - RNA, 12 nt, Salmonella enterica enterica serovar Typhi Ty2
uuacucccgucg

SEQ ID NO: 3747486 - RNA, 15 nt, Salmonella enterica enterica serovar Typhi Ty2
uuacucucauguuca

SEQ ID NO: 3747487 - RNA, 13 nt, Salmonella enterica enterica serovar Typhi Ty2
uuacucucuuucu

SEQ ID NO: 3747488 - RNA, 11 nt, Salmonella enterica enterica serovar Typhi Ty2
uuacucuucca

SEQ ID NO: 3747489 - RNA, 12 nt, Salmonella enterica enterica serovar Typhi Ty2
uuacugaauaaa

SEQ ID NO: 3747490 - RNA, 14 nt, Salmonella enterica enterica serovar Typhi Ty2
uuacugacaauaag

SEQ ID NO: 3747491 - RNA, 11 nt, Salmonella enterica enterica serovar Typhi Ty2
uuacugauaaa

SEQ ID NO: 3747492 - RNA, 16 nt, Salmonella enterica enterica serovar Typhi Ty2
uuacugcaagcgaugu

SEQ ID NO: 3747493 - RNA, 20 nt, Salmonella enterica enterica serovar Typhi Ty2
uuacugcgccagccugcugg

SEQ ID NO: 3747494 - RNA, 18 nt, Salmonella enterica enterica serovar Typhi Ty2
uuacugcucguagcguuu

SEQ ID NO: 3747495 - RNA, 16 nt, Salmonella enterica enterica serovar Typhi Ty2
uuacuguuuuaucagg

SEQ ID NO: 3747496 - RNA, 12 nt, Salmonella enterica enterica serovar Typhi Ty2
uuacuucaggcu

SEQ ID NO: 3747497 - RNA, 14 nt, Salmonella enterica enterica serovar Typhi Ty2
uuacuuguaggccu

SEQ ID NO: 3747498 - RNA, 15 nt, Salmonella enterica enterica serovar Typhi Ty2
uuacuuucauuccuu

SEQ ID NO: 3747499 - RNA, 13 nt, Salmonella enterica enterica serovar Typhi Ty2
uuacuuuuuuaaa

SEQ ID NO: 3747500 - RNA, 20 nt, Salmonella enterica enterica serovar Typhi Ty2
uuagaaaaaauuaaaaauac

SEQ ID NO: 3747501 - RNA, 12 nt, Salmonella enterica enterica serovar Typhi Ty2
uuagaaaaagaa

SEQ ID NO: 3747502 - RNA, 13 nt, Salmonella enterica enterica serovar Typhi Ty2
uuagaaaaagaaa

SEQ ID NO: 3747503 - RNA, 16 nt, Salmonella enterica enterica serovar Typhi Ty2
uuagaaaauacugcua

SEQ ID NO: 3747504 - RNA, 20 nt, Salmonella enterica enterica serovar Typhi Ty2
uuagaaaauauauuggccuu

SEQ ID NO: 3747505 - RNA, 15 nt, Salmonella enterica enterica serovar Typhi Ty2
uuagaagugaagaau

SEQ ID NO: 3747506 - RNA, 22 nt, Salmonella enterica enterica serovar Typhi Ty2
uuagaauagaaucaauuucucu

SEQ ID NO: 3747507 - RNA, 21 nt, Salmonella enterica enterica serovar Typhi Ty2
uuagaauauaguuagaaaaua

SEQ ID NO: 3747508 - RNA, 13 nt, Salmonella enterica enterica serovar Typhi Ty2
uuagaaucucuga

SEQ ID NO: 3747509 - RNA, 13 nt, Salmonella enterica enterica serovar Typhi Ty2
uuagacaagcagu

SEQ ID NO: 3747510 - RNA, 17 nt, Salmonella enterica enterica serovar Typhi Ty2
uuagacuucuuccauac

SEQ ID NO: 3747511 - RNA, 19 nt, Salmonella enterica enterica serovar Typhi Ty2
uuagagaguaaaaccggca

SEQ ID NO: 3747512 - RNA, 21 nt, Salmonella enterica enterica serovar Typhi Ty2
uuagagcacaucacucauaau

SEQ ID NO: 3747513 - RNA, 14 nt, Salmonella enterica enterica serovar Typhi Ty2
uuagauuaaucacu

SEQ ID NO: 3747514 - RNA, 21 nt, Salmonella enterica enterica serovar Typhi Ty2
uuagcaacacagacuuugcac

SEQ ID NO: 3747515 - RNA, 22 nt, Salmonella enterica enterica serovar Typhi Ty2
uuagcaaccagcuaaccuguuc

SEQ ID NO: 3747516 - RNA, 20 nt, Salmonella enterica enterica serovar Typhi Ty2
uuagcaauugccauaaaaac

SEQ ID NO: 3747517 - RNA, 17 nt, Salmonella enterica enterica serovar Typhi Ty2
uuagcacagcucuaauu

SEQ ID NO: 3747518 - RNA, 19 nt, Salmonella enterica enterica serovar Typhi Ty2
uuagcagccacacacuguu

SEQ ID NO: 3747519 - RNA, 23 nt, Salmonella enterica enterica serovar Typhi Ty2
uuaucggcgucgcggcaauagcg

SEQ ID NO: 3747520 - RNA, 13 nt, Salmonella enterica enterica serovar Typhi Ty2
uuaucguccggca

SEQ ID NO: 3747521 - RNA, 18 nt, Salmonella enterica enterica serovar Typhi Ty2
uuaucguccgucagaucc

SEQ ID NO: 3747522 - RNA, 20 nt, Salmonella enterica enterica serovar Typhi Ty2
uuaucuccccaauugcugcu

SEQ ID NO: 3747523 - RNA, 22 nt, Salmonella enterica enterica serovar Typhi Ty2
uuaucuccccaauugcugcuau

SEQ ID NO: 3747524 - RNA, 16 nt, Salmonella enterica enterica serovar Typhi Ty2
uuaucucuacuuuccu

SEQ ID NO: 3747525 - RNA, 17 nt, Salmonella enterica enterica serovar Typhi Ty2
uuaucucuacuuuccug

SEQ ID NO: 3747526 - RNA, 14 nt, Salmonella enterica enterica serovar Typhi Ty2
uuaucucuuuugcu

SEQ ID NO: 3747527 - RNA, 16 nt, Salmonella enterica enterica serovar Typhi Ty2
uuaucucuuuugcuuc

SEQ ID NO: 3747528 - RNA, 22 nt, Salmonella enterica enterica serovar Typhi Ty2
uuaucucuuuugcuucaauaag

SEQ ID NO: 3747529 - RNA, 15 nt, Salmonella enterica enterica serovar Typhi Ty2
uuaucuggucgcggu

SEQ ID NO: 3747530 - RNA, 12 nt, Salmonella enterica enterica serovar Typhi Ty2
uuaucuguugau

SEQ ID NO: 3747531 - RNA, 12 nt, Salmonella enterica enterica serovar Typhi Ty2
uuaucuucaagg

SEQ ID NO: 3747532 - RNA, 18 nt, Salmonella enterica enterica serovar Typhi Ty2
uuaucuucaagguuaugc

SEQ ID NO: 3747533 - RNA, 16 nt, Salmonella enterica enterica serovar Typhi Ty2
uuaucuuccacgguaa

SEQ ID NO: 3747534 - RNA, 17 nt, Salmonella enterica enterica serovar Typhi Ty2
uuaucuuccacgguaaa

SEQ ID NO: 3747535 - RNA, 23 nt, Salmonella enterica enterica serovar Typhi Ty2
uuaugaauaguuucaccuucugc

SEQ ID NO: 3747536 - RNA, 19 nt, Salmonella enterica enterica serovar Typhi Ty2
uuaugaccaauaauaaucc

SEQ ID NO: 3747537 - RNA, 20 nt, Salmonella enterica enterica serovar Typhi Ty2
uuaugaccguauuacaagua

SEQ ID NO: 3747538 - RNA, 21 nt, Salmonella enterica enterica serovar Typhi Ty2
uuaugaccguauuacaaguaa

SEQ ID NO: 3747539 - RNA, 13 nt, Salmonella enterica enterica serovar Typhi Ty2
uuaugaucgccca

SEQ ID NO: 3747540 - RNA, 22 nt, Salmonella enterica enterica serovar Typhi Ty2
uuaugaucgcccagccacuccu

SEQ ID NO: 3747541 - RNA, 22 nt, Salmonella enterica enterica serovar Typhi Ty2
uuaugcaguuccguugcaauau

SEQ ID NO: 3747542 - RNA, 20 nt, Salmonella enterica enterica serovar Typhi Ty2
uuaugcccggaugauuauca

SEQ ID NO: 3747543 - RNA, 22 nt, Salmonella enterica enterica serovar Typhi Ty2
uuaugccgaccaaugacgcuau

SEQ ID NO: 3747544 - RNA, 19 nt, Salmonella enterica enterica serovar Typhi Ty2
uuaugcguuuaauugaauu

SEQ ID NO: 3747545 - RNA, 21 nt, Salmonella enterica enterica serovar Typhi Ty2
uuauggaggauauaaaaaaca

SEQ ID NO: 3747546 - RNA, 14 nt, Salmonella enterica enterica serovar Typhi Ty2
uuauggcccgccag

SEQ ID NO: 3747547 - RNA, 13 nt, Salmonella enterica enterica serovar Typhi Ty2
uuaugggauugca

SEQ ID NO: 3747548 - RNA, 16 nt, Salmonella enterica enterica serovar Typhi Ty2
uuauggguuuuuuauu

SEQ ID NO: 3747549 - RNA, 17 nt, Salmonella enterica enterica serovar Typhi Ty2
uuauguaccgucaucgc

SEQ ID NO: 3747550 - RNA, 19 nt, Salmonella enterica enterica serovar Typhi Ty2
uuauguagccagccauggc

SEQ ID NO: 3747551 - RNA, 18 nt, Salmonella enterica enterica serovar Typhi Ty2
uuauguaggccugauaag

SEQ ID NO: 3747552 - RNA, 14 nt, Salmonella enterica enterica serovar Typhi Ty2
uuaugucauucagg

SEQ ID NO: 3747553 - RNA, 17 nt, Salmonella enterica enterica serovar Typhi Ty2
uuauguccuuccagcuc

SEQ ID NO: 3747554 - RNA, 14 nt, Salmonella enterica enterica serovar Typhi Ty2
uuauguugauaacg

SEQ ID NO: 3747555 - RNA, 13 nt, Salmonella enterica enterica serovar Typhi Ty2
uuauguuugccca

SEQ ID NO: 3747556 - RNA, 14 nt, Salmonella enterica enterica serovar Typhi Ty2
uuauguuugcugau

SEQ ID NO: 3747557 - RNA, 15 nt, Salmonella enterica enterica serovar Typhi Ty2
uuauuaaagccccuu

SEQ ID NO: 3747558 - RNA, 12 nt, Salmonella enterica enterica serovar Typhi Ty2
uuauuaacccuu

SEQ ID NO: 3747559 - RNA, 15 nt, Salmonella enterica enterica serovar Typhi Ty2
uuauuaacccuuccu

SEQ ID NO: 3747560 - RNA, 15 nt, Salmonella enterica enterica serovar Typhi Ty2
uuauuaaucuuuaca

SEQ ID NO: 3747561 - RNA, 19 nt, Salmonella enterica enterica serovar Typhi Ty2
uuauuacgaaguuuaauuc

SEQ ID NO: 3747562 - RNA, 22 nt, Salmonella enterica enterica serovar Typhi Ty2
uuauuacgcgcucucauaagcc

SEQ ID NO: 3747563 - RNA, 19 nt, Salmonella enterica enterica serovar Typhi Ty2
uuauuagaggucagaauaa

SEQ ID NO: 3747564 - RNA, 23 nt, Salmonella enterica enterica serovar Typhi Ty2
uuauuagaggucagaauaacuca

SEQ ID NO: 3747565 - RNA, 20 nt, Salmonella enterica enterica serovar Typhi Ty2
uuauucacgcuauguuugcu

SEQ ID NO: 3747566 - RNA, 22 nt, Salmonella enterica enterica serovar Typhi Ty2
uuauucagaaaaucuggcgaga

SEQ ID NO: 3747567 - RNA, 19 nt, Salmonella enterica enterica serovar Typhi Ty2
uuauuccauucaucgauuu

SEQ ID NO: 3747568 - RNA, 17 nt, Salmonella enterica enterica serovar Typhi Ty2
uuauucccauuccugca

SEQ ID NO: 3747569 - RNA, 21 nt, Salmonella enterica enterica serovar Typhi Ty2
uuauuccuuuuuaggcuauaa

SEQ ID NO: 3747570 - RNA, 22 nt, Salmonella enterica enterica serovar Typhi Ty2
uuauucgcauguugacugcgcu

SEQ ID NO: 3747571 - RNA, 19 nt, Salmonella enterica enterica serovar Typhi Ty2
uuauucggaaugaugugcu

SEQ ID NO: 3747572 - RNA, 23 nt, Salmonella enterica enterica serovar Typhi Ty2
uuauucuuugucugucggacuca

SEQ ID NO: 3747573 - RNA, 19 nt, Salmonella enterica enterica serovar Typhi Ty2
uuauugaaaagcagccaga

SEQ ID NO: 3747574 - RNA, 21 nt, Salmonella enterica enterica serovar Typhi Ty2
uuauugaccaucgccagccau

SEQ ID NO: 3747575 - RNA, 14 nt, Salmonella enterica enterica serovar Typhi Ty2
uuauugcacguuau

SEQ ID NO: 3747576 - RNA, 15 nt, Salmonella enterica enterica serovar Typhi Ty2
uuauugcguugcuuu

SEQ ID NO: 3747577 - RNA, 20 nt, Salmonella enterica enterica serovar Typhi Ty2
uuauuggugaaaaaucauua

SEQ ID NO: 3747578 - RNA, 16 nt, Salmonella enterica enterica serovar Typhi Ty2
uuauuguuaaaaagac

SEQ ID NO: 3747579 - RNA, 13 nt, Salmonella enterica enterica serovar Typhi Ty2
uuauuuaauucuu

SEQ ID NO: 3747580 - RNA, 16 nt, Salmonella enterica enterica serovar Typhi Ty2
uuauuucaagcaauac

SEQ ID NO: 3747581 - RNA, 17 nt, Salmonella enterica enterica serovar Typhi Ty2
uuauuucaagcaauacc

SEQ ID NO: 3747582 - RNA, 10 nt, Salmonella enterica enterica serovar Typhi Ty2
uuauuucuau

SEQ ID NO: 3747583 - RNA, 11 nt, Salmonella enterica enterica serovar Typhi Ty2
uuauuucuauc

SEQ ID NO: 3747584 - RNA, 21 nt, Salmonella enterica enterica serovar Typhi Ty2
uuauuuuagugaaaaaauauc

SEQ ID NO: 3747585 - RNA, 15 nt, Salmonella enterica enterica serovar Typhi Ty2
uuauuuucacgccau

SEQ ID NO: 3747586 - RNA, 13 nt, Salmonella enterica enterica serovar Typhi Ty2
uuauuuucauacu

SEQ ID NO: 3747587 - RNA, 14 nt, Salmonella enterica enterica serovar Typhi Ty2
uuauuuugucaugu

SEQ ID NO: 3747588 - RNA, 20 nt, Salmonella enterica enterica serovar Typhi Ty2
uuauuuuucgccagaucgau

SEQ ID NO: 3747589 - RNA, 17 nt, Salmonella enterica enterica serovar Typhi Ty2
uuauuuuucuggcuucu

SEQ ID NO: 3747590 - RNA, 17 nt, Salmonella enterica enterica serovar Typhi Ty2
uucaaaaaugauguguu

SEQ ID NO: 3747591 - RNA, 23 nt, Salmonella enterica enterica serovar Typhi Ty2
uucaaaagccuguuuaccaagca

SEQ ID NO: 3747592 - RNA, 17 nt, Salmonella enterica enterica serovar Typhi Ty2
uucaaaccuucaagaau

SEQ ID NO: 3747593 - RNA, 20 nt, Salmonella enterica enterica serovar Typhi Ty2
uucaaacguucuguccgcuu

SEQ ID NO: 3747594 - RNA, 23 nt, Salmonella enterica enterica serovar Typhi Ty2
uucaaagccgccauccggccugu

SEQ ID NO: 3747595 - RNA, 17 nt, Salmonella enterica enterica serovar Typhi Ty2
uucaaauauauugaaaa

SEQ ID NO: 3747596 - RNA, 19 nt, Salmonella enterica enterica serovar Typhi Ty2
uucaaauguuguuugaaaa

SEQ ID NO: 3747597 - RNA, 19 nt, Salmonella enterica enterica serovar Typhi Ty2
uucaaauuucugaugugau

SEQ ID NO: 3747598 - RNA, 14 nt, Salmonella enterica enterica serovar Typhi Ty2
uucaacaaacucag

SEQ ID NO: 3747599 - RNA, 16 nt, Salmonella enterica enterica serovar Typhi Ty2
uucaacagcucgccau

SEQ ID NO: 3747600 - RNA, 19 nt, Salmonella enterica enterica serovar Typhi Ty2
uucaacagggguuccggca

SEQ ID NO: 3747601 - RNA, 11 nt, Salmonella enterica enterica serovar Typhi Ty2
uucagaucaaa

SEQ ID NO: 3747602 - RNA, 14 nt, Salmonella enterica enterica serovar Typhi Ty2
uucagaugcagcgg

SEQ ID NO: 3747603 - RNA, 18 nt, Salmonella enterica enterica serovar Typhi Ty2
uucagauggccaaugaug

SEQ ID NO: 3747604 - RNA, 21 nt, Salmonella enterica enterica serovar Typhi Ty2
uucagcagcgaauagcggcaa

SEQ ID NO: 3747605 - RNA, 13 nt, Salmonella enterica enterica serovar Typhi Ty2
uucagcagcgccc

SEQ ID NO: 3747606 - RNA, 17 nt, Salmonella enterica enterica serovar Typhi Ty2
uucagcagcgcccagcc

SEQ ID NO: 3747607 - RNA, 19 nt, Salmonella enterica enterica serovar Typhi Ty2
uucagcauauccagcgccu

SEQ ID NO: 3747608 - RNA, 12 nt, Salmonella enterica enterica serovar Typhi Ty2
uucagcaucauc

SEQ ID NO: 3747609 - RNA, 13 nt, Salmonella enterica enterica serovar Typhi Ty2
uucagccaggugg

SEQ ID NO: 3747610 - RNA, 19 nt, Salmonella enterica enterica serovar Typhi Ty2
uucagccagguggcaauau

SEQ ID NO: 3747611 - RNA, 14 nt, Salmonella enterica enterica serovar Typhi Ty2
uucagcccaggcuu

SEQ ID NO: 3747612 - RNA, 15 nt, Salmonella enterica enterica serovar Typhi Ty2
uucagccugaagcca

SEQ ID NO: 3747613 - RNA, 19 nt, Salmonella enterica enterica serovar Typhi Ty2
uucagcgccagauagucac

SEQ ID NO: 3747614 - RNA, 18 nt, Salmonella enterica enterica serovar Typhi Ty2
uucagcgcgauaaauacc

SEQ ID NO: 3747615 - RNA, 17 nt, Salmonella enterica enterica serovar Typhi Ty2
uucagcggcagcucugc

SEQ ID NO: 3747616 - RNA, 23 nt, Salmonella enterica enterica serovar Typhi Ty2
uucagcggcuugucauccugcuc

SEQ ID NO: 3747617 - RNA, 16 nt, Salmonella enterica enterica serovar Typhi Ty2
uucagcguacagaagg

SEQ ID NO: 3747618 - RNA, 16 nt, Salmonella enterica enterica serovar Typhi Ty2
uucagcguugcagcca

SEQ ID NO: 3747619 - RNA, 23 nt, Salmonella enterica enterica serovar Typhi Ty2
uucagcugcggcugaaccacccu

SEQ ID NO: 3747620 - RNA, 18 nt, Salmonella enterica enterica serovar Typhi Ty2
uucaggaaguuuaacgcg

SEQ ID NO: 3747621 - RNA, 22 nt, Salmonella enterica enterica serovar Typhi Ty2
uucaggacgagagacugauaau

SEQ ID NO: 3747622 - RNA, 19 nt, Salmonella enterica enterica serovar Typhi Ty2
uucaggagaccuaaagucu

SEQ ID NO: 3747623 - RNA, 23 nt, Salmonella enterica enterica serovar Typhi Ty2
uucaggauaauaucgcuggccau

SEQ ID NO: 3747624 - RNA, 18 nt, Salmonella enterica enterica serovar Typhi Ty2
uucaggcaaaaaaaaacc

SEQ ID NO: 3747625 - RNA, 17 nt, Salmonella enterica enterica serovar Typhi Ty2
uucaggcaaaggaaugc

SEQ ID NO: 3747626 - RNA, 18 nt, Salmonella enterica enterica serovar Typhi Ty2
uucaggcaucagauaaac

SEQ ID NO: 3747627 - RNA, 17 nt, Salmonella enterica enterica serovar Typhi Ty2
uucaggcggcaaaaaac

SEQ ID NO: 3747628 - RNA, 20 nt, Salmonella enterica enterica serovar Typhi Ty2
uucaggcucaucagcgccau

SEQ ID NO: 3747629 - RNA, 16 nt, Salmonella enterica enterica serovar Typhi Ty2
uucagggugaacaugg

SEQ ID NO: 3747630 - RNA, 21 nt, Salmonella enterica enterica serovar Typhi Ty2
uucaggucauacggcaugcca

SEQ ID NO: 3747631 - RNA, 21 nt, Salmonella enterica enterica serovar Typhi Ty2
uucagguuuuuaagcugccca

SEQ ID NO: 3747632 - RNA, 19 nt, Salmonella enterica enterica serovar Typhi Ty2
uucaguaagcguaccauuc

SEQ ID NO: 3747633 - RNA, 19 nt, Salmonella enterica enterica serovar Typhi Ty2
uucagucauaauccuuccu

SEQ ID NO: 3747634 - RNA, 18 nt, Salmonella enterica enterica serovar Typhi Ty2
uucagugccauccauauu

SEQ ID NO: 3747635 - RNA, 21 nt, Salmonella enterica enterica serovar Typhi Ty2
uucaguucgacuuaacgauaa

SEQ ID NO: 3747636 - RNA, 16 nt, Salmonella enterica enterica serovar Typhi Ty2
uucaguucggagauca

SEQ ID NO: 3747637 - RNA, 21 nt, Salmonella enterica enterica serovar Typhi Ty2
uucaguugcccauuuuccucc

SEQ ID NO: 3747638 - RNA, 20 nt, Salmonella enterica enterica serovar Typhi Ty2
uucaguuucggcccccccca

SEQ ID NO: 3747639 - RNA, 17 nt, Salmonella enterica enterica serovar Typhi Ty2
uucauaaagugccaggg

SEQ ID NO: 3747640 - RNA, 14 nt, Salmonella enterica enterica serovar Typhi Ty2
uucauaaauguacu

SEQ ID NO: 3747641 - RNA, 16 nt, Salmonella enterica enterica serovar Typhi Ty2
uucauaacaccaauac

SEQ ID NO: 3747642 - RNA, 14 nt, Salmonella enterica enterica serovar Typhi Ty2
uucauaacgccgau

SEQ ID NO: 3747643 - RNA, 15 nt, Salmonella enterica enterica serovar Typhi Ty2
uucauaagucaucca

SEQ ID NO: 3747644 - RNA, 21 nt, Salmonella enterica enterica serovar Typhi Ty2
uucauaauaagcgcucaggca

SEQ ID NO: 3747645 - RNA, 12 nt, Salmonella enterica enterica serovar Typhi Ty2
uucauaccacug

SEQ ID NO: 3747646 - RNA, 21 nt, Salmonella enterica enterica serovar Typhi Ty2
uucauaccggauauggcaaaa

SEQ ID NO: 3747647 - RNA, 17 nt, Salmonella enterica enterica serovar Typhi Ty2
uucauagagaagucuga

SEQ ID NO: 3747648 - RNA, 15 nt, Salmonella enterica enterica serovar Typhi Ty2
uucauagccguggcu

SEQ ID NO: 3747649 - RNA, 17 nt, Salmonella enterica enterica serovar Typhi Ty2
uucauaggugaacauga

SEQ ID NO: 3747650 - RNA, 20 nt, Salmonella enterica enterica serovar Typhi Ty2
uucauaugcgccaacugcau

SEQ ID NO: 3747651 - RNA, 14 nt, Salmonella enterica enterica serovar Typhi Ty2
uucaucaaaaugca

SEQ ID NO: 3747652 - RNA, 16 nt, Salmonella enterica enterica serovar Typhi Ty2
uucaucaaagaaauac

SEQ ID NO: 3747653 - RNA, 11 nt, Salmonella enterica enterica serovar Typhi Ty2
uucaucaccau

SEQ ID NO: 3747654 - RNA, 18 nt, Salmonella enterica enterica serovar Typhi Ty2
uucaucaggcaauaaaca

SEQ ID NO: 3747655 - RNA, 17 nt, Salmonella enterica enterica serovar Typhi Ty2
uucaucaggcugacgaa

SEQ ID NO: 3747656 - RNA, 14 nt, Salmonella enterica enterica serovar Typhi Ty2
uucaucaguaacug

SEQ ID NO: 3747657 - RNA, 17 nt, Salmonella enterica enterica serovar Typhi Ty2
uucaucaguaacugacg

SEQ ID NO: 3747658 - RNA, 16 nt, Salmonella enterica enterica serovar Typhi Ty2
uucaucauaucuuccc

SEQ ID NO: 3747659 - RNA, 14 nt, Salmonella enterica enterica serovar Typhi Ty2
uucauccaccgccc

SEQ ID NO: 3747660 - RNA, 12 nt, Salmonella enterica enterica serovar Typhi Ty2
uucauccacgcc

SEQ ID NO: 3747661 - RNA, 13 nt, Salmonella enterica enterica serovar Typhi Ty2
uucauccaugcca

SEQ ID NO: 3747662 - RNA, 20 nt, Salmonella enterica enterica serovar Typhi Ty2
uucauccaugccaagcggca

SEQ ID NO: 3747663 - RNA, 23 nt, Salmonella enterica enterica serovar Typhi Ty2
uucaucccugcgacggcuaccug

SEQ ID NO: 3747664 - RNA, 18 nt, Salmonella enterica enterica serovar Typhi Ty2
uucauccggcguugcgcc

SEQ ID NO: 3747665 - RNA, 15 nt, Salmonella enterica enterica serovar Typhi Ty2
uucaucggcucgacu

SEQ ID NO: 3747666 - RNA, 15 nt, Salmonella enterica enterica serovar Typhi Ty2
uucaucgguaauauu

SEQ ID NO: 3747667 - RNA, 14 nt, Salmonella enterica enterica serovar Typhi Ty2
uucaucucaucaau

SEQ ID NO: 3747668 - RNA, 15 nt, Salmonella enterica enterica serovar Typhi Ty2
uucaucucaucaaug

SEQ ID NO: 3747669 - RNA, 17 nt, Salmonella enterica enterica serovar Typhi Ty2
uucaucuccgauaaaua

SEQ ID NO: 3747670 - RNA, 21 nt, Salmonella enterica enterica serovar Typhi Ty2
uucaucuccgauaaauaagaa

SEQ ID NO: 3747671 - RNA, 21 nt, Salmonella enterica enterica serovar Typhi Ty2
uucaucuccucuucaguaagc

SEQ ID NO: 3747672 - RNA, 20 nt, Salmonella enterica enterica serovar Typhi Ty2
uucaucuguggcaauuuuca

SEQ ID NO: 3747673 - RNA, 22 nt, Salmonella enterica enterica serovar Typhi Ty2
uucaucuucaccuuuccaguca

SEQ ID NO: 3747674 - RNA, 14 nt, Salmonella enterica enterica serovar Typhi Ty2
uucaucuucaguaa

SEQ ID NO: 3747675 - RNA, 14 nt, Salmonella enterica enterica serovar Typhi Ty2
uucaugaaucauca

SEQ ID NO: 3747676 - RNA, 16 nt, Salmonella enterica enterica serovar Typhi Ty2
uucaugaucuuuccuu

SEQ ID NO: 3747677 - RNA, 13 nt, Salmonella enterica enterica serovar Typhi Ty2
uucaugcaauaau

SEQ ID NO: 3747678 - RNA, 21 nt, Salmonella enterica enterica serovar Typhi Ty2
uucaugcaauuccgcuuucuu

SEQ ID NO: 3747679 - RNA, 22 nt, Salmonella enterica enterica serovar Typhi Ty2
uucaugcacaaaacccgcagcc

SEQ ID NO: 3747680 - RNA, 23 nt, Salmonella enterica enterica serovar Typhi Ty2
uucaugcaucauugaagcgaugu

SEQ ID NO: 3747681 - RNA, 12 nt, Salmonella enterica enterica serovar Typhi Ty2
uucaugcauuaa

SEQ ID NO: 3747682 - RNA, 21 nt, Salmonella enterica enterica serovar Typhi Ty2
uucaugccagaagcaaauuca

SEQ ID NO: 3747683 - RNA, 20 nt, Salmonella enterica enterica serovar Typhi Ty2
uucccccacuucugacagaa

SEQ ID NO: 3747684 - RNA, 11 nt, Salmonella enterica enterica serovar Typhi Ty2
uuccccuccgc

SEQ ID NO: 3747685 - RNA, 16 nt, Salmonella enterica enterica serovar Typhi Ty2
uuccccugaugcguau

SEQ ID NO: 3747686 - RNA, 22 nt, Salmonella enterica enterica serovar Typhi Ty2
uuccccuguaacugcaccuuuu

SEQ ID NO: 3747687 - RNA, 15 nt, Salmonella enterica enterica serovar Typhi Ty2
uuccccuucuguaag

SEQ ID NO: 3747688 - RNA, 23 nt, Salmonella enterica enterica serovar Typhi Ty2
uucccgagccggguuauagccuu

SEQ ID NO: 3747689 - RNA, 11 nt, Salmonella enterica enterica serovar Typhi Ty2
uucccgagcga

SEQ ID NO: 3747690 - RNA, 14 nt, Salmonella enterica enterica serovar Typhi Ty2
uucccgaugccagc

SEQ ID NO: 3747691 - RNA, 21 nt, Salmonella enterica enterica serovar Typhi Ty2
uucccgcaaacuggccacagc

SEQ ID NO: 3747692 - RNA, 22 nt, Salmonella enterica enterica serovar Typhi Ty2
uucccgcacgcgacgcgccagc

SEQ ID NO: 3747693 - RNA, 18 nt, Salmonella enterica enterica serovar Typhi Ty2
uucccgccgccauugcca

SEQ ID NO: 3747694 - RNA, 17 nt, Salmonella enterica enterica serovar Typhi Ty2
uucccgcuauccaucau

SEQ ID NO: 3747695 - RNA, 16 nt, Salmonella enterica enterica serovar Typhi Ty2
uucccggaaaaguauu

SEQ ID NO: 3747696 - RNA, 18 nt, Salmonella enterica enterica serovar Typhi Ty2
uucccggcaauuaccgcc

SEQ ID NO: 3747697 - RNA, 19 nt, Salmonella enterica enterica serovar Typhi Ty2
uucccggcaugccauaauc

SEQ ID NO: 3747698 - RNA, 16 nt, Salmonella enterica enterica serovar Typhi Ty2
uucccggcuaaccugu

SEQ ID NO: 3747699 - RNA, 21 nt, Salmonella enterica enterica serovar Typhi Ty2
uucccggcuaaccuguaucug

SEQ ID NO: 3747700 - RNA, 17 nt, Salmonella enterica enterica serovar Typhi Ty2
uucccuacucucgcaug

SEQ ID NO: 3747701 - RNA, 15 nt, Salmonella enterica enterica serovar Typhi Ty2
uucccucauauuugu

SEQ ID NO: 3747702 - RNA, 12 nt, Salmonella enterica enterica serovar Typhi Ty2
uucccugaccag

SEQ ID NO: 3747703 - RNA, 11 nt, Salmonella enterica enterica serovar Typhi Ty2
uucccuggccg

SEQ ID NO: 3747704 - RNA, 16 nt, Salmonella enterica enterica serovar Typhi Ty2
uucccuucugaaauga

SEQ ID NO: 3747705 - RNA, 17 nt, Salmonella enterica enterica serovar Typhi Ty2
uucccuuuuuaaaauga

SEQ ID NO: 3747706 - RNA, 23 nt, Salmonella enterica enterica serovar Typhi Ty2
uuccgacagugaacggcauaauc

SEQ ID NO: 3747707 - RNA, 12 nt, Salmonella enterica enterica serovar Typhi Ty2
uuccgcaauaag

SEQ ID NO: 3747708 - RNA, 22 nt, Salmonella enterica enterica serovar Typhi Ty2
uuccgcaauaugcgucagcgcg

SEQ ID NO: 3747709 - RNA, 16 nt, Salmonella enterica enterica serovar Typhi Ty2
uuccgcaucaauaugc

SEQ ID NO: 3747710 - RNA, 18 nt, Salmonella enterica enterica serovar Typhi Ty2
uuccgcaucaauaugcgu

SEQ ID NO: 3747711 - RNA, 15 nt, Salmonella enterica enterica serovar Typhi Ty2
uuccgccaccacgcc

SEQ ID NO: 3747712 - RNA, 23 nt, Salmonella enterica enterica serovar Typhi Ty2
uuccgccaccagauagucaucac

SEQ ID NO: 3747713 - RNA, 14 nt, Salmonella enterica enterica serovar Typhi Ty2
uuccgccagauaca

SEQ ID NO: 3747714 - RNA, 19 nt, Salmonella enterica enterica serovar Typhi Ty2
uuccgcccgcgcucccgcc

SEQ ID NO: 3747715 - RNA, 20 nt, Salmonella enterica enterica serovar Typhi Ty2
uuccgccgucgugccugacg

SEQ ID NO: 3747716 - RNA, 19 nt, Salmonella enterica enterica serovar Typhi Ty2
uuccgcgagagaaaaaaau

SEQ ID NO: 3747717 - RNA, 17 nt, Salmonella enterica enterica serovar Typhi Ty2
uuccgcguuaucaagag

SEQ ID NO: 3747718 - RNA, 17 nt, Salmonella enterica enterica serovar Typhi Ty2
uuccgcuggugcguaac

SEQ ID NO: 3747719 - RNA, 22 nt, Salmonella enterica enterica serovar Typhi Ty2
uuccggaucgccgaagcggcag

SEQ ID NO: 3747720 - RNA, 16 nt, Salmonella enterica enterica serovar Typhi Ty2
uuccggcagacggcug

SEQ ID NO: 3747721 - RNA, 21 nt, Salmonella enterica enterica serovar Typhi Ty2
uuccgggauguuaauuucauc

SEQ ID NO: 3747722 - RNA, 17 nt, Salmonella enterica enterica serovar Typhi Ty2
uuccgggcgcaccaguu

SEQ ID NO: 3747723 - RNA, 21 nt, Salmonella enterica enterica serovar Typhi Ty2
uuccgggcgcaccaguucccc

SEQ ID NO: 3747724 - RNA, 15 nt, Salmonella enterica enterica serovar Typhi Ty2
uuccggguccagacg

SEQ ID NO: 3747725 - RNA, 13 nt, Salmonella enterica enterica serovar Typhi Ty2
uuccgggucgcuu

SEQ ID NO: 3747726 - RNA, 20 nt, Salmonella enterica enterica serovar Typhi Ty2
uuccgguuaauacgccggug

SEQ ID NO: 3747727 - RNA, 18 nt, Salmonella enterica enterica serovar Typhi Ty2
uuccgucauggugaugau

SEQ ID NO: 3747728 - RNA, 14 nt, Salmonella enterica enterica serovar Typhi Ty2
uuccguccaccugg

SEQ ID NO: 3747729 - RNA, 18 nt, Salmonella enterica enterica serovar Typhi Ty2
uuccguuaauggaggcag

SEQ ID NO: 3747730 - RNA, 18 nt, Salmonella enterica enterica serovar Typhi Ty2
uuccguucgcgucacaau

SEQ ID NO: 3747731 - RNA, 12 nt, Salmonella enterica enterica serovar Typhi Ty2
uuccucacagcc

SEQ ID NO: 3747732 - RNA, 14 nt, Salmonella enterica enterica serovar Typhi Ty2
uuccucagaauccg

SEQ ID NO: 3747733 - RNA, 16 nt, Salmonella enterica enterica serovar Typhi Ty2
uuccuccaucgccagc

SEQ ID NO: 3747734 - RNA, 13 nt, Salmonella enterica enterica serovar Typhi Ty2
uuccucccggugc

SEQ ID NO: 3747735 - RNA, 17 nt, Salmonella enterica enterica serovar Typhi Ty2
uuccucgucgcgcgccg

SEQ ID NO: 3747736 - RNA, 15 nt, Salmonella enterica enterica serovar Typhi Ty2
uuccucgucggcaag

SEQ ID NO: 3747737 - RNA, 14 nt, Salmonella enterica enterica serovar Typhi Ty2
uuccugaaaaaauu

SEQ ID NO: 3747738 - RNA, 21 nt, Salmonella enterica enterica serovar Typhi Ty2
uuccugacuguaauuucgcug

SEQ ID NO: 3747739 - RNA, 22 nt, Salmonella enterica enterica serovar Typhi Ty2
uuccugagcagacauauuuuca

SEQ ID NO: 3747740 - RNA, 17 nt, Salmonella enterica enterica serovar Typhi Ty2
uuccugaucaaucaacu

SEQ ID NO: 3747741 - RNA, 16 nt, Salmonella enterica enterica serovar Typhi Ty2
uuccugauccgccuua

SEQ ID NO: 3747742 - RNA, 15 nt, Salmonella enterica enterica serovar Typhi Ty2
uuccugcacgccugc

SEQ ID NO: 3747743 - RNA, 18 nt, Salmonella enterica enterica serovar Typhi Ty2
uuccugccaggccggacu

SEQ ID NO: 3747744 - RNA, 19 nt, Salmonella enterica enterica serovar Typhi Ty2
uuccugcgccaguugcugg

SEQ ID NO: 3747745 - RNA, 21 nt, Salmonella enterica enterica serovar Typhi Ty2
uuccugcggcgguaacgccuu

SEQ ID NO: 3747746 - RNA, 15 nt, Salmonella enterica enterica serovar Typhi Ty2
uuccugcguugacca

SEQ ID NO: 3747747 - RNA, 16 nt, Salmonella enterica enterica serovar Typhi Ty2
uuccugcugcgccagc

SEQ ID NO: 3747748 - RNA, 17 nt, Salmonella enterica enterica serovar Typhi Ty2
uuccugcugcgccagcg

SEQ ID NO: 3747749 - RNA, 16 nt, Salmonella enterica enterica serovar Typhi Ty2
uuccugcugcgcuuug

SEQ ID NO: 3747750 - RNA, 14 nt, Salmonella enterica enterica serovar Typhi Ty2
uuccuggugcgaca

SEQ ID NO: 3747751 - RNA, 23 nt, Salmonella enterica enterica serovar Typhi Ty2
uuccuguauaauuauuuguuuac

SEQ ID NO: 3747752 - RNA, 18 nt, Salmonella enterica enterica serovar Typhi Ty2
uuccugucucuauuaacc

SEQ ID NO: 3747753 - RNA, 12 nt, Salmonella enterica enterica serovar Typhi Ty2
uuccuuaucagc

SEQ ID NO: 3747754 - RNA, 23 nt, Salmonella enterica enterica serovar Typhi Ty2
uuccuuauuaaagccccuuccuc

SEQ ID NO: 3747755 - RNA, 20 nt, Salmonella enterica enterica serovar Typhi Ty2
uuccuuguccgaugcagaca

SEQ ID NO: 3747756 - RNA, 19 nt, Salmonella enterica enterica serovar Typhi Ty2
uuccuuguuuuaacggaau

SEQ ID NO: 3747757 - RNA, 14 nt, Salmonella enterica enterica serovar Typhi Ty2
uuccuuucugcgcc

SEQ ID NO: 3747758 - RNA, 12 nt, Salmonella enterica enterica serovar Typhi Ty2
uucgaaccugcg

SEQ ID NO: 3747759 - RNA, 22 nt, Salmonella enterica enterica serovar Typhi Ty2
uucgaacgcuagcucaacgccc

SEQ ID NO: 3747760 - RNA, 14 nt, Salmonella enterica enterica serovar Typhi Ty2
uucgaauccuccug

SEQ ID NO: 3747761 - RNA, 17 nt, Salmonella enterica enterica serovar Typhi Ty2
uucgaauuacauaacca

SEQ ID NO: 3747762 - RNA, 20 nt, Salmonella enterica enterica serovar Typhi Ty2
uucgacaaacagcuauccau

SEQ ID NO: 3747763 - RNA, 15 nt, Salmonella enterica enterica serovar Typhi Ty2
uucgacaguuucuuc

SEQ ID NO: 3747764 - RNA, 18 nt, Salmonella enterica enterica serovar Typhi Ty2
uucgacgagguuuccggc

SEQ ID NO: 3747765 - RNA, 18 nt, Salmonella enterica enterica serovar Typhi Ty2
uucucgccgguagccagc

SEQ ID NO: 3747766 - RNA, 17 nt, Salmonella enterica enterica serovar Typhi Ty2
uucucggcuuuccagcu

SEQ ID NO: 3747767 - RNA, 16 nt, Salmonella enterica enterica serovar Typhi Ty2
uucucguucaacggca

SEQ ID NO: 3747768 - RNA, 18 nt, Salmonella enterica enterica serovar Typhi Ty2
uucucucucguucccgcc

SEQ ID NO: 3747769 - RNA, 14 nt, Salmonella enterica enterica serovar Typhi Ty2
uucucuuccacaaa

SEQ ID NO: 3747770 - RNA, 14 nt, Salmonella enterica enterica serovar Typhi Ty2
uucucuuuuauuau

SEQ ID NO: 3747771 - RNA, 19 nt, Salmonella enterica enterica serovar Typhi Ty2
uucugaacuguaaccggcg

SEQ ID NO: 3747772 - RNA, 19 nt, Salmonella enterica enterica serovar Typhi Ty2
uucugaagcguaacagcgc

SEQ ID NO: 3747773 - RNA, 21 nt, Salmonella enterica enterica serovar Typhi Ty2
uucugaagcguaacagcgcua

SEQ ID NO: 3747774 - RNA, 18 nt, Salmonella enterica enterica serovar Typhi Ty2
uucugaauaaauugaauu

SEQ ID NO: 3747775 - RNA, 15 nt, Salmonella enterica enterica serovar Typhi Ty2
uucugaauuucacgc

SEQ ID NO: 3747776 - RNA, 21 nt, Salmonella enterica enterica serovar Typhi Ty2
uucugaccacauuuucucgug

SEQ ID NO: 3747777 - RNA, 18 nt, Salmonella enterica enterica serovar Typhi Ty2
uucugaccaguugcaggc

SEQ ID NO: 3747778 - RNA, 16 nt, Salmonella enterica enterica serovar Typhi Ty2
uucugauggcuuugcu

SEQ ID NO: 3747779 - RNA, 17 nt, Salmonella enterica enterica serovar Typhi Ty2
uucugauuauugacauu

SEQ ID NO: 3747780 - RNA, 13 nt, Salmonella enterica enterica serovar Typhi Ty2
uucugcaggccaa

SEQ ID NO: 3747781 - RNA, 17 nt, Salmonella enterica enterica serovar Typhi Ty2
uucugccagcagaagac

SEQ ID NO: 3747782 - RNA, 12 nt, Salmonella enterica enterica serovar Typhi Ty2
uucugccagguu

SEQ ID NO: 3747783 - RNA, 13 nt, Salmonella enterica enterica serovar Typhi Ty2
uucugccagguuc

SEQ ID NO: 3747784 - RNA, 13 nt, Salmonella enterica enterica serovar Typhi Ty2
uucugccuuuuuu

SEQ ID NO: 3747785 - RNA, 22 nt, Salmonella enterica enterica serovar Typhi Ty2
uucugcgccgcuugugccgaca

SEQ ID NO: 3747786 - RNA, 23 nt, Salmonella enterica enterica serovar Typhi Ty2
uucugcgcuaagcguuacggaaa

SEQ ID NO: 3747787 - RNA, 14 nt, Salmonella enterica enterica serovar Typhi Ty2
uucugcuccagacg

SEQ ID NO: 3747788 - RNA, 15 nt, Salmonella enterica enterica serovar Typhi Ty2
uucugcuuccagaau

SEQ ID NO: 3747789 - RNA, 16 nt, Salmonella enterica enterica serovar Typhi Ty2
uucuggcaacagccau

SEQ ID NO: 3747790 - RNA, 14 nt, Salmonella enterica enterica serovar Typhi Ty2
uucuggcucggccu

SEQ ID NO: 3747791 - RNA, 18 nt, Salmonella enterica enterica serovar Typhi Ty2
uucuguaauuugaaauug

SEQ ID NO: 3747792 - RNA, 14 nt, Salmonella enterica enterica serovar Typhi Ty2
uucugucagccuug

SEQ ID NO: 3747793 - RNA, 15 nt, Salmonella enterica enterica serovar Typhi Ty2
uucugucgccaccac

SEQ ID NO: 3747794 - RNA, 20 nt, Salmonella enterica enterica serovar Typhi Ty2
uucuguuuucgagccuugcc

SEQ ID NO: 3747795 - RNA, 13 nt, Salmonella enterica enterica serovar Typhi Ty2
uucuuaaccccuu

SEQ ID NO: 3747796 - RNA, 22 nt, Salmonella enterica enterica serovar Typhi Ty2
uucuuaauacccauuucuucuu

SEQ ID NO: 3747797 - RNA, 14 nt, Salmonella enterica enterica serovar Typhi Ty2
uucuuaauuccuca

SEQ ID NO: 3747798 - RNA, 20 nt, Salmonella enterica enterica serovar Typhi Ty2
uucuuacuaauaaauauuca

SEQ ID NO: 3747799 - RNA, 22 nt, Salmonella enterica enterica serovar Typhi Ty2
uucuuagcgccagcagaaaacc

SEQ ID NO: 3747800 - RNA, 16 nt, Salmonella enterica enterica serovar Typhi Ty2
uucuuauuacaagaaa

SEQ ID NO: 3747801 - RNA, 20 nt, Salmonella enterica enterica serovar Typhi Ty2
uucuucaagcguuuccagag

SEQ ID NO: 3747802 - RNA, 18 nt, Salmonella enterica enterica serovar Typhi Ty2
uucuucaaugaagcggaa

SEQ ID NO: 3747803 - RNA, 13 nt, Salmonella enterica enterica serovar Typhi Ty2
uucuuccagaacg

SEQ ID NO: 3747804 - RNA, 18 nt, Salmonella enterica enterica serovar Typhi Ty2
uucuuccagguuaaccca

SEQ ID NO: 3747805 - RNA, 14 nt, Salmonella enterica enterica serovar Typhi Ty2
uucuuccauuccca

SEQ ID NO: 3747806 - RNA, 12 nt, Salmonella enterica enterica serovar Typhi Ty2
uucuuccucucg

SEQ ID NO: 3747807 - RNA, 19 nt, Salmonella enterica enterica serovar Typhi Ty2
uucuucgccgucauaaaac

SEQ ID NO: 3747808 - RNA, 13 nt, Salmonella enterica enterica serovar Typhi Ty2
uucuucucuucuu

SEQ ID NO: 3747809 - RNA, 15 nt, Salmonella enterica enterica serovar Typhi Ty2
uucuucugccuuuuu

SEQ ID NO: 3747810 - RNA, 13 nt, Salmonella enterica enterica serovar Typhi Ty2
uucuucuggcugc

SEQ ID NO: 3747811 - RNA, 12 nt, Salmonella enterica enterica serovar Typhi Ty2
uucuucuucacg

SEQ ID NO: 3747812 - RNA, 15 nt, Salmonella enterica enterica serovar Typhi Ty2
uucuuuaauuugugc

SEQ ID NO: 3747813 - RNA, 17 nt, Salmonella enterica enterica serovar Typhi Ty2
uucuuuaauuugugcca

SEQ ID NO: 3747814 - RNA, 19 nt, Salmonella enterica enterica serovar Typhi Ty2
uucuuuauucacuuuuucu

SEQ ID NO: 3747815 - RNA, 18 nt, Salmonella enterica enterica serovar Typhi Ty2
uucuuucagcucuucaau

SEQ ID NO: 3747816 - RNA, 14 nt, Salmonella enterica enterica serovar Typhi Ty2
uucuuuccugcaaa

SEQ ID NO: 3747817 - RNA, 13 nt, Salmonella enterica enterica serovar Typhi Ty2
uucuuugguauug

SEQ ID NO: 3747818 - RNA, 16 nt, Salmonella enterica enterica serovar Typhi Ty2
uucuuuucaauaaagc

SEQ ID NO: 3747819 - RNA, 12 nt, Salmonella enterica enterica serovar Typhi Ty2
uucuuuuuauau

SEQ ID NO: 3747820 - RNA, 15 nt, Salmonella enterica enterica serovar Typhi Ty2
uucuuuuuauauucc

SEQ ID NO: 3747821 - RNA, 20 nt, Salmonella enterica enterica serovar Typhi Ty2
uucuuuuucgaucagcauau

SEQ ID NO: 3747822 - RNA, 16 nt, Salmonella enterica enterica serovar Typhi Ty2
uugaaaacaccaggga

SEQ ID NO: 3747823 - RNA, 21 nt, Salmonella enterica enterica serovar Typhi Ty2
uugaaaaccacaaucacagcg

SEQ ID NO: 3747824 - RNA, 15 nt, Salmonella enterica enterica serovar Typhi Ty2
uugaacauauccgcg

SEQ ID NO: 3747825 - RNA, 13 nt, Salmonella enterica enterica serovar Typhi Ty2
uugaaccaucucg

SEQ ID NO: 3747826 - RNA, 17 nt, Salmonella enterica enterica serovar Typhi Ty2
uugaacccguaagcccu

SEQ ID NO: 3747827 - RNA, 23 nt, Salmonella enterica enterica serovar Typhi Ty2
uugaacggcggcucguuguuuaa

SEQ ID NO: 3747828 - RNA, 13 nt, Salmonella enterica enterica serovar Typhi Ty2
uugaagaaaaacc

SEQ ID NO: 3747829 - RNA, 15 nt, Salmonella enterica enterica serovar Typhi Ty2
uugaagcgaccagcg

SEQ ID NO: 3747830 - RNA, 18 nt, Salmonella enterica enterica serovar Typhi Ty2
uugaauaaccauacugac

SEQ ID NO: 3747831 - RNA, 16 nt, Salmonella enterica enterica serovar Typhi Ty2
uugaauaaugcccguu

SEQ ID NO: 3747832 - RNA, 21 nt, Salmonella enterica enterica serovar Typhi Ty2
uugaauaaugcccguugacga

SEQ ID NO: 3747833 - RNA, 15 nt, Salmonella enterica enterica serovar Typhi Ty2
uugaauaucgcuuuu

SEQ ID NO: 3747834 - RNA, 13 nt, Salmonella enterica enterica serovar Typhi Ty2
uugaauuugacga

SEQ ID NO: 3747835 - RNA, 14 nt, Salmonella enterica enterica serovar Typhi Ty2
uugacaugaaaaau

SEQ ID NO: 3747836 - RNA, 14 nt, Salmonella enterica enterica serovar Typhi Ty2
uugaccaucgccag

SEQ ID NO: 3747837 - RNA, 20 nt, Salmonella enterica enterica serovar Typhi Ty2
uugaccgcauaaucugugau

SEQ ID NO: 3747838 - RNA, 16 nt, Salmonella enterica enterica serovar Typhi Ty2
uugaccucaucaccua

SEQ ID NO: 3747839 - RNA, 14 nt, Salmonella enterica enterica serovar Typhi Ty2
uugacgaaaagaua

SEQ ID NO: 3747840 - RNA, 12 nt, Salmonella enterica enterica serovar Typhi Ty2
uugacgaacgcu

SEQ ID NO: 3747841 - RNA, 13 nt, Salmonella enterica enterica serovar Typhi Ty2
uugacgcuuugca

SEQ ID NO: 3747842 - RNA, 15 nt, Salmonella enterica enterica serovar Typhi Ty2
uugacgcuuugcauu

SEQ ID NO: 3747843 - RNA, 16 nt, Salmonella enterica enterica serovar Typhi Ty2
uugacguuuaccugaa

SEQ ID NO: 3747844 - RNA, 16 nt, Salmonella enterica enterica serovar Typhi Ty2
uugacucuguuauaua

SEQ ID NO: 3747845 - RNA, 20 nt, Salmonella enterica enterica serovar Typhi Ty2
uugacugaaauuacgccaua

SEQ ID NO: 3747846 - RNA, 20 nt, Salmonella enterica enterica serovar Typhi Ty2
uugacugcgggggcaaaugc

SEQ ID NO: 3747847 - RNA, 18 nt, Salmonella enterica enterica serovar Typhi Ty2
uugacuggauuuuugacu

SEQ ID NO: 3747848 - RNA, 15 nt, Salmonella enterica enterica serovar Typhi Ty2
uugcgauaauacacg

SEQ ID NO: 3747849 - RNA, 16 nt, Salmonella enterica enterica serovar Typhi Ty2
uugcgcaaccuccgcg

SEQ ID NO: 3747850 - RNA, 19 nt, Salmonella enterica enterica serovar Typhi Ty2
uugcgcaggguaucaucgc

SEQ ID NO: 3747851 - RNA, 16 nt, Salmonella enterica enterica serovar Typhi Ty2
uugcgcauauuccggc

SEQ ID NO: 3747852 - RNA, 22 nt, Salmonella enterica enterica serovar Typhi Ty2
uugcgccaaagcaaucgccagc

SEQ ID NO: 3747853 - RNA, 18 nt, Salmonella enterica enterica serovar Typhi Ty2
uugcgccacggauggccu

SEQ ID NO: 3747854 - RNA, 18 nt, Salmonella enterica enterica serovar Typhi Ty2
uugcgccacuuuuccggc

SEQ ID NO: 3747855 - RNA, 12 nt, Salmonella enterica enterica serovar Typhi Ty2
uugcgccagacc

SEQ ID NO: 3747856 - RNA, 15 nt, Salmonella enterica enterica serovar Typhi Ty2
uugcgccagcgccac

SEQ ID NO: 3747857 - RNA, 15 nt, Salmonella enterica enterica serovar Typhi Ty2
uugcgcccagauaau

SEQ ID NO: 3747858 - RNA, 17 nt, Salmonella enterica enterica serovar Typhi Ty2
uugcgcccaggccaaaa

SEQ ID NO: 3747859 - RNA, 23 nt, Salmonella enterica enterica serovar Typhi Ty2
uugcgcccgcucuuauugcucuu

SEQ ID NO: 3747860 - RNA, 13 nt, Salmonella enterica enterica serovar Typhi Ty2
uugcgccgcgaac

SEQ ID NO: 3747861 - RNA, 14 nt, Salmonella enterica enterica serovar Typhi Ty2
uugcgccgucacac

SEQ ID NO: 3747862 - RNA, 18 nt, Salmonella enterica enterica serovar Typhi Ty2
uugcgcgacgacgccagc

SEQ ID NO: 3747863 - RNA, 20 nt, Salmonella enterica enterica serovar Typhi Ty2
uugcgcguucggguuuuccu

SEQ ID NO: 3747864 - RNA, 14 nt, Salmonella enterica enterica serovar Typhi Ty2
uugcgcuaaaaucc

SEQ ID NO: 3747865 - RNA, 23 nt, Salmonella enterica enterica serovar Typhi Ty2
uugcgcucaccuuuuuauuuacu

SEQ ID NO: 3747866 - RNA, 18 nt, Salmonella enterica enterica serovar Typhi Ty2
uugcgcucgcgccagaug

SEQ ID NO: 3747867 - RNA, 13 nt, Salmonella enterica enterica serovar Typhi Ty2
uugcgcucugcca

SEQ ID NO: 3747868 - RNA, 13 nt, Salmonella enterica enterica serovar Typhi Ty2
uugcggauaugcg

SEQ ID NO: 3747869 - RNA, 19 nt, Salmonella enterica enterica serovar Typhi Ty2
uugcggaucgaucucgaua

SEQ ID NO: 3747870 - RNA, 15 nt, Salmonella enterica enterica serovar Typhi Ty2
uugcggcacacagcc

SEQ ID NO: 3747871 - RNA, 18 nt, Salmonella enterica enterica serovar Typhi Ty2
uugcggcaucagauggcg

SEQ ID NO: 3747872 - RNA, 21 nt, Salmonella enterica enterica serovar Typhi Ty2
uugcggcggggauaaucagca

SEQ ID NO: 3747873 - RNA, 20 nt, Salmonella enterica enterica serovar Typhi Ty2
uugcgggccucguuaaaauc

SEQ ID NO: 3747874 - RNA, 15 nt, Salmonella enterica enterica serovar Typhi Ty2
uugcguaaugauuaa

SEQ ID NO: 3747875 - RNA, 22 nt, Salmonella enterica enterica serovar Typhi Ty2
uugcguaucguaagccaccgcc

SEQ ID NO: 3747876 - RNA, 14 nt, Salmonella enterica enterica serovar Typhi Ty2
uugcgucaccgggc

SEQ ID NO: 3747877 - RNA, 14 nt, Salmonella enterica enterica serovar Typhi Ty2
uugcgucuguuuuu

SEQ ID NO: 3747878 - RNA, 13 nt, Salmonella enterica enterica serovar Typhi Ty2
uugcgugucauca

SEQ ID NO: 3747879 - RNA, 17 nt, Salmonella enterica enterica serovar Typhi Ty2
uugcuaggaacagugac

SEQ ID NO: 3747880 - RNA, 11 nt, Salmonella enterica enterica serovar Typhi Ty2
uugcucaagcu

SEQ ID NO: 3747881 - RNA, 12 nt, Salmonella enterica enterica serovar Typhi Ty2
uugcucaaugga

SEQ ID NO: 3747882 - RNA, 17 nt, Salmonella enterica enterica serovar Typhi Ty2
uugcucaauggauuuuc

SEQ ID NO: 3747883 - RNA, 13 nt, Salmonella enterica enterica serovar Typhi Ty2
uugcucaauuuuu

SEQ ID NO: 3747884 - RNA, 19 nt, Salmonella enterica enterica serovar Typhi Ty2
uugcucaggcgcgaauaau

SEQ ID NO: 3747885 - RNA, 20 nt, Salmonella enterica enterica serovar Typhi Ty2
uugcuccccaaccgccagcc

SEQ ID NO: 3747886 - RNA, 18 nt, Salmonella enterica enterica serovar Typhi Ty2
uugcucucaggcaguaac

SEQ ID NO: 3747887 - RNA, 17 nt, Salmonella enterica enterica serovar Typhi Ty2
uugcugaagauaaaauu

SEQ ID NO: 3747888 - RNA, 22 nt, Salmonella enterica enterica serovar Typhi Ty2
uugcugacagcaucgauuccgc

SEQ ID NO: 3747889 - RNA, 21 nt, Salmonella enterica enterica serovar Typhi Ty2
uugcugagccaucauuaccaa

SEQ ID NO: 3747890 - RNA, 21 nt, Salmonella enterica enterica serovar Typhi Ty2
uugcugaggaucaccccaaca

SEQ ID NO: 3747891 - RNA, 19 nt, Salmonella enterica enterica serovar Typhi Ty2
uugcugcgccagccagacg

SEQ ID NO: 3747892 - RNA, 18 nt, Salmonella enterica enterica serovar Typhi Ty2
uugcugcggcacgaaaaa

SEQ ID NO: 3747893 - RNA, 15 nt, Salmonella enterica enterica serovar Typhi Ty2
uugcugcgucacgcg

SEQ ID NO: 3747894 - RNA, 15 nt, Salmonella enterica enterica serovar Typhi Ty2
uugcugcuauauaac

SEQ ID NO: 3747895 - RNA, 14 nt, Salmonella enterica enterica serovar Typhi Ty2
uugcuggcgugaac

SEQ ID NO: 3747896 - RNA, 17 nt, Salmonella enterica enterica serovar Typhi Ty2
uugcuggcuugcucagg

SEQ ID NO: 3747897 - RNA, 18 nt, Salmonella enterica enterica serovar Typhi Ty2
uugcuggugccuuccguc

SEQ ID NO: 3747898 - RNA, 16 nt, Salmonella enterica enterica serovar Typhi Ty2
uugcuuauccggccua

SEQ ID NO: 3747899 - RNA, 20 nt, Salmonella enterica enterica serovar Typhi Ty2
uugcuuauuagaggcguaag

SEQ ID NO: 3747900 - RNA, 23 nt, Salmonella enterica enterica serovar Typhi Ty2
uugcuucgcucucgugccaguaa

SEQ ID NO: 3747901 - RNA, 22 nt, Salmonella enterica enterica serovar Typhi Ty2
uugcuugugacggcaaaguucc

SEQ ID NO: 3747902 - RNA, 17 nt, Salmonella enterica enterica serovar Typhi Ty2
uugcuuucaucaauacc

SEQ ID NO: 3747903 - RNA, 17 nt, Salmonella enterica enterica serovar Typhi Ty2
uugcuuuucaucaccau

SEQ ID NO: 3747904 - RNA, 16 nt, Salmonella enterica enterica serovar Typhi Ty2
uugcuuuuucggcaau

SEQ ID NO: 3747905 - RNA, 13 nt, Salmonella enterica enterica serovar Typhi Ty2
uugcuuuuuucca

SEQ ID NO: 3747906 - RNA, 21 nt, Salmonella enterica enterica serovar Typhi Ty2
uuggaaacuaugcaaaacgua

SEQ ID NO: 3747907 - RNA, 18 nt, Salmonella enterica enterica serovar Typhi Ty2
uuggaaccaaacaccaga

SEQ ID NO: 3747908 - RNA, 14 nt, Salmonella enterica enterica serovar Typhi Ty2
uuggacgaggaaaa

SEQ ID NO: 3747909 - RNA, 16 nt, Salmonella enterica enterica serovar Typhi Ty2
uuggacgaggaaaaau

SEQ ID NO: 3747910 - RNA, 16 nt, Salmonella enterica enterica serovar Typhi Ty2
uuggacggcgucacca

SEQ ID NO: 3747911 - RNA, 16 nt, Salmonella enterica enterica serovar Typhi Ty2
uuggauuaacggcaaa

SEQ ID NO: 3747912 - RNA, 14 nt, Salmonella enterica enterica serovar Typhi Ty2
uuggauuauacauu

SEQ ID NO: 3747913 - RNA, 16 nt, Salmonella enterica enterica serovar Typhi Ty2
uuggcaaaccccugcu

SEQ ID NO: 3747914 - RNA, 23 nt, Salmonella enterica enterica serovar Typhi Ty2
uuggcaaacugucgguaaagaaa

SEQ ID NO: 3747915 - RNA, 19 nt, Salmonella enterica enterica serovar Typhi Ty2
uuggcaacggcagccagcg

SEQ ID NO: 3747916 - RNA, 13 nt, Salmonella enterica enterica serovar Typhi Ty2
uuggcaccaccag

SEQ ID NO: 3747917 - RNA, 22 nt, Salmonella enterica enterica serovar Typhi Ty2
uuggcagcccggcguugaaauc

SEQ ID NO: 3747918 - RNA, 21 nt, Salmonella enterica enterica serovar Typhi Ty2
uuggcaggaggggcagauaaa

SEQ ID NO: 3747919 - RNA, 15 nt, Salmonella enterica enterica serovar Typhi Ty2
uuggccagcauggcg

SEQ ID NO: 3747920 - RNA, 11 nt, Salmonella enterica enterica serovar Typhi Ty2
uuggccagcgu

SEQ ID NO: 3747921 - RNA, 22 nt, Salmonella enterica enterica serovar Typhi Ty2
uuggcgaggaacaucagccagc

SEQ ID NO: 3747922 - RNA, 16 nt, Salmonella enterica enterica serovar Typhi Ty2
uuggcgaugcuaucgg

SEQ ID NO: 3747923 - RNA, 14 nt, Salmonella enterica enterica serovar Typhi Ty2
uuggcgauuuccag

SEQ ID NO: 3747924 - RNA, 16 nt, Salmonella enterica enterica serovar Typhi Ty2
uuggcgcgaaccguaa

SEQ ID NO: 3747925 - RNA, 15 nt, Salmonella enterica enterica serovar Typhi Ty2
uuggcgcucaauagc

SEQ ID NO: 3747926 - RNA, 18 nt, Salmonella enterica enterica serovar Typhi Ty2
uuggcguaaaucaggcca

SEQ ID NO: 3747927 - RNA, 19 nt, Salmonella enterica enterica serovar Typhi Ty2
uuggcguaaaucaggccaa

SEQ ID NO: 3747928 - RNA, 13 nt, Salmonella enterica enterica serovar Typhi Ty2
uuggcguauuaug

SEQ ID NO: 3747929 - RNA, 19 nt, Salmonella enterica enterica serovar Typhi Ty2
uuggcuauacgcggcguac

SEQ ID NO: 3747930 - RNA, 21 nt, Salmonella enterica enterica serovar Typhi Ty2
uuuaacgcaaccgucucacca

SEQ ID NO: 3747931 - RNA, 16 nt, Salmonella enterica enterica serovar Typhi Ty2
uuuaagcauccaggaa

SEQ ID NO: 3747932 - RNA, 16 nt, Salmonella enterica enterica serovar Typhi Ty2
uuuaagccgauugaau

SEQ ID NO: 3747933 - RNA, 18 nt, Salmonella enterica enterica serovar Typhi Ty2
uuuaagcgcaggugcgau

SEQ ID NO: 3747934 - RNA, 17 nt, Salmonella enterica enterica serovar Typhi Ty2
uuuaagcgccuccacaa

SEQ ID NO: 3747935 - RNA, 17 nt, Salmonella enterica enterica serovar Typhi Ty2
uuuaagcuggcgaacgu

SEQ ID NO: 3747936 - RNA, 23 nt, Salmonella enterica enterica serovar Typhi Ty2
uuuaaggaauaacgcgcuuuuuu

SEQ ID NO: 3747937 - RNA, 15 nt, Salmonella enterica enterica serovar Typhi Ty2
uuuaaggacauucag

SEQ ID NO: 3747938 - RNA, 16 nt, Salmonella enterica enterica serovar Typhi Ty2
uuuaaggcggcaaaga

SEQ ID NO: 3747939 - RNA, 18 nt, Salmonella enterica enterica serovar Typhi Ty2
uuuaagucaucuguucaa

SEQ ID NO: 3747940 - RNA, 13 nt, Salmonella enterica enterica serovar Typhi Ty2
uuuaauaaagaaa

SEQ ID NO: 3747941 - RNA, 17 nt, Salmonella enterica enterica serovar Typhi Ty2
uuuaaucagauuguugc

SEQ ID NO: 3747942 - RNA, 16 nt, Salmonella enterica enterica serovar Typhi Ty2
uuuaauccaccacagu

SEQ ID NO: 3747943 - RNA, 20 nt, Salmonella enterica enterica serovar Typhi Ty2
uuuaaugcccgguauuuuuu

SEQ ID NO: 3747944 - RNA, 18 nt, Salmonella enterica enterica serovar Typhi Ty2
uuuaaugcuuuccagcca

SEQ ID NO: 3747945 - RNA, 18 nt, Salmonella enterica enterica serovar Typhi Ty2
uuuaauguugccguggca

SEQ ID NO: 3747946 - RNA, 15 nt, Salmonella enterica enterica serovar Typhi Ty2
uuuaauuuucuguaa

SEQ ID NO: 3747947 - RNA, 21 nt, Salmonella enterica enterica serovar Typhi Ty2
uuuaauuuucuguaauucucc

SEQ ID NO: 3747948 - RNA, 14 nt, Salmonella enterica enterica serovar Typhi Ty2
uuuaauuuuuaugu

SEQ ID NO: 3747949 - RNA, 22 nt, Salmonella enterica enterica serovar Typhi Ty2
uuuacaaaauuggguaguaaua

SEQ ID NO: 3747950 - RNA, 14 nt, Salmonella enterica enterica serovar Typhi Ty2
uuuacaauaauucg

SEQ ID NO: 3747951 - RNA, 17 nt, Salmonella enterica enterica serovar Typhi Ty2
uuuacaauuucgcaaac

SEQ ID NO: 3747952 - RNA, 23 nt, Salmonella enterica enterica serovar Typhi Ty2
uuuacauaauguaaaggugagcu

SEQ ID NO: 3747953 - RNA, 18 nt, Salmonella enterica enterica serovar Typhi Ty2
uuuacccacuucuuccag

SEQ ID NO: 3747954 - RNA, 20 nt, Salmonella enterica enterica serovar Typhi Ty2
uuuacccacuucuuccagcg

SEQ ID NO: 3747955 - RNA, 20 nt, Salmonella enterica enterica serovar Typhi Ty2
uuuacccagcgaaugcugca

SEQ ID NO: 3747956 - RNA, 18 nt, Salmonella enterica enterica serovar Typhi Ty2
uuuaccgccgcuuuucag

SEQ ID NO: 3747957 - RNA, 21 nt, Salmonella enterica enterica serovar Typhi Ty2
uuuaccggaucgaucccggca

SEQ ID NO: 3747958 - RNA, 22 nt, Salmonella enterica enterica serovar Typhi Ty2
uuuaccggugcagaccucugca

SEQ ID NO: 3747959 - RNA, 19 nt, Salmonella enterica enterica serovar Typhi Ty2
uuuacgcagcaagaacaga

SEQ ID NO: 3747960 - RNA, 16 nt, Salmonella enterica enterica serovar Typhi Ty2
uuuacgcuuguuguaa

SEQ ID NO: 3747961 - RNA, 22 nt, Salmonella enterica enterica serovar Typhi Ty2
uuuacguaacugcgguaaauaa

SEQ ID NO: 3747962 - RNA, 18 nt, Salmonella enterica enterica serovar Typhi Ty2
uuuacuaaugaauuuaau

SEQ ID NO: 3747963 - RNA, 12 nt, Salmonella enterica enterica serovar Typhi Ty2
uuuacugaauaa

SEQ ID NO: 3747964 - RNA, 18 nt, Salmonella enterica enterica serovar Typhi Ty2
uuuacugcaagcgauguu

SEQ ID NO: 3747965 - RNA, 16 nt, Salmonella enterica enterica serovar Typhi Ty2
uuuacuuaauucugcu

SEQ ID NO: 3747966 - RNA, 16 nt, Salmonella enterica enterica serovar Typhi Ty2
uuuacuucuucaggcu

SEQ ID NO: 3747967 - RNA, 18 nt, Salmonella enterica enterica serovar Typhi Ty2
uuuacuuuuuuaaauguu

SEQ ID NO: 3747968 - RNA, 12 nt, Salmonella enterica enterica serovar Typhi Ty2
uuuagaaaauau

SEQ ID NO: 3747969 - RNA, 14 nt, Salmonella enterica enterica serovar Typhi Ty2
uuuagaaaauauau

SEQ ID NO: 3747970 - RNA, 16 nt, Salmonella enterica enterica serovar Typhi Ty2
uuuagaaccaauagua

SEQ ID NO: 3747971 - RNA, 13 nt, Salmonella enterica enterica serovar Typhi Ty2
uuuagcaccagac

SEQ ID NO: 3747972 - RNA, 13 nt, Salmonella enterica enterica serovar Typhi Ty2
uuuagcauaacgu

SEQ ID NO: 3747973 - RNA, 19 nt, Salmonella enterica enterica serovar Typhi Ty2
uuuagcauaacguuuccuu

SEQ ID NO: 3747974 - RNA, 14 nt, Salmonella enterica enterica serovar Typhi Ty2
uuuagccagcagcg

SEQ ID NO: 3747975 - RNA, 17 nt, Salmonella enterica enterica serovar Typhi Ty2
uuuagcgccauuccugc

SEQ ID NO: 3747976 - RNA, 19 nt, Salmonella enterica enterica serovar Typhi Ty2
uuuagcguaggccacaaag

SEQ ID NO: 3747977 - RNA, 18 nt, Salmonella enterica enterica serovar Typhi Ty2
uuuagcuguucaaucacu

SEQ ID NO: 3747978 - RNA, 11 nt, Salmonella enterica enterica serovar Typhi Ty2
uuuagcuuuuc

SEQ ID NO: 3747979 - RNA, 19 nt, Salmonella enterica enterica serovar Typhi Ty2
uuuaggcggcuucacgcca

SEQ ID NO: 3747980 - RNA, 15 nt, Salmonella enterica enterica serovar Typhi Ty2
uuuaggucaaaaaag

SEQ ID NO: 3747981 - RNA, 17 nt, Salmonella enterica enterica serovar Typhi Ty2
uuuaguuucuuuucguu

SEQ ID NO: 3747982 - RNA, 13 nt, Salmonella enterica enterica serovar Typhi Ty2
uuuauaacauaaa

SEQ ID NO: 3747983 - RNA, 14 nt, Salmonella enterica enterica serovar Typhi Ty2
uuuauaacauaaau

SEQ ID NO: 3747984 - RNA, 15 nt, Salmonella enterica enterica serovar Typhi Ty2
uuuauacucaaaaaa

SEQ ID NO: 3747985 - RNA, 23 nt, Salmonella enterica enterica serovar Typhi Ty2
uuuauagagcgccauauugcugu

SEQ ID NO: 3747986 - RNA, 21 nt, Salmonella enterica enterica serovar Typhi Ty2
uuuauauucugggcuuacuuu

SEQ ID NO: 3747987 - RNA, 14 nt, Salmonella enterica enterica serovar Typhi Ty2
uuuaucaaaaagac

SEQ ID NO: 3747988 - RNA, 21 nt, Salmonella enterica enterica serovar Typhi Ty2
uuuaucaaaaagacuccggca

SEQ ID NO: 3747989 - RNA, 18 nt, Salmonella enterica enterica serovar Typhi Ty2
uuuaucaggccuacaaga

SEQ ID NO: 3747990 - RNA, 20 nt, Salmonella enterica enterica serovar Typhi Ty2
uuuaucaggccuacaagaau

SEQ ID NO: 3747991 - RNA, 23 nt, Salmonella enterica enterica serovar Typhi Ty2
uuuauccacgccgcuaucgacca

SEQ ID NO: 3747992 - RNA, 12 nt, Salmonella enterica enterica serovar Typhi Ty2
uuuauccagcac

SEQ ID NO: 3747993 - RNA, 16 nt, Salmonella enterica enterica serovar Typhi Ty2
uuuauccaguaacgcg

SEQ ID NO: 3747994 - RNA, 17 nt, Salmonella enterica enterica serovar Typhi Ty2
uuuaucgaucuccaucu

SEQ ID NO: 3747995 - RNA, 24 nt, Salmonella enterica enterica serovar Typhi Ty2
uuuaucuauucagguuauuugccu

SEQ ID NO: 3747996 - RNA, 13 nt, Salmonella enterica enterica serovar Typhi Ty2
uuuaucuauuucu

SEQ ID NO: 3747997 - RNA, 22 nt, Salmonella enterica enterica serovar Typhi Ty2
uuuaucuucucuaucagcgccu

SEQ ID NO: 3747998 - RNA, 18 nt, Salmonella enterica enterica serovar Typhi Ty2
uuuaucuuuuacgcuguc

SEQ ID NO: 3747999 - RNA, 22 nt, Salmonella enterica enterica serovar Typhi Ty2
uuuaugacuggggcguuuuuua

SEQ ID NO: 3748000 - RNA, 19 nt, Salmonella enterica enterica serovar Typhi Ty2
uuuaugccggcuaauaguu

SEQ ID NO: 3748001 - RNA, 16 nt, Salmonella enterica enterica serovar Typhi Ty2
uuuaugggaaaauucc

SEQ ID NO: 3748002 - RNA, 11 nt, Salmonella enterica enterica serovar Typhi Ty2
uuuaugguucc

SEQ ID NO: 3748003 - RNA, 13 nt, Salmonella enterica enterica serovar Typhi Ty2
uuuaugugccgau

SEQ ID NO: 3748004 - RNA, 18 nt, Salmonella enterica enterica serovar Typhi Ty2
uuuauguuugcugauaag

SEQ ID NO: 3748005 - RNA, 13 nt, Salmonella enterica enterica serovar Typhi Ty2
uuuauuaacccuu

SEQ ID NO: 3748006 - RNA, 22 nt, Salmonella enterica enterica serovar Typhi Ty2
uuuauuacgcgcucucauaagc

SEQ ID NO: 3748007 - RNA, 17 nt, Salmonella enterica enterica serovar Typhi Ty2
uuuauuaguaauaucag

SEQ ID NO: 3748008 - RNA, 22 nt, Salmonella enterica enterica serovar Typhi Ty2
uuuauugaagugcgaaauuuaa

SEQ ID NO: 3748009 - RNA, 18 nt, Salmonella enterica enterica serovar Typhi Ty2
uuuauugaugacauuaau

SEQ ID NO: 3748010 - RNA, 23 nt, Salmonella enterica enterica serovar Typhi Ty2
uuuauugggcguaagaaaaguuu

SEQ ID NO: 3748011 - RNA, 23 nt, Salmonella enterica enterica serovar Typhi Ty2
uuuauuuggcucugaagcguaaa

SEQ ID NO: 3748012 - RNA, 13 nt, Salmonella enterica enterica serovar Typhi Ty2
uuugauugccauc

SEQ ID NO: 3748013 - RNA, 18 nt, Salmonella enterica enterica serovar Typhi Ty2
uuugauuuauuuugaauu

SEQ ID NO: 3748014 - RNA, 23 nt, Salmonella enterica enterica serovar Typhi Ty2
uuugauuuauuuugaauuuuuau

SEQ ID NO: 3748015 - RNA, 22 nt, Salmonella enterica enterica serovar Typhi Ty2
uuugauuuguuuuuuauauuuu

SEQ ID NO: 3748016 - RNA, 20 nt, Salmonella enterica enterica serovar Typhi Ty2
uuugcaccgcuaaaaaacag

SEQ ID NO: 3748017 - RNA, 22 nt, Salmonella enterica enterica serovar Typhi Ty2
uuugcacggcaucuuuguucug

SEQ ID NO: 3748018 - RNA, 17 nt, Salmonella enterica enterica serovar Typhi Ty2
uuugcacguucugcugg

SEQ ID NO: 3748019 - RNA, 12 nt, Salmonella enterica enterica serovar Typhi Ty2
uuugcagaaaau

SEQ ID NO: 3748020 - RNA, 18 nt, Salmonella enterica enterica serovar Typhi Ty2
uuugcagcaacugauuca

SEQ ID NO: 3748021 - RNA, 16 nt, Salmonella enterica enterica serovar Typhi Ty2
uuugcaggccggauaa

SEQ ID NO: 3748022 - RNA, 19 nt, Salmonella enterica enterica serovar Typhi Ty2
uuugcagguuacucacugc

SEQ ID NO: 3748023 - RNA, 21 nt, Salmonella enterica enterica serovar Typhi Ty2
uuugcagguuacucacugccg

SEQ ID NO: 3748024 - RNA, 21 nt, Salmonella enterica enterica serovar Typhi Ty2
uuugcaguuccgcaauccugg

SEQ ID NO: 3748025 - RNA, 17 nt, Salmonella enterica enterica serovar Typhi Ty2
uuugcauaccaaguuug

SEQ ID NO: 3748026 - RNA, 13 nt, Salmonella enterica enterica serovar Typhi Ty2
uuugcauucgcuc

SEQ ID NO: 3748027 - RNA, 15 nt, Salmonella enterica enterica serovar Typhi Ty2
uuugcauucgcuccu

SEQ ID NO: 3748028 - RNA, 14 nt, Salmonella enterica enterica serovar Typhi Ty2
uuugcauugccacu

SEQ ID NO: 3748029 - RNA, 16 nt, Salmonella enterica enterica serovar Typhi Ty2
uuugccaaacugcugg

SEQ ID NO: 3748030 - RNA, 20 nt, Salmonella enterica enterica serovar Typhi Ty2
uuugccaaauauucucccua

SEQ ID NO: 3748031 - RNA, 14 nt, Salmonella enterica enterica serovar Typhi Ty2
uuugccauccggcg

SEQ ID NO: 3748032 - RNA, 15 nt, Salmonella enterica enterica serovar Typhi Ty2
uuugccucuggccag

SEQ ID NO: 3748033 - RNA, 21 nt, Salmonella enterica enterica serovar Typhi Ty2
uuugccucuggccaguuucaa

SEQ ID NO: 3748034 - RNA, 14 nt, Salmonella enterica enterica serovar Typhi Ty2
uuugccuuucuuau

SEQ ID NO: 3748035 - RNA, 15 nt, Salmonella enterica enterica serovar Typhi Ty2
uuugcgacacgcugc

SEQ ID NO: 3748036 - RNA, 23 nt, Salmonella enterica enterica serovar Typhi Ty2
uuugcgcagcaacgucucgacau

SEQ ID NO: 3748037 - RNA, 20 nt, Salmonella enterica enterica serovar Typhi Ty2
uuugcgcaguuuaaaucaca

SEQ ID NO: 3748038 - RNA, 23 nt, Salmonella enterica enterica serovar Typhi Ty2
uuugcgccggcaguccuugcagc

SEQ ID NO: 3748039 - RNA, 18 nt, Salmonella enterica enterica serovar Typhi Ty2
uuugcgcgaggucgagcu

SEQ ID NO: 3748040 - RNA, 21 nt, Salmonella enterica enterica serovar Typhi Ty2
uuugcgcgaggucgagcucag

SEQ ID NO: 3748041 - RNA, 15 nt, Salmonella enterica enterica serovar Typhi Ty2
uuugcgcuacgcugc

SEQ ID NO: 3748042 - RNA, 19 nt, Salmonella enterica enterica serovar Typhi Ty2
uuugcggcgucgccuggug

SEQ ID NO: 3748043 - RNA, 16 nt, Salmonella enterica enterica serovar Typhi Ty2
uuugcgguuuuaauuu

SEQ ID NO: 3748044 - RNA, 18 nt, Salmonella enterica enterica serovar Typhi Ty2
uuugcgguuuuaauuucc

SEQ ID NO: 3748045 - RNA, 15 nt, Salmonella enterica enterica serovar Typhi Ty2
uuugcguaaaaaaca

SEQ ID NO: 3748046 - RNA, 18 nt, Salmonella enterica enterica serovar Typhi Ty2
uuugcguaaaaaacauca

SEQ ID NO: 3748047 - RNA, 19 nt, Salmonella enterica enterica serovar Typhi Ty2
uuugcuacaccccuucugg

SEQ ID NO: 3748048 - RNA, 20 nt, Salmonella enterica enterica serovar Typhi Ty2
uuugcucaggcuccgcgcag

SEQ ID NO: 3748049 - RNA, 22 nt, Salmonella enterica enterica serovar Typhi Ty2
uuugcucaguucagcggucaua

SEQ ID NO: 3748050 - RNA, 15 nt, Salmonella enterica enterica serovar Typhi Ty2
uuugcugacaaucug

SEQ ID NO: 3748051 - RNA, 15 nt, Salmonella enterica enterica serovar Typhi Ty2
uuugcugcauuucuu

SEQ ID NO: 3748052 - RNA, 19 nt, Salmonella enterica enterica serovar Typhi Ty2
uuugcugcauuucuuguug

SEQ ID NO: 3748053 - RNA, 11 nt, Salmonella enterica enterica serovar Typhi Ty2
uuugcugccac

SEQ ID NO: 3748054 - RNA, 11 nt, Salmonella enterica enterica serovar Typhi Ty2
uuugcugcugc

SEQ ID NO: 3748055 - RNA, 20 nt, Salmonella enterica enterica serovar Typhi Ty2
uuugcuggaaaaauaagagg

SEQ ID NO: 3748056 - RNA, 21 nt, Salmonella enterica enterica serovar Typhi Ty2
uuugcugguugucucaaaaaa

SEQ ID NO: 3748057 - RNA, 16 nt, Salmonella enterica enterica serovar Typhi Ty2
uuugcuuauccggccu

SEQ ID NO: 3748058 - RNA, 12 nt, Salmonella enterica enterica serovar Typhi Ty2
uuugcuuccagu

SEQ ID NO: 3748059 - RNA, 22 nt, Salmonella enterica enterica serovar Typhi Ty2
uuugcuucgccaucuccaucau

SEQ ID NO: 3748060 - RNA, 18 nt, Salmonella enterica enterica serovar Typhi Ty2
uuugcuucucgccuucgg

SEQ ID NO: 3748061 - RNA, 21 nt, Salmonella enterica enterica serovar Typhi Ty2
uuugcuucucgccuucggccu

SEQ ID NO: 3748062 - RNA, 17 nt, Salmonella enterica enterica serovar Typhi Ty2
uuugcuuucucgggccu

SEQ ID NO: 3748063 - RNA, 12 nt, Salmonella enterica enterica serovar Typhi Ty2
uuugcuuuguag

SEQ ID NO: 3748064 - RNA, 21 nt, Salmonella enterica enterica serovar Typhi Ty2
uuuggcaaucaaauccagcuc

SEQ ID NO: 3748065 - RNA, 20 nt, Salmonella enterica enterica serovar Typhi Ty2
uuuggcagacagccauauuu

SEQ ID NO: 3748066 - RNA, 24 nt, Salmonella enterica enterica serovar Typhi Ty2
uuuggcaggccucuaucuucucag

SEQ ID NO: 3748067 - RNA, 13 nt, Salmonella enterica enterica serovar Typhi Ty2
uuuggccugcugc

SEQ ID NO: 3748068 - RNA, 15 nt, Salmonella enterica enterica serovar Typhi Ty2
uuuggcgauuuucag

SEQ ID NO: 3748069 - RNA, 21 nt, Salmonella enterica enterica serovar Typhi Ty2
uuuggcgcgaaauguauuuuu

SEQ ID NO: 3748070 - RNA, 22 nt, Salmonella enterica enterica serovar Typhi Ty2
uuuggcguaaucgauaagcuca

SEQ ID NO: 3748071 - RNA, 19 nt, Salmonella enterica enterica serovar Typhi Ty2
uuuggcucacugcuaagga

SEQ ID NO: 3748072 - RNA, 17 nt, Salmonella enterica enterica serovar Typhi Ty2
uuuggcuuaaauaaucu

SEQ ID NO: 3748073 - RNA, 21 nt, Salmonella enterica enterica serovar Typhi Ty2
uuugggaauuagcgaaucaca

SEQ ID NO: 3748074 - RNA, 21 nt, Salmonella enterica enterica serovar Typhi Ty2
uuuggugcccgcguggaaaac

SEQ ID NO: 3748075 - RNA, 18 nt, Salmonella enterica enterica serovar Typhi Ty2
uuugguuacuauuuuuca

SEQ ID NO: 3748076 - RNA, 17 nt, Salmonella enterica enterica serovar Typhi Ty2
uuuguaaaauacauucu

SEQ ID NO: 3748077 - RNA, 19 nt, Salmonella enterica enterica serovar Typhi Ty2
uuuguaaacccgauucugc

SEQ ID NO: 3748078 - RNA, 17 nt, Salmonella enterica enterica serovar Typhi Ty2
uuuguaacauauuuuua

SEQ ID NO: 3748079 - RNA, 19 nt, Salmonella enterica enterica serovar Typhi Ty2
uuuguaaccaacaaacgcg

SEQ ID NO: 3748080 - RNA, 18 nt, Salmonella enterica enterica serovar Typhi Ty2
uuuguacguauuuacaaa

SEQ ID NO: 3748081 - RNA, 16 nt, Salmonella enterica enterica serovar Typhi Ty2
uuuguacuucagagcu

SEQ ID NO: 3748082 - RNA, 19 nt, Salmonella enterica enterica serovar Typhi Ty2
uuuguaggccugauaagcg

SEQ ID NO: 3748083 - RNA, 16 nt, Salmonella enterica enterica serovar Typhi Ty2
uuugucuccucgccag

SEQ ID NO: 3748084 - RNA, 18 nt, Salmonella enterica enterica serovar Typhi Ty2
uuugucugucggacucag

SEQ ID NO: 3748085 - RNA, 23 nt, Salmonella enterica enterica serovar Typhi Ty2
uuuguggccugcuuaaacaguau

SEQ ID NO: 3748086 - RNA, 16 nt, Salmonella enterica enterica serovar Typhi Ty2
uuuguggcguguggcu

SEQ ID NO: 3748087 - RNA, 18 nt, Salmonella enterica enterica serovar Typhi Ty2
uuuguuaucuacagugua

SEQ ID NO: 3748088 - RNA, 22 nt, Salmonella enterica enterica serovar Typhi Ty2
uuuguucagacacauucuguga

SEQ ID NO: 3748089 - RNA, 14 nt, Salmonella enterica enterica serovar Typhi Ty2
uuuguugauuuuau

SEQ ID NO: 3748090 - RNA, 20 nt, Salmonella enterica enterica serovar Typhi Ty2
uuuguuggaaaugcguggca

SEQ ID NO: 3748091 - RNA, 14 nt, Salmonella enterica enterica serovar Typhi Ty2
uuuguuuuuuauau

SEQ ID NO: 3748092 - RNA, 13 nt, Salmonella enterica enterica serovar Typhi Ty2
uuuuaaaaaaccg

SEQ ID NO: 3748093 - RNA, 12 nt, Salmonella enterica enterica serovar Typhi Ty2
uuuuaaaagaag

SEQ ID NO: 3748094 - RNA, 19 nt, Salmonella enterica enterica serovar Typhi Ty2
uuuucucguguagccagua

SEQ ID NO: 3748095 - RNA, 23 nt, Salmonella enterica enterica serovar Typhi Ty2
uuuucucuucugcugacaucucu

SEQ ID NO: 3748096 - RNA, 20 nt, Salmonella enterica enterica serovar Typhi Ty2
uuuucugucguguccuugcc

SEQ ID NO: 3748097 - RNA, 16 nt, Salmonella enterica enterica serovar Typhi Ty2
uuuucuuauuacaaga

SEQ ID NO: 3748098 - RNA, 23 nt, Salmonella enterica enterica serovar Typhi Ty2
uuuucuucuggccauuucaucau

SEQ ID NO: 3748099 - RNA, 12 nt, Salmonella enterica enterica serovar Typhi Ty2
uuuucuucuucg

SEQ ID NO: 3748100 - RNA, 18 nt, Salmonella enterica enterica serovar Typhi Ty2
uuuugacaacaaaaagau

SEQ ID NO: 3748101 - RNA, 23 nt, Salmonella enterica enterica serovar Typhi Ty2
uuuugacugcgggggcaaaugcg

SEQ ID NO: 3748102 - RNA, 20 nt, Salmonella enterica enterica serovar Typhi Ty2
uuuugauaagagaaaauacc

SEQ ID NO: 3748103 - RNA, 21 nt, Salmonella enterica enterica serovar Typhi Ty2
uuuugcccgaucccaugcuca

SEQ ID NO: 3748104 - RNA, 10 nt, Salmonella enterica enterica serovar Typhi Ty2
uuuugccgcc

SEQ ID NO: 3748105 - RNA, 21 nt, Salmonella enterica enterica serovar Typhi Ty2
uuuugccgcccagucacggcu

SEQ ID NO: 3748106 - RNA, 17 nt, Salmonella enterica enterica serovar Typhi Ty2
uuuugccguugcuguuc

SEQ ID NO: 3748107 - RNA, 19 nt, Salmonella enterica enterica serovar Typhi Ty2
uuuugcgccuaccgccaua

SEQ ID NO: 3748108 - RNA, 20 nt, Salmonella enterica enterica serovar Typhi Ty2
uuuuggcaacggcagccagc

SEQ ID NO: 3748109 - RNA, 11 nt, Salmonella enterica enterica serovar Typhi Ty2
uuuuggcagcc

SEQ ID NO: 3748110 - RNA, 17 nt, Salmonella enterica enterica serovar Typhi Ty2
uuuuggccggaccugcg

SEQ ID NO: 3748111 - RNA, 14 nt, Salmonella enterica enterica serovar Typhi Ty2
uuuugguaucuucu

SEQ ID NO: 3748112 - RNA, 15 nt, Salmonella enterica enterica serovar Typhi Ty2
uuuuguagacucgcg

SEQ ID NO: 3748113 - RNA, 21 nt, Salmonella enterica enterica serovar Typhi Ty2
uuuuguauuccuucggugcca

SEQ ID NO: 3748114 - RNA, 23 nt, Salmonella enterica enterica serovar Typhi Ty2
uuuuguauugcgcgucacaagcu

SEQ ID NO: 3748115 - RNA, 20 nt, Salmonella enterica enterica serovar Typhi Ty2
uuuuguggccugcuuaaaca

SEQ ID NO: 3748116 - RNA, 18 nt, Salmonella enterica enterica serovar Typhi Ty2
uuuugugucaaaaaguug

SEQ ID NO: 3748117 - RNA, 13 nt, Salmonella enterica enterica serovar Typhi Ty2
uuuuuaaaaaacc

SEQ ID NO: 3748118 - RNA, 16 nt, Salmonella enterica enterica serovar Typhi Ty2
uuuuuaauauaagccu

SEQ ID NO: 3748119 - RNA, 15 nt, Salmonella enterica enterica serovar Typhi Ty2
uuuuuaauccaggaa

SEQ ID NO: 3748120 - RNA, 12 nt, Salmonella enterica enterica serovar Typhi Ty2
uuuuuaccaauu

SEQ ID NO: 3748121 - RNA, 22 nt, Salmonella enterica enterica serovar Typhi Ty2
uuuuuaccgcauuauaaauauc

SEQ ID NO: 3748122 - RNA, 14 nt, Salmonella enterica enterica serovar Typhi Ty2
uuuuuacgccauaa

SEQ ID NO: 3748123 - RNA, 22 nt, Salmonella enterica enterica serovar Typhi Ty2
uuuuuacgccauaacacaaacu

SEQ ID NO: 3748124 - RNA, 16 nt, Salmonella enterica enterica serovar Typhi Ty2
uuuuuacgccugaacg

SEQ ID NO: 3748125 - RNA, 20 nt, Salmonella enterica enterica serovar Typhi Ty2
uuuuuagccuguuauucaau

SEQ ID NO: 3748126 - RNA, 17 nt, Salmonella enterica enterica serovar Typhi Ty2
uuuuuaggccaaacuua

SEQ ID NO: 3748127 - RNA, 23 nt, Salmonella enterica enterica serovar Typhi Ty2
uuuuuaggcuauaaaaaucaucc

SEQ ID NO: 3748128 - RNA, 12 nt, Salmonella enterica enterica serovar Typhi Ty2
uuuuucagaucg

SEQ ID NO: 3748129 - RNA, 12 nt, Salmonella enterica enterica serovar Typhi Ty2
uuuuucagaucu

SEQ ID NO: 3748130 - RNA, 14 nt, Salmonella enterica enterica serovar Typhi Ty2
uuuuucagccgcgc

SEQ ID NO: 3748131 - RNA, 13 nt, Salmonella enterica enterica serovar Typhi Ty2
uuuuucagcggca

SEQ ID NO: 3748132 - RNA, 13 nt, Salmonella enterica enterica serovar Typhi Ty2
uuuuucaucauac

SEQ ID NO: 3748133 - RNA, 16 nt, Salmonella enterica enterica serovar Typhi Ty2
uuuuucgaucagcaua

SEQ ID NO: 3748134 - RNA, 16 nt, Salmonella enterica enterica serovar Typhi Ty2
uuuuucgccgcgcgga

SEQ ID NO: 3748135 - RNA, 15 nt, Salmonella enterica enterica serovar Typhi Ty2
uuuuugaccauucca

SEQ ID NO: 3748136 - RNA, 19 nt, Salmonella enterica enterica serovar Typhi Ty2
uuuuugaguuugucaucca

SEQ ID NO: 3748137 - RNA, 22 nt, Salmonella enterica enterica serovar Typhi Ty2
uuuuugcacggcaucuuuguuc

SEQ ID NO: 3748138 - RNA, 17 nt, Salmonella enterica enterica serovar Typhi Ty2
uuuuugccacauuuccc

SEQ ID NO: 3748139 - RNA, 21 nt, Salmonella enterica enterica serovar Typhi Ty2
uuuuugcgacacgcugcauau

SEQ ID NO: 3748140 - RNA, 18 nt, Salmonella enterica enterica serovar Typhi Ty2
uuuuugcuuuaauauuca

SEQ ID NO: 3748141 - RNA, 21 nt, Salmonella enterica enterica serovar Typhi Ty2
uuuuuucuguuauuuccgcaa

SEQ ID NO: 3748142 - RNA, 11 nt, Salmonella enterica enterica serovar Typhi Ty2
uuuuuuggcag

SEQ ID NO: 3748143 - RNA, 10 nt, Salmonella enterica enterica serovar Typhi Ty2
uuuuuuugca

SEQ ID NO: 3748144 - RNA, 11 nt, Salmonella enterica enterica serovar Typhi Ty2
uuuuuuugccc

SEQ ID NO: 3748145 - RNA, 18 nt, Salmonella typhimurium LT2
aaaaaacaagauuaauuu

SEQ ID NO: 3748146 - RNA, 13 nt, Salmonella typhimurium LT2
aaaaaacaccugu

SEQ ID NO: 3748147 - RNA, 10 nt, Salmonella typhimurium LT2
aaaaaacagg

SEQ ID NO: 3748148 - RNA, 13 nt, Salmonella typhimurium LT2
aaaaaacaucaug

SEQ ID NO: 3748149 - RNA, 14 nt, Salmonella typhimurium LT2
aaaaaaccagaauu

SEQ ID NO: 3748150 - RNA, 12 nt, Salmonella typhimurium LT2
aaaaaaccguau

SEQ ID NO: 3748151 - RNA, 17 nt, Salmonella typhimurium LT2
aaaaaacggaaccaaaa

SEQ ID NO: 3748152 - RNA, 15 nt, Salmonella typhimurium LT2
aaaaaagaaaaauau

SEQ ID NO: 3748153 - RNA, 13 nt, Salmonella typhimurium LT2
aaaaaagagaagc

SEQ ID NO: 3748154 - RNA, 22 nt, Salmonella typhimurium LT2
aaaaaagcugcgaucaaguuuu

SEQ ID NO: 3748155 - RNA, 21 nt, Salmonella typhimurium LT2
aaaaaagugauucacuuucuu

SEQ ID NO: 3748156 - RNA, 21 nt, Salmonella typhimurium LT2
aaaaaauacugauaaaaaaca

SEQ ID NO: 3748157 - RNA, 13 nt, Salmonella typhimurium LT2
aaaaaauauguuc

SEQ ID NO: 3748158 - RNA, 12 nt, Salmonella typhimurium LT2
aaaaaaugccgu

SEQ ID NO: 3748159 - RNA, 17 nt, Salmonella typhimurium LT2
aaaaaaugguuuuauuu

SEQ ID NO: 3748160 - RNA, 20 nt, Salmonella typhimurium LT2
aaaaaauuaaaauucauuau

SEQ ID NO: 3748161 - RNA, 12 nt, Salmonella typhimurium LT2
aaaaaauuacga

SEQ ID NO: 3748162 - RNA, 17 nt, Salmonella typhimurium LT2
aaaaaauuaucauguau

SEQ ID NO: 3748163 - RNA, 20 nt, Salmonella typhimurium LT2
aaaaacaacucuauuaaaau

SEQ ID NO: 3748164 - RNA, 12 nt, Salmonella typhimurium LT2
aaaaacagccau

SEQ ID NO: 3748165 - RNA, 11 nt, Salmonella typhimurium LT2
aaaaacaucau

SEQ ID NO: 3748166 - RNA, 15 nt, Salmonella typhimurium LT2
aaaaaccauuuauaa

SEQ ID NO: 3748167 - RNA, 20 nt, Salmonella typhimurium LT2
aaaaaccauuuauaaaauau

SEQ ID NO: 3748168 - RNA, 20 nt, Salmonella typhimurium LT2
aaaaacgcgcucgccagcgc

SEQ ID NO: 3748169 - RNA, 22 nt, Salmonella typhimurium LT2
aaaaacgcgcucgccagcgcag

SEQ ID NO: 3748170 - RNA, 19 nt, Salmonella typhimurium LT2
aaaaacgggagauuguuau

SEQ ID NO: 3748171 - RNA, 16 nt, Salmonella typhimurium LT2
aaaaacucaaagcguu

SEQ ID NO: 3748172 - RNA, 18 nt, Salmonella typhimurium LT2
aaaaacucaggaaaucgu

SEQ ID NO: 3748173 - RNA, 14 nt, Salmonella typhimurium LT2
aaaaagagaaaaaa

SEQ ID NO: 3748174 - RNA, 15 nt, Salmonella typhimurium LT2
aaaaagagaaaaaau

SEQ ID NO: 3748175 - RNA, 16 nt, Salmonella typhimurium LT2
aaaaagagaaaaaauu

SEQ ID NO: 3748176 - RNA, 11 nt, Salmonella typhimurium LT2
aaaaagagaag

SEQ ID NO: 3748177 - RNA, 14 nt, Salmonella typhimurium LT2
aaaaagaggaaagc

SEQ ID NO: 3748178 - RNA, 14 nt, Salmonella typhimurium LT2
aaaaagauugcugu

SEQ ID NO: 3748179 - RNA, 21 nt, Salmonella typhimurium LT2
aaaaagcgaucaccucuucca

SEQ ID NO: 3748180 - RNA, 21 nt, Salmonella typhimurium LT2
aaaaagcugugccacauuuau

SEQ ID NO: 3748181 - RNA, 20 nt, Salmonella typhimurium LT2
aaaaaggcgaacuccagcgc

SEQ ID NO: 3748182 - RNA, 17 nt, Salmonella typhimurium LT2
aaaaagggaauaauaca

SEQ ID NO: 3748183 - RNA, 15 nt, Salmonella typhimurium LT2
aaaaauaaaaaaacc

SEQ ID NO: 3748184 - RNA, 20 nt, Salmonella typhimurium LT2
aaaaauaauuacuaucuuca

SEQ ID NO: 3748185 - RNA, 22 nt, Salmonella typhimurium LT2
aaaauaaacgcuugacucugaa

SEQ ID NO: 3748186 - RNA, 13 nt, Salmonella typhimurium LT2
aaaauaaaggugc

SEQ ID NO: 3748187 - RNA, 12 nt, Salmonella typhimurium LT2
aaaauaaauuaa

SEQ ID NO: 3748188 - RNA, 18 nt, Salmonella typhimurium LT2
aaaauaacgaaaaugccc

SEQ ID NO: 3748189 - RNA, 13 nt, Salmonella typhimurium LT2
aaaauaacgcgau

SEQ ID NO: 3748190 - RNA, 15 nt, Salmonella typhimurium LT2
aaaauaccccagcgc

SEQ ID NO: 3748191 - RNA, 21 nt, Salmonella typhimurium LT2
aaaauagcccggcuucccauc

SEQ ID NO: 3748192 - RNA, 19 nt, Salmonella typhimurium LT2
aaaauagccgccaugcgac

SEQ ID NO: 3748193 - RNA, 13 nt, Salmonella typhimurium LT2
aaaauagccugaa

SEQ ID NO: 3748194 - RNA, 21 nt, Salmonella typhimurium LT2
aaaauagcuuaccuggcgauc

SEQ ID NO: 3748195 - RNA, 19 nt, Salmonella typhimurium LT2
aaaauaggcguaaagauua

SEQ ID NO: 3748196 - RNA, 20 nt, Salmonella typhimurium LT2
aaaauaggcguaaagauuag

SEQ ID NO: 3748197 - RNA, 23 nt, Salmonella typhimurium LT2
aaaauauacaccugacggcagcc

SEQ ID NO: 3748198 - RNA, 11 nt, Salmonella typhimurium LT2
aaaauauccuc

SEQ ID NO: 3748199 - RNA, 13 nt, Salmonella typhimurium LT2
aaaauauccucca

SEQ ID NO: 3748200 - RNA, 24 nt, Salmonella typhimurium LT2
aaaauaucggccugaaugcucuca

SEQ ID NO: 3748201 - RNA, 14 nt, Salmonella typhimurium LT2
aaaauaucugaaua

SEQ ID NO: 3748202 - RNA, 15 nt, Salmonella typhimurium LT2
aaaauaucugaauaa

SEQ ID NO: 3748203 - RNA, 12 nt, Salmonella typhimurium LT2
aaaauauguucc

SEQ ID NO: 3748204 - RNA, 21 nt, Salmonella typhimurium LT2
aaaauauuuaacuuaaauaaa

SEQ ID NO: 3748205 - RNA, 13 nt, Salmonella typhimurium LT2
aaaaucagcagcg

SEQ ID NO: 3748206 - RNA, 18 nt, Salmonella typhimurium LT2
aaaaucccggcuggguuc

SEQ ID NO: 3748207 - RNA, 15 nt, Salmonella typhimurium LT2
aaaauccggcaggca

SEQ ID NO: 3748208 - RNA, 21 nt, Salmonella typhimurium LT2
aaaauccggcugccugccgga

SEQ ID NO: 3748209 - RNA, 23 nt, Salmonella typhimurium LT2
aaaauccguagcuguaacagucc

SEQ ID NO: 3748210 - RNA, 19 nt, Salmonella typhimurium LT2
aaaauccugcacuuccagc

SEQ ID NO: 3748211 - RNA, 18 nt, Salmonella typhimurium LT2
aaaauccuucuuccauuc

SEQ ID NO: 3748212 - RNA, 22 nt, Salmonella typhimurium LT2
aaaaucggggucuuccagcaga

SEQ ID NO: 3748213 - RNA, 14 nt, Salmonella typhimurium LT2
aaaaugaauaccaa

SEQ ID NO: 3748214 - RNA, 23 nt, Salmonella typhimurium LT2
aaaaugagauugauaaucagcaa

SEQ ID NO: 3748215 - RNA, 21 nt, Salmonella typhimurium LT2
aaaaugccauauacauaugga

SEQ ID NO: 3748216 - RNA, 22 nt, Salmonella typhimurium LT2
aaaaugccgcccauccagagca

SEQ ID NO: 3748217 - RNA, 14 nt, Salmonella typhimurium LT2
aaaaugcgcaugau

SEQ ID NO: 3748218 - RNA, 18 nt, Salmonella typhimurium LT2
aaaaugcgcuaacgucgc

SEQ ID NO: 3748219 - RNA, 18 nt, Salmonella typhimurium LT2
aaaaugcggcauccggcu

SEQ ID NO: 3748220 - RNA, 21 nt, Salmonella typhimurium LT2
aaaauggaggcgcccacaaug

SEQ ID NO: 3748221 - RNA, 18 nt, Salmonella typhimurium LT2
aaaauggcaauugcgccg

SEQ ID NO: 3748222 - RNA, 21 nt, Salmonella typhimurium LT2
aaaauuaaacaagauaaugga

SEQ ID NO: 3748223 - RNA, 22 nt, Salmonella typhimurium LT2
aaaauuaacgacaaaaauacca

SEQ ID NO: 3748224 - RNA, 23 nt, Salmonella typhimurium LT2
aaaauuaagcgacccgauaaaca

SEQ ID NO: 3748225 - RNA, 13 nt, Salmonella typhimurium LT2
aaaauuaccaggc

SEQ ID NO: 3748226 - RNA, 18 nt, Salmonella typhimurium LT2
aaaauuacuucguagacu

SEQ ID NO: 3748227 - RNA, 15 nt, Salmonella typhimurium LT2
aaaauuauauucuaa

SEQ ID NO: 3748228 - RNA, 23 nt, Salmonella typhimurium LT2
aaaauuaugaauaaccaucggac

SEQ ID NO: 3748229 - RNA, 16 nt, Salmonella typhimurium LT2
aaaauucauuauaaaa

SEQ ID NO: 3748230 - RNA, 18 nt, Salmonella typhimurium LT2
aaaauugcgaggugguuu

SEQ ID NO: 3748231 - RNA, 11 nt, Salmonella typhimurium LT2
aaaauuuuuau

SEQ ID NO: 3748232 - RNA, 23 nt, Salmonella typhimurium LT2
aaaauuuuuauagucuaauaaca

SEQ ID NO: 3748233 - RNA, 15 nt, Salmonella typhimurium LT2
aaacaaaccaaacug

SEQ ID NO: 3748234 - RNA, 12 nt, Salmonella typhimurium LT2
aaacaacucuau

SEQ ID NO: 3748235 - RNA, 17 nt, Salmonella typhimurium LT2
aaacaacucuauuaaaa

SEQ ID NO: 3748236 - RNA, 19 nt, Salmonella typhimurium LT2
aaacaagauuaauuuaauu

SEQ ID NO: 3748237 - RNA, 17 nt, Salmonella typhimurium LT2
aaacaauuuacgcagcc

SEQ ID NO: 3748238 - RNA, 13 nt, Salmonella typhimurium LT2
aaacacaaauuuc

SEQ ID NO: 3748239 - RNA, 19 nt, Salmonella typhimurium LT2
aaacacagcucaauaucau

SEQ ID NO: 3748240 - RNA, 13 nt, Salmonella typhimurium LT2
aaacaccagaaug

SEQ ID NO: 3748241 - RNA, 14 nt, Salmonella typhimurium LT2
aaacaccauuuuuu

SEQ ID NO: 3748242 - RNA, 23 nt, Salmonella typhimurium LT2
aaacaccugucugucaaaaccca

SEQ ID NO: 3748243 - RNA, 13 nt, Salmonella typhimurium LT2
aaacacgaggcug

SEQ ID NO: 3748244 - RNA, 17 nt, Salmonella typhimurium LT2
aaacacgccuccauaca

SEQ ID NO: 3748245 - RNA, 15 nt, Salmonella typhimurium LT2
aaacacucuccacca

SEQ ID NO: 3748246 - RNA, 11 nt, Salmonella typhimurium LT2
aaacagaauuu

SEQ ID NO: 3748247 - RNA, 14 nt, Salmonella typhimurium LT2
aaacagcaaaucgg

SEQ ID NO: 3748248 - RNA, 21 nt, Salmonella typhimurium LT2
aaacagcagcgcggcacacag

SEQ ID NO: 3748249 - RNA, 23 nt, Salmonella typhimurium LT2
aaacagcaguucguaauuuaaac

SEQ ID NO: 3748250 - RNA, 17 nt, Salmonella typhimurium LT2
aaacagccaaucauaaa

SEQ ID NO: 3748251 - RNA, 20 nt, Salmonella typhimurium LT2
aaacagcgccccgacaaaac

SEQ ID NO: 3748252 - RNA, 21 nt, Salmonella typhimurium LT2
aaacagcgccggcaacagcuc

SEQ ID NO: 3748253 - RNA, 19 nt, Salmonella typhimurium LT2
aaacagcgugggaagcagc

SEQ ID NO: 3748254 - RNA, 20 nt, Salmonella typhimurium LT2
aaacagcgugggaagcagca

SEQ ID NO: 3748255 - RNA, 21 nt, Salmonella typhimurium LT2
aaacagcgugggaagcagcag

SEQ ID NO: 3748256 - RNA, 16 nt, Salmonella typhimurium LT2
aaacagcuguaaaucg

SEQ ID NO: 3748257 - RNA, 15 nt, Salmonella typhimurium LT2
aaacagggcuucuuu

SEQ ID NO: 3748258 - RNA, 19 nt, Salmonella typhimurium LT2
aaacagguacuuacccaga

SEQ ID NO: 3748259 - RNA, 21 nt, Salmonella typhimurium LT2
aaacaguccggcgaaaaaaga

SEQ ID NO: 3748260 - RNA, 16 nt, Salmonella typhimurium LT2
aaacagugauuacaaa

SEQ ID NO: 3748261 - RNA, 15 nt, Salmonella typhimurium LT2
aaacauaagcaaauc

SEQ ID NO: 3748262 - RNA, 15 nt, Salmonella typhimurium LT2
aaacaucauuucuac

SEQ ID NO: 3748263 - RNA, 20 nt, Salmonella typhimurium LT2
aaacaucauuucuacaaaug

SEQ ID NO: 3748264 - RNA, 14 nt, Salmonella typhimurium LT2
aaaccaaacaccag

SEQ ID NO: 3748265 - RNA, 14 nt, Salmonella typhimurium LT2
aaaccaaacagcga

SEQ ID NO: 3748266 - RNA, 20 nt, Salmonella typhimurium LT2
aaaccaaccacggggcaugc

SEQ ID NO: 3748267 - RNA, 14 nt, Salmonella typhimurium LT2
aaaccacaaucaca

SEQ ID NO: 3748268 - RNA, 16 nt, Salmonella typhimurium LT2
aaaccacgcugaggcg

SEQ ID NO: 3748269 - RNA, 19 nt, Salmonella typhimurium LT2
aaaccacgucugcgcuuuc

SEQ ID NO: 3748270 - RNA, 12 nt, Salmonella typhimurium LT2
aaaccacuccgg

SEQ ID NO: 3748271 - RNA, 15 nt, Salmonella typhimurium LT2
aaaccacuuaacguu

SEQ ID NO: 3748272 - RNA, 18 nt, Salmonella typhimurium LT2
aaaccagacccgcugcgu

SEQ ID NO: 3748273 - RNA, 16 nt, Salmonella typhimurium LT2
aaaccagcauaauauu

SEQ ID NO: 3748274 - RNA, 13 nt, Salmonella typhimurium LT2
aaaccaggcaaca

SEQ ID NO: 3748275 - RNA, 17 nt, Salmonella typhimurium LT2
aaaccaggcgaaaauag

SEQ ID NO: 3748276 - RNA, 20 nt, Salmonella typhimurium LT2
aaaccaguuuuucauuuguu

SEQ ID NO: 3748277 - RNA, 15 nt, Salmonella typhimurium LT2
aaaccaugaucguca

SEQ ID NO: 3748278 - RNA, 21 nt, Salmonella typhimurium LT2
aaaccauuuauaaaauauuua

SEQ ID NO: 3748279 - RNA, 22 nt, Salmonella typhimurium LT2
aaacccacccgguaauaccgau

SEQ ID NO: 3748280 - RNA, 16 nt, Salmonella typhimurium LT2
aaacccagaaucagca

SEQ ID NO: 3748281 - RNA, 21 nt, Salmonella typhimurium LT2
aaacccaucucaggccgacaa

SEQ ID NO: 3748282 - RNA, 17 nt, Salmonella typhimurium LT2
aaaccccugguuaaccc

SEQ ID NO: 3748283 - RNA, 16 nt, Salmonella typhimurium LT2
aaaccccuucaccacu

SEQ ID NO: 3748284 - RNA, 13 nt, Salmonella typhimurium LT2
aaacccgccaccg

SEQ ID NO: 3748285 - RNA, 15 nt, Salmonella typhimurium LT2
aaacccggugcggca

SEQ ID NO: 3748286 - RNA, 15 nt, Salmonella typhimurium LT2
aaacccguccggcag

SEQ ID NO: 3748287 - RNA, 22 nt, Salmonella typhimurium LT2
aaaccgaaaggguauacaaaaa

SEQ ID NO: 3748288 - RNA, 15 nt, Salmonella typhimurium LT2
aaaccgaauucgucc

SEQ ID NO: 3748289 - RNA, 13 nt, Salmonella typhimurium LT2
aaagauaaucuga

SEQ ID NO: 3748290 - RNA, 15 nt, Salmonella typhimurium LT2
aaagauaaucugaau

SEQ ID NO: 3748291 - RNA, 19 nt, Salmonella typhimurium LT2
aaagauagccaccggcagc

SEQ ID NO: 3748292 - RNA, 16 nt, Salmonella typhimurium LT2
aaagaugauuucuugu

SEQ ID NO: 3748293 - RNA, 17 nt, Salmonella typhimurium LT2
aaagauuacaccacuuu

SEQ ID NO: 3748294 - RNA, 23 nt, Salmonella typhimurium LT2
aaagauuauuuuaucaucagcac

SEQ ID NO: 3748295 - RNA, 18 nt, Salmonella typhimurium LT2
aaagauugcuguccaggu

SEQ ID NO: 3748296 - RNA, 18 nt, Salmonella typhimurium LT2
aaagauuuuuauuaaaau

SEQ ID NO: 3748297 - RNA, 16 nt, Salmonella typhimurium LT2
aaagcaaaaaaugaca

SEQ ID NO: 3748298 - RNA, 18 nt, Salmonella typhimurium LT2
aaagcaacaugaaaggga

SEQ ID NO: 3748299 - RNA, 16 nt, Salmonella typhimurium LT2
aaagcaaucgccagcg

SEQ ID NO: 3748300 - RNA, 12 nt, Salmonella typhimurium LT2
aaagcaauguaa

SEQ ID NO: 3748301 - RNA, 22 nt, Salmonella typhimurium LT2
aaagcaauguaagaauaacaau

SEQ ID NO: 3748302 - RNA, 21 nt, Salmonella typhimurium LT2
aaagcacaucaggaaaugaac

SEQ ID NO: 3748303 - RNA, 17 nt, Salmonella typhimurium LT2
aaagcaccgguuaacau

SEQ ID NO: 3748304 - RNA, 13 nt, Salmonella typhimurium LT2
aaagcagcugcug

SEQ ID NO: 3748305 - RNA, 21 nt, Salmonella typhimurium LT2
aaagccaauccagaauaccag

SEQ ID NO: 3748306 - RNA, 19 nt, Salmonella typhimurium LT2
aaagccacgguucucaccg

SEQ ID NO: 3748307 - RNA, 17 nt, Salmonella typhimurium LT2
aaagccagauaaagcag

SEQ ID NO: 3748308 - RNA, 16 nt, Salmonella typhimurium LT2
aaagcccaucagcgcc

SEQ ID NO: 3748309 - RNA, 23 nt, Salmonella typhimurium LT2
aaagccccaggcuauccagcuca

SEQ ID NO: 3748310 - RNA, 14 nt, Salmonella typhimurium LT2
aaagccccggcuca

SEQ ID NO: 3748311 - RNA, 22 nt, Salmonella typhimurium LT2
aaagccccggcucaagccaggu

SEQ ID NO: 3748312 - RNA, 13 nt, Salmonella typhimurium LT2
aaagcccgguuca

SEQ ID NO: 3748313 - RNA, 17 nt, Salmonella typhimurium LT2
aaagccgaccgccaggu

SEQ ID NO: 3748314 - RNA, 18 nt, Salmonella typhimurium LT2
aaagccgccauccggcau

SEQ ID NO: 3748315 - RNA, 20 nt, Salmonella typhimurium LT2
aaagccgccauccggcauuu

SEQ ID NO: 3748316 - RNA, 13 nt, Salmonella typhimurium LT2
aaagccgcucgcc

SEQ ID NO: 3748317 - RNA, 21 nt, Salmonella typhimurium LT2
aaagccggaugugagcgcauc

SEQ ID NO: 3748318 - RNA, 23 nt, Salmonella typhimurium LT2
aaagccggaugugagcgcauccg

SEQ ID NO: 3748319 - RNA, 13 nt, Salmonella typhimurium LT2
aaagcgaauaauu

SEQ ID NO: 3748320 - RNA, 23 nt, Salmonella typhimurium LT2
aaagcgaccggcacucaccucuu

SEQ ID NO: 3748321 - RNA, 14 nt, Salmonella typhimurium LT2
aaagcgcauccagc

SEQ ID NO: 3748322 - RNA, 17 nt, Salmonella typhimurium LT2
aaagcgcccaaugccga

SEQ ID NO: 3748323 - RNA, 21 nt, Salmonella typhimurium LT2
aaagcgcgcccuuucaguuca

SEQ ID NO: 3748324 - RNA, 21 nt, Salmonella typhimurium LT2
aaagcgcgccgaaaauauaca

SEQ ID NO: 3748325 - RNA, 18 nt, Salmonella typhimurium LT2
aaagcgcugagucaggcg

SEQ ID NO: 3748326 - RNA, 18 nt, Salmonella typhimurium LT2
aaagcggauacuccugca

SEQ ID NO: 3748327 - RNA, 22 nt, Salmonella typhimurium LT2
aaagcggcgaauauagcuaaug

SEQ ID NO: 3748328 - RNA, 22 nt, Salmonella typhimurium LT2
aaagcgucgcgucagcaaaaug

SEQ ID NO: 3748329 - RNA, 20 nt, Salmonella typhimurium LT2
aaagcguucggccugcugca

SEQ ID NO: 3748330 - RNA, 22 nt, Salmonella typhimurium LT2
aaagcuacguuugaacagcagc

SEQ ID NO: 3748331 - RNA, 18 nt, Salmonella typhimurium LT2
aaagcucaccugcucgcc

SEQ ID NO: 3748332 - RNA, 19 nt, Salmonella typhimurium LT2
aaagcucgucuguuguucu

SEQ ID NO: 3748333 - RNA, 13 nt, Salmonella typhimurium LT2
aaagcucuucaug

SEQ ID NO: 3748334 - RNA, 20 nt, Salmonella typhimurium LT2
aaagcugcaccaggagcaaa

SEQ ID NO: 3748335 - RNA, 20 nt, Salmonella typhimurium LT2
aaagcuggauaucacgcgcg

SEQ ID NO: 3748336 - RNA, 22 nt, Salmonella typhimurium LT2
aaagcuggccuucagguuuuua

SEQ ID NO: 3748337 - RNA, 13 nt, Salmonella typhimurium LT2
aaagcuguagcau

SEQ ID NO: 3748338 - RNA, 21 nt, Salmonella typhimurium LT2
aaagcugugccacauuuaugu

SEQ ID NO: 3748339 - RNA, 19 nt, Salmonella typhimurium LT2
aaaggacguucuucuccca

SEQ ID NO: 3748340 - RNA, 16 nt, Salmonella typhimurium LT2
aaaggagccuuacggc

SEQ ID NO: 3748341 - RNA, 22 nt, Salmonella typhimurium LT2
aaaggaggaaaagcgaccauuc

SEQ ID NO: 3748342 - RNA, 17 nt, Salmonella typhimurium LT2
aaaggagguucaucaug

SEQ ID NO: 3748343 - RNA, 16 nt, Salmonella typhimurium LT2
aaaggccuggcugaga

SEQ ID NO: 3748344 - RNA, 20 nt, Salmonella typhimurium LT2
aaaggccuggcugagaaaaa

SEQ ID NO: 3748345 - RNA, 23 nt, Salmonella typhimurium LT2
aaaggccuggcugagaaaaauac

SEQ ID NO: 3748346 - RNA, 20 nt, Salmonella typhimurium LT2
aaaggcgccgcuucccccgg

SEQ ID NO: 3748347 - RNA, 13 nt, Salmonella typhimurium LT2
aaaggcggaaauc

SEQ ID NO: 3748348 - RNA, 14 nt, Salmonella typhimurium LT2
aaaggcuaccgguu

SEQ ID NO: 3748349 - RNA, 12 nt, Salmonella typhimurium LT2
aaaggcuuuaaa

SEQ ID NO: 3748350 - RNA, 16 nt, Salmonella typhimurium LT2
aaaggcuuuaaagcag

SEQ ID NO: 3748351 - RNA, 17 nt, Salmonella typhimurium LT2
aaaggcuuuuuaaucaa

SEQ ID NO: 3748352 - RNA, 20 nt, Salmonella typhimurium LT2
aaaggcuuuuuaaucaaaau

SEQ ID NO: 3748353 - RNA, 16 nt, Salmonella typhimurium LT2
aaagggagcagacugu

SEQ ID NO: 3748354 - RNA, 18 nt, Salmonella typhimurium LT2
aaaggggagcccaguagc

SEQ ID NO: 3748355 - RNA, 21 nt, Salmonella typhimurium LT2
aaaggggagggcaacaaacau

SEQ ID NO: 3748356 - RNA, 21 nt, Salmonella typhimurium LT2
aaaggggccacaggcggcaug

SEQ ID NO: 3748357 - RNA, 22 nt, Salmonella typhimurium LT2
aaaggggccugcacaauaccaa

SEQ ID NO: 3748358 - RNA, 13 nt, Salmonella typhimurium LT2
aaaggguauacaa

SEQ ID NO: 3748359 - RNA, 23 nt, Salmonella typhimurium LT2
aaagguaaacgcgaccagcgcac

SEQ ID NO: 3748360 - RNA, 18 nt, Salmonella typhimurium LT2
aaaggucgccgcaucggc

SEQ ID NO: 3748361 - RNA, 19 nt, Salmonella typhimurium LT2
aaagguuguuucaccaacg

SEQ ID NO: 3748362 - RNA, 21 nt, Salmonella typhimurium LT2
aaagguuuguuuaauuuuguu

SEQ ID NO: 3748363 - RNA, 16 nt, Salmonella typhimurium LT2
aaaguaaauaagaaaa

SEQ ID NO: 3748364 - RNA, 22 nt, Salmonella typhimurium LT2
aaaguaaccaacgucauuaaaa

SEQ ID NO: 3748365 - RNA, 20 nt, Salmonella typhimurium LT2
aaaguaaggcugauuauaua

SEQ ID NO: 3748366 - RNA, 21 nt, Salmonella typhimurium LT2
aaaguaaggcugauuauauaa

SEQ ID NO: 3748367 - RNA, 20 nt, Salmonella typhimurium LT2
aaaguacaaugcaaagaaaa

SEQ ID NO: 3748368 - RNA, 21 nt, Salmonella typhimurium LT2
aaaguacaaugcaaagaaaaa

SEQ ID NO: 3748369 - RNA, 16 nt, Salmonella typhimurium LT2
aaaguacuucacaauc

SEQ ID NO: 3748370 - RNA, 18 nt, Salmonella typhimurium LT2
aaaguacuucacaaucag

SEQ ID NO: 3748371 - RNA, 12 nt, Salmonella typhimurium LT2
aaaguagccaau

SEQ ID NO: 3748372 - RNA, 23 nt, Salmonella typhimurium LT2
aaaguauuguuuuuauguuaaaa

SEQ ID NO: 3748373 - RNA, 19 nt, Salmonella typhimurium LT2
aaagucaacugcucuacca

SEQ ID NO: 3748374 - RNA, 17 nt, Salmonella typhimurium LT2
aaagucaucugccaguu

SEQ ID NO: 3748375 - RNA, 17 nt, Salmonella typhimurium LT2
aaagucgauaaaugccc

SEQ ID NO: 3748376 - RNA, 19 nt, Salmonella typhimurium LT2
aaagucgucaauagaggcc

SEQ ID NO: 3748377 - RNA, 23 nt, Salmonella typhimurium LT2
aaagucuucguuauagauaagaa

SEQ ID NO: 3748378 - RNA, 18 nt, Salmonella typhimurium LT2
aaagugaaggccagacuu

SEQ ID NO: 3748379 - RNA, 23 nt, Salmonella typhimurium LT2
aaagugaccgaucugguugucca

SEQ ID NO: 3748380 - RNA, 21 nt, Salmonella typhimurium LT2
aaagugaccguaauagaguuu

SEQ ID NO: 3748381 - RNA, 14 nt, Salmonella typhimurium LT2
aaagugauucacuu

SEQ ID NO: 3748382 - RNA, 18 nt, Salmonella typhimurium LT2
aaagugauucacuuucuu

SEQ ID NO: 3748383 - RNA, 19 nt, Salmonella typhimurium LT2
aaaguggcauccgaagaac

SEQ ID NO: 3748384 - RNA, 23 nt, Salmonella typhimurium LT2
aaagugggcgcuuuguuacucuu

SEQ ID NO: 3748385 - RNA, 15 nt, Salmonella typhimurium LT2
aaaguggugggugau

SEQ ID NO: 3748386 - RNA, 16 nt, Salmonella typhimurium LT2
aaagugguuuuaagcu

SEQ ID NO: 3748387 - RNA, 18 nt, Salmonella typhimurium LT2
aaaguuaacgauaguggu

SEQ ID NO: 3748388 - RNA, 16 nt, Salmonella typhimurium LT2
aaaguuaaucagcgcu

SEQ ID NO: 3748389 - RNA, 22 nt, Salmonella typhimurium LT2
aaaguuaaucagcgcugucgcc

SEQ ID NO: 3748390 - RNA, 14 nt, Salmonella typhimurium LT2
aaaguuaccggcau

SEQ ID NO: 3748391 - RNA, 15 nt, Salmonella typhimurium LT2
aaaguugcaucaaga

SEQ ID NO: 3748392 - RNA, 20 nt, Salmonella typhimurium LT2
aaaucuggugauaaagcaga

SEQ ID NO: 3748393 - RNA, 18 nt, Salmonella typhimurium LT2
aaaucugguguaaauaac

SEQ ID NO: 3748394 - RNA, 23 nt, Salmonella typhimurium LT2
aaaucuucuacuucaauuuucca

SEQ ID NO: 3748395 - RNA, 13 nt, Salmonella typhimurium LT2
aaaugaauaccaa

SEQ ID NO: 3748396 - RNA, 13 nt, Salmonella typhimurium LT2
aaaugacagccac

SEQ ID NO: 3748397 - RNA, 22 nt, Salmonella typhimurium LT2
aaaugacgccggguaaacgcag

SEQ ID NO: 3748398 - RNA, 10 nt, Salmonella typhimurium LT2
aaaugauaag

SEQ ID NO: 3748399 - RNA, 20 nt, Salmonella typhimurium LT2
aaaugauaagcacuauuaua

SEQ ID NO: 3748400 - RNA, 13 nt, Salmonella typhimurium LT2
aaaugaucacuuc

SEQ ID NO: 3748401 - RNA, 15 nt, Salmonella typhimurium LT2
aaaugaucacuuccg

SEQ ID NO: 3748402 - RNA, 13 nt, Salmonella typhimurium LT2
aaaugauguccac

SEQ ID NO: 3748403 - RNA, 21 nt, Salmonella typhimurium LT2
aaaugccauauacauauggau

SEQ ID NO: 3748404 - RNA, 23 nt, Salmonella typhimurium LT2
aaaugccccgugacuuuccaguu

SEQ ID NO: 3748405 - RNA, 18 nt, Salmonella typhimurium LT2
aaaugcccggcuggcgau

SEQ ID NO: 3748406 - RNA, 23 nt, Salmonella typhimurium LT2
aaaugccgcccauccagagcagu

SEQ ID NO: 3748407 - RNA, 22 nt, Salmonella typhimurium LT2
aaaugccugccguuuuuaacac

SEQ ID NO: 3748408 - RNA, 21 nt, Salmonella typhimurium LT2
aaaugccuguuuauauucugg

SEQ ID NO: 3748409 - RNA, 20 nt, Salmonella typhimurium LT2
aaaugcgcgcggcugccgga

SEQ ID NO: 3748410 - RNA, 16 nt, Salmonella typhimurium LT2
aaaugcggcauccggc

SEQ ID NO: 3748411 - RNA, 21 nt, Salmonella typhimurium LT2
aaaugcggguccugaucggcg

SEQ ID NO: 3748412 - RNA, 20 nt, Salmonella typhimurium LT2
aaaugcgguuaauuggcccu

SEQ ID NO: 3748413 - RNA, 13 nt, Salmonella typhimurium LT2
aaaugcucugcaa

SEQ ID NO: 3748414 - RNA, 17 nt, Salmonella typhimurium LT2
aaauggagcgagcuggu

SEQ ID NO: 3748415 - RNA, 19 nt, Salmonella typhimurium LT2
aaauggaucggcuugccuu

SEQ ID NO: 3748416 - RNA, 21 nt, Salmonella typhimurium LT2
aaauggcauugcccggcggca

SEQ ID NO: 3748417 - RNA, 12 nt, Salmonella typhimurium LT2
aaauggcgcugu

SEQ ID NO: 3748418 - RNA, 21 nt, Salmonella typhimurium LT2
aaauggcggaacugcguuuga

SEQ ID NO: 3748419 - RNA, 21 nt, Salmonella typhimurium LT2
aaaugggccggauagcgcugu

SEQ ID NO: 3748420 - RNA, 14 nt, Salmonella typhimurium LT2
aaaugguuuugccc

SEQ ID NO: 3748421 - RNA, 16 nt, Salmonella typhimurium LT2
aaaugguuuugcccau

SEQ ID NO: 3748422 - RNA, 17 nt, Salmonella typhimurium LT2
aaaugguuuugcccauu

SEQ ID NO: 3748423 - RNA, 17 nt, Salmonella typhimurium LT2
aaauguaggccggauaa

SEQ ID NO: 3748424 - RNA, 20 nt, Salmonella typhimurium LT2
aaaugucagaucguaugcgc

SEQ ID NO: 3748425 - RNA, 15 nt, Salmonella typhimurium LT2
aaauguugauaaggu

SEQ ID NO: 3748426 - RNA, 17 nt, Salmonella typhimurium LT2
aaauguuggauugcauc

SEQ ID NO: 3748427 - RNA, 19 nt, Salmonella typhimurium LT2
aaauguuguuugaaaagug

SEQ ID NO: 3748428 - RNA, 21 nt, Salmonella typhimurium LT2
aaauguuguuugaaaagugaa

SEQ ID NO: 3748429 - RNA, 15 nt, Salmonella typhimurium LT2
aaauuaaaauucauu

SEQ ID NO: 3748430 - RNA, 16 nt, Salmonella typhimurium LT2
aaauuaaaauucauua

SEQ ID NO: 3748431 - RNA, 17 nt, Salmonella typhimurium LT2
aaauuaaaauucauuau

SEQ ID NO: 3748432 - RNA, 16 nt, Salmonella typhimurium LT2
aaauuaaaucaucuug

SEQ ID NO: 3748433 - RNA, 19 nt, Salmonella typhimurium LT2
aaauuaagcgacccgauaa

SEQ ID NO: 3748434 - RNA, 18 nt, Salmonella typhimurium LT2
aaauuaaucgccagcagc

SEQ ID NO: 3748435 - RNA, 13 nt, Salmonella typhimurium LT2
aaauuaauugcca

SEQ ID NO: 3748436 - RNA, 17 nt, Salmonella typhimurium LT2
aaauuacuuaugauaua

SEQ ID NO: 3748437 - RNA, 14 nt, Salmonella typhimurium LT2
aaauuaucauguau

SEQ ID NO: 3748438 - RNA, 20 nt, Salmonella typhimurium LT2
aaauuaucuguugauaaaac

SEQ ID NO: 3748439 - RNA, 14 nt, Salmonella typhimurium LT2
aaauuauuuaagcu

SEQ ID NO: 3748440 - RNA, 13 nt, Salmonella typhimurium LT2
aaauuauuuuaaa

SEQ ID NO: 3748441 - RNA, 15 nt, Salmonella typhimurium LT2
aaauuauuuuaaauu

SEQ ID NO: 3748442 - RNA, 19 nt, Salmonella typhimurium LT2
aaauucacgcuucucuggc

SEQ ID NO: 3748443 - RNA, 13 nt, Salmonella typhimurium LT2
aaauucagcgcag

SEQ ID NO: 3748444 - RNA, 12 nt, Salmonella typhimurium LT2
aaauuccggcac

SEQ ID NO: 3748445 - RNA, 12 nt, Salmonella typhimurium LT2
aaauucgaaaua

SEQ ID NO: 3748446 - RNA, 16 nt, Salmonella typhimurium LT2
aaauucgaaauaaaga

SEQ ID NO: 3748447 - RNA, 20 nt, Salmonella typhimurium LT2
aaauucuuuacgcagcaaga

SEQ ID NO: 3748448 - RNA, 13 nt, Salmonella typhimurium LT2
aaauugaagaguu

SEQ ID NO: 3748449 - RNA, 19 nt, Salmonella typhimurium LT2
aaauugcgcgcggcccacu

SEQ ID NO: 3748450 - RNA, 22 nt, Salmonella typhimurium LT2
aaauugcgucaucauccgguaa

SEQ ID NO: 3748451 - RNA, 13 nt, Salmonella typhimurium LT2
aaauugcugaugu

SEQ ID NO: 3748452 - RNA, 14 nt, Salmonella typhimurium LT2
aaauugcuuucuag

SEQ ID NO: 3748453 - RNA, 15 nt, Salmonella typhimurium LT2
aaauuggugauauaa

SEQ ID NO: 3748454 - RNA, 22 nt, Salmonella typhimurium LT2
aaauuguugcugcguuucauuc

SEQ ID NO: 3748455 - RNA, 14 nt, Salmonella typhimurium LT2
aaauuuaauauaug

SEQ ID NO: 3748456 - RNA, 16 nt, Salmonella typhimurium LT2
aaauuuaauauaugaa

SEQ ID NO: 3748457 - RNA, 23 nt, Salmonella typhimurium LT2
aaauuucacgucacguucauccu

SEQ ID NO: 3748458 - RNA, 19 nt, Salmonella typhimurium LT2
aaauuucaguggucaggcg

SEQ ID NO: 3748459 - RNA, 12 nt, Salmonella typhimurium LT2
aaauuuccucuu

SEQ ID NO: 3748460 - RNA, 16 nt, Salmonella typhimurium LT2
aaauuugcagcgcugu

SEQ ID NO: 3748461 - RNA, 20 nt, Salmonella typhimurium LT2
aaauuuucaaccacggauaa

SEQ ID NO: 3748462 - RNA, 10 nt, Salmonella typhimurium LT2
aaauuuucau

SEQ ID NO: 3748463 - RNA, 20 nt, Salmonella typhimurium LT2
aaauuuucauuauaaaacuu

SEQ ID NO: 3748464 - RNA, 16 nt, Salmonella typhimurium LT2
aacaaaacggaauguu

SEQ ID NO: 3748465 - RNA, 15 nt, Salmonella typhimurium LT2
aacaaaauuguauca

SEQ ID NO: 3748466 - RNA, 14 nt, Salmonella typhimurium LT2
aacaaaccaaacug

SEQ ID NO: 3748467 - RNA, 18 nt, Salmonella typhimurium LT2
aacaaagaggcugcgcga

SEQ ID NO: 3748468 - RNA, 20 nt, Salmonella typhimurium LT2
aacaaaggcuauccaguggu

SEQ ID NO: 3748469 - RNA, 20 nt, Salmonella typhimurium LT2
aacaaaggguaccugggcaa

SEQ ID NO: 3748470 - RNA, 18 nt, Salmonella typhimurium LT2
aacaaauaaauccaugag

SEQ ID NO: 3748471 - RNA, 19 nt, Salmonella typhimurium LT2
aacaaaucgcaacagauca

SEQ ID NO: 3748472 - RNA, 16 nt, Salmonella typhimurium LT2
aacaacaucugugaaa

SEQ ID NO: 3748473 - RNA, 14 nt, Salmonella typhimurium LT2
aacaaccggcuggc

SEQ ID NO: 3748474 - RNA, 17 nt, Salmonella typhimurium LT2
aacaaccggcuggcuau

SEQ ID NO: 3748475 - RNA, 21 nt, Salmonella typhimurium LT2
aacaacuccagcaaaucaauu

SEQ ID NO: 3748476 - RNA, 16 nt, Salmonella typhimurium LT2
aacaacucuauuaaaa

SEQ ID NO: 3748477 - RNA, 17 nt, Salmonella typhimurium LT2
aacaagauuaauuuaau

SEQ ID NO: 3748478 - RNA, 22 nt, Salmonella typhimurium LT2
aacaagauuaauuuaauugaua

SEQ ID NO: 3748479 - RNA, 17 nt, Salmonella typhimurium LT2
aacaagcugauuuuucg

SEQ ID NO: 3748480 - RNA, 18 nt, Salmonella typhimurium LT2
aacaaggauauccgccag

SEQ ID NO: 3748481 - RNA, 14 nt, Salmonella typhimurium LT2
aacaaggcaucuau

SEQ ID NO: 3748482 - RNA, 23 nt, Salmonella typhimurium LT2
aacaauaucgauagcauuuuuac

SEQ ID NO: 3748483 - RNA, 19 nt, Salmonella typhimurium LT2
aacaaucgccccaggccac

SEQ ID NO: 3748484 - RNA, 15 nt, Salmonella typhimurium LT2
aacaaugccauuuuu

SEQ ID NO: 3748485 - RNA, 22 nt, Salmonella typhimurium LT2
aacaauugugaugcauuuuguc

SEQ ID NO: 3748486 - RNA, 21 nt, Salmonella typhimurium LT2
aacaauuucuacugauuuaac

SEQ ID NO: 3748487 - RNA, 14 nt, Salmonella typhimurium LT2
aacacaaucacacc

SEQ ID NO: 3748488 - RNA, 13 nt, Salmonella typhimurium LT2
aacacaaucacug

SEQ ID NO: 3748489 - RNA, 18 nt, Salmonella typhimurium LT2
aacacacaguugccuucg

SEQ ID NO: 3748490 - RNA, 16 nt, Salmonella typhimurium LT2
aacacacuuucugcuu

SEQ ID NO: 3748491 - RNA, 14 nt, Salmonella typhimurium LT2
aacacauccagcgu

SEQ ID NO: 3748492 - RNA, 14 nt, Salmonella typhimurium LT2
aacaccaacaaagu

SEQ ID NO: 3748493 - RNA, 11 nt, Salmonella typhimurium LT2
aacaccagcac

SEQ ID NO: 3748494 - RNA, 21 nt, Salmonella typhimurium LT2
aacaccagccgcaucuuauau

SEQ ID NO: 3748495 - RNA, 17 nt, Salmonella typhimurium LT2
aacaccagcgauccaga

SEQ ID NO: 3748496 - RNA, 20 nt, Salmonella typhimurium LT2
aaccaccugggucagcguca

SEQ ID NO: 3748497 - RNA, 14 nt, Salmonella typhimurium LT2
aaccacgauaaaga

SEQ ID NO: 3748498 - RNA, 20 nt, Salmonella typhimurium LT2
aaccacggagagacaguuca

SEQ ID NO: 3748499 - RNA, 19 nt, Salmonella typhimurium LT2
aaccacggauaagccagcc

SEQ ID NO: 3748500 - RNA, 13 nt, Salmonella typhimurium LT2
aaccacuucugac

SEQ ID NO: 3748501 - RNA, 15 nt, Salmonella typhimurium LT2
aaccagacccgcugc

SEQ ID NO: 3748502 - RNA, 14 nt, Salmonella typhimurium LT2
aaccagauuuuuca

SEQ ID NO: 3748503 - RNA, 21 nt, Salmonella typhimurium LT2
aaccagauuuuucaccaucug

SEQ ID NO: 3748504 - RNA, 17 nt, Salmonella typhimurium LT2
aaccagcaaugagacaa

SEQ ID NO: 3748505 - RNA, 21 nt, Salmonella typhimurium LT2
aaccagcagggcaauagcgau

SEQ ID NO: 3748506 - RNA, 15 nt, Salmonella typhimurium LT2
aaccagcaguccugc

SEQ ID NO: 3748507 - RNA, 18 nt, Salmonella typhimurium LT2
aaccagcccaugaaugag

SEQ ID NO: 3748508 - RNA, 12 nt, Salmonella typhimurium LT2
aaccagccgauc

SEQ ID NO: 3748509 - RNA, 20 nt, Salmonella typhimurium LT2
aaccagccgaucagcgccau

SEQ ID NO: 3748510 - RNA, 16 nt, Salmonella typhimurium LT2
aaccagcgaaaugaca

SEQ ID NO: 3748511 - RNA, 24 nt, Salmonella typhimurium LT2
aaccagcgaaaugacagccaccag

SEQ ID NO: 3748512 - RNA, 20 nt, Salmonella typhimurium LT2
aaccagcgcgccgccaacgc

SEQ ID NO: 3748513 - RNA, 21 nt, Salmonella typhimurium LT2
aaccaggauucaacgcgugau

SEQ ID NO: 3748514 - RNA, 11 nt, Salmonella typhimurium LT2
aaccaggcaaa

SEQ ID NO: 3748515 - RNA, 13 nt, Salmonella typhimurium LT2
aaccaggcaacag

SEQ ID NO: 3748516 - RNA, 12 nt, Salmonella typhimurium LT2
aaccaggccaga

SEQ ID NO: 3748517 - RNA, 14 nt, Salmonella typhimurium LT2
aaccaggcgaaaau

SEQ ID NO: 3748518 - RNA, 18 nt, Salmonella typhimurium LT2
aaccaggcgaaaauaggc

SEQ ID NO: 3748519 - RNA, 15 nt, Salmonella typhimurium LT2
aaccaguucgcgcgu

SEQ ID NO: 3748520 - RNA, 18 nt, Salmonella typhimurium LT2
aaccaguugccaggguuc

SEQ ID NO: 3748521 - RNA, 15 nt, Salmonella typhimurium LT2
aaccaguuuuucauu

SEQ ID NO: 3748522 - RNA, 16 nt, Salmonella typhimurium LT2
aaccauaauaaugcca

SEQ ID NO: 3748523 - RNA, 12 nt, Salmonella typhimurium LT2
aaccauccauuc

SEQ ID NO: 3748524 - RNA, 23 nt, Salmonella typhimurium LT2
aaccaucgacccccaccauguca

SEQ ID NO: 3748525 - RNA, 18 nt, Salmonella typhimurium LT2
aaccaugauaucgccaau

SEQ ID NO: 3748526 - RNA, 23 nt, Salmonella typhimurium LT2
aaccaugcccgggcgcugugcga

SEQ ID NO: 3748527 - RNA, 15 nt, Salmonella typhimurium LT2
aaccauucaaauuca

SEQ ID NO: 3748528 - RNA, 17 nt, Salmonella typhimurium LT2
aaccauuucuccugcau

SEQ ID NO: 3748529 - RNA, 16 nt, Salmonella typhimurium LT2
aaccauuucuuuugau

SEQ ID NO: 3748530 - RNA, 17 nt, Salmonella typhimurium LT2
aaccauuugccugccgc

SEQ ID NO: 3748531 - RNA, 16 nt, Salmonella typhimurium LT2
aacccaaauaaccaga

SEQ ID NO: 3748532 - RNA, 14 nt, Salmonella typhimurium LT2
aacccaaauccgca

SEQ ID NO: 3748533 - RNA, 15 nt, Salmonella typhimurium LT2
aacccacaugaucgc

SEQ ID NO: 3748534 - RNA, 14 nt, Salmonella typhimurium LT2
aacccaccagcagg

SEQ ID NO: 3748535 - RNA, 23 nt, Salmonella typhimurium LT2
aacccauggcuuacgguuguuuc

SEQ ID NO: 3748536 - RNA, 14 nt, Salmonella typhimurium LT2
aaccccaaacacca

SEQ ID NO: 3748537 - RNA, 15 nt, Salmonella typhimurium LT2
aaccccaucccggca

SEQ ID NO: 3748538 - RNA, 13 nt, Salmonella typhimurium LT2
aaccccaucgccu

SEQ ID NO: 3748539 - RNA, 16 nt, Salmonella typhimurium LT2
aaccccgauaaaccag

SEQ ID NO: 3748540 - RNA, 21 nt, Salmonella typhimurium LT2
aaccccuguucaaaagccugu

SEQ ID NO: 3748541 - RNA, 17 nt, Salmonella typhimurium LT2
aaccccuuuagcggcau

SEQ ID NO: 3748542 - RNA, 14 nt, Salmonella typhimurium LT2
aacccgaucgccau

SEQ ID NO: 3748543 - RNA, 16 nt, Salmonella typhimurium LT2
aacccgaucgccaucc

SEQ ID NO: 3748544 - RNA, 21 nt, Salmonella typhimurium LT2
aacccgaucgccauccugcac

SEQ ID NO: 3748545 - RNA, 23 nt, Salmonella typhimurium LT2
aacccgaucgccauccugcaccg

SEQ ID NO: 3748546 - RNA, 18 nt, Salmonella typhimurium LT2
aacccgcauuaacugccu

SEQ ID NO: 3748547 - RNA, 13 nt, Salmonella typhimurium LT2
aacccgccacagg

SEQ ID NO: 3748548 - RNA, 17 nt, Salmonella typhimurium LT2
aacccgccaccaucucc

SEQ ID NO: 3748549 - RNA, 15 nt, Salmonella typhimurium LT2
aacccgccuucaguc

SEQ ID NO: 3748550 - RNA, 15 nt, Salmonella typhimurium LT2
aacccggccugacgc

SEQ ID NO: 3748551 - RNA, 17 nt, Salmonella typhimurium LT2
aacccggcuaaaugacg

SEQ ID NO: 3748552 - RNA, 23 nt, Salmonella typhimurium LT2
aacccggcugccauuaucaccau

SEQ ID NO: 3748553 - RNA, 13 nt, Salmonella typhimurium LT2
aacccguccggca

SEQ ID NO: 3748554 - RNA, 21 nt, Salmonella typhimurium LT2
aacccguuaaauaccagcacc

SEQ ID NO: 3748555 - RNA, 17 nt, Salmonella typhimurium LT2
aaccgaaauccaccagc

SEQ ID NO: 3748556 - RNA, 20 nt, Salmonella typhimurium LT2
aaccgaaauccaccagcgga

SEQ ID NO: 3748557 - RNA, 14 nt, Salmonella typhimurium LT2
aaccgacagcaaua

SEQ ID NO: 3748558 - RNA, 16 nt, Salmonella typhimurium LT2
aaccgacccaaaaaug

SEQ ID NO: 3748559 - RNA, 13 nt, Salmonella typhimurium LT2
aaccgaccgcgau

SEQ ID NO: 3748560 - RNA, 19 nt, Salmonella typhimurium LT2
aaccgacgaacaaaauagu

SEQ ID NO: 3748561 - RNA, 20 nt, Salmonella typhimurium LT2
aaccgacggugcucaugaca

SEQ ID NO: 3748562 - RNA, 18 nt, Salmonella typhimurium LT2
aaccgacuaucagaaaaa

SEQ ID NO: 3748563 - RNA, 16 nt, Salmonella typhimurium LT2
aaccgauguaucaacc

SEQ ID NO: 3748564 - RNA, 17 nt, Salmonella typhimurium LT2
aaccgcagaaaaagccc

SEQ ID NO: 3748565 - RNA, 13 nt, Salmonella typhimurium LT2
aaccgccagcagc

SEQ ID NO: 3748566 - RNA, 15 nt, Salmonella typhimurium LT2
aaccgccgcccauca

SEQ ID NO: 3748567 - RNA, 16 nt, Salmonella typhimurium LT2
aaccgccguuuugauu

SEQ ID NO: 3748568 - RNA, 17 nt, Salmonella typhimurium LT2
aaccgccuccaggccgg

SEQ ID NO: 3748569 - RNA, 22 nt, Salmonella typhimurium LT2
aaccgccugcacugguagaaaa

SEQ ID NO: 3748570 - RNA, 16 nt, Salmonella typhimurium LT2
aaccgcgauaaaccug

SEQ ID NO: 3748571 - RNA, 21 nt, Salmonella typhimurium LT2
aaccgcgaucgaugugauaaa

SEQ ID NO: 3748572 - RNA, 19 nt, Salmonella typhimurium LT2
aaccgcgccaaagauaaga

SEQ ID NO: 3748573 - RNA, 21 nt, Salmonella typhimurium LT2
aaccgcgcuggaaagcggcag

SEQ ID NO: 3748574 - RNA, 19 nt, Salmonella typhimurium LT2
aaccgcugaccaucaacaa

SEQ ID NO: 3748575 - RNA, 15 nt, Salmonella typhimurium LT2
aaccgcuuuuccugc

SEQ ID NO: 3748576 - RNA, 17 nt, Salmonella typhimurium LT2
aaccggaacggacgugc

SEQ ID NO: 3748577 - RNA, 19 nt, Salmonella typhimurium LT2
aaccggaccagcacaaaaa

SEQ ID NO: 3748578 - RNA, 20 nt, Salmonella typhimurium LT2
aaccggaccagcacaaaaaa

SEQ ID NO: 3748579 - RNA, 19 nt, Salmonella typhimurium LT2
aaccggaguggccgcaaau

SEQ ID NO: 3748580 - RNA, 23 nt, Salmonella typhimurium LT2
aaccggcaacucgccgguuuuuu

SEQ ID NO: 3748581 - RNA, 23 nt, Salmonella typhimurium LT2
aaccggcguccggcgccugaaua

SEQ ID NO: 3748582 - RNA, 23 nt, Salmonella typhimurium LT2
aaccggguugcggaagcuuuuag

SEQ ID NO: 3748583 - RNA, 18 nt, Salmonella typhimurium LT2
aaccggucaggcagcaga

SEQ ID NO: 3748584 - RNA, 20 nt, Salmonella typhimurium LT2
aaccggucaggcagcagacc

SEQ ID NO: 3748585 - RNA, 22 nt, Salmonella typhimurium LT2
aaccgguuugucauucgccuca

SEQ ID NO: 3748586 - RNA, 22 nt, Salmonella typhimurium LT2
aaccguaucacuguaaaaggga

SEQ ID NO: 3748587 - RNA, 13 nt, Salmonella typhimurium LT2
aaccgucggcaau

SEQ ID NO: 3748588 - RNA, 20 nt, Salmonella typhimurium LT2
aaccguucaucuaucgccag

SEQ ID NO: 3748589 - RNA, 16 nt, Salmonella typhimurium LT2
aaccguucuuccuggg

SEQ ID NO: 3748590 - RNA, 17 nt, Salmonella typhimurium LT2
aaccguuggggaaaaua

SEQ ID NO: 3748591 - RNA, 12 nt, Salmonella typhimurium LT2
aaccuaaauaaa

SEQ ID NO: 3748592 - RNA, 15 nt, Salmonella typhimurium LT2
aaccuaaauaaauac

SEQ ID NO: 3748593 - RNA, 19 nt, Salmonella typhimurium LT2
aaccucaauagguguaucc

SEQ ID NO: 3748594 - RNA, 19 nt, Salmonella typhimurium LT2
aaccucaccguccgccagg

SEQ ID NO: 3748595 - RNA, 20 nt, Salmonella typhimurium LT2
aaccucaucccggcuuaaau

SEQ ID NO: 3748596 - RNA, 19 nt, Salmonella typhimurium LT2
aaccucauuucucaaaaac

SEQ ID NO: 3748597 - RNA, 20 nt, Salmonella typhimurium LT2
aaccucauuucucaaaaaca

SEQ ID NO: 3748598 - RNA, 22 nt, Salmonella typhimurium LT2
aaccucauuucucaaaaacacc

SEQ ID NO: 3748599 - RNA, 13 nt, Salmonella typhimurium LT2
aaccucccgccgg

SEQ ID NO: 3748600 - RNA, 14 nt, Salmonella typhimurium LT2
aacgcucgcgcugu

SEQ ID NO: 3748601 - RNA, 14 nt, Salmonella typhimurium LT2
aacgcucgcuuaau

SEQ ID NO: 3748602 - RNA, 20 nt, Salmonella typhimurium LT2
aacgcucuuaccgcuaaaau

SEQ ID NO: 3748603 - RNA, 22 nt, Salmonella typhimurium LT2
aacgcucuuaccgcuaaaauac

SEQ ID NO: 3748604 - RNA, 16 nt, Salmonella typhimurium LT2
aacgcugagucagaaa

SEQ ID NO: 3748605 - RNA, 13 nt, Salmonella typhimurium LT2
aacgcugcgccug

SEQ ID NO: 3748606 - RNA, 19 nt, Salmonella typhimurium LT2
aacgcuggcggcaggccua

SEQ ID NO: 3748607 - RNA, 20 nt, Salmonella typhimurium LT2
aacgcuggcuggguaaaauc

SEQ ID NO: 3748608 - RNA, 21 nt, Salmonella typhimurium LT2
aacgcuuaaccccucgcagac

SEQ ID NO: 3748609 - RNA, 19 nt, Salmonella typhimurium LT2
aacgcuuccggaucgcggc

SEQ ID NO: 3748610 - RNA, 17 nt, Salmonella typhimurium LT2
aacgcuugacucugaag

SEQ ID NO: 3748611 - RNA, 14 nt, Salmonella typhimurium LT2
aacgcuugagcagg

SEQ ID NO: 3748612 - RNA, 16 nt, Salmonella typhimurium LT2
aacgcuuucgccagcg

SEQ ID NO: 3748613 - RNA, 20 nt, Salmonella typhimurium LT2
aacgcuuucgccagcgcgac

SEQ ID NO: 3748614 - RNA, 17 nt, Salmonella typhimurium LT2
aacgcuuugccagcauc

SEQ ID NO: 3748615 - RNA, 23 nt, Salmonella typhimurium LT2
aacgcuuugcgauagcccggcau

SEQ ID NO: 3748616 - RNA, 22 nt, Salmonella typhimurium LT2
aacgcuuuuucaaagaugaaac

SEQ ID NO: 3748617 - RNA, 16 nt, Salmonella typhimurium LT2
aacggaaccaaaauag

SEQ ID NO: 3748618 - RNA, 21 nt, Salmonella typhimurium LT2
aacggagauauagaccagcgc

SEQ ID NO: 3748619 - RNA, 22 nt, Salmonella typhimurium LT2
aacggaucaugguugaaaaaag

SEQ ID NO: 3748620 - RNA, 13 nt, Salmonella typhimurium LT2
aacggaugaaagc

SEQ ID NO: 3748621 - RNA, 23 nt, Salmonella typhimurium LT2
aacggcaaaacgugguaaaaagc

SEQ ID NO: 3748622 - RNA, 16 nt, Salmonella typhimurium LT2
aacggcauggacgugu

SEQ ID NO: 3748623 - RNA, 17 nt, Salmonella typhimurium LT2
aacggcccaaucaacgc

SEQ ID NO: 3748624 - RNA, 17 nt, Salmonella typhimurium LT2
aacggccucccagcuau

SEQ ID NO: 3748625 - RNA, 17 nt, Salmonella typhimurium LT2
aacggcgacaagaauau

SEQ ID NO: 3748626 - RNA, 13 nt, Salmonella typhimurium LT2
aacggcgagcuuu

SEQ ID NO: 3748627 - RNA, 18 nt, Salmonella typhimurium LT2
aacggcgagcuuuaauga

SEQ ID NO: 3748628 - RNA, 17 nt, Salmonella typhimurium LT2
aacggcgauacucugcc

SEQ ID NO: 3748629 - RNA, 20 nt, Salmonella typhimurium LT2
aacggcgcuuuuaaaauaaa

SEQ ID NO: 3748630 - RNA, 14 nt, Salmonella typhimurium LT2
aacggcguaccaga

SEQ ID NO: 3748631 - RNA, 21 nt, Salmonella typhimurium LT2
aacggcucgguuuauccccgc

SEQ ID NO: 3748632 - RNA, 18 nt, Salmonella typhimurium LT2
aacggcugacgcccauca

SEQ ID NO: 3748633 - RNA, 17 nt, Salmonella typhimurium LT2
aacggcuuuccagcagc

SEQ ID NO: 3748634 - RNA, 18 nt, Salmonella typhimurium LT2
aacggcuuuccagcagcc

SEQ ID NO: 3748635 - RNA, 17 nt, Salmonella typhimurium LT2
aacgggcuuuugaauaa

SEQ ID NO: 3748636 - RNA, 18 nt, Salmonella typhimurium LT2
aacgguaaacacgacgcu

SEQ ID NO: 3748637 - RNA, 16 nt, Salmonella typhimurium LT2
aacgguccugguccgg

SEQ ID NO: 3748638 - RNA, 16 nt, Salmonella typhimurium LT2
aacggucuugccagcg

SEQ ID NO: 3748639 - RNA, 17 nt, Salmonella typhimurium LT2
aacggucuugccagcga

SEQ ID NO: 3748640 - RNA, 18 nt, Salmonella typhimurium LT2
aacggugggguccgauuu

SEQ ID NO: 3748641 - RNA, 16 nt, Salmonella typhimurium LT2
aacgguuuauccccgc

SEQ ID NO: 3748642 - RNA, 22 nt, Salmonella typhimurium LT2
aacgguuuugcgcugguaccgg

SEQ ID NO: 3748643 - RNA, 20 nt, Salmonella typhimurium LT2
aacguaaacggcagccgcca

SEQ ID NO: 3748644 - RNA, 14 nt, Salmonella typhimurium LT2
aacguaaauaccca

SEQ ID NO: 3748645 - RNA, 16 nt, Salmonella typhimurium LT2
aacguaaauacccagg

SEQ ID NO: 3748646 - RNA, 19 nt, Salmonella typhimurium LT2
aacguaaauacccaggcca

SEQ ID NO: 3748647 - RNA, 19 nt, Salmonella typhimurium LT2
aacguagcccauugucauc

SEQ ID NO: 3748648 - RNA, 14 nt, Salmonella typhimurium LT2
aacgucaccgcuuu

SEQ ID NO: 3748649 - RNA, 13 nt, Salmonella typhimurium LT2
aacgucagcgcca

SEQ ID NO: 3748650 - RNA, 15 nt, Salmonella typhimurium LT2
aacgucaucauuacc

SEQ ID NO: 3748651 - RNA, 23 nt, Salmonella typhimurium LT2
aacgucauugcgaucuccuuuaa

SEQ ID NO: 3748652 - RNA, 15 nt, Salmonella typhimurium LT2
aacguccagcggcca

SEQ ID NO: 3748653 - RNA, 23 nt, Salmonella typhimurium LT2
aacgucccgacgaauaacaaaau

SEQ ID NO: 3748654 - RNA, 19 nt, Salmonella typhimurium LT2
aacguccggugaucggcuu

SEQ ID NO: 3748655 - RNA, 14 nt, Salmonella typhimurium LT2
aacgucgccauccg

SEQ ID NO: 3748656 - RNA, 16 nt, Salmonella typhimurium LT2
aacgucgccauccggc

SEQ ID NO: 3748657 - RNA, 16 nt, Salmonella typhimurium LT2
aacgucgcgcccugca

SEQ ID NO: 3748658 - RNA, 16 nt, Salmonella typhimurium LT2
aacgucguaaaaccug

SEQ ID NO: 3748659 - RNA, 12 nt, Salmonella typhimurium LT2
aacgucgucauu

SEQ ID NO: 3748660 - RNA, 20 nt, Salmonella typhimurium LT2
aacgucuuauccggccugca

SEQ ID NO: 3748661 - RNA, 23 nt, Salmonella typhimurium LT2
aacgucuuuuuccagcagcucca

SEQ ID NO: 3748662 - RNA, 17 nt, Salmonella typhimurium LT2
aacgugauugcugacac

SEQ ID NO: 3748663 - RNA, 22 nt, Salmonella typhimurium LT2
aacgugauugcugacacaauau

SEQ ID NO: 3748664 - RNA, 23 nt, Salmonella typhimurium LT2
aacgugcauuauuuuagugaaaa

SEQ ID NO: 3748665 - RNA, 13 nt, Salmonella typhimurium LT2
aacgugccacagu

SEQ ID NO: 3748666 - RNA, 21 nt, Salmonella typhimurium LT2
aacgugcgguauaucacgcca

SEQ ID NO: 3748667 - RNA, 22 nt, Salmonella typhimurium LT2
aacgugcgguauaucacgccau

SEQ ID NO: 3748668 - RNA, 18 nt, Salmonella typhimurium LT2
aacguguuaugcgccugg

SEQ ID NO: 3748669 - RNA, 17 nt, Salmonella typhimurium LT2
aacguguuuauccccgc

SEQ ID NO: 3748670 - RNA, 15 nt, Salmonella typhimurium LT2
aacguuacgccagcg

SEQ ID NO: 3748671 - RNA, 18 nt, Salmonella typhimurium LT2
aacguuacuuuaaaacau

SEQ ID NO: 3748672 - RNA, 17 nt, Salmonella typhimurium LT2
aacguucgcaucccagg

SEQ ID NO: 3748673 - RNA, 17 nt, Salmonella typhimurium LT2
aacguugguucggcgga

SEQ ID NO: 3748674 - RNA, 18 nt, Salmonella typhimurium LT2
aacguugugcuccgccgg

SEQ ID NO: 3748675 - RNA, 18 nt, Salmonella typhimurium LT2
aacguuuguaacagcagg

SEQ ID NO: 3748676 - RNA, 20 nt, Salmonella typhimurium LT2
aacguuuguagaugaacucg

SEQ ID NO: 3748677 - RNA, 14 nt, Salmonella typhimurium LT2
aacuaaagcgaauu

SEQ ID NO: 3748678 - RNA, 12 nt, Salmonella typhimurium LT2
aacuaaggggac

SEQ ID NO: 3748679 - RNA, 22 nt, Salmonella typhimurium LT2
aacuaauggcgcagcaguugca

SEQ ID NO: 3748680 - RNA, 14 nt, Salmonella typhimurium LT2
aacuagcaaaacau

SEQ ID NO: 3748681 - RNA, 20 nt, Salmonella typhimurium LT2
aacuagccauauaugaaauc

SEQ ID NO: 3748682 - RNA, 21 nt, Salmonella typhimurium LT2
aacuauaauugcuuuuuucca

SEQ ID NO: 3748683 - RNA, 14 nt, Salmonella typhimurium LT2
aacucacauauuca

SEQ ID NO: 3748684 - RNA, 20 nt, Salmonella typhimurium LT2
aacucacauauucaauaaua

SEQ ID NO: 3748685 - RNA, 13 nt, Salmonella typhimurium LT2
aacucaucacagc

SEQ ID NO: 3748686 - RNA, 12 nt, Salmonella typhimurium LT2
aacucaucauca

SEQ ID NO: 3748687 - RNA, 13 nt, Salmonella typhimurium LT2
aacucaucgccag

SEQ ID NO: 3748688 - RNA, 20 nt, Salmonella typhimurium LT2
aacucaucgcuuagcggcuc

SEQ ID NO: 3748689 - RNA, 18 nt, Salmonella typhimurium LT2
aacucaucggaacaguaa

SEQ ID NO: 3748690 - RNA, 14 nt, Salmonella typhimurium LT2
aacuccaccugauc

SEQ ID NO: 3748691 - RNA, 16 nt, Salmonella typhimurium LT2
aacuccagcaaaucaa

SEQ ID NO: 3748692 - RNA, 11 nt, Salmonella typhimurium LT2
aacuccagcac

SEQ ID NO: 3748693 - RNA, 19 nt, Salmonella typhimurium LT2
aacuccccuguuugcauca

SEQ ID NO: 3748694 - RNA, 22 nt, Salmonella typhimurium LT2
aacuccggcgaccaguuauucg

SEQ ID NO: 3748695 - RNA, 13 nt, Salmonella typhimurium LT2
aacuccuccggcg

SEQ ID NO: 3748696 - RNA, 16 nt, Salmonella typhimurium LT2
aacuccugggcaaaau

SEQ ID NO: 3748697 - RNA, 18 nt, Salmonella typhimurium LT2
aacucgacuuuuuccggc

SEQ ID NO: 3748698 - RNA, 16 nt, Salmonella typhimurium LT2
aacucuauuaaaauaa

SEQ ID NO: 3748699 - RNA, 17 nt, Salmonella typhimurium LT2
aacucuauuaaaauaaa

SEQ ID NO: 3748700 - RNA, 16 nt, Salmonella typhimurium LT2
aacucuccaugccauc

SEQ ID NO: 3748701 - RNA, 13 nt, Salmonella typhimurium LT2
aacucucccaacu

SEQ ID NO: 3748702 - RNA, 14 nt, Salmonella typhimurium LT2
aacucuccugucgu

SEQ ID NO: 3748703 - RNA, 19 nt, Salmonella typhimurium LT2
aacucugcuuuuauuuuca

SEQ ID NO: 3748704 - RNA, 13 nt, Salmonella typhimurium LT2
aagacguuucaga

SEQ ID NO: 3748705 - RNA, 15 nt, Salmonella typhimurium LT2
aagacuacgcaaaaa

SEQ ID NO: 3748706 - RNA, 14 nt, Salmonella typhimurium LT2
aagacuccccugca

SEQ ID NO: 3748707 - RNA, 17 nt, Salmonella typhimurium LT2
aagagaauggccagcac

SEQ ID NO: 3748708 - RNA, 21 nt, Salmonella typhimurium LT2
aagagagcaacauaccgcaga

SEQ ID NO: 3748709 - RNA, 21 nt, Salmonella typhimurium LT2
aagagccgcgcagcgcaacgc

SEQ ID NO: 3748710 - RNA, 23 nt, Salmonella typhimurium LT2
aagagcgacgaguuguuucaaca

SEQ ID NO: 3748711 - RNA, 19 nt, Salmonella typhimurium LT2
aagagcgagucuuuguccg

SEQ ID NO: 3748712 - RNA, 16 nt, Salmonella typhimurium LT2
aagagcgccugaccgc

SEQ ID NO: 3748713 - RNA, 16 nt, Salmonella typhimurium LT2
aagaggccggauggcg

SEQ ID NO: 3748714 - RNA, 18 nt, Salmonella typhimurium LT2
aagagggagagagccugu

SEQ ID NO: 3748715 - RNA, 22 nt, Salmonella typhimurium LT2
aagagguauccugaaccagcgg

SEQ ID NO: 3748716 - RNA, 20 nt, Salmonella typhimurium LT2
aagaguccauucggccugcg

SEQ ID NO: 3748717 - RNA, 11 nt, Salmonella typhimurium LT2
aagaguuaacu

SEQ ID NO: 3748718 - RNA, 18 nt, Salmonella typhimurium LT2
aagaguuguugaccaaca

SEQ ID NO: 3748719 - RNA, 20 nt, Salmonella typhimurium LT2
aagauaaacgacagcgccau

SEQ ID NO: 3748720 - RNA, 17 nt, Salmonella typhimurium LT2
aagauaaauaaaaaauu

SEQ ID NO: 3748721 - RNA, 14 nt, Salmonella typhimurium LT2
aagauaagaaguaa

SEQ ID NO: 3748722 - RNA, 23 nt, Salmonella typhimurium LT2
aagauaagccgucauaaaaucaa

SEQ ID NO: 3748723 - RNA, 22 nt, Salmonella typhimurium LT2
aagauagcgggcaaugccacca

SEQ ID NO: 3748724 - RNA, 22 nt, Salmonella typhimurium LT2
aagauauuuuguuuuaaauuca

SEQ ID NO: 3748725 - RNA, 19 nt, Salmonella typhimurium LT2
aagaucaggaguaaauaac

SEQ ID NO: 3748726 - RNA, 12 nt, Salmonella typhimurium LT2
aagaucccaggg

SEQ ID NO: 3748727 - RNA, 21 nt, Salmonella typhimurium LT2
aagaucccagggcggcgucgc

SEQ ID NO: 3748728 - RNA, 17 nt, Salmonella typhimurium LT2
aagauccgggcuggcaa

SEQ ID NO: 3748729 - RNA, 21 nt, Salmonella typhimurium LT2
aagaucgcauuuaaucgccug

SEQ ID NO: 3748730 - RNA, 18 nt, Salmonella typhimurium LT2
aagaucgccaagcuguga

SEQ ID NO: 3748731 - RNA, 23 nt, Salmonella typhimurium LT2
aagaucgccaagcugugauugcg

SEQ ID NO: 3748732 - RNA, 23 nt, Salmonella typhimurium LT2
aagaucgcgaggcaacagauacg

SEQ ID NO: 3748733 - RNA, 19 nt, Salmonella typhimurium LT2
aagaucguuauccagcagc

SEQ ID NO: 3748734 - RNA, 22 nt, Salmonella typhimurium LT2
aagaucguuauccagcagccac

SEQ ID NO: 3748735 - RNA, 17 nt, Salmonella typhimurium LT2
aagaucuggcgaaagua

SEQ ID NO: 3748736 - RNA, 15 nt, Salmonella typhimurium LT2
aagauguagucgccu

SEQ ID NO: 3748737 - RNA, 16 nt, Salmonella typhimurium LT2
aagauuaaccagcagu

SEQ ID NO: 3748738 - RNA, 20 nt, Salmonella typhimurium LT2
aagauuaauugauuacaaag

SEQ ID NO: 3748739 - RNA, 17 nt, Salmonella typhimurium LT2
aagauuacaccacuuuu

SEQ ID NO: 3748740 - RNA, 22 nt, Salmonella typhimurium LT2
aagauuacucccuugccagcgc

SEQ ID NO: 3748741 - RNA, 19 nt, Salmonella typhimurium LT2
aagauuagccguugaguuu

SEQ ID NO: 3748742 - RNA, 22 nt, Salmonella typhimurium LT2
aagauuagcguuuuuaucuuuu

SEQ ID NO: 3748743 - RNA, 18 nt, Salmonella typhimurium LT2
aagauugauuuauucacu

SEQ ID NO: 3748744 - RNA, 17 nt, Salmonella typhimurium LT2
aagcaacaugaaaggga

SEQ ID NO: 3748745 - RNA, 23 nt, Salmonella typhimurium LT2
aagcaacugggcuugcauugcuu

SEQ ID NO: 3748746 - RNA, 20 nt, Salmonella typhimurium LT2
aagcaacuguagaaugcuau

SEQ ID NO: 3748747 - RNA, 20 nt, Salmonella typhimurium LT2
aagcaauauggcugcgacaa

SEQ ID NO: 3748748 - RNA, 22 nt, Salmonella typhimurium LT2
aagcaauauggcugcgacaaug

SEQ ID NO: 3748749 - RNA, 23 nt, Salmonella typhimurium LT2
aagcaauuacggacagaaaaaau

SEQ ID NO: 3748750 - RNA, 17 nt, Salmonella typhimurium LT2
aagcacagauaaaggau

SEQ ID NO: 3748751 - RNA, 13 nt, Salmonella typhimurium LT2
aagcacagcccca

SEQ ID NO: 3748752 - RNA, 22 nt, Salmonella typhimurium LT2
aagcacaggccauuaagcuucg

SEQ ID NO: 3748753 - RNA, 18 nt, Salmonella typhimurium LT2
aagcacauagcugagacu

SEQ ID NO: 3748754 - RNA, 20 nt, Salmonella typhimurium LT2
aagcacccaugaagauguag

SEQ ID NO: 3748755 - RNA, 14 nt, Salmonella typhimurium LT2
aagcaccgccagcg

SEQ ID NO: 3748756 - RNA, 17 nt, Salmonella typhimurium LT2
aagcaccgccagcgccg

SEQ ID NO: 3748757 - RNA, 19 nt, Salmonella typhimurium LT2
aagcaccuagguuccagcu

SEQ ID NO: 3748758 - RNA, 21 nt, Salmonella typhimurium LT2
aagcaccugcauuuaucuuua

SEQ ID NO: 3748759 - RNA, 18 nt, Salmonella typhimurium LT2
aagcacuauuauauuuua

SEQ ID NO: 3748760 - RNA, 14 nt, Salmonella typhimurium LT2
aagcacuucuccac

SEQ ID NO: 3748761 - RNA, 19 nt, Salmonella typhimurium LT2
aagcagaacguagcccauu

SEQ ID NO: 3748762 - RNA, 22 nt, Salmonella typhimurium LT2
aagcagaccaccccacagcaau

SEQ ID NO: 3748763 - RNA, 15 nt, Salmonella typhimurium LT2
aagcagauaccagcc

SEQ ID NO: 3748764 - RNA, 12 nt, Salmonella typhimurium LT2
aagcagcgacaa

SEQ ID NO: 3748765 - RNA, 19 nt, Salmonella typhimurium LT2
aagcagcggcgguuauccg

SEQ ID NO: 3748766 - RNA, 22 nt, Salmonella typhimurium LT2
aagcagcggcgguuauccgcca

SEQ ID NO: 3748767 - RNA, 12 nt, Salmonella typhimurium LT2
aagcagcugcug

SEQ ID NO: 3748768 - RNA, 23 nt, Salmonella typhimurium LT2
aagcagcugcuuaacuucugcag

SEQ ID NO: 3748769 - RNA, 23 nt, Salmonella typhimurium LT2
aagcagguagcgccuuuacuggu

SEQ ID NO: 3748770 - RNA, 19 nt, Salmonella typhimurium LT2
aagcagguguuauuuuugu

SEQ ID NO: 3748771 - RNA, 15 nt, Salmonella typhimurium LT2
aagcaguuccagcau

SEQ ID NO: 3748772 - RNA, 16 nt, Salmonella typhimurium LT2
aagcaguuccagcauc

SEQ ID NO: 3748773 - RNA, 14 nt, Salmonella typhimurium LT2
aagcauaccuucac

SEQ ID NO: 3748774 - RNA, 15 nt, Salmonella typhimurium LT2
aagcauaccuucaca

SEQ ID NO: 3748775 - RNA, 18 nt, Salmonella typhimurium LT2
aagcauugccguuuucaa

SEQ ID NO: 3748776 - RNA, 19 nt, Salmonella typhimurium LT2
aagcauugccguuuucaau

SEQ ID NO: 3748777 - RNA, 15 nt, Salmonella typhimurium LT2
aagccaaaauuuuca

SEQ ID NO: 3748778 - RNA, 21 nt, Salmonella typhimurium LT2
aagccaacgcagucaaaacga

SEQ ID NO: 3748779 - RNA, 15 nt, Salmonella typhimurium LT2
aagccacaaucugau

SEQ ID NO: 3748780 - RNA, 20 nt, Salmonella typhimurium LT2
aagccagcacggcuucacgu

SEQ ID NO: 3748781 - RNA, 22 nt, Salmonella typhimurium LT2
aagccagccaaauagcgccaga

SEQ ID NO: 3748782 - RNA, 15 nt, Salmonella typhimurium LT2
aagccaggcuuuaaa

SEQ ID NO: 3748783 - RNA, 23 nt, Salmonella typhimurium LT2
aagccaucuucgguaauacaauc

SEQ ID NO: 3748784 - RNA, 22 nt, Salmonella typhimurium LT2
aagccaugccgaagacuccccu

SEQ ID NO: 3748785 - RNA, 15 nt, Salmonella typhimurium LT2
aagccaugugacggc

SEQ ID NO: 3748786 - RNA, 23 nt, Salmonella typhimurium LT2
aagccauuccccacgccaucgcg

SEQ ID NO: 3748787 - RNA, 15 nt, Salmonella typhimurium LT2
aagccccccgcacag

SEQ ID NO: 3748788 - RNA, 18 nt, Salmonella typhimurium LT2
aagccccccgcacagcac

SEQ ID NO: 3748789 - RNA, 21 nt, Salmonella typhimurium LT2
aagccccccgcacagcacaua

SEQ ID NO: 3748790 - RNA, 20 nt, Salmonella typhimurium LT2
aagccccuggcgcgccagcu

SEQ ID NO: 3748791 - RNA, 17 nt, Salmonella typhimurium LT2
aagcccgcaaacagagc

SEQ ID NO: 3748792 - RNA, 15 nt, Salmonella typhimurium LT2
aagcccggccuuauc

SEQ ID NO: 3748793 - RNA, 18 nt, Salmonella typhimurium LT2
aagccgaaaccacagcgg

SEQ ID NO: 3748794 - RNA, 19 nt, Salmonella typhimurium LT2
aagccgauggcccccguuu

SEQ ID NO: 3748795 - RNA, 22 nt, Salmonella typhimurium LT2
aagccggauaguaucuuauccg

SEQ ID NO: 3748796 - RNA, 22 nt, Salmonella typhimurium LT2
aagccguagaccuggcucucgg

SEQ ID NO: 3748797 - RNA, 17 nt, Salmonella typhimurium LT2
aagccguagcagaagac

SEQ ID NO: 3748798 - RNA, 20 nt, Salmonella typhimurium LT2
aagccguuuuggcagcgccc

SEQ ID NO: 3748799 - RNA, 22 nt, Salmonella typhimurium LT2
aagccucuuccgccugauaaaa

SEQ ID NO: 3748800 - RNA, 22 nt, Salmonella typhimurium LT2
aagccugauggcgcuucgcuua

SEQ ID NO: 3748801 - RNA, 21 nt, Salmonella typhimurium LT2
aagccuuuuuaaauauuaaga

SEQ ID NO: 3748802 - RNA, 14 nt, Salmonella typhimurium LT2
aagcgaaaauaaac

SEQ ID NO: 3748803 - RNA, 13 nt, Salmonella typhimurium LT2
aagcgaagcgcca

SEQ ID NO: 3748804 - RNA, 15 nt, Salmonella typhimurium LT2
aagcgacagcgccau

SEQ ID NO: 3748805 - RNA, 15 nt, Salmonella typhimurium LT2
aagcgagcgccugau

SEQ ID NO: 3748806 - RNA, 18 nt, Salmonella typhimurium LT2
aagcgauuuauccaccgc

SEQ ID NO: 3748807 - RNA, 20 nt, Salmonella typhimurium LT2
aagcgauuuauccaccgcca

SEQ ID NO: 3748808 - RNA, 17 nt, Salmonella typhimurium LT2
aagcgcaaaauagcagc

SEQ ID NO: 3748809 - RNA, 21 nt, Salmonella typhimurium LT2
aagcgcaaacuuccacacggc

SEQ ID NO: 3748810 - RNA, 14 nt, Salmonella typhimurium LT2
aagcgcaagcgcca

SEQ ID NO: 3748811 - RNA, 14 nt, Salmonella typhimurium LT2
aagcgcagcgccau

SEQ ID NO: 3748812 - RNA, 16 nt, Salmonella typhimurium LT2
aagcgcagcgccauca

SEQ ID NO: 3748813 - RNA, 16 nt, Salmonella typhimurium LT2
aagcgcagcgccaucc

SEQ ID NO: 3748814 - RNA, 19 nt, Salmonella typhimurium LT2
aagcgcauccgguaaacgc

SEQ ID NO: 3748815 - RNA, 17 nt, Salmonella typhimurium LT2
aagcgccacgcgucagg

SEQ ID NO: 3748816 - RNA, 23 nt, Salmonella typhimurium LT2
aagcgccacgguugucaaauuug

SEQ ID NO: 3748817 - RNA, 23 nt, Salmonella typhimurium LT2
aagcgccagauaugaucgaaaau

SEQ ID NO: 3748818 - RNA, 21 nt, Salmonella typhimurium LT2
aagcgccauuaaaaaaggcag

SEQ ID NO: 3748819 - RNA, 15 nt, Salmonella typhimurium LT2
aagcgcccgauaaua

SEQ ID NO: 3748820 - RNA, 16 nt, Salmonella typhimurium LT2
aagcgcccgcgcgcca

SEQ ID NO: 3748821 - RNA, 12 nt, Salmonella typhimurium LT2
aagcgccgcgau

SEQ ID NO: 3748822 - RNA, 13 nt, Salmonella typhimurium LT2
aagcgccgcgcca

SEQ ID NO: 3748823 - RNA, 18 nt, Salmonella typhimurium LT2
aagcgccuguucaacaug

SEQ ID NO: 3748824 - RNA, 13 nt, Salmonella typhimurium LT2
aagcgcgccauaa

SEQ ID NO: 3748825 - RNA, 17 nt, Salmonella typhimurium LT2
aagcgcgcggcugcggg

SEQ ID NO: 3748826 - RNA, 13 nt, Salmonella typhimurium LT2
aagcgcggacagc

SEQ ID NO: 3748827 - RNA, 16 nt, Salmonella typhimurium LT2
aagcgcggacagcaga

SEQ ID NO: 3748828 - RNA, 12 nt, Salmonella typhimurium LT2
aagcgcgggcug

SEQ ID NO: 3748829 - RNA, 20 nt, Salmonella typhimurium LT2
aagcgcgguaaauuucuuga

SEQ ID NO: 3748830 - RNA, 19 nt, Salmonella typhimurium LT2
aagcgcguuucugcgccuc

SEQ ID NO: 3748831 - RNA, 20 nt, Salmonella typhimurium LT2
aagcgcucaugccacgccau

SEQ ID NO: 3748832 - RNA, 17 nt, Salmonella typhimurium LT2
aagcgcugagucaggcg

SEQ ID NO: 3748833 - RNA, 13 nt, Salmonella typhimurium LT2
aagcgcugcugcu

SEQ ID NO: 3748834 - RNA, 16 nt, Salmonella typhimurium LT2
aagcgcugggcgauaa

SEQ ID NO: 3748835 - RNA, 18 nt, Salmonella typhimurium LT2
aagcgcuuuggucaggcu

SEQ ID NO: 3748836 - RNA, 13 nt, Salmonella typhimurium LT2
aagcggaacugau

SEQ ID NO: 3748837 - RNA, 13 nt, Salmonella typhimurium LT2
aagcggcacugcu

SEQ ID NO: 3748838 - RNA, 21 nt, Salmonella typhimurium LT2
aagcggcacugcucuuuaaca

SEQ ID NO: 3748839 - RNA, 16 nt, Salmonella typhimurium LT2
aagcggcugucaucaa

SEQ ID NO: 3748840 - RNA, 19 nt, Salmonella typhimurium LT2
aagcgguaaggcaccgguu

SEQ ID NO: 3748841 - RNA, 16 nt, Salmonella typhimurium LT2
aagcgguaauaacuga

SEQ ID NO: 3748842 - RNA, 18 nt, Salmonella typhimurium LT2
aagcgguguaaaagccag

SEQ ID NO: 3748843 - RNA, 17 nt, Salmonella typhimurium LT2
aagcgguuaagauacau

SEQ ID NO: 3748844 - RNA, 18 nt, Salmonella typhimurium LT2
aagcgguuaagauacaua

SEQ ID NO: 3748845 - RNA, 15 nt, Salmonella typhimurium LT2
aagcguaacagcgcu

SEQ ID NO: 3748846 - RNA, 16 nt, Salmonella typhimurium LT2
aagcguagccgcgcca

SEQ ID NO: 3748847 - RNA, 18 nt, Salmonella typhimurium LT2
aagcguagccgcgccaga

SEQ ID NO: 3748848 - RNA, 13 nt, Salmonella typhimurium LT2
aagcguagcgcca

SEQ ID NO: 3748849 - RNA, 14 nt, Salmonella typhimurium LT2
aagcguagcgccau

SEQ ID NO: 3748850 - RNA, 21 nt, Salmonella typhimurium LT2
aagcguagcgccaucaggcau

SEQ ID NO: 3748851 - RNA, 15 nt, Salmonella typhimurium LT2
aagcgucagcgccau

SEQ ID NO: 3748852 - RNA, 17 nt, Salmonella typhimurium LT2
aagcgucagcgccaucc

SEQ ID NO: 3748853 - RNA, 15 nt, Salmonella typhimurium LT2
aagcgucaggcgaag

SEQ ID NO: 3748854 - RNA, 19 nt, Salmonella typhimurium LT2
aagcgucauaaguguuuua

SEQ ID NO: 3748855 - RNA, 21 nt, Salmonella typhimurium LT2
aagcgucgccagcguuucacu

SEQ ID NO: 3748856 - RNA, 21 nt, Salmonella typhimurium LT2
aagcgucuuuaaagccuucau

SEQ ID NO: 3748857 - RNA, 15 nt, Salmonella typhimurium LT2
aagcguuaaugcguu

SEQ ID NO: 3748858 - RNA, 22 nt, Salmonella typhimurium LT2
aagcguuaaugcguuuacacag

SEQ ID NO: 3748859 - RNA, 19 nt, Salmonella typhimurium LT2
aagcguuacggaaaaaaua

SEQ ID NO: 3748860 - RNA, 17 nt, Salmonella typhimurium LT2
aagcguucaucaggcau

SEQ ID NO: 3748861 - RNA, 16 nt, Salmonella typhimurium LT2
aagcguuguaacaaac

SEQ ID NO: 3748862 - RNA, 13 nt, Salmonella typhimurium LT2
aagcguuuccaga

SEQ ID NO: 3748863 - RNA, 14 nt, Salmonella typhimurium LT2
aagcguuuccagag

SEQ ID NO: 3748864 - RNA, 22 nt, Salmonella typhimurium LT2
aagcguuuccagaguacauucu

SEQ ID NO: 3748865 - RNA, 11 nt, Salmonella typhimurium LT2
aagcuaauccc

SEQ ID NO: 3748866 - RNA, 21 nt, Salmonella typhimurium LT2
aagcuaucgccaucaacgcca

SEQ ID NO: 3748867 - RNA, 17 nt, Salmonella typhimurium LT2
aagcucaacgcaggcug

SEQ ID NO: 3748868 - RNA, 18 nt, Salmonella typhimurium LT2
aagcucaacgcaggcugg

SEQ ID NO: 3748869 - RNA, 13 nt, Salmonella typhimurium LT2
aagcucaccugcu

SEQ ID NO: 3748870 - RNA, 15 nt, Salmonella typhimurium LT2
aagcucagccaggcg

SEQ ID NO: 3748871 - RNA, 13 nt, Salmonella typhimurium LT2
aagcucauuuccc

SEQ ID NO: 3748872 - RNA, 21 nt, Salmonella typhimurium LT2
aagcucauuucccaauaguuu

SEQ ID NO: 3748873 - RNA, 22 nt, Salmonella typhimurium LT2
aagcucauuucccaauaguuua

SEQ ID NO: 3748874 - RNA, 23 nt, Salmonella typhimurium LT2
aagcucauuucccaauaguuuau

SEQ ID NO: 3748875 - RNA, 16 nt, Salmonella typhimurium LT2
aagcucccggggauuu

SEQ ID NO: 3748876 - RNA, 12 nt, Salmonella typhimurium LT2
aagcucgcggau

SEQ ID NO: 3748877 - RNA, 17 nt, Salmonella typhimurium LT2
aagcugauguucauuca

SEQ ID NO: 3748878 - RNA, 14 nt, Salmonella typhimurium LT2
aagcugcaaccagc

SEQ ID NO: 3748879 - RNA, 17 nt, Salmonella typhimurium LT2
aagcugcaccaggagca

SEQ ID NO: 3748880 - RNA, 12 nt, Salmonella typhimurium LT2
aagcugcauaau

SEQ ID NO: 3748881 - RNA, 24 nt, Salmonella typhimurium LT2
aagcugcgccacgcgcucgugcaa

SEQ ID NO: 3748882 - RNA, 22 nt, Salmonella typhimurium LT2
aagcugcgcccgcucugcgcca

SEQ ID NO: 3748883 - RNA, 17 nt, Salmonella typhimurium LT2
aagcugcggcagaauca

SEQ ID NO: 3748884 - RNA, 15 nt, Salmonella typhimurium LT2
aagcugcggcccaga

SEQ ID NO: 3748885 - RNA, 18 nt, Salmonella typhimurium LT2
aagcuggccuucagguuu

SEQ ID NO: 3748886 - RNA, 14 nt, Salmonella typhimurium LT2
aagcuggcugacag

SEQ ID NO: 3748887 - RNA, 14 nt, Salmonella typhimurium LT2
aagcugggcgucaa

SEQ ID NO: 3748888 - RNA, 20 nt, Salmonella typhimurium LT2
aagcugggcgucaacgugaa

SEQ ID NO: 3748889 - RNA, 16 nt, Salmonella typhimurium LT2
aagcugggucaggaca

SEQ ID NO: 3748890 - RNA, 21 nt, Salmonella typhimurium LT2
aagcugguggcgaguccugcc

SEQ ID NO: 3748891 - RNA, 22 nt, Salmonella typhimurium LT2
aagcugguggcgaguccugccg

SEQ ID NO: 3748892 - RNA, 23 nt, Salmonella typhimurium LT2
aagcugguuaaugaccugccgcg

SEQ ID NO: 3748893 - RNA, 19 nt, Salmonella typhimurium LT2
aagcuguaaccuacgccaa

SEQ ID NO: 3748894 - RNA, 17 nt, Salmonella typhimurium LT2
aagcugugccacauuua

SEQ ID NO: 3748895 - RNA, 23 nt, Salmonella typhimurium LT2
aagcuguuaauuugcaucaggcc

SEQ ID NO: 3748896 - RNA, 20 nt, Salmonella typhimurium LT2
aagcuguuccggcuucguua

SEQ ID NO: 3748897 - RNA, 21 nt, Salmonella typhimurium LT2
aagcuguuucuccguuguugc

SEQ ID NO: 3748898 - RNA, 20 nt, Salmonella typhimurium LT2
aagcuuauaaacuucauccu

SEQ ID NO: 3748899 - RNA, 13 nt, Salmonella typhimurium LT2
aagcuuguagaaa

SEQ ID NO: 3748900 - RNA, 14 nt, Salmonella typhimurium LT2
aagcuuguagaaaa

SEQ ID NO: 3748901 - RNA, 17 nt, Salmonella typhimurium LT2
aagcuuugcguaaaaaa

SEQ ID NO: 3748902 - RNA, 20 nt, Salmonella typhimurium LT2
aagcuuugcguaaaaaaaca

SEQ ID NO: 3748903 - RNA, 21 nt, Salmonella typhimurium LT2
aagcuuugcguaaaaaaacau

SEQ ID NO: 3748904 - RNA, 13 nt, Salmonella typhimurium LT2
aaggaaacgccag

SEQ ID NO: 3748905 - RNA, 16 nt, Salmonella typhimurium LT2
aaggaaacgccaggca

SEQ ID NO: 3748906 - RNA, 17 nt, Salmonella typhimurium LT2
aaggaaacgccaggcac

SEQ ID NO: 3748907 - RNA, 14 nt, Salmonella typhimurium LT2
aaggacaagcugcg

SEQ ID NO: 3748908 - RNA, 16 nt, Salmonella typhimurium LT2
aaggacauucagcacg

SEQ ID NO: 3748909 - RNA, 15 nt, Salmonella typhimurium LT2
aaggauacagcgccg

SEQ ID NO: 3748910 - RNA, 21 nt, Salmonella typhimurium LT2
aaguuuauuugaauagucaac

SEQ ID NO: 3748911 - RNA, 14 nt, Salmonella typhimurium LT2
aaguuuuuuuaaaa

SEQ ID NO: 3748912 - RNA, 20 nt, Salmonella typhimurium LT2
aauaaaaaacaagauuaauu

SEQ ID NO: 3748913 - RNA, 13 nt, Salmonella typhimurium LT2
aauaaaaaauucc

SEQ ID NO: 3748914 - RNA, 13 nt, Salmonella typhimurium LT2
aauaaaaaccauu

SEQ ID NO: 3748915 - RNA, 16 nt, Salmonella typhimurium LT2
aauaaaaaccauuuau

SEQ ID NO: 3748916 - RNA, 14 nt, Salmonella typhimurium LT2
aauaaaauagcgau

SEQ ID NO: 3748917 - RNA, 20 nt, Salmonella typhimurium LT2
aauaaaauauccuccaccuc

SEQ ID NO: 3748918 - RNA, 13 nt, Salmonella typhimurium LT2
aauaaaauauuau

SEQ ID NO: 3748919 - RNA, 18 nt, Salmonella typhimurium LT2
aauaaaauuguuauuuaa

SEQ ID NO: 3748920 - RNA, 10 nt, Salmonella typhimurium LT2
aauaaacaca

SEQ ID NO: 3748921 - RNA, 14 nt, Salmonella typhimurium LT2
aauaaacaucagcc

SEQ ID NO: 3748922 - RNA, 15 nt, Salmonella typhimurium LT2
aauaaacaucagcca

SEQ ID NO: 3748923 - RNA, 13 nt, Salmonella typhimurium LT2
aauaaacauuuuu

SEQ ID NO: 3748924 - RNA, 20 nt, Salmonella typhimurium LT2
aauaaacauuuuuuuugcau

SEQ ID NO: 3748925 - RNA, 22 nt, Salmonella typhimurium LT2
aauaaacgccaguggaugcgcu

SEQ ID NO: 3748926 - RNA, 22 nt, Salmonella typhimurium LT2
aauaaacggcgcguccagccag

SEQ ID NO: 3748927 - RNA, 17 nt, Salmonella typhimurium LT2
aauaaacugcauccccu

SEQ ID NO: 3748928 - RNA, 22 nt, Salmonella typhimurium LT2
aauaaagagcacuucugacauu

SEQ ID NO: 3748929 - RNA, 24 nt, Salmonella typhimurium LT2
aauaaagccgcauuuuuccagcca

SEQ ID NO: 3748930 - RNA, 22 nt, Salmonella typhimurium LT2
aauaaagcguagccgcgccaga

SEQ ID NO: 3748931 - RNA, 20 nt, Salmonella typhimurium LT2
aauaaaggcuugacucaaaa

SEQ ID NO: 3748932 - RNA, 16 nt, Salmonella typhimurium LT2
aauaaaguuuauuuga

SEQ ID NO: 3748933 - RNA, 13 nt, Salmonella typhimurium LT2
aauaaauaccaca

SEQ ID NO: 3748934 - RNA, 20 nt, Salmonella typhimurium LT2
aauaaauccaugagaagaaa

SEQ ID NO: 3748935 - RNA, 22 nt, Salmonella typhimurium LT2
aauaaauccgcgcucagucacu

SEQ ID NO: 3748936 - RNA, 17 nt, Salmonella typhimurium LT2
aauaaaugccgcaauaa

SEQ ID NO: 3748937 - RNA, 23 nt, Salmonella typhimurium LT2
aauaaauucuuuacgcagcaaga

SEQ ID NO: 3748938 - RNA, 16 nt, Salmonella typhimurium LT2
aauaaauuuucauuau

SEQ ID NO: 3748939 - RNA, 18 nt, Salmonella typhimurium LT2
aauaaauuuucauuauaa

SEQ ID NO: 3748940 - RNA, 19 nt, Salmonella typhimurium LT2
aauaaauuuucauuauaaa

SEQ ID NO: 3748941 - RNA, 22 nt, Salmonella typhimurium LT2
aauaaauuuucauuauaaaacu

SEQ ID NO: 3748942 - RNA, 14 nt, Salmonella typhimurium LT2
aauaacaaaaugag

SEQ ID NO: 3748943 - RNA, 13 nt, Salmonella typhimurium LT2
aauaacaaaugaa

SEQ ID NO: 3748944 - RNA, 22 nt, Salmonella typhimurium LT2
aauaacaggcacaguagacaac

SEQ ID NO: 3748945 - RNA, 22 nt, Salmonella typhimurium LT2
aauaacaucguaaaucaaauga

SEQ ID NO: 3748946 - RNA, 15 nt, Salmonella typhimurium LT2
aauaaccaccuguuc

SEQ ID NO: 3748947 - RNA, 15 nt, Salmonella typhimurium LT2
aauaaccccaagcaa

SEQ ID NO: 3748948 - RNA, 14 nt, Salmonella typhimurium LT2
aauaaccccagcug

SEQ ID NO: 3748949 - RNA, 19 nt, Salmonella typhimurium LT2
aauaaccucaacgucgcuc

SEQ ID NO: 3748950 - RNA, 16 nt, Salmonella typhimurium LT2
aauaaccucuacacau

SEQ ID NO: 3748951 - RNA, 22 nt, Salmonella typhimurium LT2
aauaaccucuacacauuuuaaa

SEQ ID NO: 3748952 - RNA, 19 nt, Salmonella typhimurium LT2
aauaacgcacuaccagaaa

SEQ ID NO: 3748953 - RNA, 19 nt, Salmonella typhimurium LT2
aauaacgccagaucucaca

SEQ ID NO: 3748954 - RNA, 22 nt, Salmonella typhimurium LT2
aauaacgccagaucucacaaga

SEQ ID NO: 3748955 - RNA, 12 nt, Salmonella typhimurium LT2
aauaacgcgcuu

SEQ ID NO: 3748956 - RNA, 21 nt, Salmonella typhimurium LT2
aauaacgggcacggucugcug

SEQ ID NO: 3748957 - RNA, 16 nt, Salmonella typhimurium LT2
aauaacuauaauugcu

SEQ ID NO: 3748958 - RNA, 17 nt, Salmonella typhimurium LT2
aauaacuauaauugcuu

SEQ ID NO: 3748959 - RNA, 14 nt, Salmonella typhimurium LT2
aauaagaaacugcu

SEQ ID NO: 3748960 - RNA, 16 nt, Salmonella typhimurium LT2
aauaagaacuuuauca

SEQ ID NO: 3748961 - RNA, 20 nt, Salmonella typhimurium LT2
aauaagcaccggcgggcuga

SEQ ID NO: 3748962 - RNA, 12 nt, Salmonella typhimurium LT2
aauaagcgaauu

SEQ ID NO: 3748963 - RNA, 15 nt, Salmonella typhimurium LT2
aauaagcgcucaggc

SEQ ID NO: 3748964 - RNA, 12 nt, Salmonella typhimurium LT2
aauaaggcaccg

SEQ ID NO: 3748965 - RNA, 16 nt, Salmonella typhimurium LT2
aauaaggccugagcuu

SEQ ID NO: 3748966 - RNA, 20 nt, Salmonella typhimurium LT2
aauaauaaaacggcucauca

SEQ ID NO: 3748967 - RNA, 12 nt, Salmonella typhimurium LT2
aauaauauccug

SEQ ID NO: 3748968 - RNA, 17 nt, Salmonella typhimurium LT2
aauaauauccugccgca

SEQ ID NO: 3748969 - RNA, 18 nt, Salmonella typhimurium LT2
aauaaucccgcauauuuu

SEQ ID NO: 3748970 - RNA, 13 nt, Salmonella typhimurium LT2
aauaaucgccgga

SEQ ID NO: 3748971 - RNA, 20 nt, Salmonella typhimurium LT2
aauaaucgcgagaaaauaga

SEQ ID NO: 3748972 - RNA, 19 nt, Salmonella typhimurium LT2
aauaaugaagacguugaau

SEQ ID NO: 3748973 - RNA, 21 nt, Salmonella typhimurium LT2
aauaaugcaggcuauccacaa

SEQ ID NO: 3748974 - RNA, 12 nt, Salmonella typhimurium LT2
aauaaugcccac

SEQ ID NO: 3748975 - RNA, 21 nt, Salmonella typhimurium LT2
aauaaugccucauuaaaaaaa

SEQ ID NO: 3748976 - RNA, 18 nt, Salmonella typhimurium LT2
aauaauggcgcgaaaaca

SEQ ID NO: 3748977 - RNA, 20 nt, Salmonella typhimurium LT2
aauaauggcgcgaaaacagc

SEQ ID NO: 3748978 - RNA, 22 nt, Salmonella typhimurium LT2
aauaauggcgcgaaaacagcug

SEQ ID NO: 3748979 - RNA, 17 nt, Salmonella typhimurium LT2
aauaauguaaaaaaaua

SEQ ID NO: 3748980 - RNA, 18 nt, Salmonella typhimurium LT2
aauaauguaaaaaaauaa

SEQ ID NO: 3748981 - RNA, 17 nt, Salmonella typhimurium LT2
aauaauguuuacgccau

SEQ ID NO: 3748982 - RNA, 15 nt, Salmonella typhimurium LT2
aauaauuaacccaca

SEQ ID NO: 3748983 - RNA, 13 nt, Salmonella typhimurium LT2
aauaauucucaau

SEQ ID NO: 3748984 - RNA, 20 nt, Salmonella typhimurium LT2
aauaauucucaauuucguau

SEQ ID NO: 3748985 - RNA, 21 nt, Salmonella typhimurium LT2
aauaauugagcgcaaaacgcu

SEQ ID NO: 3748986 - RNA, 15 nt, Salmonella typhimurium LT2
aauacacaaugcuuc

SEQ ID NO: 3748987 - RNA, 22 nt, Salmonella typhimurium LT2
aauacacgcgacaaugccauaa

SEQ ID NO: 3748988 - RNA, 14 nt, Salmonella typhimurium LT2
aauacagccagcac

SEQ ID NO: 3748989 - RNA, 14 nt, Salmonella typhimurium LT2
aauacaguuuuccu

SEQ ID NO: 3748990 - RNA, 20 nt, Salmonella typhimurium LT2
aauacaguuuuccuucagca

SEQ ID NO: 3748991 - RNA, 16 nt, Salmonella typhimurium LT2
aauacauucaguacaa

SEQ ID NO: 3748992 - RNA, 13 nt, Salmonella typhimurium LT2
aauaccaauaaga

SEQ ID NO: 3748993 - RNA, 20 nt, Salmonella typhimurium LT2
aauaccaauaucgccguuaa

SEQ ID NO: 3748994 - RNA, 21 nt, Salmonella typhimurium LT2
aauaccacaaauuuugauaaa

SEQ ID NO: 3748995 - RNA, 15 nt, Salmonella typhimurium LT2
aauaccacaucagac

SEQ ID NO: 3748996 - RNA, 18 nt, Salmonella typhimurium LT2
aauaccagaaucaccgac

SEQ ID NO: 3748997 - RNA, 19 nt, Salmonella typhimurium LT2
aauaccagcaccugaauaa

SEQ ID NO: 3748998 - RNA, 16 nt, Salmonella typhimurium LT2
aauaccaggcacuuga

SEQ ID NO: 3748999 - RNA, 19 nt, Salmonella typhimurium LT2
aauaccaggcggcuuuuuc

SEQ ID NO: 3749000 - RNA, 14 nt, Salmonella typhimurium LT2
aauacccuccgcca

SEQ ID NO: 3749001 - RNA, 21 nt, Salmonella typhimurium LT2
aauacccuuaugauagccguu

SEQ ID NO: 3749002 - RNA, 16 nt, Salmonella typhimurium LT2
aauaccguccagcgca

SEQ ID NO: 3749003 - RNA, 14 nt, Salmonella typhimurium LT2
aauaccgugcagga

SEQ ID NO: 3749004 - RNA, 19 nt, Salmonella typhimurium LT2
aauaccuaacucuuccgca

SEQ ID NO: 3749005 - RNA, 21 nt, Salmonella typhimurium LT2
aauaccugccgaccucacugg

SEQ ID NO: 3749006 - RNA, 19 nt, Salmonella typhimurium LT2
aauaccugccugucacgca

SEQ ID NO: 3749007 - RNA, 16 nt, Salmonella typhimurium LT2
aauaccuucacaaaaa

SEQ ID NO: 3749008 - RNA, 16 nt, Salmonella typhimurium LT2
aauaccuuuaagcgcu

SEQ ID NO: 3749009 - RNA, 20 nt, Salmonella typhimurium LT2
aauacgacucaauacauuca

SEQ ID NO: 3749010 - RNA, 15 nt, Salmonella typhimurium LT2
aauacgcauaaugcg

SEQ ID NO: 3749011 - RNA, 23 nt, Salmonella typhimurium LT2
aauacgcggcacguuuuccaggu

SEQ ID NO: 3749012 - RNA, 23 nt, Salmonella typhimurium LT2
aauacgggagagcguauccagca

SEQ ID NO: 3749013 - RNA, 18 nt, Salmonella typhimurium LT2
aauacguuuauucuuuuc

SEQ ID NO: 3749014 - RNA, 15 nt, Salmonella typhimurium LT2
aaucgcgugcaacag

SEQ ID NO: 3749015 - RNA, 20 nt, Salmonella typhimurium LT2
aaucgcucuugcacaauacu

SEQ ID NO: 3749016 - RNA, 21 nt, Salmonella typhimurium LT2
aaucgcucuugcacaauacuu

SEQ ID NO: 3749017 - RNA, 11 nt, Salmonella typhimurium LT2
aaucgcugccu

SEQ ID NO: 3749018 - RNA, 14 nt, Salmonella typhimurium LT2
aaucgcuuccuggg

SEQ ID NO: 3749019 - RNA, 19 nt, Salmonella typhimurium LT2
aaucggaugccauguuucu

SEQ ID NO: 3749020 - RNA, 20 nt, Salmonella typhimurium LT2
aaucggcaaauacaucgcca

SEQ ID NO: 3749021 - RNA, 17 nt, Salmonella typhimurium LT2
aaucggcggaaugccgu

SEQ ID NO: 3749022 - RNA, 19 nt, Salmonella typhimurium LT2
aaucgggaacagccacaau

SEQ ID NO: 3749023 - RNA, 12 nt, Salmonella typhimurium LT2
aaucggugcuuc

SEQ ID NO: 3749024 - RNA, 14 nt, Salmonella typhimurium LT2
aaucgucacagacc

SEQ ID NO: 3749025 - RNA, 19 nt, Salmonella typhimurium LT2
aaucgucccacaugaacuc

SEQ ID NO: 3749026 - RNA, 18 nt, Salmonella typhimurium LT2
aaucgucgaggaagcugc

SEQ ID NO: 3749027 - RNA, 20 nt, Salmonella typhimurium LT2
aaucgucgugccuuccgcaa

SEQ ID NO: 3749028 - RNA, 21 nt, Salmonella typhimurium LT2
aaucgucgugccuuccgcaau

SEQ ID NO: 3749029 - RNA, 19 nt, Salmonella typhimurium LT2
aaucguucgccagugacaa

SEQ ID NO: 3749030 - RNA, 17 nt, Salmonella typhimurium LT2
aaucucacugcccauuc

SEQ ID NO: 3749031 - RNA, 18 nt, Salmonella typhimurium LT2
aaucucacugcccauucg

SEQ ID NO: 3749032 - RNA, 13 nt, Salmonella typhimurium LT2
aaucucagauaau

SEQ ID NO: 3749033 - RNA, 22 nt, Salmonella typhimurium LT2
aaucucagauaauagcugcggc

SEQ ID NO: 3749034 - RNA, 18 nt, Salmonella typhimurium LT2
aaucucccccggcaccac

SEQ ID NO: 3749035 - RNA, 16 nt, Salmonella typhimurium LT2
aaucucuggccaggca

SEQ ID NO: 3749036 - RNA, 14 nt, Salmonella typhimurium LT2
aaucugacagauau

SEQ ID NO: 3749037 - RNA, 16 nt, Salmonella typhimurium LT2
aaucugacgaucaacc

SEQ ID NO: 3749038 - RNA, 23 nt, Salmonella typhimurium LT2
aaucugaugauggaacagacgcc

SEQ ID NO: 3749039 - RNA, 15 nt, Salmonella typhimurium LT2
aaucugccaucagca

SEQ ID NO: 3749040 - RNA, 19 nt, Salmonella typhimurium LT2
aaucuggucggugauauau

SEQ ID NO: 3749041 - RNA, 21 nt, Salmonella typhimurium LT2
aaucuggucggugauauauuc

SEQ ID NO: 3749042 - RNA, 19 nt, Salmonella typhimurium LT2
aaucuggugauaaagcaga

SEQ ID NO: 3749043 - RNA, 14 nt, Salmonella typhimurium LT2
aaucugguguaaau

SEQ ID NO: 3749044 - RNA, 19 nt, Salmonella typhimurium LT2
aaucugugugggcacucga

SEQ ID NO: 3749045 - RNA, 15 nt, Salmonella typhimurium LT2
aaucuguucugucca

SEQ ID NO: 3749046 - RNA, 15 nt, Salmonella typhimurium LT2
aaucuuaccuguucc

SEQ ID NO: 3749047 - RNA, 18 nt, Salmonella typhimurium LT2
aaucuucggcaaaauacu

SEQ ID NO: 3749048 - RNA, 23 nt, Salmonella typhimurium LT2
aaucuucuucagcuuguggaaau

SEQ ID NO: 3749049 - RNA, 16 nt, Salmonella typhimurium LT2
aaucuuuccagcucca

SEQ ID NO: 3749050 - RNA, 12 nt, Salmonella typhimurium LT2
aaugaaaucguc

SEQ ID NO: 3749051 - RNA, 22 nt, Salmonella typhimurium LT2
aaugaaaucgucgccaacaccg

SEQ ID NO: 3749052 - RNA, 19 nt, Salmonella typhimurium LT2
aaugaacggaggucaugga

SEQ ID NO: 3749053 - RNA, 15 nt, Salmonella typhimurium LT2
aaugaagcauaaaaa

SEQ ID NO: 3749054 - RNA, 16 nt, Salmonella typhimurium LT2
aaugaagcauaaaaag

SEQ ID NO: 3749055 - RNA, 18 nt, Salmonella typhimurium LT2
aaugaagcauaaaaagac

SEQ ID NO: 3749056 - RNA, 18 nt, Salmonella typhimurium LT2
aaugaagcggaaaggacg

SEQ ID NO: 3749057 - RNA, 21 nt, Salmonella typhimurium LT2
aaugaauaccaagucucaaga

SEQ ID NO: 3749058 - RNA, 15 nt, Salmonella typhimurium LT2
aaugaauagcggcag

SEQ ID NO: 3749059 - RNA, 23 nt, Salmonella typhimurium LT2
aaugacaaacgccaccgcuaccu

SEQ ID NO: 3749060 - RNA, 19 nt, Salmonella typhimurium LT2
aaugacauagugcaagaug

SEQ ID NO: 3749061 - RNA, 13 nt, Salmonella typhimurium LT2
aaugaccucaaga

SEQ ID NO: 3749062 - RNA, 15 nt, Salmonella typhimurium LT2
aaugaccucaagaau

SEQ ID NO: 3749063 - RNA, 19 nt, Salmonella typhimurium LT2
aaugaccugagcgugcaac

SEQ ID NO: 3749064 - RNA, 20 nt, Salmonella typhimurium LT2
aaugacgagcggugcaaaaa

SEQ ID NO: 3749065 - RNA, 13 nt, Salmonella typhimurium LT2
aaugacuguccac

SEQ ID NO: 3749066 - RNA, 16 nt, Salmonella typhimurium LT2
aaugacuguccacgac

SEQ ID NO: 3749067 - RNA, 13 nt, Salmonella typhimurium LT2
aaugacuuuuuau

SEQ ID NO: 3749068 - RNA, 14 nt, Salmonella typhimurium LT2
aaugagaaaaggaa

SEQ ID NO: 3749069 - RNA, 17 nt, Salmonella typhimurium LT2
aaugagaaaaggaagaa

SEQ ID NO: 3749070 - RNA, 15 nt, Salmonella typhimurium LT2
aaugagcaucuaccc

SEQ ID NO: 3749071 - RNA, 24 nt, Salmonella typhimurium LT2
aaugagcggaacgcguuccacgau

SEQ ID NO: 3749072 - RNA, 18 nt, Salmonella typhimurium LT2
aaugagcugucgccugcu

SEQ ID NO: 3749073 - RNA, 17 nt, Salmonella typhimurium LT2
aaugaguacggaacaaa

SEQ ID NO: 3749074 - RNA, 15 nt, Salmonella typhimurium LT2
aaugauaaugccgcu

SEQ ID NO: 3749075 - RNA, 17 nt, Salmonella typhimurium LT2
aaugauaucgcgccagg

SEQ ID NO: 3749076 - RNA, 19 nt, Salmonella typhimurium LT2
aaugaucagaacucacaua

SEQ ID NO: 3749077 - RNA, 19 nt, Salmonella typhimurium LT2
aaugaucagcaaaauagug

SEQ ID NO: 3749078 - RNA, 19 nt, Salmonella typhimurium LT2
aaugauccggacgauagcc

SEQ ID NO: 3749079 - RNA, 21 nt, Salmonella typhimurium LT2
aaugaucguaugcagccaggc

SEQ ID NO: 3749080 - RNA, 22 nt, Salmonella typhimurium LT2
aaugauggcgagaguuugugau

SEQ ID NO: 3749081 - RNA, 19 nt, Salmonella typhimurium LT2
aaugauggggucacagguu

SEQ ID NO: 3749082 - RNA, 15 nt, Salmonella typhimurium LT2
aaugauguccacacu

SEQ ID NO: 3749083 - RNA, 14 nt, Salmonella typhimurium LT2
aaugauuaucuuuu

SEQ ID NO: 3749084 - RNA, 16 nt, Salmonella typhimurium LT2
aaugcaaagaaaaaca

SEQ ID NO: 3749085 - RNA, 19 nt, Salmonella typhimurium LT2
aaugcaaauuauuuuaugu

SEQ ID NO: 3749086 - RNA, 12 nt, Salmonella typhimurium LT2
aaugcaaugucu

SEQ ID NO: 3749087 - RNA, 19 nt, Salmonella typhimurium LT2
aaugcauagccccagcgca

SEQ ID NO: 3749088 - RNA, 20 nt, Salmonella typhimurium LT2
aaugcaucucguaaaucaau

SEQ ID NO: 3749089 - RNA, 18 nt, Salmonella typhimurium LT2
aaugcauggcagauaaac

SEQ ID NO: 3749090 - RNA, 19 nt, Salmonella typhimurium LT2
aaugcauggcagauaaacc

SEQ ID NO: 3749091 - RNA, 23 nt, Salmonella typhimurium LT2
aaugcauuggccagcguggauga

SEQ ID NO: 3749092 - RNA, 16 nt, Salmonella typhimurium LT2
aaugccaccagcgcca

SEQ ID NO: 3749093 - RNA, 19 nt, Salmonella typhimurium LT2
aaugccauaauuuauccuc

SEQ ID NO: 3749094 - RNA, 23 nt, Salmonella typhimurium LT2
aaugccauacuuuuccagcgccu

SEQ ID NO: 3749095 - RNA, 22 nt, Salmonella typhimurium LT2
aaugccauauacauauggauga

SEQ ID NO: 3749096 - RNA, 20 nt, Salmonella typhimurium LT2
aaugcccagcucaucgaacc

SEQ ID NO: 3749097 - RNA, 24 nt, Salmonella typhimurium LT2
aaugccccagguuauagaccuguu

SEQ ID NO: 3749098 - RNA, 12 nt, Salmonella typhimurium LT2
aaugcccggcgc

SEQ ID NO: 3749099 - RNA, 18 nt, Salmonella typhimurium LT2
aaugcccucaacgcccug

SEQ ID NO: 3749100 - RNA, 20 nt, Salmonella typhimurium LT2
aaugcccuuaaauccggccu

SEQ ID NO: 3749101 - RNA, 23 nt, Salmonella typhimurium LT2
aaugcccuuaaauccggccucca

SEQ ID NO: 3749102 - RNA, 23 nt, Salmonella typhimurium LT2
aaugccgauagucuccgccaccu

SEQ ID NO: 3749103 - RNA, 19 nt, Salmonella typhimurium LT2
aaugccgaucaccagcgca

SEQ ID NO: 3749104 - RNA, 18 nt, Salmonella typhimurium LT2
aaugccgcccaggauaca

SEQ ID NO: 3749105 - RNA, 21 nt, Salmonella typhimurium LT2
aaugccgcccauccagagcag

SEQ ID NO: 3749106 - RNA, 20 nt, Salmonella typhimurium LT2
aaugccgcgagaaauaccaa

SEQ ID NO: 3749107 - RNA, 17 nt, Salmonella typhimurium LT2
aaugccguuaccguuca

SEQ ID NO: 3749108 - RNA, 23 nt, Salmonella typhimurium LT2
aaugccguuaccguucaggcaaa

SEQ ID NO: 3749109 - RNA, 22 nt, Salmonella typhimurium LT2
aaugccguucgcgacaaagcuc

SEQ ID NO: 3749110 - RNA, 19 nt, Salmonella typhimurium LT2
aaugccucauuaaaaaaac

SEQ ID NO: 3749111 - RNA, 20 nt, Salmonella typhimurium LT2
aaugccucuuguuucaccuc

SEQ ID NO: 3749112 - RNA, 22 nt, Salmonella typhimurium LT2
aaugccugacgccaccacgccg

SEQ ID NO: 3749113 - RNA, 20 nt, Salmonella typhimurium LT2
aaugccuggagccagccuga

SEQ ID NO: 3749114 - RNA, 24 nt, Salmonella typhimurium LT2
aaugccuuauccggccugcaggca

SEQ ID NO: 3749115 - RNA, 13 nt, Salmonella typhimurium LT2
aaugcgaaaaacg

SEQ ID NO: 3749116 - RNA, 20 nt, Salmonella typhimurium LT2
aaugcgaaaauacucccggc

SEQ ID NO: 3749117 - RNA, 19 nt, Salmonella typhimurium LT2
aauucgcguucagaaaugu

SEQ ID NO: 3749118 - RNA, 17 nt, Salmonella typhimurium LT2
aauucggcgaauguuuu

SEQ ID NO: 3749119 - RNA, 14 nt, Salmonella typhimurium LT2
aauucguccacacg

SEQ ID NO: 3749120 - RNA, 16 nt, Salmonella typhimurium LT2
aauucguccagaugac

SEQ ID NO: 3749121 - RNA, 17 nt, Salmonella typhimurium LT2
aauucguuaccugcgca

SEQ ID NO: 3749122 - RNA, 15 nt, Salmonella typhimurium LT2
aauucuaugccaagc

SEQ ID NO: 3749123 - RNA, 21 nt, Salmonella typhimurium LT2
aauucucagaaacaacacaaa

SEQ ID NO: 3749124 - RNA, 21 nt, Salmonella typhimurium LT2
aauucucccaaauuuuuuuag

SEQ ID NO: 3749125 - RNA, 18 nt, Salmonella typhimurium LT2
aauucucccugccaggcc

SEQ ID NO: 3749126 - RNA, 14 nt, Salmonella typhimurium LT2
aauucugcaggcca

SEQ ID NO: 3749127 - RNA, 17 nt, Salmonella typhimurium LT2
aauucuucgaaugucuc

SEQ ID NO: 3749128 - RNA, 20 nt, Salmonella typhimurium LT2
aauucuucguaggcaacaau

SEQ ID NO: 3749129 - RNA, 20 nt, Salmonella typhimurium LT2
aauucuugcccgcugagugg

SEQ ID NO: 3749130 - RNA, 23 nt, Salmonella typhimurium LT2
aauucuuuaauuugugccagcgu

SEQ ID NO: 3749131 - RNA, 23 nt, Salmonella typhimurium LT2
aauugaaauacucuuugaacagc

SEQ ID NO: 3749132 - RNA, 15 nt, Salmonella typhimurium LT2
aauugaagaguuuga

SEQ ID NO: 3749133 - RNA, 14 nt, Salmonella typhimurium LT2
aauugacgcugccu

SEQ ID NO: 3749134 - RNA, 20 nt, Salmonella typhimurium LT2
aauugacgcuugacucugug

SEQ ID NO: 3749135 - RNA, 14 nt, Salmonella typhimurium LT2
aauugacuggauuu

SEQ ID NO: 3749136 - RNA, 20 nt, Salmonella typhimurium LT2
aauugacuggauuuuugacu

SEQ ID NO: 3749137 - RNA, 23 nt, Salmonella typhimurium LT2
aauugacuggauuuuugacuaaa

SEQ ID NO: 3749138 - RNA, 12 nt, Salmonella typhimurium LT2
aauugaggccgu

SEQ ID NO: 3749139 - RNA, 20 nt, Salmonella typhimurium LT2
aauugaguggacaucgccau

SEQ ID NO: 3749140 - RNA, 13 nt, Salmonella typhimurium LT2
aauugccgcccgu

SEQ ID NO: 3749141 - RNA, 16 nt, Salmonella typhimurium LT2
aauugccgucgccgga

SEQ ID NO: 3749142 - RNA, 20 nt, Salmonella typhimurium LT2
aauugccugacgaaaacccg

SEQ ID NO: 3749143 - RNA, 15 nt, Salmonella typhimurium LT2
aauugccugauggcg

SEQ ID NO: 3749144 - RNA, 23 nt, Salmonella typhimurium LT2
aauugcugcccgccgccagccug

SEQ ID NO: 3749145 - RNA, 21 nt, Salmonella typhimurium LT2
aauugguagacgcgcuagcuu

SEQ ID NO: 3749146 - RNA, 14 nt, Salmonella typhimurium LT2
aauugguuauauua

SEQ ID NO: 3749147 - RNA, 18 nt, Salmonella typhimurium LT2
aauugguuauauuacuga

SEQ ID NO: 3749148 - RNA, 17 nt, Salmonella typhimurium LT2
aauuguaauaauuuaaa

SEQ ID NO: 3749149 - RNA, 15 nt, Salmonella typhimurium LT2
aauuuaaaguaaggc

SEQ ID NO: 3749150 - RNA, 23 nt, Salmonella typhimurium LT2
aauuuaaaguaaggcugauuaua

SEQ ID NO: 3749151 - RNA, 19 nt, Salmonella typhimurium LT2
aauuuaauauaugaaccaa

SEQ ID NO: 3749152 - RNA, 20 nt, Salmonella typhimurium LT2
aauuuaauugauaucgcaac

SEQ ID NO: 3749153 - RNA, 23 nt, Salmonella typhimurium LT2
aauuuacccggcgggaaguuguu

SEQ ID NO: 3749154 - RNA, 14 nt, Salmonella typhimurium LT2
aauuuaucaacaaa

SEQ ID NO: 3749155 - RNA, 14 nt, Salmonella typhimurium LT2
aauuuaucagacaa

SEQ ID NO: 3749156 - RNA, 14 nt, Salmonella typhimurium LT2
aauuuauccaguaa

SEQ ID NO: 3749157 - RNA, 21 nt, Salmonella typhimurium LT2
aauuuauccaguaacgcgucc

SEQ ID NO: 3749158 - RNA, 12 nt, Salmonella typhimurium LT2
aauuuaugauuu

SEQ ID NO: 3749159 - RNA, 21 nt, Salmonella typhimurium LT2
aauuucacgcugcaguuuauu

SEQ ID NO: 3749160 - RNA, 20 nt, Salmonella typhimurium LT2
aauuucacugucgccaggcc

SEQ ID NO: 3749161 - RNA, 14 nt, Salmonella typhimurium LT2
aauuuccccaguua

SEQ ID NO: 3749162 - RNA, 20 nt, Salmonella typhimurium LT2
aauuucccccacuucugaca

SEQ ID NO: 3749163 - RNA, 22 nt, Salmonella typhimurium LT2
aauuuccccugcgaacagcgcu

SEQ ID NO: 3749164 - RNA, 22 nt, Salmonella typhimurium LT2
aauuuccgcacgcgcgcccaug

SEQ ID NO: 3749165 - RNA, 15 nt, Salmonella typhimurium LT2
aauuuccgcagccag

SEQ ID NO: 3749166 - RNA, 23 nt, Salmonella typhimurium LT2
aauuuccucuugucaggcagaaa

SEQ ID NO: 3749167 - RNA, 18 nt, Salmonella typhimurium LT2
aauuucguuuuacccaua

SEQ ID NO: 3749168 - RNA, 15 nt, Salmonella typhimurium LT2
aauuucuacugauuu

SEQ ID NO: 3749169 - RNA, 14 nt, Salmonella typhimurium LT2
aauuucucgcccgc

SEQ ID NO: 3749170 - RNA, 17 nt, Salmonella typhimurium LT2
aauuucuuccauuagcu

SEQ ID NO: 3749171 - RNA, 16 nt, Salmonella typhimurium LT2
aauuucuugaucaauc

SEQ ID NO: 3749172 - RNA, 17 nt, Salmonella typhimurium LT2
aauuugucgauaagcau

SEQ ID NO: 3749173 - RNA, 21 nt, Salmonella typhimurium LT2
aauuugugaucgucgcugcgu

SEQ ID NO: 3749174 - RNA, 21 nt, Salmonella typhimurium LT2
aauuuuacuuucauuccuuua

SEQ ID NO: 3749175 - RNA, 15 nt, Salmonella typhimurium LT2
aauuuucauuauaaa

SEQ ID NO: 3749176 - RNA, 17 nt, Salmonella typhimurium LT2
aauuuugauaaaaacac

SEQ ID NO: 3749177 - RNA, 15 nt, Salmonella typhimurium LT2
aauuuugcauaaaua

SEQ ID NO: 3749178 - RNA, 12 nt, Salmonella typhimurium LT2
aauuuuuccagc

SEQ ID NO: 3749179 - RNA, 12 nt, Salmonella typhimurium LT2
aauuuuuccagu

SEQ ID NO: 3749180 - RNA, 13 nt, Salmonella typhimurium LT2
aauuuuuccuuca

SEQ ID NO: 3749181 - RNA, 18 nt, Salmonella typhimurium LT2
acaaaaaaacggccucaa

SEQ ID NO: 3749182 - RNA, 15 nt, Salmonella typhimurium LT2
acaaaaaaaucccaa

SEQ ID NO: 3749183 - RNA, 21 nt, Salmonella typhimurium LT2
acaaaaagcgcgccgaaaaua

SEQ ID NO: 3749184 - RNA, 13 nt, Salmonella typhimurium LT2
acaaaaaucugaa

SEQ ID NO: 3749185 - RNA, 15 nt, Salmonella typhimurium LT2
acaaaaauuaaaaca

SEQ ID NO: 3749186 - RNA, 18 nt, Salmonella typhimurium LT2
acaaaacuaccgcgccag

SEQ ID NO: 3749187 - RNA, 17 nt, Salmonella typhimurium LT2
acaaaagcgguuaagau

SEQ ID NO: 3749188 - RNA, 23 nt, Salmonella typhimurium LT2
acaaaaggcuggaacagauguuu

SEQ ID NO: 3749189 - RNA, 19 nt, Salmonella typhimurium LT2
acaaaauaaagugaaauaa

SEQ ID NO: 3749190 - RNA, 12 nt, Salmonella typhimurium LT2
acaaaauauuac

SEQ ID NO: 3749191 - RNA, 14 nt, Salmonella typhimurium LT2
acaaaaucauugcg

SEQ ID NO: 3749192 - RNA, 16 nt, Salmonella typhimurium LT2
acaaacaccgagccag

SEQ ID NO: 3749193 - RNA, 19 nt, Salmonella typhimurium LT2
acaaacauaagcaaauccu

SEQ ID NO: 3749194 - RNA, 17 nt, Salmonella typhimurium LT2
acaaacauuagcggugc

SEQ ID NO: 3749195 - RNA, 16 nt, Salmonella typhimurium LT2
acaaacgcaccgccaa

SEQ ID NO: 3749196 - RNA, 17 nt, Salmonella typhimurium LT2
acaaacgcuucuauuuc

SEQ ID NO: 3749197 - RNA, 16 nt, Salmonella typhimurium LT2
acaaacuuaauuauua

SEQ ID NO: 3749198 - RNA, 17 nt, Salmonella typhimurium LT2
acaaacuuaauuauuaa

SEQ ID NO: 3749199 - RNA, 16 nt, Salmonella typhimurium LT2
acaaacuucaucgcca

SEQ ID NO: 3749200 - RNA, 11 nt, Salmonella typhimurium LT2
acaaagagcuc

SEQ ID NO: 3749201 - RNA, 16 nt, Salmonella typhimurium LT2
acaaagagcuccccac

SEQ ID NO: 3749202 - RNA, 13 nt, Salmonella typhimurium LT2
acaaagaggcugc

SEQ ID NO: 3749203 - RNA, 20 nt, Salmonella typhimurium LT2
acaaagagugccagaaacau

SEQ ID NO: 3749204 - RNA, 22 nt, Salmonella typhimurium LT2
acaaagccugcuggaaaggccg

SEQ ID NO: 3749205 - RNA, 19 nt, Salmonella typhimurium LT2
acaaagcgguaaaucgcaa

SEQ ID NO: 3749206 - RNA, 21 nt, Salmonella typhimurium LT2
acaaagcguucggccugcugc

SEQ ID NO: 3749207 - RNA, 18 nt, Salmonella typhimurium LT2
acaaaggaucauuggcca

SEQ ID NO: 3749208 - RNA, 19 nt, Salmonella typhimurium LT2
acaaauaaaauaagcaauu

SEQ ID NO: 3749209 - RNA, 14 nt, Salmonella typhimurium LT2
acaaauaaauccau

SEQ ID NO: 3749210 - RNA, 13 nt, Salmonella typhimurium LT2
acaaaucaucagc

SEQ ID NO: 3749211 - RNA, 15 nt, Salmonella typhimurium LT2
acaaaucaucagcau

SEQ ID NO: 3749212 - RNA, 15 nt, Salmonella typhimurium LT2
acaaauccaaucuga

SEQ ID NO: 3749213 - RNA, 21 nt, Salmonella typhimurium LT2
acaaaucggcuccggcaaaau

SEQ ID NO: 3749214 - RNA, 18 nt, Salmonella typhimurium LT2
acaaaugacgucagcaag

SEQ ID NO: 3749215 - RNA, 19 nt, Salmonella typhimurium LT2
acaaauguugauaagguga

SEQ ID NO: 3749216 - RNA, 21 nt, Salmonella typhimurium LT2
acaaauuacacaauaucaaua

SEQ ID NO: 3749217 - RNA, 19 nt, Salmonella typhimurium LT2
acaaauuccggcacaaccu

SEQ ID NO: 3749218 - RNA, 19 nt, Salmonella typhimurium LT2
acaaauuucgagcagaacu

SEQ ID NO: 3749219 - RNA, 13 nt, Salmonella typhimurium LT2
acaacaaaaagau

SEQ ID NO: 3749220 - RNA, 13 nt, Salmonella typhimurium LT2
acaacaagaauau

SEQ ID NO: 3749221 - RNA, 14 nt, Salmonella typhimurium LT2
acaccagcgauaaa

SEQ ID NO: 3749222 - RNA, 15 nt, Salmonella typhimurium LT2
acaccaucccgcucu

SEQ ID NO: 3749223 - RNA, 14 nt, Salmonella typhimurium LT2
acaccauuucacaa

SEQ ID NO: 3749224 - RNA, 15 nt, Salmonella typhimurium LT2
acaccauuucacaaa

SEQ ID NO: 3749225 - RNA, 15 nt, Salmonella typhimurium LT2
acacccagccccccu

SEQ ID NO: 3749226 - RNA, 22 nt, Salmonella typhimurium LT2
acaccccgcgccgcugagaaaa

SEQ ID NO: 3749227 - RNA, 23 nt, Salmonella typhimurium LT2
acaccccgcgccgcugagaaaaa

SEQ ID NO: 3749228 - RNA, 13 nt, Salmonella typhimurium LT2
acaccccuggcuu

SEQ ID NO: 3749229 - RNA, 12 nt, Salmonella typhimurium LT2
acacccugcaga

SEQ ID NO: 3749230 - RNA, 12 nt, Salmonella typhimurium LT2
acacccugcccc

SEQ ID NO: 3749231 - RNA, 16 nt, Salmonella typhimurium LT2
acaccgcauccgcauc

SEQ ID NO: 3749232 - RNA, 13 nt, Salmonella typhimurium LT2
acaccgccagcgu

SEQ ID NO: 3749233 - RNA, 22 nt, Salmonella typhimurium LT2
acaccgccgcgcugaucgccac

SEQ ID NO: 3749234 - RNA, 19 nt, Salmonella typhimurium LT2
acaccggaauucuguucag

SEQ ID NO: 3749235 - RNA, 18 nt, Salmonella typhimurium LT2
acaccggccauugccgcg

SEQ ID NO: 3749236 - RNA, 17 nt, Salmonella typhimurium LT2
acaccggcgccagcucu

SEQ ID NO: 3749237 - RNA, 21 nt, Salmonella typhimurium LT2
acaccguauccggccugcagg

SEQ ID NO: 3749238 - RNA, 17 nt, Salmonella typhimurium LT2
acaccguuauccggcaa

SEQ ID NO: 3749239 - RNA, 15 nt, Salmonella typhimurium LT2
acaccuccaguucag

SEQ ID NO: 3749240 - RNA, 18 nt, Salmonella typhimurium LT2
acaccuccaguucaguua

SEQ ID NO: 3749241 - RNA, 20 nt, Salmonella typhimurium LT2
acaccuguaacgucacauuc

SEQ ID NO: 3749242 - RNA, 12 nt, Salmonella typhimurium LT2
acaccuuacgca

SEQ ID NO: 3749243 - RNA, 19 nt, Salmonella typhimurium LT2
acaccuuauccggccuaca

SEQ ID NO: 3749244 - RNA, 17 nt, Salmonella typhimurium LT2
acaccuuuaucaauaga

SEQ ID NO: 3749245 - RNA, 12 nt, Salmonella typhimurium LT2
acacgauaguga

SEQ ID NO: 3749246 - RNA, 13 nt, Salmonella typhimurium LT2
acacgauggcaaa

SEQ ID NO: 3749247 - RNA, 16 nt, Salmonella typhimurium LT2
acacgcaaaaaagccc

SEQ ID NO: 3749248 - RNA, 17 nt, Salmonella typhimurium LT2
acacgcgaauagccaga

SEQ ID NO: 3749249 - RNA, 18 nt, Salmonella typhimurium LT2
acacgcgcaguacggcgc

SEQ ID NO: 3749250 - RNA, 18 nt, Salmonella typhimurium LT2
acacgcggcgcuacggcg

SEQ ID NO: 3749251 - RNA, 20 nt, Salmonella typhimurium LT2
acacgcugguaaucauuuca

SEQ ID NO: 3749252 - RNA, 19 nt, Salmonella typhimurium LT2
acacgcuuuucagcgccag

SEQ ID NO: 3749253 - RNA, 21 nt, Salmonella typhimurium LT2
acacggcgccaugauccagcg

SEQ ID NO: 3749254 - RNA, 16 nt, Salmonella typhimurium LT2
acacggggcgguaccg

SEQ ID NO: 3749255 - RNA, 20 nt, Salmonella typhimurium LT2
acacggucgccuaauccgcc

SEQ ID NO: 3749256 - RNA, 19 nt, Salmonella typhimurium LT2
acacgguuauaaccggaca

SEQ ID NO: 3749257 - RNA, 19 nt, Salmonella typhimurium LT2
acacguaauucauuacgaa

SEQ ID NO: 3749258 - RNA, 14 nt, Salmonella typhimurium LT2
acacuauuuuucag

SEQ ID NO: 3749259 - RNA, 15 nt, Salmonella typhimurium LT2
acacuccgcgcaugu

SEQ ID NO: 3749260 - RNA, 14 nt, Salmonella typhimurium LT2
acacucuccucccc

SEQ ID NO: 3749261 - RNA, 14 nt, Salmonella typhimurium LT2
acacugacaauaaa

SEQ ID NO: 3749262 - RNA, 15 nt, Salmonella typhimurium LT2
acacugauacggcgu

SEQ ID NO: 3749263 - RNA, 20 nt, Salmonella typhimurium LT2
acacuuaccgaaugccaugu

SEQ ID NO: 3749264 - RNA, 19 nt, Salmonella typhimurium LT2
acacuuaccgacgcguggu

SEQ ID NO: 3749265 - RNA, 14 nt, Salmonella typhimurium LT2
acacuucagccaga

SEQ ID NO: 3749266 - RNA, 21 nt, Salmonella typhimurium LT2
acacuucauccuuuacgcugc

SEQ ID NO: 3749267 - RNA, 18 nt, Salmonella typhimurium LT2
acacuucucaacauugac

SEQ ID NO: 3749268 - RNA, 17 nt, Salmonella typhimurium LT2
acacuugcgcaucgcau

SEQ ID NO: 3749269 - RNA, 14 nt, Salmonella typhimurium LT2
acacuuucaucagc

SEQ ID NO: 3749270 - RNA, 14 nt, Salmonella typhimurium LT2
acagaaacuucugc

SEQ ID NO: 3749271 - RNA, 15 nt, Salmonella typhimurium LT2
acagaacagugaguu

SEQ ID NO: 3749272 - RNA, 15 nt, Salmonella typhimurium LT2
acagaacccggcuua

SEQ ID NO: 3749273 - RNA, 13 nt, Salmonella typhimurium LT2
acagaacugauuu

SEQ ID NO: 3749274 - RNA, 13 nt, Salmonella typhimurium LT2
acagaagcgcugg

SEQ ID NO: 3749275 - RNA, 18 nt, Salmonella typhimurium LT2
acagaagcgcugguaaau

SEQ ID NO: 3749276 - RNA, 21 nt, Salmonella typhimurium LT2
acagaaugccguugaccauau

SEQ ID NO: 3749277 - RNA, 13 nt, Salmonella typhimurium LT2
acagacaauacca

SEQ ID NO: 3749278 - RNA, 19 nt, Salmonella typhimurium LT2
acagacaucaucgaacgcc

SEQ ID NO: 3749279 - RNA, 20 nt, Salmonella typhimurium LT2
acagacaucggagauuucau

SEQ ID NO: 3749280 - RNA, 12 nt, Salmonella typhimurium LT2
acagacaucggu

SEQ ID NO: 3749281 - RNA, 14 nt, Salmonella typhimurium LT2
acagaccacagaua

SEQ ID NO: 3749282 - RNA, 22 nt, Salmonella typhimurium LT2
acagacccaguacaaacaaaua

SEQ ID NO: 3749283 - RNA, 14 nt, Salmonella typhimurium LT2
acagaccgccaugc

SEQ ID NO: 3749284 - RNA, 12 nt, Salmonella typhimurium LT2
acagacgcaggc

SEQ ID NO: 3749285 - RNA, 11 nt, Salmonella typhimurium LT2
acagacgcauc

SEQ ID NO: 3749286 - RNA, 23 nt, Salmonella typhimurium LT2
acagacucaccgcuaaucccagc

SEQ ID NO: 3749287 - RNA, 14 nt, Salmonella typhimurium LT2
acagacuucaccca

SEQ ID NO: 3749288 - RNA, 13 nt, Salmonella typhimurium LT2
acagaggaaugaa

SEQ ID NO: 3749289 - RNA, 22 nt, Salmonella typhimurium LT2
acagaguccacagcccggcgca

SEQ ID NO: 3749290 - RNA, 23 nt, Salmonella typhimurium LT2
acagagucgcuuaucugcugcug

SEQ ID NO: 3749291 - RNA, 17 nt, Salmonella typhimurium LT2
acagauaagcaccugca

SEQ ID NO: 3749292 - RNA, 16 nt, Salmonella typhimurium LT2
acagauaagcgucugc

SEQ ID NO: 3749293 - RNA, 17 nt, Salmonella typhimurium LT2
acagauaagcgucugca

SEQ ID NO: 3749294 - RNA, 23 nt, Salmonella typhimurium LT2
acagauagcccugaucccacagc

SEQ ID NO: 3749295 - RNA, 20 nt, Salmonella typhimurium LT2
acagauggcgcuucguuucc

SEQ ID NO: 3749296 - RNA, 22 nt, Salmonella typhimurium LT2
acagauugaugcccucuuccag

SEQ ID NO: 3749297 - RNA, 17 nt, Salmonella typhimurium LT2
acagauuggucagcagc

SEQ ID NO: 3749298 - RNA, 22 nt, Salmonella typhimurium LT2
acagauuuuguacuuuugccag

SEQ ID NO: 3749299 - RNA, 14 nt, Salmonella typhimurium LT2
acagcaacaucuau

SEQ ID NO: 3749300 - RNA, 16 nt, Salmonella typhimurium LT2
acagcaauaucagcca

SEQ ID NO: 3749301 - RNA, 13 nt, Salmonella typhimurium LT2
acagcaauguuuc

SEQ ID NO: 3749302 - RNA, 14 nt, Salmonella typhimurium LT2
acagcaccagcagg

SEQ ID NO: 3749303 - RNA, 23 nt, Salmonella typhimurium LT2
acagcacuacggauggcccugcc

SEQ ID NO: 3749304 - RNA, 22 nt, Salmonella typhimurium LT2
acagcagcgcggcacacagcac

SEQ ID NO: 3749305 - RNA, 22 nt, Salmonella typhimurium LT2
acagcagugacauuuaucuucc

SEQ ID NO: 3749306 - RNA, 12 nt, Salmonella typhimurium LT2
acagcauacgcc

SEQ ID NO: 3749307 - RNA, 15 nt, Salmonella typhimurium LT2
acagcaucuaauuaa

SEQ ID NO: 3749308 - RNA, 20 nt, Salmonella typhimurium LT2
acagcaucuaauuaaaaaga

SEQ ID NO: 3749309 - RNA, 17 nt, Salmonella typhimurium LT2
acagcauugaggcuacc

SEQ ID NO: 3749310 - RNA, 18 nt, Salmonella typhimurium LT2
acagccaaaaauaacgcc

SEQ ID NO: 3749311 - RNA, 22 nt, Salmonella typhimurium LT2
acagccaaacugcuguagcugu

SEQ ID NO: 3749312 - RNA, 22 nt, Salmonella typhimurium LT2
acagccaggcuuucccuucaga

SEQ ID NO: 3749313 - RNA, 13 nt, Salmonella typhimurium LT2
acagccaguaaug

SEQ ID NO: 3749314 - RNA, 19 nt, Salmonella typhimurium LT2
acagccauaaugcugccag

SEQ ID NO: 3749315 - RNA, 19 nt, Salmonella typhimurium LT2
acagccauaccggcgcgcg

SEQ ID NO: 3749316 - RNA, 18 nt, Salmonella typhimurium LT2
acagcccaguaauauccc

SEQ ID NO: 3749317 - RNA, 16 nt, Salmonella typhimurium LT2
acagcccauaccagcg

SEQ ID NO: 3749318 - RNA, 18 nt, Salmonella typhimurium LT2
acagcccgccagcaccag

SEQ ID NO: 3749319 - RNA, 21 nt, Salmonella typhimurium LT2
acagcccuauaacagcgccag

SEQ ID NO: 3749320 - RNA, 16 nt, Salmonella typhimurium LT2
acagcccuuucaggaa

SEQ ID NO: 3749321 - RNA, 17 nt, Salmonella typhimurium LT2
acagccugucgccguca

SEQ ID NO: 3749322 - RNA, 15 nt, Salmonella typhimurium LT2
acagcgaccacgcca

SEQ ID NO: 3749323 - RNA, 18 nt, Salmonella typhimurium LT2
acagcgagcuauccggca

SEQ ID NO: 3749324 - RNA, 13 nt, Salmonella typhimurium LT2
acagcgaucacgc

SEQ ID NO: 3749325 - RNA, 20 nt, Salmonella typhimurium LT2
acauccgccaccuuaugcuc

SEQ ID NO: 3749326 - RNA, 20 nt, Salmonella typhimurium LT2
acauccggcaggcauuuuac

SEQ ID NO: 3749327 - RNA, 15 nt, Salmonella typhimurium LT2
acauccggcggcguc

SEQ ID NO: 3749328 - RNA, 17 nt, Salmonella typhimurium LT2
acauccugugaaguaaa

SEQ ID NO: 3749329 - RNA, 18 nt, Salmonella typhimurium LT2
acauccugugaaguaaaa

SEQ ID NO: 3749330 - RNA, 20 nt, Salmonella typhimurium LT2
acauccugugaaguaaaaaa

SEQ ID NO: 3749331 - RNA, 18 nt, Salmonella typhimurium LT2
acaucgcacgccuuuaag

SEQ ID NO: 3749332 - RNA, 16 nt, Salmonella typhimurium LT2
acaucgccgugaucga

SEQ ID NO: 3749333 - RNA, 16 nt, Salmonella typhimurium LT2
acaucgcucaaaacac

SEQ ID NO: 3749334 - RNA, 17 nt, Salmonella typhimurium LT2
acaucgcucaaaacacu

SEQ ID NO: 3749335 - RNA, 22 nt, Salmonella typhimurium LT2
acaucgcucgcgccacgcagau

SEQ ID NO: 3749336 - RNA, 14 nt, Salmonella typhimurium LT2
acaucgcuuuccag

SEQ ID NO: 3749337 - RNA, 21 nt, Salmonella typhimurium LT2
acaucggagauuucauccucu

SEQ ID NO: 3749338 - RNA, 21 nt, Salmonella typhimurium LT2
acaucggcuacgcucacgcgc

SEQ ID NO: 3749339 - RNA, 14 nt, Salmonella typhimurium LT2
acaucgguuaucgg

SEQ ID NO: 3749340 - RNA, 15 nt, Salmonella typhimurium LT2
acaucguaaaucaaa

SEQ ID NO: 3749341 - RNA, 22 nt, Salmonella typhimurium LT2
acaucguaaaucaaaugagaau

SEQ ID NO: 3749342 - RNA, 16 nt, Salmonella typhimurium LT2
acaucguuggccgcca

SEQ ID NO: 3749343 - RNA, 14 nt, Salmonella typhimurium LT2
acaucuaccagguu

SEQ ID NO: 3749344 - RNA, 22 nt, Salmonella typhimurium LT2
acaucugccgcuuugaggauca

SEQ ID NO: 3749345 - RNA, 16 nt, Salmonella typhimurium LT2
acaucugugaaaacgc

SEQ ID NO: 3749346 - RNA, 18 nt, Salmonella typhimurium LT2
acaucuuauuucaccgga

SEQ ID NO: 3749347 - RNA, 15 nt, Salmonella typhimurium LT2
acaucuuccaugccu

SEQ ID NO: 3749348 - RNA, 14 nt, Salmonella typhimurium LT2
acaugaaagggaaa

SEQ ID NO: 3749349 - RNA, 14 nt, Salmonella typhimurium LT2
acaugaacucgacu

SEQ ID NO: 3749350 - RNA, 19 nt, Salmonella typhimurium LT2
acaugaccgcacagcagac

SEQ ID NO: 3749351 - RNA, 15 nt, Salmonella typhimurium LT2
acaugagauaaugcu

SEQ ID NO: 3749352 - RNA, 21 nt, Salmonella typhimurium LT2
acaugccggugcgagaaaaag

SEQ ID NO: 3749353 - RNA, 21 nt, Salmonella typhimurium LT2
acaugcuccgccccgccuucc

SEQ ID NO: 3749354 - RNA, 23 nt, Salmonella typhimurium LT2
acaugguggagucuaaaaauaau

SEQ ID NO: 3749355 - RNA, 13 nt, Salmonella typhimurium LT2
acauuacauccuc

SEQ ID NO: 3749356 - RNA, 21 nt, Salmonella typhimurium LT2
acauuacgcccauuaugccgc

SEQ ID NO: 3749357 - RNA, 17 nt, Salmonella typhimurium LT2
acauuacuuccggcgau

SEQ ID NO: 3749358 - RNA, 19 nt, Salmonella typhimurium LT2
acauuauaggugucagauc

SEQ ID NO: 3749359 - RNA, 15 nt, Salmonella typhimurium LT2
acauuauugucuuug

SEQ ID NO: 3749360 - RNA, 20 nt, Salmonella typhimurium LT2
acauucaaaccuucaagaau

SEQ ID NO: 3749361 - RNA, 13 nt, Salmonella typhimurium LT2
acauucagcacau

SEQ ID NO: 3749362 - RNA, 21 nt, Salmonella typhimurium LT2
acauucaggcuggcaaagcag

SEQ ID NO: 3749363 - RNA, 22 nt, Salmonella typhimurium LT2
acauucauaaaagaucauuccc

SEQ ID NO: 3749364 - RNA, 21 nt, Salmonella typhimurium LT2
acauucccgccgagaaaauac

SEQ ID NO: 3749365 - RNA, 20 nt, Salmonella typhimurium LT2
acauucgucugccgggaaca

SEQ ID NO: 3749366 - RNA, 21 nt, Salmonella typhimurium LT2
acauugaagguauccagccag

SEQ ID NO: 3749367 - RNA, 22 nt, Salmonella typhimurium LT2
acauugaagguauccagccagg

SEQ ID NO: 3749368 - RNA, 15 nt, Salmonella typhimurium LT2
acauugaccagugca

SEQ ID NO: 3749369 - RNA, 14 nt, Salmonella typhimurium LT2
acauugaguaaaua

SEQ ID NO: 3749370 - RNA, 11 nt, Salmonella typhimurium LT2
acauugcgaac

SEQ ID NO: 3749371 - RNA, 20 nt, Salmonella typhimurium LT2
acauugcgccgcacuucacg

SEQ ID NO: 3749372 - RNA, 17 nt, Salmonella typhimurium LT2
acauugcgcggcgaacu

SEQ ID NO: 3749373 - RNA, 18 nt, Salmonella typhimurium LT2
acauugcucauaccgccg

SEQ ID NO: 3749374 - RNA, 18 nt, Salmonella typhimurium LT2
acauugcuguggaaaauc

SEQ ID NO: 3749375 - RNA, 20 nt, Salmonella typhimurium LT2
acauugguuaucaaaaaccu

SEQ ID NO: 3749376 - RNA, 21 nt, Salmonella typhimurium LT2
acauugguuaucaaaaaccuu

SEQ ID NO: 3749377 - RNA, 19 nt, Salmonella typhimurium LT2
acauuucaggcaaaaaaaa

SEQ ID NO: 3749378 - RNA, 16 nt, Salmonella typhimurium LT2
acauuucgugcagucc

SEQ ID NO: 3749379 - RNA, 22 nt, Salmonella typhimurium LT2
acauuucgugcaguccuguagg

SEQ ID NO: 3749380 - RNA, 12 nt, Salmonella typhimurium LT2
acauuucuuuug

SEQ ID NO: 3749381 - RNA, 23 nt, Salmonella typhimurium LT2
acauuugauuccagccuugcuga

SEQ ID NO: 3749382 - RNA, 18 nt, Salmonella typhimurium LT2
acauuugcgcacggcgcg

SEQ ID NO: 3749383 - RNA, 13 nt, Salmonella typhimurium LT2
acauuuuuguaau

SEQ ID NO: 3749384 - RNA, 21 nt, Salmonella typhimurium LT2
acauuuuuuuugcaugauagu

SEQ ID NO: 3749385 - RNA, 20 nt, Salmonella typhimurium LT2
accaaaaacgcccccagaua

SEQ ID NO: 3749386 - RNA, 12 nt, Salmonella typhimurium LT2
accaaaagcauu

SEQ ID NO: 3749387 - RNA, 14 nt, Salmonella typhimurium LT2
accaaacacgaggc

SEQ ID NO: 3749388 - RNA, 21 nt, Salmonella typhimurium LT2
accaaacagcaauuccgccau

SEQ ID NO: 3749389 - RNA, 12 nt, Salmonella typhimurium LT2
accaaagcccgc

SEQ ID NO: 3749390 - RNA, 15 nt, Salmonella typhimurium LT2
accaaaucaauagaa

SEQ ID NO: 3749391 - RNA, 19 nt, Salmonella typhimurium LT2
accaaaucaucaaucgcuu

SEQ ID NO: 3749392 - RNA, 18 nt, Salmonella typhimurium LT2
accaaaucucaagaguga

SEQ ID NO: 3749393 - RNA, 17 nt, Salmonella typhimurium LT2
accaacaagaagggagg

SEQ ID NO: 3749394 - RNA, 18 nt, Salmonella typhimurium LT2
accaacaagaagggaggu

SEQ ID NO: 3749395 - RNA, 17 nt, Salmonella typhimurium LT2
accaaccgugagcgcgc

SEQ ID NO: 3749396 - RNA, 15 nt, Salmonella typhimurium LT2
accaacgacccccac

SEQ ID NO: 3749397 - RNA, 16 nt, Salmonella typhimurium LT2
accaacgcccaacugu

SEQ ID NO: 3749398 - RNA, 20 nt, Salmonella typhimurium LT2
accaacggucgugcgagaua

SEQ ID NO: 3749399 - RNA, 22 nt, Salmonella typhimurium LT2
accaacgucgugccagugaugc

SEQ ID NO: 3749400 - RNA, 13 nt, Salmonella typhimurium LT2
accaacugccaaa

SEQ ID NO: 3749401 - RNA, 16 nt, Salmonella typhimurium LT2
accaacugccaaacca

SEQ ID NO: 3749402 - RNA, 13 nt, Salmonella typhimurium LT2
accaacugcugcg

SEQ ID NO: 3749403 - RNA, 16 nt, Salmonella typhimurium LT2
accaagucucaagagu

SEQ ID NO: 3749404 - RNA, 14 nt, Salmonella typhimurium LT2
accaauaagaacuu

SEQ ID NO: 3749405 - RNA, 12 nt, Salmonella typhimurium LT2
accaauaaugca

SEQ ID NO: 3749406 - RNA, 17 nt, Salmonella typhimurium LT2
accaauaaugcaggcua

SEQ ID NO: 3749407 - RNA, 14 nt, Salmonella typhimurium LT2
accaauaucgccgu

SEQ ID NO: 3749408 - RNA, 12 nt, Salmonella typhimurium LT2
accaaucaucac

SEQ ID NO: 3749409 - RNA, 15 nt, Salmonella typhimurium LT2
accaaugugcaaaga

SEQ ID NO: 3749410 - RNA, 16 nt, Salmonella typhimurium LT2
accacaaacgccguca

SEQ ID NO: 3749411 - RNA, 18 nt, Salmonella typhimurium LT2
accacaaagagugccaga

SEQ ID NO: 3749412 - RNA, 18 nt, Salmonella typhimurium LT2
accacaaagcgguaaauc

SEQ ID NO: 3749413 - RNA, 22 nt, Salmonella typhimurium LT2
accacaaagcgguaaaucgcaa

SEQ ID NO: 3749414 - RNA, 15 nt, Salmonella typhimurium LT2
accacaaauuuugau

SEQ ID NO: 3749415 - RNA, 21 nt, Salmonella typhimurium LT2
accacaacaagaauauauucu

SEQ ID NO: 3749416 - RNA, 22 nt, Salmonella typhimurium LT2
accacaauaaucgcgagaaaau

SEQ ID NO: 3749417 - RNA, 22 nt, Salmonella typhimurium LT2
accacaccgguucgcggcagau

SEQ ID NO: 3749418 - RNA, 22 nt, Salmonella typhimurium LT2
accacagcggacacccgcagcc

SEQ ID NO: 3749419 - RNA, 16 nt, Salmonella typhimurium LT2
accacaugaccagcgc

SEQ ID NO: 3749420 - RNA, 17 nt, Salmonella typhimurium LT2
accacaugaccagcgcc

SEQ ID NO: 3749421 - RNA, 18 nt, Salmonella typhimurium LT2
accaccauacccaacagc

SEQ ID NO: 3749422 - RNA, 13 nt, Salmonella typhimurium LT2
accaccccacagc

SEQ ID NO: 3749423 - RNA, 16 nt, Salmonella typhimurium LT2
accaccccacagcaau

SEQ ID NO: 3749424 - RNA, 18 nt, Salmonella typhimurium LT2
accacccgcggccagguc

SEQ ID NO: 3749425 - RNA, 14 nt, Salmonella typhimurium LT2
accacccugaaaag

SEQ ID NO: 3749426 - RNA, 14 nt, Salmonella typhimurium LT2
accaccgauaaacg

SEQ ID NO: 3749427 - RNA, 14 nt, Salmonella typhimurium LT2
accaccgcccgcuc

SEQ ID NO: 3749428 - RNA, 20 nt, Salmonella typhimurium LT2
accaccggcgcgccagcgca

SEQ ID NO: 3749429 - RNA, 23 nt, Salmonella typhimurium LT2
accagggcgucccgucccaccac

SEQ ID NO: 3749430 - RNA, 22 nt, Salmonella typhimurium LT2
accaggucuuaccuauuuuaaa

SEQ ID NO: 3749431 - RNA, 13 nt, Salmonella typhimurium LT2
accaguaaccgcc

SEQ ID NO: 3749432 - RNA, 14 nt, Salmonella typhimurium LT2
accaguaaccgcca

SEQ ID NO: 3749433 - RNA, 15 nt, Salmonella typhimurium LT2
accaguaaccgccac

SEQ ID NO: 3749434 - RNA, 15 nt, Salmonella typhimurium LT2
accaguaagagaaca

SEQ ID NO: 3749435 - RNA, 20 nt, Salmonella typhimurium LT2
accaguacccuguauuuuuu

SEQ ID NO: 3749436 - RNA, 22 nt, Salmonella typhimurium LT2
accagugaacgucugcacggca

SEQ ID NO: 3749437 - RNA, 15 nt, Salmonella typhimurium LT2
accagugcaacgccu

SEQ ID NO: 3749438 - RNA, 16 nt, Salmonella typhimurium LT2
accaguuaauuucuuu

SEQ ID NO: 3749439 - RNA, 21 nt, Salmonella typhimurium LT2
accaguucacuccuaagagaa

SEQ ID NO: 3749440 - RNA, 16 nt, Salmonella typhimurium LT2
accaguuccccauacu

SEQ ID NO: 3749441 - RNA, 18 nt, Salmonella typhimurium LT2
accaguugaccaaacagc

SEQ ID NO: 3749442 - RNA, 13 nt, Salmonella typhimurium LT2
accaguuuauccg

SEQ ID NO: 3749443 - RNA, 14 nt, Salmonella typhimurium LT2
accaguuuauccgc

SEQ ID NO: 3749444 - RNA, 22 nt, Salmonella typhimurium LT2
accauaaacggcaccuggaagu

SEQ ID NO: 3749445 - RNA, 15 nt, Salmonella typhimurium LT2
accauaccaggcgca

SEQ ID NO: 3749446 - RNA, 19 nt, Salmonella typhimurium LT2
accauaccggugcgcccca

SEQ ID NO: 3749447 - RNA, 22 nt, Salmonella typhimurium LT2
accauaccggugcgccccagca

SEQ ID NO: 3749448 - RNA, 16 nt, Salmonella typhimurium LT2
accauacugacuuaau

SEQ ID NO: 3749449 - RNA, 18 nt, Salmonella typhimurium LT2
accauauccaacgcgguu

SEQ ID NO: 3749450 - RNA, 14 nt, Salmonella typhimurium LT2
accauauucacgca

SEQ ID NO: 3749451 - RNA, 21 nt, Salmonella typhimurium LT2
accaucaaauaauacgccggc

SEQ ID NO: 3749452 - RNA, 12 nt, Salmonella typhimurium LT2
accaucagcauc

SEQ ID NO: 3749453 - RNA, 21 nt, Salmonella typhimurium LT2
accaucaggugaguaaauaaa

SEQ ID NO: 3749454 - RNA, 15 nt, Salmonella typhimurium LT2
accauccaugaaaua

SEQ ID NO: 3749455 - RNA, 22 nt, Salmonella typhimurium LT2
accauccauucgguacggcgcu

SEQ ID NO: 3749456 - RNA, 16 nt, Salmonella typhimurium LT2
accauccgcgccgaga

SEQ ID NO: 3749457 - RNA, 21 nt, Salmonella typhimurium LT2
accauccgguuuuaaauuccu

SEQ ID NO: 3749458 - RNA, 13 nt, Salmonella typhimurium LT2
accaucgccggag

SEQ ID NO: 3749459 - RNA, 14 nt, Salmonella typhimurium LT2
accaucgccggaga

SEQ ID NO: 3749460 - RNA, 15 nt, Salmonella typhimurium LT2
accaucgcgcagcca

SEQ ID NO: 3749461 - RNA, 14 nt, Salmonella typhimurium LT2
accaucgcgccgcu

SEQ ID NO: 3749462 - RNA, 15 nt, Salmonella typhimurium LT2
accaucuaaaucaau

SEQ ID NO: 3749463 - RNA, 21 nt, Salmonella typhimurium LT2
accaucuaaaucaaucacuua

SEQ ID NO: 3749464 - RNA, 19 nt, Salmonella typhimurium LT2
accaucuuuuccggcaggg

SEQ ID NO: 3749465 - RNA, 16 nt, Salmonella typhimurium LT2
accaugacgcagugca

SEQ ID NO: 3749466 - RNA, 22 nt, Salmonella typhimurium LT2
accaugacgcagugcaauauua

SEQ ID NO: 3749467 - RNA, 14 nt, Salmonella typhimurium LT2
accaugcaccacac

SEQ ID NO: 3749468 - RNA, 17 nt, Salmonella typhimurium LT2
accaugcaccacaccgg

SEQ ID NO: 3749469 - RNA, 12 nt, Salmonella typhimurium LT2
accaugcccggg

SEQ ID NO: 3749470 - RNA, 14 nt, Salmonella typhimurium LT2
accaugcugguugg

SEQ ID NO: 3749471 - RNA, 19 nt, Salmonella typhimurium LT2
accaugguucccgccacug

SEQ ID NO: 3749472 - RNA, 23 nt, Salmonella typhimurium LT2
accaugucaagguggugcucuaa

SEQ ID NO: 3749473 - RNA, 13 nt, Salmonella typhimurium LT2
accauuaucgcgc

SEQ ID NO: 3749474 - RNA, 21 nt, Salmonella typhimurium LT2
accauucccacgcauaguccu

SEQ ID NO: 3749475 - RNA, 18 nt, Salmonella typhimurium LT2
accauuccgauagcgaaa

SEQ ID NO: 3749476 - RNA, 17 nt, Salmonella typhimurium LT2
accauugcguauuucac

SEQ ID NO: 3749477 - RNA, 18 nt, Salmonella typhimurium LT2
accauugcguauuucacc

SEQ ID NO: 3749478 - RNA, 16 nt, Salmonella typhimurium LT2
accauugcuaaaaaua

SEQ ID NO: 3749479 - RNA, 23 nt, Salmonella typhimurium LT2
accauuggcgcgucaucaauauc

SEQ ID NO: 3749480 - RNA, 17 nt, Salmonella typhimurium LT2
accauuggcgcuggggu

SEQ ID NO: 3749481 - RNA, 14 nt, Salmonella typhimurium LT2
accauuuccggauc

SEQ ID NO: 3749482 - RNA, 10 nt, Salmonella typhimurium LT2
acccaaaaau

SEQ ID NO: 3749483 - RNA, 15 nt, Salmonella typhimurium LT2
acccaacgcaaugcg

SEQ ID NO: 3749484 - RNA, 13 nt, Salmonella typhimurium LT2
acccacacauaga

SEQ ID NO: 3749485 - RNA, 17 nt, Salmonella typhimurium LT2
acccacaccacagccac

SEQ ID NO: 3749486 - RNA, 17 nt, Salmonella typhimurium LT2
acccacaucagcggcac

SEQ ID NO: 3749487 - RNA, 13 nt, Salmonella typhimurium LT2
acccaccagcagg

SEQ ID NO: 3749488 - RNA, 22 nt, Salmonella typhimurium LT2
acccacccccuuacuaagccag

SEQ ID NO: 3749489 - RNA, 16 nt, Salmonella typhimurium LT2
acccacgccggaaauc

SEQ ID NO: 3749490 - RNA, 15 nt, Salmonella typhimurium LT2
acccacgucaguaag

SEQ ID NO: 3749491 - RNA, 14 nt, Salmonella typhimurium LT2
acccacgucauccg

SEQ ID NO: 3749492 - RNA, 20 nt, Salmonella typhimurium LT2
acccacuaacugccgcugac

SEQ ID NO: 3749493 - RNA, 21 nt, Salmonella typhimurium LT2
acccacuaacugccgcugacc

SEQ ID NO: 3749494 - RNA, 15 nt, Salmonella typhimurium LT2
acccacuucuuccag

SEQ ID NO: 3749495 - RNA, 16 nt, Salmonella typhimurium LT2
acccacuuugcuuuuc

SEQ ID NO: 3749496 - RNA, 18 nt, Salmonella typhimurium LT2
acccacuuugcuuuucug

SEQ ID NO: 3749497 - RNA, 15 nt, Salmonella typhimurium LT2
acccagaaucagcaa

SEQ ID NO: 3749498 - RNA, 22 nt, Salmonella typhimurium LT2
acccagaaucagcaacacaauc

SEQ ID NO: 3749499 - RNA, 19 nt, Salmonella typhimurium LT2
acccagacugugauggcgg

SEQ ID NO: 3749500 - RNA, 22 nt, Salmonella typhimurium LT2
acccagaugcgaaucuucaucg

SEQ ID NO: 3749501 - RNA, 12 nt, Salmonella typhimurium LT2
acccagcccaau

SEQ ID NO: 3749502 - RNA, 22 nt, Salmonella typhimurium LT2
acccagcccaauacgccagccu

SEQ ID NO: 3749503 - RNA, 14 nt, Salmonella typhimurium LT2
acccagccccccua

SEQ ID NO: 3749504 - RNA, 15 nt, Salmonella typhimurium LT2
acccagcgcaugagc

SEQ ID NO: 3749505 - RNA, 14 nt, Salmonella typhimurium LT2
acccagcgcgacau

SEQ ID NO: 3749506 - RNA, 17 nt, Salmonella typhimurium LT2
acccagcgcgacauggc

SEQ ID NO: 3749507 - RNA, 20 nt, Salmonella typhimurium LT2
acccaggauggcggccaaau

SEQ ID NO: 3749508 - RNA, 15 nt, Salmonella typhimurium LT2
acccaggccaucaga

SEQ ID NO: 3749509 - RNA, 15 nt, Salmonella typhimurium LT2
acccaggucgccgau

SEQ ID NO: 3749510 - RNA, 19 nt, Salmonella typhimurium LT2
acccauaacgggaagccgu

SEQ ID NO: 3749511 - RNA, 15 nt, Salmonella typhimurium LT2
accccacccgcugau

SEQ ID NO: 3749512 - RNA, 23 nt, Salmonella typhimurium LT2
accccacccgcugauaaaauucc

SEQ ID NO: 3749513 - RNA, 12 nt, Salmonella typhimurium LT2
accccagcaucu

SEQ ID NO: 3749514 - RNA, 22 nt, Salmonella typhimurium LT2
accccaggcgauaccgcgcugg

SEQ ID NO: 3749515 - RNA, 15 nt, Salmonella typhimurium LT2
accccaguagcccug

SEQ ID NO: 3749516 - RNA, 11 nt, Salmonella typhimurium LT2
accccaucccg

SEQ ID NO: 3749517 - RNA, 15 nt, Salmonella typhimurium LT2
accccaucccggcaa

SEQ ID NO: 3749518 - RNA, 22 nt, Salmonella typhimurium LT2
acccccaccaugucaagguggu

SEQ ID NO: 3749519 - RNA, 11 nt, Salmonella typhimurium LT2
acccccagcca

SEQ ID NO: 3749520 - RNA, 12 nt, Salmonella typhimurium LT2
acccccagccau

SEQ ID NO: 3749521 - RNA, 19 nt, Salmonella typhimurium LT2
acccccagcugacuggcag

SEQ ID NO: 3749522 - RNA, 12 nt, Salmonella typhimurium LT2
acccccucagca

SEQ ID NO: 3749523 - RNA, 13 nt, Salmonella typhimurium LT2
acccccuggccgg

SEQ ID NO: 3749524 - RNA, 19 nt, Salmonella typhimurium LT2
acccccuuacuaagccagu

SEQ ID NO: 3749525 - RNA, 20 nt, Salmonella typhimurium LT2
accccgauaaaccaggcagc

SEQ ID NO: 3749526 - RNA, 21 nt, Salmonella typhimurium LT2
accccgcagcgaaaauccagu

SEQ ID NO: 3749527 - RNA, 17 nt, Salmonella typhimurium LT2
accccgcaucgcccgcc

SEQ ID NO: 3749528 - RNA, 20 nt, Salmonella typhimurium LT2
accccgcaucgcccgccccc

SEQ ID NO: 3749529 - RNA, 16 nt, Salmonella typhimurium LT2
accccgccaucagaca

SEQ ID NO: 3749530 - RNA, 13 nt, Salmonella typhimurium LT2
accccgccugacg

SEQ ID NO: 3749531 - RNA, 22 nt, Salmonella typhimurium LT2
accccgcgccguucggaguuga

SEQ ID NO: 3749532 - RNA, 22 nt, Salmonella typhimurium LT2
accccggcauauggauauucau

SEQ ID NO: 3749533 - RNA, 15 nt, Salmonella typhimurium LT2
accccggcgcgggca

SEQ ID NO: 3749534 - RNA, 13 nt, Salmonella typhimurium LT2
accccugacgggc

SEQ ID NO: 3749535 - RNA, 21 nt, Salmonella typhimurium LT2
accccugacgggcgauagcuc

SEQ ID NO: 3749536 - RNA, 23 nt, Salmonella typhimurium LT2
accccuggcuuugcaacagggcu

SEQ ID NO: 3749537 - RNA, 17 nt, Salmonella typhimurium LT2
accccuucgccuucgcc

SEQ ID NO: 3749538 - RNA, 20 nt, Salmonella typhimurium LT2
accccuucuggagaauaucc

SEQ ID NO: 3749539 - RNA, 16 nt, Salmonella typhimurium LT2
accccuuuagcggcau

SEQ ID NO: 3749540 - RNA, 17 nt, Salmonella typhimurium LT2
acccgaaagucaaaaua

SEQ ID NO: 3749541 - RNA, 21 nt, Salmonella typhimurium LT2
acccgaacaacaauacgcguc

SEQ ID NO: 3749542 - RNA, 22 nt, Salmonella typhimurium LT2
acccgacagcggcgcagacacu

SEQ ID NO: 3749543 - RNA, 16 nt, Salmonella typhimurium LT2
acccgaccgucuuugu

SEQ ID NO: 3749544 - RNA, 15 nt, Salmonella typhimurium LT2
acccgacugccacca

SEQ ID NO: 3749545 - RNA, 21 nt, Salmonella typhimurium LT2
acccgacugccaccacgcggc

SEQ ID NO: 3749546 - RNA, 15 nt, Salmonella typhimurium LT2
acccgauaccgccag

SEQ ID NO: 3749547 - RNA, 21 nt, Salmonella typhimurium LT2
acccgaucgccauccugcacc

SEQ ID NO: 3749548 - RNA, 13 nt, Salmonella typhimurium LT2
acccgaucgcccu

SEQ ID NO: 3749549 - RNA, 12 nt, Salmonella typhimurium LT2
acccgaugcgag

SEQ ID NO: 3749550 - RNA, 20 nt, Salmonella typhimurium LT2
acccgaugcgaguagcaaau

SEQ ID NO: 3749551 - RNA, 18 nt, Salmonella typhimurium LT2
acccgcaauaacgccgau

SEQ ID NO: 3749552 - RNA, 19 nt, Salmonella typhimurium LT2
acccgcacccgaaagucaa

SEQ ID NO: 3749553 - RNA, 15 nt, Salmonella typhimurium LT2
acccgcagcggaaga

SEQ ID NO: 3749554 - RNA, 19 nt, Salmonella typhimurium LT2
acccgcaguagcuaaugau

SEQ ID NO: 3749555 - RNA, 14 nt, Salmonella typhimurium LT2
acccgccgauaaac

SEQ ID NO: 3749556 - RNA, 14 nt, Salmonella typhimurium LT2
acccgccugcgccu

SEQ ID NO: 3749557 - RNA, 16 nt, Salmonella typhimurium LT2
acccgcgcauggccau

SEQ ID NO: 3749558 - RNA, 16 nt, Salmonella typhimurium LT2
acccgcgcucagcguc

SEQ ID NO: 3749559 - RNA, 16 nt, Salmonella typhimurium LT2
acccgcuccagaagca

SEQ ID NO: 3749560 - RNA, 15 nt, Salmonella typhimurium LT2
acccgcucggcauac

SEQ ID NO: 3749561 - RNA, 14 nt, Salmonella typhimurium LT2
acccgcuuaacgau

SEQ ID NO: 3749562 - RNA, 22 nt, Salmonella typhimurium LT2
acccgcuuacaguuuaucugcg

SEQ ID NO: 3749563 - RNA, 15 nt, Salmonella typhimurium LT2
acccgcuuccaguuu

SEQ ID NO: 3749564 - RNA, 13 nt, Salmonella typhimurium LT2
acccggauauccg

SEQ ID NO: 3749565 - RNA, 17 nt, Salmonella typhimurium LT2
acccggccuacacauca

SEQ ID NO: 3749566 - RNA, 17 nt, Salmonella typhimurium LT2
acccggccugacgcagc

SEQ ID NO: 3749567 - RNA, 19 nt, Salmonella typhimurium LT2
acccggcuaaaugacgcgc

SEQ ID NO: 3749568 - RNA, 22 nt, Salmonella typhimurium LT2
acccggcugccauuaucaccau

SEQ ID NO: 3749569 - RNA, 21 nt, Salmonella typhimurium LT2
acccgggccaucuuuuuucac

SEQ ID NO: 3749570 - RNA, 17 nt, Salmonella typhimurium LT2
acccgguacuuucucca

SEQ ID NO: 3749571 - RNA, 20 nt, Salmonella typhimurium LT2
acccguuaaauaccagcacc

SEQ ID NO: 3749572 - RNA, 15 nt, Salmonella typhimurium LT2
acccguucgcugcau

SEQ ID NO: 3749573 - RNA, 21 nt, Salmonella typhimurium LT2
acccguugccgaacgcggcuu

SEQ ID NO: 3749574 - RNA, 19 nt, Salmonella typhimurium LT2
acccguugguuaacuucaa

SEQ ID NO: 3749575 - RNA, 13 nt, Salmonella typhimurium LT2
acccucaucccgu

SEQ ID NO: 3749576 - RNA, 16 nt, Salmonella typhimurium LT2
acccugaaaaguuaca

SEQ ID NO: 3749577 - RNA, 20 nt, Salmonella typhimurium LT2
acccugaagcugcaaccagc

SEQ ID NO: 3749578 - RNA, 19 nt, Salmonella typhimurium LT2
acccugccgaaaugaaagc

SEQ ID NO: 3749579 - RNA, 16 nt, Salmonella typhimurium LT2
acccugcgaaucccgg

SEQ ID NO: 3749580 - RNA, 22 nt, Salmonella typhimurium LT2
acccugcgugaacgaccgccac

SEQ ID NO: 3749581 - RNA, 14 nt, Salmonella typhimurium LT2
acccuguauuuuuu

SEQ ID NO: 3749582 - RNA, 15 nt, Salmonella typhimurium LT2
acccuguucagcacc

SEQ ID NO: 3749583 - RNA, 15 nt, Salmonella typhimurium LT2
acccuucauacugcg

SEQ ID NO: 3749584 - RNA, 21 nt, Salmonella typhimurium LT2
acccuuccaguugcgucagcg

SEQ ID NO: 3749585 - RNA, 14 nt, Salmonella typhimurium LT2
acccuucgcaacag

SEQ ID NO: 3749586 - RNA, 19 nt, Salmonella typhimurium LT2
acccuucuucuggcucaga

SEQ ID NO: 3749587 - RNA, 17 nt, Salmonella typhimurium LT2
acccuuugcagcgcgau

SEQ ID NO: 3749588 - RNA, 15 nt, Salmonella typhimurium LT2
acccuuuggccacca

SEQ ID NO: 3749589 - RNA, 19 nt, Salmonella typhimurium LT2
acccuuuuuugguuaucca

SEQ ID NO: 3749590 - RNA, 23 nt, Salmonella typhimurium LT2
acccuuuuuugguuauccagcag

SEQ ID NO: 3749591 - RNA, 17 nt, Salmonella typhimurium LT2
accgaaacagucacgcu

SEQ ID NO: 3749592 - RNA, 18 nt, Salmonella typhimurium LT2
accgaaacgcauacgcag

SEQ ID NO: 3749593 - RNA, 23 nt, Salmonella typhimurium LT2
accgaaaggguauacaaaaaaga

SEQ ID NO: 3749594 - RNA, 13 nt, Salmonella typhimurium LT2
accgaaaucauca

SEQ ID NO: 3749595 - RNA, 16 nt, Salmonella typhimurium LT2
accgaaauccaccagc

SEQ ID NO: 3749596 - RNA, 18 nt, Salmonella typhimurium LT2
accgaaauccaccagcgg

SEQ ID NO: 3749597 - RNA, 17 nt, Salmonella typhimurium LT2
accgaacagccaggcuu

SEQ ID NO: 3749598 - RNA, 12 nt, Salmonella typhimurium LT2
accgaaccugcg

SEQ ID NO: 3749599 - RNA, 22 nt, Salmonella typhimurium LT2
accgacagccauaccggcgcgc

SEQ ID NO: 3749600 - RNA, 17 nt, Salmonella typhimurium LT2
accgacauccgccaccu

SEQ ID NO: 3749601 - RNA, 12 nt, Salmonella typhimurium LT2
accgacgaacaa

SEQ ID NO: 3749602 - RNA, 14 nt, Salmonella typhimurium LT2
accgacgcgaauug

SEQ ID NO: 3749603 - RNA, 17 nt, Salmonella typhimurium LT2
accgacgcguggugaag

SEQ ID NO: 3749604 - RNA, 22 nt, Salmonella typhimurium LT2
accgacugucgaaaccagcaua

SEQ ID NO: 3749605 - RNA, 16 nt, Salmonella typhimurium LT2
accgagccagaaaugu

SEQ ID NO: 3749606 - RNA, 17 nt, Salmonella typhimurium LT2
accgaguuccaguccac

SEQ ID NO: 3749607 - RNA, 20 nt, Salmonella typhimurium LT2
accgauagagacugccgccg

SEQ ID NO: 3749608 - RNA, 18 nt, Salmonella typhimurium LT2
accgauccgaagaacaga

SEQ ID NO: 3749609 - RNA, 14 nt, Salmonella typhimurium LT2
accgaucugguugu

SEQ ID NO: 3749610 - RNA, 16 nt, Salmonella typhimurium LT2
accgaugacaauaauc

SEQ ID NO: 3749611 - RNA, 15 nt, Salmonella typhimurium LT2
accgaugacggcaaa

SEQ ID NO: 3749612 - RNA, 22 nt, Salmonella typhimurium LT2
accgaugcaaccgcucuccgca

SEQ ID NO: 3749613 - RNA, 16 nt, Salmonella typhimurium LT2
accgaugcccagcuug

SEQ ID NO: 3749614 - RNA, 19 nt, Salmonella typhimurium LT2
accgaugcccggcaaucgc

SEQ ID NO: 3749615 - RNA, 16 nt, Salmonella typhimurium LT2
accgauuucagcgugg

SEQ ID NO: 3749616 - RNA, 16 nt, Salmonella typhimurium LT2
accgcacaucacugcc

SEQ ID NO: 3749617 - RNA, 13 nt, Salmonella typhimurium LT2
accgcagaaaaag

SEQ ID NO: 3749618 - RNA, 18 nt, Salmonella typhimurium LT2
accgcauaacgcgcuggu

SEQ ID NO: 3749619 - RNA, 16 nt, Salmonella typhimurium LT2
accgcaucaaacucgc

SEQ ID NO: 3749620 - RNA, 15 nt, Salmonella typhimurium LT2
accgcaucgcgccca

SEQ ID NO: 3749621 - RNA, 13 nt, Salmonella typhimurium LT2
accgcaucggcau

SEQ ID NO: 3749622 - RNA, 15 nt, Salmonella typhimurium LT2
accgcauggaaucga

SEQ ID NO: 3749623 - RNA, 13 nt, Salmonella typhimurium LT2
accgcauuuucag

SEQ ID NO: 3749624 - RNA, 16 nt, Salmonella typhimurium LT2
accgccaaacgccgca

SEQ ID NO: 3749625 - RNA, 14 nt, Salmonella typhimurium LT2
accgccaagcgcgg

SEQ ID NO: 3749626 - RNA, 18 nt, Salmonella typhimurium LT2
accgccaagcgcggacag

SEQ ID NO: 3749627 - RNA, 18 nt, Salmonella typhimurium LT2
accgccaccauccggcgc

SEQ ID NO: 3749628 - RNA, 21 nt, Salmonella typhimurium LT2
accgccagaaaagaaccgacu

SEQ ID NO: 3749629 - RNA, 21 nt, Salmonella typhimurium LT2
accgccagaacgcuguugccg

SEQ ID NO: 3749630 - RNA, 20 nt, Salmonella typhimurium LT2
accgccagagcacgaaaagu

SEQ ID NO: 3749631 - RNA, 11 nt, Salmonella typhimurium LT2
accgccagaug

SEQ ID NO: 3749632 - RNA, 15 nt, Salmonella typhimurium LT2
accgccagucccagc

SEQ ID NO: 3749633 - RNA, 20 nt, Salmonella typhimurium LT2
accgccauacggaugccgau

SEQ ID NO: 3749634 - RNA, 15 nt, Salmonella typhimurium LT2
accgccauccggcau

SEQ ID NO: 3749635 - RNA, 16 nt, Salmonella typhimurium LT2
accgccauccggcauu

SEQ ID NO: 3749636 - RNA, 17 nt, Salmonella typhimurium LT2
accgcccccagucugcu

SEQ ID NO: 3749637 - RNA, 23 nt, Salmonella typhimurium LT2
accguaagcuuucugaauuucac

SEQ ID NO: 3749638 - RNA, 22 nt, Salmonella typhimurium LT2
accguaaucaucgcgaucgcca

SEQ ID NO: 3749639 - RNA, 22 nt, Salmonella typhimurium LT2
accguaccagaacucguugcca

SEQ ID NO: 3749640 - RNA, 15 nt, Salmonella typhimurium LT2
accguagaucgccag

SEQ ID NO: 3749641 - RNA, 16 nt, Salmonella typhimurium LT2
accguagcaucaucaa

SEQ ID NO: 3749642 - RNA, 22 nt, Salmonella typhimurium LT2
accguaguagguauccagcaga

SEQ ID NO: 3749643 - RNA, 12 nt, Salmonella typhimurium LT2
accguauccgcc

SEQ ID NO: 3749644 - RNA, 13 nt, Salmonella typhimurium LT2
accguauccggcc

SEQ ID NO: 3749645 - RNA, 18 nt, Salmonella typhimurium LT2
accguauccuuccagccc

SEQ ID NO: 3749646 - RNA, 19 nt, Salmonella typhimurium LT2
accguauccuuccagcccg

SEQ ID NO: 3749647 - RNA, 21 nt, Salmonella typhimurium LT2
accguaucgcccagcuuaugc

SEQ ID NO: 3749648 - RNA, 18 nt, Salmonella typhimurium LT2
accguauugccagaucug

SEQ ID NO: 3749649 - RNA, 17 nt, Salmonella typhimurium LT2
accgucaccacgcgcga

SEQ ID NO: 3749650 - RNA, 14 nt, Salmonella typhimurium LT2
accgucagauucug

SEQ ID NO: 3749651 - RNA, 17 nt, Salmonella typhimurium LT2
accgucagcaccagcga

SEQ ID NO: 3749652 - RNA, 14 nt, Salmonella typhimurium LT2
accgucagcagcac

SEQ ID NO: 3749653 - RNA, 13 nt, Salmonella typhimurium LT2
accgucagccacu

SEQ ID NO: 3749654 - RNA, 18 nt, Salmonella typhimurium LT2
accgucagccacuucuuc

SEQ ID NO: 3749655 - RNA, 16 nt, Salmonella typhimurium LT2
accgucagcuccggua

SEQ ID NO: 3749656 - RNA, 23 nt, Salmonella typhimurium LT2
accgucagcuccgguaucgccgg

SEQ ID NO: 3749657 - RNA, 13 nt, Salmonella typhimurium LT2
accguccacaucc

SEQ ID NO: 3749658 - RNA, 23 nt, Salmonella typhimurium LT2
accguccgcucacgauaaugaac

SEQ ID NO: 3749659 - RNA, 17 nt, Salmonella typhimurium LT2
accgucgaucucggcca

SEQ ID NO: 3749660 - RNA, 16 nt, Salmonella typhimurium LT2
accgucuccaugucac

SEQ ID NO: 3749661 - RNA, 18 nt, Salmonella typhimurium LT2
accgucuggcgaggcgcc

SEQ ID NO: 3749662 - RNA, 18 nt, Salmonella typhimurium LT2
accgucuucauccaugcg

SEQ ID NO: 3749663 - RNA, 13 nt, Salmonella typhimurium LT2
accgucuugcugc

SEQ ID NO: 3749664 - RNA, 14 nt, Salmonella typhimurium LT2
accgucuugcugcg

SEQ ID NO: 3749665 - RNA, 19 nt, Salmonella typhimurium LT2
accgugaccuucaccugaa

SEQ ID NO: 3749666 - RNA, 18 nt, Salmonella typhimurium LT2
accgugagaaucgaucag

SEQ ID NO: 3749667 - RNA, 21 nt, Salmonella typhimurium LT2
accgugaguaucgaucgucau

SEQ ID NO: 3749668 - RNA, 14 nt, Salmonella typhimurium LT2
accgugcacgcugc

SEQ ID NO: 3749669 - RNA, 15 nt, Salmonella typhimurium LT2
accgugcacgcugcg

SEQ ID NO: 3749670 - RNA, 22 nt, Salmonella typhimurium LT2
accguggcuuuccccugacggg

SEQ ID NO: 3749671 - RNA, 16 nt, Salmonella typhimurium LT2
accguggucuccgccu

SEQ ID NO: 3749672 - RNA, 16 nt, Salmonella typhimurium LT2
accgugugcagugaca

SEQ ID NO: 3749673 - RNA, 21 nt, Salmonella typhimurium LT2
accguuaacguuuuacgcugc

SEQ ID NO: 3749674 - RNA, 22 nt, Salmonella typhimurium LT2
accguuaacguuuuacgcugcc

SEQ ID NO: 3749675 - RNA, 23 nt, Salmonella typhimurium LT2
accguuaccguuuaacgcaucgc

SEQ ID NO: 3749676 - RNA, 17 nt, Salmonella typhimurium LT2
accguucagaucgccaa

SEQ ID NO: 3749677 - RNA, 18 nt, Salmonella typhimurium LT2
accguugcgcccaucauc

SEQ ID NO: 3749678 - RNA, 17 nt, Salmonella typhimurium LT2
accguuggaauaaauca

SEQ ID NO: 3749679 - RNA, 23 nt, Salmonella typhimurium LT2
accguuggaauaaaucacaacgu

SEQ ID NO: 3749680 - RNA, 23 nt, Salmonella typhimurium LT2
accguugucggggcuuuaaugcu

SEQ ID NO: 3749681 - RNA, 18 nt, Salmonella typhimurium LT2
accguuuaaaaacaucau

SEQ ID NO: 3749682 - RNA, 15 nt, Salmonella typhimurium LT2
accguuuccgccagu

SEQ ID NO: 3749683 - RNA, 12 nt, Salmonella typhimurium LT2
accguuuuccag

SEQ ID NO: 3749684 - RNA, 13 nt, Salmonella typhimurium LT2
accguuuugcaau

SEQ ID NO: 3749685 - RNA, 18 nt, Salmonella typhimurium LT2
accguuuuucaucaagag

SEQ ID NO: 3749686 - RNA, 20 nt, Salmonella typhimurium LT2
accguuuuuuuaugcagccg

SEQ ID NO: 3749687 - RNA, 17 nt, Salmonella typhimurium LT2
accuaaaaaccagaacu

SEQ ID NO: 3749688 - RNA, 16 nt, Salmonella typhimurium LT2
accuaauaaccagccc

SEQ ID NO: 3749689 - RNA, 18 nt, Salmonella typhimurium LT2
accuacaagauuugcaau

SEQ ID NO: 3749690 - RNA, 23 nt, Salmonella typhimurium LT2
accuacaaucgucuucagcaauu

SEQ ID NO: 3749691 - RNA, 21 nt, Salmonella typhimurium LT2
accuacaauuugaauuacccc

SEQ ID NO: 3749692 - RNA, 19 nt, Salmonella typhimurium LT2
accuacaccguauccggcc

SEQ ID NO: 3749693 - RNA, 11 nt, Salmonella typhimurium LT2
accuaccagcg

SEQ ID NO: 3749694 - RNA, 13 nt, Salmonella typhimurium LT2
accuaccggcaua

SEQ ID NO: 3749695 - RNA, 17 nt, Salmonella typhimurium LT2
accuaccguaauacuuc

SEQ ID NO: 3749696 - RNA, 18 nt, Salmonella typhimurium LT2
accuaccugcucaaucgc

SEQ ID NO: 3749697 - RNA, 17 nt, Salmonella typhimurium LT2
accuacuuuauuuuucg

SEQ ID NO: 3749698 - RNA, 14 nt, Salmonella typhimurium LT2
accuaucaggauca

SEQ ID NO: 3749699 - RNA, 20 nt, Salmonella typhimurium LT2
accuaucaggcguugaccgc

SEQ ID NO: 3749700 - RNA, 22 nt, Salmonella typhimurium LT2
accuaucggcucgcccgcgcuc

SEQ ID NO: 3749701 - RNA, 20 nt, Salmonella typhimurium LT2
accuauuuuaaauucccagc

SEQ ID NO: 3749702 - RNA, 14 nt, Salmonella typhimurium LT2
accuauuuugcaaa

SEQ ID NO: 3749703 - RNA, 16 nt, Salmonella typhimurium LT2
accucaaggcucagca

SEQ ID NO: 3749704 - RNA, 16 nt, Salmonella typhimurium LT2
accucaccguccgcca

SEQ ID NO: 3749705 - RNA, 20 nt, Salmonella typhimurium LT2
accucacggagaaaagcgaa

SEQ ID NO: 3749706 - RNA, 23 nt, Salmonella typhimurium LT2
accucacggagaaaagcgaaaau

SEQ ID NO: 3749707 - RNA, 20 nt, Salmonella typhimurium LT2
accucacuccagaccugaag

SEQ ID NO: 3749708 - RNA, 17 nt, Salmonella typhimurium LT2
accucaucaccuacccu

SEQ ID NO: 3749709 - RNA, 16 nt, Salmonella typhimurium LT2
accucaucccccagcc

SEQ ID NO: 3749710 - RNA, 20 nt, Salmonella typhimurium LT2
accucaugcuuaucgccaaa

SEQ ID NO: 3749711 - RNA, 17 nt, Salmonella typhimurium LT2
accuccacgcccagcgc

SEQ ID NO: 3749712 - RNA, 23 nt, Salmonella typhimurium LT2
accuccagcgaggccucuccucg

SEQ ID NO: 3749713 - RNA, 19 nt, Salmonella typhimurium LT2
accucccgccggggcuccc

SEQ ID NO: 3749714 - RNA, 11 nt, Salmonella typhimurium LT2
accuccgccac

SEQ ID NO: 3749715 - RNA, 14 nt, Salmonella typhimurium LT2
accuccgcccggug

SEQ ID NO: 3749716 - RNA, 22 nt, Salmonella typhimurium LT2
accuccgcccggugcucaauaa

SEQ ID NO: 3749717 - RNA, 11 nt, Salmonella typhimurium LT2
accuccgggug

SEQ ID NO: 3749718 - RNA, 16 nt, Salmonella typhimurium LT2
accuccucucuuccuc

SEQ ID NO: 3749719 - RNA, 15 nt, Salmonella typhimurium LT2
accucgcauacuucc

SEQ ID NO: 3749720 - RNA, 20 nt, Salmonella typhimurium LT2
accucgcuucccugacgcgc

SEQ ID NO: 3749721 - RNA, 23 nt, Salmonella typhimurium LT2
accucgcuucccugacgcgcagc

SEQ ID NO: 3749722 - RNA, 18 nt, Salmonella typhimurium LT2
accucgguauguccugcc

SEQ ID NO: 3749723 - RNA, 20 nt, Salmonella typhimurium LT2
accucgguauguccugccgc

SEQ ID NO: 3749724 - RNA, 15 nt, Salmonella typhimurium LT2
accucuaccggggcg

SEQ ID NO: 3749725 - RNA, 16 nt, Salmonella typhimurium LT2
accucuauaguaaauu

SEQ ID NO: 3749726 - RNA, 12 nt, Salmonella typhimurium LT2
accucucaccgc

SEQ ID NO: 3749727 - RNA, 16 nt, Salmonella typhimurium LT2
accucucaccgcccag

SEQ ID NO: 3749728 - RNA, 17 nt, Salmonella typhimurium LT2
accucuuccgccagguc

SEQ ID NO: 3749729 - RNA, 20 nt, Salmonella typhimurium LT2
accucuuuggcgcgaaccgu

SEQ ID NO: 3749730 - RNA, 22 nt, Salmonella typhimurium LT2
accugaauccagacuuuuuugc

SEQ ID NO: 3749731 - RNA, 20 nt, Salmonella typhimurium LT2
accugaaugccauccagcac

SEQ ID NO: 3749732 - RNA, 16 nt, Salmonella typhimurium LT2
accugacggcagccac

SEQ ID NO: 3749733 - RNA, 18 nt, Salmonella typhimurium LT2
accugaggaagaagcgca

SEQ ID NO: 3749734 - RNA, 17 nt, Salmonella typhimurium LT2
accugauugauacgcgc

SEQ ID NO: 3749735 - RNA, 13 nt, Salmonella typhimurium LT2
accugcaaaaaaa

SEQ ID NO: 3749736 - RNA, 23 nt, Salmonella typhimurium LT2
accugcaaaaacgccagaccgac

SEQ ID NO: 3749737 - RNA, 22 nt, Salmonella typhimurium LT2
accugcacaucgccauuaaaag

SEQ ID NO: 3749738 - RNA, 16 nt, Salmonella typhimurium LT2
accugcacuccggcuc

SEQ ID NO: 3749739 - RNA, 12 nt, Salmonella typhimurium LT2
accugcaucacg

SEQ ID NO: 3749740 - RNA, 21 nt, Salmonella typhimurium LT2
accugcaucccuuucuuuaca

SEQ ID NO: 3749741 - RNA, 23 nt, Salmonella typhimurium LT2
acgccaauuccuaucaguacgac

SEQ ID NO: 3749742 - RNA, 14 nt, Salmonella typhimurium LT2
acgccacaaacugc

SEQ ID NO: 3749743 - RNA, 15 nt, Salmonella typhimurium LT2
acgccacaguugguu

SEQ ID NO: 3749744 - RNA, 16 nt, Salmonella typhimurium LT2
acgccaccacagucau

SEQ ID NO: 3749745 - RNA, 19 nt, Salmonella typhimurium LT2
acgccaccacagucaucgc

SEQ ID NO: 3749746 - RNA, 14 nt, Salmonella typhimurium LT2
acgccaccacgccg

SEQ ID NO: 3749747 - RNA, 18 nt, Salmonella typhimurium LT2
acgccaccgccgccacca

SEQ ID NO: 3749748 - RNA, 22 nt, Salmonella typhimurium LT2
acgccaccgccgccaccaaaaa

SEQ ID NO: 3749749 - RNA, 19 nt, Salmonella typhimurium LT2
acgccaccuuugaaaauca

SEQ ID NO: 3749750 - RNA, 20 nt, Salmonella typhimurium LT2
acgccacgcuccagcggaag

SEQ ID NO: 3749751 - RNA, 15 nt, Salmonella typhimurium LT2
acgccacggccagca

SEQ ID NO: 3749752 - RNA, 17 nt, Salmonella typhimurium LT2
acgccacggucgagcau

SEQ ID NO: 3749753 - RNA, 15 nt, Salmonella typhimurium LT2
acgccacugccauaa

SEQ ID NO: 3749754 - RNA, 19 nt, Salmonella typhimurium LT2
acgccagaucguuaauaau

SEQ ID NO: 3749755 - RNA, 17 nt, Salmonella typhimurium LT2
acgccagauuaucggcc

SEQ ID NO: 3749756 - RNA, 12 nt, Salmonella typhimurium LT2
acgccagccagc

SEQ ID NO: 3749757 - RNA, 13 nt, Salmonella typhimurium LT2
acgccagccagcc

SEQ ID NO: 3749758 - RNA, 18 nt, Salmonella typhimurium LT2
acgccagccuaucgccau

SEQ ID NO: 3749759 - RNA, 19 nt, Salmonella typhimurium LT2
acgccaggcacgccggcaa

SEQ ID NO: 3749760 - RNA, 17 nt, Salmonella typhimurium LT2
acgccaguggaugcgcu

SEQ ID NO: 3749761 - RNA, 15 nt, Salmonella typhimurium LT2
acgccaguuccgcca

SEQ ID NO: 3749762 - RNA, 21 nt, Salmonella typhimurium LT2
acgccaguuccgccacggcgu

SEQ ID NO: 3749763 - RNA, 15 nt, Salmonella typhimurium LT2
acgccauaucgccgg

SEQ ID NO: 3749764 - RNA, 19 nt, Salmonella typhimurium LT2
acgccauaucgccggcaag

SEQ ID NO: 3749765 - RNA, 14 nt, Salmonella typhimurium LT2
acgccaucgacaaa

SEQ ID NO: 3749766 - RNA, 21 nt, Salmonella typhimurium LT2
acgccaucgccugauggcgcu

SEQ ID NO: 3749767 - RNA, 16 nt, Salmonella typhimurium LT2
acgccaucgcggcgca

SEQ ID NO: 3749768 - RNA, 19 nt, Salmonella typhimurium LT2
acgccaucgcggcgcaaau

SEQ ID NO: 3749769 - RNA, 15 nt, Salmonella typhimurium LT2
acgccauggccgcag

SEQ ID NO: 3749770 - RNA, 18 nt, Salmonella typhimurium LT2
acgccauggggugaggca

SEQ ID NO: 3749771 - RNA, 14 nt, Salmonella typhimurium LT2
acgccauuccgcuu

SEQ ID NO: 3749772 - RNA, 19 nt, Salmonella typhimurium LT2
acgcccaaaaugcggcauc

SEQ ID NO: 3749773 - RNA, 14 nt, Salmonella typhimurium LT2
acgcccagccguga

SEQ ID NO: 3749774 - RNA, 12 nt, Salmonella typhimurium LT2
acgcccagcgcc

SEQ ID NO: 3749775 - RNA, 22 nt, Salmonella typhimurium LT2
acgcccagcgccgggaaaauca

SEQ ID NO: 3749776 - RNA, 15 nt, Salmonella typhimurium LT2
acgcccaucggcaca

SEQ ID NO: 3749777 - RNA, 16 nt, Salmonella typhimurium LT2
acgcccauuaugccgc

SEQ ID NO: 3749778 - RNA, 15 nt, Salmonella typhimurium LT2
acgcccgacaaucgc

SEQ ID NO: 3749779 - RNA, 12 nt, Salmonella typhimurium LT2
acgcccgccauc

SEQ ID NO: 3749780 - RNA, 13 nt, Salmonella typhimurium LT2
acgcccgcccgcc

SEQ ID NO: 3749781 - RNA, 17 nt, Salmonella typhimurium LT2
acgcccgccgccagcau

SEQ ID NO: 3749782 - RNA, 16 nt, Salmonella typhimurium LT2
acgcccgccgccugau

SEQ ID NO: 3749783 - RNA, 19 nt, Salmonella typhimurium LT2
acgcccgcugacguuggcc

SEQ ID NO: 3749784 - RNA, 16 nt, Salmonella typhimurium LT2
acgcccggcgcgacac

SEQ ID NO: 3749785 - RNA, 22 nt, Salmonella typhimurium LT2
acgcccggcggguauggcaaug

SEQ ID NO: 3749786 - RNA, 15 nt, Salmonella typhimurium LT2
acgcccgugacgcca

SEQ ID NO: 3749787 - RNA, 18 nt, Salmonella typhimurium LT2
acgcccugcucccacagc

SEQ ID NO: 3749788 - RNA, 15 nt, Salmonella typhimurium LT2
acgccgaacaggcca

SEQ ID NO: 3749789 - RNA, 14 nt, Salmonella typhimurium LT2
acgccgaagugcgc

SEQ ID NO: 3749790 - RNA, 16 nt, Salmonella typhimurium LT2
acgccgacgacaggca

SEQ ID NO: 3749791 - RNA, 21 nt, Salmonella typhimurium LT2
acgccgacgacaggcagcguc

SEQ ID NO: 3749792 - RNA, 23 nt, Salmonella typhimurium LT2
acgccgagcaucgcuuuuaggcu

SEQ ID NO: 3749793 - RNA, 15 nt, Salmonella typhimurium LT2
acgccgauuaaugcu

SEQ ID NO: 3749794 - RNA, 13 nt, Salmonella typhimurium LT2
acgccgcaaacgc

SEQ ID NO: 3749795 - RNA, 16 nt, Salmonella typhimurium LT2
acgccgcacacagcgg

SEQ ID NO: 3749796 - RNA, 18 nt, Salmonella typhimurium LT2
acgccgcagccugauggc

SEQ ID NO: 3749797 - RNA, 17 nt, Salmonella typhimurium LT2
acgccgccauccggcaa

SEQ ID NO: 3749798 - RNA, 19 nt, Salmonella typhimurium LT2
acgccgccauccggcauuu

SEQ ID NO: 3749799 - RNA, 19 nt, Salmonella typhimurium LT2
acgccgcccagcgaacugg

SEQ ID NO: 3749800 - RNA, 16 nt, Salmonella typhimurium LT2
acgccgccgcaggcca

SEQ ID NO: 3749801 - RNA, 12 nt, Salmonella typhimurium LT2
acgccgccgcau

SEQ ID NO: 3749802 - RNA, 13 nt, Salmonella typhimurium LT2
acgccgccgccca

SEQ ID NO: 3749803 - RNA, 13 nt, Salmonella typhimurium LT2
acgccgcgcucgc

SEQ ID NO: 3749804 - RNA, 19 nt, Salmonella typhimurium LT2
acgccgcuaucgaccagca

SEQ ID NO: 3749805 - RNA, 22 nt, Salmonella typhimurium LT2
acgccgcuggcggaaauaaaca

SEQ ID NO: 3749806 - RNA, 20 nt, Salmonella typhimurium LT2
acgccggaacccgcgacgac

SEQ ID NO: 3749807 - RNA, 17 nt, Salmonella typhimurium LT2
acgccggaccagacgac

SEQ ID NO: 3749808 - RNA, 18 nt, Salmonella typhimurium LT2
acgccggaugacgccguu

SEQ ID NO: 3749809 - RNA, 19 nt, Salmonella typhimurium LT2
acgccggcaacacccgccg

SEQ ID NO: 3749810 - RNA, 11 nt, Salmonella typhimurium LT2
acgccggcauc

SEQ ID NO: 3749811 - RNA, 18 nt, Salmonella typhimurium LT2
acgccgggaaauuuuucg

SEQ ID NO: 3749812 - RNA, 18 nt, Salmonella typhimurium LT2
acgccgggcacgcugacc

SEQ ID NO: 3749813 - RNA, 15 nt, Salmonella typhimurium LT2
acgccgggccugcca

SEQ ID NO: 3749814 - RNA, 21 nt, Salmonella typhimurium LT2
acgccggguaaacgcagcguc

SEQ ID NO: 3749815 - RNA, 22 nt, Salmonella typhimurium LT2
acgccggguaaacgcagcguca

SEQ ID NO: 3749816 - RNA, 15 nt, Salmonella typhimurium LT2
acgccggugccugcc

SEQ ID NO: 3749817 - RNA, 20 nt, Salmonella typhimurium LT2
acgccggugccugccgccuc

SEQ ID NO: 3749818 - RNA, 13 nt, Salmonella typhimurium LT2
acgccguccagca

SEQ ID NO: 3749819 - RNA, 14 nt, Salmonella typhimurium LT2
acgccguccagcac

SEQ ID NO: 3749820 - RNA, 16 nt, Salmonella typhimurium LT2
acgccguccagcacca

SEQ ID NO: 3749821 - RNA, 15 nt, Salmonella typhimurium LT2
acgccguccaggcuc

SEQ ID NO: 3749822 - RNA, 14 nt, Salmonella typhimurium LT2
acgccgucgacaaa

SEQ ID NO: 3749823 - RNA, 18 nt, Salmonella typhimurium LT2
acgccgucgaugauggcg

SEQ ID NO: 3749824 - RNA, 13 nt, Salmonella typhimurium LT2
acgccgucggcag

SEQ ID NO: 3749825 - RNA, 15 nt, Salmonella typhimurium LT2
acgccgucggcagcc

SEQ ID NO: 3749826 - RNA, 18 nt, Salmonella typhimurium LT2
acgccgucggcagccaga

SEQ ID NO: 3749827 - RNA, 22 nt, Salmonella typhimurium LT2
acgccgucugguacggccacca

SEQ ID NO: 3749828 - RNA, 16 nt, Salmonella typhimurium LT2
acgccgugaacgccaa

SEQ ID NO: 3749829 - RNA, 12 nt, Salmonella typhimurium LT2
acgccucugucu

SEQ ID NO: 3749830 - RNA, 22 nt, Salmonella typhimurium LT2
acgccucuuucagccggcuauc

SEQ ID NO: 3749831 - RNA, 17 nt, Salmonella typhimurium LT2
acgccugaugcugcgag

SEQ ID NO: 3749832 - RNA, 16 nt, Salmonella typhimurium LT2
acgccugcauaaagga

SEQ ID NO: 3749833 - RNA, 20 nt, Salmonella typhimurium LT2
acgccugcaucaacaggcga

SEQ ID NO: 3749834 - RNA, 14 nt, Salmonella typhimurium LT2
acgccugcccgguu

SEQ ID NO: 3749835 - RNA, 15 nt, Salmonella typhimurium LT2
acgccugcuucacgg

SEQ ID NO: 3749836 - RNA, 22 nt, Salmonella typhimurium LT2
acgccugcuucacggauagacu

SEQ ID NO: 3749837 - RNA, 22 nt, Salmonella typhimurium LT2
acgccuggcgcuuuaaaacgaa

SEQ ID NO: 3749838 - RNA, 16 nt, Salmonella typhimurium LT2
acgccuguaaugccgc

SEQ ID NO: 3749839 - RNA, 15 nt, Salmonella typhimurium LT2
acgccuguucaucag

SEQ ID NO: 3749840 - RNA, 16 nt, Salmonella typhimurium LT2
acgccuguucaucagg

SEQ ID NO: 3749841 - RNA, 19 nt, Salmonella typhimurium LT2
acgccuuacccggccuaca

SEQ ID NO: 3749842 - RNA, 20 nt, Salmonella typhimurium LT2
acgccuuauccggccugccc

SEQ ID NO: 3749843 - RNA, 19 nt, Salmonella typhimurium LT2
acgccuuauccugccuaca

SEQ ID NO: 3749844 - RNA, 19 nt, Salmonella typhimurium LT2
acgccuuuacccuuacggc

SEQ ID NO: 3749845 - RNA, 16 nt, Salmonella typhimurium LT2
acgccuuucacgccga

SEQ ID NO: 3749846 - RNA, 15 nt, Salmonella typhimurium LT2
acgcugcgucaggcg

SEQ ID NO: 3749847 - RNA, 17 nt, Salmonella typhimurium LT2
acgcuggaagaggcgcc

SEQ ID NO: 3749848 - RNA, 14 nt, Salmonella typhimurium LT2
acgcuggcacagga

SEQ ID NO: 3749849 - RNA, 19 nt, Salmonella typhimurium LT2
acgcuggcacuuuccgguu

SEQ ID NO: 3749850 - RNA, 20 nt, Salmonella typhimurium LT2
acgcuggcaucaauauggau

SEQ ID NO: 3749851 - RNA, 17 nt, Salmonella typhimurium LT2
acgcuggugcgcggaag

SEQ ID NO: 3749852 - RNA, 20 nt, Salmonella typhimurium LT2
acgcugguuguccugguaca

SEQ ID NO: 3749853 - RNA, 23 nt, Salmonella typhimurium LT2
acgcugguuugugugcaggagca

SEQ ID NO: 3749854 - RNA, 22 nt, Salmonella typhimurium LT2
acgcuguacauaacaucucacu

SEQ ID NO: 3749855 - RNA, 13 nt, Salmonella typhimurium LT2
acgcuguaccggc

SEQ ID NO: 3749856 - RNA, 19 nt, Salmonella typhimurium LT2
acgcuguacgcuggcucuu

SEQ ID NO: 3749857 - RNA, 18 nt, Salmonella typhimurium LT2
acgcuuaucaggccuaca

SEQ ID NO: 3749858 - RNA, 19 nt, Salmonella typhimurium LT2
acgcuuaucaggccuacaa

SEQ ID NO: 3749859 - RNA, 20 nt, Salmonella typhimurium LT2
acgcuuaucaggccuacauc

SEQ ID NO: 3749860 - RNA, 19 nt, Salmonella typhimurium LT2
acgcuuaucaggccuacca

SEQ ID NO: 3749861 - RNA, 23 nt, Salmonella typhimurium LT2
acgcuuaucaggccuaccagucg

SEQ ID NO: 3749862 - RNA, 19 nt, Salmonella typhimurium LT2
acgcuuaucaguccccaca

SEQ ID NO: 3749863 - RNA, 14 nt, Salmonella typhimurium LT2
acgcuuaucccagc

SEQ ID NO: 3749864 - RNA, 16 nt, Salmonella typhimurium LT2
acgcuuaucccagccg

SEQ ID NO: 3749865 - RNA, 19 nt, Salmonella typhimurium LT2
acgcuuaucccagccgcga

SEQ ID NO: 3749866 - RNA, 14 nt, Salmonella typhimurium LT2
acgcuuaucgccgu

SEQ ID NO: 3749867 - RNA, 17 nt, Salmonella typhimurium LT2
acgcuucggcuccagcg

SEQ ID NO: 3749868 - RNA, 20 nt, Salmonella typhimurium LT2
acgcuucguauuucuucgcu

SEQ ID NO: 3749869 - RNA, 14 nt, Salmonella typhimurium LT2
acgcuucugguugu

SEQ ID NO: 3749870 - RNA, 15 nt, Salmonella typhimurium LT2
acgcuucuucgauuu

SEQ ID NO: 3749871 - RNA, 21 nt, Salmonella typhimurium LT2
acgcuugcaugaccauccacg

SEQ ID NO: 3749872 - RNA, 15 nt, Salmonella typhimurium LT2
acgcuugcccggauc

SEQ ID NO: 3749873 - RNA, 13 nt, Salmonella typhimurium LT2
acgcuugcgccag

SEQ ID NO: 3749874 - RNA, 20 nt, Salmonella typhimurium LT2
acgcuuuacgcuuaucccag

SEQ ID NO: 3749875 - RNA, 13 nt, Salmonella typhimurium LT2
acgcuuucugggg

SEQ ID NO: 3749876 - RNA, 19 nt, Salmonella typhimurium LT2
acgcuuucuucccuccccu

SEQ ID NO: 3749877 - RNA, 21 nt, Salmonella typhimurium LT2
acgcuuugcgauagcccggca

SEQ ID NO: 3749878 - RNA, 21 nt, Salmonella typhimurium LT2
acgcuuugcuguacauaucca

SEQ ID NO: 3749879 - RNA, 23 nt, Salmonella typhimurium LT2
acgcuuuuaaauucgcuccacug

SEQ ID NO: 3749880 - RNA, 16 nt, Salmonella typhimurium LT2
acgcuuuugcgcacug

SEQ ID NO: 3749881 - RNA, 14 nt, Salmonella typhimurium LT2
acggaaaaaauacu

SEQ ID NO: 3749882 - RNA, 14 nt, Salmonella typhimurium LT2
acggaaaccagaua

SEQ ID NO: 3749883 - RNA, 14 nt, Salmonella typhimurium LT2
acggaaaccagcau

SEQ ID NO: 3749884 - RNA, 22 nt, Salmonella typhimurium LT2
acggaacaacgcaacacaggcc

SEQ ID NO: 3749885 - RNA, 14 nt, Salmonella typhimurium LT2
acggaaccaaaaua

SEQ ID NO: 3749886 - RNA, 18 nt, Salmonella typhimurium LT2
acggaaccaaaugcccag

SEQ ID NO: 3749887 - RNA, 22 nt, Salmonella typhimurium LT2
acggaaccauuccgacagugaa

SEQ ID NO: 3749888 - RNA, 14 nt, Salmonella typhimurium LT2
acggaacccagcaa

SEQ ID NO: 3749889 - RNA, 20 nt, Salmonella typhimurium LT2
acggaaccgcguuuacgccg

SEQ ID NO: 3749890 - RNA, 22 nt, Salmonella typhimurium LT2
acggaaggaaauaacgugcccu

SEQ ID NO: 3749891 - RNA, 19 nt, Salmonella typhimurium LT2
acggaagguaauaauccuc

SEQ ID NO: 3749892 - RNA, 16 nt, Salmonella typhimurium LT2
acggacaucagaggua

SEQ ID NO: 3749893 - RNA, 16 nt, Salmonella typhimurium LT2
acggaccggcaaucgc

SEQ ID NO: 3749894 - RNA, 12 nt, Salmonella typhimurium LT2
acggacgugggg

SEQ ID NO: 3749895 - RNA, 15 nt, Salmonella typhimurium LT2
acggagaaaagcgaa

SEQ ID NO: 3749896 - RNA, 20 nt, Salmonella typhimurium LT2
acggagauuaacagcgcgac

SEQ ID NO: 3749897 - RNA, 21 nt, Salmonella typhimurium LT2
acggagauuaacagcgcgacc

SEQ ID NO: 3749898 - RNA, 23 nt, Salmonella typhimurium LT2
acggagcauaauuuuccugucgu

SEQ ID NO: 3749899 - RNA, 16 nt, Salmonella typhimurium LT2
acggaggcgccagaga

SEQ ID NO: 3749900 - RNA, 12 nt, Salmonella typhimurium LT2
acggauaaaaac

SEQ ID NO: 3749901 - RNA, 19 nt, Salmonella typhimurium LT2
acggauacgcugcgucagg

SEQ ID NO: 3749902 - RNA, 13 nt, Salmonella typhimurium LT2
acggaucagccug

SEQ ID NO: 3749903 - RNA, 19 nt, Salmonella typhimurium LT2
acggcaaaacgugguaaaa

SEQ ID NO: 3749904 - RNA, 13 nt, Salmonella typhimurium LT2
acggcaacaguac

SEQ ID NO: 3749905 - RNA, 18 nt, Salmonella typhimurium LT2
acggcaacggauuguggc

SEQ ID NO: 3749906 - RNA, 14 nt, Salmonella typhimurium LT2
acggcacacaggcc

SEQ ID NO: 3749907 - RNA, 14 nt, Salmonella typhimurium LT2
acggcagcgccauc

SEQ ID NO: 3749908 - RNA, 20 nt, Salmonella typhimurium LT2
acggcagcgccauccggcac

SEQ ID NO: 3749909 - RNA, 20 nt, Salmonella typhimurium LT2
acggcagcguauacgccgga

SEQ ID NO: 3749910 - RNA, 20 nt, Salmonella typhimurium LT2
acggcaggcccgauaaacgg

SEQ ID NO: 3749911 - RNA, 18 nt, Salmonella typhimurium LT2
acggcaguguuucccaac

SEQ ID NO: 3749912 - RNA, 12 nt, Salmonella typhimurium LT2
acggcauaagcc

SEQ ID NO: 3749913 - RNA, 20 nt, Salmonella typhimurium LT2
acggcauagcuguuccgcaa

SEQ ID NO: 3749914 - RNA, 13 nt, Salmonella typhimurium LT2
acggcaucaggaa

SEQ ID NO: 3749915 - RNA, 14 nt, Salmonella typhimurium LT2
acggcaugaagcag

SEQ ID NO: 3749916 - RNA, 17 nt, Salmonella typhimurium LT2
acggccagugaaauaaa

SEQ ID NO: 3749917 - RNA, 18 nt, Salmonella typhimurium LT2
acggcccguaauauugac

SEQ ID NO: 3749918 - RNA, 18 nt, Salmonella typhimurium LT2
acggcccguacugaaccc

SEQ ID NO: 3749919 - RNA, 23 nt, Salmonella typhimurium LT2
acggccugcaaacgaaucaccuc

SEQ ID NO: 3749920 - RNA, 15 nt, Salmonella typhimurium LT2
acggccugucuccgc

SEQ ID NO: 3749921 - RNA, 21 nt, Salmonella typhimurium LT2
acggcgaaauuaacgacauuu

SEQ ID NO: 3749922 - RNA, 14 nt, Salmonella typhimurium LT2
acggcgaaucgccu

SEQ ID NO: 3749923 - RNA, 15 nt, Salmonella typhimurium LT2
acggcgacaggcaca

SEQ ID NO: 3749924 - RNA, 13 nt, Salmonella typhimurium LT2
acggcgaccaaaa

SEQ ID NO: 3749925 - RNA, 14 nt, Salmonella typhimurium LT2
acggcgaccagcaa

SEQ ID NO: 3749926 - RNA, 22 nt, Salmonella typhimurium LT2
acggcgacgcccgccaucugcu

SEQ ID NO: 3749927 - RNA, 15 nt, Salmonella typhimurium LT2
acggcgagaccauau

SEQ ID NO: 3749928 - RNA, 15 nt, Salmonella typhimurium LT2
acggcgauaccagua

SEQ ID NO: 3749929 - RNA, 18 nt, Salmonella typhimurium LT2
acggcgauaccaguaaua

SEQ ID NO: 3749930 - RNA, 16 nt, Salmonella typhimurium LT2
acggcgauacugcucc

SEQ ID NO: 3749931 - RNA, 19 nt, Salmonella typhimurium LT2
acggcgcagguaaaaucca

SEQ ID NO: 3749932 - RNA, 17 nt, Salmonella typhimurium LT2
acggcgccaugauccag

SEQ ID NO: 3749933 - RNA, 19 nt, Salmonella typhimurium LT2
acggcgccaugauccagcg

SEQ ID NO: 3749934 - RNA, 21 nt, Salmonella typhimurium LT2
acggcgcgaaucccgcguucg

SEQ ID NO: 3749935 - RNA, 13 nt, Salmonella typhimurium LT2
acggcgcgccacc

SEQ ID NO: 3749936 - RNA, 17 nt, Salmonella typhimurium LT2
acggcgcguccagccag

SEQ ID NO: 3749937 - RNA, 14 nt, Salmonella typhimurium LT2
acggcggaccccuc

SEQ ID NO: 3749938 - RNA, 17 nt, Salmonella typhimurium LT2
acggcguaacgguucgg

SEQ ID NO: 3749939 - RNA, 18 nt, Salmonella typhimurium LT2
acggcguaccagaaugcc

SEQ ID NO: 3749940 - RNA, 21 nt, Salmonella typhimurium LT2
acggcgucaaauccaccgcca

SEQ ID NO: 3749941 - RNA, 14 nt, Salmonella typhimurium LT2
acggcgucaauucc

SEQ ID NO: 3749942 - RNA, 23 nt, Salmonella typhimurium LT2
acggcgucaccaccgcaggcagc

SEQ ID NO: 3749943 - RNA, 14 nt, Salmonella typhimurium LT2
acggcgucagccac

SEQ ID NO: 3749944 - RNA, 20 nt, Salmonella typhimurium LT2
acggcguguugaaguccucu

SEQ ID NO: 3749945 - RNA, 14 nt, Salmonella typhimurium LT2
acggcuacccauga

SEQ ID NO: 3749946 - RNA, 13 nt, Salmonella typhimurium LT2
acggcuaccugca

SEQ ID NO: 3749947 - RNA, 19 nt, Salmonella typhimurium LT2
acggcuauucuucgaucgc

SEQ ID NO: 3749948 - RNA, 23 nt, Salmonella typhimurium LT2
acggcuauucuucgaucgccugg

SEQ ID NO: 3749949 - RNA, 21 nt, Salmonella typhimurium LT2
acggcucaaacggccugcgcu

SEQ ID NO: 3749950 - RNA, 13 nt, Salmonella typhimurium LT2
acgucgcaucacc

SEQ ID NO: 3749951 - RNA, 13 nt, Salmonella typhimurium LT2
acgucgcccaccg

SEQ ID NO: 3749952 - RNA, 15 nt, Salmonella typhimurium LT2
acgucgcucccggca

SEQ ID NO: 3749953 - RNA, 16 nt, Salmonella typhimurium LT2
acgucgcucccggcac

SEQ ID NO: 3749954 - RNA, 14 nt, Salmonella typhimurium LT2
acgucguaaaaccu

SEQ ID NO: 3749955 - RNA, 13 nt, Salmonella typhimurium LT2
acgucugucagaa

SEQ ID NO: 3749956 - RNA, 19 nt, Salmonella typhimurium LT2
acgugagugguagaaacug

SEQ ID NO: 3749957 - RNA, 16 nt, Salmonella typhimurium LT2
acgugauugcugacac

SEQ ID NO: 3749958 - RNA, 20 nt, Salmonella typhimurium LT2
acgugauuucaugcggugca

SEQ ID NO: 3749959 - RNA, 14 nt, Salmonella typhimurium LT2
acgugcauaaagcg

SEQ ID NO: 3749960 - RNA, 22 nt, Salmonella typhimurium LT2
acgugcauuauuuuagugaaaa

SEQ ID NO: 3749961 - RNA, 17 nt, Salmonella typhimurium LT2
acgugcucaaucgccug

SEQ ID NO: 3749962 - RNA, 20 nt, Salmonella typhimurium LT2
acgugcuguggaaaaucagc

SEQ ID NO: 3749963 - RNA, 17 nt, Salmonella typhimurium LT2
acguggaguccgaggca

SEQ ID NO: 3749964 - RNA, 15 nt, Salmonella typhimurium LT2
acguggccagcaugc

SEQ ID NO: 3749965 - RNA, 17 nt, Salmonella typhimurium LT2
acguggggguucaaguc

SEQ ID NO: 3749966 - RNA, 22 nt, Salmonella typhimurium LT2
acguuaaagccgaccaucgcgc

SEQ ID NO: 3749967 - RNA, 13 nt, Salmonella typhimurium LT2
acguuaacucauu

SEQ ID NO: 3749968 - RNA, 15 nt, Salmonella typhimurium LT2
acguuagccucgguc

SEQ ID NO: 3749969 - RNA, 20 nt, Salmonella typhimurium LT2
acguuauuggcccccaucgc

SEQ ID NO: 3749970 - RNA, 24 nt, Salmonella typhimurium LT2
acguuauuggcccccaucgccagc

SEQ ID NO: 3749971 - RNA, 23 nt, Salmonella typhimurium LT2
acguucagcauauccagcgccug

SEQ ID NO: 3749972 - RNA, 13 nt, Salmonella typhimurium LT2
acguucagcgcgg

SEQ ID NO: 3749973 - RNA, 22 nt, Salmonella typhimurium LT2
acguucagcgcgguacggccca

SEQ ID NO: 3749974 - RNA, 20 nt, Salmonella typhimurium LT2
acguucagggauaccacgcc

SEQ ID NO: 3749975 - RNA, 19 nt, Salmonella typhimurium LT2
acguucaucaggccugcaa

SEQ ID NO: 3749976 - RNA, 15 nt, Salmonella typhimurium LT2
acguucaucauuuuc

SEQ ID NO: 3749977 - RNA, 17 nt, Salmonella typhimurium LT2
acguucaucauuuuccc

SEQ ID NO: 3749978 - RNA, 18 nt, Salmonella typhimurium LT2
acguucaucauuuuccca

SEQ ID NO: 3749979 - RNA, 15 nt, Salmonella typhimurium LT2
acguuccgcaaucgc

SEQ ID NO: 3749980 - RNA, 14 nt, Salmonella typhimurium LT2
acguucgaugauuu

SEQ ID NO: 3749981 - RNA, 19 nt, Salmonella typhimurium LT2
acguucggcaaaacgccgc

SEQ ID NO: 3749982 - RNA, 21 nt, Salmonella typhimurium LT2
acguucggcguguagccaauc

SEQ ID NO: 3749983 - RNA, 13 nt, Salmonella typhimurium LT2
acguucuucgaua

SEQ ID NO: 3749984 - RNA, 12 nt, Salmonella typhimurium LT2
acguucuucucc

SEQ ID NO: 3749985 - RNA, 17 nt, Salmonella typhimurium LT2
acguugaucgccaucgc

SEQ ID NO: 3749986 - RNA, 18 nt, Salmonella typhimurium LT2
acguuggggauaaccaga

SEQ ID NO: 3749987 - RNA, 16 nt, Salmonella typhimurium LT2
acguugucccaggcca

SEQ ID NO: 3749988 - RNA, 22 nt, Salmonella typhimurium LT2
acguugucggcucauccagcag

SEQ ID NO: 3749989 - RNA, 14 nt, Salmonella typhimurium LT2
acguugugaugaac

SEQ ID NO: 3749990 - RNA, 19 nt, Salmonella typhimurium LT2
acguuguucgcuucuucua

SEQ ID NO: 3749991 - RNA, 11 nt, Salmonella typhimurium LT2
acguuuccccg

SEQ ID NO: 3749992 - RNA, 15 nt, Salmonella typhimurium LT2
acguuucgcuaucgc

SEQ ID NO: 3749993 - RNA, 22 nt, Salmonella typhimurium LT2
acguuucucaugcguaaaucgc

SEQ ID NO: 3749994 - RNA, 16 nt, Salmonella typhimurium LT2
acguuugaacagcagc

SEQ ID NO: 3749995 - RNA, 18 nt, Salmonella typhimurium LT2
acguuugaccugcagcuc

SEQ ID NO: 3749996 - RNA, 19 nt, Salmonella typhimurium LT2
acguuugccggugccauuc

SEQ ID NO: 3749997 - RNA, 21 nt, Salmonella typhimurium LT2
acguuuggcuuauccgcgugg

SEQ ID NO: 3749998 - RNA, 16 nt, Salmonella typhimurium LT2
acguuuguaacagcag

SEQ ID NO: 3749999 - RNA, 13 nt, Salmonella typhimurium LT2
acguuuuccugcg

SEQ ID NO: 3750000 - RNA, 16 nt, Salmonella typhimurium LT2
acguuuuuagcagugc

SEQ ID NO: 3750001 - RNA, 17 nt, Salmonella typhimurium LT2
acguuuuucagccgcgc

SEQ ID NO: 3750002 - RNA, 22 nt, Salmonella typhimurium LT2
acuaaaauacucacuaucacac

SEQ ID NO: 3750003 - RNA, 23 nt, Salmonella typhimurium LT2
acuaaaauacucacuaucacacu

SEQ ID NO: 3750004 - RNA, 20 nt, Salmonella typhimurium LT2
acuaaacuaaugccuggcag

SEQ ID NO: 3750005 - RNA, 21 nt, Salmonella typhimurium LT2
acuaaacuaaugccuggcagu

SEQ ID NO: 3750006 - RNA, 22 nt, Salmonella typhimurium LT2
acuaaagcgaauuguuugaaaa

SEQ ID NO: 3750007 - RNA, 21 nt, Salmonella typhimurium LT2
acuaaaggcagcgcgcugucu

SEQ ID NO: 3750008 - RNA, 20 nt, Salmonella typhimurium LT2
acuaaauccuugagugcugc

SEQ ID NO: 3750009 - RNA, 18 nt, Salmonella typhimurium LT2
acuaaccagcgcgguuua

SEQ ID NO: 3750010 - RNA, 21 nt, Salmonella typhimurium LT2
acuaacgugaaccuccuguga

SEQ ID NO: 3750011 - RNA, 15 nt, Salmonella typhimurium LT2
acuaacuccagcauc

SEQ ID NO: 3750012 - RNA, 19 nt, Salmonella typhimurium LT2
acuaacuccagcaucauuu

SEQ ID NO: 3750013 - RNA, 15 nt, Salmonella typhimurium LT2
acuaagaccagcauc

SEQ ID NO: 3750014 - RNA, 17 nt, Salmonella typhimurium LT2
acuaagaccagcaucag

SEQ ID NO: 3750015 - RNA, 21 nt, Salmonella typhimurium LT2
acuaagguugaaagaccuaaa

SEQ ID NO: 3750016 - RNA, 16 nt, Salmonella typhimurium LT2
acuaaguaaggaggaa

SEQ ID NO: 3750017 - RNA, 16 nt, Salmonella typhimurium LT2
acuaauccccauuuuu

SEQ ID NO: 3750018 - RNA, 20 nt, Salmonella typhimurium LT2
acuaauuaaacggaauacca

SEQ ID NO: 3750019 - RNA, 11 nt, Salmonella typhimurium LT2
acuacagcccu

SEQ ID NO: 3750020 - RNA, 18 nt, Salmonella typhimurium LT2
acuacauacgcgcaugaa

SEQ ID NO: 3750021 - RNA, 20 nt, Salmonella typhimurium LT2
acuacauagcuauauuuuuu

SEQ ID NO: 3750022 - RNA, 15 nt, Salmonella typhimurium LT2
acuacaucauucgag

SEQ ID NO: 3750023 - RNA, 20 nt, Salmonella typhimurium LT2
acuaccagcguaccgauaau

SEQ ID NO: 3750024 - RNA, 17 nt, Salmonella typhimurium LT2
acuaccggcaccagcaa

SEQ ID NO: 3750025 - RNA, 16 nt, Salmonella typhimurium LT2
acuacgccuccugccg

SEQ ID NO: 3750026 - RNA, 14 nt, Salmonella typhimurium LT2
acuacggcaaacac

SEQ ID NO: 3750027 - RNA, 15 nt, Salmonella typhimurium LT2
acuacgguaaaccag

SEQ ID NO: 3750028 - RNA, 19 nt, Salmonella typhimurium LT2
acuacuggcugguuucucc

SEQ ID NO: 3750029 - RNA, 20 nt, Salmonella typhimurium LT2
acuacuggcugguuucuccg

SEQ ID NO: 3750030 - RNA, 15 nt, Salmonella typhimurium LT2
acuagacagccucuc

SEQ ID NO: 3750031 - RNA, 13 nt, Salmonella typhimurium LT2
acuagcaaaacau

SEQ ID NO: 3750032 - RNA, 14 nt, Salmonella typhimurium LT2
acuagcauaagcac

SEQ ID NO: 3750033 - RNA, 22 nt, Salmonella typhimurium LT2
acuagcgaaucacauccgccag

SEQ ID NO: 3750034 - RNA, 23 nt, Salmonella typhimurium LT2
acuagcucagcuggauagagcau

SEQ ID NO: 3750035 - RNA, 14 nt, Salmonella typhimurium LT2
acuaguccugauau

SEQ ID NO: 3750036 - RNA, 20 nt, Salmonella typhimurium LT2
acuauaaaaauaccggcauc

SEQ ID NO: 3750037 - RNA, 15 nt, Salmonella typhimurium LT2
acuauagauauuaaa

SEQ ID NO: 3750038 - RNA, 20 nt, Salmonella typhimurium LT2
acuaucacacugacaauaaa

SEQ ID NO: 3750039 - RNA, 18 nt, Salmonella typhimurium LT2
acuaucaugaaugcccca

SEQ ID NO: 3750040 - RNA, 16 nt, Salmonella typhimurium LT2
acuauccacagcgaau

SEQ ID NO: 3750041 - RNA, 16 nt, Salmonella typhimurium LT2
acuaucccauuuuuug

SEQ ID NO: 3750042 - RNA, 23 nt, Salmonella typhimurium LT2
acuauccuuacgguuacagcauc

SEQ ID NO: 3750043 - RNA, 20 nt, Salmonella typhimurium LT2
acuauguugacgcuaaccuc

SEQ ID NO: 3750044 - RNA, 16 nt, Salmonella typhimurium LT2
acuauucuuaucauuu

SEQ ID NO: 3750045 - RNA, 16 nt, Salmonella typhimurium LT2
acuauugucgucuggu

SEQ ID NO: 3750046 - RNA, 18 nt, Salmonella typhimurium LT2
acuauuugccugaacggu

SEQ ID NO: 3750047 - RNA, 14 nt, Salmonella typhimurium LT2
acucaaaaagagga

SEQ ID NO: 3750048 - RNA, 15 nt, Salmonella typhimurium LT2
acucaaaccugcgcc

SEQ ID NO: 3750049 - RNA, 12 nt, Salmonella typhimurium LT2
acucaaagaaaa

SEQ ID NO: 3750050 - RNA, 14 nt, Salmonella typhimurium LT2
acucaaagaaaaca

SEQ ID NO: 3750051 - RNA, 12 nt, Salmonella typhimurium LT2
acucaacaucau

SEQ ID NO: 3750052 - RNA, 22 nt, Salmonella typhimurium LT2
acucaacgcccgcuuucaccau

SEQ ID NO: 3750053 - RNA, 17 nt, Salmonella typhimurium LT2
acucaacggucaaaaua

SEQ ID NO: 3750054 - RNA, 20 nt, Salmonella typhimurium LT2
acucaaggcuauuagccaaa

SEQ ID NO: 3750055 - RNA, 22 nt, Salmonella typhimurium LT2
acucaaggcuauuagccaaagc

SEQ ID NO: 3750056 - RNA, 22 nt, Salmonella typhimurium LT2
acucaaugacgacuaaaaaaau

SEQ ID NO: 3750057 - RNA, 11 nt, Salmonella typhimurium LT2
acucacauuca

SEQ ID NO: 3750058 - RNA, 21 nt, Salmonella typhimurium LT2
acucacauucauaaaagauca

SEQ ID NO: 3750059 - RNA, 17 nt, Salmonella typhimurium LT2
acucaccgcuaauccca

SEQ ID NO: 3750060 - RNA, 23 nt, Salmonella typhimurium LT2
acucaccgcuaaucccagcgcgc

SEQ ID NO: 3750061 - RNA, 19 nt, Salmonella typhimurium LT2
acucaccugaugcgaugaa

SEQ ID NO: 3750062 - RNA, 18 nt, Salmonella typhimurium LT2
acucacgacuuucaccag

SEQ ID NO: 3750063 - RNA, 20 nt, Salmonella typhimurium LT2
acucacgcaacaacaggcca

SEQ ID NO: 3750064 - RNA, 21 nt, Salmonella typhimurium LT2
acucacgcaacaacaggccag

SEQ ID NO: 3750065 - RNA, 12 nt, Salmonella typhimurium LT2
acucacgggcgu

SEQ ID NO: 3750066 - RNA, 20 nt, Salmonella typhimurium LT2
acucacgggcguagucagcg

SEQ ID NO: 3750067 - RNA, 15 nt, Salmonella typhimurium LT2
acucacgguuuuuau

SEQ ID NO: 3750068 - RNA, 15 nt, Salmonella typhimurium LT2
acucacuugucuucu

SEQ ID NO: 3750069 - RNA, 11 nt, Salmonella typhimurium LT2
acucagcaaua

SEQ ID NO: 3750070 - RNA, 15 nt, Salmonella typhimurium LT2
acucagcacauucag

SEQ ID NO: 3750071 - RNA, 13 nt, Salmonella typhimurium LT2
acucagccagguc

SEQ ID NO: 3750072 - RNA, 21 nt, Salmonella typhimurium LT2
acucagggaacguugcgccau

SEQ ID NO: 3750073 - RNA, 14 nt, Salmonella typhimurium LT2
acucagggcgaaaa

SEQ ID NO: 3750074 - RNA, 22 nt, Salmonella typhimurium LT2
acucagggugacagaagagaga

SEQ ID NO: 3750075 - RNA, 17 nt, Salmonella typhimurium LT2
acucaguuuccagccag

SEQ ID NO: 3750076 - RNA, 20 nt, Salmonella typhimurium LT2
acucaucacagccacacugc

SEQ ID NO: 3750077 - RNA, 21 nt, Salmonella typhimurium LT2
acucaucacagccacacugcu

SEQ ID NO: 3750078 - RNA, 14 nt, Salmonella typhimurium LT2
acucauccagacca

SEQ ID NO: 3750079 - RNA, 15 nt, Salmonella typhimurium LT2
acucauccagcaaaa

SEQ ID NO: 3750080 - RNA, 16 nt, Salmonella typhimurium LT2
acucaucgccgcaaug

SEQ ID NO: 3750081 - RNA, 18 nt, Salmonella typhimurium LT2
acucaucgccgcaaugac

SEQ ID NO: 3750082 - RNA, 20 nt, Salmonella typhimurium LT2
acucaucgucauccauccac

SEQ ID NO: 3750083 - RNA, 12 nt, Salmonella typhimurium LT2
acucaugcgccu

SEQ ID NO: 3750084 - RNA, 21 nt, Salmonella typhimurium LT2
acucauuaccggcugccgaua

SEQ ID NO: 3750085 - RNA, 12 nt, Salmonella typhimurium LT2
acuccacccgga

SEQ ID NO: 3750086 - RNA, 17 nt, Salmonella typhimurium LT2
acuccacccggagcaag

SEQ ID NO: 3750087 - RNA, 19 nt, Salmonella typhimurium LT2
acuccacggaaucacggca

SEQ ID NO: 3750088 - RNA, 14 nt, Salmonella typhimurium LT2
acuccagaauauug

SEQ ID NO: 3750089 - RNA, 11 nt, Salmonella typhimurium LT2
acuccagaccu

SEQ ID NO: 3750090 - RNA, 12 nt, Salmonella typhimurium LT2
acuccagacgau

SEQ ID NO: 3750091 - RNA, 12 nt, Salmonella typhimurium LT2
acuccagcacgu

SEQ ID NO: 3750092 - RNA, 17 nt, Salmonella typhimurium LT2
acuccagcacguccugg

SEQ ID NO: 3750093 - RNA, 15 nt, Salmonella typhimurium LT2
acuccagcagggcgu

SEQ ID NO: 3750094 - RNA, 15 nt, Salmonella typhimurium LT2
acuccagcccaucag

SEQ ID NO: 3750095 - RNA, 21 nt, Salmonella typhimurium LT2
acuccagcccaucagucccca

SEQ ID NO: 3750096 - RNA, 14 nt, Salmonella typhimurium LT2
acuccagcggcagg

SEQ ID NO: 3750097 - RNA, 22 nt, Salmonella typhimurium LT2
acuccaggaacaggcccgccag

SEQ ID NO: 3750098 - RNA, 17 nt, Salmonella typhimurium LT2
acuccaggcguuuauga

SEQ ID NO: 3750099 - RNA, 19 nt, Salmonella typhimurium LT2
acuccauaauuugaaucgc

SEQ ID NO: 3750100 - RNA, 16 nt, Salmonella typhimurium LT2
acuccauucccagcuc

SEQ ID NO: 3750101 - RNA, 18 nt, Salmonella typhimurium LT2
acuccauucccagcucuu

SEQ ID NO: 3750102 - RNA, 15 nt, Salmonella typhimurium LT2
acuccauugucggca

SEQ ID NO: 3750103 - RNA, 12 nt, Salmonella typhimurium LT2
acucccaaauuu

SEQ ID NO: 3750104 - RNA, 18 nt, Salmonella typhimurium LT2
acucccccagauucugau

SEQ ID NO: 3750105 - RNA, 17 nt, Salmonella typhimurium LT2
acucccccuuuuuacua

SEQ ID NO: 3750106 - RNA, 13 nt, Salmonella typhimurium LT2
acuccccugcaga

SEQ ID NO: 3750107 - RNA, 23 nt, Salmonella typhimurium LT2
acucccgcacgcuggcaucaaua

SEQ ID NO: 3750108 - RNA, 16 nt, Salmonella typhimurium LT2
acucccgcguagcguu

SEQ ID NO: 3750109 - RNA, 19 nt, Salmonella typhimurium LT2
acucccuggugacgcgcau

SEQ ID NO: 3750110 - RNA, 17 nt, Salmonella typhimurium LT2
acucccuugccagcgca

SEQ ID NO: 3750111 - RNA, 22 nt, Salmonella typhimurium LT2
acuccgccggcgcggaagggau

SEQ ID NO: 3750112 - RNA, 16 nt, Salmonella typhimurium LT2
acuccgcuauaaaaau

SEQ ID NO: 3750113 - RNA, 15 nt, Salmonella typhimurium LT2
acuccugggcaaaau

SEQ ID NO: 3750114 - RNA, 12 nt, Salmonella typhimurium LT2
acuccuuuuacc

SEQ ID NO: 3750115 - RNA, 19 nt, Salmonella typhimurium LT2
acucgaagcggucagugau

SEQ ID NO: 3750116 - RNA, 19 nt, Salmonella typhimurium LT2
acucgaggaacuguucagc

SEQ ID NO: 3750117 - RNA, 13 nt, Salmonella typhimurium LT2
acucgauucccau

SEQ ID NO: 3750118 - RNA, 15 nt, Salmonella typhimurium LT2
acucgcccagcgccu

SEQ ID NO: 3750119 - RNA, 21 nt, Salmonella typhimurium LT2
acucgcgcagaaucagcgugc

SEQ ID NO: 3750120 - RNA, 14 nt, Salmonella typhimurium LT2
acucgcgcuucagc

SEQ ID NO: 3750121 - RNA, 16 nt, Salmonella typhimurium LT2
acucgcugcgcucgcc

SEQ ID NO: 3750122 - RNA, 19 nt, Salmonella typhimurium LT2
acucgcuguacuucccucu

SEQ ID NO: 3750123 - RNA, 16 nt, Salmonella typhimurium LT2
acucggcgaucaccac

SEQ ID NO: 3750124 - RNA, 22 nt, Salmonella typhimurium LT2
acucggugccgcugcugaccuu

SEQ ID NO: 3750125 - RNA, 15 nt, Salmonella typhimurium LT2
acucguagccaaaau

SEQ ID NO: 3750126 - RNA, 16 nt, Salmonella typhimurium LT2
acucgucaccgaauag

SEQ ID NO: 3750127 - RNA, 15 nt, Salmonella typhimurium LT2
acucgugaagaucag

SEQ ID NO: 3750128 - RNA, 18 nt, Salmonella typhimurium LT2
acucgugaagaucagcag

SEQ ID NO: 3750129 - RNA, 17 nt, Salmonella typhimurium LT2
acucuauuaaaauaaau

SEQ ID NO: 3750130 - RNA, 20 nt, Salmonella typhimurium LT2
acucuauuaaaauaaauuaa

SEQ ID NO: 3750131 - RNA, 12 nt, Salmonella typhimurium LT2
acucuccagcau

SEQ ID NO: 3750132 - RNA, 12 nt, Salmonella typhimurium LT2
acucucccaacu

SEQ ID NO: 3750133 - RNA, 14 nt, Salmonella typhimurium LT2
acucucccaacugu

SEQ ID NO: 3750134 - RNA, 21 nt, Salmonella typhimurium LT2
acucucccaucaauaagcgaa

SEQ ID NO: 3750135 - RNA, 15 nt, Salmonella typhimurium LT2
acucucccggcgccc

SEQ ID NO: 3750136 - RNA, 18 nt, Salmonella typhimurium LT2
acucucgcgaauagugau

SEQ ID NO: 3750137 - RNA, 15 nt, Salmonella typhimurium LT2
acucucucuguaaua

SEQ ID NO: 3750138 - RNA, 20 nt, Salmonella typhimurium LT2
acucucucuguaauaauuaa

SEQ ID NO: 3750139 - RNA, 16 nt, Salmonella typhimurium LT2
acucugagcauacaca

SEQ ID NO: 3750140 - RNA, 13 nt, Salmonella typhimurium LT2
acucuucaucgcg

SEQ ID NO: 3750141 - RNA, 21 nt, Salmonella typhimurium LT2
acucuuccaccacggcaaaaa

SEQ ID NO: 3750142 - RNA, 22 nt, Salmonella typhimurium LT2
acucuuccagcugcucuucuug

SEQ ID NO: 3750143 - RNA, 16 nt, Salmonella typhimurium LT2
acucuuccgcaaucac

SEQ ID NO: 3750144 - RNA, 19 nt, Salmonella typhimurium LT2
acucuuccgggcugacaua

SEQ ID NO: 3750145 - RNA, 17 nt, Salmonella typhimurium LT2
acucuucgacauauuua

SEQ ID NO: 3750146 - RNA, 20 nt, Salmonella typhimurium LT2
acucuucggcuuccggcagc

SEQ ID NO: 3750147 - RNA, 16 nt, Salmonella typhimurium LT2
acucuuguaggcccga

SEQ ID NO: 3750148 - RNA, 16 nt, Salmonella typhimurium LT2
acucuuucggcgccug

SEQ ID NO: 3750149 - RNA, 15 nt, Salmonella typhimurium LT2
acucuuuugcagcaa

SEQ ID NO: 3750150 - RNA, 23 nt, Salmonella typhimurium LT2
acucuuuuuccgcgagagaaaaa

SEQ ID NO: 3750151 - RNA, 15 nt, Salmonella typhimurium LT2
acugaaaaucaaaua

SEQ ID NO: 3750152 - RNA, 14 nt, Salmonella typhimurium LT2
acugaaauaacucu

SEQ ID NO: 3750153 - RNA, 17 nt, Salmonella typhimurium LT2
acugaacccggguaggc

SEQ ID NO: 3750154 - RNA, 20 nt, Salmonella typhimurium LT2
acugaagauaaacagcagcg

SEQ ID NO: 3750155 - RNA, 16 nt, Salmonella typhimurium LT2
acugaagguuuuuccc

SEQ ID NO: 3750156 - RNA, 20 nt, Salmonella typhimurium LT2
acugaauuacugcguaaacc

SEQ ID NO: 3750157 - RNA, 17 nt, Salmonella typhimurium LT2
acugaauuaucaggguu

SEQ ID NO: 3750158 - RNA, 17 nt, Salmonella typhimurium LT2
acuguuagcgaaacugc

SEQ ID NO: 3750159 - RNA, 19 nt, Salmonella typhimurium LT2
acuguuagcgaaacugccu

SEQ ID NO: 3750160 - RNA, 21 nt, Salmonella typhimurium LT2
acuguucaucaaagaaaacca

SEQ ID NO: 3750161 - RNA, 17 nt, Salmonella typhimurium LT2
acuguucggcggggauc

SEQ ID NO: 3750162 - RNA, 20 nt, Salmonella typhimurium LT2
acuguugaaagccccggcuc

SEQ ID NO: 3750163 - RNA, 15 nt, Salmonella typhimurium LT2
acuguugcaguuuac

SEQ ID NO: 3750164 - RNA, 15 nt, Salmonella typhimurium LT2
acuguugcgccagca

SEQ ID NO: 3750165 - RNA, 14 nt, Salmonella typhimurium LT2
acuguuuaaugcuu

SEQ ID NO: 3750166 - RNA, 14 nt, Salmonella typhimurium LT2
acuguuugcugaca

SEQ ID NO: 3750167 - RNA, 19 nt, Salmonella typhimurium LT2
acuguuuuaccaaaucaau

SEQ ID NO: 3750168 - RNA, 20 nt, Salmonella typhimurium LT2
acuguuuuaccaaaucaaua

SEQ ID NO: 3750169 - RNA, 11 nt, Salmonella typhimurium LT2
acuuaaaaaca

SEQ ID NO: 3750170 - RNA, 22 nt, Salmonella typhimurium LT2
acuuaaacgccggauuccagaa

SEQ ID NO: 3750171 - RNA, 12 nt, Salmonella typhimurium LT2
acuuaaauaaaa

SEQ ID NO: 3750172 - RNA, 21 nt, Salmonella typhimurium LT2
acuuacccagagucaccagca

SEQ ID NO: 3750173 - RNA, 16 nt, Salmonella typhimurium LT2
acuuaccgggcaucug

SEQ ID NO: 3750174 - RNA, 13 nt, Salmonella typhimurium LT2
acuuacugcuguc

SEQ ID NO: 3750175 - RNA, 15 nt, Salmonella typhimurium LT2
acuuacuguuucacg

SEQ ID NO: 3750176 - RNA, 16 nt, Salmonella typhimurium LT2
acuuagaacgcggaag

SEQ ID NO: 3750177 - RNA, 17 nt, Salmonella typhimurium LT2
acuuagcccaggccaau

SEQ ID NO: 3750178 - RNA, 16 nt, Salmonella typhimurium LT2
acuuaucaacuucuuc

SEQ ID NO: 3750179 - RNA, 16 nt, Salmonella typhimurium LT2
acuuauugcaagaaau

SEQ ID NO: 3750180 - RNA, 18 nt, Salmonella typhimurium LT2
acuuauuuggguaauaaa

SEQ ID NO: 3750181 - RNA, 15 nt, Salmonella typhimurium LT2
acuucaaucgccaaa

SEQ ID NO: 3750182 - RNA, 18 nt, Salmonella typhimurium LT2
acuucaauuuuccagaua

SEQ ID NO: 3750183 - RNA, 13 nt, Salmonella typhimurium LT2
acuucacaaacaa

SEQ ID NO: 3750184 - RNA, 14 nt, Salmonella typhimurium LT2
acuucacgcugcau

SEQ ID NO: 3750185 - RNA, 15 nt, Salmonella typhimurium LT2
acuucacgcugcaua

SEQ ID NO: 3750186 - RNA, 16 nt, Salmonella typhimurium LT2
acuucacuuucaagcc

SEQ ID NO: 3750187 - RNA, 14 nt, Salmonella typhimurium LT2
acuucagccagcug

SEQ ID NO: 3750188 - RNA, 19 nt, Salmonella typhimurium LT2
acuucauccggauaaagcc

SEQ ID NO: 3750189 - RNA, 20 nt, Salmonella typhimurium LT2
acuucaucgccacagacgaa

SEQ ID NO: 3750190 - RNA, 18 nt, Salmonella typhimurium LT2
acuuccaacuaaagcgaa

SEQ ID NO: 3750191 - RNA, 10 nt, Salmonella typhimurium LT2
acuuccagcg

SEQ ID NO: 3750192 - RNA, 22 nt, Salmonella typhimurium LT2
acuuccagcgcgccgucaucgc

SEQ ID NO: 3750193 - RNA, 17 nt, Salmonella typhimurium LT2
acuuccccuguaacugc

SEQ ID NO: 3750194 - RNA, 19 nt, Salmonella typhimurium LT2
acuuccggcgaugccacca

SEQ ID NO: 3750195 - RNA, 20 nt, Salmonella typhimurium LT2
acuuccggcucgccacggcc

SEQ ID NO: 3750196 - RNA, 17 nt, Salmonella typhimurium LT2
acuuccuuugccuuucu

SEQ ID NO: 3750197 - RNA, 19 nt, Salmonella typhimurium LT2
acuucgagaagccagccau

SEQ ID NO: 3750198 - RNA, 20 nt, Salmonella typhimurium LT2
acuucgccgggauaaaacac

SEQ ID NO: 3750199 - RNA, 15 nt, Salmonella typhimurium LT2
acuucgcuuccugca

SEQ ID NO: 3750200 - RNA, 12 nt, Salmonella typhimurium LT2
acuucuaauuuu

SEQ ID NO: 3750201 - RNA, 15 nt, Salmonella typhimurium LT2
acuucuaauuuuucc

SEQ ID NO: 3750202 - RNA, 17 nt, Salmonella typhimurium LT2
acuucuccugccaguau

SEQ ID NO: 3750203 - RNA, 14 nt, Salmonella typhimurium LT2
acuugaccagcacu

SEQ ID NO: 3750204 - RNA, 17 nt, Salmonella typhimurium LT2
acuugacgcuuugcauu

SEQ ID NO: 3750205 - RNA, 14 nt, Salmonella typhimurium LT2
acuugauggaaaac

SEQ ID NO: 3750206 - RNA, 13 nt, Salmonella typhimurium LT2
acuugcgccgcca

SEQ ID NO: 3750207 - RNA, 19 nt, Salmonella typhimurium LT2
acuugcgccgccauccggc

SEQ ID NO: 3750208 - RNA, 20 nt, Salmonella typhimurium LT2
acuugcugcuaugaaaaauc

SEQ ID NO: 3750209 - RNA, 17 nt, Salmonella typhimurium LT2
acuuggcgaucaccagc

SEQ ID NO: 3750210 - RNA, 10 nt, Salmonella typhimurium LT2
acuuguauag

SEQ ID NO: 3750211 - RNA, 18 nt, Salmonella typhimurium LT2
acuuguauagacaaguau

SEQ ID NO: 3750212 - RNA, 14 nt, Salmonella typhimurium LT2
acuuuaagcggcag

SEQ ID NO: 3750213 - RNA, 16 nt, Salmonella typhimurium LT2
acuuuaccgcucacaa

SEQ ID NO: 3750214 - RNA, 18 nt, Salmonella typhimurium LT2
acuuuaccgucagccacu

SEQ ID NO: 3750215 - RNA, 22 nt, Salmonella typhimurium LT2
acuuuacugaauaacagcacca

SEQ ID NO: 3750216 - RNA, 13 nt, Salmonella typhimurium LT2
acuuuauaaauca

SEQ ID NO: 3750217 - RNA, 12 nt, Salmonella typhimurium LT2
acuuuauucucu

SEQ ID NO: 3750218 - RNA, 12 nt, Salmonella typhimurium LT2
acuuucagauuu

SEQ ID NO: 3750219 - RNA, 17 nt, Salmonella typhimurium LT2
acuuuccaaaauccagg

SEQ ID NO: 3750220 - RNA, 19 nt, Salmonella typhimurium LT2
acuuuccaaaauccaggga

SEQ ID NO: 3750221 - RNA, 22 nt, Salmonella typhimurium LT2
acuuuccagccccuucgcuguc

SEQ ID NO: 3750222 - RNA, 19 nt, Salmonella typhimurium LT2
acuuuccuggcugucggca

SEQ ID NO: 3750223 - RNA, 23 nt, Salmonella typhimurium LT2
acuuucgcccggcgccagcucaa

SEQ ID NO: 3750224 - RNA, 13 nt, Salmonella typhimurium LT2
acuuucuacaaau

SEQ ID NO: 3750225 - RNA, 17 nt, Salmonella typhimurium LT2
acuuucuccaugccaga

SEQ ID NO: 3750226 - RNA, 18 nt, Salmonella typhimurium LT2
acuuucuccaugccagaa

SEQ ID NO: 3750227 - RNA, 22 nt, Salmonella typhimurium LT2
acuuucucggcuuuccagcuca

SEQ ID NO: 3750228 - RNA, 17 nt, Salmonella typhimurium LT2
acuuucucuccuucacg

SEQ ID NO: 3750229 - RNA, 17 nt, Salmonella typhimurium LT2
acuuucuugccacuggc

SEQ ID NO: 3750230 - RNA, 21 nt, Salmonella typhimurium LT2
acuuucuuuugauacucugcu

SEQ ID NO: 3750231 - RNA, 15 nt, Salmonella typhimurium LT2
acuuugaccagcauc

SEQ ID NO: 3750232 - RNA, 14 nt, Salmonella typhimurium LT2
acuuugccagaggc

SEQ ID NO: 3750233 - RNA, 20 nt, Salmonella typhimurium LT2
acuuugcccuuuuugcauuc

SEQ ID NO: 3750234 - RNA, 17 nt, Salmonella typhimurium LT2
acuuugcgccggcaguc

SEQ ID NO: 3750235 - RNA, 23 nt, Salmonella typhimurium LT2
acuuugcucaccacgucauccgg

SEQ ID NO: 3750236 - RNA, 19 nt, Salmonella typhimurium LT2
acuuuggauaaagccaaug

SEQ ID NO: 3750237 - RNA, 18 nt, Salmonella typhimurium LT2
acuuuuacuuucaagaca

SEQ ID NO: 3750238 - RNA, 12 nt, Salmonella typhimurium LT2
acuuuucugcgu

SEQ ID NO: 3750239 - RNA, 13 nt, Salmonella typhimurium LT2
acuuuugaacaua

SEQ ID NO: 3750240 - RNA, 14 nt, Salmonella typhimurium LT2
acuuuugccaggcg

SEQ ID NO: 3750241 - RNA, 22 nt, Salmonella typhimurium LT2
acuuuugccaggcggauaaaac

SEQ ID NO: 3750242 - RNA, 20 nt, Salmonella typhimurium LT2
acuuuuguagagauccagaa

SEQ ID NO: 3750243 - RNA, 20 nt, Salmonella typhimurium LT2
acuuuuucucuuaucgccgc

SEQ ID NO: 3750244 - RNA, 22 nt, Salmonella typhimurium LT2
acuuuuugaucuaaaaauuaca

SEQ ID NO: 3750245 - RNA, 22 nt, Salmonella typhimurium LT2
acuuuuugcugaacguauggca

SEQ ID NO: 3750246 - RNA, 22 nt, Salmonella typhimurium LT2
acuuuuuuauggccaaccagau

SEQ ID NO: 3750247 - RNA, 20 nt, Salmonella typhimurium LT2
acuuuuuugccgagguggua

SEQ ID NO: 3750248 - RNA, 18 nt, Salmonella typhimurium LT2
agaaaaaauuaaaauuca

SEQ ID NO: 3750249 - RNA, 17 nt, Salmonella typhimurium LT2
agaaaaagaagaaaaaa

SEQ ID NO: 3750250 - RNA, 22 nt, Salmonella typhimurium LT2
agaaaaagaccgacaucgccag

SEQ ID NO: 3750251 - RNA, 18 nt, Salmonella typhimurium LT2
agaaaaccagaccuccac

SEQ ID NO: 3750252 - RNA, 18 nt, Salmonella typhimurium LT2
agaaaaccgacagcaaua

SEQ ID NO: 3750253 - RNA, 18 nt, Salmonella typhimurium LT2
agaaaacgcaauaaccgu

SEQ ID NO: 3750254 - RNA, 17 nt, Salmonella typhimurium LT2
agaaaagcgaaaauaaa

SEQ ID NO: 3750255 - RNA, 19 nt, Salmonella typhimurium LT2
agaaaauagaggaaauaac

SEQ ID NO: 3750256 - RNA, 20 nt, Salmonella typhimurium LT2
agaaaauuaacgacaaaaau

SEQ ID NO: 3750257 - RNA, 17 nt, Salmonella typhimurium LT2
agaaaauuauuuuaaau

SEQ ID NO: 3750258 - RNA, 18 nt, Salmonella typhimurium LT2
agaaacaacacgaucgau

SEQ ID NO: 3750259 - RNA, 14 nt, Salmonella typhimurium LT2
agaaacaccagaau

SEQ ID NO: 3750260 - RNA, 15 nt, Salmonella typhimurium LT2
agaaacaccagaaug

SEQ ID NO: 3750261 - RNA, 16 nt, Salmonella typhimurium LT2
agaaaccgcagaaaaa

SEQ ID NO: 3750262 - RNA, 16 nt, Salmonella typhimurium LT2
agaauuugaacucuuu

SEQ ID NO: 3750263 - RNA, 17 nt, Salmonella typhimurium LT2
agaauuuguugguuuaa

SEQ ID NO: 3750264 - RNA, 15 nt, Salmonella typhimurium LT2
agacaaaaaagcugc

SEQ ID NO: 3750265 - RNA, 12 nt, Salmonella typhimurium LT2
agacaaaaaugg

SEQ ID NO: 3750266 - RNA, 15 nt, Salmonella typhimurium LT2
agacaaaguugacuu

SEQ ID NO: 3750267 - RNA, 23 nt, Salmonella typhimurium LT2
agacaaaguugacuuuuacgcca

SEQ ID NO: 3750268 - RNA, 14 nt, Salmonella typhimurium LT2
agacaacauccaga

SEQ ID NO: 3750269 - RNA, 17 nt, Salmonella typhimurium LT2
agacaaccagcagggca

SEQ ID NO: 3750270 - RNA, 20 nt, Salmonella typhimurium LT2
agacaacccgucaccgccag

SEQ ID NO: 3750271 - RNA, 17 nt, Salmonella typhimurium LT2
agacaaguauaugucug

SEQ ID NO: 3750272 - RNA, 19 nt, Salmonella typhimurium LT2
agacaauccgcggcaaauc

SEQ ID NO: 3750273 - RNA, 17 nt, Salmonella typhimurium LT2
agacagacaaccagcag

SEQ ID NO: 3750274 - RNA, 18 nt, Salmonella typhimurium LT2
agacagacaaccagcagg

SEQ ID NO: 3750275 - RNA, 22 nt, Salmonella typhimurium LT2
agacagcccuauaacagcgcca

SEQ ID NO: 3750276 - RNA, 21 nt, Salmonella typhimurium LT2
agacagcuuauacugauaucu

SEQ ID NO: 3750277 - RNA, 20 nt, Salmonella typhimurium LT2
agacaggcaugguuaacaau

SEQ ID NO: 3750278 - RNA, 20 nt, Salmonella typhimurium LT2
agacaggccuucuucauauu

SEQ ID NO: 3750279 - RNA, 22 nt, Salmonella typhimurium LT2
agacaggugaacauuacaaugu

SEQ ID NO: 3750280 - RNA, 19 nt, Salmonella typhimurium LT2
agacagucucauugaucag

SEQ ID NO: 3750281 - RNA, 24 nt, Salmonella typhimurium LT2
agacaguggccaucuuccagcauc

SEQ ID NO: 3750282 - RNA, 21 nt, Salmonella typhimurium LT2
agacauacgggaauuccaguc

SEQ ID NO: 3750283 - RNA, 21 nt, Salmonella typhimurium LT2
agacaucggagauuucauccu

SEQ ID NO: 3750284 - RNA, 23 nt, Salmonella typhimurium LT2
agacaucggucagaccguaaauc

SEQ ID NO: 3750285 - RNA, 12 nt, Salmonella typhimurium LT2
agacaugaccgc

SEQ ID NO: 3750286 - RNA, 19 nt, Salmonella typhimurium LT2
agacaugaccgcacagcag

SEQ ID NO: 3750287 - RNA, 19 nt, Salmonella typhimurium LT2
agacauugguuucaugcau

SEQ ID NO: 3750288 - RNA, 23 nt, Salmonella typhimurium LT2
agacauuugauuccagccuugcu

SEQ ID NO: 3750289 - RNA, 17 nt, Salmonella typhimurium LT2
agaccacgaaucaggau

SEQ ID NO: 3750290 - RNA, 15 nt, Salmonella typhimurium LT2
agaccauccaugaaa

SEQ ID NO: 3750291 - RNA, 23 nt, Salmonella typhimurium LT2
agacccacauauugcgcuucacu

SEQ ID NO: 3750292 - RNA, 19 nt, Salmonella typhimurium LT2
agacccaguacaaacaaau

SEQ ID NO: 3750293 - RNA, 20 nt, Salmonella typhimurium LT2
agaccccaguaauccggcaa

SEQ ID NO: 3750294 - RNA, 17 nt, Salmonella typhimurium LT2
agacccgacaguaaaac

SEQ ID NO: 3750295 - RNA, 14 nt, Salmonella typhimurium LT2
agaccgacgccaac

SEQ ID NO: 3750296 - RNA, 17 nt, Salmonella typhimurium LT2
agaccgacuuuuuugcc

SEQ ID NO: 3750297 - RNA, 16 nt, Salmonella typhimurium LT2
agaccgccuaacagcg

SEQ ID NO: 3750298 - RNA, 18 nt, Salmonella typhimurium LT2
agaccgccuaacagcgcc

SEQ ID NO: 3750299 - RNA, 12 nt, Salmonella typhimurium LT2
agaccggcacaa

SEQ ID NO: 3750300 - RNA, 17 nt, Salmonella typhimurium LT2
agaccggcaucucaucu

SEQ ID NO: 3750301 - RNA, 18 nt, Salmonella typhimurium LT2
agaccggcaucucaucuu

SEQ ID NO: 3750302 - RNA, 16 nt, Salmonella typhimurium LT2
agaccggcgaaaucgu

SEQ ID NO: 3750303 - RNA, 15 nt, Salmonella typhimurium LT2
agaccguggauaaga

SEQ ID NO: 3750304 - RNA, 16 nt, Salmonella typhimurium LT2
agaccguggauaagau

SEQ ID NO: 3750305 - RNA, 22 nt, Salmonella typhimurium LT2
agaccuccgcccggugcucaau

SEQ ID NO: 3750306 - RNA, 19 nt, Salmonella typhimurium LT2
agaccucguucggcgcacc

SEQ ID NO: 3750307 - RNA, 19 nt, Salmonella typhimurium LT2
agaccugccugaucgccac

SEQ ID NO: 3750308 - RNA, 20 nt, Salmonella typhimurium LT2
agaccuggggguaacacaaa

SEQ ID NO: 3750309 - RNA, 18 nt, Salmonella typhimurium LT2
agaccuuuuacuucacgu

SEQ ID NO: 3750310 - RNA, 21 nt, Salmonella typhimurium LT2
agacgaacaaacuccagcacg

SEQ ID NO: 3750311 - RNA, 21 nt, Salmonella typhimurium LT2
agacgaagaguucaacgccga

SEQ ID NO: 3750312 - RNA, 18 nt, Salmonella typhimurium LT2
agacgaagccgaagcuaa

SEQ ID NO: 3750313 - RNA, 16 nt, Salmonella typhimurium LT2
agacgaauaaucucau

SEQ ID NO: 3750314 - RNA, 20 nt, Salmonella typhimurium LT2
agacgaauaaucucaucgcc

SEQ ID NO: 3750315 - RNA, 22 nt, Salmonella typhimurium LT2
agacgacaucgcucaaaacacu

SEQ ID NO: 3750316 - RNA, 16 nt, Salmonella typhimurium LT2
agacgacaucuuuucc

SEQ ID NO: 3750317 - RNA, 15 nt, Salmonella typhimurium LT2
agacgccauaucgcc

SEQ ID NO: 3750318 - RNA, 16 nt, Salmonella typhimurium LT2
agacgccgccgcaucc

SEQ ID NO: 3750319 - RNA, 20 nt, Salmonella typhimurium LT2
agacgcgcucggcagcagcg

SEQ ID NO: 3750320 - RNA, 16 nt, Salmonella typhimurium LT2
agacgcguaaaucaga

SEQ ID NO: 3750321 - RNA, 18 nt, Salmonella typhimurium LT2
agacgcuaucguccuggc

SEQ ID NO: 3750322 - RNA, 19 nt, Salmonella typhimurium LT2
agacgcuaucguccuggcu

SEQ ID NO: 3750323 - RNA, 19 nt, Salmonella typhimurium LT2
agacgcugauagccacggc

SEQ ID NO: 3750324 - RNA, 19 nt, Salmonella typhimurium LT2
agacgcuggcacuggcagc

SEQ ID NO: 3750325 - RNA, 13 nt, Salmonella typhimurium LT2
agacgcugguugu

SEQ ID NO: 3750326 - RNA, 19 nt, Salmonella typhimurium LT2
agacgguuguuuuucagau

SEQ ID NO: 3750327 - RNA, 22 nt, Salmonella typhimurium LT2
agacgucaacaccuccaguuca

SEQ ID NO: 3750328 - RNA, 13 nt, Salmonella typhimurium LT2
agacgucauaccu

SEQ ID NO: 3750329 - RNA, 14 nt, Salmonella typhimurium LT2
agacguugggauua

SEQ ID NO: 3750330 - RNA, 20 nt, Salmonella typhimurium LT2
agacguuuacgccgccaucc

SEQ ID NO: 3750331 - RNA, 18 nt, Salmonella typhimurium LT2
agacguuuaucggccagc

SEQ ID NO: 3750332 - RNA, 14 nt, Salmonella typhimurium LT2
agacuaaaaagcgc

SEQ ID NO: 3750333 - RNA, 19 nt, Salmonella typhimurium LT2
agacuacaugccaacuuua

SEQ ID NO: 3750334 - RNA, 14 nt, Salmonella typhimurium LT2
agacuauccagcca

SEQ ID NO: 3750335 - RNA, 20 nt, Salmonella typhimurium LT2
agacuauccagccagggauc

SEQ ID NO: 3750336 - RNA, 21 nt, Salmonella typhimurium LT2
agacucaaagaaaacaucagc

SEQ ID NO: 3750337 - RNA, 18 nt, Salmonella typhimurium LT2
agacucaccccuucuuua

SEQ ID NO: 3750338 - RNA, 13 nt, Salmonella typhimurium LT2
agacucagccagg

SEQ ID NO: 3750339 - RNA, 22 nt, Salmonella typhimurium LT2
agacucagccaggucugaacca

SEQ ID NO: 3750340 - RNA, 19 nt, Salmonella typhimurium LT2
agacucaguucgcgaccca

SEQ ID NO: 3750341 - RNA, 12 nt, Salmonella typhimurium LT2
agacucaucgcc

SEQ ID NO: 3750342 - RNA, 14 nt, Salmonella typhimurium LT2
agacucaucgccgc

SEQ ID NO: 3750343 - RNA, 18 nt, Salmonella typhimurium LT2
agacucaucgccgcaaug

SEQ ID NO: 3750344 - RNA, 22 nt, Salmonella typhimurium LT2
agacucgcuucacgcggauugc

SEQ ID NO: 3750345 - RNA, 16 nt, Salmonella typhimurium LT2
agacugacgaaacacu

SEQ ID NO: 3750346 - RNA, 15 nt, Salmonella typhimurium LT2
agacugagcaaacuc

SEQ ID NO: 3750347 - RNA, 21 nt, Salmonella typhimurium LT2
agacugaucgccgcugcuggc

SEQ ID NO: 3750348 - RNA, 13 nt, Salmonella typhimurium LT2
agacugcccggca

SEQ ID NO: 3750349 - RNA, 14 nt, Salmonella typhimurium LT2
agacugugauggcg

SEQ ID NO: 3750350 - RNA, 17 nt, Salmonella typhimurium LT2
agacugugauggcgguc

SEQ ID NO: 3750351 - RNA, 21 nt, Salmonella typhimurium LT2
agacuguugaaagccccggcu

SEQ ID NO: 3750352 - RNA, 22 nt, Salmonella typhimurium LT2
agacuucaaugccgcacacuca

SEQ ID NO: 3750353 - RNA, 10 nt, Salmonella typhimurium LT2
agagaaaaaa

SEQ ID NO: 3750354 - RNA, 12 nt, Salmonella typhimurium LT2
agagaaaaaaau

SEQ ID NO: 3750355 - RNA, 17 nt, Salmonella typhimurium LT2
agagaaaaaaauccagu

SEQ ID NO: 3750356 - RNA, 23 nt, Salmonella typhimurium LT2
agagaaaaagaagaaaaaauuaa

SEQ ID NO: 3750357 - RNA, 15 nt, Salmonella typhimurium LT2
agagaaccaacguca

SEQ ID NO: 3750358 - RNA, 12 nt, Salmonella typhimurium LT2
agagaaccguuc

SEQ ID NO: 3750359 - RNA, 22 nt, Salmonella typhimurium LT2
agagaacgaaauauggcacagc

SEQ ID NO: 3750360 - RNA, 23 nt, Salmonella typhimurium LT2
agagaacgacgcauaaaaaauga

SEQ ID NO: 3750361 - RNA, 20 nt, Salmonella typhimurium LT2
agagaagcuuuuucuuuauu

SEQ ID NO: 3750362 - RNA, 14 nt, Salmonella typhimurium LT2
agagaagucugagc

SEQ ID NO: 3750363 - RNA, 16 nt, Salmonella typhimurium LT2
agagaaguguacaaac

SEQ ID NO: 3750364 - RNA, 21 nt, Salmonella typhimurium LT2
agagacucucuuuaaucaccc

SEQ ID NO: 3750365 - RNA, 22 nt, Salmonella typhimurium LT2
agaucgcuuaacaacuccagca

SEQ ID NO: 3750366 - RNA, 17 nt, Salmonella typhimurium LT2
agaucgguaauuuccac

SEQ ID NO: 3750367 - RNA, 14 nt, Salmonella typhimurium LT2
agaucguauccggc

SEQ ID NO: 3750368 - RNA, 19 nt, Salmonella typhimurium LT2
agaucguuauccagcagcc

SEQ ID NO: 3750369 - RNA, 15 nt, Salmonella typhimurium LT2
agaucucuaucggca

SEQ ID NO: 3750370 - RNA, 18 nt, Salmonella typhimurium LT2
agaucugcauccggggcg

SEQ ID NO: 3750371 - RNA, 15 nt, Salmonella typhimurium LT2
agaucugcgccgccg

SEQ ID NO: 3750372 - RNA, 16 nt, Salmonella typhimurium LT2
agaucuucuuuaaccg

SEQ ID NO: 3750373 - RNA, 21 nt, Salmonella typhimurium LT2
agaucuuuauccugcacgaag

SEQ ID NO: 3750374 - RNA, 16 nt, Salmonella typhimurium LT2
agaucuuucaccccca

SEQ ID NO: 3750375 - RNA, 21 nt, Salmonella typhimurium LT2
agaucuuucacccccagcuga

SEQ ID NO: 3750376 - RNA, 12 nt, Salmonella typhimurium LT2
agaucuuugggc

SEQ ID NO: 3750377 - RNA, 23 nt, Salmonella typhimurium LT2
agaucuuuugcgccuuccaguuc

SEQ ID NO: 3750378 - RNA, 21 nt, Salmonella typhimurium LT2
agaugaaacgugaaauauuuc

SEQ ID NO: 3750379 - RNA, 17 nt, Salmonella typhimurium LT2
agaugaacguaacguga

SEQ ID NO: 3750380 - RNA, 14 nt, Salmonella typhimurium LT2
agaugaacucgacg

SEQ ID NO: 3750381 - RNA, 15 nt, Salmonella typhimurium LT2
agaugaaugacuguc

SEQ ID NO: 3750382 - RNA, 17 nt, Salmonella typhimurium LT2
agaugagcaaaccgcaa

SEQ ID NO: 3750383 - RNA, 12 nt, Salmonella typhimurium LT2
agaugagccaca

SEQ ID NO: 3750384 - RNA, 14 nt, Salmonella typhimurium LT2
agaugaugauuuau

SEQ ID NO: 3750385 - RNA, 15 nt, Salmonella typhimurium LT2
agaugauuucuuguu

SEQ ID NO: 3750386 - RNA, 17 nt, Salmonella typhimurium LT2
agaugcauaaaaaaacg

SEQ ID NO: 3750387 - RNA, 21 nt, Salmonella typhimurium LT2
agaugcguuggcucgcugcca

SEQ ID NO: 3750388 - RNA, 16 nt, Salmonella typhimurium LT2
agauggcaagauuaac

SEQ ID NO: 3750389 - RNA, 14 nt, Salmonella typhimurium LT2
agauggcgcuaaaa

SEQ ID NO: 3750390 - RNA, 18 nt, Salmonella typhimurium LT2
agauggcgcuaaaaccgu

SEQ ID NO: 3750391 - RNA, 18 nt, Salmonella typhimurium LT2
agaugugguauuuucuau

SEQ ID NO: 3750392 - RNA, 19 nt, Salmonella typhimurium LT2
agauguucuaucuuucaga

SEQ ID NO: 3750393 - RNA, 13 nt, Salmonella typhimurium LT2
agauuaaacguga

SEQ ID NO: 3750394 - RNA, 16 nt, Salmonella typhimurium LT2
agauuaacagcgcgac

SEQ ID NO: 3750395 - RNA, 16 nt, Salmonella typhimurium LT2
agauuaacagcuucau

SEQ ID NO: 3750396 - RNA, 20 nt, Salmonella typhimurium LT2
agauuacucccuugccagcg

SEQ ID NO: 3750397 - RNA, 21 nt, Salmonella typhimurium LT2
agauuacucccuugccagcgc

SEQ ID NO: 3750398 - RNA, 23 nt, Salmonella typhimurium LT2
agauuacucccuugccagcgcau

SEQ ID NO: 3750399 - RNA, 17 nt, Salmonella typhimurium LT2
agauuagccaggugacu

SEQ ID NO: 3750400 - RNA, 16 nt, Salmonella typhimurium LT2
agauuauacucaagaa

SEQ ID NO: 3750401 - RNA, 19 nt, Salmonella typhimurium LT2
agauuaucggccagcgcca

SEQ ID NO: 3750402 - RNA, 16 nt, Salmonella typhimurium LT2
agauuauuucacuucg

SEQ ID NO: 3750403 - RNA, 19 nt, Salmonella typhimurium LT2
agauuauuuuaucaucagc

SEQ ID NO: 3750404 - RNA, 18 nt, Salmonella typhimurium LT2
agauucaaacugauaagg

SEQ ID NO: 3750405 - RNA, 16 nt, Salmonella typhimurium LT2
agauucaaccagugca

SEQ ID NO: 3750406 - RNA, 19 nt, Salmonella typhimurium LT2
agauuccgcgauccaacaa

SEQ ID NO: 3750407 - RNA, 18 nt, Salmonella typhimurium LT2
agauugaaacgaaaacug

SEQ ID NO: 3750408 - RNA, 21 nt, Salmonella typhimurium LT2
agauugaguuugauagcgcua

SEQ ID NO: 3750409 - RNA, 21 nt, Salmonella typhimurium LT2
agauugauuuauucacuggca

SEQ ID NO: 3750410 - RNA, 16 nt, Salmonella typhimurium LT2
agauugguaucugcaa

SEQ ID NO: 3750411 - RNA, 14 nt, Salmonella typhimurium LT2
agauuggucagcag

SEQ ID NO: 3750412 - RNA, 16 nt, Salmonella typhimurium LT2
agauuggucagcagcc

SEQ ID NO: 3750413 - RNA, 16 nt, Salmonella typhimurium LT2
agauuggugaugcgca

SEQ ID NO: 3750414 - RNA, 23 nt, Salmonella typhimurium LT2
agauuggugaugcgcaacguuuc

SEQ ID NO: 3750415 - RNA, 21 nt, Salmonella typhimurium LT2
agauugugcuuuagcuuuacu

SEQ ID NO: 3750416 - RNA, 20 nt, Salmonella typhimurium LT2
agauuguggaacuuuaucgc

SEQ ID NO: 3750417 - RNA, 18 nt, Salmonella typhimurium LT2
agauuuccggcaccagaa

SEQ ID NO: 3750418 - RNA, 17 nt, Salmonella typhimurium LT2
agauuucgcaacagcau

SEQ ID NO: 3750419 - RNA, 16 nt, Salmonella typhimurium LT2
agauuucggcauuuuu

SEQ ID NO: 3750420 - RNA, 13 nt, Salmonella typhimurium LT2
agauuucuuaauu

SEQ ID NO: 3750421 - RNA, 18 nt, Salmonella typhimurium LT2
agauuucuuaauuccuca

SEQ ID NO: 3750422 - RNA, 19 nt, Salmonella typhimurium LT2
agauuucuuaauuccucag

SEQ ID NO: 3750423 - RNA, 12 nt, Salmonella typhimurium LT2
agauuugggaug

SEQ ID NO: 3750424 - RNA, 20 nt, Salmonella typhimurium LT2
agauuuucaucauaucugau

SEQ ID NO: 3750425 - RNA, 19 nt, Salmonella typhimurium LT2
agauuuuucugcgccacca

SEQ ID NO: 3750426 - RNA, 12 nt, Salmonella typhimurium LT2
agcaaaaaauac

SEQ ID NO: 3750427 - RNA, 22 nt, Salmonella typhimurium LT2
agcaaaaaauaccccgaugccu

SEQ ID NO: 3750428 - RNA, 15 nt, Salmonella typhimurium LT2
agcaaaaacauuacc

SEQ ID NO: 3750429 - RNA, 17 nt, Salmonella typhimurium LT2
agcaaaaagaaucgcca

SEQ ID NO: 3750430 - RNA, 20 nt, Salmonella typhimurium LT2
agcaaaaauuucgcucagau

SEQ ID NO: 3750431 - RNA, 12 nt, Salmonella typhimurium LT2
agcaaaacacag

SEQ ID NO: 3750432 - RNA, 16 nt, Salmonella typhimurium LT2
agcaaaaguugcgauc

SEQ ID NO: 3750433 - RNA, 16 nt, Salmonella typhimurium LT2
agcaaaaucacgcaca

SEQ ID NO: 3750434 - RNA, 18 nt, Salmonella typhimurium LT2
agcaaaccgacccaaaaa

SEQ ID NO: 3750435 - RNA, 18 nt, Salmonella typhimurium LT2
agcaaaccggcaugaaga

SEQ ID NO: 3750436 - RNA, 22 nt, Salmonella typhimurium LT2
agcaaacgaccuuucgccguca

SEQ ID NO: 3750437 - RNA, 12 nt, Salmonella typhimurium LT2
agcaaagcgcca

SEQ ID NO: 3750438 - RNA, 14 nt, Salmonella typhimurium LT2
agcaaagcgccauc

SEQ ID NO: 3750439 - RNA, 19 nt, Salmonella typhimurium LT2
agcaaagcgccauccggca

SEQ ID NO: 3750440 - RNA, 22 nt, Salmonella typhimurium LT2
agcaaaggcuaccggacaaaca

SEQ ID NO: 3750441 - RNA, 14 nt, Salmonella typhimurium LT2
agcaaauaugaaga

SEQ ID NO: 3750442 - RNA, 21 nt, Salmonella typhimurium LT2
agcaaaucgcccaucacaugu

SEQ ID NO: 3750443 - RNA, 17 nt, Salmonella typhimurium LT2
agcaaaugcgcuuugau

SEQ ID NO: 3750444 - RNA, 13 nt, Salmonella typhimurium LT2
agcaaauugcuga

SEQ ID NO: 3750445 - RNA, 17 nt, Salmonella typhimurium LT2
agcaacaaaccgauaau

SEQ ID NO: 3750446 - RNA, 22 nt, Salmonella typhimurium LT2
agcaacaaaccgauaaucacca

SEQ ID NO: 3750447 - RNA, 20 nt, Salmonella typhimurium LT2
agcaacacuuugcgcugcgc

SEQ ID NO: 3750448 - RNA, 14 nt, Salmonella typhimurium LT2
agcaaccagaaugc

SEQ ID NO: 3750449 - RNA, 16 nt, Salmonella typhimurium LT2
agcaacccaccugcca

SEQ ID NO: 3750450 - RNA, 12 nt, Salmonella typhimurium LT2
agcaacccuuuu

SEQ ID NO: 3750451 - RNA, 16 nt, Salmonella typhimurium LT2
agcaacggaagcugac

SEQ ID NO: 3750452 - RNA, 18 nt, Salmonella typhimurium LT2
agcaacgggcaguccggc

SEQ ID NO: 3750453 - RNA, 22 nt, Salmonella typhimurium LT2
agcaacgugaacugcgccugca

SEQ ID NO: 3750454 - RNA, 20 nt, Salmonella typhimurium LT2
agcaacguuuguaacagcag

SEQ ID NO: 3750455 - RNA, 18 nt, Salmonella typhimurium LT2
agcaacugaccaucuucg

SEQ ID NO: 3750456 - RNA, 15 nt, Salmonella typhimurium LT2
agcaacuguagaaug

SEQ ID NO: 3750457 - RNA, 22 nt, Salmonella typhimurium LT2
agcaacuguuuuaccaaaucaa

SEQ ID NO: 3750458 - RNA, 12 nt, Salmonella typhimurium LT2
agcaagaacaga

SEQ ID NO: 3750459 - RNA, 13 nt, Salmonella typhimurium LT2
agcaagaacagag

SEQ ID NO: 3750460 - RNA, 18 nt, Salmonella typhimurium LT2
agcaagaacagagcaauu

SEQ ID NO: 3750461 - RNA, 14 nt, Salmonella typhimurium LT2
agcaauaaaaggaa

SEQ ID NO: 3750462 - RNA, 18 nt, Salmonella typhimurium LT2
agcaauaacaggcacagu

SEQ ID NO: 3750463 - RNA, 19 nt, Salmonella typhimurium LT2
agcaauaaugcgccuugag

SEQ ID NO: 3750464 - RNA, 17 nt, Salmonella typhimurium LT2
agcaauacaauuauugc

SEQ ID NO: 3750465 - RNA, 18 nt, Salmonella typhimurium LT2
agcaauacagccagcaca

SEQ ID NO: 3750466 - RNA, 21 nt, Salmonella typhimurium LT2
agcaauagguuugaccagaua

SEQ ID NO: 3750467 - RNA, 23 nt, Salmonella typhimurium LT2
agcaauauggcugcgacaaugaa

SEQ ID NO: 3750468 - RNA, 22 nt, Salmonella typhimurium LT2
agcaauauuuuguaguuguuuu

SEQ ID NO: 3750469 - RNA, 14 nt, Salmonella typhimurium LT2
agcaguucagcagc

SEQ ID NO: 3750470 - RNA, 16 nt, Salmonella typhimurium LT2
agcaguucagcagcac

SEQ ID NO: 3750471 - RNA, 15 nt, Salmonella typhimurium LT2
agcaguuccagcauc

SEQ ID NO: 3750472 - RNA, 16 nt, Salmonella typhimurium LT2
agcaguugcauucccu

SEQ ID NO: 3750473 - RNA, 18 nt, Salmonella typhimurium LT2
agcauaaaaaagauugcu

SEQ ID NO: 3750474 - RNA, 13 nt, Salmonella typhimurium LT2
agcauaaaaagac

SEQ ID NO: 3750475 - RNA, 16 nt, Salmonella typhimurium LT2
agcauaagcacagaua

SEQ ID NO: 3750476 - RNA, 17 nt, Salmonella typhimurium LT2
agcauaauaaagcagcg

SEQ ID NO: 3750477 - RNA, 14 nt, Salmonella typhimurium LT2
agcauacaaagcag

SEQ ID NO: 3750478 - RNA, 15 nt, Salmonella typhimurium LT2
agcauacaaagcaga

SEQ ID NO: 3750479 - RNA, 16 nt, Salmonella typhimurium LT2
agcauacacauucagg

SEQ ID NO: 3750480 - RNA, 21 nt, Salmonella typhimurium LT2
agcauaccgugugcagugaca

SEQ ID NO: 3750481 - RNA, 17 nt, Salmonella typhimurium LT2
agcauacgacaucgcca

SEQ ID NO: 3750482 - RNA, 14 nt, Salmonella typhimurium LT2
agcauacugauguc

SEQ ID NO: 3750483 - RNA, 17 nt, Salmonella typhimurium LT2
agcauaguaaauuguuu

SEQ ID NO: 3750484 - RNA, 21 nt, Salmonella typhimurium LT2
agcauaguaaauuguuugguu

SEQ ID NO: 3750485 - RNA, 12 nt, Salmonella typhimurium LT2
agcauauccacc

SEQ ID NO: 3750486 - RNA, 14 nt, Salmonella typhimurium LT2
agcauauccagcgc

SEQ ID NO: 3750487 - RNA, 15 nt, Salmonella typhimurium LT2
agcauaucgauagca

SEQ ID NO: 3750488 - RNA, 13 nt, Salmonella typhimurium LT2
agcauaucgccgu

SEQ ID NO: 3750489 - RNA, 16 nt, Salmonella typhimurium LT2
agcauaucguagaaag

SEQ ID NO: 3750490 - RNA, 15 nt, Salmonella typhimurium LT2
agcaucaaacuuuua

SEQ ID NO: 3750491 - RNA, 17 nt, Salmonella typhimurium LT2
agcaucaaacuuuuaaa

SEQ ID NO: 3750492 - RNA, 13 nt, Salmonella typhimurium LT2
agcaucagcgccg

SEQ ID NO: 3750493 - RNA, 17 nt, Salmonella typhimurium LT2
agcaucaguggaaaaac

SEQ ID NO: 3750494 - RNA, 23 nt, Salmonella typhimurium LT2
agcaucauuuuuuaauaucaauu

SEQ ID NO: 3750495 - RNA, 12 nt, Salmonella typhimurium LT2
agcaucccacga

SEQ ID NO: 3750496 - RNA, 18 nt, Salmonella typhimurium LT2
agcaucccgcuggcgcca

SEQ ID NO: 3750497 - RNA, 18 nt, Salmonella typhimurium LT2
agcauccgggauauaaaa

SEQ ID NO: 3750498 - RNA, 20 nt, Salmonella typhimurium LT2
agcauccgggauauaaaauu

SEQ ID NO: 3750499 - RNA, 15 nt, Salmonella typhimurium LT2
agcaucgcagcauca

SEQ ID NO: 3750500 - RNA, 18 nt, Salmonella typhimurium LT2
agcaucgccgguagcuuc

SEQ ID NO: 3750501 - RNA, 22 nt, Salmonella typhimurium LT2
agcaucgcuuuuaggcugaaag

SEQ ID NO: 3750502 - RNA, 22 nt, Salmonella typhimurium LT2
agcaucucacguacaaacgcuu

SEQ ID NO: 3750503 - RNA, 22 nt, Salmonella typhimurium LT2
agcaucucuucgacaucuucac

SEQ ID NO: 3750504 - RNA, 18 nt, Salmonella typhimurium LT2
agcaucugauagcccauc

SEQ ID NO: 3750505 - RNA, 14 nt, Salmonella typhimurium LT2
agcaucugcggcuu

SEQ ID NO: 3750506 - RNA, 17 nt, Salmonella typhimurium LT2
agcaucuuaagaaaauu

SEQ ID NO: 3750507 - RNA, 16 nt, Salmonella typhimurium LT2
agcaucuuaugcgcaa

SEQ ID NO: 3750508 - RNA, 14 nt, Salmonella typhimurium LT2
agcaugaauaaccu

SEQ ID NO: 3750509 - RNA, 20 nt, Salmonella typhimurium LT2
agcaugacugugcgccgcgu

SEQ ID NO: 3750510 - RNA, 14 nt, Salmonella typhimurium LT2
agcaugcccgccag

SEQ ID NO: 3750511 - RNA, 19 nt, Salmonella typhimurium LT2
agcauggcgccugcggaau

SEQ ID NO: 3750512 - RNA, 16 nt, Salmonella typhimurium LT2
agcaugggcuaaagca

SEQ ID NO: 3750513 - RNA, 16 nt, Salmonella typhimurium LT2
agcauggucuccagca

SEQ ID NO: 3750514 - RNA, 19 nt, Salmonella typhimurium LT2
agcaugucggcaaucaccu

SEQ ID NO: 3750515 - RNA, 13 nt, Salmonella typhimurium LT2
agcauuaccagca

SEQ ID NO: 3750516 - RNA, 16 nt, Salmonella typhimurium LT2
agcauuaccagcaaua

SEQ ID NO: 3750517 - RNA, 18 nt, Salmonella typhimurium LT2
agcauuaccagcaauaac

SEQ ID NO: 3750518 - RNA, 14 nt, Salmonella typhimurium LT2
agcauuauuuuuaa

SEQ ID NO: 3750519 - RNA, 15 nt, Salmonella typhimurium LT2
agcauuauuuuuaac

SEQ ID NO: 3750520 - RNA, 14 nt, Salmonella typhimurium LT2
agcauucuauuguu

SEQ ID NO: 3750521 - RNA, 16 nt, Salmonella typhimurium LT2
agcauugauuuuucau

SEQ ID NO: 3750522 - RNA, 21 nt, Salmonella typhimurium LT2
agcauugccguuuucaauaau

SEQ ID NO: 3750523 - RNA, 19 nt, Salmonella typhimurium LT2
agcauugggccgauaaagc

SEQ ID NO: 3750524 - RNA, 17 nt, Salmonella typhimurium LT2
agcauuucgccaguucc

SEQ ID NO: 3750525 - RNA, 16 nt, Salmonella typhimurium LT2
agcauuucuucaagcg

SEQ ID NO: 3750526 - RNA, 14 nt, Salmonella typhimurium LT2
agcauuugcgcuuu

SEQ ID NO: 3750527 - RNA, 12 nt, Salmonella typhimurium LT2
agcauuuguagc

SEQ ID NO: 3750528 - RNA, 18 nt, Salmonella typhimurium LT2
agccaaaagaaguggcaa

SEQ ID NO: 3750529 - RNA, 23 nt, Salmonella typhimurium LT2
agccaaaagcgccacgcgucagg

SEQ ID NO: 3750530 - RNA, 14 nt, Salmonella typhimurium LT2
agccaaacugcugu

SEQ ID NO: 3750531 - RNA, 17 nt, Salmonella typhimurium LT2
agccaacacaucagcaa

SEQ ID NO: 3750532 - RNA, 20 nt, Salmonella typhimurium LT2
agccaacguauaaaauggca

SEQ ID NO: 3750533 - RNA, 12 nt, Salmonella typhimurium LT2
agccaauauccg

SEQ ID NO: 3750534 - RNA, 14 nt, Salmonella typhimurium LT2
agccaauauccgga

SEQ ID NO: 3750535 - RNA, 19 nt, Salmonella typhimurium LT2
agccaaucagccccagcac

SEQ ID NO: 3750536 - RNA, 15 nt, Salmonella typhimurium LT2
agccaauccagaaua

SEQ ID NO: 3750537 - RNA, 18 nt, Salmonella typhimurium LT2
agccaauccagaauacca

SEQ ID NO: 3750538 - RNA, 17 nt, Salmonella typhimurium LT2
agccacaagagcagcaa

SEQ ID NO: 3750539 - RNA, 16 nt, Salmonella typhimurium LT2
agccacaaucugauaa

SEQ ID NO: 3750540 - RNA, 23 nt, Salmonella typhimurium LT2
agccacaaugggggcauaauacg

SEQ ID NO: 3750541 - RNA, 16 nt, Salmonella typhimurium LT2
agccacagaaugccgu

SEQ ID NO: 3750542 - RNA, 20 nt, Salmonella typhimurium LT2
agccacagauuaugcagcuc

SEQ ID NO: 3750543 - RNA, 20 nt, Salmonella typhimurium LT2
agccacagccugugucagau

SEQ ID NO: 3750544 - RNA, 21 nt, Salmonella typhimurium LT2
agccacaggaaccgguagcca

SEQ ID NO: 3750545 - RNA, 19 nt, Salmonella typhimurium LT2
agccacgcccgccgccuga

SEQ ID NO: 3750546 - RNA, 18 nt, Salmonella typhimurium LT2
agccacgccgauccgaca

SEQ ID NO: 3750547 - RNA, 12 nt, Salmonella typhimurium LT2
agccacggcaac

SEQ ID NO: 3750548 - RNA, 13 nt, Salmonella typhimurium LT2
agccacuauccag

SEQ ID NO: 3750549 - RNA, 20 nt, Salmonella typhimurium LT2
agccacuauccagucagcgu

SEQ ID NO: 3750550 - RNA, 17 nt, Salmonella typhimurium LT2
agccacugcauuacucg

SEQ ID NO: 3750551 - RNA, 18 nt, Salmonella typhimurium LT2
agccacugcgccauuaac

SEQ ID NO: 3750552 - RNA, 23 nt, Salmonella typhimurium LT2
agccacuucaugcgcuuuuucac

SEQ ID NO: 3750553 - RNA, 21 nt, Salmonella typhimurium LT2
agccacuucuuccagcggcag

SEQ ID NO: 3750554 - RNA, 20 nt, Salmonella typhimurium LT2
agccagaacgagaggaggag

SEQ ID NO: 3750555 - RNA, 22 nt, Salmonella typhimurium LT2
agccagaaugacauggucgaac

SEQ ID NO: 3750556 - RNA, 23 nt, Salmonella typhimurium LT2
agccagacgccgcgccgcggcgu

SEQ ID NO: 3750557 - RNA, 16 nt, Salmonella typhimurium LT2
agccagacgcgcagca

SEQ ID NO: 3750558 - RNA, 19 nt, Salmonella typhimurium LT2
agccagacgcgcagcaccg

SEQ ID NO: 3750559 - RNA, 22 nt, Salmonella typhimurium LT2
agccagacgcuccgcaguaauc

SEQ ID NO: 3750560 - RNA, 23 nt, Salmonella typhimurium LT2
agccagacgcuccgcaguaauca

SEQ ID NO: 3750561 - RNA, 16 nt, Salmonella typhimurium LT2
agccagaggcuaauca

SEQ ID NO: 3750562 - RNA, 22 nt, Salmonella typhimurium LT2
agccagaggcuaaucaggaaga

SEQ ID NO: 3750563 - RNA, 18 nt, Salmonella typhimurium LT2
agccagauaaagcagcga

SEQ ID NO: 3750564 - RNA, 18 nt, Salmonella typhimurium LT2
agccagauguaaucugac

SEQ ID NO: 3750565 - RNA, 15 nt, Salmonella typhimurium LT2
agccagcagcucaac

SEQ ID NO: 3750566 - RNA, 11 nt, Salmonella typhimurium LT2
agccagcaucg

SEQ ID NO: 3750567 - RNA, 18 nt, Salmonella typhimurium LT2
agccagccaaacaguauc

SEQ ID NO: 3750568 - RNA, 21 nt, Salmonella typhimurium LT2
agccagccaaauagcgccaga

SEQ ID NO: 3750569 - RNA, 15 nt, Salmonella typhimurium LT2
agccagcccagcgca

SEQ ID NO: 3750570 - RNA, 15 nt, Salmonella typhimurium LT2
agccagcccucaaca

SEQ ID NO: 3750571 - RNA, 17 nt, Salmonella typhimurium LT2
agccagcccugccacca

SEQ ID NO: 3750572 - RNA, 22 nt, Salmonella typhimurium LT2
agccagccgccaaaaauaucgc

SEQ ID NO: 3750573 - RNA, 16 nt, Salmonella typhimurium LT2
agccgcaucuuccgua

SEQ ID NO: 3750574 - RNA, 21 nt, Salmonella typhimurium LT2
agccgccaaaaauaucgccgu

SEQ ID NO: 3750575 - RNA, 12 nt, Salmonella typhimurium LT2
agccgccacccg

SEQ ID NO: 3750576 - RNA, 17 nt, Salmonella typhimurium LT2
agccgccagaggaaaca

SEQ ID NO: 3750577 - RNA, 18 nt, Salmonella typhimurium LT2
agccgccagaggaaacac

SEQ ID NO: 3750578 - RNA, 17 nt, Salmonella typhimurium LT2
agccgccagauccuggc

SEQ ID NO: 3750579 - RNA, 12 nt, Salmonella typhimurium LT2
agccgccaggca

SEQ ID NO: 3750580 - RNA, 20 nt, Salmonella typhimurium LT2
agccgccaggcaaucagcag

SEQ ID NO: 3750581 - RNA, 22 nt, Salmonella typhimurium LT2
agccgccaggcaaucagcagcc

SEQ ID NO: 3750582 - RNA, 15 nt, Salmonella typhimurium LT2
agccgccaguaacgc

SEQ ID NO: 3750583 - RNA, 21 nt, Salmonella typhimurium LT2
agccgccaguucaauauccag

SEQ ID NO: 3750584 - RNA, 23 nt, Salmonella typhimurium LT2
agccgccaguucaauauccagcc

SEQ ID NO: 3750585 - RNA, 15 nt, Salmonella typhimurium LT2
agccgccaucaggca

SEQ ID NO: 3750586 - RNA, 14 nt, Salmonella typhimurium LT2
agccgccauccggc

SEQ ID NO: 3750587 - RNA, 15 nt, Salmonella typhimurium LT2
agccgccauccggca

SEQ ID NO: 3750588 - RNA, 15 nt, Salmonella typhimurium LT2
agccgccauccggcc

SEQ ID NO: 3750589 - RNA, 12 nt, Salmonella typhimurium LT2
agccgcccaucc

SEQ ID NO: 3750590 - RNA, 16 nt, Salmonella typhimurium LT2
agccgcgcauagcugg

SEQ ID NO: 3750591 - RNA, 20 nt, Salmonella typhimurium LT2
agccgcgccaucuccuccuc

SEQ ID NO: 3750592 - RNA, 22 nt, Salmonella typhimurium LT2
agccgcgcuaucaaaaugcacc

SEQ ID NO: 3750593 - RNA, 18 nt, Salmonella typhimurium LT2
agccgcgcucaagcuggg

SEQ ID NO: 3750594 - RNA, 16 nt, Salmonella typhimurium LT2
agccgcggaccuuuug

SEQ ID NO: 3750595 - RNA, 17 nt, Salmonella typhimurium LT2
agccgcguugcgcugaa

SEQ ID NO: 3750596 - RNA, 19 nt, Salmonella typhimurium LT2
agccgcucaauaauauccu

SEQ ID NO: 3750597 - RNA, 14 nt, Salmonella typhimurium LT2
agccgcucgccaga

SEQ ID NO: 3750598 - RNA, 11 nt, Salmonella typhimurium LT2
agccgcugccu

SEQ ID NO: 3750599 - RNA, 18 nt, Salmonella typhimurium LT2
agccgcuguuuuucauca

SEQ ID NO: 3750600 - RNA, 22 nt, Salmonella typhimurium LT2
agccgcuguuuuucaucaucau

SEQ ID NO: 3750601 - RNA, 21 nt, Salmonella typhimurium LT2
agccggauguugggcgguucc

SEQ ID NO: 3750602 - RNA, 16 nt, Salmonella typhimurium LT2
agccggauuuuaaauu

SEQ ID NO: 3750603 - RNA, 13 nt, Salmonella typhimurium LT2
agccggcgccauu

SEQ ID NO: 3750604 - RNA, 16 nt, Salmonella typhimurium LT2
agccggcuaucuucuu

SEQ ID NO: 3750605 - RNA, 19 nt, Salmonella typhimurium LT2
agccggcuaucuucuuccg

SEQ ID NO: 3750606 - RNA, 18 nt, Salmonella typhimurium LT2
agccgggcgggaaccugu

SEQ ID NO: 3750607 - RNA, 21 nt, Salmonella typhimurium LT2
agccggggauuuccccggcuu

SEQ ID NO: 3750608 - RNA, 19 nt, Salmonella typhimurium LT2
agccgguacgggaaauggc

SEQ ID NO: 3750609 - RNA, 19 nt, Salmonella typhimurium LT2
agccguaacgagugaggac

SEQ ID NO: 3750610 - RNA, 17 nt, Salmonella typhimurium LT2
agccgucaaacaucgcg

SEQ ID NO: 3750611 - RNA, 15 nt, Salmonella typhimurium LT2
agccguucaccagcc

SEQ ID NO: 3750612 - RNA, 13 nt, Salmonella typhimurium LT2
agccguucuccag

SEQ ID NO: 3750613 - RNA, 20 nt, Salmonella typhimurium LT2
agccguugccauagcgggca

SEQ ID NO: 3750614 - RNA, 14 nt, Salmonella typhimurium LT2
agccguuucuuguc

SEQ ID NO: 3750615 - RNA, 18 nt, Salmonella typhimurium LT2
agccguuuugcugucugg

SEQ ID NO: 3750616 - RNA, 19 nt, Salmonella typhimurium LT2
agccguuuuggcagcgccc

SEQ ID NO: 3750617 - RNA, 22 nt, Salmonella typhimurium LT2
agccguuuuggcagcgcccgcu

SEQ ID NO: 3750618 - RNA, 13 nt, Salmonella typhimurium LT2
agccuaaaaacag

SEQ ID NO: 3750619 - RNA, 14 nt, Salmonella typhimurium LT2
agccuaaugacgga

SEQ ID NO: 3750620 - RNA, 19 nt, Salmonella typhimurium LT2
agccuacaccguaccugua

SEQ ID NO: 3750621 - RNA, 16 nt, Salmonella typhimurium LT2
agccuaccugccgcca

SEQ ID NO: 3750622 - RNA, 21 nt, Salmonella typhimurium LT2
agccucauuuuugaguuuguc

SEQ ID NO: 3750623 - RNA, 18 nt, Salmonella typhimurium LT2
agccucggucgagcuuuu

SEQ ID NO: 3750624 - RNA, 15 nt, Salmonella typhimurium LT2
agccucuaaauguug

SEQ ID NO: 3750625 - RNA, 20 nt, Salmonella typhimurium LT2
agccugaacgccggaacccg

SEQ ID NO: 3750626 - RNA, 17 nt, Salmonella typhimurium LT2
agccugacgaauagcgc

SEQ ID NO: 3750627 - RNA, 16 nt, Salmonella typhimurium LT2
agccugagcgccagcg

SEQ ID NO: 3750628 - RNA, 21 nt, Salmonella typhimurium LT2
agccugauaaauaugccggcc

SEQ ID NO: 3750629 - RNA, 18 nt, Salmonella typhimurium LT2
agccugauacuuuuacuc

SEQ ID NO: 3750630 - RNA, 14 nt, Salmonella typhimurium LT2
agccugccagcacc

SEQ ID NO: 3750631 - RNA, 15 nt, Salmonella typhimurium LT2
agccugcgcgccugc

SEQ ID NO: 3750632 - RNA, 18 nt, Salmonella typhimurium LT2
agccugcgcgccugcugc

SEQ ID NO: 3750633 - RNA, 20 nt, Salmonella typhimurium LT2
agccuggcggcuuccuguuu

SEQ ID NO: 3750634 - RNA, 17 nt, Salmonella typhimurium LT2
agccuggcugaaccagg

SEQ ID NO: 3750635 - RNA, 16 nt, Salmonella typhimurium LT2
agccuguuccagcugc

SEQ ID NO: 3750636 - RNA, 17 nt, Salmonella typhimurium LT2
agccuguuccagcugcg

SEQ ID NO: 3750637 - RNA, 21 nt, Salmonella typhimurium LT2
agccuuacuaucccauuuuuu

SEQ ID NO: 3750638 - RNA, 15 nt, Salmonella typhimurium LT2
agccuuagcgggagg

SEQ ID NO: 3750639 - RNA, 22 nt, Salmonella typhimurium LT2
agccuuagcgggaggcgguucu

SEQ ID NO: 3750640 - RNA, 15 nt, Salmonella typhimurium LT2
agccuucaucaucau

SEQ ID NO: 3750641 - RNA, 22 nt, Salmonella typhimurium LT2
agccuuccaucgcauccucgcc

SEQ ID NO: 3750642 - RNA, 17 nt, Salmonella typhimurium LT2
agccuucgccuucacgc

SEQ ID NO: 3750643 - RNA, 23 nt, Salmonella typhimurium LT2
agccuucgccuucacgcauucuu

SEQ ID NO: 3750644 - RNA, 23 nt, Salmonella typhimurium LT2
agccuuuguaacgaacgcugcau

SEQ ID NO: 3750645 - RNA, 15 nt, Salmonella typhimurium LT2
agccuuuugagcagc

SEQ ID NO: 3750646 - RNA, 15 nt, Salmonella typhimurium LT2
agccuuuuuaaauau

SEQ ID NO: 3750647 - RNA, 15 nt, Salmonella typhimurium LT2
agcgaaacgcgcuau

SEQ ID NO: 3750648 - RNA, 12 nt, Salmonella typhimurium LT2
agcgaaacugcc

SEQ ID NO: 3750649 - RNA, 19 nt, Salmonella typhimurium LT2
agcgaaaugcgaauccggc

SEQ ID NO: 3750650 - RNA, 20 nt, Salmonella typhimurium LT2
agcgaaaugcgaauccggcg

SEQ ID NO: 3750651 - RNA, 17 nt, Salmonella typhimurium LT2
agcgaaauguucgucca

SEQ ID NO: 3750652 - RNA, 17 nt, Salmonella typhimurium LT2
agcgaaccaucauuaau

SEQ ID NO: 3750653 - RNA, 19 nt, Salmonella typhimurium LT2
agcgaacguccagcggcca

SEQ ID NO: 3750654 - RNA, 17 nt, Salmonella typhimurium LT2
agcgaagcggcacugcu

SEQ ID NO: 3750655 - RNA, 21 nt, Salmonella typhimurium LT2
agcgaaggcaacugauccugc

SEQ ID NO: 3750656 - RNA, 20 nt, Salmonella typhimurium LT2
agcgaauaaucccggcgcca

SEQ ID NO: 3750657 - RNA, 18 nt, Salmonella typhimurium LT2
agcgaaucacauccgcca

SEQ ID NO: 3750658 - RNA, 14 nt, Salmonella typhimurium LT2
agcgaauccagcgc

SEQ ID NO: 3750659 - RNA, 20 nt, Salmonella typhimurium LT2
agcgaauuccggccaucaga

SEQ ID NO: 3750660 - RNA, 12 nt, Salmonella typhimurium LT2
agcgacaacgcu

SEQ ID NO: 3750661 - RNA, 17 nt, Salmonella typhimurium LT2
agcgacacuccgcgcau

SEQ ID NO: 3750662 - RNA, 22 nt, Salmonella typhimurium LT2
agcgaccacgccaccgccgcca

SEQ ID NO: 3750663 - RNA, 17 nt, Salmonella typhimurium LT2
agcgaccaggguuaaaa

SEQ ID NO: 3750664 - RNA, 14 nt, Salmonella typhimurium LT2
agcgaccggcguca

SEQ ID NO: 3750665 - RNA, 16 nt, Salmonella typhimurium LT2
agcgacgccagauuau

SEQ ID NO: 3750666 - RNA, 21 nt, Salmonella typhimurium LT2
agcgacgcgcgguugcggcgg

SEQ ID NO: 3750667 - RNA, 22 nt, Salmonella typhimurium LT2
agcgacgguuuuauccccuuca

SEQ ID NO: 3750668 - RNA, 20 nt, Salmonella typhimurium LT2
agcgacucauccacauacug

SEQ ID NO: 3750669 - RNA, 16 nt, Salmonella typhimurium LT2
agcgacuuauccggcc

SEQ ID NO: 3750670 - RNA, 15 nt, Salmonella typhimurium LT2
agcgagacuuuugcc

SEQ ID NO: 3750671 - RNA, 14 nt, Salmonella typhimurium LT2
agcgagaggcaauu

SEQ ID NO: 3750672 - RNA, 17 nt, Salmonella typhimurium LT2
agcgagccaucggcaaa

SEQ ID NO: 3750673 - RNA, 14 nt, Salmonella typhimurium LT2
agcgagccuuccau

SEQ ID NO: 3750674 - RNA, 15 nt, Salmonella typhimurium LT2
agcgagccuuccauc

SEQ ID NO: 3750675 - RNA, 22 nt, Salmonella typhimurium LT2
agcgagcgauagagaguuccuc

SEQ ID NO: 3750676 - RNA, 13 nt, Salmonella typhimurium LT2
agcgagcgccuga

SEQ ID NO: 3750677 - RNA, 16 nt, Salmonella typhimurium LT2
agcgccugcgcggcaa

SEQ ID NO: 3750678 - RNA, 19 nt, Salmonella typhimurium LT2
agcgccugucgggccuaca

SEQ ID NO: 3750679 - RNA, 23 nt, Salmonella typhimurium LT2
agcgccugugcuuucgccaccag

SEQ ID NO: 3750680 - RNA, 17 nt, Salmonella typhimurium LT2
agcgccuguucaacaug

SEQ ID NO: 3750681 - RNA, 20 nt, Salmonella typhimurium LT2
agcgccuuauccggccuacg

SEQ ID NO: 3750682 - RNA, 14 nt, Salmonella typhimurium LT2
agcgccuucaggca

SEQ ID NO: 3750683 - RNA, 16 nt, Salmonella typhimurium LT2
agcgccuuuucaaaag

SEQ ID NO: 3750684 - RNA, 20 nt, Salmonella typhimurium LT2
agcgccuuuucaaaagagag

SEQ ID NO: 3750685 - RNA, 13 nt, Salmonella typhimurium LT2
agcgcgaaauuua

SEQ ID NO: 3750686 - RNA, 13 nt, Salmonella typhimurium LT2
agcgcgaacuaca

SEQ ID NO: 3750687 - RNA, 15 nt, Salmonella typhimurium LT2
agcgcgaaucgccuc

SEQ ID NO: 3750688 - RNA, 13 nt, Salmonella typhimurium LT2
agcgcgaauuugc

SEQ ID NO: 3750689 - RNA, 14 nt, Salmonella typhimurium LT2
agcgcgacauagag

SEQ ID NO: 3750690 - RNA, 16 nt, Salmonella typhimurium LT2
agcgcgaccagcguga

SEQ ID NO: 3750691 - RNA, 14 nt, Salmonella typhimurium LT2
agcgcgaccgguuu

SEQ ID NO: 3750692 - RNA, 22 nt, Salmonella typhimurium LT2
agcgcgaucgccccgaccagga

SEQ ID NO: 3750693 - RNA, 18 nt, Salmonella typhimurium LT2
agcgcgaugacgucacga

SEQ ID NO: 3750694 - RNA, 22 nt, Salmonella typhimurium LT2
agcgcgccaauccaugccggcu

SEQ ID NO: 3750695 - RNA, 21 nt, Salmonella typhimurium LT2
agcgcgccaauggccgccccc

SEQ ID NO: 3750696 - RNA, 12 nt, Salmonella typhimurium LT2
agcgcgccagcg

SEQ ID NO: 3750697 - RNA, 15 nt, Salmonella typhimurium LT2
agcgcgccagcgcca

SEQ ID NO: 3750698 - RNA, 17 nt, Salmonella typhimurium LT2
agcgcgcccaugccgcc

SEQ ID NO: 3750699 - RNA, 19 nt, Salmonella typhimurium LT2
agcgcgcccgccaccagca

SEQ ID NO: 3750700 - RNA, 18 nt, Salmonella typhimurium LT2
agcgcgccgcacaucggc

SEQ ID NO: 3750701 - RNA, 19 nt, Salmonella typhimurium LT2
agcgcgccgccgcccauaa

SEQ ID NO: 3750702 - RNA, 21 nt, Salmonella typhimurium LT2
agcgcgcgcaggguuucgaua

SEQ ID NO: 3750703 - RNA, 12 nt, Salmonella typhimurium LT2
agcgcgcgcuaa

SEQ ID NO: 3750704 - RNA, 13 nt, Salmonella typhimurium LT2
agcgcgcggcugc

SEQ ID NO: 3750705 - RNA, 16 nt, Salmonella typhimurium LT2
agcgcgcucugccuuu

SEQ ID NO: 3750706 - RNA, 13 nt, Salmonella typhimurium LT2
agcgcgcuggcaa

SEQ ID NO: 3750707 - RNA, 16 nt, Salmonella typhimurium LT2
agcgcggcagcagcuu

SEQ ID NO: 3750708 - RNA, 14 nt, Salmonella typhimurium LT2
agcgcggcagccgg

SEQ ID NO: 3750709 - RNA, 15 nt, Salmonella typhimurium LT2
agcgcggccagaaug

SEQ ID NO: 3750710 - RNA, 16 nt, Salmonella typhimurium LT2
agcgcggccagcgccu

SEQ ID NO: 3750711 - RNA, 11 nt, Salmonella typhimurium LT2
agcgcgguggg

SEQ ID NO: 3750712 - RNA, 15 nt, Salmonella typhimurium LT2
agcgcgucagcgccu

SEQ ID NO: 3750713 - RNA, 20 nt, Salmonella typhimurium LT2
agcgcgucagcgccuccgcg

SEQ ID NO: 3750714 - RNA, 17 nt, Salmonella typhimurium LT2
agcgcgucgaaugacgc

SEQ ID NO: 3750715 - RNA, 22 nt, Salmonella typhimurium LT2
agcgcgucggccggcaccagcc

SEQ ID NO: 3750716 - RNA, 17 nt, Salmonella typhimurium LT2
agcgcgugcccgguaag

SEQ ID NO: 3750717 - RNA, 19 nt, Salmonella typhimurium LT2
agcgcguucgccgucacgc

SEQ ID NO: 3750718 - RNA, 20 nt, Salmonella typhimurium LT2
agcgcguuuuccaucaucag

SEQ ID NO: 3750719 - RNA, 15 nt, Salmonella typhimurium LT2
agcgcuaacgcgaag

SEQ ID NO: 3750720 - RNA, 15 nt, Salmonella typhimurium LT2
agcgcuacagggcgu

SEQ ID NO: 3750721 - RNA, 14 nt, Salmonella typhimurium LT2
agcgcucaggcagc

SEQ ID NO: 3750722 - RNA, 18 nt, Salmonella typhimurium LT2
agcgcuccgcacgccggu

SEQ ID NO: 3750723 - RNA, 18 nt, Salmonella typhimurium LT2
agcgcuccgggguucuuu

SEQ ID NO: 3750724 - RNA, 22 nt, Salmonella typhimurium LT2
agcgcugacaucauccacggca

SEQ ID NO: 3750725 - RNA, 20 nt, Salmonella typhimurium LT2
agcgcugaugcaggcaauau

SEQ ID NO: 3750726 - RNA, 17 nt, Salmonella typhimurium LT2
agcgcugcgcaaauacg

SEQ ID NO: 3750727 - RNA, 20 nt, Salmonella typhimurium LT2
agcgcugcuguaacagacgc

SEQ ID NO: 3750728 - RNA, 20 nt, Salmonella typhimurium LT2
agcgcugucgccaucaccag

SEQ ID NO: 3750729 - RNA, 23 nt, Salmonella typhimurium LT2
agcgcuuaccacuuugcgcuccu

SEQ ID NO: 3750730 - RNA, 23 nt, Salmonella typhimurium LT2
agcgcuucgugaaaaccuaaaua

SEQ ID NO: 3750731 - RNA, 22 nt, Salmonella typhimurium LT2
agcgcuucuaacaaaacagauu

SEQ ID NO: 3750732 - RNA, 15 nt, Salmonella typhimurium LT2
agcgcuucucuuucc

SEQ ID NO: 3750733 - RNA, 15 nt, Salmonella typhimurium LT2
agcgcuugauccagu

SEQ ID NO: 3750734 - RNA, 19 nt, Salmonella typhimurium LT2
agcgcuuguuaucuggcau

SEQ ID NO: 3750735 - RNA, 23 nt, Salmonella typhimurium LT2
agcgcuuuccagucccugaagaa

SEQ ID NO: 3750736 - RNA, 16 nt, Salmonella typhimurium LT2
agcgcuuucuucuuca

SEQ ID NO: 3750737 - RNA, 16 nt, Salmonella typhimurium LT2
agcgcuuugccgcugc

SEQ ID NO: 3750738 - RNA, 21 nt, Salmonella typhimurium LT2
agcgcuuuggaggucauuauu

SEQ ID NO: 3750739 - RNA, 13 nt, Salmonella typhimurium LT2
agcgcuuuugccg

SEQ ID NO: 3750740 - RNA, 17 nt, Salmonella typhimurium LT2
agcgcuuuuuccagcgc

SEQ ID NO: 3750741 - RNA, 16 nt, Salmonella typhimurium LT2
agcgcuuuuuuuaugc

SEQ ID NO: 3750742 - RNA, 14 nt, Salmonella typhimurium LT2
agcggaaagcaaca

SEQ ID NO: 3750743 - RNA, 18 nt, Salmonella typhimurium LT2
agcggaagggccuuuggc

SEQ ID NO: 3750744 - RNA, 17 nt, Salmonella typhimurium LT2
agcggaauagacggccu

SEQ ID NO: 3750745 - RNA, 17 nt, Salmonella typhimurium LT2
agcggaccguaauaucg

SEQ ID NO: 3750746 - RNA, 19 nt, Salmonella typhimurium LT2
agcggacugccuaacugga

SEQ ID NO: 3750747 - RNA, 22 nt, Salmonella typhimurium LT2
agcggauaagcgcagcgccauc

SEQ ID NO: 3750748 - RNA, 19 nt, Salmonella typhimurium LT2
agcggauaauccgccacuu

SEQ ID NO: 3750749 - RNA, 13 nt, Salmonella typhimurium LT2
agcggaugacggc

SEQ ID NO: 3750750 - RNA, 19 nt, Salmonella typhimurium LT2
agcggaugucggucaucag

SEQ ID NO: 3750751 - RNA, 19 nt, Salmonella typhimurium LT2
agcggcaaacagcgacucg

SEQ ID NO: 3750752 - RNA, 14 nt, Salmonella typhimurium LT2
agcggcaacagcac

SEQ ID NO: 3750753 - RNA, 19 nt, Salmonella typhimurium LT2
agcggcaacugagcgaauc

SEQ ID NO: 3750754 - RNA, 14 nt, Salmonella typhimurium LT2
agcggcaagcgcgc

SEQ ID NO: 3750755 - RNA, 19 nt, Salmonella typhimurium LT2
agcggcaagcgcgccauaa

SEQ ID NO: 3750756 - RNA, 19 nt, Salmonella typhimurium LT2
agcggcaaggaaaaccagu

SEQ ID NO: 3750757 - RNA, 15 nt, Salmonella typhimurium LT2
agcggcaaucgccuc

SEQ ID NO: 3750758 - RNA, 15 nt, Salmonella typhimurium LT2
agcggcaccagcacg

SEQ ID NO: 3750759 - RNA, 12 nt, Salmonella typhimurium LT2
agcggcagcgca

SEQ ID NO: 3750760 - RNA, 19 nt, Salmonella typhimurium LT2
agcggcaggauccccaucc

SEQ ID NO: 3750761 - RNA, 14 nt, Salmonella typhimurium LT2
agcggccaaaggga

SEQ ID NO: 3750762 - RNA, 19 nt, Salmonella typhimurium LT2
agcggccaaagggagcaga

SEQ ID NO: 3750763 - RNA, 21 nt, Salmonella typhimurium LT2
agcggccagcguaccugcggc

SEQ ID NO: 3750764 - RNA, 15 nt, Salmonella typhimurium LT2
agcggcccgcgcuga

SEQ ID NO: 3750765 - RNA, 17 nt, Salmonella typhimurium LT2
agcggcgccaucaccau

SEQ ID NO: 3750766 - RNA, 18 nt, Salmonella typhimurium LT2
agcggcgccaucaccauc

SEQ ID NO: 3750767 - RNA, 16 nt, Salmonella typhimurium LT2
agcggcggcacggcgu

SEQ ID NO: 3750768 - RNA, 23 nt, Salmonella typhimurium LT2
agcggcgggauuuuaagcaucca

SEQ ID NO: 3750769 - RNA, 18 nt, Salmonella typhimurium LT2
agcggcgggcgugaugga

SEQ ID NO: 3750770 - RNA, 23 nt, Salmonella typhimurium LT2
agcggcgugguaucucgucgcca

SEQ ID NO: 3750771 - RNA, 12 nt, Salmonella typhimurium LT2
agcggcguucaa

SEQ ID NO: 3750772 - RNA, 15 nt, Salmonella typhimurium LT2
agcggcguucaaaac

SEQ ID NO: 3750773 - RNA, 17 nt, Salmonella typhimurium LT2
agcggcguucaaaacgc

SEQ ID NO: 3750774 - RNA, 22 nt, Salmonella typhimurium LT2
agcggcguuuuuuccugcuggu

SEQ ID NO: 3750775 - RNA, 18 nt, Salmonella typhimurium LT2
agcggcucauccagcaac

SEQ ID NO: 3750776 - RNA, 22 nt, Salmonella typhimurium LT2
agcggcugacacucauccagac

SEQ ID NO: 3750777 - RNA, 13 nt, Salmonella typhimurium LT2
agcggcugcaaag

SEQ ID NO: 3750778 - RNA, 16 nt, Salmonella typhimurium LT2
agcggcugcaaagcau

SEQ ID NO: 3750779 - RNA, 20 nt, Salmonella typhimurium LT2
agcggcugcaaagcaucugc

SEQ ID NO: 3750780 - RNA, 15 nt, Salmonella typhimurium LT2
agcggcugcgccugu

SEQ ID NO: 3750781 - RNA, 19 nt, Salmonella typhimurium LT2
agcucauuuuuacagacac

SEQ ID NO: 3750782 - RNA, 19 nt, Salmonella typhimurium LT2
agcuccauagaaaucagca

SEQ ID NO: 3750783 - RNA, 13 nt, Salmonella typhimurium LT2
agcuccugcgggc

SEQ ID NO: 3750784 - RNA, 21 nt, Salmonella typhimurium LT2
agcucgcacugauagccgcca

SEQ ID NO: 3750785 - RNA, 13 nt, Salmonella typhimurium LT2
agcucgcccggua

SEQ ID NO: 3750786 - RNA, 20 nt, Salmonella typhimurium LT2
agcucggcuucgacauagcc

SEQ ID NO: 3750787 - RNA, 21 nt, Salmonella typhimurium LT2
agcucgguggcgguaucaaug

SEQ ID NO: 3750788 - RNA, 20 nt, Salmonella typhimurium LT2
agcucgguucuucggcauaa

SEQ ID NO: 3750789 - RNA, 14 nt, Salmonella typhimurium LT2
agcucguuauuucc

SEQ ID NO: 3750790 - RNA, 15 nt, Salmonella typhimurium LT2
agcucguuauuuccg

SEQ ID NO: 3750791 - RNA, 16 nt, Salmonella typhimurium LT2
agcucuaccagaccac

SEQ ID NO: 3750792 - RNA, 17 nt, Salmonella typhimurium LT2
agcucucuuccagguua

SEQ ID NO: 3750793 - RNA, 20 nt, Salmonella typhimurium LT2
agcucugccgguuggccggc

SEQ ID NO: 3750794 - RNA, 15 nt, Salmonella typhimurium LT2
agcucugcgguaaca

SEQ ID NO: 3750795 - RNA, 14 nt, Salmonella typhimurium LT2
agcucugugugacg

SEQ ID NO: 3750796 - RNA, 14 nt, Salmonella typhimurium LT2
agcucuucaugcag

SEQ ID NO: 3750797 - RNA, 15 nt, Salmonella typhimurium LT2
agcucuucgaugacc

SEQ ID NO: 3750798 - RNA, 15 nt, Salmonella typhimurium LT2
agcugaacgcgguga

SEQ ID NO: 3750799 - RNA, 17 nt, Salmonella typhimurium LT2
agcugaacgcggugacu

SEQ ID NO: 3750800 - RNA, 18 nt, Salmonella typhimurium LT2
agcugacaaugugccgga

SEQ ID NO: 3750801 - RNA, 16 nt, Salmonella typhimurium LT2
agcugacgcagcagcu

SEQ ID NO: 3750802 - RNA, 14 nt, Salmonella typhimurium LT2
agcugaugauuggc

SEQ ID NO: 3750803 - RNA, 17 nt, Salmonella typhimurium LT2
agcugaugcgaacgucc

SEQ ID NO: 3750804 - RNA, 18 nt, Salmonella typhimurium LT2
agcugauugggauaaaca

SEQ ID NO: 3750805 - RNA, 13 nt, Salmonella typhimurium LT2
agcugauuuuucg

SEQ ID NO: 3750806 - RNA, 15 nt, Salmonella typhimurium LT2
agcugcaccaggagc

SEQ ID NO: 3750807 - RNA, 18 nt, Salmonella typhimurium LT2
agcugccacaccacaugc

SEQ ID NO: 3750808 - RNA, 23 nt, Salmonella typhimurium LT2
agcugcccgucgcuacaggcaau

SEQ ID NO: 3750809 - RNA, 16 nt, Salmonella typhimurium LT2
agcugcgaucaaguuu

SEQ ID NO: 3750810 - RNA, 17 nt, Salmonella typhimurium LT2
agcugcgaucaaguuuu

SEQ ID NO: 3750811 - RNA, 17 nt, Salmonella typhimurium LT2
agcugcgccauaccccg

SEQ ID NO: 3750812 - RNA, 14 nt, Salmonella typhimurium LT2
agcugcgccugaaa

SEQ ID NO: 3750813 - RNA, 14 nt, Salmonella typhimurium LT2
agcugcgcgccgca

SEQ ID NO: 3750814 - RNA, 15 nt, Salmonella typhimurium LT2
agcugcgcuucgaug

SEQ ID NO: 3750815 - RNA, 19 nt, Salmonella typhimurium LT2
agcugcgcuuuuucaucau

SEQ ID NO: 3750816 - RNA, 21 nt, Salmonella typhimurium LT2
agcugcgcuuuuucaucaucu

SEQ ID NO: 3750817 - RNA, 20 nt, Salmonella typhimurium LT2
agcugcggcuauauaaaauc

SEQ ID NO: 3750818 - RNA, 17 nt, Salmonella typhimurium LT2
agcugcguuaagccgug

SEQ ID NO: 3750819 - RNA, 14 nt, Salmonella typhimurium LT2
agcugcucuucuug

SEQ ID NO: 3750820 - RNA, 13 nt, Salmonella typhimurium LT2
agcugcugguacc

SEQ ID NO: 3750821 - RNA, 17 nt, Salmonella typhimurium LT2
agcuggauagagcauca

SEQ ID NO: 3750822 - RNA, 19 nt, Salmonella typhimurium LT2
agcuggcacuuccccugua

SEQ ID NO: 3750823 - RNA, 20 nt, Salmonella typhimurium LT2
agcuggcgagaaaguggugg

SEQ ID NO: 3750824 - RNA, 22 nt, Salmonella typhimurium LT2
agcuggcggucgggaacgcugu

SEQ ID NO: 3750825 - RNA, 23 nt, Salmonella typhimurium LT2
agcuggcugacagaagccccgcu

SEQ ID NO: 3750826 - RNA, 23 nt, Salmonella typhimurium LT2
agcuggcuuuauauaaaaaaugg

SEQ ID NO: 3750827 - RNA, 17 nt, Salmonella typhimurium LT2
agcugggucaggacaga

SEQ ID NO: 3750828 - RNA, 18 nt, Salmonella typhimurium LT2
agcugguauaggccaggc

SEQ ID NO: 3750829 - RNA, 19 nt, Salmonella typhimurium LT2
agcugguauaggccaggcu

SEQ ID NO: 3750830 - RNA, 17 nt, Salmonella typhimurium LT2
agcugugcguugucuac

SEQ ID NO: 3750831 - RNA, 16 nt, Salmonella typhimurium LT2
agcuguuaauuugcau

SEQ ID NO: 3750832 - RNA, 17 nt, Salmonella typhimurium LT2
agcuuaaaaaauccugc

SEQ ID NO: 3750833 - RNA, 16 nt, Salmonella typhimurium LT2
agcuuaauuuuauagc

SEQ ID NO: 3750834 - RNA, 12 nt, Salmonella typhimurium LT2
agcuuaccuggc

SEQ ID NO: 3750835 - RNA, 13 nt, Salmonella typhimurium LT2
agcuuauccugcc

SEQ ID NO: 3750836 - RNA, 19 nt, Salmonella typhimurium LT2
agcuucaucaucagcagca

SEQ ID NO: 3750837 - RNA, 19 nt, Salmonella typhimurium LT2
agcuuccgucgccaguuuu

SEQ ID NO: 3750838 - RNA, 14 nt, Salmonella typhimurium LT2
agcuucgccagaug

SEQ ID NO: 3750839 - RNA, 15 nt, Salmonella typhimurium LT2
agcuucggcggcauc

SEQ ID NO: 3750840 - RNA, 19 nt, Salmonella typhimurium LT2
agcuucggcggcaucccuu

SEQ ID NO: 3750841 - RNA, 19 nt, Salmonella typhimurium LT2
agcuucucgccggaaagaa

SEQ ID NO: 3750842 - RNA, 14 nt, Salmonella typhimurium LT2
agcuucugucccag

SEQ ID NO: 3750843 - RNA, 14 nt, Salmonella typhimurium LT2
agcuugaucaucag

SEQ ID NO: 3750844 - RNA, 22 nt, Salmonella typhimurium LT2
agcuugcauggccggucuuaug

SEQ ID NO: 3750845 - RNA, 15 nt, Salmonella typhimurium LT2
agcuugcgcagagua

SEQ ID NO: 3750846 - RNA, 22 nt, Salmonella typhimurium LT2
agcuuggccaguggggcugcug

SEQ ID NO: 3750847 - RNA, 14 nt, Salmonella typhimurium LT2
agcuuuauggcgau

SEQ ID NO: 3750848 - RNA, 16 nt, Salmonella typhimurium LT2
agcuuuccaccagcca

SEQ ID NO: 3750849 - RNA, 18 nt, Salmonella typhimurium LT2
agcuuucugaauuucacg

SEQ ID NO: 3750850 - RNA, 18 nt, Salmonella typhimurium LT2
agcuuugcguaaaaaaac

SEQ ID NO: 3750851 - RNA, 22 nt, Salmonella typhimurium LT2
agcuuugcguaaaaaaacauca

SEQ ID NO: 3750852 - RNA, 22 nt, Salmonella typhimurium LT2
agcuuuucaugacgcucuccuc

SEQ ID NO: 3750853 - RNA, 14 nt, Salmonella typhimurium LT2
agcuuuucugaugg

SEQ ID NO: 3750854 - RNA, 21 nt, Salmonella typhimurium LT2
agcuuuuggcguaauggcggg

SEQ ID NO: 3750855 - RNA, 15 nt, Salmonella typhimurium LT2
agcuuuuuauuacuu

SEQ ID NO: 3750856 - RNA, 11 nt, Salmonella typhimurium LT2
agcuuuuucuu

SEQ ID NO: 3750857 - RNA, 22 nt, Salmonella typhimurium LT2
aggaaaagaccauccgguuuua

SEQ ID NO: 3750858 - RNA, 14 nt, Salmonella typhimurium LT2
aggaaaagcuguag

SEQ ID NO: 3750859 - RNA, 21 nt, Salmonella typhimurium LT2
aggaaacagguacuuacccag

SEQ ID NO: 3750860 - RNA, 22 nt, Salmonella typhimurium LT2
aggaaacccucggcgaacaggc

SEQ ID NO: 3750861 - RNA, 13 nt, Salmonella typhimurium LT2
aggaaacgccagg

SEQ ID NO: 3750862 - RNA, 20 nt, Salmonella typhimurium LT2
aggaaacgcgccggaaggcg

SEQ ID NO: 3750863 - RNA, 16 nt, Salmonella typhimurium LT2
aggaaagcucaggccu

SEQ ID NO: 3750864 - RNA, 12 nt, Salmonella typhimurium LT2
aggaaaggcaga

SEQ ID NO: 3750865 - RNA, 14 nt, Salmonella typhimurium LT2
aggaaauaacgugc

SEQ ID NO: 3750866 - RNA, 13 nt, Salmonella typhimurium LT2
aggaaauccagca

SEQ ID NO: 3750867 - RNA, 20 nt, Salmonella typhimurium LT2
aggaaauccuuccagcgcca

SEQ ID NO: 3750868 - RNA, 16 nt, Salmonella typhimurium LT2
aggaaaucuuccaguu

SEQ ID NO: 3750869 - RNA, 12 nt, Salmonella typhimurium LT2
aggaaauucugg

SEQ ID NO: 3750870 - RNA, 17 nt, Salmonella typhimurium LT2
aggaacaucagccagca

SEQ ID NO: 3750871 - RNA, 19 nt, Salmonella typhimurium LT2
aggaacugcggccagacga

SEQ ID NO: 3750872 - RNA, 17 nt, Salmonella typhimurium LT2
aggaacuguucagccag

SEQ ID NO: 3750873 - RNA, 20 nt, Salmonella typhimurium LT2
aggaacuguucagccagcaa

SEQ ID NO: 3750874 - RNA, 13 nt, Salmonella typhimurium LT2
aggaagcugcgca

SEQ ID NO: 3750875 - RNA, 19 nt, Salmonella typhimurium LT2
aggaaggggaaaagggugg

SEQ ID NO: 3750876 - RNA, 19 nt, Salmonella typhimurium LT2
aggaaguugcugauuaaaa

SEQ ID NO: 3750877 - RNA, 22 nt, Salmonella typhimurium LT2
aggaauaacaucguaaaucaaa

SEQ ID NO: 3750878 - RNA, 17 nt, Salmonella typhimurium LT2
aggaauacccagcucag

SEQ ID NO: 3750879 - RNA, 15 nt, Salmonella typhimurium LT2
aggaauccagcgcgc

SEQ ID NO: 3750880 - RNA, 13 nt, Salmonella typhimurium LT2
aggaaucguccga

SEQ ID NO: 3750881 - RNA, 15 nt, Salmonella typhimurium LT2
aggaauuuaucaaca

SEQ ID NO: 3750882 - RNA, 13 nt, Salmonella typhimurium LT2
aggaauuuuccca

SEQ ID NO: 3750883 - RNA, 21 nt, Salmonella typhimurium LT2
aggaauuuucccauaaaagag

SEQ ID NO: 3750884 - RNA, 14 nt, Salmonella typhimurium LT2
aggacaagcugcgc

SEQ ID NO: 3750885 - RNA, 15 nt, Salmonella typhimurium LT2
aggccggacaggcga

SEQ ID NO: 3750886 - RNA, 14 nt, Salmonella typhimurium LT2
aggccggauaagca

SEQ ID NO: 3750887 - RNA, 16 nt, Salmonella typhimurium LT2
aggccggcauaaugau

SEQ ID NO: 3750888 - RNA, 14 nt, Salmonella typhimurium LT2
aggccgggaaaucu

SEQ ID NO: 3750889 - RNA, 22 nt, Salmonella typhimurium LT2
aggccgggaaaucuucuacuuc

SEQ ID NO: 3750890 - RNA, 19 nt, Salmonella typhimurium LT2
aggccggguccgcccggca

SEQ ID NO: 3750891 - RNA, 16 nt, Salmonella typhimurium LT2
aggccgucgacagacg

SEQ ID NO: 3750892 - RNA, 20 nt, Salmonella typhimurium LT2
aggccguuauugucaugcua

SEQ ID NO: 3750893 - RNA, 23 nt, Salmonella typhimurium LT2
aggccguuauugucaugcuaaaa

SEQ ID NO: 3750894 - RNA, 19 nt, Salmonella typhimurium LT2
aggccguugugucccugga

SEQ ID NO: 3750895 - RNA, 18 nt, Salmonella typhimurium LT2
aggccuacacguugcgac

SEQ ID NO: 3750896 - RNA, 13 nt, Salmonella typhimurium LT2
aggccuaccagcc

SEQ ID NO: 3750897 - RNA, 21 nt, Salmonella typhimurium LT2
aggccucgaccaguuuuuccg

SEQ ID NO: 3750898 - RNA, 22 nt, Salmonella typhimurium LT2
aggccucuaucuucucaggcga

SEQ ID NO: 3750899 - RNA, 18 nt, Salmonella typhimurium LT2
aggccugcaaaccucucc

SEQ ID NO: 3750900 - RNA, 22 nt, Salmonella typhimurium LT2
aggccugccggguuuaaugcgc

SEQ ID NO: 3750901 - RNA, 19 nt, Salmonella typhimurium LT2
aggccuggccuucaaucag

SEQ ID NO: 3750902 - RNA, 24 nt, Salmonella typhimurium LT2
aggccuuauugugccgcggcuuca

SEQ ID NO: 3750903 - RNA, 17 nt, Salmonella typhimurium LT2
aggccuuuucguacaug

SEQ ID NO: 3750904 - RNA, 18 nt, Salmonella typhimurium LT2
aggccuuuugcagcagcg

SEQ ID NO: 3750905 - RNA, 18 nt, Salmonella typhimurium LT2
aggcgaaaauaggcuuuu

SEQ ID NO: 3750906 - RNA, 21 nt, Salmonella typhimurium LT2
aggcgaacauaagagauggaa

SEQ ID NO: 3750907 - RNA, 21 nt, Salmonella typhimurium LT2
aggcgaaccgagauacgcuga

SEQ ID NO: 3750908 - RNA, 13 nt, Salmonella typhimurium LT2
aggcgaauagcgc

SEQ ID NO: 3750909 - RNA, 14 nt, Salmonella typhimurium LT2
aggcgacauauuuu

SEQ ID NO: 3750910 - RNA, 18 nt, Salmonella typhimurium LT2
aggcgaccaauauccgca

SEQ ID NO: 3750911 - RNA, 14 nt, Salmonella typhimurium LT2
aggcgacccauaac

SEQ ID NO: 3750912 - RNA, 17 nt, Salmonella typhimurium LT2
aggcgacgaugugcaua

SEQ ID NO: 3750913 - RNA, 21 nt, Salmonella typhimurium LT2
aggcgacucauuacgccacgu

SEQ ID NO: 3750914 - RNA, 15 nt, Salmonella typhimurium LT2
aggcgauaccgcgcu

SEQ ID NO: 3750915 - RNA, 15 nt, Salmonella typhimurium LT2
aggcgauagccccag

SEQ ID NO: 3750916 - RNA, 21 nt, Salmonella typhimurium LT2
aggcgauccuguucaaacauc

SEQ ID NO: 3750917 - RNA, 18 nt, Salmonella typhimurium LT2
aggcgcagaaccauacug

SEQ ID NO: 3750918 - RNA, 11 nt, Salmonella typhimurium LT2
aggcgcagcaa

SEQ ID NO: 3750919 - RNA, 21 nt, Salmonella typhimurium LT2
aggcgcagcaaacggcauagc

SEQ ID NO: 3750920 - RNA, 13 nt, Salmonella typhimurium LT2
aggcgcagccgcc

SEQ ID NO: 3750921 - RNA, 20 nt, Salmonella typhimurium LT2
aggcgcagccgccauccggc

SEQ ID NO: 3750922 - RNA, 21 nt, Salmonella typhimurium LT2
aggcgcagccgccauccggca

SEQ ID NO: 3750923 - RNA, 17 nt, Salmonella typhimurium LT2
aggcgcaguugaaaaca

SEQ ID NO: 3750924 - RNA, 22 nt, Salmonella typhimurium LT2
aggcgcaguugaaaacauuguc

SEQ ID NO: 3750925 - RNA, 20 nt, Salmonella typhimurium LT2
aggcgcccgagcgccgcuuu

SEQ ID NO: 3750926 - RNA, 21 nt, Salmonella typhimurium LT2
aggcgccgcucaucaccagca

SEQ ID NO: 3750927 - RNA, 22 nt, Salmonella typhimurium LT2
aggcgccgcucaucaccagcag

SEQ ID NO: 3750928 - RNA, 18 nt, Salmonella typhimurium LT2
aggcgccguuuacagccg

SEQ ID NO: 3750929 - RNA, 17 nt, Salmonella typhimurium LT2
aggcgccuuauccggcc

SEQ ID NO: 3750930 - RNA, 15 nt, Salmonella typhimurium LT2
aggcgcgaaacgccu

SEQ ID NO: 3750931 - RNA, 23 nt, Salmonella typhimurium LT2
aggcgcgaaucgacaauccgcca

SEQ ID NO: 3750932 - RNA, 17 nt, Salmonella typhimurium LT2
aggcgcgaccucaucaa

SEQ ID NO: 3750933 - RNA, 15 nt, Salmonella typhimurium LT2
aggcgcgcagcugcc

SEQ ID NO: 3750934 - RNA, 17 nt, Salmonella typhimurium LT2
aggcgcgcagcugccac

SEQ ID NO: 3750935 - RNA, 18 nt, Salmonella typhimurium LT2
aggcgcggccucauggcg

SEQ ID NO: 3750936 - RNA, 18 nt, Salmonella typhimurium LT2
aggcgcguaguuggccuu

SEQ ID NO: 3750937 - RNA, 12 nt, Salmonella typhimurium LT2
aggcgcuaccag

SEQ ID NO: 3750938 - RNA, 16 nt, Salmonella typhimurium LT2
aggcgcuaugcugauc

SEQ ID NO: 3750939 - RNA, 21 nt, Salmonella typhimurium LT2
aggcgcuaugcugaucaucug

SEQ ID NO: 3750940 - RNA, 20 nt, Salmonella typhimurium LT2
aggcgcuauucccaggcaaa

SEQ ID NO: 3750941 - RNA, 16 nt, Salmonella typhimurium LT2
aggcgcuugugauauc

SEQ ID NO: 3750942 - RNA, 16 nt, Salmonella typhimurium LT2
aggcggaaaucagcac

SEQ ID NO: 3750943 - RNA, 16 nt, Salmonella typhimurium LT2
aggcggagccgccauc

SEQ ID NO: 3750944 - RNA, 20 nt, Salmonella typhimurium LT2
aggcggauacagcggcgcgc

SEQ ID NO: 3750945 - RNA, 20 nt, Salmonella typhimurium LT2
aggcggauaccccucgccuu

SEQ ID NO: 3750946 - RNA, 15 nt, Salmonella typhimurium LT2
aggcggcaauauccu

SEQ ID NO: 3750947 - RNA, 13 nt, Salmonella typhimurium LT2
aggcggcaaucag

SEQ ID NO: 3750948 - RNA, 18 nt, Salmonella typhimurium LT2
aggcggcaaucagcgccc

SEQ ID NO: 3750949 - RNA, 23 nt, Salmonella typhimurium LT2
aggcggcgccgcgccgccguagc

SEQ ID NO: 3750950 - RNA, 20 nt, Salmonella typhimurium LT2
aggcggcuuuuucaucaucg

SEQ ID NO: 3750951 - RNA, 15 nt, Salmonella typhimurium LT2
aggcggguaauuugc

SEQ ID NO: 3750952 - RNA, 21 nt, Salmonella typhimurium LT2
aggcggguauggcgccaauau

SEQ ID NO: 3750953 - RNA, 18 nt, Salmonella typhimurium LT2
aggcggucuggauuuggc

SEQ ID NO: 3750954 - RNA, 23 nt, Salmonella typhimurium LT2
aggcgguucuguaucccguuaag

SEQ ID NO: 3750955 - RNA, 17 nt, Salmonella typhimurium LT2
aggcgguuuauccggcg

SEQ ID NO: 3750956 - RNA, 14 nt, Salmonella typhimurium LT2
aggcguaaccgcca

SEQ ID NO: 3750957 - RNA, 16 nt, Salmonella typhimurium LT2
aggcguaaccgccauc

SEQ ID NO: 3750958 - RNA, 20 nt, Salmonella typhimurium LT2
aggcguagcgccaucaggca

SEQ ID NO: 3750959 - RNA, 15 nt, Salmonella typhimurium LT2
aggcgucaaaacagg

SEQ ID NO: 3750960 - RNA, 14 nt, Salmonella typhimurium LT2
aggcgucacggcga

SEQ ID NO: 3750961 - RNA, 18 nt, Salmonella typhimurium LT2
aggcgucauagccgcgcg

SEQ ID NO: 3750962 - RNA, 17 nt, Salmonella typhimurium LT2
aggcgucgaccggucca

SEQ ID NO: 3750963 - RNA, 14 nt, Salmonella typhimurium LT2
aggcgugacguuca

SEQ ID NO: 3750964 - RNA, 16 nt, Salmonella typhimurium LT2
aggcgugacguucagg

SEQ ID NO: 3750965 - RNA, 16 nt, Salmonella typhimurium LT2
aggcgugauugagcag

SEQ ID NO: 3750966 - RNA, 23 nt, Salmonella typhimurium LT2
aggcgugcguauugccccgucag

SEQ ID NO: 3750967 - RNA, 18 nt, Salmonella typhimurium LT2
aggcgugguggauaucca

SEQ ID NO: 3750968 - RNA, 20 nt, Salmonella typhimurium LT2
aggcguugugcugcggcaug

SEQ ID NO: 3750969 - RNA, 13 nt, Salmonella typhimurium LT2
aggcguuucaaca

SEQ ID NO: 3750970 - RNA, 22 nt, Salmonella typhimurium LT2
aggcguuucgccgccauccggc

SEQ ID NO: 3750971 - RNA, 22 nt, Salmonella typhimurium LT2
aggcguuuuagccguucauagu

SEQ ID NO: 3750972 - RNA, 14 nt, Salmonella typhimurium LT2
aggcuaaucaggaa

SEQ ID NO: 3750973 - RNA, 14 nt, Salmonella typhimurium LT2
aggcuacccagaca

SEQ ID NO: 3750974 - RNA, 17 nt, Salmonella typhimurium LT2
aggcuacccagacaagc

SEQ ID NO: 3750975 - RNA, 23 nt, Salmonella typhimurium LT2
aggcuacgaacgcgaaggccagc

SEQ ID NO: 3750976 - RNA, 22 nt, Salmonella typhimurium LT2
aggcuacgguacugcccaccuu

SEQ ID NO: 3750977 - RNA, 19 nt, Salmonella typhimurium LT2
aggcuaugcucccccccuu

SEQ ID NO: 3750978 - RNA, 19 nt, Salmonella typhimurium LT2
aggcucaaaguuaccggca

SEQ ID NO: 3750979 - RNA, 13 nt, Salmonella typhimurium LT2
aggcucaaauuug

SEQ ID NO: 3750980 - RNA, 22 nt, Salmonella typhimurium LT2
aggcuccgagacucaaagaaaa

SEQ ID NO: 3750981 - RNA, 21 nt, Salmonella typhimurium LT2
aggcucgcauucgcgagccuu

SEQ ID NO: 3750982 - RNA, 14 nt, Salmonella typhimurium LT2
aggcugcgcgaauu

SEQ ID NO: 3750983 - RNA, 20 nt, Salmonella typhimurium LT2
aggcugcucauuucagcgag

SEQ ID NO: 3750984 - RNA, 20 nt, Salmonella typhimurium LT2
aggcugcuugagccagugag

SEQ ID NO: 3750985 - RNA, 22 nt, Salmonella typhimurium LT2
aggcuggaauaaccggugccaa

SEQ ID NO: 3750986 - RNA, 13 nt, Salmonella typhimurium LT2
aggcuggaucagg

SEQ ID NO: 3750987 - RNA, 16 nt, Salmonella typhimurium LT2
aggcuggcaaagcagg

SEQ ID NO: 3750988 - RNA, 12 nt, Salmonella typhimurium LT2
aggugaguaaau

SEQ ID NO: 3750989 - RNA, 12 nt, Salmonella typhimurium LT2
aggugauaagca

SEQ ID NO: 3750990 - RNA, 23 nt, Salmonella typhimurium LT2
aggugauaccuguugcacgcaug

SEQ ID NO: 3750991 - RNA, 17 nt, Salmonella typhimurium LT2
aggugauguccagacca

SEQ ID NO: 3750992 - RNA, 18 nt, Salmonella typhimurium LT2
aggugcggauaguccugc

SEQ ID NO: 3750993 - RNA, 23 nt, Salmonella typhimurium LT2
aggugcuugcgccgccauccggc

SEQ ID NO: 3750994 - RNA, 23 nt, Salmonella typhimurium LT2
agguggcgaagcucagccaggcg

SEQ ID NO: 3750995 - RNA, 20 nt, Salmonella typhimurium LT2
agguggcggaauugguagac

SEQ ID NO: 3750996 - RNA, 16 nt, Salmonella typhimurium LT2
agguggcuagcccgcu

SEQ ID NO: 3750997 - RNA, 17 nt, Salmonella typhimurium LT2
agguggcuagcccgcug

SEQ ID NO: 3750998 - RNA, 13 nt, Salmonella typhimurium LT2
agguggugcaggc

SEQ ID NO: 3750999 - RNA, 18 nt, Salmonella typhimurium LT2
agguggugcucuaaccaa

SEQ ID NO: 3751000 - RNA, 23 nt, Salmonella typhimurium LT2
agguggugcucuaaccaacugag

SEQ ID NO: 3751001 - RNA, 17 nt, Salmonella typhimurium LT2
agguguaucccuauucu

SEQ ID NO: 3751002 - RNA, 14 nt, Salmonella typhimurium LT2
agguguauguaacu

SEQ ID NO: 3751003 - RNA, 22 nt, Salmonella typhimurium LT2
aggugugguacggcuuucacac

SEQ ID NO: 3751004 - RNA, 21 nt, Salmonella typhimurium LT2
agguguuacgcgggucgagaa

SEQ ID NO: 3751005 - RNA, 14 nt, Salmonella typhimurium LT2
agguuaaccaugcc

SEQ ID NO: 3751006 - RNA, 16 nt, Salmonella typhimurium LT2
agguuaaccaugcccg

SEQ ID NO: 3751007 - RNA, 20 nt, Salmonella typhimurium LT2
agguuaacccacaacgcacc

SEQ ID NO: 3751008 - RNA, 14 nt, Salmonella typhimurium LT2
agguuaguaaugcc

SEQ ID NO: 3751009 - RNA, 20 nt, Salmonella typhimurium LT2
agguuaguaaugccuucuga

SEQ ID NO: 3751010 - RNA, 13 nt, Salmonella typhimurium LT2
agguuaugcgcac

SEQ ID NO: 3751011 - RNA, 24 nt, Salmonella typhimurium LT2
agguuauuaaaaagccagcguaaa

SEQ ID NO: 3751012 - RNA, 19 nt, Salmonella typhimurium LT2
agguuauuguguuacaugu

SEQ ID NO: 3751013 - RNA, 18 nt, Salmonella typhimurium LT2
agguucaccaccacccag

SEQ ID NO: 3751014 - RNA, 15 nt, Salmonella typhimurium LT2
agguuccaggcacuc

SEQ ID NO: 3751015 - RNA, 15 nt, Salmonella typhimurium LT2
agguucccgccgcca

SEQ ID NO: 3751016 - RNA, 17 nt, Salmonella typhimurium LT2
agguucccgccgccauc

SEQ ID NO: 3751017 - RNA, 14 nt, Salmonella typhimurium LT2
agguuccgacaaua

SEQ ID NO: 3751018 - RNA, 20 nt, Salmonella typhimurium LT2
agguucgggccaccuuccag

SEQ ID NO: 3751019 - RNA, 14 nt, Salmonella typhimurium LT2
agguugaugcaaau

SEQ ID NO: 3751020 - RNA, 17 nt, Salmonella typhimurium LT2
agguugcgccaacguca

SEQ ID NO: 3751021 - RNA, 16 nt, Salmonella typhimurium LT2
agguugcgcccggcgc

SEQ ID NO: 3751022 - RNA, 16 nt, Salmonella typhimurium LT2
agguuguuuuauuacc

SEQ ID NO: 3751023 - RNA, 21 nt, Salmonella typhimurium LT2
agguuuaauguugccguggca

SEQ ID NO: 3751024 - RNA, 15 nt, Salmonella typhimurium LT2
agguuucuucaucaa

SEQ ID NO: 3751025 - RNA, 16 nt, Salmonella typhimurium LT2
agguuucuucaucaaa

SEQ ID NO: 3751026 - RNA, 20 nt, Salmonella typhimurium LT2
agguuugcgcggcggguaaa

SEQ ID NO: 3751027 - RNA, 13 nt, Salmonella typhimurium LT2
aguaaaaagaaag

SEQ ID NO: 3751028 - RNA, 14 nt, Salmonella typhimurium LT2
aguaaacagcauca

SEQ ID NO: 3751029 - RNA, 15 nt, Salmonella typhimurium LT2
aguaaacagguaguc

SEQ ID NO: 3751030 - RNA, 20 nt, Salmonella typhimurium LT2
aguaaacuccucuuccgaca

SEQ ID NO: 3751031 - RNA, 14 nt, Salmonella typhimurium LT2
aguaaagauuuguu

SEQ ID NO: 3751032 - RNA, 17 nt, Salmonella typhimurium LT2
aguaaagauuuuuauua

SEQ ID NO: 3751033 - RNA, 19 nt, Salmonella typhimurium LT2
aguaaagauuuuuauuaaa

SEQ ID NO: 3751034 - RNA, 12 nt, Salmonella typhimurium LT2
aguaaaggcguu

SEQ ID NO: 3751035 - RNA, 15 nt, Salmonella typhimurium LT2
aguaaaguuauucac

SEQ ID NO: 3751036 - RNA, 13 nt, Salmonella typhimurium LT2
aguaaauaaaaac

SEQ ID NO: 3751037 - RNA, 17 nt, Salmonella typhimurium LT2
aguaaauaaaaaccauu

SEQ ID NO: 3751038 - RNA, 13 nt, Salmonella typhimurium LT2
aguaaauaacaaa

SEQ ID NO: 3751039 - RNA, 15 nt, Salmonella typhimurium LT2
aguaaauaagaaaau

SEQ ID NO: 3751040 - RNA, 15 nt, Salmonella typhimurium LT2
aguaaaucaacuuuu

SEQ ID NO: 3751041 - RNA, 17 nt, Salmonella typhimurium LT2
aguaaauuauuccuuga

SEQ ID NO: 3751042 - RNA, 21 nt, Salmonella typhimurium LT2
aguaaauuauuuacaguaucu

SEQ ID NO: 3751043 - RNA, 22 nt, Salmonella typhimurium LT2
aguaaauugacgcuugacucug

SEQ ID NO: 3751044 - RNA, 15 nt, Salmonella typhimurium LT2
aguaaauuuacucag

SEQ ID NO: 3751045 - RNA, 14 nt, Salmonella typhimurium LT2
aguaacauaaugcc

SEQ ID NO: 3751046 - RNA, 15 nt, Salmonella typhimurium LT2
aguaaccaccacuga

SEQ ID NO: 3751047 - RNA, 20 nt, Salmonella typhimurium LT2
aguaaccacgauaaagacac

SEQ ID NO: 3751048 - RNA, 22 nt, Salmonella typhimurium LT2
aguaacccgauacccugagccc

SEQ ID NO: 3751049 - RNA, 16 nt, Salmonella typhimurium LT2
aguaaccuauuuuaaa

SEQ ID NO: 3751050 - RNA, 16 nt, Salmonella typhimurium LT2
aguaaccuuucaccuu

SEQ ID NO: 3751051 - RNA, 17 nt, Salmonella typhimurium LT2
aguaacgauacccacca

SEQ ID NO: 3751052 - RNA, 22 nt, Salmonella typhimurium LT2
aguaacgcguccaacuggcuuu

SEQ ID NO: 3751053 - RNA, 15 nt, Salmonella typhimurium LT2
aguaacgcuggaaga

SEQ ID NO: 3751054 - RNA, 18 nt, Salmonella typhimurium LT2
aguaacgcuggaagaggc

SEQ ID NO: 3751055 - RNA, 19 nt, Salmonella typhimurium LT2
aguaacucuauaucgacag

SEQ ID NO: 3751056 - RNA, 18 nt, Salmonella typhimurium LT2
aguaacugcaaaucuucg

SEQ ID NO: 3751057 - RNA, 13 nt, Salmonella typhimurium LT2
aguaagacaaaaa

SEQ ID NO: 3751058 - RNA, 16 nt, Salmonella typhimurium LT2
aguaagcgccagccgu

SEQ ID NO: 3751059 - RNA, 17 nt, Salmonella typhimurium LT2
aguaagcuauuucugua

SEQ ID NO: 3751060 - RNA, 17 nt, Salmonella typhimurium LT2
aguaaggcauaaugcca

SEQ ID NO: 3751061 - RNA, 17 nt, Salmonella typhimurium LT2
aguaaggcugauuauau

SEQ ID NO: 3751062 - RNA, 18 nt, Salmonella typhimurium LT2
aguaaggcugauuauaua

SEQ ID NO: 3751063 - RNA, 19 nt, Salmonella typhimurium LT2
aguaaggcugauuauauaa

SEQ ID NO: 3751064 - RNA, 14 nt, Salmonella typhimurium LT2
aguaaguacuccag

SEQ ID NO: 3751065 - RNA, 12 nt, Salmonella typhimurium LT2
aguaauaaaaaa

SEQ ID NO: 3751066 - RNA, 12 nt, Salmonella typhimurium LT2
aguaauauuaaa

SEQ ID NO: 3751067 - RNA, 19 nt, Salmonella typhimurium LT2
aguaaugauguuggggaga

SEQ ID NO: 3751068 - RNA, 18 nt, Salmonella typhimurium LT2
aguaauuucuugcgccag

SEQ ID NO: 3751069 - RNA, 13 nt, Salmonella typhimurium LT2
aguaauuugugau

SEQ ID NO: 3751070 - RNA, 21 nt, Salmonella typhimurium LT2
aguaauuuuucucccagcaga

SEQ ID NO: 3751071 - RNA, 15 nt, Salmonella typhimurium LT2
aguacaaacaaauaa

SEQ ID NO: 3751072 - RNA, 11 nt, Salmonella typhimurium LT2
aguacaauacc

SEQ ID NO: 3751073 - RNA, 20 nt, Salmonella typhimurium LT2
aguacaaugcaaagaaaaac

SEQ ID NO: 3751074 - RNA, 15 nt, Salmonella typhimurium LT2
aguacacgucgguau

SEQ ID NO: 3751075 - RNA, 18 nt, Salmonella typhimurium LT2
aguacagggcgauuuccg

SEQ ID NO: 3751076 - RNA, 18 nt, Salmonella typhimurium LT2
aguacaggguuugucagc

SEQ ID NO: 3751077 - RNA, 18 nt, Salmonella typhimurium LT2
aguaccgaaaucaucaau

SEQ ID NO: 3751078 - RNA, 19 nt, Salmonella typhimurium LT2
aguaccgaaaucaucaauc

SEQ ID NO: 3751079 - RNA, 15 nt, Salmonella typhimurium LT2
aguaccgaacagcca

SEQ ID NO: 3751080 - RNA, 18 nt, Salmonella typhimurium LT2
aguaccgaacagccaggc

SEQ ID NO: 3751081 - RNA, 19 nt, Salmonella typhimurium LT2
aguaccgaacagccaggcu

SEQ ID NO: 3751082 - RNA, 17 nt, Salmonella typhimurium LT2
aguaccgccgccgggcc

SEQ ID NO: 3751083 - RNA, 23 nt, Salmonella typhimurium LT2
aguaccggcaggacaaucauaau

SEQ ID NO: 3751084 - RNA, 14 nt, Salmonella typhimurium LT2
aguacgcaccagcc

SEQ ID NO: 3751085 - RNA, 22 nt, Salmonella typhimurium LT2
aguacgcccgugacgccaggca

SEQ ID NO: 3751086 - RNA, 15 nt, Salmonella typhimurium LT2
aguacgccucgcgca

SEQ ID NO: 3751087 - RNA, 23 nt, Salmonella typhimurium LT2
aguacgccuuucaccaucagcau

SEQ ID NO: 3751088 - RNA, 19 nt, Salmonella typhimurium LT2
aguacggaacaaaacggaa

SEQ ID NO: 3751089 - RNA, 18 nt, Salmonella typhimurium LT2
aguacggcgcgaaucccg

SEQ ID NO: 3751090 - RNA, 20 nt, Salmonella typhimurium LT2
aguacggcgcgaaucccgcg

SEQ ID NO: 3751091 - RNA, 18 nt, Salmonella typhimurium LT2
aguacgggucugaauagc

SEQ ID NO: 3751092 - RNA, 16 nt, Salmonella typhimurium LT2
agucuucauggucgga

SEQ ID NO: 3751093 - RNA, 17 nt, Salmonella typhimurium LT2
agucuuuuguuuuucuc

SEQ ID NO: 3751094 - RNA, 12 nt, Salmonella typhimurium LT2
agugaaaaaaag

SEQ ID NO: 3751095 - RNA, 15 nt, Salmonella typhimurium LT2
agugaacacccugcc

SEQ ID NO: 3751096 - RNA, 19 nt, Salmonella typhimurium LT2
agugaacgguugagcuuuu

SEQ ID NO: 3751097 - RNA, 18 nt, Salmonella typhimurium LT2
agugaagugcaggauaga

SEQ ID NO: 3751098 - RNA, 21 nt, Salmonella typhimurium LT2
agugaagugugaacuaugcug

SEQ ID NO: 3751099 - RNA, 21 nt, Salmonella typhimurium LT2
agugaauacugcgcgucguca

SEQ ID NO: 3751100 - RNA, 19 nt, Salmonella typhimurium LT2
agugaauccagcguacuga

SEQ ID NO: 3751101 - RNA, 17 nt, Salmonella typhimurium LT2
agugaaucgacggcaau

SEQ ID NO: 3751102 - RNA, 23 nt, Salmonella typhimurium LT2
agugaaucgacggcaauauuaaa

SEQ ID NO: 3751103 - RNA, 21 nt, Salmonella typhimurium LT2
agugaauggauaacggcguua

SEQ ID NO: 3751104 - RNA, 16 nt, Salmonella typhimurium LT2
agugacagaggaauga

SEQ ID NO: 3751105 - RNA, 22 nt, Salmonella typhimurium LT2
agugacagaggaaugaaaacga

SEQ ID NO: 3751106 - RNA, 17 nt, Salmonella typhimurium LT2
agugacgacggcagggg

SEQ ID NO: 3751107 - RNA, 20 nt, Salmonella typhimurium LT2
agugacgguuuucacuggca

SEQ ID NO: 3751108 - RNA, 18 nt, Salmonella typhimurium LT2
agugaguccccaggagca

SEQ ID NO: 3751109 - RNA, 20 nt, Salmonella typhimurium LT2
agugauaaagcacagcccca

SEQ ID NO: 3751110 - RNA, 16 nt, Salmonella typhimurium LT2
agugauaacgcgccga

SEQ ID NO: 3751111 - RNA, 17 nt, Salmonella typhimurium LT2
agugauaccagccaaca

SEQ ID NO: 3751112 - RNA, 16 nt, Salmonella typhimurium LT2
agugauuauaaaucaa

SEQ ID NO: 3751113 - RNA, 13 nt, Salmonella typhimurium LT2
agugauuccuuug

SEQ ID NO: 3751114 - RNA, 22 nt, Salmonella typhimurium LT2
agugauuuccggguucacauca

SEQ ID NO: 3751115 - RNA, 21 nt, Salmonella typhimurium LT2
agugcaaucuuuacccggcgc

SEQ ID NO: 3751116 - RNA, 18 nt, Salmonella typhimurium LT2
agugcaggaucaccggca

SEQ ID NO: 3751117 - RNA, 18 nt, Salmonella typhimurium LT2
agugcaguauugcaccag

SEQ ID NO: 3751118 - RNA, 20 nt, Salmonella typhimurium LT2
agugccaaguaacacggcga

SEQ ID NO: 3751119 - RNA, 18 nt, Salmonella typhimurium LT2
agugccacaacgccugau

SEQ ID NO: 3751120 - RNA, 15 nt, Salmonella typhimurium LT2
agugcccagcgcgac

SEQ ID NO: 3751121 - RNA, 19 nt, Salmonella typhimurium LT2
agugcccagcgcgaccugc

SEQ ID NO: 3751122 - RNA, 20 nt, Salmonella typhimurium LT2
agugcccgaacgcaauacug

SEQ ID NO: 3751123 - RNA, 15 nt, Salmonella typhimurium LT2
agugccgccaggcaa

SEQ ID NO: 3751124 - RNA, 15 nt, Salmonella typhimurium LT2
agugccgcucacugg

SEQ ID NO: 3751125 - RNA, 14 nt, Salmonella typhimurium LT2
agugcgcugucagc

SEQ ID NO: 3751126 - RNA, 14 nt, Salmonella typhimurium LT2
agugcucaccgaca

SEQ ID NO: 3751127 - RNA, 14 nt, Salmonella typhimurium LT2
agugcuguuccucg

SEQ ID NO: 3751128 - RNA, 16 nt, Salmonella typhimurium LT2
agugcuucuucaaacu

SEQ ID NO: 3751129 - RNA, 23 nt, Salmonella typhimurium LT2
aguggaaaacagcauaauaaagc

SEQ ID NO: 3751130 - RNA, 14 nt, Salmonella typhimurium LT2
aguggacgcgucgc

SEQ ID NO: 3751131 - RNA, 20 nt, Salmonella typhimurium LT2
aguggauagaguuaaaaggu

SEQ ID NO: 3751132 - RNA, 20 nt, Salmonella typhimurium LT2
aguggccaucuuccagcauc

SEQ ID NO: 3751133 - RNA, 21 nt, Salmonella typhimurium LT2
aguggccaucuuccagcauca

SEQ ID NO: 3751134 - RNA, 15 nt, Salmonella typhimurium LT2
aguggcggaaaauag

SEQ ID NO: 3751135 - RNA, 14 nt, Salmonella typhimurium LT2
aguggcggcaaaaa

SEQ ID NO: 3751136 - RNA, 16 nt, Salmonella typhimurium LT2
aguggcggcacgcagg

SEQ ID NO: 3751137 - RNA, 16 nt, Salmonella typhimurium LT2
agugggaucagguaag

SEQ ID NO: 3751138 - RNA, 20 nt, Salmonella typhimurium LT2
aguggggaaaaaccccuggu

SEQ ID NO: 3751139 - RNA, 16 nt, Salmonella typhimurium LT2
agugggucacaucgcc

SEQ ID NO: 3751140 - RNA, 22 nt, Salmonella typhimurium LT2
aguggucgccacgcgacgccag

SEQ ID NO: 3751141 - RNA, 13 nt, Salmonella typhimurium LT2
aguggugggugau

SEQ ID NO: 3751142 - RNA, 17 nt, Salmonella typhimurium LT2
aguggugggugaugacg

SEQ ID NO: 3751143 - RNA, 16 nt, Salmonella typhimurium LT2
agugguuuuaagcuuc

SEQ ID NO: 3751144 - RNA, 16 nt, Salmonella typhimurium LT2
aguguaaaaauuuuug

SEQ ID NO: 3751145 - RNA, 22 nt, Salmonella typhimurium LT2
aguguaaaaauuuuugaucugc

SEQ ID NO: 3751146 - RNA, 16 nt, Salmonella typhimurium LT2
aguguaaguucauuua

SEQ ID NO: 3751147 - RNA, 14 nt, Salmonella typhimurium LT2
agugucgauaaccu

SEQ ID NO: 3751148 - RNA, 18 nt, Salmonella typhimurium LT2
agugucgauaaccuggau

SEQ ID NO: 3751149 - RNA, 22 nt, Salmonella typhimurium LT2
agugugcaaacgauaaaagcuc

SEQ ID NO: 3751150 - RNA, 19 nt, Salmonella typhimurium LT2
agugugccgucauccagca

SEQ ID NO: 3751151 - RNA, 18 nt, Salmonella typhimurium LT2
agugugcucguuuuuaua

SEQ ID NO: 3751152 - RNA, 20 nt, Salmonella typhimurium LT2
aguguguaccagcaacgcca

SEQ ID NO: 3751153 - RNA, 21 nt, Salmonella typhimurium LT2
aguguguaccagcaacgccag

SEQ ID NO: 3751154 - RNA, 16 nt, Salmonella typhimurium LT2
aguguuagcucuuauu

SEQ ID NO: 3751155 - RNA, 21 nt, Salmonella typhimurium LT2
aguguuauauucccgaaaggu

SEQ ID NO: 3751156 - RNA, 14 nt, Salmonella typhimurium LT2
aguguuaucgccga

SEQ ID NO: 3751157 - RNA, 18 nt, Salmonella typhimurium LT2
aguguuucccaacaaugc

SEQ ID NO: 3751158 - RNA, 23 nt, Salmonella typhimurium LT2
aguuaacagaaugcugaacagcc

SEQ ID NO: 3751159 - RNA, 23 nt, Salmonella typhimurium LT2
aguuaacgccguuaccagcauca

SEQ ID NO: 3751160 - RNA, 21 nt, Salmonella typhimurium LT2
aguuaacgcguuaaucacuac

SEQ ID NO: 3751161 - RNA, 19 nt, Salmonella typhimurium LT2
aguuaagcaacugauuaau

SEQ ID NO: 3751162 - RNA, 19 nt, Salmonella typhimurium LT2
aguuaagcggggguaacaa

SEQ ID NO: 3751163 - RNA, 24 nt, Salmonella typhimurium LT2
aguuaauucguccccagcgaucca

SEQ ID NO: 3751164 - RNA, 18 nt, Salmonella typhimurium LT2
aguuacaggcuccaggua

SEQ ID NO: 3751165 - RNA, 15 nt, Salmonella typhimurium LT2
aguuacgcacgccag

SEQ ID NO: 3751166 - RNA, 19 nt, Salmonella typhimurium LT2
aguuacgcacgccagauaa

SEQ ID NO: 3751167 - RNA, 14 nt, Salmonella typhimurium LT2
aguuacguuugcag

SEQ ID NO: 3751168 - RNA, 23 nt, Salmonella typhimurium LT2
aguuauaaauccccgccgccauc

SEQ ID NO: 3751169 - RNA, 21 nt, Salmonella typhimurium LT2
aguuaucgauucugaauaaua

SEQ ID NO: 3751170 - RNA, 19 nt, Salmonella typhimurium LT2
aguuauguauuuaauuuuu

SEQ ID NO: 3751171 - RNA, 23 nt, Salmonella typhimurium LT2
aguuauguauuuaauuuuuccuu

SEQ ID NO: 3751172 - RNA, 19 nt, Salmonella typhimurium LT2
aguuauguuauccccacuu

SEQ ID NO: 3751173 - RNA, 16 nt, Salmonella typhimurium LT2
aguucaccaguuuuuc

SEQ ID NO: 3751174 - RNA, 14 nt, Salmonella typhimurium LT2
aguucacgguaaua

SEQ ID NO: 3751175 - RNA, 15 nt, Salmonella typhimurium LT2
aguucagcagcacca

SEQ ID NO: 3751176 - RNA, 23 nt, Salmonella typhimurium LT2
aguucaggaacaucagcauuggu

SEQ ID NO: 3751177 - RNA, 23 nt, Salmonella typhimurium LT2
aguucaguaugaucaugcccggc

SEQ ID NO: 3751178 - RNA, 14 nt, Salmonella typhimurium LT2
aguucauauggcgu

SEQ ID NO: 3751179 - RNA, 17 nt, Salmonella typhimurium LT2
aguucaucacaaaauca

SEQ ID NO: 3751180 - RNA, 14 nt, Salmonella typhimurium LT2
aguucauccagcag

SEQ ID NO: 3751181 - RNA, 16 nt, Salmonella typhimurium LT2
aguucauccagcagca

SEQ ID NO: 3751182 - RNA, 15 nt, Salmonella typhimurium LT2
aguucauuauuucau

SEQ ID NO: 3751183 - RNA, 22 nt, Salmonella typhimurium LT2
aguuccaccguaugugcgccgu

SEQ ID NO: 3751184 - RNA, 17 nt, Salmonella typhimurium LT2
aguuccaggacggacau

SEQ ID NO: 3751185 - RNA, 11 nt, Salmonella typhimurium LT2
aguucccagcg

SEQ ID NO: 3751186 - RNA, 15 nt, Salmonella typhimurium LT2
aguucccgacaggcu

SEQ ID NO: 3751187 - RNA, 15 nt, Salmonella typhimurium LT2
aguucccuacucucg

SEQ ID NO: 3751188 - RNA, 22 nt, Salmonella typhimurium LT2
aguucccuacucucgcaugggg

SEQ ID NO: 3751189 - RNA, 19 nt, Salmonella typhimurium LT2
aguuccgcaaagcccauca

SEQ ID NO: 3751190 - RNA, 20 nt, Salmonella typhimurium LT2
aguuccgcaaagcccaucag

SEQ ID NO: 3751191 - RNA, 18 nt, Salmonella typhimurium LT2
aguuccgcaauccuggcu

SEQ ID NO: 3751192 - RNA, 13 nt, Salmonella typhimurium LT2
aguuccgccagac

SEQ ID NO: 3751193 - RNA, 19 nt, Salmonella typhimurium LT2
aguuccgccagacucagcc

SEQ ID NO: 3751194 - RNA, 12 nt, Salmonella typhimurium LT2
aguuccggauac

SEQ ID NO: 3751195 - RNA, 15 nt, Salmonella typhimurium LT2
auaaagcuuucaucu

SEQ ID NO: 3751196 - RNA, 23 nt, Salmonella typhimurium LT2
auaaaggcuugacucaaaaagag

SEQ ID NO: 3751197 - RNA, 14 nt, Salmonella typhimurium LT2
auaaaggggugcuu

SEQ ID NO: 3751198 - RNA, 16 nt, Salmonella typhimurium LT2
auaaagguauagugga

SEQ ID NO: 3751199 - RNA, 16 nt, Salmonella typhimurium LT2
auaaaguagccaaugc

SEQ ID NO: 3751200 - RNA, 13 nt, Salmonella typhimurium LT2
auaaaguuuauuu

SEQ ID NO: 3751201 - RNA, 23 nt, Salmonella typhimurium LT2
auaaaguuuauuugaauagucaa

SEQ ID NO: 3751202 - RNA, 18 nt, Salmonella typhimurium LT2
auaaauaaggccugagcu

SEQ ID NO: 3751203 - RNA, 16 nt, Salmonella typhimurium LT2
auaaauaccaaagaac

SEQ ID NO: 3751204 - RNA, 17 nt, Salmonella typhimurium LT2
auaaauaccguaaugcc

SEQ ID NO: 3751205 - RNA, 13 nt, Salmonella typhimurium LT2
auaaauagccgac

SEQ ID NO: 3751206 - RNA, 15 nt, Salmonella typhimurium LT2
auaaauagugacgcc

SEQ ID NO: 3751207 - RNA, 15 nt, Salmonella typhimurium LT2
auaaaucaaacgcac

SEQ ID NO: 3751208 - RNA, 13 nt, Salmonella typhimurium LT2
auaaaucagcaca

SEQ ID NO: 3751209 - RNA, 13 nt, Salmonella typhimurium LT2
auaaaucagcgcg

SEQ ID NO: 3751210 - RNA, 16 nt, Salmonella typhimurium LT2
auaaaucaggaaaaag

SEQ ID NO: 3751211 - RNA, 20 nt, Salmonella typhimurium LT2
auaaaucaggaaaaagggaa

SEQ ID NO: 3751212 - RNA, 13 nt, Salmonella typhimurium LT2
auaaaucaucauc

SEQ ID NO: 3751213 - RNA, 20 nt, Salmonella typhimurium LT2
auaaaucgccaccguaacua

SEQ ID NO: 3751214 - RNA, 23 nt, Salmonella typhimurium LT2
auaaaucgccaccguaacuaaaa

SEQ ID NO: 3751215 - RNA, 16 nt, Salmonella typhimurium LT2
auaaaugcuuugcccg

SEQ ID NO: 3751216 - RNA, 18 nt, Salmonella typhimurium LT2
auaaauguacugcaauaa

SEQ ID NO: 3751217 - RNA, 22 nt, Salmonella typhimurium LT2
auaaauuaacucucucuguaau

SEQ ID NO: 3751218 - RNA, 21 nt, Salmonella typhimurium LT2
auaaauucuuuacgcagcaag

SEQ ID NO: 3751219 - RNA, 20 nt, Salmonella typhimurium LT2
auaaauugcacgcccauaca

SEQ ID NO: 3751220 - RNA, 19 nt, Salmonella typhimurium LT2
auaaauuucauccaugcca

SEQ ID NO: 3751221 - RNA, 20 nt, Salmonella typhimurium LT2
auaaauuucauccaugccaa

SEQ ID NO: 3751222 - RNA, 19 nt, Salmonella typhimurium LT2
auaaauuuucauuauaaaa

SEQ ID NO: 3751223 - RNA, 21 nt, Salmonella typhimurium LT2
auaaauuuuuacccacgucau

SEQ ID NO: 3751224 - RNA, 18 nt, Salmonella typhimurium LT2
auaaauuuuuuaacagaa

SEQ ID NO: 3751225 - RNA, 15 nt, Salmonella typhimurium LT2
auaacaaaagcgguu

SEQ ID NO: 3751226 - RNA, 14 nt, Salmonella typhimurium LT2
auaacaaacgccgc

SEQ ID NO: 3751227 - RNA, 23 nt, Salmonella typhimurium LT2
auaacacaauacuucaaaugauu

SEQ ID NO: 3751228 - RNA, 12 nt, Salmonella typhimurium LT2
auaacaucaucc

SEQ ID NO: 3751229 - RNA, 20 nt, Salmonella typhimurium LT2
auaacaucguaaaucaaaug

SEQ ID NO: 3751230 - RNA, 21 nt, Salmonella typhimurium LT2
auaacauugguuaucaaaaac

SEQ ID NO: 3751231 - RNA, 14 nt, Salmonella typhimurium LT2
auaaccaauaaugc

SEQ ID NO: 3751232 - RNA, 14 nt, Salmonella typhimurium LT2
auaaccaauaauug

SEQ ID NO: 3751233 - RNA, 13 nt, Salmonella typhimurium LT2
auaaccaauuaaa

SEQ ID NO: 3751234 - RNA, 18 nt, Salmonella typhimurium LT2
auaaccaauuaaauuauu

SEQ ID NO: 3751235 - RNA, 14 nt, Salmonella typhimurium LT2
auaaccagaaaacc

SEQ ID NO: 3751236 - RNA, 16 nt, Salmonella typhimurium LT2
auaaccagaaaaccga

SEQ ID NO: 3751237 - RNA, 22 nt, Salmonella typhimurium LT2
auaaccagaaaaccgacagcaa

SEQ ID NO: 3751238 - RNA, 17 nt, Salmonella typhimurium LT2
auaaccaucgcgcagcc

SEQ ID NO: 3751239 - RNA, 13 nt, Salmonella typhimurium LT2
auaacccgccugg

SEQ ID NO: 3751240 - RNA, 22 nt, Salmonella typhimurium LT2
auaacccgccuggcgacggguu

SEQ ID NO: 3751241 - RNA, 12 nt, Salmonella typhimurium LT2
auaacccggcug

SEQ ID NO: 3751242 - RNA, 21 nt, Salmonella typhimurium LT2
auaaccggacgauuuaagcuu

SEQ ID NO: 3751243 - RNA, 23 nt, Salmonella typhimurium LT2
auaaccguagauuuucaucauau

SEQ ID NO: 3751244 - RNA, 20 nt, Salmonella typhimurium LT2
auaaccgucgcccguccgcu

SEQ ID NO: 3751245 - RNA, 23 nt, Salmonella typhimurium LT2
auaaccgucuucauccaugcggc

SEQ ID NO: 3751246 - RNA, 16 nt, Salmonella typhimurium LT2
auaaccuauuuugcaa

SEQ ID NO: 3751247 - RNA, 20 nt, Salmonella typhimurium LT2
auaaccucaaugauuuccgc

SEQ ID NO: 3751248 - RNA, 16 nt, Salmonella typhimurium LT2
auaaccucucaccgcc

SEQ ID NO: 3751249 - RNA, 19 nt, Salmonella typhimurium LT2
auaaccuggaugacacagg

SEQ ID NO: 3751250 - RNA, 19 nt, Salmonella typhimurium LT2
auaacgaccccaauagcga

SEQ ID NO: 3751251 - RNA, 18 nt, Salmonella typhimurium LT2
auaacgcaacgucagcga

SEQ ID NO: 3751252 - RNA, 22 nt, Salmonella typhimurium LT2
auaacgcaggcgauagccccag

SEQ ID NO: 3751253 - RNA, 19 nt, Salmonella typhimurium LT2
auaacgccgauaaccagcg

SEQ ID NO: 3751254 - RNA, 22 nt, Salmonella typhimurium LT2
auaacgccgaugccgccgacaa

SEQ ID NO: 3751255 - RNA, 21 nt, Salmonella typhimurium LT2
auaacgccgcccccaugccgc

SEQ ID NO: 3751256 - RNA, 12 nt, Salmonella typhimurium LT2
auaacgcgcugg

SEQ ID NO: 3751257 - RNA, 18 nt, Salmonella typhimurium LT2
auaacgcggguuagcgcc

SEQ ID NO: 3751258 - RNA, 23 nt, Salmonella typhimurium LT2
auaacgggguauaacucagcggc

SEQ ID NO: 3751259 - RNA, 19 nt, Salmonella typhimurium LT2
auaacggucguucccuacc

SEQ ID NO: 3751260 - RNA, 15 nt, Salmonella typhimurium LT2
auaacguguuaugcg

SEQ ID NO: 3751261 - RNA, 18 nt, Salmonella typhimurium LT2
auaacguuuaacgcgugc

SEQ ID NO: 3751262 - RNA, 14 nt, Salmonella typhimurium LT2
auaacuauaauugc

SEQ ID NO: 3751263 - RNA, 22 nt, Salmonella typhimurium LT2
auaacuauaauugcuuuuuucc

SEQ ID NO: 3751264 - RNA, 15 nt, Salmonella typhimurium LT2
auaacucaauagcgg

SEQ ID NO: 3751265 - RNA, 20 nt, Salmonella typhimurium LT2
auaacuuucggguugcccug

SEQ ID NO: 3751266 - RNA, 16 nt, Salmonella typhimurium LT2
auaagaaguaaacaga

SEQ ID NO: 3751267 - RNA, 13 nt, Salmonella typhimurium LT2
auaagaaucagau

SEQ ID NO: 3751268 - RNA, 15 nt, Salmonella typhimurium LT2
auaagagaaaauacc

SEQ ID NO: 3751269 - RNA, 19 nt, Salmonella typhimurium LT2
auaagcaacugggcuugca

SEQ ID NO: 3751270 - RNA, 17 nt, Salmonella typhimurium LT2
auaagcacaccauuuca

SEQ ID NO: 3751271 - RNA, 14 nt, Salmonella typhimurium LT2
auaagcauagcgcc

SEQ ID NO: 3751272 - RNA, 18 nt, Salmonella typhimurium LT2
auaagccgcguucugucg

SEQ ID NO: 3751273 - RNA, 15 nt, Salmonella typhimurium LT2
auaagccugcgcgcc

SEQ ID NO: 3751274 - RNA, 20 nt, Salmonella typhimurium LT2
auaagcgacagcgccauccg

SEQ ID NO: 3751275 - RNA, 21 nt, Salmonella typhimurium LT2
auaagcgcagcgccaucaggc

SEQ ID NO: 3751276 - RNA, 18 nt, Salmonella typhimurium LT2
auaagcgccgucauccgc

SEQ ID NO: 3751277 - RNA, 19 nt, Salmonella typhimurium LT2
auaagcggcgucauccgga

SEQ ID NO: 3751278 - RNA, 22 nt, Salmonella typhimurium LT2
auaagcguaagcgccauccggc

SEQ ID NO: 3751279 - RNA, 22 nt, Salmonella typhimurium LT2
auaagcguagcgccaucaggcu

SEQ ID NO: 3751280 - RNA, 21 nt, Salmonella typhimurium LT2
auaagcguagcgccauccggc

SEQ ID NO: 3751281 - RNA, 14 nt, Salmonella typhimurium LT2
auaagcgucagcgc

SEQ ID NO: 3751282 - RNA, 22 nt, Salmonella typhimurium LT2
auaagcgucagcgccauccggc

SEQ ID NO: 3751283 - RNA, 16 nt, Salmonella typhimurium LT2
auaagcgucagcgugc

SEQ ID NO: 3751284 - RNA, 15 nt, Salmonella typhimurium LT2
auaagcgucugcaau

SEQ ID NO: 3751285 - RNA, 23 nt, Salmonella typhimurium LT2
auaagcgucuuuaaagccuucau

SEQ ID NO: 3751286 - RNA, 21 nt, Salmonella typhimurium LT2
auaagcgugagcgcauccggc

SEQ ID NO: 3751287 - RNA, 17 nt, Salmonella typhimurium LT2
auaagcgugcgucaucc

SEQ ID NO: 3751288 - RNA, 20 nt, Salmonella typhimurium LT2
auaagcgugcgucauccggc

SEQ ID NO: 3751289 - RNA, 20 nt, Salmonella typhimurium LT2
auaaggccugagcuuuccug

SEQ ID NO: 3751290 - RNA, 21 nt, Salmonella typhimurium LT2
auaaggccugagcuuuccuga

SEQ ID NO: 3751291 - RNA, 14 nt, Salmonella typhimurium LT2
auaaggcgauaccu

SEQ ID NO: 3751292 - RNA, 20 nt, Salmonella typhimurium LT2
auaaggcgccguuuacagcc

SEQ ID NO: 3751293 - RNA, 22 nt, Salmonella typhimurium LT2
auaaggcguuucgccgccaucc

SEQ ID NO: 3751294 - RNA, 14 nt, Salmonella typhimurium LT2
auaagggccuucau

SEQ ID NO: 3751295 - RNA, 18 nt, Salmonella typhimurium LT2
auaaggguaagcaauaug

SEQ ID NO: 3751296 - RNA, 19 nt, Salmonella typhimurium LT2
auaaggguaagcaauaugg

SEQ ID NO: 3751297 - RNA, 23 nt, Salmonella typhimurium LT2
auaagguaacgcgaaaaaaagau

SEQ ID NO: 3751298 - RNA, 14 nt, Salmonella typhimurium LT2
auaccggauugcuc

SEQ ID NO: 3751299 - RNA, 15 nt, Salmonella typhimurium LT2
auaccggcaucacgc

SEQ ID NO: 3751300 - RNA, 21 nt, Salmonella typhimurium LT2
auaccggcguaauugcgccug

SEQ ID NO: 3751301 - RNA, 16 nt, Salmonella typhimurium LT2
auaccggcugcuuuug

SEQ ID NO: 3751302 - RNA, 15 nt, Salmonella typhimurium LT2
auaccggucggcaaa

SEQ ID NO: 3751303 - RNA, 13 nt, Salmonella typhimurium LT2
auaccguccacca

SEQ ID NO: 3751304 - RNA, 18 nt, Salmonella typhimurium LT2
auaccguccaccagcaca

SEQ ID NO: 3751305 - RNA, 20 nt, Salmonella typhimurium LT2
auaccguccaccagcacagg

SEQ ID NO: 3751306 - RNA, 20 nt, Salmonella typhimurium LT2
auaccguccagacuccuuuu

SEQ ID NO: 3751307 - RNA, 15 nt, Salmonella typhimurium LT2
auaccguccagcgca

SEQ ID NO: 3751308 - RNA, 16 nt, Salmonella typhimurium LT2
auaccuaacucuuccg

SEQ ID NO: 3751309 - RNA, 18 nt, Salmonella typhimurium LT2
auaccuaacucuuccgca

SEQ ID NO: 3751310 - RNA, 19 nt, Salmonella typhimurium LT2
auaccuacuuuauuuuucg

SEQ ID NO: 3751311 - RNA, 13 nt, Salmonella typhimurium LT2
auaccucauuuca

SEQ ID NO: 3751312 - RNA, 20 nt, Salmonella typhimurium LT2
auaccuccucucuuccuccu

SEQ ID NO: 3751313 - RNA, 22 nt, Salmonella typhimurium LT2
auaccugcgcuuuggguuaaug

SEQ ID NO: 3751314 - RNA, 15 nt, Salmonella typhimurium LT2
auaccuucacaaaaa

SEQ ID NO: 3751315 - RNA, 21 nt, Salmonella typhimurium LT2
auaccuucccgcgauaaaaac

SEQ ID NO: 3751316 - RNA, 14 nt, Salmonella typhimurium LT2
auaccuuccggcgu

SEQ ID NO: 3751317 - RNA, 21 nt, Salmonella typhimurium LT2
auaccuucgugaugugguugu

SEQ ID NO: 3751318 - RNA, 21 nt, Salmonella typhimurium LT2
auaccuucuucacuaaaaaca

SEQ ID NO: 3751319 - RNA, 12 nt, Salmonella typhimurium LT2
auaccuucuucg

SEQ ID NO: 3751320 - RNA, 23 nt, Salmonella typhimurium LT2
auacgaccgccgacaaucgucac

SEQ ID NO: 3751321 - RNA, 22 nt, Salmonella typhimurium LT2
auacgagcgggucaggaaacug

SEQ ID NO: 3751322 - RNA, 16 nt, Salmonella typhimurium LT2
auacgauccucgccau

SEQ ID NO: 3751323 - RNA, 12 nt, Salmonella typhimurium LT2
auacgcaccagc

SEQ ID NO: 3751324 - RNA, 17 nt, Salmonella typhimurium LT2
auacgcaccagcucuac

SEQ ID NO: 3751325 - RNA, 13 nt, Salmonella typhimurium LT2
auacgccacgcuc

SEQ ID NO: 3751326 - RNA, 13 nt, Salmonella typhimurium LT2
auacgccagcaga

SEQ ID NO: 3751327 - RNA, 16 nt, Salmonella typhimurium LT2
auacgcgucagccuac

SEQ ID NO: 3751328 - RNA, 15 nt, Salmonella typhimurium LT2
auacgcguugccauc

SEQ ID NO: 3751329 - RNA, 19 nt, Salmonella typhimurium LT2
auacgcucccacugccgua

SEQ ID NO: 3751330 - RNA, 15 nt, Salmonella typhimurium LT2
auacgcugcggccug

SEQ ID NO: 3751331 - RNA, 19 nt, Salmonella typhimurium LT2
auacgcuucggcuccagcg

SEQ ID NO: 3751332 - RNA, 21 nt, Salmonella typhimurium LT2
auacgcuucggcuccagcgcc

SEQ ID NO: 3751333 - RNA, 23 nt, Salmonella typhimurium LT2
auacgcuuucugaauuuccugcg

SEQ ID NO: 3751334 - RNA, 17 nt, Salmonella typhimurium LT2
auacggaaggauagccg

SEQ ID NO: 3751335 - RNA, 22 nt, Salmonella typhimurium LT2
auacggagaacggcacaauagc

SEQ ID NO: 3751336 - RNA, 22 nt, Salmonella typhimurium LT2
auacgggagagcguauccagca

SEQ ID NO: 3751337 - RNA, 23 nt, Salmonella typhimurium LT2
auacgggagagcguauccagcac

SEQ ID NO: 3751338 - RNA, 17 nt, Salmonella typhimurium LT2
auacgguaaaucauuug

SEQ ID NO: 3751339 - RNA, 14 nt, Salmonella typhimurium LT2
auacgguagcgauc

SEQ ID NO: 3751340 - RNA, 19 nt, Salmonella typhimurium LT2
auacggucgacaccagcga

SEQ ID NO: 3751341 - RNA, 15 nt, Salmonella typhimurium LT2
auacguaauaccuga

SEQ ID NO: 3751342 - RNA, 20 nt, Salmonella typhimurium LT2
auacgucauaucaguugccc

SEQ ID NO: 3751343 - RNA, 14 nt, Salmonella typhimurium LT2
auacgucauaucau

SEQ ID NO: 3751344 - RNA, 19 nt, Salmonella typhimurium LT2
auacgucauaucauccagc

SEQ ID NO: 3751345 - RNA, 20 nt, Salmonella typhimurium LT2
auacgucauaucauccagcc

SEQ ID NO: 3751346 - RNA, 13 nt, Salmonella typhimurium LT2
auacgucccugcu

SEQ ID NO: 3751347 - RNA, 13 nt, Salmonella typhimurium LT2
auacguuaacccg

SEQ ID NO: 3751348 - RNA, 12 nt, Salmonella typhimurium LT2
auacguuaugca

SEQ ID NO: 3751349 - RNA, 19 nt, Salmonella typhimurium LT2
auacguuccagcagcgcau

SEQ ID NO: 3751350 - RNA, 19 nt, Salmonella typhimurium LT2
auacguuugaaaugaauac

SEQ ID NO: 3751351 - RNA, 13 nt, Salmonella typhimurium LT2
auacucaaaaaau

SEQ ID NO: 3751352 - RNA, 16 nt, Salmonella typhimurium LT2
auacucaauauccugc

SEQ ID NO: 3751353 - RNA, 14 nt, Salmonella typhimurium LT2
auacucccgaaugg

SEQ ID NO: 3751354 - RNA, 12 nt, Salmonella typhimurium LT2
auacuccgacgg

SEQ ID NO: 3751355 - RNA, 20 nt, Salmonella typhimurium LT2
auacucugcuuuuucacccu

SEQ ID NO: 3751356 - RNA, 11 nt, Salmonella typhimurium LT2
auacucuuucc

SEQ ID NO: 3751357 - RNA, 22 nt, Salmonella typhimurium LT2
auacugaaauccgacaauuuuc

SEQ ID NO: 3751358 - RNA, 21 nt, Salmonella typhimurium LT2
auacugaagauaaacagcagc

SEQ ID NO: 3751359 - RNA, 15 nt, Salmonella typhimurium LT2
auacugacacgccag

SEQ ID NO: 3751360 - RNA, 20 nt, Salmonella typhimurium LT2
auacugacacgccaguucau

SEQ ID NO: 3751361 - RNA, 17 nt, Salmonella typhimurium LT2
auacugccauagccggu

SEQ ID NO: 3751362 - RNA, 17 nt, Salmonella typhimurium LT2
auacugcucauaacccu

SEQ ID NO: 3751363 - RNA, 20 nt, Salmonella typhimurium LT2
auacuggcaguaaaaagaaa

SEQ ID NO: 3751364 - RNA, 20 nt, Salmonella typhimurium LT2
auacuggucgcgucaauauu

SEQ ID NO: 3751365 - RNA, 17 nt, Salmonella typhimurium LT2
auacuguacgcccagcc

SEQ ID NO: 3751366 - RNA, 22 nt, Salmonella typhimurium LT2
auacuguacgcccagccgugaa

SEQ ID NO: 3751367 - RNA, 21 nt, Salmonella typhimurium LT2
auacuuaacccugaaccggga

SEQ ID NO: 3751368 - RNA, 18 nt, Salmonella typhimurium LT2
auacuuaucaacuucuuc

SEQ ID NO: 3751369 - RNA, 20 nt, Salmonella typhimurium LT2
auacuuaucaacuucuucau

SEQ ID NO: 3751370 - RNA, 22 nt, Salmonella typhimurium LT2
auacuucgacaauauuuuucag

SEQ ID NO: 3751371 - RNA, 21 nt, Salmonella typhimurium LT2
auacuugcugcuaugaaaaau

SEQ ID NO: 3751372 - RNA, 12 nt, Salmonella typhimurium LT2
auacuuuuacuc

SEQ ID NO: 3751373 - RNA, 17 nt, Salmonella typhimurium LT2
auagaaagucuuuuguu

SEQ ID NO: 3751374 - RNA, 14 nt, Salmonella typhimurium LT2
auagaaauagccuu

SEQ ID NO: 3751375 - RNA, 20 nt, Salmonella typhimurium LT2
auagaagcucaugugcagca

SEQ ID NO: 3751376 - RNA, 21 nt, Salmonella typhimurium LT2
auagacagcggcuaauuuauu

SEQ ID NO: 3751377 - RNA, 23 nt, Salmonella typhimurium LT2
auagacaugaccggacgugccaa

SEQ ID NO: 3751378 - RNA, 21 nt, Salmonella typhimurium LT2
auagacgacaucgcucaaaac

SEQ ID NO: 3751379 - RNA, 18 nt, Salmonella typhimurium LT2
auagacgacaucuuuucc

SEQ ID NO: 3751380 - RNA, 13 nt, Salmonella typhimurium LT2
auagacgauauag

SEQ ID NO: 3751381 - RNA, 18 nt, Salmonella typhimurium LT2
auagacgccggucaugcc

SEQ ID NO: 3751382 - RNA, 23 nt, Salmonella typhimurium LT2
auagacucguugggugaggcgua

SEQ ID NO: 3751383 - RNA, 13 nt, Salmonella typhimurium LT2
auagacuggcgcc

SEQ ID NO: 3751384 - RNA, 17 nt, Salmonella typhimurium LT2
auagagacugccgccgu

SEQ ID NO: 3751385 - RNA, 14 nt, Salmonella typhimurium LT2
auagagaguuccuc

SEQ ID NO: 3751386 - RNA, 15 nt, Salmonella typhimurium LT2
auagagauccuggcg

SEQ ID NO: 3751387 - RNA, 16 nt, Salmonella typhimurium LT2
auagagauccuggcga

SEQ ID NO: 3751388 - RNA, 22 nt, Salmonella typhimurium LT2
auagagcaaaggaucgcaacca

SEQ ID NO: 3751389 - RNA, 14 nt, Salmonella typhimurium LT2
auagagcaucaacc

SEQ ID NO: 3751390 - RNA, 20 nt, Salmonella typhimurium LT2
auagagcccucuauccacac

SEQ ID NO: 3751391 - RNA, 15 nt, Salmonella typhimurium LT2
auagaguaaugacaa

SEQ ID NO: 3751392 - RNA, 21 nt, Salmonella typhimurium LT2
auagaguaaugacaaaaauua

SEQ ID NO: 3751393 - RNA, 15 nt, Salmonella typhimurium LT2
auagagugcgauuug

SEQ ID NO: 3751394 - RNA, 14 nt, Salmonella typhimurium LT2
auagaguuaaaagg

SEQ ID NO: 3751395 - RNA, 14 nt, Salmonella typhimurium LT2
auagaucaggcgac

SEQ ID NO: 3751396 - RNA, 23 nt, Salmonella typhimurium LT2
auagaucaggcgaccauccacca

SEQ ID NO: 3751397 - RNA, 13 nt, Salmonella typhimurium LT2
auagaugggaugg

SEQ ID NO: 3751398 - RNA, 16 nt, Salmonella typhimurium LT2
auagaugggauggucu

SEQ ID NO: 3751399 - RNA, 17 nt, Salmonella typhimurium LT2
auagcaaccccucaucg

SEQ ID NO: 3751400 - RNA, 11 nt, Salmonella typhimurium LT2
auagcaacgcg

SEQ ID NO: 3751401 - RNA, 20 nt, Salmonella typhimurium LT2
auagcaauacuuuccagcug

SEQ ID NO: 3751402 - RNA, 15 nt, Salmonella typhimurium LT2
auaucacgcgcgcga

SEQ ID NO: 3751403 - RNA, 17 nt, Salmonella typhimurium LT2
auaucacuaucaguuuu

SEQ ID NO: 3751404 - RNA, 13 nt, Salmonella typhimurium LT2
auaucaucaucuc

SEQ ID NO: 3751405 - RNA, 22 nt, Salmonella typhimurium LT2
auaucauuagcgucauacuuaa

SEQ ID NO: 3751406 - RNA, 14 nt, Salmonella typhimurium LT2
auaucauucuguuc

SEQ ID NO: 3751407 - RNA, 21 nt, Salmonella typhimurium LT2
auauccaccagcccaucuuuc

SEQ ID NO: 3751408 - RNA, 17 nt, Salmonella typhimurium LT2
auauccacguuccgcaa

SEQ ID NO: 3751409 - RNA, 13 nt, Salmonella typhimurium LT2
auauccagcacgc

SEQ ID NO: 3751410 - RNA, 23 nt, Salmonella typhimurium LT2
auauccauaaacgucccgacgaa

SEQ ID NO: 3751411 - RNA, 16 nt, Salmonella typhimurium LT2
auauccccaucccaga

SEQ ID NO: 3751412 - RNA, 14 nt, Salmonella typhimurium LT2
auaucccgcaagaa

SEQ ID NO: 3751413 - RNA, 15 nt, Salmonella typhimurium LT2
auaucccgcauaccg

SEQ ID NO: 3751414 - RNA, 13 nt, Salmonella typhimurium LT2
auaucccuucuca

SEQ ID NO: 3751415 - RNA, 16 nt, Salmonella typhimurium LT2
auaucccuucucaugg

SEQ ID NO: 3751416 - RNA, 14 nt, Salmonella typhimurium LT2
auauccgcugcggu

SEQ ID NO: 3751417 - RNA, 15 nt, Salmonella typhimurium LT2
auauccggcgcaucg

SEQ ID NO: 3751418 - RNA, 23 nt, Salmonella typhimurium LT2
auauccgugcgcaauuccagcaa

SEQ ID NO: 3751419 - RNA, 19 nt, Salmonella typhimurium LT2
auauccucgcauccuccau

SEQ ID NO: 3751420 - RNA, 20 nt, Salmonella typhimurium LT2
auauccucuuuucgaacgcc

SEQ ID NO: 3751421 - RNA, 17 nt, Salmonella typhimurium LT2
auaucgauagcauuuuu

SEQ ID NO: 3751422 - RNA, 23 nt, Salmonella typhimurium LT2
auaucgaugcuuauuauuuuuuc

SEQ ID NO: 3751423 - RNA, 13 nt, Salmonella typhimurium LT2
auaucgccauaca

SEQ ID NO: 3751424 - RNA, 14 nt, Salmonella typhimurium LT2
auaucgccauucac

SEQ ID NO: 3751425 - RNA, 15 nt, Salmonella typhimurium LT2
auaucgcgagcaauu

SEQ ID NO: 3751426 - RNA, 20 nt, Salmonella typhimurium LT2
auaucgcuggccuccagcac

SEQ ID NO: 3751427 - RNA, 14 nt, Salmonella typhimurium LT2
auaucggcugcugu

SEQ ID NO: 3751428 - RNA, 18 nt, Salmonella typhimurium LT2
auaucguaaccgcuaaac

SEQ ID NO: 3751429 - RNA, 20 nt, Salmonella typhimurium LT2
auaucguucaguuucaaaga

SEQ ID NO: 3751430 - RNA, 19 nt, Salmonella typhimurium LT2
auaucuaugguaauuuaaa

SEQ ID NO: 3751431 - RNA, 19 nt, Salmonella typhimurium LT2
auaucuggacgggccgcca

SEQ ID NO: 3751432 - RNA, 18 nt, Salmonella typhimurium LT2
auaucuguauaaauaaaa

SEQ ID NO: 3751433 - RNA, 20 nt, Salmonella typhimurium LT2
auaucuucccgacgcuggcg

SEQ ID NO: 3751434 - RNA, 14 nt, Salmonella typhimurium LT2
auaugaaagagaaa

SEQ ID NO: 3751435 - RNA, 15 nt, Salmonella typhimurium LT2
auaugaaagagaaau

SEQ ID NO: 3751436 - RNA, 18 nt, Salmonella typhimurium LT2
auaugacguauugaaaau

SEQ ID NO: 3751437 - RNA, 13 nt, Salmonella typhimurium LT2
auaugaguuaugu

SEQ ID NO: 3751438 - RNA, 13 nt, Salmonella typhimurium LT2
auaugcaauuaau

SEQ ID NO: 3751439 - RNA, 17 nt, Salmonella typhimurium LT2
auaugcaauuaauauau

SEQ ID NO: 3751440 - RNA, 23 nt, Salmonella typhimurium LT2
auaugcacaugauggugacuguc

SEQ ID NO: 3751441 - RNA, 17 nt, Salmonella typhimurium LT2
auaugcaggcauaaaaa

SEQ ID NO: 3751442 - RNA, 19 nt, Salmonella typhimurium LT2
auaugcaggcauaaaaaag

SEQ ID NO: 3751443 - RNA, 14 nt, Salmonella typhimurium LT2
auaugccaaguaau

SEQ ID NO: 3751444 - RNA, 19 nt, Salmonella typhimurium LT2
auaugccaaguaauaaaga

SEQ ID NO: 3751445 - RNA, 18 nt, Salmonella typhimurium LT2
auaugccccgacaucaga

SEQ ID NO: 3751446 - RNA, 18 nt, Salmonella typhimurium LT2
auaugcgcaaucacccca

SEQ ID NO: 3751447 - RNA, 15 nt, Salmonella typhimurium LT2
auaugcgccaacugc

SEQ ID NO: 3751448 - RNA, 23 nt, Salmonella typhimurium LT2
auaugcgcggcgaucagacgcug

SEQ ID NO: 3751449 - RNA, 17 nt, Salmonella typhimurium LT2
auaugcuuguagcagau

SEQ ID NO: 3751450 - RNA, 17 nt, Salmonella typhimurium LT2
auauggaugagucuugc

SEQ ID NO: 3751451 - RNA, 15 nt, Salmonella typhimurium LT2
auauggccguuugcu

SEQ ID NO: 3751452 - RNA, 20 nt, Salmonella typhimurium LT2
auauggcgggccugugccug

SEQ ID NO: 3751453 - RNA, 17 nt, Salmonella typhimurium LT2
auaugggcaauuauauu

SEQ ID NO: 3751454 - RNA, 19 nt, Salmonella typhimurium LT2
auauguaaauuauccguuu

SEQ ID NO: 3751455 - RNA, 17 nt, Salmonella typhimurium LT2
auaugucugauucuuau

SEQ ID NO: 3751456 - RNA, 16 nt, Salmonella typhimurium LT2
auauguucccgacggc

SEQ ID NO: 3751457 - RNA, 17 nt, Salmonella typhimurium LT2
auauguuucaaaaagag

SEQ ID NO: 3751458 - RNA, 24 nt, Salmonella typhimurium LT2
auauguuugauaaacugcgccaug

SEQ ID NO: 3751459 - RNA, 18 nt, Salmonella typhimurium LT2
auauuaaauuuauacuca

SEQ ID NO: 3751460 - RNA, 18 nt, Salmonella typhimurium LT2
auauuaacaaugcaaacg

SEQ ID NO: 3751461 - RNA, 22 nt, Salmonella typhimurium LT2
auauuaccuucgcguaaugcaa

SEQ ID NO: 3751462 - RNA, 12 nt, Salmonella typhimurium LT2
auauuacugacu

SEQ ID NO: 3751463 - RNA, 22 nt, Salmonella typhimurium LT2
auauuagcgguacucuuuuucc

SEQ ID NO: 3751464 - RNA, 18 nt, Salmonella typhimurium LT2
auauuauaaaauaacggu

SEQ ID NO: 3751465 - RNA, 22 nt, Salmonella typhimurium LT2
auauuauugacgcuuucuuccc

SEQ ID NO: 3751466 - RNA, 13 nt, Salmonella typhimurium LT2
auauucagcaaau

SEQ ID NO: 3751467 - RNA, 18 nt, Salmonella typhimurium LT2
auauuccauauaacagaa

SEQ ID NO: 3751468 - RNA, 18 nt, Salmonella typhimurium LT2
auauucccacaguuaacg

SEQ ID NO: 3751469 - RNA, 11 nt, Salmonella typhimurium LT2
auauuccccac

SEQ ID NO: 3751470 - RNA, 22 nt, Salmonella typhimurium LT2
auauucccguuccagcuugaau

SEQ ID NO: 3751471 - RNA, 18 nt, Salmonella typhimurium LT2
auauucgcagcucugugu

SEQ ID NO: 3751472 - RNA, 13 nt, Salmonella typhimurium LT2
auauucucuggcg

SEQ ID NO: 3751473 - RNA, 21 nt, Salmonella typhimurium LT2
auauucugggcuuacuuucca

SEQ ID NO: 3751474 - RNA, 20 nt, Salmonella typhimurium LT2
auauucuguuagcgcccucu

SEQ ID NO: 3751475 - RNA, 22 nt, Salmonella typhimurium LT2
auauugagacguuauuagccgg

SEQ ID NO: 3751476 - RNA, 17 nt, Salmonella typhimurium LT2
auauugcauaggggcaa

SEQ ID NO: 3751477 - RNA, 21 nt, Salmonella typhimurium LT2
auauugcauuugcguccauau

SEQ ID NO: 3751478 - RNA, 20 nt, Salmonella typhimurium LT2
auauugcccaucgcgccaug

SEQ ID NO: 3751479 - RNA, 15 nt, Salmonella typhimurium LT2
auauugcgccgcagc

SEQ ID NO: 3751480 - RNA, 20 nt, Salmonella typhimurium LT2
auauuggcgaggaacaucag

SEQ ID NO: 3751481 - RNA, 23 nt, Salmonella typhimurium LT2
auauuggcgaggaacaucagcca

SEQ ID NO: 3751482 - RNA, 14 nt, Salmonella typhimurium LT2
auauuuaccgccgc

SEQ ID NO: 3751483 - RNA, 19 nt, Salmonella typhimurium LT2
auauuuauuuuauaaauua

SEQ ID NO: 3751484 - RNA, 21 nt, Salmonella typhimurium LT2
auauuuuauuuccaauguaaa

SEQ ID NO: 3751485 - RNA, 16 nt, Salmonella typhimurium LT2
auauuuucaacggcau

SEQ ID NO: 3751486 - RNA, 13 nt, Salmonella typhimurium LT2
auauuuucaccuc

SEQ ID NO: 3751487 - RNA, 22 nt, Salmonella typhimurium LT2
auauuuucagaaaucauauaaa

SEQ ID NO: 3751488 - RNA, 16 nt, Salmonella typhimurium LT2
auauuuucaggcaccg

SEQ ID NO: 3751489 - RNA, 18 nt, Salmonella typhimurium LT2
auauuuucuugcuacaua

SEQ ID NO: 3751490 - RNA, 16 nt, Salmonella typhimurium LT2
auauuuuguaggccua

SEQ ID NO: 3751491 - RNA, 20 nt, Salmonella typhimurium LT2
auauuuuguaggccuaaaaa

SEQ ID NO: 3751492 - RNA, 22 nt, Salmonella typhimurium LT2
auauuuuguaggccuaaaaaua

SEQ ID NO: 3751493 - RNA, 16 nt, Salmonella typhimurium LT2
auauuuuucacacaua

SEQ ID NO: 3751494 - RNA, 12 nt, Salmonella typhimurium LT2
auauuuuucccu

SEQ ID NO: 3751495 - RNA, 13 nt, Salmonella typhimurium LT2
auauuuuuucccc

SEQ ID NO: 3751496 - RNA, 16 nt, Salmonella typhimurium LT2
aucaaaaaaaaccaga

SEQ ID NO: 3751497 - RNA, 22 nt, Salmonella typhimurium LT2
aucaaaacuggaaacgcaucca

SEQ ID NO: 3751498 - RNA, 18 nt, Salmonella typhimurium LT2
aucaaaccaccccagguu

SEQ ID NO: 3751499 - RNA, 22 nt, Salmonella typhimurium LT2
aucaaaccauucccgucccugc

SEQ ID NO: 3751500 - RNA, 20 nt, Salmonella typhimurium LT2
aucaaacggauaaguaaguu

SEQ ID NO: 3751501 - RNA, 12 nt, Salmonella typhimurium LT2
aucaaacgucac

SEQ ID NO: 3751502 - RNA, 21 nt, Salmonella typhimurium LT2
aucaaacuccgcgcuggcaau

SEQ ID NO: 3751503 - RNA, 20 nt, Salmonella typhimurium LT2
aucaaaggcgucgccgaaua

SEQ ID NO: 3751504 - RNA, 17 nt, Salmonella typhimurium LT2
aucaaauaccuuuucau

SEQ ID NO: 3751505 - RNA, 20 nt, Salmonella typhimurium LT2
aucaaauacgcuauuuaaaa

SEQ ID NO: 3751506 - RNA, 17 nt, Salmonella typhimurium LT2
aucagaccgacaaaaca

SEQ ID NO: 3751507 - RNA, 20 nt, Salmonella typhimurium LT2
aucagaccgagacccagcgc

SEQ ID NO: 3751508 - RNA, 16 nt, Salmonella typhimurium LT2
aucagacgcacaaucg

SEQ ID NO: 3751509 - RNA, 23 nt, Salmonella typhimurium LT2
aucagacguuuauaccccaccau

SEQ ID NO: 3751510 - RNA, 15 nt, Salmonella typhimurium LT2
aucagacuaucuucg

SEQ ID NO: 3751511 - RNA, 23 nt, Salmonella typhimurium LT2
aucagacugaucgccgcugcugg

SEQ ID NO: 3751512 - RNA, 15 nt, Salmonella typhimurium LT2
aucagacugguuguu

SEQ ID NO: 3751513 - RNA, 18 nt, Salmonella typhimurium LT2
aucagagacaaauacaug

SEQ ID NO: 3751514 - RNA, 12 nt, Salmonella typhimurium LT2
aucagaggggau

SEQ ID NO: 3751515 - RNA, 22 nt, Salmonella typhimurium LT2
aucagaguaauuuguugcgcuu

SEQ ID NO: 3751516 - RNA, 13 nt, Salmonella typhimurium LT2
aucagauaaccug

SEQ ID NO: 3751517 - RNA, 20 nt, Salmonella typhimurium LT2
aucagauacggcuccagcac

SEQ ID NO: 3751518 - RNA, 18 nt, Salmonella typhimurium LT2
aucagauaucccugcaaa

SEQ ID NO: 3751519 - RNA, 17 nt, Salmonella typhimurium LT2
aucagaugaccaccgau

SEQ ID NO: 3751520 - RNA, 17 nt, Salmonella typhimurium LT2
aucagaugugguauuuu

SEQ ID NO: 3751521 - RNA, 15 nt, Salmonella typhimurium LT2
aucagauuguugccg

SEQ ID NO: 3751522 - RNA, 17 nt, Salmonella typhimurium LT2
aucagcaacacaaucag

SEQ ID NO: 3751523 - RNA, 14 nt, Salmonella typhimurium LT2
aucagcaagaugac

SEQ ID NO: 3751524 - RNA, 21 nt, Salmonella typhimurium LT2
aucagcaagaugacccauuua

SEQ ID NO: 3751525 - RNA, 13 nt, Salmonella typhimurium LT2
aucagcaauaauu

SEQ ID NO: 3751526 - RNA, 17 nt, Salmonella typhimurium LT2
aucagcacacuacacag

SEQ ID NO: 3751527 - RNA, 15 nt, Salmonella typhimurium LT2
aucagcaccacgccc

SEQ ID NO: 3751528 - RNA, 14 nt, Salmonella typhimurium LT2
aucagcagcagcgu

SEQ ID NO: 3751529 - RNA, 18 nt, Salmonella typhimurium LT2
aucagcagccgggccaga

SEQ ID NO: 3751530 - RNA, 17 nt, Salmonella typhimurium LT2
aucagcaguugcgacug

SEQ ID NO: 3751531 - RNA, 12 nt, Salmonella typhimurium LT2
aucagcaucacc

SEQ ID NO: 3751532 - RNA, 22 nt, Salmonella typhimurium LT2
aucagcaucuuaugcgcaaaaa

SEQ ID NO: 3751533 - RNA, 22 nt, Salmonella typhimurium LT2
aucagcaucuuuggcuuuauga

SEQ ID NO: 3751534 - RNA, 13 nt, Salmonella typhimurium LT2
aucagccagcauc

SEQ ID NO: 3751535 - RNA, 21 nt, Salmonella typhimurium LT2
aucagccagccgccaaaaaua

SEQ ID NO: 3751536 - RNA, 12 nt, Salmonella typhimurium LT2
aucagccaggcg

SEQ ID NO: 3751537 - RNA, 22 nt, Salmonella typhimurium LT2
aucagcccaugccguauuuaug

SEQ ID NO: 3751538 - RNA, 14 nt, Salmonella typhimurium LT2
aucagccccagcac

SEQ ID NO: 3751539 - RNA, 19 nt, Salmonella typhimurium LT2
aucagccccagcaccagag

SEQ ID NO: 3751540 - RNA, 22 nt, Salmonella typhimurium LT2
aucagcccgauacccgcccaga

SEQ ID NO: 3751541 - RNA, 15 nt, Salmonella typhimurium LT2
aucagccgccauccg

SEQ ID NO: 3751542 - RNA, 16 nt, Salmonella typhimurium LT2
aucagccugagcgcca

SEQ ID NO: 3751543 - RNA, 15 nt, Salmonella typhimurium LT2
aucagcgaaggcaac

SEQ ID NO: 3751544 - RNA, 14 nt, Salmonella typhimurium LT2
aucagcgacucauu

SEQ ID NO: 3751545 - RNA, 17 nt, Salmonella typhimurium LT2
aucagcgauugcgccag

SEQ ID NO: 3751546 - RNA, 22 nt, Salmonella typhimurium LT2
aucagcgauugcgccagaccca

SEQ ID NO: 3751547 - RNA, 14 nt, Salmonella typhimurium LT2
aucagcgccaccac

SEQ ID NO: 3751548 - RNA, 15 nt, Salmonella typhimurium LT2
aucagcgccaccaca

SEQ ID NO: 3751549 - RNA, 13 nt, Salmonella typhimurium LT2
aucagcgccagcc

SEQ ID NO: 3751550 - RNA, 15 nt, Salmonella typhimurium LT2
aucagcgccagcccu

SEQ ID NO: 3751551 - RNA, 14 nt, Salmonella typhimurium LT2
aucagcgcgcucca

SEQ ID NO: 3751552 - RNA, 17 nt, Salmonella typhimurium LT2
aucagcgcgcuccagac

SEQ ID NO: 3751553 - RNA, 22 nt, Salmonella typhimurium LT2
aucagcgcggcgugaucaaauu

SEQ ID NO: 3751554 - RNA, 14 nt, Salmonella typhimurium LT2
aucagcgcgggaua

SEQ ID NO: 3751555 - RNA, 17 nt, Salmonella typhimurium LT2
aucagcgcggugggaca

SEQ ID NO: 3751556 - RNA, 15 nt, Salmonella typhimurium LT2
aucagcgcuaccagc

SEQ ID NO: 3751557 - RNA, 24 nt, Salmonella typhimurium LT2
aucagcggcugcaaagcaucugcc

SEQ ID NO: 3751558 - RNA, 16 nt, Salmonella typhimurium LT2
aucagcuuugcggcca

SEQ ID NO: 3751559 - RNA, 22 nt, Salmonella typhimurium LT2
aucagcuuugcggccagcauau

SEQ ID NO: 3751560 - RNA, 13 nt, Salmonella typhimurium LT2
aucaggaaaugaa

SEQ ID NO: 3751561 - RNA, 14 nt, Salmonella typhimurium LT2
aucaggaaaugaac

SEQ ID NO: 3751562 - RNA, 22 nt, Salmonella typhimurium LT2
aucaggaaauucucagaaacaa

SEQ ID NO: 3751563 - RNA, 15 nt, Salmonella typhimurium LT2
aucaggaguaaauaa

SEQ ID NO: 3751564 - RNA, 21 nt, Salmonella typhimurium LT2
aucaggaguaaauaacaaaag

SEQ ID NO: 3751565 - RNA, 16 nt, Salmonella typhimurium LT2
aucaggauauggccgc

SEQ ID NO: 3751566 - RNA, 14 nt, Salmonella typhimurium LT2
aucaggaucuucau

SEQ ID NO: 3751567 - RNA, 21 nt, Salmonella typhimurium LT2
aucaggcaaaaaucgucauca

SEQ ID NO: 3751568 - RNA, 19 nt, Salmonella typhimurium LT2
aucaggcaauaaacaucag

SEQ ID NO: 3751569 - RNA, 22 nt, Salmonella typhimurium LT2
aucaggcaauaaacaucagcca

SEQ ID NO: 3751570 - RNA, 17 nt, Salmonella typhimurium LT2
aucaggcaauacgcugc

SEQ ID NO: 3751571 - RNA, 17 nt, Salmonella typhimurium LT2
aucaggcacaacccaaa

SEQ ID NO: 3751572 - RNA, 16 nt, Salmonella typhimurium LT2
aucaggcauaaaccua

SEQ ID NO: 3751573 - RNA, 18 nt, Salmonella typhimurium LT2
aucaggcaugccaaacca

SEQ ID NO: 3751574 - RNA, 21 nt, Salmonella typhimurium LT2
aucaggccuaccagccgagug

SEQ ID NO: 3751575 - RNA, 19 nt, Salmonella typhimurium LT2
aucaggccugcaaaccucu

SEQ ID NO: 3751576 - RNA, 19 nt, Salmonella typhimurium LT2
aucaggcgcaaacgcgugc

SEQ ID NO: 3751577 - RNA, 21 nt, Salmonella typhimurium LT2
aucaggcguugaccgcuucgc

SEQ ID NO: 3751578 - RNA, 14 nt, Salmonella typhimurium LT2
aucagggaaaaaug

SEQ ID NO: 3751579 - RNA, 20 nt, Salmonella typhimurium LT2
aucagguacauauaggcauu

SEQ ID NO: 3751580 - RNA, 19 nt, Salmonella typhimurium LT2
aucaggugcgagagcuguc

SEQ ID NO: 3751581 - RNA, 18 nt, Salmonella typhimurium LT2
aucaguccgcaaagaacc

SEQ ID NO: 3751582 - RNA, 15 nt, Salmonella typhimurium LT2
aucagucgcagcggc

SEQ ID NO: 3751583 - RNA, 18 nt, Salmonella typhimurium LT2
aucagugaacacccugcc

SEQ ID NO: 3751584 - RNA, 22 nt, Salmonella typhimurium LT2
aucagugauggauuucacaauc

SEQ ID NO: 3751585 - RNA, 20 nt, Salmonella typhimurium LT2
aucaguggcggcaaaaaaua

SEQ ID NO: 3751586 - RNA, 15 nt, Salmonella typhimurium LT2
aucaguuaugacaga

SEQ ID NO: 3751587 - RNA, 13 nt, Salmonella typhimurium LT2
aucaguucaggaa

SEQ ID NO: 3751588 - RNA, 15 nt, Salmonella typhimurium LT2
aucaguucaggaaca

SEQ ID NO: 3751589 - RNA, 20 nt, Salmonella typhimurium LT2
aucaguucucgguauccagc

SEQ ID NO: 3751590 - RNA, 17 nt, Salmonella typhimurium LT2
aucaguucuugcaggca

SEQ ID NO: 3751591 - RNA, 19 nt, Salmonella typhimurium LT2
aucaguuguacuuguugcu

SEQ ID NO: 3751592 - RNA, 14 nt, Salmonella typhimurium LT2
aucauaaaaggcau

SEQ ID NO: 3751593 - RNA, 18 nt, Salmonella typhimurium LT2
aucauaaagcgcccggug

SEQ ID NO: 3751594 - RNA, 16 nt, Salmonella typhimurium LT2
aucauacauagcaggc

SEQ ID NO: 3751595 - RNA, 24 nt, Salmonella typhimurium LT2
aucauacugccgccgugggauugc

SEQ ID NO: 3751596 - RNA, 16 nt, Salmonella typhimurium LT2
aucauagacugcgcuu

SEQ ID NO: 3751597 - RNA, 19 nt, Salmonella typhimurium LT2
aucauagugccgguggcau

SEQ ID NO: 3751598 - RNA, 14 nt, Salmonella typhimurium LT2
aucauaguggcgca

SEQ ID NO: 3751599 - RNA, 18 nt, Salmonella typhimurium LT2
aucauauucgcagcucug

SEQ ID NO: 3751600 - RNA, 21 nt, Salmonella typhimurium LT2
aucauauuuucuugcuacaua

SEQ ID NO: 3751601 - RNA, 21 nt, Salmonella typhimurium LT2
aucaucaauaccguccagcgc

SEQ ID NO: 3751602 - RNA, 14 nt, Salmonella typhimurium LT2
aucaucacaauuag

SEQ ID NO: 3751603 - RNA, 17 nt, Salmonella typhimurium LT2
aucaucagaagaagaca

SEQ ID NO: 3751604 - RNA, 15 nt, Salmonella typhimurium LT2
aucaucagcagcagc

SEQ ID NO: 3751605 - RNA, 16 nt, Salmonella typhimurium LT2
aucaucaggaacaucc

SEQ ID NO: 3751606 - RNA, 15 nt, Salmonella typhimurium LT2
aucaucauaguggcg

SEQ ID NO: 3751607 - RNA, 16 nt, Salmonella typhimurium LT2
aucaucauaucccggc

SEQ ID NO: 3751608 - RNA, 19 nt, Salmonella typhimurium LT2
aucaucaucggcacagcca

SEQ ID NO: 3751609 - RNA, 20 nt, Salmonella typhimurium LT2
aucaucaucggcacagccag

SEQ ID NO: 3751610 - RNA, 20 nt, Salmonella typhimurium LT2
auccauuugcgacaucagcc

SEQ ID NO: 3751611 - RNA, 16 nt, Salmonella typhimurium LT2
aucccaaucagguuug

SEQ ID NO: 3751612 - RNA, 19 nt, Salmonella typhimurium LT2
aucccaauugaucggccag

SEQ ID NO: 3751613 - RNA, 11 nt, Salmonella typhimurium LT2
aucccacagcg

SEQ ID NO: 3751614 - RNA, 15 nt, Salmonella typhimurium LT2
aucccaccggaaaug

SEQ ID NO: 3751615 - RNA, 18 nt, Salmonella typhimurium LT2
aucccacgggauugaacc

SEQ ID NO: 3751616 - RNA, 20 nt, Salmonella typhimurium LT2
aucccagggcggcgucgcca

SEQ ID NO: 3751617 - RNA, 20 nt, Salmonella typhimurium LT2
aucccauccgggccacucuc

SEQ ID NO: 3751618 - RNA, 21 nt, Salmonella typhimurium LT2
aucccauccgggccacucucc

SEQ ID NO: 3751619 - RNA, 18 nt, Salmonella typhimurium LT2
auccccaacaucaugucc

SEQ ID NO: 3751620 - RNA, 12 nt, Salmonella typhimurium LT2
auccccagcgcu

SEQ ID NO: 3751621 - RNA, 12 nt, Salmonella typhimurium LT2
auccccauccca

SEQ ID NO: 3751622 - RNA, 20 nt, Salmonella typhimurium LT2
auccccccuuuuuugcuggc

SEQ ID NO: 3751623 - RNA, 12 nt, Salmonella typhimurium LT2
auccccgcuggc

SEQ ID NO: 3751624 - RNA, 14 nt, Salmonella typhimurium LT2
auccccgcuggcgc

SEQ ID NO: 3751625 - RNA, 15 nt, Salmonella typhimurium LT2
auccccgcuggcgcg

SEQ ID NO: 3751626 - RNA, 17 nt, Salmonella typhimurium LT2
auccccggcaaccuuaa

SEQ ID NO: 3751627 - RNA, 21 nt, Salmonella typhimurium LT2
auccccucuuccaucagccag

SEQ ID NO: 3751628 - RNA, 22 nt, Salmonella typhimurium LT2
aucccgacccauacucuuuccc

SEQ ID NO: 3751629 - RNA, 13 nt, Salmonella typhimurium LT2
aucccgcaucacc

SEQ ID NO: 3751630 - RNA, 22 nt, Salmonella typhimurium LT2
aucccgccacuguccugacggc

SEQ ID NO: 3751631 - RNA, 14 nt, Salmonella typhimurium LT2
aucccgccagcggc

SEQ ID NO: 3751632 - RNA, 21 nt, Salmonella typhimurium LT2
aucccgccaucguccagccau

SEQ ID NO: 3751633 - RNA, 14 nt, Salmonella typhimurium LT2
aucccgccgcaucc

SEQ ID NO: 3751634 - RNA, 14 nt, Salmonella typhimurium LT2
aucccgccgcuggc

SEQ ID NO: 3751635 - RNA, 23 nt, Salmonella typhimurium LT2
aucccgccuugcggcgccaggac

SEQ ID NO: 3751636 - RNA, 14 nt, Salmonella typhimurium LT2
aucccgcgcugcgc

SEQ ID NO: 3751637 - RNA, 23 nt, Salmonella typhimurium LT2
aucccgcgcugcgccgcaaagcg

SEQ ID NO: 3751638 - RNA, 22 nt, Salmonella typhimurium LT2
aucccgcggcggacagcggcag

SEQ ID NO: 3751639 - RNA, 14 nt, Salmonella typhimurium LT2
aucccgcucgccag

SEQ ID NO: 3751640 - RNA, 23 nt, Salmonella typhimurium LT2
aucccgcugugauccauguugcc

SEQ ID NO: 3751641 - RNA, 17 nt, Salmonella typhimurium LT2
aucccggcgcgcguggc

SEQ ID NO: 3751642 - RNA, 19 nt, Salmonella typhimurium LT2
aucccgggcgauaaaccag

SEQ ID NO: 3751643 - RNA, 22 nt, Salmonella typhimurium LT2
aucccgggcgauaaaccagccc

SEQ ID NO: 3751644 - RNA, 21 nt, Salmonella typhimurium LT2
aucccgguauuccguuccuuc

SEQ ID NO: 3751645 - RNA, 15 nt, Salmonella typhimurium LT2
aucccguagccgcuu

SEQ ID NO: 3751646 - RNA, 13 nt, Salmonella typhimurium LT2
aucccugcggcug

SEQ ID NO: 3751647 - RNA, 15 nt, Salmonella typhimurium LT2
auccgacaacaugaa

SEQ ID NO: 3751648 - RNA, 16 nt, Salmonella typhimurium LT2
auccgacagauagugg

SEQ ID NO: 3751649 - RNA, 12 nt, Salmonella typhimurium LT2
auccgacaugau

SEQ ID NO: 3751650 - RNA, 18 nt, Salmonella typhimurium LT2
auccgacaugaugccaaa

SEQ ID NO: 3751651 - RNA, 19 nt, Salmonella typhimurium LT2
auccgacgcaacucacgcc

SEQ ID NO: 3751652 - RNA, 13 nt, Salmonella typhimurium LT2
auccgacgcaggu

SEQ ID NO: 3751653 - RNA, 16 nt, Salmonella typhimurium LT2
auccgacgccuguucg

SEQ ID NO: 3751654 - RNA, 13 nt, Salmonella typhimurium LT2
auccgagaccagg

SEQ ID NO: 3751655 - RNA, 17 nt, Salmonella typhimurium LT2
auccgauugcugacgaa

SEQ ID NO: 3751656 - RNA, 17 nt, Salmonella typhimurium LT2
auccgcaagacacgcuu

SEQ ID NO: 3751657 - RNA, 21 nt, Salmonella typhimurium LT2
auccgcagcggauugccgcgc

SEQ ID NO: 3751658 - RNA, 15 nt, Salmonella typhimurium LT2
auccgcauacaccuu

SEQ ID NO: 3751659 - RNA, 15 nt, Salmonella typhimurium LT2
auccgcauccgucaa

SEQ ID NO: 3751660 - RNA, 23 nt, Salmonella typhimurium LT2
auccgccaccaugaucaccugaa

SEQ ID NO: 3751661 - RNA, 14 nt, Salmonella typhimurium LT2
auccgccaccuuau

SEQ ID NO: 3751662 - RNA, 20 nt, Salmonella typhimurium LT2
auccgccaccuuaugcucau

SEQ ID NO: 3751663 - RNA, 12 nt, Salmonella typhimurium LT2
auccgccagcca

SEQ ID NO: 3751664 - RNA, 14 nt, Salmonella typhimurium LT2
auccgccagcgccu

SEQ ID NO: 3751665 - RNA, 19 nt, Salmonella typhimurium LT2
auccgccagugaauccacc

SEQ ID NO: 3751666 - RNA, 16 nt, Salmonella typhimurium LT2
auccgccgccagccau

SEQ ID NO: 3751667 - RNA, 21 nt, Salmonella typhimurium LT2
auccgcggauagacgauauag

SEQ ID NO: 3751668 - RNA, 14 nt, Salmonella typhimurium LT2
auccgcguggacgc

SEQ ID NO: 3751669 - RNA, 15 nt, Salmonella typhimurium LT2
auccggaauaagaau

SEQ ID NO: 3751670 - RNA, 17 nt, Salmonella typhimurium LT2
auccggacgauagccau

SEQ ID NO: 3751671 - RNA, 15 nt, Salmonella typhimurium LT2
auccggcaagcgcug

SEQ ID NO: 3751672 - RNA, 13 nt, Salmonella typhimurium LT2
auccggcaauaau

SEQ ID NO: 3751673 - RNA, 16 nt, Salmonella typhimurium LT2
auccggcaauuccgca

SEQ ID NO: 3751674 - RNA, 16 nt, Salmonella typhimurium LT2
auccggcacaaaauau

SEQ ID NO: 3751675 - RNA, 14 nt, Salmonella typhimurium LT2
auccggcacgccau

SEQ ID NO: 3751676 - RNA, 14 nt, Salmonella typhimurium LT2
auccggcacgguca

SEQ ID NO: 3751677 - RNA, 23 nt, Salmonella typhimurium LT2
auccggcaguuauuuuacgggcg

SEQ ID NO: 3751678 - RNA, 13 nt, Salmonella typhimurium LT2
auccggcauuuuu

SEQ ID NO: 3751679 - RNA, 19 nt, Salmonella typhimurium LT2
auccggccuccaccaccuc

SEQ ID NO: 3751680 - RNA, 17 nt, Salmonella typhimurium LT2
auccggcgaggcgauaa

SEQ ID NO: 3751681 - RNA, 11 nt, Salmonella typhimurium LT2
auccggcgcug

SEQ ID NO: 3751682 - RNA, 20 nt, Salmonella typhimurium LT2
auccggcgucagcauggugu

SEQ ID NO: 3751683 - RNA, 14 nt, Salmonella typhimurium LT2
auccggcugcgucg

SEQ ID NO: 3751684 - RNA, 17 nt, Salmonella typhimurium LT2
auccggguuaaaccagc

SEQ ID NO: 3751685 - RNA, 21 nt, Salmonella typhimurium LT2
auccgguaaacgcuccggcag

SEQ ID NO: 3751686 - RNA, 16 nt, Salmonella typhimurium LT2
auccggucauccagcg

SEQ ID NO: 3751687 - RNA, 20 nt, Salmonella typhimurium LT2
auccguagccaacacaucag

SEQ ID NO: 3751688 - RNA, 22 nt, Salmonella typhimurium LT2
auccguagccaacacaucagca

SEQ ID NO: 3751689 - RNA, 18 nt, Salmonella typhimurium LT2
auccgucaaaaugaucag

SEQ ID NO: 3751690 - RNA, 14 nt, Salmonella typhimurium LT2
auccguccucuuuc

SEQ ID NO: 3751691 - RNA, 18 nt, Salmonella typhimurium LT2
auccgucguguagccuuc

SEQ ID NO: 3751692 - RNA, 21 nt, Salmonella typhimurium LT2
auccguuccggauauuuauac

SEQ ID NO: 3751693 - RNA, 16 nt, Salmonella typhimurium LT2
auccguuucagaaaga

SEQ ID NO: 3751694 - RNA, 12 nt, Salmonella typhimurium LT2
auccguuuucag

SEQ ID NO: 3751695 - RNA, 22 nt, Salmonella typhimurium LT2
auccguuuucaguaaaucaacu

SEQ ID NO: 3751696 - RNA, 16 nt, Salmonella typhimurium LT2
auccuaaaucugccau

SEQ ID NO: 3751697 - RNA, 15 nt, Salmonella typhimurium LT2
auccucaauguuaac

SEQ ID NO: 3751698 - RNA, 23 nt, Salmonella typhimurium LT2
auccucauuuuguugcuccagca

SEQ ID NO: 3751699 - RNA, 15 nt, Salmonella typhimurium LT2
auccuccagcggcau

SEQ ID NO: 3751700 - RNA, 16 nt, Salmonella typhimurium LT2
auccucgcauccucca

SEQ ID NO: 3751701 - RNA, 18 nt, Salmonella typhimurium LT2
auccucuuggguuauuuc

SEQ ID NO: 3751702 - RNA, 15 nt, Salmonella typhimurium LT2
auccugaagcggcgc

SEQ ID NO: 3751703 - RNA, 21 nt, Salmonella typhimurium LT2
auccugaaggacaagcugcgc

SEQ ID NO: 3751704 - RNA, 22 nt, Salmonella typhimurium LT2
auccugaaggacaagcugcgcc

SEQ ID NO: 3751705 - RNA, 15 nt, Salmonella typhimurium LT2
auccugacaggccgg

SEQ ID NO: 3751706 - RNA, 17 nt, Salmonella typhimurium LT2
auccugacuauugcuga

SEQ ID NO: 3751707 - RNA, 16 nt, Salmonella typhimurium LT2
auccugacucaccagc

SEQ ID NO: 3751708 - RNA, 15 nt, Salmonella typhimurium LT2
auccugaugcgccuc

SEQ ID NO: 3751709 - RNA, 15 nt, Salmonella typhimurium LT2
auccugauuaaguuu

SEQ ID NO: 3751710 - RNA, 16 nt, Salmonella typhimurium LT2
auccugcaaauagcgc

SEQ ID NO: 3751711 - RNA, 21 nt, Salmonella typhimurium LT2
auccugcaccgccugcggcau

SEQ ID NO: 3751712 - RNA, 16 nt, Salmonella typhimurium LT2
auccuggauacguucc

SEQ ID NO: 3751713 - RNA, 20 nt, Salmonella typhimurium LT2
auccuggauacguuccagca

SEQ ID NO: 3751714 - RNA, 13 nt, Salmonella typhimurium LT2
aucgccgcgacag

SEQ ID NO: 3751715 - RNA, 22 nt, Salmonella typhimurium LT2
aucgccgcgccggacuccagca

SEQ ID NO: 3751716 - RNA, 16 nt, Salmonella typhimurium LT2
aucgccgcugcgagca

SEQ ID NO: 3751717 - RNA, 15 nt, Salmonella typhimurium LT2
aucgccgcugcuggc

SEQ ID NO: 3751718 - RNA, 20 nt, Salmonella typhimurium LT2
aucgccggacggcgcagcgc

SEQ ID NO: 3751719 - RNA, 17 nt, Salmonella typhimurium LT2
aucgccggagccgccug

SEQ ID NO: 3751720 - RNA, 22 nt, Salmonella typhimurium LT2
aucgccgguagcuucagcggcg

SEQ ID NO: 3751721 - RNA, 21 nt, Salmonella typhimurium LT2
aucgccucaacgcucauaccu

SEQ ID NO: 3751722 - RNA, 16 nt, Salmonella typhimurium LT2
aucgccugaugaccgc

SEQ ID NO: 3751723 - RNA, 18 nt, Salmonella typhimurium LT2
aucgccugcgcgccugac

SEQ ID NO: 3751724 - RNA, 22 nt, Salmonella typhimurium LT2
aucgccuggugugaacaucacg

SEQ ID NO: 3751725 - RNA, 20 nt, Salmonella typhimurium LT2
aucgccuucgacuuccgcau

SEQ ID NO: 3751726 - RNA, 13 nt, Salmonella typhimurium LT2
aucgcgagaaaau

SEQ ID NO: 3751727 - RNA, 22 nt, Salmonella typhimurium LT2
aucgcgagcaauuuccucugcc

SEQ ID NO: 3751728 - RNA, 16 nt, Salmonella typhimurium LT2
aucgcgauagcgcuga

SEQ ID NO: 3751729 - RNA, 17 nt, Salmonella typhimurium LT2
aucgcgauagcgcugag

SEQ ID NO: 3751730 - RNA, 19 nt, Salmonella typhimurium LT2
aucgcgaucaucagcacgc

SEQ ID NO: 3751731 - RNA, 22 nt, Salmonella typhimurium LT2
aucgcgauccagccccagcgcc

SEQ ID NO: 3751732 - RNA, 17 nt, Salmonella typhimurium LT2
aucgcgcaauuacucuu

SEQ ID NO: 3751733 - RNA, 19 nt, Salmonella typhimurium LT2
aucgcgcaguguaaagcgu

SEQ ID NO: 3751734 - RNA, 13 nt, Salmonella typhimurium LT2
aucgcgcgcgcca

SEQ ID NO: 3751735 - RNA, 18 nt, Salmonella typhimurium LT2
aucgcggaugacuucuuc

SEQ ID NO: 3751736 - RNA, 19 nt, Salmonella typhimurium LT2
aucgcggucagcggcgcgc

SEQ ID NO: 3751737 - RNA, 16 nt, Salmonella typhimurium LT2
aucgcguacaggaugu

SEQ ID NO: 3751738 - RNA, 19 nt, Salmonella typhimurium LT2
aucgcguacaggaugucca

SEQ ID NO: 3751739 - RNA, 15 nt, Salmonella typhimurium LT2
aucgcgugcaacagu

SEQ ID NO: 3751740 - RNA, 11 nt, Salmonella typhimurium LT2
aucgcguucgc

SEQ ID NO: 3751741 - RNA, 19 nt, Salmonella typhimurium LT2
aucgcguugcaaucgccug

SEQ ID NO: 3751742 - RNA, 20 nt, Salmonella typhimurium LT2
aucgcguuuuccagcauccu

SEQ ID NO: 3751743 - RNA, 15 nt, Salmonella typhimurium LT2
aucgcuaauuuuuaa

SEQ ID NO: 3751744 - RNA, 23 nt, Salmonella typhimurium LT2
aucgcuaucugacagccaaacug

SEQ ID NO: 3751745 - RNA, 15 nt, Salmonella typhimurium LT2
aucgcugccuugagu

SEQ ID NO: 3751746 - RNA, 17 nt, Salmonella typhimurium LT2
aucgcugccuugaguga

SEQ ID NO: 3751747 - RNA, 18 nt, Salmonella typhimurium LT2
aucgcugccuugagugac

SEQ ID NO: 3751748 - RNA, 13 nt, Salmonella typhimurium LT2
aucgcugcgccag

SEQ ID NO: 3751749 - RNA, 13 nt, Salmonella typhimurium LT2
aucgcugcgcccg

SEQ ID NO: 3751750 - RNA, 16 nt, Salmonella typhimurium LT2
aucgcugcuaaacgaa

SEQ ID NO: 3751751 - RNA, 19 nt, Salmonella typhimurium LT2
aucgcuggcguacgccauu

SEQ ID NO: 3751752 - RNA, 21 nt, Salmonella typhimurium LT2
aucgcuuaacggcccaggcau

SEQ ID NO: 3751753 - RNA, 15 nt, Salmonella typhimurium LT2
aucgcuugcccagca

SEQ ID NO: 3751754 - RNA, 21 nt, Salmonella typhimurium LT2
aucgcuuugagcagcgccauc

SEQ ID NO: 3751755 - RNA, 22 nt, Salmonella typhimurium LT2
aucgcuuugcagaaaauccuuc

SEQ ID NO: 3751756 - RNA, 19 nt, Salmonella typhimurium LT2
aucgcuuuuaucuggguca

SEQ ID NO: 3751757 - RNA, 21 nt, Salmonella typhimurium LT2
aucgcuuuuugcagauccuua

SEQ ID NO: 3751758 - RNA, 20 nt, Salmonella typhimurium LT2
aucggaaaaauaguggcugg

SEQ ID NO: 3751759 - RNA, 17 nt, Salmonella typhimurium LT2
aucggaagacuggcgca

SEQ ID NO: 3751760 - RNA, 20 nt, Salmonella typhimurium LT2
aucggagauauaaaccugau

SEQ ID NO: 3751761 - RNA, 19 nt, Salmonella typhimurium LT2
aucggagggggaggcaggc

SEQ ID NO: 3751762 - RNA, 15 nt, Salmonella typhimurium LT2
aucggaguccagcaa

SEQ ID NO: 3751763 - RNA, 11 nt, Salmonella typhimurium LT2
aucggcaaaca

SEQ ID NO: 3751764 - RNA, 19 nt, Salmonella typhimurium LT2
aucggcaaacgccgccugg

SEQ ID NO: 3751765 - RNA, 15 nt, Salmonella typhimurium LT2
aucggcaagcaucug

SEQ ID NO: 3751766 - RNA, 17 nt, Salmonella typhimurium LT2
aucggcaagcaucugau

SEQ ID NO: 3751767 - RNA, 16 nt, Salmonella typhimurium LT2
aucggcaccuggagcg

SEQ ID NO: 3751768 - RNA, 20 nt, Salmonella typhimurium LT2
aucggcaggacuuaaaaaca

SEQ ID NO: 3751769 - RNA, 20 nt, Salmonella typhimurium LT2
aucggcaggccggagcugau

SEQ ID NO: 3751770 - RNA, 13 nt, Salmonella typhimurium LT2
aucggccagcagu

SEQ ID NO: 3751771 - RNA, 14 nt, Salmonella typhimurium LT2
aucggccagcgcca

SEQ ID NO: 3751772 - RNA, 21 nt, Salmonella typhimurium LT2
aucggccagcgccagcguagu

SEQ ID NO: 3751773 - RNA, 16 nt, Salmonella typhimurium LT2
aucggcgcgcuggcgu

SEQ ID NO: 3751774 - RNA, 17 nt, Salmonella typhimurium LT2
aucggcgcggcgacgcc

SEQ ID NO: 3751775 - RNA, 22 nt, Salmonella typhimurium LT2
aucggcgcuacggcguuucacu

SEQ ID NO: 3751776 - RNA, 17 nt, Salmonella typhimurium LT2
aucggcggcaaagccga

SEQ ID NO: 3751777 - RNA, 22 nt, Salmonella typhimurium LT2
aucggcggcaaugcccacgccg

SEQ ID NO: 3751778 - RNA, 14 nt, Salmonella typhimurium LT2
aucggcguaccgca

SEQ ID NO: 3751779 - RNA, 15 nt, Salmonella typhimurium LT2
aucggcguugcccau

SEQ ID NO: 3751780 - RNA, 23 nt, Salmonella typhimurium LT2
aucggcguuuugcgcgccacgcc

SEQ ID NO: 3751781 - RNA, 20 nt, Salmonella typhimurium LT2
aucggcuugagcaccacgcg

SEQ ID NO: 3751782 - RNA, 12 nt, Salmonella typhimurium LT2
aucggcuugccu

SEQ ID NO: 3751783 - RNA, 22 nt, Salmonella typhimurium LT2
aucggcuuuggcaaacggcgcc

SEQ ID NO: 3751784 - RNA, 22 nt, Salmonella typhimurium LT2
aucgggacgaucaccaucccau

SEQ ID NO: 3751785 - RNA, 18 nt, Salmonella typhimurium LT2
aucgggauuccagugaca

SEQ ID NO: 3751786 - RNA, 20 nt, Salmonella typhimurium LT2
aucgggauuggaucgacgcu

SEQ ID NO: 3751787 - RNA, 16 nt, Salmonella typhimurium LT2
aucgggcaauccauua

SEQ ID NO: 3751788 - RNA, 20 nt, Salmonella typhimurium LT2
aucgggcgggcauuauacgc

SEQ ID NO: 3751789 - RNA, 15 nt, Salmonella typhimurium LT2
aucgggcuuccagcg

SEQ ID NO: 3751790 - RNA, 17 nt, Salmonella typhimurium LT2
aucgggcuuccagcguu

SEQ ID NO: 3751791 - RNA, 19 nt, Salmonella typhimurium LT2
aucgggcuuccagcguuga

SEQ ID NO: 3751792 - RNA, 22 nt, Salmonella typhimurium LT2
aucgguaaacgucgucacguua

SEQ ID NO: 3751793 - RNA, 20 nt, Salmonella typhimurium LT2
aucgguaaaggucgccgcau

SEQ ID NO: 3751794 - RNA, 21 nt, Salmonella typhimurium LT2
aucgguaauugcgccguucac

SEQ ID NO: 3751795 - RNA, 18 nt, Salmonella typhimurium LT2
aucgguauaacuggucau

SEQ ID NO: 3751796 - RNA, 14 nt, Salmonella typhimurium LT2
aucgguucucugcc

SEQ ID NO: 3751797 - RNA, 17 nt, Salmonella typhimurium LT2
aucgguucugacgcgac

SEQ ID NO: 3751798 - RNA, 17 nt, Salmonella typhimurium LT2
aucgguucugcgacaua

SEQ ID NO: 3751799 - RNA, 16 nt, Salmonella typhimurium LT2
aucgguuucgcggcgu

SEQ ID NO: 3751800 - RNA, 17 nt, Salmonella typhimurium LT2
aucguaaaaugaaaaac

SEQ ID NO: 3751801 - RNA, 18 nt, Salmonella typhimurium LT2
aucguaaaucaaaugaga

SEQ ID NO: 3751802 - RNA, 16 nt, Salmonella typhimurium LT2
aucguaccaauaccca

SEQ ID NO: 3751803 - RNA, 22 nt, Salmonella typhimurium LT2
aucguaccaauacccagcgcca

SEQ ID NO: 3751804 - RNA, 23 nt, Salmonella typhimurium LT2
aucguagcaucucuucgacaucu

SEQ ID NO: 3751805 - RNA, 22 nt, Salmonella typhimurium LT2
aucguagcgugcgcaauauggu

SEQ ID NO: 3751806 - RNA, 17 nt, Salmonella typhimurium LT2
aucguagucaggcagca

SEQ ID NO: 3751807 - RNA, 21 nt, Salmonella typhimurium LT2
aucguauccggucaauacauc

SEQ ID NO: 3751808 - RNA, 19 nt, Salmonella typhimurium LT2
aucguaugcagccaggcca

SEQ ID NO: 3751809 - RNA, 13 nt, Salmonella typhimurium LT2
aucguaugcgccu

SEQ ID NO: 3751810 - RNA, 14 nt, Salmonella typhimurium LT2
aucguaugcgccug

SEQ ID NO: 3751811 - RNA, 16 nt, Salmonella typhimurium LT2
aucgucaccaggaugc

SEQ ID NO: 3751812 - RNA, 21 nt, Salmonella typhimurium LT2
aucgucagacggcuccagcgc

SEQ ID NO: 3751813 - RNA, 16 nt, Salmonella typhimurium LT2
aucgucaugucucaga

SEQ ID NO: 3751814 - RNA, 16 nt, Salmonella typhimurium LT2
aucgucgccagaccca

SEQ ID NO: 3751815 - RNA, 15 nt, Salmonella typhimurium LT2
aucgucgccgaucgg

SEQ ID NO: 3751816 - RNA, 12 nt, Salmonella typhimurium LT2
aucgucgcgcca

SEQ ID NO: 3751817 - RNA, 15 nt, Salmonella typhimurium LT2
aucuuccagguagug

SEQ ID NO: 3751818 - RNA, 19 nt, Salmonella typhimurium LT2
aucuuccggaguaaugaaa

SEQ ID NO: 3751819 - RNA, 12 nt, Salmonella typhimurium LT2
aucuuccggcau

SEQ ID NO: 3751820 - RNA, 16 nt, Salmonella typhimurium LT2
aucuuccuccugugcu

SEQ ID NO: 3751821 - RNA, 23 nt, Salmonella typhimurium LT2
aucuucgauuguugacugccagc

SEQ ID NO: 3751822 - RNA, 18 nt, Salmonella typhimurium LT2
aucuucgucaaugcugcu

SEQ ID NO: 3751823 - RNA, 15 nt, Salmonella typhimurium LT2
aucuucuacaaugcg

SEQ ID NO: 3751824 - RNA, 17 nt, Salmonella typhimurium LT2
aucuucugcugcucccu

SEQ ID NO: 3751825 - RNA, 17 nt, Salmonella typhimurium LT2
aucuucuguccggcauu

SEQ ID NO: 3751826 - RNA, 16 nt, Salmonella typhimurium LT2
aucuugacaugaaaaa

SEQ ID NO: 3751827 - RNA, 17 nt, Salmonella typhimurium LT2
aucuugauuacagucuc

SEQ ID NO: 3751828 - RNA, 16 nt, Salmonella typhimurium LT2
aucuuguccucaucau

SEQ ID NO: 3751829 - RNA, 17 nt, Salmonella typhimurium LT2
aucuuuaccaaugugca

SEQ ID NO: 3751830 - RNA, 13 nt, Salmonella typhimurium LT2
aucuuuacguaac

SEQ ID NO: 3751831 - RNA, 20 nt, Salmonella typhimurium LT2
aucuuuaugucaguaauaua

SEQ ID NO: 3751832 - RNA, 20 nt, Salmonella typhimurium LT2
aucuuuauuaaaaagcagcc

SEQ ID NO: 3751833 - RNA, 16 nt, Salmonella typhimurium LT2
aucuuucacccccagc

SEQ ID NO: 3751834 - RNA, 16 nt, Salmonella typhimurium LT2
aucuuucucgcggcag

SEQ ID NO: 3751835 - RNA, 14 nt, Salmonella typhimurium LT2
aucuuugccgcaaa

SEQ ID NO: 3751836 - RNA, 22 nt, Salmonella typhimurium LT2
aucuuuggcuuuaugaauauca

SEQ ID NO: 3751837 - RNA, 14 nt, Salmonella typhimurium LT2
aucuuuuccggcag

SEQ ID NO: 3751838 - RNA, 15 nt, Salmonella typhimurium LT2
aucuuuuugcuccug

SEQ ID NO: 3751839 - RNA, 13 nt, Salmonella typhimurium LT2
augaaaaauagac

SEQ ID NO: 3751840 - RNA, 13 nt, Salmonella typhimurium LT2
augaaaccccaaa

SEQ ID NO: 3751841 - RNA, 18 nt, Salmonella typhimurium LT2
augaaaccgcccugcagg

SEQ ID NO: 3751842 - RNA, 16 nt, Salmonella typhimurium LT2
augaaacgugaaauau

SEQ ID NO: 3751843 - RNA, 22 nt, Salmonella typhimurium LT2
augaaacgugaaauauuucuuu

SEQ ID NO: 3751844 - RNA, 12 nt, Salmonella typhimurium LT2
augaaagagaaa

SEQ ID NO: 3751845 - RNA, 14 nt, Salmonella typhimurium LT2
augaaaucacccag

SEQ ID NO: 3751846 - RNA, 22 nt, Salmonella typhimurium LT2
augaaaucgucgccaacaccga

SEQ ID NO: 3751847 - RNA, 19 nt, Salmonella typhimurium LT2
augaaaugagaccaauaag

SEQ ID NO: 3751848 - RNA, 18 nt, Salmonella typhimurium LT2
augaaccagaugugcuuu

SEQ ID NO: 3751849 - RNA, 21 nt, Salmonella typhimurium LT2
augaaccauaucaaacaggac

SEQ ID NO: 3751850 - RNA, 22 nt, Salmonella typhimurium LT2
augaacgaugcugauuugccag

SEQ ID NO: 3751851 - RNA, 13 nt, Salmonella typhimurium LT2
augaagaaggccu

SEQ ID NO: 3751852 - RNA, 12 nt, Salmonella typhimurium LT2
augaagacgaag

SEQ ID NO: 3751853 - RNA, 22 nt, Salmonella typhimurium LT2
augaagacgaaggggacaaaau

SEQ ID NO: 3751854 - RNA, 18 nt, Salmonella typhimurium LT2
augaagcaagugcuggag

SEQ ID NO: 3751855 - RNA, 11 nt, Salmonella typhimurium LT2
augaagcgcgu

SEQ ID NO: 3751856 - RNA, 16 nt, Salmonella typhimurium LT2
augaagcggaaaggac

SEQ ID NO: 3751857 - RNA, 15 nt, Salmonella typhimurium LT2
augaagguuagcguc

SEQ ID NO: 3751858 - RNA, 13 nt, Salmonella typhimurium LT2
augaauaaaaaac

SEQ ID NO: 3751859 - RNA, 16 nt, Salmonella typhimurium LT2
augaauaaaaaacaag

SEQ ID NO: 3751860 - RNA, 12 nt, Salmonella typhimurium LT2
augaauaaccuc

SEQ ID NO: 3751861 - RNA, 15 nt, Salmonella typhimurium LT2
augaauaaccucccg

SEQ ID NO: 3751862 - RNA, 22 nt, Salmonella typhimurium LT2
augaauaaccucccgccggggc

SEQ ID NO: 3751863 - RNA, 23 nt, Salmonella typhimurium LT2
augaauacgcuccagcuggcugg

SEQ ID NO: 3751864 - RNA, 20 nt, Salmonella typhimurium LT2
augaauagccccucaauuau

SEQ ID NO: 3751865 - RNA, 16 nt, Salmonella typhimurium LT2
augaaucaucgguaaa

SEQ ID NO: 3751866 - RNA, 20 nt, Salmonella typhimurium LT2
augaaugacaguucccugcu

SEQ ID NO: 3751867 - RNA, 13 nt, Salmonella typhimurium LT2
augaaugacuguc

SEQ ID NO: 3751868 - RNA, 14 nt, Salmonella typhimurium LT2
augaaugacugucc

SEQ ID NO: 3751869 - RNA, 17 nt, Salmonella typhimurium LT2
augaaugaguaaccaga

SEQ ID NO: 3751870 - RNA, 15 nt, Salmonella typhimurium LT2
augacaaacaaaaaa

SEQ ID NO: 3751871 - RNA, 21 nt, Salmonella typhimurium LT2
augacacaucaccuccagcga

SEQ ID NO: 3751872 - RNA, 14 nt, Salmonella typhimurium LT2
augacagacaggcc

SEQ ID NO: 3751873 - RNA, 16 nt, Salmonella typhimurium LT2
augacagccaccagcg

SEQ ID NO: 3751874 - RNA, 14 nt, Salmonella typhimurium LT2
augacauccagagg

SEQ ID NO: 3751875 - RNA, 20 nt, Salmonella typhimurium LT2
augaccaucaaauaauacgc

SEQ ID NO: 3751876 - RNA, 13 nt, Salmonella typhimurium LT2
augaccauucgca

SEQ ID NO: 3751877 - RNA, 15 nt, Salmonella typhimurium LT2
augacccagcgcgac

SEQ ID NO: 3751878 - RNA, 13 nt, Salmonella typhimurium LT2
augacccauuuau

SEQ ID NO: 3751879 - RNA, 15 nt, Salmonella typhimurium LT2
augaccgcaauuaaa

SEQ ID NO: 3751880 - RNA, 16 nt, Salmonella typhimurium LT2
augaccggacgugcca

SEQ ID NO: 3751881 - RNA, 14 nt, Salmonella typhimurium LT2
augaccgguuuuuc

SEQ ID NO: 3751882 - RNA, 20 nt, Salmonella typhimurium LT2
augaccguuaguaaucggau

SEQ ID NO: 3751883 - RNA, 18 nt, Salmonella typhimurium LT2
augaccguugauucagcg

SEQ ID NO: 3751884 - RNA, 21 nt, Salmonella typhimurium LT2
augaccugggcgccagagagc

SEQ ID NO: 3751885 - RNA, 18 nt, Salmonella typhimurium LT2
augacgaacaggauauua

SEQ ID NO: 3751886 - RNA, 21 nt, Salmonella typhimurium LT2
augacgacagccaggagucua

SEQ ID NO: 3751887 - RNA, 16 nt, Salmonella typhimurium LT2
augacgacaucugcac

SEQ ID NO: 3751888 - RNA, 16 nt, Salmonella typhimurium LT2
augacgcaggcgcaaa

SEQ ID NO: 3751889 - RNA, 19 nt, Salmonella typhimurium LT2
augacgcccugcgccagca

SEQ ID NO: 3751890 - RNA, 13 nt, Salmonella typhimurium LT2
augacgccgcagc

SEQ ID NO: 3751891 - RNA, 12 nt, Salmonella typhimurium LT2
augacgccgucu

SEQ ID NO: 3751892 - RNA, 15 nt, Salmonella typhimurium LT2
augacgcgcaggccg

SEQ ID NO: 3751893 - RNA, 20 nt, Salmonella typhimurium LT2
augacgcugcgcuuauccgg

SEQ ID NO: 3751894 - RNA, 16 nt, Salmonella typhimurium LT2
augacgcuggaaguac

SEQ ID NO: 3751895 - RNA, 21 nt, Salmonella typhimurium LT2
augacggcaaagcccacgccc

SEQ ID NO: 3751896 - RNA, 23 nt, Salmonella typhimurium LT2
augacggcagucgcuacaaccag

SEQ ID NO: 3751897 - RNA, 23 nt, Salmonella typhimurium LT2
augacgggaucgaaccgccgacc

SEQ ID NO: 3751898 - RNA, 14 nt, Salmonella typhimurium LT2
augacgucagcaag

SEQ ID NO: 3751899 - RNA, 14 nt, Salmonella typhimurium LT2
augacguccaggcc

SEQ ID NO: 3751900 - RNA, 15 nt, Salmonella typhimurium LT2
augacguggccagca

SEQ ID NO: 3751901 - RNA, 23 nt, Salmonella typhimurium LT2
augacuaaaucagcauccgcaag

SEQ ID NO: 3751902 - RNA, 20 nt, Salmonella typhimurium LT2
augacugcgaauuuccugcc

SEQ ID NO: 3751903 - RNA, 13 nt, Salmonella typhimurium LT2
augacuguccacg

SEQ ID NO: 3751904 - RNA, 16 nt, Salmonella typhimurium LT2
augacuuuuuugccaa

SEQ ID NO: 3751905 - RNA, 13 nt, Salmonella typhimurium LT2
augagaagaaaaa

SEQ ID NO: 3751906 - RNA, 22 nt, Salmonella typhimurium LT2
augagauacgucaucaugcugc

SEQ ID NO: 3751907 - RNA, 23 nt, Salmonella typhimurium LT2
augagauugauaaucagcaagau

SEQ ID NO: 3751908 - RNA, 22 nt, Salmonella typhimurium LT2
augagcacagcccauaccagcg

SEQ ID NO: 3751909 - RNA, 12 nt, Salmonella typhimurium LT2
augagcaggccc

SEQ ID NO: 3751910 - RNA, 22 nt, Salmonella typhimurium LT2
augagcaggcccgguaagcaca

SEQ ID NO: 3751911 - RNA, 18 nt, Salmonella typhimurium LT2
augagccagauggauaac

SEQ ID NO: 3751912 - RNA, 12 nt, Salmonella typhimurium LT2
augagccagccc

SEQ ID NO: 3751913 - RNA, 22 nt, Salmonella typhimurium LT2
augagcgcaaucaagcucacca

SEQ ID NO: 3751914 - RNA, 15 nt, Salmonella typhimurium LT2
augaggcaagaggga

SEQ ID NO: 3751915 - RNA, 23 nt, Salmonella typhimurium LT2
augaggccagaaggcgaacauaa

SEQ ID NO: 3751916 - RNA, 15 nt, Salmonella typhimurium LT2
augaguuaacuacag

SEQ ID NO: 3751917 - RNA, 18 nt, Salmonella typhimurium LT2
augaguucaguaugauca

SEQ ID NO: 3751918 - RNA, 19 nt, Salmonella typhimurium LT2
augaguuggccuaccauuu

SEQ ID NO: 3751919 - RNA, 19 nt, Salmonella typhimurium LT2
augauaagcacuauuauau

SEQ ID NO: 3751920 - RNA, 16 nt, Salmonella typhimurium LT2
augauaauaugcucaa

SEQ ID NO: 3751921 - RNA, 21 nt, Salmonella typhimurium LT2
augccugaugcgacgcuuacc

SEQ ID NO: 3751922 - RNA, 20 nt, Salmonella typhimurium LT2
augccugauggcgcagcgcc

SEQ ID NO: 3751923 - RNA, 14 nt, Salmonella typhimurium LT2
augccugcgccaug

SEQ ID NO: 3751924 - RNA, 22 nt, Salmonella typhimurium LT2
augccugcgccauguucauaaa

SEQ ID NO: 3751925 - RNA, 11 nt, Salmonella typhimurium LT2
augccuggcag

SEQ ID NO: 3751926 - RNA, 12 nt, Salmonella typhimurium LT2
augccuggcagu

SEQ ID NO: 3751927 - RNA, 12 nt, Salmonella typhimurium LT2
augccuucgccg

SEQ ID NO: 3751928 - RNA, 15 nt, Salmonella typhimurium LT2
augcgaauaaucgcc

SEQ ID NO: 3751929 - RNA, 17 nt, Salmonella typhimurium LT2
augcgacuccaggaaca

SEQ ID NO: 3751930 - RNA, 18 nt, Salmonella typhimurium LT2
augcgacuccaggaacag

SEQ ID NO: 3751931 - RNA, 17 nt, Salmonella typhimurium LT2
augcgacugaaaaucaa

SEQ ID NO: 3751932 - RNA, 16 nt, Salmonella typhimurium LT2
augcgacugcccaaca

SEQ ID NO: 3751933 - RNA, 19 nt, Salmonella typhimurium LT2
augcgacuuugcgccggca

SEQ ID NO: 3751934 - RNA, 19 nt, Salmonella typhimurium LT2
augcgagaaugucgccaug

SEQ ID NO: 3751935 - RNA, 15 nt, Salmonella typhimurium LT2
augcgaguagcaaau

SEQ ID NO: 3751936 - RNA, 17 nt, Salmonella typhimurium LT2
augcgauaaccguauug

SEQ ID NO: 3751937 - RNA, 19 nt, Salmonella typhimurium LT2
augcgaucgggcaauccau

SEQ ID NO: 3751938 - RNA, 14 nt, Salmonella typhimurium LT2
augcgauguaaaaa

SEQ ID NO: 3751939 - RNA, 15 nt, Salmonella typhimurium LT2
augcgauguaaaaau

SEQ ID NO: 3751940 - RNA, 16 nt, Salmonella typhimurium LT2
augcgauguaaaaaug

SEQ ID NO: 3751941 - RNA, 21 nt, Salmonella typhimurium LT2
augcgcaaggccguuauccag

SEQ ID NO: 3751942 - RNA, 20 nt, Salmonella typhimurium LT2
augcgcagaaacugaucgaa

SEQ ID NO: 3751943 - RNA, 16 nt, Salmonella typhimurium LT2
augcgccagccagucg

SEQ ID NO: 3751944 - RNA, 15 nt, Salmonella typhimurium LT2
augcgccagccgcuu

SEQ ID NO: 3751945 - RNA, 17 nt, Salmonella typhimurium LT2
augcgccagcggccagc

SEQ ID NO: 3751946 - RNA, 16 nt, Salmonella typhimurium LT2
augcgccaggcagcac

SEQ ID NO: 3751947 - RNA, 18 nt, Salmonella typhimurium LT2
augcgccaggcagcaccu

SEQ ID NO: 3751948 - RNA, 17 nt, Salmonella typhimurium LT2
augcgccccugcaggcg

SEQ ID NO: 3751949 - RNA, 18 nt, Salmonella typhimurium LT2
augcgccccugcaggcga

SEQ ID NO: 3751950 - RNA, 17 nt, Salmonella typhimurium LT2
augcgcccggagcggug

SEQ ID NO: 3751951 - RNA, 15 nt, Salmonella typhimurium LT2
augcgccgucaggcu

SEQ ID NO: 3751952 - RNA, 20 nt, Salmonella typhimurium LT2
augcgcgcguuuaucaccgu

SEQ ID NO: 3751953 - RNA, 16 nt, Salmonella typhimurium LT2
augcgcguagcccaca

SEQ ID NO: 3751954 - RNA, 14 nt, Salmonella typhimurium LT2
augcgcgucaggcc

SEQ ID NO: 3751955 - RNA, 15 nt, Salmonella typhimurium LT2
augcgcgucaggcca

SEQ ID NO: 3751956 - RNA, 20 nt, Salmonella typhimurium LT2
augcgcgucccggcagugca

SEQ ID NO: 3751957 - RNA, 17 nt, Salmonella typhimurium LT2
augcgcguuuagcgcca

SEQ ID NO: 3751958 - RNA, 15 nt, Salmonella typhimurium LT2
augcgcuauaaaaau

SEQ ID NO: 3751959 - RNA, 13 nt, Salmonella typhimurium LT2
augcgcuccagcu

SEQ ID NO: 3751960 - RNA, 17 nt, Salmonella typhimurium LT2
augcgcuuccagcauga

SEQ ID NO: 3751961 - RNA, 17 nt, Salmonella typhimurium LT2
augcggaugcugcgcca

SEQ ID NO: 3751962 - RNA, 23 nt, Salmonella typhimurium LT2
augcggcaaaaauccuucuucca

SEQ ID NO: 3751963 - RNA, 21 nt, Salmonella typhimurium LT2
augcggcagaggucgccgcug

SEQ ID NO: 3751964 - RNA, 17 nt, Salmonella typhimurium LT2
augcgggguuugcagau

SEQ ID NO: 3751965 - RNA, 18 nt, Salmonella typhimurium LT2
augcgggguuugcagaug

SEQ ID NO: 3751966 - RNA, 20 nt, Salmonella typhimurium LT2
augcgggguuugcagaugug

SEQ ID NO: 3751967 - RNA, 22 nt, Salmonella typhimurium LT2
augcgggugacgcuggcggaga

SEQ ID NO: 3751968 - RNA, 18 nt, Salmonella typhimurium LT2
augcggguuucguucggc

SEQ ID NO: 3751969 - RNA, 20 nt, Salmonella typhimurium LT2
augcgguuguucuuccagcg

SEQ ID NO: 3751970 - RNA, 23 nt, Salmonella typhimurium LT2
augcgguuguucuuccagcguca

SEQ ID NO: 3751971 - RNA, 20 nt, Salmonella typhimurium LT2
augcguaauccggccuggcg

SEQ ID NO: 3751972 - RNA, 17 nt, Salmonella typhimurium LT2
augcguauuuccaccuu

SEQ ID NO: 3751973 - RNA, 22 nt, Salmonella typhimurium LT2
augcguauuuccaccuucucuu

SEQ ID NO: 3751974 - RNA, 15 nt, Salmonella typhimurium LT2
augcguccgcccaga

SEQ ID NO: 3751975 - RNA, 16 nt, Salmonella typhimurium LT2
augcguccgcccagaa

SEQ ID NO: 3751976 - RNA, 12 nt, Salmonella typhimurium LT2
augcgucggcac

SEQ ID NO: 3751977 - RNA, 19 nt, Salmonella typhimurium LT2
augcguggcguaucggcag

SEQ ID NO: 3751978 - RNA, 22 nt, Salmonella typhimurium LT2
augcguucuagcuuaucgccaa

SEQ ID NO: 3751979 - RNA, 18 nt, Salmonella typhimurium LT2
augcguugaaaaccugca

SEQ ID NO: 3751980 - RNA, 17 nt, Salmonella typhimurium LT2
augcguuucgucgggcg

SEQ ID NO: 3751981 - RNA, 13 nt, Salmonella typhimurium LT2
augcuaaaacaga

SEQ ID NO: 3751982 - RNA, 20 nt, Salmonella typhimurium LT2
augcuaacgcccucucuccg

SEQ ID NO: 3751983 - RNA, 13 nt, Salmonella typhimurium LT2
augcuaucccagg

SEQ ID NO: 3751984 - RNA, 23 nt, Salmonella typhimurium LT2
augcuaucgguaguguuaucgcc

SEQ ID NO: 3751985 - RNA, 22 nt, Salmonella typhimurium LT2
augcuauucagcaguucauucg

SEQ ID NO: 3751986 - RNA, 14 nt, Salmonella typhimurium LT2
augcuauuuguggg

SEQ ID NO: 3751987 - RNA, 22 nt, Salmonella typhimurium LT2
augcucaacccgaccuacaaau

SEQ ID NO: 3751988 - RNA, 15 nt, Salmonella typhimurium LT2
augcucaacuuccag

SEQ ID NO: 3751989 - RNA, 13 nt, Salmonella typhimurium LT2
augcucaccgcga

SEQ ID NO: 3751990 - RNA, 23 nt, Salmonella typhimurium LT2
augcucagggcauccgccgccgc

SEQ ID NO: 3751991 - RNA, 21 nt, Salmonella typhimurium LT2
augcucaguauggccagaugc

SEQ ID NO: 3751992 - RNA, 17 nt, Salmonella typhimurium LT2
augcuccaauaaauauu

SEQ ID NO: 3751993 - RNA, 20 nt, Salmonella typhimurium LT2
augcucccccccuuccccca

SEQ ID NO: 3751994 - RNA, 21 nt, Salmonella typhimurium LT2
augcuccuuccgucgcugcgu

SEQ ID NO: 3751995 - RNA, 13 nt, Salmonella typhimurium LT2
augcucuccagca

SEQ ID NO: 3751996 - RNA, 20 nt, Salmonella typhimurium LT2
augcucugcugugccaguac

SEQ ID NO: 3751997 - RNA, 14 nt, Salmonella typhimurium LT2
augcugaacagccg

SEQ ID NO: 3751998 - RNA, 20 nt, Salmonella typhimurium LT2
augcugaauagccagccccc

SEQ ID NO: 3751999 - RNA, 21 nt, Salmonella typhimurium LT2
augcugacggauucuuccucu

SEQ ID NO: 3752000 - RNA, 15 nt, Salmonella typhimurium LT2
augcugauacaaagc

SEQ ID NO: 3752001 - RNA, 16 nt, Salmonella typhimurium LT2
augcugcaccgcauca

SEQ ID NO: 3752002 - RNA, 16 nt, Salmonella typhimurium LT2
augcugcaucuuacug

SEQ ID NO: 3752003 - RNA, 13 nt, Salmonella typhimurium LT2
augcugccagcau

SEQ ID NO: 3752004 - RNA, 18 nt, Salmonella typhimurium LT2
augcugccagcaugauaa

SEQ ID NO: 3752005 - RNA, 23 nt, Salmonella typhimurium LT2
augcugcgguugagcuucuuggc

SEQ ID NO: 3752006 - RNA, 17 nt, Salmonella typhimurium LT2
augcuggcggagccaaa

SEQ ID NO: 3752007 - RNA, 19 nt, Salmonella typhimurium LT2
augcugggcgguaaaaccu

SEQ ID NO: 3752008 - RNA, 20 nt, Salmonella typhimurium LT2
augcugggcgugucccugga

SEQ ID NO: 3752009 - RNA, 14 nt, Salmonella typhimurium LT2
augcuggucagcaa

SEQ ID NO: 3752010 - RNA, 21 nt, Salmonella typhimurium LT2
augcuggugaagacgcugcaa

SEQ ID NO: 3752011 - RNA, 14 nt, Salmonella typhimurium LT2
augcuuacagagca

SEQ ID NO: 3752012 - RNA, 19 nt, Salmonella typhimurium LT2
augcuuauccggccuacag

SEQ ID NO: 3752013 - RNA, 14 nt, Salmonella typhimurium LT2
augcuuaucgccaa

SEQ ID NO: 3752014 - RNA, 14 nt, Salmonella typhimurium LT2
augcuuuaaaugcc

SEQ ID NO: 3752015 - RNA, 17 nt, Salmonella typhimurium LT2
augcuuuaaaugccugu

SEQ ID NO: 3752016 - RNA, 17 nt, Salmonella typhimurium LT2
augcuuucaauacucca

SEQ ID NO: 3752017 - RNA, 15 nt, Salmonella typhimurium LT2
augcuuucagcaugu

SEQ ID NO: 3752018 - RNA, 21 nt, Salmonella typhimurium LT2
augcuuucgcgauaaucaacu

SEQ ID NO: 3752019 - RNA, 14 nt, Salmonella typhimurium LT2
auggaaaugcacgu

SEQ ID NO: 3752020 - RNA, 15 nt, Salmonella typhimurium LT2
auggaacaucuccca

SEQ ID NO: 3752021 - RNA, 21 nt, Salmonella typhimurium LT2
auggaacaucucccaggcgau

SEQ ID NO: 3752022 - RNA, 20 nt, Salmonella typhimurium LT2
auggaacugccuggcucauu

SEQ ID NO: 3752023 - RNA, 14 nt, Salmonella typhimurium LT2
auggaacuuaucca

SEQ ID NO: 3752024 - RNA, 18 nt, Salmonella typhimurium LT2
auggacaaguaaaccggu

SEQ ID NO: 3752025 - RNA, 16 nt, Salmonella typhimurium LT2
auguaauucaccaaau

SEQ ID NO: 3752026 - RNA, 18 nt, Salmonella typhimurium LT2
auguacaucguaaagcac

SEQ ID NO: 3752027 - RNA, 15 nt, Salmonella typhimurium LT2
auguaccgucaucgc

SEQ ID NO: 3752028 - RNA, 17 nt, Salmonella typhimurium LT2
auguacgaaagcgcgau

SEQ ID NO: 3752029 - RNA, 18 nt, Salmonella typhimurium LT2
auguacgcaggcggcugg

SEQ ID NO: 3752030 - RNA, 13 nt, Salmonella typhimurium LT2
auguacuagucag

SEQ ID NO: 3752031 - RNA, 17 nt, Salmonella typhimurium LT2
auguagcgcggcagcgc

SEQ ID NO: 3752032 - RNA, 13 nt, Salmonella typhimurium LT2
auguagcgcugaa

SEQ ID NO: 3752033 - RNA, 21 nt, Salmonella typhimurium LT2
auguaguaaauaggagaugca

SEQ ID NO: 3752034 - RNA, 20 nt, Salmonella typhimurium LT2
auguagucgcucagguuguc

SEQ ID NO: 3752035 - RNA, 17 nt, Salmonella typhimurium LT2
auguaucgcgcggauuc

SEQ ID NO: 3752036 - RNA, 20 nt, Salmonella typhimurium LT2
auguaucgcgcuuacacaga

SEQ ID NO: 3752037 - RNA, 22 nt, Salmonella typhimurium LT2
auguauucucccgucagcaaca

SEQ ID NO: 3752038 - RNA, 15 nt, Salmonella typhimurium LT2
auguauugguauuuu

SEQ ID NO: 3752039 - RNA, 15 nt, Salmonella typhimurium LT2
augucaccaucaucg

SEQ ID NO: 3752040 - RNA, 18 nt, Salmonella typhimurium LT2
augucagcgcaaagccaa

SEQ ID NO: 3752041 - RNA, 15 nt, Salmonella typhimurium LT2
augucagcucaggaa

SEQ ID NO: 3752042 - RNA, 16 nt, Salmonella typhimurium LT2
augucagcucaggaag

SEQ ID NO: 3752043 - RNA, 16 nt, Salmonella typhimurium LT2
augucaguaauauauu

SEQ ID NO: 3752044 - RNA, 15 nt, Salmonella typhimurium LT2
augucaucaagauuu

SEQ ID NO: 3752045 - RNA, 14 nt, Salmonella typhimurium LT2
augucaucggcuuu

SEQ ID NO: 3752046 - RNA, 14 nt, Salmonella typhimurium LT2
augucaugaagcuc

SEQ ID NO: 3752047 - RNA, 17 nt, Salmonella typhimurium LT2
augucaugacuuaacgu

SEQ ID NO: 3752048 - RNA, 19 nt, Salmonella typhimurium LT2
auguccaggcgacaugaca

SEQ ID NO: 3752049 - RNA, 18 nt, Salmonella typhimurium LT2
auguccaucagauucaac

SEQ ID NO: 3752050 - RNA, 19 nt, Salmonella typhimurium LT2
auguccccugacagagcuc

SEQ ID NO: 3752051 - RNA, 17 nt, Salmonella typhimurium LT2
augucccgauauugguc

SEQ ID NO: 3752052 - RNA, 11 nt, Salmonella typhimurium LT2
augucccugcc

SEQ ID NO: 3752053 - RNA, 15 nt, Salmonella typhimurium LT2
auguccgacgccgcu

SEQ ID NO: 3752054 - RNA, 17 nt, Salmonella typhimurium LT2
auguccgauagcauuau

SEQ ID NO: 3752055 - RNA, 20 nt, Salmonella typhimurium LT2
auguccgguugcauugacca

SEQ ID NO: 3752056 - RNA, 19 nt, Salmonella typhimurium LT2
auguccguuugcugcacca

SEQ ID NO: 3752057 - RNA, 16 nt, Salmonella typhimurium LT2
augucgacauaauuuc

SEQ ID NO: 3752058 - RNA, 14 nt, Salmonella typhimurium LT2
augucgacgcgcuc

SEQ ID NO: 3752059 - RNA, 22 nt, Salmonella typhimurium LT2
augucgcggauaugcagcagcc

SEQ ID NO: 3752060 - RNA, 17 nt, Salmonella typhimurium LT2
augucgcgucagguuua

SEQ ID NO: 3752061 - RNA, 20 nt, Salmonella typhimurium LT2
augucguuguaguuaucgcc

SEQ ID NO: 3752062 - RNA, 12 nt, Salmonella typhimurium LT2
augucuaugauu

SEQ ID NO: 3752063 - RNA, 21 nt, Salmonella typhimurium LT2
augucucaauaucgccuaccg

SEQ ID NO: 3752064 - RNA, 14 nt, Salmonella typhimurium LT2
augugacauuuucg

SEQ ID NO: 3752065 - RNA, 16 nt, Salmonella typhimurium LT2
augugauuagcccacc

SEQ ID NO: 3752066 - RNA, 21 nt, Salmonella typhimurium LT2
augugcaaucacacuacacga

SEQ ID NO: 3752067 - RNA, 13 nt, Salmonella typhimurium LT2
augugcgccagcc

SEQ ID NO: 3752068 - RNA, 19 nt, Salmonella typhimurium LT2
augugcuauuuucucuugc

SEQ ID NO: 3752069 - RNA, 22 nt, Salmonella typhimurium LT2
auguggacgccauaaaccagaa

SEQ ID NO: 3752070 - RNA, 14 nt, Salmonella typhimurium LT2
auguguuugagcag

SEQ ID NO: 3752071 - RNA, 17 nt, Salmonella typhimurium LT2
auguguuugagcagccc

SEQ ID NO: 3752072 - RNA, 18 nt, Salmonella typhimurium LT2
auguuaaaagagaaaaag

SEQ ID NO: 3752073 - RNA, 17 nt, Salmonella typhimurium LT2
auguuaacuacuuuaca

SEQ ID NO: 3752074 - RNA, 22 nt, Salmonella typhimurium LT2
auguuaauaccagcgccaauca

SEQ ID NO: 3752075 - RNA, 15 nt, Salmonella typhimurium LT2
auguuaccuguuaaa

SEQ ID NO: 3752076 - RNA, 16 nt, Salmonella typhimurium LT2
auguuagaaucuauua

SEQ ID NO: 3752077 - RNA, 22 nt, Salmonella typhimurium LT2
auguucaacgucagcuggaaug

SEQ ID NO: 3752078 - RNA, 15 nt, Salmonella typhimurium LT2
auguuccccguugag

SEQ ID NO: 3752079 - RNA, 12 nt, Salmonella typhimurium LT2
auguuccggcag

SEQ ID NO: 3752080 - RNA, 20 nt, Salmonella typhimurium LT2
auguucguccaacacgcugc

SEQ ID NO: 3752081 - RNA, 17 nt, Salmonella typhimurium LT2
auguugccggauagcuc

SEQ ID NO: 3752082 - RNA, 22 nt, Salmonella typhimurium LT2
auguuggguuucgacuucgccu

SEQ ID NO: 3752083 - RNA, 17 nt, Salmonella typhimurium LT2
auguuguggcaauauuu

SEQ ID NO: 3752084 - RNA, 17 nt, Salmonella typhimurium LT2
auguuguuccagagugc

SEQ ID NO: 3752085 - RNA, 14 nt, Salmonella typhimurium LT2
auguuguuugaaaa

SEQ ID NO: 3752086 - RNA, 21 nt, Salmonella typhimurium LT2
auguuuaaucaacggguuaaa

SEQ ID NO: 3752087 - RNA, 14 nt, Salmonella typhimurium LT2
auguuuaccaucgc

SEQ ID NO: 3752088 - RNA, 15 nt, Salmonella typhimurium LT2
auguuuaccgugucc

SEQ ID NO: 3752089 - RNA, 14 nt, Salmonella typhimurium LT2
auguuuacgccauu

SEQ ID NO: 3752090 - RNA, 15 nt, Salmonella typhimurium LT2
auguuuccguuugua

SEQ ID NO: 3752091 - RNA, 20 nt, Salmonella typhimurium LT2
auguuuccugaauagcaggc

SEQ ID NO: 3752092 - RNA, 20 nt, Salmonella typhimurium LT2
auguuucgacaguuucuucg

SEQ ID NO: 3752093 - RNA, 14 nt, Salmonella typhimurium LT2
auguuucuucgccc

SEQ ID NO: 3752094 - RNA, 18 nt, Salmonella typhimurium LT2
auguuugacaagcagcgg

SEQ ID NO: 3752095 - RNA, 23 nt, Salmonella typhimurium LT2
auguuuucuuaacguuaagcaua

SEQ ID NO: 3752096 - RNA, 16 nt, Salmonella typhimurium LT2
auguuuugucguucac

SEQ ID NO: 3752097 - RNA, 19 nt, Salmonella typhimurium LT2
auguuuuuaucagcuugcc

SEQ ID NO: 3752098 - RNA, 19 nt, Salmonella typhimurium LT2
auuaaaaaaggcagaagaa

SEQ ID NO: 3752099 - RNA, 20 nt, Salmonella typhimurium LT2
auuaaaaagcagccagaccc

SEQ ID NO: 3752100 - RNA, 19 nt, Salmonella typhimurium LT2
auuaaaacaagucagcguu

SEQ ID NO: 3752101 - RNA, 12 nt, Salmonella typhimurium LT2
auuaaaaccauu

SEQ ID NO: 3752102 - RNA, 22 nt, Salmonella typhimurium LT2
auuaaaaccauugcuaaaaaua

SEQ ID NO: 3752103 - RNA, 17 nt, Salmonella typhimurium LT2
auuaaaagaccccauuu

SEQ ID NO: 3752104 - RNA, 12 nt, Salmonella typhimurium LT2
auuaaaauaaau

SEQ ID NO: 3752105 - RNA, 16 nt, Salmonella typhimurium LT2
auuaaaauaaauuaau

SEQ ID NO: 3752106 - RNA, 12 nt, Salmonella typhimurium LT2
auuaaaaugaug

SEQ ID NO: 3752107 - RNA, 22 nt, Salmonella typhimurium LT2
auuaaacagacaauaccagggc

SEQ ID NO: 3752108 - RNA, 17 nt, Salmonella typhimurium LT2
auuaaacguuauucauu

SEQ ID NO: 3752109 - RNA, 22 nt, Salmonella typhimurium LT2
auuaaacguuauucauuaccau

SEQ ID NO: 3752110 - RNA, 18 nt, Salmonella typhimurium LT2
auuaaauaacaaaugaag

SEQ ID NO: 3752111 - RNA, 17 nt, Salmonella typhimurium LT2
auuaaauuuauacucaa

SEQ ID NO: 3752112 - RNA, 12 nt, Salmonella typhimurium LT2
auuaacaaauaa

SEQ ID NO: 3752113 - RNA, 13 nt, Salmonella typhimurium LT2
auuaacaaauaaa

SEQ ID NO: 3752114 - RNA, 20 nt, Salmonella typhimurium LT2
auuaacagacaaugaauauu

SEQ ID NO: 3752115 - RNA, 23 nt, Salmonella typhimurium LT2
auuaacagcgcgaccaggaaacc

SEQ ID NO: 3752116 - RNA, 11 nt, Salmonella typhimurium LT2
auuaacaucag

SEQ ID NO: 3752117 - RNA, 16 nt, Salmonella typhimurium LT2
auuaacgacaaaaaua

SEQ ID NO: 3752118 - RNA, 15 nt, Salmonella typhimurium LT2
auuaacgcgaaaaua

SEQ ID NO: 3752119 - RNA, 12 nt, Salmonella typhimurium LT2
auuaacucauca

SEQ ID NO: 3752120 - RNA, 18 nt, Salmonella typhimurium LT2
auuaacugcacuuucugc

SEQ ID NO: 3752121 - RNA, 13 nt, Salmonella typhimurium LT2
auuaagcagacug

SEQ ID NO: 3752122 - RNA, 19 nt, Salmonella typhimurium LT2
auuaagcaggccgauauug

SEQ ID NO: 3752123 - RNA, 17 nt, Salmonella typhimurium LT2
auuaagccuuuuuaaau

SEQ ID NO: 3752124 - RNA, 18 nt, Salmonella typhimurium LT2
auuaagccuuuuuaaaua

SEQ ID NO: 3752125 - RNA, 23 nt, Salmonella typhimurium LT2
auuaagccuuuuuaaauauuaag

SEQ ID NO: 3752126 - RNA, 22 nt, Salmonella typhimurium LT2
auuaagcggauuuuuucgcuuu

SEQ ID NO: 3752127 - RNA, 12 nt, Salmonella typhimurium LT2
auuaaguuuuuu

SEQ ID NO: 3752128 - RNA, 16 nt, Salmonella typhimurium LT2
auuaaguuuuuuuaaa

SEQ ID NO: 3752129 - RNA, 13 nt, Salmonella typhimurium LT2
auucagcggcugc

SEQ ID NO: 3752130 - RNA, 18 nt, Salmonella typhimurium LT2
auucagcggcugcgccug

SEQ ID NO: 3752131 - RNA, 13 nt, Salmonella typhimurium LT2
auucaggcgguaa

SEQ ID NO: 3752132 - RNA, 18 nt, Salmonella typhimurium LT2
auucaggcuggcaaagca

SEQ ID NO: 3752133 - RNA, 19 nt, Salmonella typhimurium LT2
auucaggcuggcaaagcag

SEQ ID NO: 3752134 - RNA, 11 nt, Salmonella typhimurium LT2
auucagguaau

SEQ ID NO: 3752135 - RNA, 12 nt, Salmonella typhimurium LT2
auucagguaaua

SEQ ID NO: 3752136 - RNA, 21 nt, Salmonella typhimurium LT2
auucagguuauuugccucugg

SEQ ID NO: 3752137 - RNA, 16 nt, Salmonella typhimurium LT2
auucaguaagagggug

SEQ ID NO: 3752138 - RNA, 21 nt, Salmonella typhimurium LT2
auucaguuucuucggcuucac

SEQ ID NO: 3752139 - RNA, 14 nt, Salmonella typhimurium LT2
auucauaaaagauc

SEQ ID NO: 3752140 - RNA, 17 nt, Salmonella typhimurium LT2
auucauaacaccaauac

SEQ ID NO: 3752141 - RNA, 15 nt, Salmonella typhimurium LT2
auucauauuuauaca

SEQ ID NO: 3752142 - RNA, 14 nt, Salmonella typhimurium LT2
auucauccagaccu

SEQ ID NO: 3752143 - RNA, 18 nt, Salmonella typhimurium LT2
auucauccagaccugagc

SEQ ID NO: 3752144 - RNA, 20 nt, Salmonella typhimurium LT2
auucauccagaccugagccu

SEQ ID NO: 3752145 - RNA, 15 nt, Salmonella typhimurium LT2
auucaucgacaaaua

SEQ ID NO: 3752146 - RNA, 20 nt, Salmonella typhimurium LT2
auucaucgauacgcggaugu

SEQ ID NO: 3752147 - RNA, 16 nt, Salmonella typhimurium LT2
auucaucucgauaccg

SEQ ID NO: 3752148 - RNA, 15 nt, Salmonella typhimurium LT2
auucaugaucuuucc

SEQ ID NO: 3752149 - RNA, 21 nt, Salmonella typhimurium LT2
auucaugaucuuuccuuuuuc

SEQ ID NO: 3752150 - RNA, 19 nt, Salmonella typhimurium LT2
auucaugcaacuucaccuc

SEQ ID NO: 3752151 - RNA, 18 nt, Salmonella typhimurium LT2
auucauggcgcgcgccgc

SEQ ID NO: 3752152 - RNA, 16 nt, Salmonella typhimurium LT2
auucaugugaaaguga

SEQ ID NO: 3752153 - RNA, 16 nt, Salmonella typhimurium LT2
auucauuaaaccacuu

SEQ ID NO: 3752154 - RNA, 20 nt, Salmonella typhimurium LT2
auucauuauguuagaaucua

SEQ ID NO: 3752155 - RNA, 20 nt, Salmonella typhimurium LT2
auucauugagcaucaaacuu

SEQ ID NO: 3752156 - RNA, 18 nt, Salmonella typhimurium LT2
auucauugucuuuuucuc

SEQ ID NO: 3752157 - RNA, 14 nt, Salmonella typhimurium LT2
auucauuucaaugu

SEQ ID NO: 3752158 - RNA, 15 nt, Salmonella typhimurium LT2
auucauuucaaugua

SEQ ID NO: 3752159 - RNA, 14 nt, Salmonella typhimurium LT2
auucauuuccagca

SEQ ID NO: 3752160 - RNA, 21 nt, Salmonella typhimurium LT2
auuccacagguaaaauugccg

SEQ ID NO: 3752161 - RNA, 15 nt, Salmonella typhimurium LT2
auuccagaaucuggc

SEQ ID NO: 3752162 - RNA, 11 nt, Salmonella typhimurium LT2
auuccagaccc

SEQ ID NO: 3752163 - RNA, 22 nt, Salmonella typhimurium LT2
auuccagccgguguuaaccaga

SEQ ID NO: 3752164 - RNA, 23 nt, Salmonella typhimurium LT2
auuccagggcauuuuuuccagua

SEQ ID NO: 3752165 - RNA, 14 nt, Salmonella typhimurium LT2
auuccaguccuuuc

SEQ ID NO: 3752166 - RNA, 15 nt, Salmonella typhimurium LT2
auuccagucgcucca

SEQ ID NO: 3752167 - RNA, 17 nt, Salmonella typhimurium LT2
auuccagugacaaugua

SEQ ID NO: 3752168 - RNA, 20 nt, Salmonella typhimurium LT2
auuccauauaacagaauaag

SEQ ID NO: 3752169 - RNA, 22 nt, Salmonella typhimurium LT2
auuccaucaauaauccggcaau

SEQ ID NO: 3752170 - RNA, 13 nt, Salmonella typhimurium LT2
auuccaucggcau

SEQ ID NO: 3752171 - RNA, 20 nt, Salmonella typhimurium LT2
auuccauuagcauucccuua

SEQ ID NO: 3752172 - RNA, 20 nt, Salmonella typhimurium LT2
auucccacgcauaguccugc

SEQ ID NO: 3752173 - RNA, 12 nt, Salmonella typhimurium LT2
auucccagaccc

SEQ ID NO: 3752174 - RNA, 13 nt, Salmonella typhimurium LT2
auucccagcgccc

SEQ ID NO: 3752175 - RNA, 10 nt, Salmonella typhimurium LT2
auuccccacc

SEQ ID NO: 3752176 - RNA, 21 nt, Salmonella typhimurium LT2
auucccgacacuuguaaguua

SEQ ID NO: 3752177 - RNA, 12 nt, Salmonella typhimurium LT2
auucccgccugc

SEQ ID NO: 3752178 - RNA, 20 nt, Salmonella typhimurium LT2
auucccgccugcggacacgg

SEQ ID NO: 3752179 - RNA, 15 nt, Salmonella typhimurium LT2
auucccguaaaagaa

SEQ ID NO: 3752180 - RNA, 21 nt, Salmonella typhimurium LT2
auucccguaucuucauguucu

SEQ ID NO: 3752181 - RNA, 15 nt, Salmonella typhimurium LT2
auucccgucccugca

SEQ ID NO: 3752182 - RNA, 15 nt, Salmonella typhimurium LT2
auucccugcgcauac

SEQ ID NO: 3752183 - RNA, 16 nt, Salmonella typhimurium LT2
auuccgcaaacgccgu

SEQ ID NO: 3752184 - RNA, 17 nt, Salmonella typhimurium LT2
auuccgccaacgguaag

SEQ ID NO: 3752185 - RNA, 21 nt, Salmonella typhimurium LT2
auuccgcgcuaucgguaucau

SEQ ID NO: 3752186 - RNA, 13 nt, Salmonella typhimurium LT2
auuccggcacaac

SEQ ID NO: 3752187 - RNA, 23 nt, Salmonella typhimurium LT2
auuccggcacucugcgccagguu

SEQ ID NO: 3752188 - RNA, 14 nt, Salmonella typhimurium LT2
auuccggcgcuggc

SEQ ID NO: 3752189 - RNA, 23 nt, Salmonella typhimurium LT2
auuccgucucagagcuauguacu

SEQ ID NO: 3752190 - RNA, 17 nt, Salmonella typhimurium LT2
auuccgugucugaauga

SEQ ID NO: 3752191 - RNA, 18 nt, Salmonella typhimurium LT2
auuccgugucugaaugag

SEQ ID NO: 3752192 - RNA, 19 nt, Salmonella typhimurium LT2
auuccgugucugaaugagu

SEQ ID NO: 3752193 - RNA, 23 nt, Salmonella typhimurium LT2
auuccuauuuucucaaguagaac

SEQ ID NO: 3752194 - RNA, 16 nt, Salmonella typhimurium LT2
auuccucagaauccgu

SEQ ID NO: 3752195 - RNA, 19 nt, Salmonella typhimurium LT2
auuccugcuuuuagcgaua

SEQ ID NO: 3752196 - RNA, 14 nt, Salmonella typhimurium LT2
auuccugucaacga

SEQ ID NO: 3752197 - RNA, 12 nt, Salmonella typhimurium LT2
auuccuucggug

SEQ ID NO: 3752198 - RNA, 15 nt, Salmonella typhimurium LT2
auuccuuuaaauauc

SEQ ID NO: 3752199 - RNA, 20 nt, Salmonella typhimurium LT2
auuccuuuaaauauccgcag

SEQ ID NO: 3752200 - RNA, 23 nt, Salmonella typhimurium LT2
auucgacagauuggucagcagcc

SEQ ID NO: 3752201 - RNA, 18 nt, Salmonella typhimurium LT2
auucgacggccagcgcgc

SEQ ID NO: 3752202 - RNA, 18 nt, Salmonella typhimurium LT2
auucgagaugcauaaaaa

SEQ ID NO: 3752203 - RNA, 19 nt, Salmonella typhimurium LT2
auucgcauguugacugcgc

SEQ ID NO: 3752204 - RNA, 16 nt, Salmonella typhimurium LT2
auucgccaccaggcuc

SEQ ID NO: 3752205 - RNA, 23 nt, Salmonella typhimurium LT2
auucgccaccgcgcgcuuaaucg

SEQ ID NO: 3752206 - RNA, 16 nt, Salmonella typhimurium LT2
auucgcccaaaugcuc

SEQ ID NO: 3752207 - RNA, 14 nt, Salmonella typhimurium LT2
auucgccgcgauaa

SEQ ID NO: 3752208 - RNA, 23 nt, Salmonella typhimurium LT2
auucgcgcuaaaugacaaauaga

SEQ ID NO: 3752209 - RNA, 13 nt, Salmonella typhimurium LT2
auucgcguucaga

SEQ ID NO: 3752210 - RNA, 22 nt, Salmonella typhimurium LT2
auucgcuccucagcgcuuacca

SEQ ID NO: 3752211 - RNA, 20 nt, Salmonella typhimurium LT2
auucggaaugaugugcuauu

SEQ ID NO: 3752212 - RNA, 18 nt, Salmonella typhimurium LT2
auucggauaauccagacg

SEQ ID NO: 3752213 - RNA, 17 nt, Salmonella typhimurium LT2
auucggcauaucgccau

SEQ ID NO: 3752214 - RNA, 14 nt, Salmonella typhimurium LT2
auucggcccugcgc

SEQ ID NO: 3752215 - RNA, 13 nt, Salmonella typhimurium LT2
auucggcguaucg

SEQ ID NO: 3752216 - RNA, 22 nt, Salmonella typhimurium LT2
auucgggacaaacccccagcca

SEQ ID NO: 3752217 - RNA, 23 nt, Salmonella typhimurium LT2
auucgggacaaacccccagccau

SEQ ID NO: 3752218 - RNA, 18 nt, Salmonella typhimurium LT2
auucggucagauaaauaa

SEQ ID NO: 3752219 - RNA, 14 nt, Salmonella typhimurium LT2
auucgguuuauccc

SEQ ID NO: 3752220 - RNA, 17 nt, Salmonella typhimurium LT2
auucgguuuauccccgc

SEQ ID NO: 3752221 - RNA, 17 nt, Salmonella typhimurium LT2
auucguauugacaacaa

SEQ ID NO: 3752222 - RNA, 21 nt, Salmonella typhimurium LT2
auucguccccagcgauccagc

SEQ ID NO: 3752223 - RNA, 18 nt, Salmonella typhimurium LT2
auucguuacccgauaccg

SEQ ID NO: 3752224 - RNA, 13 nt, Salmonella typhimurium LT2
auucguuagcguu

SEQ ID NO: 3752225 - RNA, 22 nt, Salmonella typhimurium LT2
auucuacaguuugucaucaguc

SEQ ID NO: 3752226 - RNA, 12 nt, Salmonella typhimurium LT2
auucuauucuug

SEQ ID NO: 3752227 - RNA, 23 nt, Salmonella typhimurium LT2
auucucacagaaucaucaggcua

SEQ ID NO: 3752228 - RNA, 21 nt, Salmonella typhimurium LT2
auucucaucagaccguggaua

SEQ ID NO: 3752229 - RNA, 18 nt, Salmonella typhimurium LT2
auucucuaccccuucugc

SEQ ID NO: 3752230 - RNA, 19 nt, Salmonella typhimurium LT2
auucucuaccccuucugcc

SEQ ID NO: 3752231 - RNA, 17 nt, Salmonella typhimurium LT2
auucucuguugccgccc

SEQ ID NO: 3752232 - RNA, 18 nt, Salmonella typhimurium LT2
auucugaaagaaaagaug

SEQ ID NO: 3752233 - RNA, 16 nt, Salmonella typhimurium LT2
auuguccacccuccca

SEQ ID NO: 3752234 - RNA, 20 nt, Salmonella typhimurium LT2
auuguccacggggcggcaau

SEQ ID NO: 3752235 - RNA, 23 nt, Salmonella typhimurium LT2
auuguccuuuaucugcccuuucu

SEQ ID NO: 3752236 - RNA, 13 nt, Salmonella typhimurium LT2
auugucggccuga

SEQ ID NO: 3752237 - RNA, 21 nt, Salmonella typhimurium LT2
auugugaagggggccagagca

SEQ ID NO: 3752238 - RNA, 16 nt, Salmonella typhimurium LT2
auugugagaaaagcag

SEQ ID NO: 3752239 - RNA, 15 nt, Salmonella typhimurium LT2
auugugcagccaugu

SEQ ID NO: 3752240 - RNA, 20 nt, Salmonella typhimurium LT2
auugugccgcggcuucauca

SEQ ID NO: 3752241 - RNA, 15 nt, Salmonella typhimurium LT2
auuguggaaauaaga

SEQ ID NO: 3752242 - RNA, 20 nt, Salmonella typhimurium LT2
auuguggaacuuuaucgcac

SEQ ID NO: 3752243 - RNA, 23 nt, Salmonella typhimurium LT2
auuguggcguaaacgccauuccu

SEQ ID NO: 3752244 - RNA, 21 nt, Salmonella typhimurium LT2
auugugguaagcaaucaaggu

SEQ ID NO: 3752245 - RNA, 15 nt, Salmonella typhimurium LT2
auuguguuacaugua

SEQ ID NO: 3752246 - RNA, 15 nt, Salmonella typhimurium LT2
auuguuuggugcuga

SEQ ID NO: 3752247 - RNA, 15 nt, Salmonella typhimurium LT2
auuguuuguggcaaa

SEQ ID NO: 3752248 - RNA, 20 nt, Salmonella typhimurium LT2
auuguuuguggcaaaguacg

SEQ ID NO: 3752249 - RNA, 13 nt, Salmonella typhimurium LT2
auuuaaaaguaca

SEQ ID NO: 3752250 - RNA, 20 nt, Salmonella typhimurium LT2
auuuaacgaguugaauaacg

SEQ ID NO: 3752251 - RNA, 12 nt, Salmonella typhimurium LT2
auuuaacgccag

SEQ ID NO: 3752252 - RNA, 17 nt, Salmonella typhimurium LT2
auuuaacuuaaauaaaa

SEQ ID NO: 3752253 - RNA, 21 nt, Salmonella typhimurium LT2
auuuaacuuaaauaaaaauga

SEQ ID NO: 3752254 - RNA, 21 nt, Salmonella typhimurium LT2
auuuaauauacuagccaguaa

SEQ ID NO: 3752255 - RNA, 13 nt, Salmonella typhimurium LT2
auuuaauauauga

SEQ ID NO: 3752256 - RNA, 17 nt, Salmonella typhimurium LT2
auuuaauauaugaacca

SEQ ID NO: 3752257 - RNA, 24 nt, Salmonella typhimurium LT2
auuuaauauugcugaauaccuuca

SEQ ID NO: 3752258 - RNA, 17 nt, Salmonella typhimurium LT2
auuuaauccaccacagu

SEQ ID NO: 3752259 - RNA, 17 nt, Salmonella typhimurium LT2
auuuaauggucuuaaau

SEQ ID NO: 3752260 - RNA, 21 nt, Salmonella typhimurium LT2
auuuacaaaugaccucaagaa

SEQ ID NO: 3752261 - RNA, 14 nt, Salmonella typhimurium LT2
auuuaccucucacc

SEQ ID NO: 3752262 - RNA, 11 nt, Salmonella typhimurium LT2
auuuacugccg

SEQ ID NO: 3752263 - RNA, 21 nt, Salmonella typhimurium LT2
auuuagacuugggaaacuuau

SEQ ID NO: 3752264 - RNA, 11 nt, Salmonella typhimurium LT2
auuuagccguu

SEQ ID NO: 3752265 - RNA, 14 nt, Salmonella typhimurium LT2
auuuaggauuuguc

SEQ ID NO: 3752266 - RNA, 20 nt, Salmonella typhimurium LT2
auuuaggcguacgacaggua

SEQ ID NO: 3752267 - RNA, 23 nt, Salmonella typhimurium LT2
auuuauaaaauauuuaacuuaaa

SEQ ID NO: 3752268 - RNA, 13 nt, Salmonella typhimurium LT2
auuuauaacguau

SEQ ID NO: 3752269 - RNA, 18 nt, Salmonella typhimurium LT2
auuuauaccgcagugugc

SEQ ID NO: 3752270 - RNA, 13 nt, Salmonella typhimurium LT2
auuuauagcaaau

SEQ ID NO: 3752271 - RNA, 20 nt, Salmonella typhimurium LT2
auuuauagcaaauaugaaga

SEQ ID NO: 3752272 - RNA, 16 nt, Salmonella typhimurium LT2
auuuauauugugccuc

SEQ ID NO: 3752273 - RNA, 14 nt, Salmonella typhimurium LT2
auuuaucaauaacc

SEQ ID NO: 3752274 - RNA, 16 nt, Salmonella typhimurium LT2
auuuaucaauuuuuaa

SEQ ID NO: 3752275 - RNA, 14 nt, Salmonella typhimurium LT2
auuuauccacgccg

SEQ ID NO: 3752276 - RNA, 13 nt, Salmonella typhimurium LT2
auuuauccaguaa

SEQ ID NO: 3752277 - RNA, 14 nt, Salmonella typhimurium LT2
auuuauccuccgaa

SEQ ID NO: 3752278 - RNA, 18 nt, Salmonella typhimurium LT2
auuuaucgaucuccaucu

SEQ ID NO: 3752279 - RNA, 21 nt, Salmonella typhimurium LT2
auuuaucggcgguugaggcug

SEQ ID NO: 3752280 - RNA, 22 nt, Salmonella typhimurium LT2
auuuaucuuccggcaucacauc

SEQ ID NO: 3752281 - RNA, 19 nt, Salmonella typhimurium LT2
auuuaugauuuuaacauca

SEQ ID NO: 3752282 - RNA, 20 nt, Salmonella typhimurium LT2
auuuauuuuauaaauuaacu

SEQ ID NO: 3752283 - RNA, 18 nt, Salmonella typhimurium LT2
auuuauuuucggacacgc

SEQ ID NO: 3752284 - RNA, 20 nt, Salmonella typhimurium LT2
auuucaaacguuucaagaug

SEQ ID NO: 3752285 - RNA, 22 nt, Salmonella typhimurium LT2
auuucaaacguuucaagaugcc

SEQ ID NO: 3752286 - RNA, 22 nt, Salmonella typhimurium LT2
auuucaauaauauguuccacaa

SEQ ID NO: 3752287 - RNA, 17 nt, Salmonella typhimurium LT2
auuucaauaaucccuuc

SEQ ID NO: 3752288 - RNA, 17 nt, Salmonella typhimurium LT2
auuucaaucaucauauc

SEQ ID NO: 3752289 - RNA, 13 nt, Salmonella typhimurium LT2
auuucaaucgcac

SEQ ID NO: 3752290 - RNA, 17 nt, Salmonella typhimurium LT2
auuucaaucgcacccgc

SEQ ID NO: 3752291 - RNA, 14 nt, Salmonella typhimurium LT2
auuucacaaauuaa

SEQ ID NO: 3752292 - RNA, 16 nt, Salmonella typhimurium LT2
auuucaccgccaauaa

SEQ ID NO: 3752293 - RNA, 14 nt, Salmonella typhimurium LT2
auuucacuucauca

SEQ ID NO: 3752294 - RNA, 17 nt, Salmonella typhimurium LT2
auuucaguacagccaaa

SEQ ID NO: 3752295 - RNA, 20 nt, Salmonella typhimurium LT2
auuucaguacagccaaaaau

SEQ ID NO: 3752296 - RNA, 21 nt, Salmonella typhimurium LT2
auuucaguacagccaaaaaua

SEQ ID NO: 3752297 - RNA, 13 nt, Salmonella typhimurium LT2
auuucagugguca

SEQ ID NO: 3752298 - RNA, 16 nt, Salmonella typhimurium LT2
auuucaguggucaggc

SEQ ID NO: 3752299 - RNA, 11 nt, Salmonella typhimurium LT2
auuucaucuac

SEQ ID NO: 3752300 - RNA, 16 nt, Salmonella typhimurium LT2
auuucaucuauuauuu

SEQ ID NO: 3752301 - RNA, 20 nt, Salmonella typhimurium LT2
auuucaucuauuauuuuucu

SEQ ID NO: 3752302 - RNA, 22 nt, Salmonella typhimurium LT2
auuucaucuauuauuuuucuau

SEQ ID NO: 3752303 - RNA, 14 nt, Salmonella typhimurium LT2
auuucauuaaucag

SEQ ID NO: 3752304 - RNA, 17 nt, Salmonella typhimurium LT2
auuucauuuauggucau

SEQ ID NO: 3752305 - RNA, 16 nt, Salmonella typhimurium LT2
auuuccaccuucucuu

SEQ ID NO: 3752306 - RNA, 21 nt, Salmonella typhimurium LT2
auuuccagugccaguuaagca

SEQ ID NO: 3752307 - RNA, 13 nt, Salmonella typhimurium LT2
auuuccaguucaa

SEQ ID NO: 3752308 - RNA, 14 nt, Salmonella typhimurium LT2
auuuccauauuaac

SEQ ID NO: 3752309 - RNA, 17 nt, Salmonella typhimurium LT2
auuuccccaguuauccu

SEQ ID NO: 3752310 - RNA, 13 nt, Salmonella typhimurium LT2
auuucccuuccca

SEQ ID NO: 3752311 - RNA, 18 nt, Salmonella typhimurium LT2
auuuccgccgccuucugc

SEQ ID NO: 3752312 - RNA, 23 nt, Salmonella typhimurium LT2
auuuccgcuuacucguuuugccg

SEQ ID NO: 3752313 - RNA, 14 nt, Salmonella typhimurium LT2
auuuccguuuucag

SEQ ID NO: 3752314 - RNA, 16 nt, Salmonella typhimurium LT2
auuuccuccgccgaua

SEQ ID NO: 3752315 - RNA, 12 nt, Salmonella typhimurium LT2
auuuccucugcc

SEQ ID NO: 3752316 - RNA, 22 nt, Salmonella typhimurium LT2
auuucgaccucuucguucaucc

SEQ ID NO: 3752317 - RNA, 17 nt, Salmonella typhimurium LT2
auuucgaugaugaccga

SEQ ID NO: 3752318 - RNA, 13 nt, Salmonella typhimurium LT2
auuucgcaacagc

SEQ ID NO: 3752319 - RNA, 19 nt, Salmonella typhimurium LT2
auuucgcccaucgcuuuca

SEQ ID NO: 3752320 - RNA, 19 nt, Salmonella typhimurium LT2
auuucgccuauuuucucuu

SEQ ID NO: 3752321 - RNA, 17 nt, Salmonella typhimurium LT2
auuucgcuacucagcgu

SEQ ID NO: 3752322 - RNA, 13 nt, Salmonella typhimurium LT2
auuucgcucagau

SEQ ID NO: 3752323 - RNA, 16 nt, Salmonella typhimurium LT2
auuucggaaugagaga

SEQ ID NO: 3752324 - RNA, 16 nt, Salmonella typhimurium LT2
auuucggcauuuuuaa

SEQ ID NO: 3752325 - RNA, 23 nt, Salmonella typhimurium LT2
auuucguagccgcgcgccgccuc

SEQ ID NO: 3752326 - RNA, 21 nt, Salmonella typhimurium LT2
auuucgucagcacuucccacu

SEQ ID NO: 3752327 - RNA, 18 nt, Salmonella typhimurium LT2
auuucucaaagugcgccg

SEQ ID NO: 3752328 - RNA, 16 nt, Salmonella typhimurium LT2
auuucuccugcgccag

SEQ ID NO: 3752329 - RNA, 13 nt, Salmonella typhimurium LT2
auuucucgcccgc

SEQ ID NO: 3752330 - RNA, 15 nt, Salmonella typhimurium LT2
auuucucgccgccgg

SEQ ID NO: 3752331 - RNA, 20 nt, Salmonella typhimurium LT2
auuucugaaucauauuuuau

SEQ ID NO: 3752332 - RNA, 18 nt, Salmonella typhimurium LT2
auuucugccugauggcgc

SEQ ID NO: 3752333 - RNA, 15 nt, Salmonella typhimurium LT2
auuucugcuggacgu

SEQ ID NO: 3752334 - RNA, 17 nt, Salmonella typhimurium LT2
auuucuuaauuccucag

SEQ ID NO: 3752335 - RNA, 12 nt, Salmonella typhimurium LT2
auuucuucaucc

SEQ ID NO: 3752336 - RNA, 13 nt, Salmonella typhimurium LT2
auuucuuccauua

SEQ ID NO: 3752337 - RNA, 20 nt, Salmonella typhimurium LT2
caaaaacauccacauaggcg

SEQ ID NO: 3752338 - RNA, 15 nt, Salmonella typhimurium LT2
caaaaacgcccccag

SEQ ID NO: 3752339 - RNA, 19 nt, Salmonella typhimurium LT2
caaaaagaaucgccaggcg

SEQ ID NO: 3752340 - RNA, 16 nt, Salmonella typhimurium LT2
caaaaagaggaaagcg

SEQ ID NO: 3752341 - RNA, 20 nt, Salmonella typhimurium LT2
caaaaagauauuauaaaaua

SEQ ID NO: 3752342 - RNA, 15 nt, Salmonella typhimurium LT2
caaaaagcgcgcggc

SEQ ID NO: 3752343 - RNA, 16 nt, Salmonella typhimurium LT2
caaaaagcgcgcggcu

SEQ ID NO: 3752344 - RNA, 19 nt, Salmonella typhimurium LT2
caaaaagcgcgcggcugcg

SEQ ID NO: 3752345 - RNA, 20 nt, Salmonella typhimurium LT2
caaaaaguaguuccagcaua

SEQ ID NO: 3752346 - RNA, 14 nt, Salmonella typhimurium LT2
caaaaauaaaaaaa

SEQ ID NO: 3752347 - RNA, 22 nt, Salmonella typhimurium LT2
caaaaaucaugcucauaaugga

SEQ ID NO: 3752348 - RNA, 20 nt, Salmonella typhimurium LT2
caaaaaucgucaucagauag

SEQ ID NO: 3752349 - RNA, 22 nt, Salmonella typhimurium LT2
caaaaaucgucaucagauaggc

SEQ ID NO: 3752350 - RNA, 15 nt, Salmonella typhimurium LT2
caaaaauuuaagcca

SEQ ID NO: 3752351 - RNA, 21 nt, Salmonella typhimurium LT2
caaaaauuucgaccucuucgu

SEQ ID NO: 3752352 - RNA, 21 nt, Salmonella typhimurium LT2
caaaacacagcucaauaucau

SEQ ID NO: 3752353 - RNA, 14 nt, Salmonella typhimurium LT2
caaaacccuucgca

SEQ ID NO: 3752354 - RNA, 17 nt, Salmonella typhimurium LT2
caaaacgcauccagcgc

SEQ ID NO: 3752355 - RNA, 15 nt, Salmonella typhimurium LT2
caaaacgcucaacgc

SEQ ID NO: 3752356 - RNA, 21 nt, Salmonella typhimurium LT2
caaaacgcucgcgcuguucgc

SEQ ID NO: 3752357 - RNA, 17 nt, Salmonella typhimurium LT2
caaaacgcugcuauuuu

SEQ ID NO: 3752358 - RNA, 16 nt, Salmonella typhimurium LT2
caaaacggcaauaagc

SEQ ID NO: 3752359 - RNA, 18 nt, Salmonella typhimurium LT2
caaaacguagagugcuuc

SEQ ID NO: 3752360 - RNA, 21 nt, Salmonella typhimurium LT2
caaaacuuauuuuauuuuuau

SEQ ID NO: 3752361 - RNA, 16 nt, Salmonella typhimurium LT2
caaaagagaucgaaca

SEQ ID NO: 3752362 - RNA, 22 nt, Salmonella typhimurium LT2
caaaagaggaaguugcucccgc

SEQ ID NO: 3752363 - RNA, 23 nt, Salmonella typhimurium LT2
caaaagaggaaguugcucccgca

SEQ ID NO: 3752364 - RNA, 14 nt, Salmonella typhimurium LT2
caaaagauugauuu

SEQ ID NO: 3752365 - RNA, 21 nt, Salmonella typhimurium LT2
caaaagcauugugaggaaccu

SEQ ID NO: 3752366 - RNA, 15 nt, Salmonella typhimurium LT2
caaaagccagauaaa

SEQ ID NO: 3752367 - RNA, 23 nt, Salmonella typhimurium LT2
caaaagcgguaauaacugacaga

SEQ ID NO: 3752368 - RNA, 20 nt, Salmonella typhimurium LT2
caaaagcgguuaagauacau

SEQ ID NO: 3752369 - RNA, 17 nt, Salmonella typhimurium LT2
caaaaggauacagcgcc

SEQ ID NO: 3752370 - RNA, 15 nt, Salmonella typhimurium LT2
caaaaggcccugucu

SEQ ID NO: 3752371 - RNA, 18 nt, Salmonella typhimurium LT2
caaaaggcccugucuucc

SEQ ID NO: 3752372 - RNA, 18 nt, Salmonella typhimurium LT2
caaaaggcuggaacagau

SEQ ID NO: 3752373 - RNA, 18 nt, Salmonella typhimurium LT2
caaaauaacgcuucaccu

SEQ ID NO: 3752374 - RNA, 16 nt, Salmonella typhimurium LT2
caaaauaauacguuua

SEQ ID NO: 3752375 - RNA, 18 nt, Salmonella typhimurium LT2
caaaauauauaauuuaua

SEQ ID NO: 3752376 - RNA, 16 nt, Salmonella typhimurium LT2
caaaauauuacgccau

SEQ ID NO: 3752377 - RNA, 10 nt, Salmonella typhimurium LT2
caaaaucaaa

SEQ ID NO: 3752378 - RNA, 16 nt, Salmonella typhimurium LT2
caaaaucaaacagaau

SEQ ID NO: 3752379 - RNA, 21 nt, Salmonella typhimurium LT2
caaaaucacgcacacgucuga

SEQ ID NO: 3752380 - RNA, 13 nt, Salmonella typhimurium LT2
caaaaucauucga

SEQ ID NO: 3752381 - RNA, 20 nt, Salmonella typhimurium LT2
caaaaucccggcuggguuca

SEQ ID NO: 3752382 - RNA, 16 nt, Salmonella typhimurium LT2
caaaauccgccaccgc

SEQ ID NO: 3752383 - RNA, 15 nt, Salmonella typhimurium LT2
caaaaucgcccaggu

SEQ ID NO: 3752384 - RNA, 19 nt, Salmonella typhimurium LT2
caaaaucgcccaggucuga

SEQ ID NO: 3752385 - RNA, 22 nt, Salmonella typhimurium LT2
caaaaugagauugauaaucagc

SEQ ID NO: 3752386 - RNA, 20 nt, Salmonella typhimurium LT2
caaaaugauguccacacuga

SEQ ID NO: 3752387 - RNA, 16 nt, Salmonella typhimurium LT2
caaaaugucaguaucg

SEQ ID NO: 3752388 - RNA, 22 nt, Salmonella typhimurium LT2
caaaaugugcaaucacacuaca

SEQ ID NO: 3752389 - RNA, 14 nt, Salmonella typhimurium LT2
caaaauuaccuuua

SEQ ID NO: 3752390 - RNA, 14 nt, Salmonella typhimurium LT2
caaaauucacacca

SEQ ID NO: 3752391 - RNA, 14 nt, Salmonella typhimurium LT2
caaaauuuucaaua

SEQ ID NO: 3752392 - RNA, 15 nt, Salmonella typhimurium LT2
caaaauuuucaauac

SEQ ID NO: 3752393 - RNA, 18 nt, Salmonella typhimurium LT2
caaacaauuuacgcagcc

SEQ ID NO: 3752394 - RNA, 20 nt, Salmonella typhimurium LT2
caaacacaaucacacccagc

SEQ ID NO: 3752395 - RNA, 18 nt, Salmonella typhimurium LT2
caaacaccaacaaagugg

SEQ ID NO: 3752396 - RNA, 12 nt, Salmonella typhimurium LT2
caaacaccacca

SEQ ID NO: 3752397 - RNA, 14 nt, Salmonella typhimurium LT2
caaacaccaccagu

SEQ ID NO: 3752398 - RNA, 18 nt, Salmonella typhimurium LT2
caaacaccgagccagaaa

SEQ ID NO: 3752399 - RNA, 21 nt, Salmonella typhimurium LT2
caaacacuaccgggcagcauc

SEQ ID NO: 3752400 - RNA, 23 nt, Salmonella typhimurium LT2
caaacagagcgccggcaaagcca

SEQ ID NO: 3752401 - RNA, 17 nt, Salmonella typhimurium LT2
caaacagcacuacagcc

SEQ ID NO: 3752402 - RNA, 23 nt, Salmonella typhimurium LT2
caaacagcacuacagcccuuuca

SEQ ID NO: 3752403 - RNA, 19 nt, Salmonella typhimurium LT2
caaacagcagaacaaccag

SEQ ID NO: 3752404 - RNA, 22 nt, Salmonella typhimurium LT2
caaacagccguaccugcacucc

SEQ ID NO: 3752405 - RNA, 17 nt, Salmonella typhimurium LT2
caaacagcgugggaagc

SEQ ID NO: 3752406 - RNA, 21 nt, Salmonella typhimurium LT2
caaacagcgugggaagcagca

SEQ ID NO: 3752407 - RNA, 17 nt, Salmonella typhimurium LT2
caaacagguuguugaug

SEQ ID NO: 3752408 - RNA, 14 nt, Salmonella typhimurium LT2
caaacaguacgccc

SEQ ID NO: 3752409 - RNA, 14 nt, Salmonella typhimurium LT2
caaacauaagcaaa

SEQ ID NO: 3752410 - RNA, 14 nt, Salmonella typhimurium LT2
caaaccaaacugau

SEQ ID NO: 3752411 - RNA, 15 nt, Salmonella typhimurium LT2
caaaccacagugacg

SEQ ID NO: 3752412 - RNA, 15 nt, Salmonella typhimurium LT2
caaaccaccccaggu

SEQ ID NO: 3752413 - RNA, 21 nt, Salmonella typhimurium LT2
caaaccacgcgcgagaacauc

SEQ ID NO: 3752414 - RNA, 14 nt, Salmonella typhimurium LT2
caaaccacugcugu

SEQ ID NO: 3752415 - RNA, 23 nt, Salmonella typhimurium LT2
caaaccagacgcguaaccccugc

SEQ ID NO: 3752416 - RNA, 15 nt, Salmonella typhimurium LT2
caaaccaggaaauaa

SEQ ID NO: 3752417 - RNA, 16 nt, Salmonella typhimurium LT2
caaaccaguuuuucau

SEQ ID NO: 3752418 - RNA, 12 nt, Salmonella typhimurium LT2
caaaccauguac

SEQ ID NO: 3752419 - RNA, 22 nt, Salmonella typhimurium LT2
caaacccacccgguaauaccga

SEQ ID NO: 3752420 - RNA, 10 nt, Salmonella typhimurium LT2
caaacccauc

SEQ ID NO: 3752421 - RNA, 20 nt, Salmonella typhimurium LT2
caaacccgaccucuucuuug

SEQ ID NO: 3752422 - RNA, 19 nt, Salmonella typhimurium LT2
caaacccgccacaggccaa

SEQ ID NO: 3752423 - RNA, 14 nt, Salmonella typhimurium LT2
caaacccugcgcca

SEQ ID NO: 3752424 - RNA, 14 nt, Salmonella typhimurium LT2
caaacccuuuggca

SEQ ID NO: 3752425 - RNA, 18 nt, Salmonella typhimurium LT2
caaaccgaauucguccac

SEQ ID NO: 3752426 - RNA, 18 nt, Salmonella typhimurium LT2
caaaccgauaaucaccag

SEQ ID NO: 3752427 - RNA, 15 nt, Salmonella typhimurium LT2
caaaccgcaaauaau

SEQ ID NO: 3752428 - RNA, 17 nt, Salmonella typhimurium LT2
caaaccgcuuucaucau

SEQ ID NO: 3752429 - RNA, 21 nt, Salmonella typhimurium LT2
caaaccugagcauauaaauaa

SEQ ID NO: 3752430 - RNA, 15 nt, Salmonella typhimurium LT2
caaacgaccgcgcuc

SEQ ID NO: 3752431 - RNA, 16 nt, Salmonella typhimurium LT2
caaacgauaaaagcuc

SEQ ID NO: 3752432 - RNA, 14 nt, Salmonella typhimurium LT2
caaacgauaccgac

SEQ ID NO: 3752433 - RNA, 12 nt, Salmonella typhimurium LT2
caaacgccaccg

SEQ ID NO: 3752434 - RNA, 16 nt, Salmonella typhimurium LT2
caaacgcccaaaaugc

SEQ ID NO: 3752435 - RNA, 21 nt, Salmonella typhimurium LT2
caaacgccugcuccguccacg

SEQ ID NO: 3752436 - RNA, 14 nt, Salmonella typhimurium LT2
caaacgcgccgcug

SEQ ID NO: 3752437 - RNA, 19 nt, Salmonella typhimurium LT2
caaacggcagcucuuucaa

SEQ ID NO: 3752438 - RNA, 15 nt, Salmonella typhimurium LT2
caaacggcgccagcu

SEQ ID NO: 3752439 - RNA, 15 nt, Salmonella typhimurium LT2
caaacuauuuuuagc

SEQ ID NO: 3752440 - RNA, 13 nt, Salmonella typhimurium LT2
caaacucaccuga

SEQ ID NO: 3752441 - RNA, 15 nt, Salmonella typhimurium LT2
caacacccacaccau

SEQ ID NO: 3752442 - RNA, 15 nt, Salmonella typhimurium LT2
caacaccgacauccg

SEQ ID NO: 3752443 - RNA, 16 nt, Salmonella typhimurium LT2
caacaccguaaaagga

SEQ ID NO: 3752444 - RNA, 14 nt, Salmonella typhimurium LT2
caacacgcagaccc

SEQ ID NO: 3752445 - RNA, 15 nt, Salmonella typhimurium LT2
caacacuuugcgcug

SEQ ID NO: 3752446 - RNA, 15 nt, Salmonella typhimurium LT2
caacagaaggccugu

SEQ ID NO: 3752447 - RNA, 16 nt, Salmonella typhimurium LT2
caacagaaucgcgaua

SEQ ID NO: 3752448 - RNA, 22 nt, Salmonella typhimurium LT2
caacagaccgacgauaaccgga

SEQ ID NO: 3752449 - RNA, 17 nt, Salmonella typhimurium LT2
caacagacuauccaggg

SEQ ID NO: 3752450 - RNA, 16 nt, Salmonella typhimurium LT2
caacagauaagcaccu

SEQ ID NO: 3752451 - RNA, 22 nt, Salmonella typhimurium LT2
caacagauacgucuuacgccau

SEQ ID NO: 3752452 - RNA, 14 nt, Salmonella typhimurium LT2
caacagcaauguuu

SEQ ID NO: 3752453 - RNA, 12 nt, Salmonella typhimurium LT2
caacagcaccag

SEQ ID NO: 3752454 - RNA, 14 nt, Salmonella typhimurium LT2
caacagcaccagca

SEQ ID NO: 3752455 - RNA, 14 nt, Salmonella typhimurium LT2
caacagccgccugu

SEQ ID NO: 3752456 - RNA, 11 nt, Salmonella typhimurium LT2
caacagcgacc

SEQ ID NO: 3752457 - RNA, 18 nt, Salmonella typhimurium LT2
caacagcgcggcaggccg

SEQ ID NO: 3752458 - RNA, 20 nt, Salmonella typhimurium LT2
caacagcgcggcaggccggc

SEQ ID NO: 3752459 - RNA, 14 nt, Salmonella typhimurium LT2
caacagcucgccau

SEQ ID NO: 3752460 - RNA, 17 nt, Salmonella typhimurium LT2
caacagcucgccaugca

SEQ ID NO: 3752461 - RNA, 16 nt, Salmonella typhimurium LT2
caacagcuugcgccca

SEQ ID NO: 3752462 - RNA, 22 nt, Salmonella typhimurium LT2
caacaggauggauauaacauuu

SEQ ID NO: 3752463 - RNA, 20 nt, Salmonella typhimurium LT2
caacaggccgcgaaagcggc

SEQ ID NO: 3752464 - RNA, 24 nt, Salmonella typhimurium LT2
caacagggcggccuccuggcuuac

SEQ ID NO: 3752465 - RNA, 14 nt, Salmonella typhimurium LT2
caacagguaccccg

SEQ ID NO: 3752466 - RNA, 21 nt, Salmonella typhimurium LT2
caacagguaccccgccaccgc

SEQ ID NO: 3752467 - RNA, 15 nt, Salmonella typhimurium LT2
caacauaauaaagcc

SEQ ID NO: 3752468 - RNA, 16 nt, Salmonella typhimurium LT2
caacauaauaaagccg

SEQ ID NO: 3752469 - RNA, 13 nt, Salmonella typhimurium LT2
caacauacaugcc

SEQ ID NO: 3752470 - RNA, 23 nt, Salmonella typhimurium LT2
caacauacgggcuuuugcgccga

SEQ ID NO: 3752471 - RNA, 22 nt, Salmonella typhimurium LT2
caacauaggccagccgacgcuc

SEQ ID NO: 3752472 - RNA, 14 nt, Salmonella typhimurium LT2
caacauauccaggc

SEQ ID NO: 3752473 - RNA, 20 nt, Salmonella typhimurium LT2
caacauauuuuucacacaua

SEQ ID NO: 3752474 - RNA, 19 nt, Salmonella typhimurium LT2
caacaucagcgcuaccagc

SEQ ID NO: 3752475 - RNA, 21 nt, Salmonella typhimurium LT2
caacaucagcgcuaccagcgc

SEQ ID NO: 3752476 - RNA, 16 nt, Salmonella typhimurium LT2
caacaucaguucagaa

SEQ ID NO: 3752477 - RNA, 21 nt, Salmonella typhimurium LT2
caacaucugugaaaacgccuu

SEQ ID NO: 3752478 - RNA, 13 nt, Salmonella typhimurium LT2
caacaucuuugcc

SEQ ID NO: 3752479 - RNA, 23 nt, Salmonella typhimurium LT2
caacaugaaagggaaaccgcucg

SEQ ID NO: 3752480 - RNA, 19 nt, Salmonella typhimurium LT2
caacaugucgagaaaauag

SEQ ID NO: 3752481 - RNA, 14 nt, Salmonella typhimurium LT2
caacauugccggca

SEQ ID NO: 3752482 - RNA, 23 nt, Salmonella typhimurium LT2
caacauugccggcaucauucugc

SEQ ID NO: 3752483 - RNA, 17 nt, Salmonella typhimurium LT2
caacauuucgcacccug

SEQ ID NO: 3752484 - RNA, 18 nt, Salmonella typhimurium LT2
caacauuucgcacccugu

SEQ ID NO: 3752485 - RNA, 18 nt, Salmonella typhimurium LT2
caaccaaagccggcgcca

SEQ ID NO: 3752486 - RNA, 22 nt, Salmonella typhimurium LT2
caaccacaaguuuauccggcac

SEQ ID NO: 3752487 - RNA, 20 nt, Salmonella typhimurium LT2
caaccacggauaagccagcc

SEQ ID NO: 3752488 - RNA, 18 nt, Salmonella typhimurium LT2
caaccagaaugcccaggc

SEQ ID NO: 3752489 - RNA, 20 nt, Salmonella typhimurium LT2
caaccagaaugcccaggccc

SEQ ID NO: 3752490 - RNA, 16 nt, Salmonella typhimurium LT2
caaccagcccaugaau

SEQ ID NO: 3752491 - RNA, 18 nt, Salmonella typhimurium LT2
caaccagccgaucagcgc

SEQ ID NO: 3752492 - RNA, 14 nt, Salmonella typhimurium LT2
caaccaggauucaa

SEQ ID NO: 3752493 - RNA, 13 nt, Salmonella typhimurium LT2
caaccaggcaaac

SEQ ID NO: 3752494 - RNA, 21 nt, Salmonella typhimurium LT2
caaccaggcaaaccagcaccg

SEQ ID NO: 3752495 - RNA, 18 nt, Salmonella typhimurium LT2
caaccagugcaacgccuu

SEQ ID NO: 3752496 - RNA, 21 nt, Salmonella typhimurium LT2
caaccaguuaauuucuuucca

SEQ ID NO: 3752497 - RNA, 20 nt, Salmonella typhimurium LT2
caaccauugucuucuaccgc

SEQ ID NO: 3752498 - RNA, 20 nt, Salmonella typhimurium LT2
caaccccaaacaccaacaaa

SEQ ID NO: 3752499 - RNA, 16 nt, Salmonella typhimurium LT2
caacccgaccaggaca

SEQ ID NO: 3752500 - RNA, 16 nt, Salmonella typhimurium LT2
caacccgaccuacaaa

SEQ ID NO: 3752501 - RNA, 14 nt, Salmonella typhimurium LT2
caacccgacugcca

SEQ ID NO: 3752502 - RNA, 19 nt, Salmonella typhimurium LT2
caacccguaccuccagcga

SEQ ID NO: 3752503 - RNA, 19 nt, Salmonella typhimurium LT2
caacccuauugccacaaua

SEQ ID NO: 3752504 - RNA, 17 nt, Salmonella typhimurium LT2
caaccgacgaacaaaau

SEQ ID NO: 3752505 - RNA, 19 nt, Salmonella typhimurium LT2
caaccgacgaacaaaauag

SEQ ID NO: 3752506 - RNA, 13 nt, Salmonella typhimurium LT2
caaccgacgcauu

SEQ ID NO: 3752507 - RNA, 18 nt, Salmonella typhimurium LT2
caaccgcauccugaagcg

SEQ ID NO: 3752508 - RNA, 14 nt, Salmonella typhimurium LT2
caaccgccugcacu

SEQ ID NO: 3752509 - RNA, 16 nt, Salmonella typhimurium LT2
caaccgccugcguuug

SEQ ID NO: 3752510 - RNA, 18 nt, Salmonella typhimurium LT2
caaccgcucuccgcaauu

SEQ ID NO: 3752511 - RNA, 12 nt, Salmonella typhimurium LT2
caaccggcuggc

SEQ ID NO: 3752512 - RNA, 19 nt, Salmonella typhimurium LT2
caaccgguaucaaacccuu

SEQ ID NO: 3752513 - RNA, 19 nt, Salmonella typhimurium LT2
caaccguuggggaaaauau

SEQ ID NO: 3752514 - RNA, 16 nt, Salmonella typhimurium LT2
caaccguuucuuuuuc

SEQ ID NO: 3752515 - RNA, 21 nt, Salmonella typhimurium LT2
caaccucauuucucaaaaaca

SEQ ID NO: 3752516 - RNA, 15 nt, Salmonella typhimurium LT2
caaccucuuuuuccg

SEQ ID NO: 3752517 - RNA, 11 nt, Salmonella typhimurium LT2
caaccugauau

SEQ ID NO: 3752518 - RNA, 21 nt, Salmonella typhimurium LT2
caaccugccguuuuccagccg

SEQ ID NO: 3752519 - RNA, 12 nt, Salmonella typhimurium LT2
caaccugcgcug

SEQ ID NO: 3752520 - RNA, 23 nt, Salmonella typhimurium LT2
caaccuguaggccggauaagcau

SEQ ID NO: 3752521 - RNA, 16 nt, Salmonella typhimurium LT2
caacgaaaaucauccg

SEQ ID NO: 3752522 - RNA, 21 nt, Salmonella typhimurium LT2
caacgacgucuuucuucgcug

SEQ ID NO: 3752523 - RNA, 21 nt, Salmonella typhimurium LT2
caacgaggugaauaaauccuu

SEQ ID NO: 3752524 - RNA, 19 nt, Salmonella typhimurium LT2
caacgagugcucaccgaca

SEQ ID NO: 3752525 - RNA, 22 nt, Salmonella typhimurium LT2
caacgcaaugcgauaagcgucu

SEQ ID NO: 3752526 - RNA, 23 nt, Salmonella typhimurium LT2
caacgcaaugcgauaagcgucuu

SEQ ID NO: 3752527 - RNA, 15 nt, Salmonella typhimurium LT2
caacgcagucaaaac

SEQ ID NO: 3752528 - RNA, 14 nt, Salmonella typhimurium LT2
caacgcaucaaaua

SEQ ID NO: 3752529 - RNA, 22 nt, Salmonella typhimurium LT2
caacgcauuggcaaugaaaccg

SEQ ID NO: 3752530 - RNA, 15 nt, Salmonella typhimurium LT2
caacgccaaccggcu

SEQ ID NO: 3752531 - RNA, 12 nt, Salmonella typhimurium LT2
caacgccaagcg

SEQ ID NO: 3752532 - RNA, 15 nt, Salmonella typhimurium LT2
caacgccaagcgcgg

SEQ ID NO: 3752533 - RNA, 17 nt, Salmonella typhimurium LT2
caacgccaagcgcggca

SEQ ID NO: 3752534 - RNA, 12 nt, Salmonella typhimurium LT2
caacgccacugc

SEQ ID NO: 3752535 - RNA, 14 nt, Salmonella typhimurium LT2
caacgccagaugcg

SEQ ID NO: 3752536 - RNA, 20 nt, Salmonella typhimurium LT2
caacgccagguagccgacgg

SEQ ID NO: 3752537 - RNA, 19 nt, Salmonella typhimurium LT2
caacgccggaugacgccgu

SEQ ID NO: 3752538 - RNA, 13 nt, Salmonella typhimurium LT2
caacgccggcaac

SEQ ID NO: 3752539 - RNA, 19 nt, Salmonella typhimurium LT2
caacgccggcaacacccgc

SEQ ID NO: 3752540 - RNA, 18 nt, Salmonella typhimurium LT2
caacgccguacuccagcc

SEQ ID NO: 3752541 - RNA, 15 nt, Salmonella typhimurium LT2
caacgccuccagcgg

SEQ ID NO: 3752542 - RNA, 14 nt, Salmonella typhimurium LT2
caacgccuccaggc

SEQ ID NO: 3752543 - RNA, 22 nt, Salmonella typhimurium LT2
caacgccuuccugccagcacag

SEQ ID NO: 3752544 - RNA, 14 nt, Salmonella typhimurium LT2
caacgcgcaucaac

SEQ ID NO: 3752545 - RNA, 19 nt, Salmonella typhimurium LT2
caaggcuauuagccaaagc

SEQ ID NO: 3752546 - RNA, 14 nt, Salmonella typhimurium LT2
caagggaagagauu

SEQ ID NO: 3752547 - RNA, 17 nt, Salmonella typhimurium LT2
caagggagugagucccc

SEQ ID NO: 3752548 - RNA, 17 nt, Salmonella typhimurium LT2
caagggcaagggcaagg

SEQ ID NO: 3752549 - RNA, 20 nt, Salmonella typhimurium LT2
caaggggggccugauggcgc

SEQ ID NO: 3752550 - RNA, 21 nt, Salmonella typhimurium LT2
caaggguaauggcuguuuucg

SEQ ID NO: 3752551 - RNA, 21 nt, Salmonella typhimurium LT2
caagggucuuaacccauggcu

SEQ ID NO: 3752552 - RNA, 14 nt, Salmonella typhimurium LT2
caagggugggcgca

SEQ ID NO: 3752553 - RNA, 19 nt, Salmonella typhimurium LT2
caaggucaaugugcucaac

SEQ ID NO: 3752554 - RNA, 17 nt, Salmonella typhimurium LT2
caagguuaacgucagau

SEQ ID NO: 3752555 - RNA, 13 nt, Salmonella typhimurium LT2
caaguaaaauaac

SEQ ID NO: 3752556 - RNA, 14 nt, Salmonella typhimurium LT2
caaguaaaauaacc

SEQ ID NO: 3752557 - RNA, 14 nt, Salmonella typhimurium LT2
caaguaauaaagag

SEQ ID NO: 3752558 - RNA, 22 nt, Salmonella typhimurium LT2
caaguaauaaagagaacgacgc

SEQ ID NO: 3752559 - RNA, 21 nt, Salmonella typhimurium LT2
caagucaccguuuuucaucaa

SEQ ID NO: 3752560 - RNA, 21 nt, Salmonella typhimurium LT2
caaguccgccgcuauuacccc

SEQ ID NO: 3752561 - RNA, 14 nt, Salmonella typhimurium LT2
caagugcuggaggu

SEQ ID NO: 3752562 - RNA, 12 nt, Salmonella typhimurium LT2
caaguucagcag

SEQ ID NO: 3752563 - RNA, 14 nt, Salmonella typhimurium LT2
caaguucagcaggc

SEQ ID NO: 3752564 - RNA, 23 nt, Salmonella typhimurium LT2
caaguucgugagcgaagcgccgg

SEQ ID NO: 3752565 - RNA, 16 nt, Salmonella typhimurium LT2
caaguugcgccacugc

SEQ ID NO: 3752566 - RNA, 12 nt, Salmonella typhimurium LT2
caaguuuauccg

SEQ ID NO: 3752567 - RNA, 23 nt, Salmonella typhimurium LT2
caauaaaacagggcuucuuuacc

SEQ ID NO: 3752568 - RNA, 15 nt, Salmonella typhimurium LT2
caauaaaagcaacau

SEQ ID NO: 3752569 - RNA, 18 nt, Salmonella typhimurium LT2
caauaaaauauccuccac

SEQ ID NO: 3752570 - RNA, 16 nt, Salmonella typhimurium LT2
caauaaaauuauccag

SEQ ID NO: 3752571 - RNA, 15 nt, Salmonella typhimurium LT2
caauaaacaguuccg

SEQ ID NO: 3752572 - RNA, 15 nt, Salmonella typhimurium LT2
caauaaacgggcagc

SEQ ID NO: 3752573 - RNA, 20 nt, Salmonella typhimurium LT2
caauaaacuaaguaaggagg

SEQ ID NO: 3752574 - RNA, 13 nt, Salmonella typhimurium LT2
caauaaagcaggg

SEQ ID NO: 3752575 - RNA, 21 nt, Salmonella typhimurium LT2
caauaaagccgcauuuuucca

SEQ ID NO: 3752576 - RNA, 12 nt, Salmonella typhimurium LT2
caauaaaguuau

SEQ ID NO: 3752577 - RNA, 17 nt, Salmonella typhimurium LT2
caauaaaucguguggcu

SEQ ID NO: 3752578 - RNA, 14 nt, Salmonella typhimurium LT2
caauaacaggcaca

SEQ ID NO: 3752579 - RNA, 16 nt, Salmonella typhimurium LT2
caauaacaggcacagu

SEQ ID NO: 3752580 - RNA, 23 nt, Salmonella typhimurium LT2
caauaacagggaauuucuucgcg

SEQ ID NO: 3752581 - RNA, 18 nt, Salmonella typhimurium LT2
caauaaccgccagcagca

SEQ ID NO: 3752582 - RNA, 22 nt, Salmonella typhimurium LT2
caauaacgccgauaaccagcgc

SEQ ID NO: 3752583 - RNA, 13 nt, Salmonella typhimurium LT2
caauaagaacuuu

SEQ ID NO: 3752584 - RNA, 17 nt, Salmonella typhimurium LT2
caauaagcgguaauaau

SEQ ID NO: 3752585 - RNA, 20 nt, Salmonella typhimurium LT2
caauaagcuugcuuuccaua

SEQ ID NO: 3752586 - RNA, 23 nt, Salmonella typhimurium LT2
caauaagggucgcgcuguauaau

SEQ ID NO: 3752587 - RNA, 15 nt, Salmonella typhimurium LT2
caauaauaagaauua

SEQ ID NO: 3752588 - RNA, 21 nt, Salmonella typhimurium LT2
caauaauauguuccacaauca

SEQ ID NO: 3752589 - RNA, 18 nt, Salmonella typhimurium LT2
caauaaucccaaaauuua

SEQ ID NO: 3752590 - RNA, 19 nt, Salmonella typhimurium LT2
caauaaucccuucuuuuac

SEQ ID NO: 3752591 - RNA, 19 nt, Salmonella typhimurium LT2
caauaaugcaaauuauuuu

SEQ ID NO: 3752592 - RNA, 22 nt, Salmonella typhimurium LT2
caauaauuucgcuacucagcgu

SEQ ID NO: 3752593 - RNA, 16 nt, Salmonella typhimurium LT2
caauaauuugucgaua

SEQ ID NO: 3752594 - RNA, 18 nt, Salmonella typhimurium LT2
caauacagccagcacaag

SEQ ID NO: 3752595 - RNA, 22 nt, Salmonella typhimurium LT2
caauacagcccgccagcaccag

SEQ ID NO: 3752596 - RNA, 15 nt, Salmonella typhimurium LT2
caauaccacaaccgg

SEQ ID NO: 3752597 - RNA, 18 nt, Salmonella typhimurium LT2
caauaccacaaccggaau

SEQ ID NO: 3752598 - RNA, 15 nt, Salmonella typhimurium LT2
caauacccagcgcca

SEQ ID NO: 3752599 - RNA, 15 nt, Salmonella typhimurium LT2
caauaccguccagcg

SEQ ID NO: 3752600 - RNA, 23 nt, Salmonella typhimurium LT2
caauaccugagccucuaaauguu

SEQ ID NO: 3752601 - RNA, 20 nt, Salmonella typhimurium LT2
caauacgccagccuaucgcc

SEQ ID NO: 3752602 - RNA, 18 nt, Salmonella typhimurium LT2
caauacgccgagcaucgc

SEQ ID NO: 3752603 - RNA, 20 nt, Salmonella typhimurium LT2
caauacuccacaguucaaug

SEQ ID NO: 3752604 - RNA, 22 nt, Salmonella typhimurium LT2
caauagaucuuaauuugcagaa

SEQ ID NO: 3752605 - RNA, 14 nt, Salmonella typhimurium LT2
caauagcaauaaau

SEQ ID NO: 3752606 - RNA, 14 nt, Salmonella typhimurium LT2
caauagcaaugaag

SEQ ID NO: 3752607 - RNA, 15 nt, Salmonella typhimurium LT2
caauagcaaugaagc

SEQ ID NO: 3752608 - RNA, 19 nt, Salmonella typhimurium LT2
caauagcaaugaagcaagu

SEQ ID NO: 3752609 - RNA, 16 nt, Salmonella typhimurium LT2
caauagcacaucagcc

SEQ ID NO: 3752610 - RNA, 18 nt, Salmonella typhimurium LT2
caauagcagcuucacgcg

SEQ ID NO: 3752611 - RNA, 22 nt, Salmonella typhimurium LT2
caauagcagcuucacgcgcugu

SEQ ID NO: 3752612 - RNA, 16 nt, Salmonella typhimurium LT2
caauagccuuuaucgg

SEQ ID NO: 3752613 - RNA, 16 nt, Salmonella typhimurium LT2
caauagcgagaggcaa

SEQ ID NO: 3752614 - RNA, 18 nt, Salmonella typhimurium LT2
caauagcgagaggcaauu

SEQ ID NO: 3752615 - RNA, 15 nt, Salmonella typhimurium LT2
caauagcgauacuga

SEQ ID NO: 3752616 - RNA, 15 nt, Salmonella typhimurium LT2
caauagcgcuaaaca

SEQ ID NO: 3752617 - RNA, 20 nt, Salmonella typhimurium LT2
caauaggcgcucuggcgaau

SEQ ID NO: 3752618 - RNA, 16 nt, Salmonella typhimurium LT2
caauaguuaacgccgu

SEQ ID NO: 3752619 - RNA, 14 nt, Salmonella typhimurium LT2
caauauaccgucag

SEQ ID NO: 3752620 - RNA, 18 nt, Salmonella typhimurium LT2
caauauaccgucagcacc

SEQ ID NO: 3752621 - RNA, 20 nt, Salmonella typhimurium LT2
caauauaccgucagcaccag

SEQ ID NO: 3752622 - RNA, 18 nt, Salmonella typhimurium LT2
caauauaguugagccauu

SEQ ID NO: 3752623 - RNA, 21 nt, Salmonella typhimurium LT2
caauauaguugagccauucca

SEQ ID NO: 3752624 - RNA, 19 nt, Salmonella typhimurium LT2
caauauauugcuccaucau

SEQ ID NO: 3752625 - RNA, 21 nt, Salmonella typhimurium LT2
caauauauugcuccaucaucg

SEQ ID NO: 3752626 - RNA, 14 nt, Salmonella typhimurium LT2
caauaucagccauu

SEQ ID NO: 3752627 - RNA, 20 nt, Salmonella typhimurium LT2
caauaucagccauuaaccag

SEQ ID NO: 3752628 - RNA, 21 nt, Salmonella typhimurium LT2
caauaucagccauuaaccaga

SEQ ID NO: 3752629 - RNA, 18 nt, Salmonella typhimurium LT2
caauauccucgcauccuc

SEQ ID NO: 3752630 - RNA, 21 nt, Salmonella typhimurium LT2
caauaucgauagcauuuuuac

SEQ ID NO: 3752631 - RNA, 14 nt, Salmonella typhimurium LT2
caauaucgaugcca

SEQ ID NO: 3752632 - RNA, 19 nt, Salmonella typhimurium LT2
caauaucgcggcaaagaaa

SEQ ID NO: 3752633 - RNA, 16 nt, Salmonella typhimurium LT2
caauaucggcggaaau

SEQ ID NO: 3752634 - RNA, 16 nt, Salmonella typhimurium LT2
caauaucguugccgcc

SEQ ID NO: 3752635 - RNA, 19 nt, Salmonella typhimurium LT2
caauaugaugcuugcucgu

SEQ ID NO: 3752636 - RNA, 14 nt, Salmonella typhimurium LT2
caauaugccaggca

SEQ ID NO: 3752637 - RNA, 18 nt, Salmonella typhimurium LT2
caauaugcgucagcgcgg

SEQ ID NO: 3752638 - RNA, 16 nt, Salmonella typhimurium LT2
caauaugguuauccag

SEQ ID NO: 3752639 - RNA, 18 nt, Salmonella typhimurium LT2
caauaugucuuaaacagc

SEQ ID NO: 3752640 - RNA, 13 nt, Salmonella typhimurium LT2
caauauuaaauga

SEQ ID NO: 3752641 - RNA, 15 nt, Salmonella typhimurium LT2
caauauuaaugcugc

SEQ ID NO: 3752642 - RNA, 17 nt, Salmonella typhimurium LT2
caauauucacacgaauu

SEQ ID NO: 3752643 - RNA, 16 nt, Salmonella typhimurium LT2
caauauucaugcuuuc

SEQ ID NO: 3752644 - RNA, 19 nt, Salmonella typhimurium LT2
caauauucaugcuuucaau

SEQ ID NO: 3752645 - RNA, 19 nt, Salmonella typhimurium LT2
caauauuccauauaacaga

SEQ ID NO: 3752646 - RNA, 13 nt, Salmonella typhimurium LT2
caauauucuggcu

SEQ ID NO: 3752647 - RNA, 16 nt, Salmonella typhimurium LT2
caauauucugugcuca

SEQ ID NO: 3752648 - RNA, 12 nt, Salmonella typhimurium LT2
caauauuuugua

SEQ ID NO: 3752649 - RNA, 23 nt, Salmonella typhimurium LT2
caauucgagauuuuucugcgcca

SEQ ID NO: 3752650 - RNA, 16 nt, Salmonella typhimurium LT2
caauucugauuuuuua

SEQ ID NO: 3752651 - RNA, 17 nt, Salmonella typhimurium LT2
caauugaugaaccgcug

SEQ ID NO: 3752652 - RNA, 17 nt, Salmonella typhimurium LT2
caauugccgucagcucc

SEQ ID NO: 3752653 - RNA, 22 nt, Salmonella typhimurium LT2
caauuggacucgaaccaacgac

SEQ ID NO: 3752654 - RNA, 21 nt, Salmonella typhimurium LT2
caauuuaaaauccggcugccu

SEQ ID NO: 3752655 - RNA, 21 nt, Salmonella typhimurium LT2
caauuucacugucgccaggcc

SEQ ID NO: 3752656 - RNA, 16 nt, Salmonella typhimurium LT2
caauuucauucaccac

SEQ ID NO: 3752657 - RNA, 15 nt, Salmonella typhimurium LT2
caauuuccgcugaaa

SEQ ID NO: 3752658 - RNA, 16 nt, Salmonella typhimurium LT2
caauuuccgcugaaau

SEQ ID NO: 3752659 - RNA, 15 nt, Salmonella typhimurium LT2
caauuuccugccaca

SEQ ID NO: 3752660 - RNA, 14 nt, Salmonella typhimurium LT2
caauuugcugcugu

SEQ ID NO: 3752661 - RNA, 18 nt, Salmonella typhimurium LT2
caauuugcugcuguuacc

SEQ ID NO: 3752662 - RNA, 23 nt, Salmonella typhimurium LT2
caauuugugagacaaaaaagcug

SEQ ID NO: 3752663 - RNA, 13 nt, Salmonella typhimurium LT2
caauuuuuaguuc

SEQ ID NO: 3752664 - RNA, 20 nt, Salmonella typhimurium LT2
cacaaaaacacccgcagccg

SEQ ID NO: 3752665 - RNA, 16 nt, Salmonella typhimurium LT2
cacaaaacccgcagcc

SEQ ID NO: 3752666 - RNA, 20 nt, Salmonella typhimurium LT2
cacaaaaggauacagcgccg

SEQ ID NO: 3752667 - RNA, 14 nt, Salmonella typhimurium LT2
cacaaacaauuucc

SEQ ID NO: 3752668 - RNA, 21 nt, Salmonella typhimurium LT2
cacaaacggcgguuuuuuuau

SEQ ID NO: 3752669 - RNA, 22 nt, Salmonella typhimurium LT2
cacaaacggcgguuuuuuuauc

SEQ ID NO: 3752670 - RNA, 22 nt, Salmonella typhimurium LT2
cacaaagagugccagaaacauc

SEQ ID NO: 3752671 - RNA, 22 nt, Salmonella typhimurium LT2
cacaaagcgcgagggauuaucu

SEQ ID NO: 3752672 - RNA, 19 nt, Salmonella typhimurium LT2
cacaaagcguucggccugc

SEQ ID NO: 3752673 - RNA, 17 nt, Salmonella typhimurium LT2
cacaaauuuugauaaaa

SEQ ID NO: 3752674 - RNA, 20 nt, Salmonella typhimurium LT2
cacaaauuuugauaaaaaca

SEQ ID NO: 3752675 - RNA, 18 nt, Salmonella typhimurium LT2
cacaacaauauuccauau

SEQ ID NO: 3752676 - RNA, 16 nt, Salmonella typhimurium LT2
cacaacccacuggccu

SEQ ID NO: 3752677 - RNA, 13 nt, Salmonella typhimurium LT2
cacaaccuccacg

SEQ ID NO: 3752678 - RNA, 17 nt, Salmonella typhimurium LT2
cacaaccuccacgccca

SEQ ID NO: 3752679 - RNA, 14 nt, Salmonella typhimurium LT2
cacaacgcauuggc

SEQ ID NO: 3752680 - RNA, 16 nt, Salmonella typhimurium LT2
cacaacgccuuauucg

SEQ ID NO: 3752681 - RNA, 16 nt, Salmonella typhimurium LT2
cacaacggcgaauaaa

SEQ ID NO: 3752682 - RNA, 12 nt, Salmonella typhimurium LT2
cacaacguaaua

SEQ ID NO: 3752683 - RNA, 21 nt, Salmonella typhimurium LT2
cacaacgucaguggaaaacag

SEQ ID NO: 3752684 - RNA, 14 nt, Salmonella typhimurium LT2
cacaacgucauccc

SEQ ID NO: 3752685 - RNA, 16 nt, Salmonella typhimurium LT2
cacaacuagcaaaaca

SEQ ID NO: 3752686 - RNA, 19 nt, Salmonella typhimurium LT2
cacaacugaagcauacccu

SEQ ID NO: 3752687 - RNA, 13 nt, Salmonella typhimurium LT2
cacaacuguucuu

SEQ ID NO: 3752688 - RNA, 19 nt, Salmonella typhimurium LT2
cacaagagcagcaacccug

SEQ ID NO: 3752689 - RNA, 19 nt, Salmonella typhimurium LT2
cacaagauucacucugaaa

SEQ ID NO: 3752690 - RNA, 14 nt, Salmonella typhimurium LT2
cacaagcugugcca

SEQ ID NO: 3752691 - RNA, 18 nt, Salmonella typhimurium LT2
cacaaggucaaugugcuc

SEQ ID NO: 3752692 - RNA, 21 nt, Salmonella typhimurium LT2
cacaagucaccguuuuucauc

SEQ ID NO: 3752693 - RNA, 13 nt, Salmonella typhimurium LT2
cacaaguuuaucc

SEQ ID NO: 3752694 - RNA, 12 nt, Salmonella typhimurium LT2
cacaauaaccag

SEQ ID NO: 3752695 - RNA, 20 nt, Salmonella typhimurium LT2
cacaauaugguuauccagca

SEQ ID NO: 3752696 - RNA, 13 nt, Salmonella typhimurium LT2
cacaaucacagcg

SEQ ID NO: 3752697 - RNA, 18 nt, Salmonella typhimurium LT2
cacaaucagccacggcaa

SEQ ID NO: 3752698 - RNA, 11 nt, Salmonella typhimurium LT2
cacaaucaucg

SEQ ID NO: 3752699 - RNA, 21 nt, Salmonella typhimurium LT2
cacaaucccgccagacccgca

SEQ ID NO: 3752700 - RNA, 22 nt, Salmonella typhimurium LT2
cacaaucgcauaaccggcgcca

SEQ ID NO: 3752701 - RNA, 20 nt, Salmonella typhimurium LT2
cacaaucgccgugaucccaa

SEQ ID NO: 3752702 - RNA, 18 nt, Salmonella typhimurium LT2
cacaaugccuucugcgcc

SEQ ID NO: 3752703 - RNA, 16 nt, Salmonella typhimurium LT2
cacaaugucaucaaga

SEQ ID NO: 3752704 - RNA, 19 nt, Salmonella typhimurium LT2
cacaaugucaucaagauuu

SEQ ID NO: 3752705 - RNA, 17 nt, Salmonella typhimurium LT2
cacaaugugauaugacc

SEQ ID NO: 3752706 - RNA, 20 nt, Salmonella typhimurium LT2
cacaauuccggcccaggcca

SEQ ID NO: 3752707 - RNA, 20 nt, Salmonella typhimurium LT2
cacaauugccagcagguauc

SEQ ID NO: 3752708 - RNA, 13 nt, Salmonella typhimurium LT2
cacaauugccaug

SEQ ID NO: 3752709 - RNA, 22 nt, Salmonella typhimurium LT2
cacacaagucaccguuuuucau

SEQ ID NO: 3752710 - RNA, 13 nt, Salmonella typhimurium LT2
cacacacuguuua

SEQ ID NO: 3752711 - RNA, 23 nt, Salmonella typhimurium LT2
cacacacuguuuaaugcuuucaa

SEQ ID NO: 3752712 - RNA, 20 nt, Salmonella typhimurium LT2
cacacagcggaaagcaacag

SEQ ID NO: 3752713 - RNA, 18 nt, Salmonella typhimurium LT2
cacacauaagcacaccau

SEQ ID NO: 3752714 - RNA, 19 nt, Salmonella typhimurium LT2
cacaccaaugucauauuug

SEQ ID NO: 3752715 - RNA, 18 nt, Salmonella typhimurium LT2
cacaccacaugcgagcag

SEQ ID NO: 3752716 - RNA, 20 nt, Salmonella typhimurium LT2
cacaccagcaggaaucccau

SEQ ID NO: 3752717 - RNA, 15 nt, Salmonella typhimurium LT2
cacaccauuucacaa

SEQ ID NO: 3752718 - RNA, 20 nt, Salmonella typhimurium LT2
cacaccauuucacaaauuaa

SEQ ID NO: 3752719 - RNA, 12 nt, Salmonella typhimurium LT2
cacacggcgcca

SEQ ID NO: 3752720 - RNA, 15 nt, Salmonella typhimurium LT2
cacacggcgccauga

SEQ ID NO: 3752721 - RNA, 22 nt, Salmonella typhimurium LT2
cacacggcgccaugauccagcg

SEQ ID NO: 3752722 - RNA, 23 nt, Salmonella typhimurium LT2
cacacggcgccaugauccagcgg

SEQ ID NO: 3752723 - RNA, 19 nt, Salmonella typhimurium LT2
cacacguauaaacgccgcc

SEQ ID NO: 3752724 - RNA, 20 nt, Salmonella typhimurium LT2
cacacguauaaacgccgccg

SEQ ID NO: 3752725 - RNA, 14 nt, Salmonella typhimurium LT2
cacacuacguugga

SEQ ID NO: 3752726 - RNA, 14 nt, Salmonella typhimurium LT2
cacacugacaauaa

SEQ ID NO: 3752727 - RNA, 19 nt, Salmonella typhimurium LT2
cacacugacgcgccagcuc

SEQ ID NO: 3752728 - RNA, 15 nt, Salmonella typhimurium LT2
cacacugcgccgcca

SEQ ID NO: 3752729 - RNA, 22 nt, Salmonella typhimurium LT2
cacacuguuuaaugcuuucaau

SEQ ID NO: 3752730 - RNA, 13 nt, Salmonella typhimurium LT2
cacacuuaccgac

SEQ ID NO: 3752731 - RNA, 22 nt, Salmonella typhimurium LT2
cacagaacggauauccagaauc

SEQ ID NO: 3752732 - RNA, 13 nt, Salmonella typhimurium LT2
cacagaagcgccu

SEQ ID NO: 3752733 - RNA, 19 nt, Salmonella typhimurium LT2
cacagaauacccuccgcca

SEQ ID NO: 3752734 - RNA, 23 nt, Salmonella typhimurium LT2
cacagaauuacauaugcgcggcg

SEQ ID NO: 3752735 - RNA, 20 nt, Salmonella typhimurium LT2
cacagaggaauauuaucaau

SEQ ID NO: 3752736 - RNA, 13 nt, Salmonella typhimurium LT2
cacagaugacaga

SEQ ID NO: 3752737 - RNA, 14 nt, Salmonella typhimurium LT2
cacagauuccagau

SEQ ID NO: 3752738 - RNA, 17 nt, Salmonella typhimurium LT2
cacagcaaaugaaagga

SEQ ID NO: 3752739 - RNA, 15 nt, Salmonella typhimurium LT2
cacagcacauagaag

SEQ ID NO: 3752740 - RNA, 19 nt, Salmonella typhimurium LT2
cacagcaccauguugacca

SEQ ID NO: 3752741 - RNA, 20 nt, Salmonella typhimurium LT2
cacagcacuaacgaggccac

SEQ ID NO: 3752742 - RNA, 14 nt, Salmonella typhimurium LT2
cacagcaugaauaa

SEQ ID NO: 3752743 - RNA, 22 nt, Salmonella typhimurium LT2
cacagcaugaauaaccucccgc

SEQ ID NO: 3752744 - RNA, 18 nt, Salmonella typhimurium LT2
cacagcccauaccagcgc

SEQ ID NO: 3752745 - RNA, 21 nt, Salmonella typhimurium LT2
cacagcccauaccagcgcggc

SEQ ID NO: 3752746 - RNA, 17 nt, Salmonella typhimurium LT2
cacagccccagcaccaa

SEQ ID NO: 3752747 - RNA, 22 nt, Salmonella typhimurium LT2
cacagccccagcaccaacgccg

SEQ ID NO: 3752748 - RNA, 19 nt, Salmonella typhimurium LT2
cacagccgcauuuuuucuu

SEQ ID NO: 3752749 - RNA, 12 nt, Salmonella typhimurium LT2
cacagcggaaua

SEQ ID NO: 3752750 - RNA, 21 nt, Salmonella typhimurium LT2
cacagcguacaauggcaggca

SEQ ID NO: 3752751 - RNA, 14 nt, Salmonella typhimurium LT2
cacagcucaauauc

SEQ ID NO: 3752752 - RNA, 21 nt, Salmonella typhimurium LT2
cacagcuugccguagcgcgcu

SEQ ID NO: 3752753 - RNA, 13 nt, Salmonella typhimurium LT2
caccgcaucggca

SEQ ID NO: 3752754 - RNA, 13 nt, Salmonella typhimurium LT2
caccgccagacgc

SEQ ID NO: 3752755 - RNA, 13 nt, Salmonella typhimurium LT2
caccgccagagca

SEQ ID NO: 3752756 - RNA, 18 nt, Salmonella typhimurium LT2
caccgccagagcacgaaa

SEQ ID NO: 3752757 - RNA, 14 nt, Salmonella typhimurium LT2
caccgccagcgccg

SEQ ID NO: 3752758 - RNA, 16 nt, Salmonella typhimurium LT2
caccgccagcgucugu

SEQ ID NO: 3752759 - RNA, 14 nt, Salmonella typhimurium LT2
caccgccagugcau

SEQ ID NO: 3752760 - RNA, 12 nt, Salmonella typhimurium LT2
caccgcccaggc

SEQ ID NO: 3752761 - RNA, 16 nt, Salmonella typhimurium LT2
caccgcccgccgggcg

SEQ ID NO: 3752762 - RNA, 18 nt, Salmonella typhimurium LT2
caccgccgccaccaaaaa

SEQ ID NO: 3752763 - RNA, 12 nt, Salmonella typhimurium LT2
caccgccgcgcu

SEQ ID NO: 3752764 - RNA, 13 nt, Salmonella typhimurium LT2
caccgccucgacc

SEQ ID NO: 3752765 - RNA, 18 nt, Salmonella typhimurium LT2
caccgcgaauauacgcac

SEQ ID NO: 3752766 - RNA, 22 nt, Salmonella typhimurium LT2
caccgcgaauauacgcaccuga

SEQ ID NO: 3752767 - RNA, 13 nt, Salmonella typhimurium LT2
caccgcgaugacc

SEQ ID NO: 3752768 - RNA, 17 nt, Salmonella typhimurium LT2
caccgcgcggcugguaa

SEQ ID NO: 3752769 - RNA, 18 nt, Salmonella typhimurium LT2
caccgcggcaaccagccc

SEQ ID NO: 3752770 - RNA, 17 nt, Salmonella typhimurium LT2
caccgcggcgcucgcca

SEQ ID NO: 3752771 - RNA, 21 nt, Salmonella typhimurium LT2
caccgcggcgcucgccagccc

SEQ ID NO: 3752772 - RNA, 20 nt, Salmonella typhimurium LT2
caccgcuacaauccaggacg

SEQ ID NO: 3752773 - RNA, 21 nt, Salmonella typhimurium LT2
caccgcuccgcgcauccugca

SEQ ID NO: 3752774 - RNA, 20 nt, Salmonella typhimurium LT2
caccgcugcgcucacgcggc

SEQ ID NO: 3752775 - RNA, 19 nt, Salmonella typhimurium LT2
caccgcugcgugcgcgcca

SEQ ID NO: 3752776 - RNA, 21 nt, Salmonella typhimurium LT2
caccgcugcgugcgcgccacc

SEQ ID NO: 3752777 - RNA, 15 nt, Salmonella typhimurium LT2
caccggauacccagc

SEQ ID NO: 3752778 - RNA, 13 nt, Salmonella typhimurium LT2
caccggauugccu

SEQ ID NO: 3752779 - RNA, 20 nt, Salmonella typhimurium LT2
caccggccauugccgcgccg

SEQ ID NO: 3752780 - RNA, 13 nt, Salmonella typhimurium LT2
caccggcgcgcca

SEQ ID NO: 3752781 - RNA, 16 nt, Salmonella typhimurium LT2
caccggcgcgccagcg

SEQ ID NO: 3752782 - RNA, 18 nt, Salmonella typhimurium LT2
caccgggagaaaacgcgg

SEQ ID NO: 3752783 - RNA, 21 nt, Salmonella typhimurium LT2
caccgggagaaaacgcggccu

SEQ ID NO: 3752784 - RNA, 19 nt, Salmonella typhimurium LT2
caccgguacgcuccagggc

SEQ ID NO: 3752785 - RNA, 15 nt, Salmonella typhimurium LT2
caccgguuaacauau

SEQ ID NO: 3752786 - RNA, 15 nt, Salmonella typhimurium LT2
caccgguucgcggca

SEQ ID NO: 3752787 - RNA, 22 nt, Salmonella typhimurium LT2
caccgguuuuuccgcuucaccu

SEQ ID NO: 3752788 - RNA, 20 nt, Salmonella typhimurium LT2
caccgguuuuuuccugcaca

SEQ ID NO: 3752789 - RNA, 19 nt, Salmonella typhimurium LT2
caccguaaaaggaaucaac

SEQ ID NO: 3752790 - RNA, 15 nt, Salmonella typhimurium LT2
caccguaaacggcuc

SEQ ID NO: 3752791 - RNA, 17 nt, Salmonella typhimurium LT2
caccguaacuaaaauac

SEQ ID NO: 3752792 - RNA, 17 nt, Salmonella typhimurium LT2
caccguagcaucaucaa

SEQ ID NO: 3752793 - RNA, 15 nt, Salmonella typhimurium LT2
caccguauccggccu

SEQ ID NO: 3752794 - RNA, 17 nt, Salmonella typhimurium LT2
caccguaucggcaguca

SEQ ID NO: 3752795 - RNA, 15 nt, Salmonella typhimurium LT2
caccgucuccggcgc

SEQ ID NO: 3752796 - RNA, 19 nt, Salmonella typhimurium LT2
caccgucuccggcgcgccg

SEQ ID NO: 3752797 - RNA, 12 nt, Salmonella typhimurium LT2
caccgucuugcu

SEQ ID NO: 3752798 - RNA, 23 nt, Salmonella typhimurium LT2
caccguggaggacgucugucaga

SEQ ID NO: 3752799 - RNA, 13 nt, Salmonella typhimurium LT2
caccguuauuucc

SEQ ID NO: 3752800 - RNA, 20 nt, Salmonella typhimurium LT2
caccguuuaaucgcccugcg

SEQ ID NO: 3752801 - RNA, 18 nt, Salmonella typhimurium LT2
caccguuugcagccagau

SEQ ID NO: 3752802 - RNA, 16 nt, Salmonella typhimurium LT2
caccguuuuucaucaa

SEQ ID NO: 3752803 - RNA, 16 nt, Salmonella typhimurium LT2
caccucacuccagacc

SEQ ID NO: 3752804 - RNA, 23 nt, Salmonella typhimurium LT2
caccucaucgcuaccuucuuccc

SEQ ID NO: 3752805 - RNA, 21 nt, Salmonella typhimurium LT2
caccuccagcgaggccucucc

SEQ ID NO: 3752806 - RNA, 14 nt, Salmonella typhimurium LT2
caccuccgccacca

SEQ ID NO: 3752807 - RNA, 18 nt, Salmonella typhimurium LT2
caccucgucacgguuuau

SEQ ID NO: 3752808 - RNA, 19 nt, Salmonella typhimurium LT2
caccucugcgggcuccgga

SEQ ID NO: 3752809 - RNA, 16 nt, Salmonella typhimurium LT2
caccucuuccgccagg

SEQ ID NO: 3752810 - RNA, 20 nt, Salmonella typhimurium LT2
caccugaauaacccgcagcc

SEQ ID NO: 3752811 - RNA, 23 nt, Salmonella typhimurium LT2
caccugaauauccugaugcgccu

SEQ ID NO: 3752812 - RNA, 20 nt, Salmonella typhimurium LT2
caccugaccguugaucuccg

SEQ ID NO: 3752813 - RNA, 13 nt, Salmonella typhimurium LT2
caccugauuaccu

SEQ ID NO: 3752814 - RNA, 22 nt, Salmonella typhimurium LT2
caccugauugauacgcgcccga

SEQ ID NO: 3752815 - RNA, 19 nt, Salmonella typhimurium LT2
caccugauuugucgcgcau

SEQ ID NO: 3752816 - RNA, 16 nt, Salmonella typhimurium LT2
caccugcaacuccugg

SEQ ID NO: 3752817 - RNA, 12 nt, Salmonella typhimurium LT2
caccugcaauuu

SEQ ID NO: 3752818 - RNA, 21 nt, Salmonella typhimurium LT2
caccugcagcagcuucgccag

SEQ ID NO: 3752819 - RNA, 22 nt, Salmonella typhimurium LT2
caccugcauggggaaauacugc

SEQ ID NO: 3752820 - RNA, 16 nt, Salmonella typhimurium LT2
caccugcguggucauc

SEQ ID NO: 3752821 - RNA, 13 nt, Salmonella typhimurium LT2
caccugcucgccc

SEQ ID NO: 3752822 - RNA, 22 nt, Salmonella typhimurium LT2
caccuggaugcugccugccuga

SEQ ID NO: 3752823 - RNA, 20 nt, Salmonella typhimurium LT2
caccuggugaaacugaugug

SEQ ID NO: 3752824 - RNA, 22 nt, Salmonella typhimurium LT2
caccuguaaccgcuaucauacc

SEQ ID NO: 3752825 - RNA, 17 nt, Salmonella typhimurium LT2
caccuuaaacuugccgu

SEQ ID NO: 3752826 - RNA, 22 nt, Salmonella typhimurium LT2
caccuuacgaauuuuaucuucc

SEQ ID NO: 3752827 - RNA, 12 nt, Salmonella typhimurium LT2
caccuuauccgg

SEQ ID NO: 3752828 - RNA, 14 nt, Salmonella typhimurium LT2
caccuucacaggug

SEQ ID NO: 3752829 - RNA, 13 nt, Salmonella typhimurium LT2
caccuuccacuuu

SEQ ID NO: 3752830 - RNA, 15 nt, Salmonella typhimurium LT2
caccuuguccggcgc

SEQ ID NO: 3752831 - RNA, 14 nt, Salmonella typhimurium LT2
caccuuucgccgcc

SEQ ID NO: 3752832 - RNA, 19 nt, Salmonella typhimurium LT2
caccuuugacgccugcauc

SEQ ID NO: 3752833 - RNA, 21 nt, Salmonella typhimurium LT2
cacgaaaaguguguaccagca

SEQ ID NO: 3752834 - RNA, 21 nt, Salmonella typhimurium LT2
cacgaaauaacgcacuaccag

SEQ ID NO: 3752835 - RNA, 14 nt, Salmonella typhimurium LT2
cacgaacgggauca

SEQ ID NO: 3752836 - RNA, 16 nt, Salmonella typhimurium LT2
cacgaaggaaacgcca

SEQ ID NO: 3752837 - RNA, 18 nt, Salmonella typhimurium LT2
cacgaaugucgcgucagg

SEQ ID NO: 3752838 - RNA, 21 nt, Salmonella typhimurium LT2
cacgaauuugucccuguucca

SEQ ID NO: 3752839 - RNA, 15 nt, Salmonella typhimurium LT2
cacgacaaucucuac

SEQ ID NO: 3752840 - RNA, 13 nt, Salmonella typhimurium LT2
cacgacacaaaag

SEQ ID NO: 3752841 - RNA, 17 nt, Salmonella typhimurium LT2
cacgacaugagauaaug

SEQ ID NO: 3752842 - RNA, 19 nt, Salmonella typhimurium LT2
cacgacgcucauuaacgac

SEQ ID NO: 3752843 - RNA, 15 nt, Salmonella typhimurium LT2
cacgacugauaggcu

SEQ ID NO: 3752844 - RNA, 15 nt, Salmonella typhimurium LT2
cacgacuuucaccag

SEQ ID NO: 3752845 - RNA, 14 nt, Salmonella typhimurium LT2
cacgacuuuuccuu

SEQ ID NO: 3752846 - RNA, 23 nt, Salmonella typhimurium LT2
cacgaguaauuugugaucgucgc

SEQ ID NO: 3752847 - RNA, 15 nt, Salmonella typhimurium LT2
cacgaguuaucgauu

SEQ ID NO: 3752848 - RNA, 20 nt, Salmonella typhimurium LT2
cacgauacuguugcaguuua

SEQ ID NO: 3752849 - RNA, 16 nt, Salmonella typhimurium LT2
cacgaucgagccgucg

SEQ ID NO: 3752850 - RNA, 16 nt, Salmonella typhimurium LT2
cacgaucgaugcccug

SEQ ID NO: 3752851 - RNA, 12 nt, Salmonella typhimurium LT2
cacgauggcaaa

SEQ ID NO: 3752852 - RNA, 19 nt, Salmonella typhimurium LT2
cacgauggucggcgcuggc

SEQ ID NO: 3752853 - RNA, 18 nt, Salmonella typhimurium LT2
cacgauguucaacgucag

SEQ ID NO: 3752854 - RNA, 13 nt, Salmonella typhimurium LT2
cacgauuaacccc

SEQ ID NO: 3752855 - RNA, 22 nt, Salmonella typhimurium LT2
cacgcaaaaaagcccguccguc

SEQ ID NO: 3752856 - RNA, 13 nt, Salmonella typhimurium LT2
cacgcaaaccgcu

SEQ ID NO: 3752857 - RNA, 15 nt, Salmonella typhimurium LT2
cacggucgcuuccca

SEQ ID NO: 3752858 - RNA, 15 nt, Salmonella typhimurium LT2
cacgguuggcccagc

SEQ ID NO: 3752859 - RNA, 23 nt, Salmonella typhimurium LT2
cacgguuuauccccgcuggcgcg

SEQ ID NO: 3752860 - RNA, 16 nt, Salmonella typhimurium LT2
cacgguuuccggcgca

SEQ ID NO: 3752861 - RNA, 14 nt, Salmonella typhimurium LT2
cacguacaaacgcu

SEQ ID NO: 3752862 - RNA, 19 nt, Salmonella typhimurium LT2
cacguacccaaauaucaaa

SEQ ID NO: 3752863 - RNA, 22 nt, Salmonella typhimurium LT2
cacguacggcgagaccaccguu

SEQ ID NO: 3752864 - RNA, 22 nt, Salmonella typhimurium LT2
cacguagccagagcgcgcuggc

SEQ ID NO: 3752865 - RNA, 18 nt, Salmonella typhimurium LT2
cacguauaaacgccgccg

SEQ ID NO: 3752866 - RNA, 19 nt, Salmonella typhimurium LT2
cacgucacgcaacaggccg

SEQ ID NO: 3752867 - RNA, 17 nt, Salmonella typhimurium LT2
cacgucauuaaagcgcu

SEQ ID NO: 3752868 - RNA, 23 nt, Salmonella typhimurium LT2
cacgucauuaaagcgcucaagcg

SEQ ID NO: 3752869 - RNA, 19 nt, Salmonella typhimurium LT2
cacgucggcgaccauugcg

SEQ ID NO: 3752870 - RNA, 21 nt, Salmonella typhimurium LT2
cacgucgguauacuguucuac

SEQ ID NO: 3752871 - RNA, 14 nt, Salmonella typhimurium LT2
cacgucguucgggc

SEQ ID NO: 3752872 - RNA, 15 nt, Salmonella typhimurium LT2
cacgucuacccaggu

SEQ ID NO: 3752873 - RNA, 14 nt, Salmonella typhimurium LT2
cacgucugagcaga

SEQ ID NO: 3752874 - RNA, 22 nt, Salmonella typhimurium LT2
cacguuaccgcgcaguucaaua

SEQ ID NO: 3752875 - RNA, 16 nt, Salmonella typhimurium LT2
cacguuagccucgguc

SEQ ID NO: 3752876 - RNA, 18 nt, Salmonella typhimurium LT2
cacguuaucugaccuaca

SEQ ID NO: 3752877 - RNA, 17 nt, Salmonella typhimurium LT2
cacguugucccaggcca

SEQ ID NO: 3752878 - RNA, 13 nt, Salmonella typhimurium LT2
cacguuuuuacuc

SEQ ID NO: 3752879 - RNA, 22 nt, Salmonella typhimurium LT2
cacguuuuuuacgucagcaaua

SEQ ID NO: 3752880 - RNA, 14 nt, Salmonella typhimurium LT2
cacuaaaaacaggc

SEQ ID NO: 3752881 - RNA, 20 nt, Salmonella typhimurium LT2
cacuaaaccagcuauccagc

SEQ ID NO: 3752882 - RNA, 19 nt, Salmonella typhimurium LT2
cacuaaacuaaugccuggc

SEQ ID NO: 3752883 - RNA, 21 nt, Salmonella typhimurium LT2
cacuaaacuaaugccuggcag

SEQ ID NO: 3752884 - RNA, 19 nt, Salmonella typhimurium LT2
cacuaacuggcaaucaugc

SEQ ID NO: 3752885 - RNA, 12 nt, Salmonella typhimurium LT2
cacuaauuuaag

SEQ ID NO: 3752886 - RNA, 14 nt, Salmonella typhimurium LT2
cacuaauuugaguc

SEQ ID NO: 3752887 - RNA, 12 nt, Salmonella typhimurium LT2
cacuaauuugcg

SEQ ID NO: 3752888 - RNA, 20 nt, Salmonella typhimurium LT2
cacuacacagggucgucaaa

SEQ ID NO: 3752889 - RNA, 15 nt, Salmonella typhimurium LT2
cacuaccagacacag

SEQ ID NO: 3752890 - RNA, 16 nt, Salmonella typhimurium LT2
cacuaccgccgcggau

SEQ ID NO: 3752891 - RNA, 15 nt, Salmonella typhimurium LT2
cacuaccgggcagca

SEQ ID NO: 3752892 - RNA, 21 nt, Salmonella typhimurium LT2
cacuaccgggcagcaucucga

SEQ ID NO: 3752893 - RNA, 22 nt, Salmonella typhimurium LT2
cacuaccugauuggcuccccgc

SEQ ID NO: 3752894 - RNA, 22 nt, Salmonella typhimurium LT2
cacuacgguccaguugcccucu

SEQ ID NO: 3752895 - RNA, 17 nt, Salmonella typhimurium LT2
cacuacugcgucaauga

SEQ ID NO: 3752896 - RNA, 19 nt, Salmonella typhimurium LT2
cacuacuucuucaguuccg

SEQ ID NO: 3752897 - RNA, 13 nt, Salmonella typhimurium LT2
cacuagcgccgcc

SEQ ID NO: 3752898 - RNA, 20 nt, Salmonella typhimurium LT2
cacuauugucgucuggugau

SEQ ID NO: 3752899 - RNA, 21 nt, Salmonella typhimurium LT2
cacucacauucauugccgcca

SEQ ID NO: 3752900 - RNA, 14 nt, Salmonella typhimurium LT2
cacucagaaaauua

SEQ ID NO: 3752901 - RNA, 21 nt, Salmonella typhimurium LT2
cacucagaaaauuauuuuaaa

SEQ ID NO: 3752902 - RNA, 22 nt, Salmonella typhimurium LT2
cacucagaaaauuauuuuaaau

SEQ ID NO: 3752903 - RNA, 12 nt, Salmonella typhimurium LT2
cacucauccagc

SEQ ID NO: 3752904 - RNA, 14 nt, Salmonella typhimurium LT2
cacucauccagcaa

SEQ ID NO: 3752905 - RNA, 12 nt, Salmonella typhimurium LT2
cacuccagaccu

SEQ ID NO: 3752906 - RNA, 15 nt, Salmonella typhimurium LT2
cacuccccagaauga

SEQ ID NO: 3752907 - RNA, 23 nt, Salmonella typhimurium LT2
cacucccgauucaacguuucgcu

SEQ ID NO: 3752908 - RNA, 16 nt, Salmonella typhimurium LT2
cacuccggcugcacca

SEQ ID NO: 3752909 - RNA, 15 nt, Salmonella typhimurium LT2
cacuccuaagagaaa

SEQ ID NO: 3752910 - RNA, 17 nt, Salmonella typhimurium LT2
cacuccuaagagaaaac

SEQ ID NO: 3752911 - RNA, 20 nt, Salmonella typhimurium LT2
cacucgauggcuuucuaccu

SEQ ID NO: 3752912 - RNA, 21 nt, Salmonella typhimurium LT2
cacucgauggcuuucuaccug

SEQ ID NO: 3752913 - RNA, 14 nt, Salmonella typhimurium LT2
cacucgcccauuug

SEQ ID NO: 3752914 - RNA, 16 nt, Salmonella typhimurium LT2
cacucgccggguuuug

SEQ ID NO: 3752915 - RNA, 22 nt, Salmonella typhimurium LT2
cacucuccaccaaaucccccaa

SEQ ID NO: 3752916 - RNA, 19 nt, Salmonella typhimurium LT2
cacucugaaaaauuuuccu

SEQ ID NO: 3752917 - RNA, 16 nt, Salmonella typhimurium LT2
cacucuuacggcgccc

SEQ ID NO: 3752918 - RNA, 15 nt, Salmonella typhimurium LT2
cacucuuccacuuca

SEQ ID NO: 3752919 - RNA, 17 nt, Salmonella typhimurium LT2
cacucuuuaaccggcaa

SEQ ID NO: 3752920 - RNA, 22 nt, Salmonella typhimurium LT2
cacugaaaaauaauuacuaucu

SEQ ID NO: 3752921 - RNA, 14 nt, Salmonella typhimurium LT2
cacugaagaggaga

SEQ ID NO: 3752922 - RNA, 19 nt, Salmonella typhimurium LT2
cacugaauuacugcguaaa

SEQ ID NO: 3752923 - RNA, 14 nt, Salmonella typhimurium LT2
cacugacauuacga

SEQ ID NO: 3752924 - RNA, 14 nt, Salmonella typhimurium LT2
cacugaccugcugg

SEQ ID NO: 3752925 - RNA, 16 nt, Salmonella typhimurium LT2
cacugacgcgccagcu

SEQ ID NO: 3752926 - RNA, 17 nt, Salmonella typhimurium LT2
cacugagcgcgccauga

SEQ ID NO: 3752927 - RNA, 19 nt, Salmonella typhimurium LT2
cacugaguuucaccgccag

SEQ ID NO: 3752928 - RNA, 20 nt, Salmonella typhimurium LT2
cacugauaacggaaagaggu

SEQ ID NO: 3752929 - RNA, 12 nt, Salmonella typhimurium LT2
cacugauacccc

SEQ ID NO: 3752930 - RNA, 18 nt, Salmonella typhimurium LT2
cacugauaccccagcgau

SEQ ID NO: 3752931 - RNA, 21 nt, Salmonella typhimurium LT2
cacugauacggcguuggcugc

SEQ ID NO: 3752932 - RNA, 20 nt, Salmonella typhimurium LT2
cacugauaguccaucaccuc

SEQ ID NO: 3752933 - RNA, 21 nt, Salmonella typhimurium LT2
cacugauggaguuucaucagc

SEQ ID NO: 3752934 - RNA, 16 nt, Salmonella typhimurium LT2
cacugcagugucaaau

SEQ ID NO: 3752935 - RNA, 21 nt, Salmonella typhimurium LT2
cacugcauaaauaucugcauu

SEQ ID NO: 3752936 - RNA, 14 nt, Salmonella typhimurium LT2
cacugcauuacucg

SEQ ID NO: 3752937 - RNA, 17 nt, Salmonella typhimurium LT2
cacugcauuacucgccu

SEQ ID NO: 3752938 - RNA, 18 nt, Salmonella typhimurium LT2
cacugccacgagccuucu

SEQ ID NO: 3752939 - RNA, 19 nt, Salmonella typhimurium LT2
cacugccacgagccuucug

SEQ ID NO: 3752940 - RNA, 15 nt, Salmonella typhimurium LT2
cacugcccagagaau

SEQ ID NO: 3752941 - RNA, 15 nt, Salmonella typhimurium LT2
cacugcccgccgcca

SEQ ID NO: 3752942 - RNA, 18 nt, Salmonella typhimurium LT2
cacugcccucaaguuaug

SEQ ID NO: 3752943 - RNA, 21 nt, Salmonella typhimurium LT2
cacugcccucaaguuauguua

SEQ ID NO: 3752944 - RNA, 20 nt, Salmonella typhimurium LT2
cacugccguagcgcauuauu

SEQ ID NO: 3752945 - RNA, 12 nt, Salmonella typhimurium LT2
cacugcgccgcc

SEQ ID NO: 3752946 - RNA, 15 nt, Salmonella typhimurium LT2
cacugcggacauuuu

SEQ ID NO: 3752947 - RNA, 15 nt, Salmonella typhimurium LT2
cacugcuguagcguc

SEQ ID NO: 3752948 - RNA, 19 nt, Salmonella typhimurium LT2
cacugcuguagcgucucau

SEQ ID NO: 3752949 - RNA, 22 nt, Salmonella typhimurium LT2
cacugcuguagcgucucaucaa

SEQ ID NO: 3752950 - RNA, 16 nt, Salmonella typhimurium LT2
cacugcuguguccagg

SEQ ID NO: 3752951 - RNA, 23 nt, Salmonella typhimurium LT2
cacugcuguguccaggucaucac

SEQ ID NO: 3752952 - RNA, 16 nt, Salmonella typhimurium LT2
cacuggaaacagccaa

SEQ ID NO: 3752953 - RNA, 13 nt, Salmonella typhimurium LT2
cacuggcagagac

SEQ ID NO: 3752954 - RNA, 20 nt, Salmonella typhimurium LT2
cacuggccucccaguucccu

SEQ ID NO: 3752955 - RNA, 20 nt, Salmonella typhimurium LT2
cacuggcgacggcaucggca

SEQ ID NO: 3752956 - RNA, 20 nt, Salmonella typhimurium LT2
cacugggcgaagguggcgga

SEQ ID NO: 3752957 - RNA, 20 nt, Salmonella typhimurium LT2
cacuggugacaucgccaacg

SEQ ID NO: 3752958 - RNA, 19 nt, Salmonella typhimurium LT2
cacugguugcccauggcau

SEQ ID NO: 3752959 - RNA, 13 nt, Salmonella typhimurium LT2
cacuguaaaaggg

SEQ ID NO: 3752960 - RNA, 14 nt, Salmonella typhimurium LT2
cacuguaaaaggga

SEQ ID NO: 3752961 - RNA, 18 nt, Salmonella typhimurium LT2
cagacaauaccagggcga

SEQ ID NO: 3752962 - RNA, 20 nt, Salmonella typhimurium LT2
cagacaauaccagggcgauu

SEQ ID NO: 3752963 - RNA, 12 nt, Salmonella typhimurium LT2
cagacaaugaau

SEQ ID NO: 3752964 - RNA, 20 nt, Salmonella typhimurium LT2
cagacaauuagcgacgcaua

SEQ ID NO: 3752965 - RNA, 18 nt, Salmonella typhimurium LT2
cagacaccagcccuggcu

SEQ ID NO: 3752966 - RNA, 15 nt, Salmonella typhimurium LT2
cagacacggucgccu

SEQ ID NO: 3752967 - RNA, 13 nt, Salmonella typhimurium LT2
cagacacugccac

SEQ ID NO: 3752968 - RNA, 19 nt, Salmonella typhimurium LT2
cagacacuggaaacagcca

SEQ ID NO: 3752969 - RNA, 17 nt, Salmonella typhimurium LT2
cagacagauaacaccag

SEQ ID NO: 3752970 - RNA, 12 nt, Salmonella typhimurium LT2
cagacagccgac

SEQ ID NO: 3752971 - RNA, 20 nt, Salmonella typhimurium LT2
cagacagccgacggcaaaaa

SEQ ID NO: 3752972 - RNA, 17 nt, Salmonella typhimurium LT2
cagacaggcuuuaaagu

SEQ ID NO: 3752973 - RNA, 17 nt, Salmonella typhimurium LT2
cagacauauuuucucug

SEQ ID NO: 3752974 - RNA, 14 nt, Salmonella typhimurium LT2
cagacaucaucgaa

SEQ ID NO: 3752975 - RNA, 18 nt, Salmonella typhimurium LT2
cagaccaaaaucaaacug

SEQ ID NO: 3752976 - RNA, 15 nt, Salmonella typhimurium LT2
cagaccacagauaaa

SEQ ID NO: 3752977 - RNA, 13 nt, Salmonella typhimurium LT2
cagaccaccagcg

SEQ ID NO: 3752978 - RNA, 16 nt, Salmonella typhimurium LT2
cagaccaccccacagc

SEQ ID NO: 3752979 - RNA, 19 nt, Salmonella typhimurium LT2
cagaccaccccacagcaau

SEQ ID NO: 3752980 - RNA, 20 nt, Salmonella typhimurium LT2
cagaccacgaaucaggauau

SEQ ID NO: 3752981 - RNA, 16 nt, Salmonella typhimurium LT2
cagaccagucggacag

SEQ ID NO: 3752982 - RNA, 18 nt, Salmonella typhimurium LT2
cagaccauucaaccagcc

SEQ ID NO: 3752983 - RNA, 16 nt, Salmonella typhimurium LT2
cagacccagacggcga

SEQ ID NO: 3752984 - RNA, 22 nt, Salmonella typhimurium LT2
cagaccccaguaauccggcaac

SEQ ID NO: 3752985 - RNA, 15 nt, Salmonella typhimurium LT2
cagacccgcaaacca

SEQ ID NO: 3752986 - RNA, 13 nt, Salmonella typhimurium LT2
cagacccgcaaua

SEQ ID NO: 3752987 - RNA, 19 nt, Salmonella typhimurium LT2
cagacccgcguacaggaag

SEQ ID NO: 3752988 - RNA, 14 nt, Salmonella typhimurium LT2
cagaccgaucucau

SEQ ID NO: 3752989 - RNA, 17 nt, Salmonella typhimurium LT2
cagaccgaucucaugca

SEQ ID NO: 3752990 - RNA, 22 nt, Salmonella typhimurium LT2
cagaccgaucucaugcaacugg

SEQ ID NO: 3752991 - RNA, 23 nt, Salmonella typhimurium LT2
cagaccgccaagcgcggacagca

SEQ ID NO: 3752992 - RNA, 19 nt, Salmonella typhimurium LT2
cagaccguagauaagcgcc

SEQ ID NO: 3752993 - RNA, 23 nt, Salmonella typhimurium LT2
cagaccugaauauucggcuccag

SEQ ID NO: 3752994 - RNA, 12 nt, Salmonella typhimurium LT2
cagaccuuaucg

SEQ ID NO: 3752995 - RNA, 19 nt, Salmonella typhimurium LT2
cagacgaaaaugcgccuua

SEQ ID NO: 3752996 - RNA, 21 nt, Salmonella typhimurium LT2
cagacgaauaaucucaucgcc

SEQ ID NO: 3752997 - RNA, 19 nt, Salmonella typhimurium LT2
cagacgaccguaauagcaa

SEQ ID NO: 3752998 - RNA, 16 nt, Salmonella typhimurium LT2
cagacgaucggcguga

SEQ ID NO: 3752999 - RNA, 11 nt, Salmonella typhimurium LT2
cagacgcaucg

SEQ ID NO: 3753000 - RNA, 14 nt, Salmonella typhimurium LT2
cagacgcgcagcac

SEQ ID NO: 3753001 - RNA, 16 nt, Salmonella typhimurium LT2
cagacgcgcagcaccg

SEQ ID NO: 3753002 - RNA, 19 nt, Salmonella typhimurium LT2
cagacgcuccgcaguaauc

SEQ ID NO: 3753003 - RNA, 22 nt, Salmonella typhimurium LT2
cagacgcuucauugguuaauuc

SEQ ID NO: 3753004 - RNA, 18 nt, Salmonella typhimurium LT2
cagacggcaaacaaccgu

SEQ ID NO: 3753005 - RNA, 16 nt, Salmonella typhimurium LT2
cagacggcgaaucaau

SEQ ID NO: 3753006 - RNA, 18 nt, Salmonella typhimurium LT2
cagacggcuccagcgcca

SEQ ID NO: 3753007 - RNA, 21 nt, Salmonella typhimurium LT2
cagacggcuccagcgccagcu

SEQ ID NO: 3753008 - RNA, 13 nt, Salmonella typhimurium LT2
cagacggcugggc

SEQ ID NO: 3753009 - RNA, 14 nt, Salmonella typhimurium LT2
cagacgguuuaucc

SEQ ID NO: 3753010 - RNA, 15 nt, Salmonella typhimurium LT2
cagacgucaacaccu

SEQ ID NO: 3753011 - RNA, 18 nt, Salmonella typhimurium LT2
cagacguuacaucuccug

SEQ ID NO: 3753012 - RNA, 21 nt, Salmonella typhimurium LT2
cagacguuuaucggccagcag

SEQ ID NO: 3753013 - RNA, 17 nt, Salmonella typhimurium LT2
cagacuaaaaagcgcgu

SEQ ID NO: 3753014 - RNA, 22 nt, Salmonella typhimurium LT2
cagacuauccguccucuuuccc

SEQ ID NO: 3753015 - RNA, 15 nt, Salmonella typhimurium LT2
cagacucagccaggu

SEQ ID NO: 3753016 - RNA, 15 nt, Salmonella typhimurium LT2
cagacucgcuucacg

SEQ ID NO: 3753017 - RNA, 19 nt, Salmonella typhimurium LT2
cagacugaauaaaggguuu

SEQ ID NO: 3753018 - RNA, 9 nt, Salmonella typhimurium LT2
cagacugcg

SEQ ID NO: 3753019 - RNA, 15 nt, Salmonella typhimurium LT2
cagacugcgccacgu

SEQ ID NO: 3753020 - RNA, 19 nt, Salmonella typhimurium LT2
cagacugcguaauguugau

SEQ ID NO: 3753021 - RNA, 13 nt, Salmonella typhimurium LT2
cagacuguaaauc

SEQ ID NO: 3753022 - RNA, 15 nt, Salmonella typhimurium LT2
cagacuguaaaucug

SEQ ID NO: 3753023 - RNA, 16 nt, Salmonella typhimurium LT2
cagacuuagggcggaa

SEQ ID NO: 3753024 - RNA, 18 nt, Salmonella typhimurium LT2
cagacuucaaugccgcac

SEQ ID NO: 3753025 - RNA, 17 nt, Salmonella typhimurium LT2
cagacuucauuuuccac

SEQ ID NO: 3753026 - RNA, 12 nt, Salmonella typhimurium LT2
cagagaaagucg

SEQ ID NO: 3753027 - RNA, 20 nt, Salmonella typhimurium LT2
cagagaaguguacaaacacg

SEQ ID NO: 3753028 - RNA, 19 nt, Salmonella typhimurium LT2
cagagagauccugagaaau

SEQ ID NO: 3753029 - RNA, 22 nt, Salmonella typhimurium LT2
cagagagcguuucuacgccaug

SEQ ID NO: 3753030 - RNA, 17 nt, Salmonella typhimurium LT2
cagagauaauuuuccca

SEQ ID NO: 3753031 - RNA, 14 nt, Salmonella typhimurium LT2
cagagauccacauu

SEQ ID NO: 3753032 - RNA, 12 nt, Salmonella typhimurium LT2
cagagcaacgag

SEQ ID NO: 3753033 - RNA, 21 nt, Salmonella typhimurium LT2
cagagcagucguugcgccugu

SEQ ID NO: 3753034 - RNA, 14 nt, Salmonella typhimurium LT2
cagagcauaaaaau

SEQ ID NO: 3753035 - RNA, 18 nt, Salmonella typhimurium LT2
cagagcaucaauggugaa

SEQ ID NO: 3753036 - RNA, 13 nt, Salmonella typhimurium LT2
cagagccaacaga

SEQ ID NO: 3753037 - RNA, 16 nt, Salmonella typhimurium LT2
cagagcgauaaagaac

SEQ ID NO: 3753038 - RNA, 14 nt, Salmonella typhimurium LT2
cagagcgcaucaaa

SEQ ID NO: 3753039 - RNA, 18 nt, Salmonella typhimurium LT2
cagagcgccggcaaagcc

SEQ ID NO: 3753040 - RNA, 20 nt, Salmonella typhimurium LT2
cagagcgccggcaaagccau

SEQ ID NO: 3753041 - RNA, 22 nt, Salmonella typhimurium LT2
cagagcgcgcuggcaagcgcca

SEQ ID NO: 3753042 - RNA, 15 nt, Salmonella typhimurium LT2
cagagcggauaaaua

SEQ ID NO: 3753043 - RNA, 18 nt, Salmonella typhimurium LT2
cagagcucgucaaaaauc

SEQ ID NO: 3753044 - RNA, 20 nt, Salmonella typhimurium LT2
cagagcucgucaaaaaucac

SEQ ID NO: 3753045 - RNA, 18 nt, Salmonella typhimurium LT2
cagagcuucaggcgcgau

SEQ ID NO: 3753046 - RNA, 21 nt, Salmonella typhimurium LT2
cagagcuuuggcgacuuuuuu

SEQ ID NO: 3753047 - RNA, 12 nt, Salmonella typhimurium LT2
cagaggaaaacg

SEQ ID NO: 3753048 - RNA, 20 nt, Salmonella typhimurium LT2
cagaggaaauccuuccagcg

SEQ ID NO: 3753049 - RNA, 20 nt, Salmonella typhimurium LT2
cagaggaucuggacgccaau

SEQ ID NO: 3753050 - RNA, 23 nt, Salmonella typhimurium LT2
cagaggcacgguauuaacggcga

SEQ ID NO: 3753051 - RNA, 15 nt, Salmonella typhimurium LT2
cagaggccugaaugc

SEQ ID NO: 3753052 - RNA, 16 nt, Salmonella typhimurium LT2
cagaggccugaaugca

SEQ ID NO: 3753053 - RNA, 17 nt, Salmonella typhimurium LT2
cagaggggauggcguau

SEQ ID NO: 3753054 - RNA, 18 nt, Salmonella typhimurium LT2
cagagguaagauguucua

SEQ ID NO: 3753055 - RNA, 16 nt, Salmonella typhimurium LT2
cagagguaaucagauc

SEQ ID NO: 3753056 - RNA, 20 nt, Salmonella typhimurium LT2
cagaggucgccgcuguaaua

SEQ ID NO: 3753057 - RNA, 20 nt, Salmonella typhimurium LT2
cagaguaaaaaaaccggcga

SEQ ID NO: 3753058 - RNA, 22 nt, Salmonella typhimurium LT2
cagaguaacccgauacccugag

SEQ ID NO: 3753059 - RNA, 14 nt, Salmonella typhimurium LT2
cagaguacgucgcc

SEQ ID NO: 3753060 - RNA, 13 nt, Salmonella typhimurium LT2
cagaguccagcgg

SEQ ID NO: 3753061 - RNA, 18 nt, Salmonella typhimurium LT2
cagaguucuuuugaggcu

SEQ ID NO: 3753062 - RNA, 17 nt, Salmonella typhimurium LT2
cagauaaagcagcgaca

SEQ ID NO: 3753063 - RNA, 20 nt, Salmonella typhimurium LT2
cagauaaagcuucugcgccu

SEQ ID NO: 3753064 - RNA, 21 nt, Salmonella typhimurium LT2
cagauaaagcuucugcgccuu

SEQ ID NO: 3753065 - RNA, 14 nt, Salmonella typhimurium LT2
cagcaauucugcug

SEQ ID NO: 3753066 - RNA, 17 nt, Salmonella typhimurium LT2
cagcaauuucucgcccg

SEQ ID NO: 3753067 - RNA, 18 nt, Salmonella typhimurium LT2
cagcaauuuuguuaaauc

SEQ ID NO: 3753068 - RNA, 22 nt, Salmonella typhimurium LT2
cagcacaaacaauuuacgcagc

SEQ ID NO: 3753069 - RNA, 13 nt, Salmonella typhimurium LT2
cagcacaaagugc

SEQ ID NO: 3753070 - RNA, 18 nt, Salmonella typhimurium LT2
cagcacaaagugcgcugu

SEQ ID NO: 3753071 - RNA, 22 nt, Salmonella typhimurium LT2
cagcacaaagugcgcugucagc

SEQ ID NO: 3753072 - RNA, 20 nt, Salmonella typhimurium LT2
cagcacaaucagcgcggcga

SEQ ID NO: 3753073 - RNA, 17 nt, Salmonella typhimurium LT2
cagcacaaucccggcac

SEQ ID NO: 3753074 - RNA, 18 nt, Salmonella typhimurium LT2
cagcacaaugccuucugc

SEQ ID NO: 3753075 - RNA, 17 nt, Salmonella typhimurium LT2
cagcacaauggucagcg

SEQ ID NO: 3753076 - RNA, 20 nt, Salmonella typhimurium LT2
cagcacaauggucagcgccg

SEQ ID NO: 3753077 - RNA, 21 nt, Salmonella typhimurium LT2
cagcacaauggucagcgccgc

SEQ ID NO: 3753078 - RNA, 21 nt, Salmonella typhimurium LT2
cagcacaauuccggcccaggc

SEQ ID NO: 3753079 - RNA, 20 nt, Salmonella typhimurium LT2
cagcacagcgaugaugauua

SEQ ID NO: 3753080 - RNA, 21 nt, Salmonella typhimurium LT2
cagcacagcgguagcaucuca

SEQ ID NO: 3753081 - RNA, 16 nt, Salmonella typhimurium LT2
cagcacauagaagcuc

SEQ ID NO: 3753082 - RNA, 17 nt, Salmonella typhimurium LT2
cagcacauagccuaaug

SEQ ID NO: 3753083 - RNA, 22 nt, Salmonella typhimurium LT2
cagcacauuacaggcaucuucc

SEQ ID NO: 3753084 - RNA, 14 nt, Salmonella typhimurium LT2
cagcaccagcgaga

SEQ ID NO: 3753085 - RNA, 23 nt, Salmonella typhimurium LT2
cagcaccagcgaguagccugcga

SEQ ID NO: 3753086 - RNA, 22 nt, Salmonella typhimurium LT2
cagcaccaggauacguucaucu

SEQ ID NO: 3753087 - RNA, 21 nt, Salmonella typhimurium LT2
cagcaccaucuuuuccggcag

SEQ ID NO: 3753088 - RNA, 14 nt, Salmonella typhimurium LT2
cagcaccauggcua

SEQ ID NO: 3753089 - RNA, 14 nt, Salmonella typhimurium LT2
cagcaccgccagcg

SEQ ID NO: 3753090 - RNA, 17 nt, Salmonella typhimurium LT2
cagcaccgccagcgcau

SEQ ID NO: 3753091 - RNA, 22 nt, Salmonella typhimurium LT2
cagcaccgccagcgcauucccc

SEQ ID NO: 3753092 - RNA, 14 nt, Salmonella typhimurium LT2
cagcaccgccggga

SEQ ID NO: 3753093 - RNA, 14 nt, Salmonella typhimurium LT2
cagcaccgcgcgcu

SEQ ID NO: 3753094 - RNA, 16 nt, Salmonella typhimurium LT2
cagcaccugaauaaug

SEQ ID NO: 3753095 - RNA, 12 nt, Salmonella typhimurium LT2
cagcaccugcuc

SEQ ID NO: 3753096 - RNA, 13 nt, Salmonella typhimurium LT2
cagcaccuugccg

SEQ ID NO: 3753097 - RNA, 17 nt, Salmonella typhimurium LT2
cagcaccuugccguccg

SEQ ID NO: 3753098 - RNA, 15 nt, Salmonella typhimurium LT2
cagcacgacagagau

SEQ ID NO: 3753099 - RNA, 17 nt, Salmonella typhimurium LT2
cagcacgcacagcggau

SEQ ID NO: 3753100 - RNA, 12 nt, Salmonella typhimurium LT2
cagcacgccacc

SEQ ID NO: 3753101 - RNA, 18 nt, Salmonella typhimurium LT2
cagcacgccggaaagaau

SEQ ID NO: 3753102 - RNA, 14 nt, Salmonella typhimurium LT2
cagcacgcggaaca

SEQ ID NO: 3753103 - RNA, 15 nt, Salmonella typhimurium LT2
cagcacgcggaacac

SEQ ID NO: 3753104 - RNA, 17 nt, Salmonella typhimurium LT2
cagcacgcuuacccagc

SEQ ID NO: 3753105 - RNA, 15 nt, Salmonella typhimurium LT2
cagcacguuauucuc

SEQ ID NO: 3753106 - RNA, 19 nt, Salmonella typhimurium LT2
cagcacuaacgaggccacc

SEQ ID NO: 3753107 - RNA, 12 nt, Salmonella typhimurium LT2
cagcacuacagc

SEQ ID NO: 3753108 - RNA, 22 nt, Salmonella typhimurium LT2
cagcacuacggauggcccugcc

SEQ ID NO: 3753109 - RNA, 14 nt, Salmonella typhimurium LT2
cagcacuacggcaa

SEQ ID NO: 3753110 - RNA, 20 nt, Salmonella typhimurium LT2
cagcacuucccacuguaaau

SEQ ID NO: 3753111 - RNA, 17 nt, Salmonella typhimurium LT2
cagcacuucgcugauac

SEQ ID NO: 3753112 - RNA, 14 nt, Salmonella typhimurium LT2
cagcagaaacuggc

SEQ ID NO: 3753113 - RNA, 19 nt, Salmonella typhimurium LT2
cagcagaacaaccagugcg

SEQ ID NO: 3753114 - RNA, 14 nt, Salmonella typhimurium LT2
cagcagacagguga

SEQ ID NO: 3753115 - RNA, 23 nt, Salmonella typhimurium LT2
cagcagacgagaaacgcuuucug

SEQ ID NO: 3753116 - RNA, 20 nt, Salmonella typhimurium LT2
cagcagacuauccgcgcgcc

SEQ ID NO: 3753117 - RNA, 20 nt, Salmonella typhimurium LT2
cagcagacugccuacgcggc

SEQ ID NO: 3753118 - RNA, 14 nt, Salmonella typhimurium LT2
cagcagauaauuuu

SEQ ID NO: 3753119 - RNA, 24 nt, Salmonella typhimurium LT2
cagcagauaauuuuucagacguca

SEQ ID NO: 3753120 - RNA, 13 nt, Salmonella typhimurium LT2
cagcagcagacag

SEQ ID NO: 3753121 - RNA, 13 nt, Salmonella typhimurium LT2
cagcagcagcagc

SEQ ID NO: 3753122 - RNA, 13 nt, Salmonella typhimurium LT2
cagcagcagcgua

SEQ ID NO: 3753123 - RNA, 15 nt, Salmonella typhimurium LT2
cagcagcaugaugga

SEQ ID NO: 3753124 - RNA, 12 nt, Salmonella typhimurium LT2
cagcagccaggu

SEQ ID NO: 3753125 - RNA, 15 nt, Salmonella typhimurium LT2
cagcagccaugccag

SEQ ID NO: 3753126 - RNA, 20 nt, Salmonella typhimurium LT2
cagcagccgggccagacgcu

SEQ ID NO: 3753127 - RNA, 22 nt, Salmonella typhimurium LT2
cagcagcgacguaaugaucagc

SEQ ID NO: 3753128 - RNA, 15 nt, Salmonella typhimurium LT2
cagcagcgagauggc

SEQ ID NO: 3753129 - RNA, 17 nt, Salmonella typhimurium LT2
cagcagcgcgccgacaa

SEQ ID NO: 3753130 - RNA, 14 nt, Salmonella typhimurium LT2
cagcagcgcggcgu

SEQ ID NO: 3753131 - RNA, 20 nt, Salmonella typhimurium LT2
cagcagcgcuuucuucuuca

SEQ ID NO: 3753132 - RNA, 22 nt, Salmonella typhimurium LT2
cagcagcgcuuucuucuucacg

SEQ ID NO: 3753133 - RNA, 17 nt, Salmonella typhimurium LT2
cagcagcggaaucgcuu

SEQ ID NO: 3753134 - RNA, 14 nt, Salmonella typhimurium LT2
cagcagcuccagag

SEQ ID NO: 3753135 - RNA, 13 nt, Salmonella typhimurium LT2
cagcagcugcugu

SEQ ID NO: 3753136 - RNA, 16 nt, Salmonella typhimurium LT2
cagcagcuucgccaga

SEQ ID NO: 3753137 - RNA, 19 nt, Salmonella typhimurium LT2
cagcagcuucgccagaugc

SEQ ID NO: 3753138 - RNA, 17 nt, Salmonella typhimurium LT2
cagcagcuugcgaucca

SEQ ID NO: 3753139 - RNA, 22 nt, Salmonella typhimurium LT2
cagcaggacaaccccuacgcag

SEQ ID NO: 3753140 - RNA, 16 nt, Salmonella typhimurium LT2
cagcaggacgcgcacu

SEQ ID NO: 3753141 - RNA, 14 nt, Salmonella typhimurium LT2
cagcaggcagacgc

SEQ ID NO: 3753142 - RNA, 14 nt, Salmonella typhimurium LT2
cagcaggccuccga

SEQ ID NO: 3753143 - RNA, 21 nt, Salmonella typhimurium LT2
cagcagggauauacaaauauc

SEQ ID NO: 3753144 - RNA, 20 nt, Salmonella typhimurium LT2
cagcagggcguuuuccagcg

SEQ ID NO: 3753145 - RNA, 21 nt, Salmonella typhimurium LT2
cagcagggucaggaacugcgg

SEQ ID NO: 3753146 - RNA, 20 nt, Salmonella typhimurium LT2
cagcaggucgcacuccucug

SEQ ID NO: 3753147 - RNA, 18 nt, Salmonella typhimurium LT2
cagcaguggcucagucag

SEQ ID NO: 3753148 - RNA, 14 nt, Salmonella typhimurium LT2
cagcaguucuacgc

SEQ ID NO: 3753149 - RNA, 21 nt, Salmonella typhimurium LT2
cagcauaaaaccgccgcccau

SEQ ID NO: 3753150 - RNA, 19 nt, Salmonella typhimurium LT2
cagcauaauaaagcagcgg

SEQ ID NO: 3753151 - RNA, 23 nt, Salmonella typhimurium LT2
cagcauaauauucauaacgccga

SEQ ID NO: 3753152 - RNA, 15 nt, Salmonella typhimurium LT2
cagcauacaaagcag

SEQ ID NO: 3753153 - RNA, 16 nt, Salmonella typhimurium LT2
cagcauacaaagcaga

SEQ ID NO: 3753154 - RNA, 21 nt, Salmonella typhimurium LT2
cagcauacaaagcagauagag

SEQ ID NO: 3753155 - RNA, 14 nt, Salmonella typhimurium LT2
cagcauacgccgcu

SEQ ID NO: 3753156 - RNA, 21 nt, Salmonella typhimurium LT2
cagcauacgccgcuggugcug

SEQ ID NO: 3753157 - RNA, 21 nt, Salmonella typhimurium LT2
cagcauacugaugucguugua

SEQ ID NO: 3753158 - RNA, 14 nt, Salmonella typhimurium LT2
cagcauagucgcuc

SEQ ID NO: 3753159 - RNA, 14 nt, Salmonella typhimurium LT2
cagcauauccagcg

SEQ ID NO: 3753160 - RNA, 16 nt, Salmonella typhimurium LT2
cagcauauccagcgcc

SEQ ID NO: 3753161 - RNA, 17 nt, Salmonella typhimurium LT2
cagcauauccagcgccu

SEQ ID NO: 3753162 - RNA, 18 nt, Salmonella typhimurium LT2
cagcauauuuuccggcgu

SEQ ID NO: 3753163 - RNA, 20 nt, Salmonella typhimurium LT2
cagcaucaauagcagcuuca

SEQ ID NO: 3753164 - RNA, 13 nt, Salmonella typhimurium LT2
cagcaucaccaua

SEQ ID NO: 3753165 - RNA, 14 nt, Salmonella typhimurium LT2
cagcaucaucuccc

SEQ ID NO: 3753166 - RNA, 22 nt, Salmonella typhimurium LT2
cagcaucaucucccaggccgcc

SEQ ID NO: 3753167 - RNA, 15 nt, Salmonella typhimurium LT2
cagcaucauggcaua

SEQ ID NO: 3753168 - RNA, 19 nt, Salmonella typhimurium LT2
cagcauccacgccacaaua

SEQ ID NO: 3753169 - RNA, 23 nt, Salmonella typhimurium LT2
cagcccuuucaggaauuuaucaa

SEQ ID NO: 3753170 - RNA, 18 nt, Salmonella typhimurium LT2
cagccgaauggcugccuu

SEQ ID NO: 3753171 - RNA, 16 nt, Salmonella typhimurium LT2
cagccgauaacucuuc

SEQ ID NO: 3753172 - RNA, 22 nt, Salmonella typhimurium LT2
cagccgauaacucuucaucgcg

SEQ ID NO: 3753173 - RNA, 14 nt, Salmonella typhimurium LT2
cagccgaucaucgu

SEQ ID NO: 3753174 - RNA, 22 nt, Salmonella typhimurium LT2
cagccgaucguucaccgcacug

SEQ ID NO: 3753175 - RNA, 17 nt, Salmonella typhimurium LT2
cagccgaucuauuucau

SEQ ID NO: 3753176 - RNA, 21 nt, Salmonella typhimurium LT2
cagccgauuuuucggcgcgcu

SEQ ID NO: 3753177 - RNA, 13 nt, Salmonella typhimurium LT2
cagccgcagccac

SEQ ID NO: 3753178 - RNA, 19 nt, Salmonella typhimurium LT2
cagccgcagccaccccggc

SEQ ID NO: 3753179 - RNA, 21 nt, Salmonella typhimurium LT2
cagccgcauaauagcgccaga

SEQ ID NO: 3753180 - RNA, 13 nt, Salmonella typhimurium LT2
cagccgccaaaaa

SEQ ID NO: 3753181 - RNA, 12 nt, Salmonella typhimurium LT2
cagccgccacca

SEQ ID NO: 3753182 - RNA, 17 nt, Salmonella typhimurium LT2
cagccgccaccacaaag

SEQ ID NO: 3753183 - RNA, 12 nt, Salmonella typhimurium LT2
cagccgccaguu

SEQ ID NO: 3753184 - RNA, 22 nt, Salmonella typhimurium LT2
cagccgccaguuugguuaauuc

SEQ ID NO: 3753185 - RNA, 18 nt, Salmonella typhimurium LT2
cagccgccaucaggcaug

SEQ ID NO: 3753186 - RNA, 17 nt, Salmonella typhimurium LT2
cagccgccauccggcac

SEQ ID NO: 3753187 - RNA, 14 nt, Salmonella typhimurium LT2
cagccgcccgcgau

SEQ ID NO: 3753188 - RNA, 13 nt, Salmonella typhimurium LT2
cagccgcgaugau

SEQ ID NO: 3753189 - RNA, 23 nt, Salmonella typhimurium LT2
cagccgcucaauaauauccugcc

SEQ ID NO: 3753190 - RNA, 19 nt, Salmonella typhimurium LT2
cagccggaacgggcaugac

SEQ ID NO: 3753191 - RNA, 16 nt, Salmonella typhimurium LT2
cagccggauuuuaaau

SEQ ID NO: 3753192 - RNA, 15 nt, Salmonella typhimurium LT2
cagccgggcaggaaa

SEQ ID NO: 3753193 - RNA, 16 nt, Salmonella typhimurium LT2
cagccgggcaggaaaa

SEQ ID NO: 3753194 - RNA, 18 nt, Salmonella typhimurium LT2
cagccgggcauaugauua

SEQ ID NO: 3753195 - RNA, 16 nt, Salmonella typhimurium LT2
cagccgguauccagcg

SEQ ID NO: 3753196 - RNA, 14 nt, Salmonella typhimurium LT2
cagccggucagcgu

SEQ ID NO: 3753197 - RNA, 17 nt, Salmonella typhimurium LT2
cagccggugcucgccgu

SEQ ID NO: 3753198 - RNA, 15 nt, Salmonella typhimurium LT2
cagccguaccacccg

SEQ ID NO: 3753199 - RNA, 14 nt, Salmonella typhimurium LT2
cagccguaccugca

SEQ ID NO: 3753200 - RNA, 15 nt, Salmonella typhimurium LT2
cagccgucuuucccg

SEQ ID NO: 3753201 - RNA, 14 nt, Salmonella typhimurium LT2
cagccgugagcaga

SEQ ID NO: 3753202 - RNA, 16 nt, Salmonella typhimurium LT2
cagccguuucuugucu

SEQ ID NO: 3753203 - RNA, 15 nt, Salmonella typhimurium LT2
cagccuaguucugcg

SEQ ID NO: 3753204 - RNA, 14 nt, Salmonella typhimurium LT2
cagccuaucgccau

SEQ ID NO: 3753205 - RNA, 20 nt, Salmonella typhimurium LT2
cagccugagcgccagcgugc

SEQ ID NO: 3753206 - RNA, 21 nt, Salmonella typhimurium LT2
cagccugaggaugauacugcu

SEQ ID NO: 3753207 - RNA, 23 nt, Salmonella typhimurium LT2
cagccugcccgccugauuuccca

SEQ ID NO: 3753208 - RNA, 12 nt, Salmonella typhimurium LT2
cagccugccguc

SEQ ID NO: 3753209 - RNA, 19 nt, Salmonella typhimurium LT2
cagccuggagagcagcgcc

SEQ ID NO: 3753210 - RNA, 15 nt, Salmonella typhimurium LT2
cagccuggcugaacc

SEQ ID NO: 3753211 - RNA, 15 nt, Salmonella typhimurium LT2
cagccuguccagaua

SEQ ID NO: 3753212 - RNA, 20 nt, Salmonella typhimurium LT2
cagccuuaaucaacugcgcc

SEQ ID NO: 3753213 - RNA, 18 nt, Salmonella typhimurium LT2
cagccuucggacugcugg

SEQ ID NO: 3753214 - RNA, 18 nt, Salmonella typhimurium LT2
cagccuuuucauauggaa

SEQ ID NO: 3753215 - RNA, 13 nt, Salmonella typhimurium LT2
cagccuuuuucuc

SEQ ID NO: 3753216 - RNA, 14 nt, Salmonella typhimurium LT2
cagcgaaaugacag

SEQ ID NO: 3753217 - RNA, 18 nt, Salmonella typhimurium LT2
cagcgaaaugacagccac

SEQ ID NO: 3753218 - RNA, 22 nt, Salmonella typhimurium LT2
cagcgaaaugacagccaccagc

SEQ ID NO: 3753219 - RNA, 14 nt, Salmonella typhimurium LT2
cagcgaauaaugaa

SEQ ID NO: 3753220 - RNA, 21 nt, Salmonella typhimurium LT2
cagcgaauuccggccaucaga

SEQ ID NO: 3753221 - RNA, 15 nt, Salmonella typhimurium LT2
cagcgacacuccgcg

SEQ ID NO: 3753222 - RNA, 19 nt, Salmonella typhimurium LT2
cagcgacacuccgcgcaug

SEQ ID NO: 3753223 - RNA, 22 nt, Salmonella typhimurium LT2
cagcgacagccaguaaugcugu

SEQ ID NO: 3753224 - RNA, 15 nt, Salmonella typhimurium LT2
cagcgacaggcuguc

SEQ ID NO: 3753225 - RNA, 19 nt, Salmonella typhimurium LT2
cagcgaccacgacgccgga

SEQ ID NO: 3753226 - RNA, 16 nt, Salmonella typhimurium LT2
cagcgaccacgccacc

SEQ ID NO: 3753227 - RNA, 23 nt, Salmonella typhimurium LT2
cagcgacccuucauacugcggau

SEQ ID NO: 3753228 - RNA, 13 nt, Salmonella typhimurium LT2
cagcgacgccaga

SEQ ID NO: 3753229 - RNA, 15 nt, Salmonella typhimurium LT2
cagcgacgccagauu

SEQ ID NO: 3753230 - RNA, 15 nt, Salmonella typhimurium LT2
cagcgacgcccagug

SEQ ID NO: 3753231 - RNA, 20 nt, Salmonella typhimurium LT2
cagcgacggaaccgucuugu

SEQ ID NO: 3753232 - RNA, 16 nt, Salmonella typhimurium LT2
cagcgacguaaugauc

SEQ ID NO: 3753233 - RNA, 22 nt, Salmonella typhimurium LT2
cagcgacguaaugaucagcgcu

SEQ ID NO: 3753234 - RNA, 23 nt, Salmonella typhimurium LT2
cagcgacguaaugaucagcgcuc

SEQ ID NO: 3753235 - RNA, 14 nt, Salmonella typhimurium LT2
cagcgacucauuca

SEQ ID NO: 3753236 - RNA, 14 nt, Salmonella typhimurium LT2
cagcgacucgcugg

SEQ ID NO: 3753237 - RNA, 20 nt, Salmonella typhimurium LT2
cagcgacuucaggcgcuaag

SEQ ID NO: 3753238 - RNA, 15 nt, Salmonella typhimurium LT2
cagcgagaagucggc

SEQ ID NO: 3753239 - RNA, 15 nt, Salmonella typhimurium LT2
cagcgagauggcuuu

SEQ ID NO: 3753240 - RNA, 19 nt, Salmonella typhimurium LT2
cagcgagcgcauacgcugu

SEQ ID NO: 3753241 - RNA, 17 nt, Salmonella typhimurium LT2
cagcgagcuacaggugc

SEQ ID NO: 3753242 - RNA, 19 nt, Salmonella typhimurium LT2
cagcgaggaaaacgcuucu

SEQ ID NO: 3753243 - RNA, 21 nt, Salmonella typhimurium LT2
cagcgaguuacguugcggcgu

SEQ ID NO: 3753244 - RNA, 17 nt, Salmonella typhimurium LT2
cagcgauaaacgccagc

SEQ ID NO: 3753245 - RNA, 14 nt, Salmonella typhimurium LT2
cagcgauauuucuc

SEQ ID NO: 3753246 - RNA, 16 nt, Salmonella typhimurium LT2
cagcgauauuucuccg

SEQ ID NO: 3753247 - RNA, 19 nt, Salmonella typhimurium LT2
cagcgauauuucuccgccc

SEQ ID NO: 3753248 - RNA, 24 nt, Salmonella typhimurium LT2
cagcgaucaggcgucagcggcuga

SEQ ID NO: 3753249 - RNA, 23 nt, Salmonella typhimurium LT2
cagcgaucccaauugaucggcca

SEQ ID NO: 3753250 - RNA, 13 nt, Salmonella typhimurium LT2
cagcgauccugcg

SEQ ID NO: 3753251 - RNA, 19 nt, Salmonella typhimurium LT2
cagcgaucugucgccgcgu

SEQ ID NO: 3753252 - RNA, 18 nt, Salmonella typhimurium LT2
cagcgaugagcgccagca

SEQ ID NO: 3753253 - RNA, 13 nt, Salmonella typhimurium LT2
cagcgauugacgg

SEQ ID NO: 3753254 - RNA, 22 nt, Salmonella typhimurium LT2
cagcgcaaacgacgcugacuca

SEQ ID NO: 3753255 - RNA, 13 nt, Salmonella typhimurium LT2
cagcgcaaacuca

SEQ ID NO: 3753256 - RNA, 14 nt, Salmonella typhimurium LT2
cagcgcaaccugcg

SEQ ID NO: 3753257 - RNA, 12 nt, Salmonella typhimurium LT2
cagcgcaacgcc

SEQ ID NO: 3753258 - RNA, 22 nt, Salmonella typhimurium LT2
cagcgcaacgccuucguccggg

SEQ ID NO: 3753259 - RNA, 12 nt, Salmonella typhimurium LT2
cagcgcaacgcg

SEQ ID NO: 3753260 - RNA, 14 nt, Salmonella typhimurium LT2
cagcgcaaucugcu

SEQ ID NO: 3753261 - RNA, 16 nt, Salmonella typhimurium LT2
cagcgcaaucugcucg

SEQ ID NO: 3753262 - RNA, 16 nt, Salmonella typhimurium LT2
cagcgcaccaaaguua

SEQ ID NO: 3753263 - RNA, 19 nt, Salmonella typhimurium LT2
cagcgcaccaaaguuaauc

SEQ ID NO: 3753264 - RNA, 16 nt, Salmonella typhimurium LT2
cagcgcagcguggccu

SEQ ID NO: 3753265 - RNA, 15 nt, Salmonella typhimurium LT2
cagcgcaggcaacgc

SEQ ID NO: 3753266 - RNA, 17 nt, Salmonella typhimurium LT2
cagcgcagucagugaaa

SEQ ID NO: 3753267 - RNA, 14 nt, Salmonella typhimurium LT2
cagcgcauacgcuu

SEQ ID NO: 3753268 - RNA, 12 nt, Salmonella typhimurium LT2
cagcgcauccac

SEQ ID NO: 3753269 - RNA, 15 nt, Salmonella typhimurium LT2
cagcgcauggacguc

SEQ ID NO: 3753270 - RNA, 19 nt, Salmonella typhimurium LT2
cagcgcauuaccgccgccu

SEQ ID NO: 3753271 - RNA, 15 nt, Salmonella typhimurium LT2
cagcgcauucguaau

SEQ ID NO: 3753272 - RNA, 21 nt, Salmonella typhimurium LT2
cagcgccaacgccacugccau

SEQ ID NO: 3753273 - RNA, 20 nt, Salmonella typhimurium LT2
cagcgguuacuuuugaacau

SEQ ID NO: 3753274 - RNA, 15 nt, Salmonella typhimurium LT2
cagcgguugcaugaa

SEQ ID NO: 3753275 - RNA, 22 nt, Salmonella typhimurium LT2
cagcgguuggaucucaccacug

SEQ ID NO: 3753276 - RNA, 18 nt, Salmonella typhimurium LT2
cagcguaaaacuuuucug

SEQ ID NO: 3753277 - RNA, 22 nt, Salmonella typhimurium LT2
cagcguaagaauucguccagau

SEQ ID NO: 3753278 - RNA, 17 nt, Salmonella typhimurium LT2
cagcguaauacaggcga

SEQ ID NO: 3753279 - RNA, 22 nt, Salmonella typhimurium LT2
cagcguaaugcgccaggcagca

SEQ ID NO: 3753280 - RNA, 16 nt, Salmonella typhimurium LT2
cagcguaauggccacc

SEQ ID NO: 3753281 - RNA, 21 nt, Salmonella typhimurium LT2
cagcguacaauggcaggcaua

SEQ ID NO: 3753282 - RNA, 21 nt, Salmonella typhimurium LT2
cagcguacugccaaagcgaug

SEQ ID NO: 3753283 - RNA, 20 nt, Salmonella typhimurium LT2
cagcguaggccaggcauccg

SEQ ID NO: 3753284 - RNA, 21 nt, Salmonella typhimurium LT2
cagcguaguuuauucuucucc

SEQ ID NO: 3753285 - RNA, 18 nt, Salmonella typhimurium LT2
cagcguauuaagccaacg

SEQ ID NO: 3753286 - RNA, 13 nt, Salmonella typhimurium LT2
cagcgucaacugc

SEQ ID NO: 3753287 - RNA, 20 nt, Salmonella typhimurium LT2
cagcgucaacugcgccugcu

SEQ ID NO: 3753288 - RNA, 17 nt, Salmonella typhimurium LT2
cagcgucacaggcuucg

SEQ ID NO: 3753289 - RNA, 20 nt, Salmonella typhimurium LT2
cagcgucaggaacgcggcgc

SEQ ID NO: 3753290 - RNA, 14 nt, Salmonella typhimurium LT2
cagcgucgccagua

SEQ ID NO: 3753291 - RNA, 15 nt, Salmonella typhimurium LT2
cagcgucgccaugcg

SEQ ID NO: 3753292 - RNA, 15 nt, Salmonella typhimurium LT2
cagcgucgcuaccag

SEQ ID NO: 3753293 - RNA, 22 nt, Salmonella typhimurium LT2
cagcgucuccagacaauccgcg

SEQ ID NO: 3753294 - RNA, 22 nt, Salmonella typhimurium LT2
cagcgucugccccaaacgcuca

SEQ ID NO: 3753295 - RNA, 18 nt, Salmonella typhimurium LT2
cagcgucugcccuccuga

SEQ ID NO: 3753296 - RNA, 14 nt, Salmonella typhimurium LT2
cagcgucuguuuca

SEQ ID NO: 3753297 - RNA, 15 nt, Salmonella typhimurium LT2
cagcgugacccagac

SEQ ID NO: 3753298 - RNA, 15 nt, Salmonella typhimurium LT2
cagcgugcagauggu

SEQ ID NO: 3753299 - RNA, 15 nt, Salmonella typhimurium LT2
cagcgugcguaugac

SEQ ID NO: 3753300 - RNA, 20 nt, Salmonella typhimurium LT2
cagcgugcguaugacgcaca

SEQ ID NO: 3753301 - RNA, 16 nt, Salmonella typhimurium LT2
cagcguggaugaacuc

SEQ ID NO: 3753302 - RNA, 18 nt, Salmonella typhimurium LT2
cagcguguaaucgccgua

SEQ ID NO: 3753303 - RNA, 14 nt, Salmonella typhimurium LT2
cagcguguacggcc

SEQ ID NO: 3753304 - RNA, 15 nt, Salmonella typhimurium LT2
cagcguuacguuaag

SEQ ID NO: 3753305 - RNA, 14 nt, Salmonella typhimurium LT2
cagcguugaccagc

SEQ ID NO: 3753306 - RNA, 18 nt, Salmonella typhimurium LT2
cagcguugcagccacguu

SEQ ID NO: 3753307 - RNA, 14 nt, Salmonella typhimurium LT2
cagcguuggccgcc

SEQ ID NO: 3753308 - RNA, 13 nt, Salmonella typhimurium LT2
cagcguuuccagc

SEQ ID NO: 3753309 - RNA, 16 nt, Salmonella typhimurium LT2
cagcuauagacgacau

SEQ ID NO: 3753310 - RNA, 19 nt, Salmonella typhimurium LT2
cagcuauuuuucaccauaa

SEQ ID NO: 3753311 - RNA, 19 nt, Salmonella typhimurium LT2
cagcucaaccgcgcggcgu

SEQ ID NO: 3753312 - RNA, 22 nt, Salmonella typhimurium LT2
cagcucaaccgcgcggcguucu

SEQ ID NO: 3753313 - RNA, 16 nt, Salmonella typhimurium LT2
cagcucaagcgccgcg

SEQ ID NO: 3753314 - RNA, 18 nt, Salmonella typhimurium LT2
cagcucaauaucauagug

SEQ ID NO: 3753315 - RNA, 18 nt, Salmonella typhimurium LT2
cagcucaccgagacugcc

SEQ ID NO: 3753316 - RNA, 19 nt, Salmonella typhimurium LT2
cagcucagcgccccagcca

SEQ ID NO: 3753317 - RNA, 22 nt, Salmonella typhimurium LT2
cagcucaggguuuucuaccgca

SEQ ID NO: 3753318 - RNA, 17 nt, Salmonella typhimurium LT2
cagcucauaaacgcgau

SEQ ID NO: 3753319 - RNA, 17 nt, Salmonella typhimurium LT2
cagcucauacccuucca

SEQ ID NO: 3753320 - RNA, 17 nt, Salmonella typhimurium LT2
cagcucaucgaaccuau

SEQ ID NO: 3753321 - RNA, 17 nt, Salmonella typhimurium LT2
cagcucaugcgcggcgg

SEQ ID NO: 3753322 - RNA, 17 nt, Salmonella typhimurium LT2
cagcucauuuuuacaga

SEQ ID NO: 3753323 - RNA, 21 nt, Salmonella typhimurium LT2
cagcucauuuuuacagacacg

SEQ ID NO: 3753324 - RNA, 14 nt, Salmonella typhimurium LT2
cagcuccacaaaua

SEQ ID NO: 3753325 - RNA, 23 nt, Salmonella typhimurium LT2
cagcuccagcucaggguccccau

SEQ ID NO: 3753326 - RNA, 18 nt, Salmonella typhimurium LT2
cagcuccauccaccagcc

SEQ ID NO: 3753327 - RNA, 13 nt, Salmonella typhimurium LT2
cagcuccaugucu

SEQ ID NO: 3753328 - RNA, 15 nt, Salmonella typhimurium LT2
cagcuccccgccgcg

SEQ ID NO: 3753329 - RNA, 16 nt, Salmonella typhimurium LT2
cagcuccccgccgcgg

SEQ ID NO: 3753330 - RNA, 18 nt, Salmonella typhimurium LT2
cagcucccgcgucacgac

SEQ ID NO: 3753331 - RNA, 17 nt, Salmonella typhimurium LT2
cagcucgacgacguggg

SEQ ID NO: 3753332 - RNA, 13 nt, Salmonella typhimurium LT2
cagcucgcacuga

SEQ ID NO: 3753333 - RNA, 22 nt, Salmonella typhimurium LT2
cagcucgcacugauagccgcca

SEQ ID NO: 3753334 - RNA, 17 nt, Salmonella typhimurium LT2
cagcucgucggccagcg

SEQ ID NO: 3753335 - RNA, 18 nt, Salmonella typhimurium LT2
cagcucgucggccagcgc

SEQ ID NO: 3753336 - RNA, 16 nt, Salmonella typhimurium LT2
cagcucguuauuuccg

SEQ ID NO: 3753337 - RNA, 23 nt, Salmonella typhimurium LT2
cagcucuucgccguuaucggccu

SEQ ID NO: 3753338 - RNA, 18 nt, Salmonella typhimurium LT2
cagcucuuuaggcaggaa

SEQ ID NO: 3753339 - RNA, 19 nt, Salmonella typhimurium LT2
cagcucuuugguccauaac

SEQ ID NO: 3753340 - RNA, 13 nt, Salmonella typhimurium LT2
cagcucuuuucug

SEQ ID NO: 3753341 - RNA, 18 nt, Salmonella typhimurium LT2
cagcugaaacagaauaaa

SEQ ID NO: 3753342 - RNA, 19 nt, Salmonella typhimurium LT2
cagcugacgcagcagcucc

SEQ ID NO: 3753343 - RNA, 19 nt, Salmonella typhimurium LT2
cagcugagcuaaucaccca

SEQ ID NO: 3753344 - RNA, 15 nt, Salmonella typhimurium LT2
cagcugauugggaua

SEQ ID NO: 3753345 - RNA, 15 nt, Salmonella typhimurium LT2
cagcugcgacagcga

SEQ ID NO: 3753346 - RNA, 11 nt, Salmonella typhimurium LT2
cagcugcugcg

SEQ ID NO: 3753347 - RNA, 19 nt, Salmonella typhimurium LT2
cagcugcugcgcuuuccag

SEQ ID NO: 3753348 - RNA, 21 nt, Salmonella typhimurium LT2
cagcugcugcgcuuuccaggc

SEQ ID NO: 3753349 - RNA, 22 nt, Salmonella typhimurium LT2
cagcuggguuuugucgguaaug

SEQ ID NO: 3753350 - RNA, 19 nt, Salmonella typhimurium LT2
cagcuguccauaccggacu

SEQ ID NO: 3753351 - RNA, 21 nt, Salmonella typhimurium LT2
cagcuguccggcuacaggcgu

SEQ ID NO: 3753352 - RNA, 20 nt, Salmonella typhimurium LT2
cagcuguuuaagcgccucca

SEQ ID NO: 3753353 - RNA, 18 nt, Salmonella typhimurium LT2
cagcuuaauuguugcgug

SEQ ID NO: 3753354 - RNA, 17 nt, Salmonella typhimurium LT2
cagcuuaucugaccaug

SEQ ID NO: 3753355 - RNA, 20 nt, Salmonella typhimurium LT2
cagcuucacgaagucuggcu

SEQ ID NO: 3753356 - RNA, 21 nt, Salmonella typhimurium LT2
cagcuucacgcgcuguaacuu

SEQ ID NO: 3753357 - RNA, 16 nt, Salmonella typhimurium LT2
cagcuucaucaucagc

SEQ ID NO: 3753358 - RNA, 10 nt, Salmonella typhimurium LT2
cagcuuccag

SEQ ID NO: 3753359 - RNA, 12 nt, Salmonella typhimurium LT2
cagcuuccugua

SEQ ID NO: 3753360 - RNA, 19 nt, Salmonella typhimurium LT2
cagcuuccuguacgccugc

SEQ ID NO: 3753361 - RNA, 17 nt, Salmonella typhimurium LT2
cagcuucgguccggcgc

SEQ ID NO: 3753362 - RNA, 18 nt, Salmonella typhimurium LT2
cagcuugaucaucagggc

SEQ ID NO: 3753363 - RNA, 17 nt, Salmonella typhimurium LT2
cagcuugccuuguuucg

SEQ ID NO: 3753364 - RNA, 18 nt, Salmonella typhimurium LT2
cagcuuguuauccaucag

SEQ ID NO: 3753365 - RNA, 14 nt, Salmonella typhimurium LT2
cagcuuguuuacgc

SEQ ID NO: 3753366 - RNA, 17 nt, Salmonella typhimurium LT2
caggaaaaacugucccu

SEQ ID NO: 3753367 - RNA, 21 nt, Salmonella typhimurium LT2
caggaaaccgguaaaggcgac

SEQ ID NO: 3753368 - RNA, 12 nt, Salmonella typhimurium LT2
caggaaacuggc

SEQ ID NO: 3753369 - RNA, 16 nt, Salmonella typhimurium LT2
caggaaagagccgcgc

SEQ ID NO: 3753370 - RNA, 17 nt, Salmonella typhimurium LT2
caggaaagagccgcgca

SEQ ID NO: 3753371 - RNA, 22 nt, Salmonella typhimurium LT2
caggaaagagccgcgcagcgca

SEQ ID NO: 3753372 - RNA, 21 nt, Salmonella typhimurium LT2
caggaaauccagcagaauaac

SEQ ID NO: 3753373 - RNA, 14 nt, Salmonella typhimurium LT2
caggaaaucuucca

SEQ ID NO: 3753374 - RNA, 16 nt, Salmonella typhimurium LT2
caggaacagauacugg

SEQ ID NO: 3753375 - RNA, 15 nt, Salmonella typhimurium LT2
caggaacaggcccgc

SEQ ID NO: 3753376 - RNA, 15 nt, Salmonella typhimurium LT2
caggaacaucagcau

SEQ ID NO: 3753377 - RNA, 18 nt, Salmonella typhimurium LT2
caggccgucggcgccagc

SEQ ID NO: 3753378 - RNA, 20 nt, Salmonella typhimurium LT2
caggccuacacguucgcuua

SEQ ID NO: 3753379 - RNA, 16 nt, Salmonella typhimurium LT2
caggccuaccagccga

SEQ ID NO: 3753380 - RNA, 16 nt, Salmonella typhimurium LT2
caggccuccugacgaa

SEQ ID NO: 3753381 - RNA, 13 nt, Salmonella typhimurium LT2
caggccucuaucu

SEQ ID NO: 3753382 - RNA, 23 nt, Salmonella typhimurium LT2
caggccugugacguuaacgcagc

SEQ ID NO: 3753383 - RNA, 16 nt, Salmonella typhimurium LT2
caggccuguggugugu

SEQ ID NO: 3753384 - RNA, 13 nt, Salmonella typhimurium LT2
caggcgaaaucaa

SEQ ID NO: 3753385 - RNA, 17 nt, Salmonella typhimurium LT2
caggcgaacuucaucca

SEQ ID NO: 3753386 - RNA, 14 nt, Salmonella typhimurium LT2
caggcgaaggagga

SEQ ID NO: 3753387 - RNA, 16 nt, Salmonella typhimurium LT2
caggcgaauagcgcgc

SEQ ID NO: 3753388 - RNA, 16 nt, Salmonella typhimurium LT2
caggcgaccgggcaga

SEQ ID NO: 3753389 - RNA, 20 nt, Salmonella typhimurium LT2
caggcgacucacgaugagau

SEQ ID NO: 3753390 - RNA, 21 nt, Salmonella typhimurium LT2
caggcgacucauuacgccacg

SEQ ID NO: 3753391 - RNA, 19 nt, Salmonella typhimurium LT2
caggcgauagccguccaug

SEQ ID NO: 3753392 - RNA, 15 nt, Salmonella typhimurium LT2
caggcgauccuguuc

SEQ ID NO: 3753393 - RNA, 18 nt, Salmonella typhimurium LT2
caggcgauccuguucaaa

SEQ ID NO: 3753394 - RNA, 14 nt, Salmonella typhimurium LT2
caggcgaugaauuc

SEQ ID NO: 3753395 - RNA, 19 nt, Salmonella typhimurium LT2
caggcgcaaacgcgugcug

SEQ ID NO: 3753396 - RNA, 13 nt, Salmonella typhimurium LT2
caggcgcaggcau

SEQ ID NO: 3753397 - RNA, 18 nt, Salmonella typhimurium LT2
caggcgcaguugaaaaca

SEQ ID NO: 3753398 - RNA, 18 nt, Salmonella typhimurium LT2
caggcgcccgagcgccgc

SEQ ID NO: 3753399 - RNA, 18 nt, Salmonella typhimurium LT2
caggcgccuuauccggcc

SEQ ID NO: 3753400 - RNA, 22 nt, Salmonella typhimurium LT2
caggcgcgaaucgacaauccgc

SEQ ID NO: 3753401 - RNA, 19 nt, Salmonella typhimurium LT2
caggcgcgaccucaucaaa

SEQ ID NO: 3753402 - RNA, 22 nt, Salmonella typhimurium LT2
caggcgcgaccucaucaaacag

SEQ ID NO: 3753403 - RNA, 15 nt, Salmonella typhimurium LT2
caggcgcggcgcgcu

SEQ ID NO: 3753404 - RNA, 19 nt, Salmonella typhimurium LT2
caggcgcuaaggcaucucu

SEQ ID NO: 3753405 - RNA, 22 nt, Salmonella typhimurium LT2
caggcgcuaucuucaauacgaa

SEQ ID NO: 3753406 - RNA, 18 nt, Salmonella typhimurium LT2
caggcgcuugcgccgcca

SEQ ID NO: 3753407 - RNA, 13 nt, Salmonella typhimurium LT2
caggcggcaauau

SEQ ID NO: 3753408 - RNA, 17 nt, Salmonella typhimurium LT2
caggcggcauggguaaa

SEQ ID NO: 3753409 - RNA, 18 nt, Salmonella typhimurium LT2
caggcggcuucgcauccc

SEQ ID NO: 3753410 - RNA, 19 nt, Salmonella typhimurium LT2
caggcggcuuuuucaucau

SEQ ID NO: 3753411 - RNA, 18 nt, Salmonella typhimurium LT2
caggcggggucaaaaaag

SEQ ID NO: 3753412 - RNA, 22 nt, Salmonella typhimurium LT2
caggcggguauggcgccaauau

SEQ ID NO: 3753413 - RNA, 13 nt, Salmonella typhimurium LT2
caggcggucagca

SEQ ID NO: 3753414 - RNA, 15 nt, Salmonella typhimurium LT2
caggcggucagggug

SEQ ID NO: 3753415 - RNA, 20 nt, Salmonella typhimurium LT2
caggcggugcucuuuuguca

SEQ ID NO: 3753416 - RNA, 18 nt, Salmonella typhimurium LT2
caggcguaagaucccagg

SEQ ID NO: 3753417 - RNA, 23 nt, Salmonella typhimurium LT2
caggcguaauacuucgcucucuu

SEQ ID NO: 3753418 - RNA, 21 nt, Salmonella typhimurium LT2
caggcgucaaaacaggucugu

SEQ ID NO: 3753419 - RNA, 16 nt, Salmonella typhimurium LT2
caggcgucauagccgc

SEQ ID NO: 3753420 - RNA, 22 nt, Salmonella typhimurium LT2
caggcgucauagccgcgcguca

SEQ ID NO: 3753421 - RNA, 22 nt, Salmonella typhimurium LT2
caggcgugaugacuuugacgga

SEQ ID NO: 3753422 - RNA, 17 nt, Salmonella typhimurium LT2
caggcgugauugagcag

SEQ ID NO: 3753423 - RNA, 20 nt, Salmonella typhimurium LT2
caggcguguggcauaaauaa

SEQ ID NO: 3753424 - RNA, 22 nt, Salmonella typhimurium LT2
caggcguguggcauaaauaaac

SEQ ID NO: 3753425 - RNA, 22 nt, Salmonella typhimurium LT2
caggcguugaccgcuucgccuu

SEQ ID NO: 3753426 - RNA, 19 nt, Salmonella typhimurium LT2
caggcguuguccaguaagg

SEQ ID NO: 3753427 - RNA, 17 nt, Salmonella typhimurium LT2
caggcuacccgcaauac

SEQ ID NO: 3753428 - RNA, 23 nt, Salmonella typhimurium LT2
caggcuauaacgcaccaccugca

SEQ ID NO: 3753429 - RNA, 15 nt, Salmonella typhimurium LT2
caggcuaugcucccc

SEQ ID NO: 3753430 - RNA, 16 nt, Salmonella typhimurium LT2
caggcuaugcuccccc

SEQ ID NO: 3753431 - RNA, 14 nt, Salmonella typhimurium LT2
caggcucagcgcca

SEQ ID NO: 3753432 - RNA, 20 nt, Salmonella typhimurium LT2
caggcugaugugcuccauca

SEQ ID NO: 3753433 - RNA, 16 nt, Salmonella typhimurium LT2
caggcuggcaaagcag

SEQ ID NO: 3753434 - RNA, 17 nt, Salmonella typhimurium LT2
caggcuggcgcagccgc

SEQ ID NO: 3753435 - RNA, 22 nt, Salmonella typhimurium LT2
caggcuuaaucccgacgcgcga

SEQ ID NO: 3753436 - RNA, 16 nt, Salmonella typhimurium LT2
caggcuuccugcgcug

SEQ ID NO: 3753437 - RNA, 21 nt, Salmonella typhimurium LT2
caggcuucgguugccugcguc

SEQ ID NO: 3753438 - RNA, 14 nt, Salmonella typhimurium LT2
caggcuugcccauu

SEQ ID NO: 3753439 - RNA, 19 nt, Salmonella typhimurium LT2
caggcuuuaaauucagcac

SEQ ID NO: 3753440 - RNA, 17 nt, Salmonella typhimurium LT2
caggcuuuaguuuccgg

SEQ ID NO: 3753441 - RNA, 16 nt, Salmonella typhimurium LT2
caggcuuuccacguuc

SEQ ID NO: 3753442 - RNA, 15 nt, Salmonella typhimurium LT2
caggcuuuucaggcu

SEQ ID NO: 3753443 - RNA, 16 nt, Salmonella typhimurium LT2
cagggaaaccauguug

SEQ ID NO: 3753444 - RNA, 18 nt, Salmonella typhimurium LT2
cagggaaagaucaaacag

SEQ ID NO: 3753445 - RNA, 15 nt, Salmonella typhimurium LT2
cagggaauaugcuga

SEQ ID NO: 3753446 - RNA, 19 nt, Salmonella typhimurium LT2
cagggaaugccauacuuuu

SEQ ID NO: 3753447 - RNA, 18 nt, Salmonella typhimurium LT2
cagggacaacgcauugcc

SEQ ID NO: 3753448 - RNA, 19 nt, Salmonella typhimurium LT2
cagggacgcauccugcacu

SEQ ID NO: 3753449 - RNA, 16 nt, Salmonella typhimurium LT2
cagggacuccugcgcc

SEQ ID NO: 3753450 - RNA, 19 nt, Salmonella typhimurium LT2
cagggagagugagcaacgu

SEQ ID NO: 3753451 - RNA, 19 nt, Salmonella typhimurium LT2
cagggauuuugcuuuuucg

SEQ ID NO: 3753452 - RNA, 16 nt, Salmonella typhimurium LT2
cagggcauccgccgcc

SEQ ID NO: 3753453 - RNA, 21 nt, Salmonella typhimurium LT2
cagggcaugauuacagauauc

SEQ ID NO: 3753454 - RNA, 16 nt, Salmonella typhimurium LT2
cagggccaaucagaau

SEQ ID NO: 3753455 - RNA, 18 nt, Salmonella typhimurium LT2
cagggccgcgagaacuuc

SEQ ID NO: 3753456 - RNA, 20 nt, Salmonella typhimurium LT2
cagggcgauauccagcgcca

SEQ ID NO: 3753457 - RNA, 16 nt, Salmonella typhimurium LT2
cagggcgaugccccca

SEQ ID NO: 3753458 - RNA, 16 nt, Salmonella typhimurium LT2
cagggcggaagcagau

SEQ ID NO: 3753459 - RNA, 22 nt, Salmonella typhimurium LT2
cagggcggcaggaugaaugacu

SEQ ID NO: 3753460 - RNA, 17 nt, Salmonella typhimurium LT2
cagggcggccuccuggc

SEQ ID NO: 3753461 - RNA, 14 nt, Salmonella typhimurium LT2
cagggcggcgcgcu

SEQ ID NO: 3753462 - RNA, 21 nt, Salmonella typhimurium LT2
cagggcgggauccccugcucc

SEQ ID NO: 3753463 - RNA, 14 nt, Salmonella typhimurium LT2
cagggcguaagcgc

SEQ ID NO: 3753464 - RNA, 16 nt, Salmonella typhimurium LT2
cagggcguagacgacc

SEQ ID NO: 3753465 - RNA, 20 nt, Salmonella typhimurium LT2
cagggcgucccgucccacca

SEQ ID NO: 3753466 - RNA, 18 nt, Salmonella typhimurium LT2
cagggcguuuuccagcgc

SEQ ID NO: 3753467 - RNA, 23 nt, Salmonella typhimurium LT2
cagggcguuuuccagcgcgcgca

SEQ ID NO: 3753468 - RNA, 17 nt, Salmonella typhimurium LT2
cagggcuaacgccggua

SEQ ID NO: 3753469 - RNA, 19 nt, Salmonella typhimurium LT2
cagggcugcuggccuucca

SEQ ID NO: 3753470 - RNA, 15 nt, Salmonella typhimurium LT2
caggggcaguaaauu

SEQ ID NO: 3753471 - RNA, 20 nt, Salmonella typhimurium LT2
caggggcauuuuccggcgac

SEQ ID NO: 3753472 - RNA, 22 nt, Salmonella typhimurium LT2
caggggcgaguuaagcgcccgc

SEQ ID NO: 3753473 - RNA, 19 nt, Salmonella typhimurium LT2
caggggcucuaaaaaggaa

SEQ ID NO: 3753474 - RNA, 19 nt, Salmonella typhimurium LT2
cagggguccuguaacaacu

SEQ ID NO: 3753475 - RNA, 17 nt, Salmonella typhimurium LT2
cagggguguuacgccau

SEQ ID NO: 3753476 - RNA, 17 nt, Salmonella typhimurium LT2
caggguaugaauuuuuu

SEQ ID NO: 3753477 - RNA, 14 nt, Salmonella typhimurium LT2
cagggucaggaacu

SEQ ID NO: 3753478 - RNA, 17 nt, Salmonella typhimurium LT2
caggguccccauauccc

SEQ ID NO: 3753479 - RNA, 15 nt, Salmonella typhimurium LT2
cagggugaaucccgc

SEQ ID NO: 3753480 - RNA, 19 nt, Salmonella typhimurium LT2
cagucccaaugcggaaacc

SEQ ID NO: 3753481 - RNA, 22 nt, Salmonella typhimurium LT2
cagucccaaugcggaaaccagu

SEQ ID NO: 3753482 - RNA, 14 nt, Salmonella typhimurium LT2
caguccccuuuuca

SEQ ID NO: 3753483 - RNA, 17 nt, Salmonella typhimurium LT2
cagucccuguucgccac

SEQ ID NO: 3753484 - RNA, 18 nt, Salmonella typhimurium LT2
cagucccuguucgccacc

SEQ ID NO: 3753485 - RNA, 20 nt, Salmonella typhimurium LT2
cagucccuguucgccacccg

SEQ ID NO: 3753486 - RNA, 17 nt, Salmonella typhimurium LT2
caguccgaugguuaaau

SEQ ID NO: 3753487 - RNA, 21 nt, Salmonella typhimurium LT2
caguccgaugguuaaauugaa

SEQ ID NO: 3753488 - RNA, 16 nt, Salmonella typhimurium LT2
caguccgcacgccugc

SEQ ID NO: 3753489 - RNA, 15 nt, Salmonella typhimurium LT2
caguccgcccgccuc

SEQ ID NO: 3753490 - RNA, 19 nt, Salmonella typhimurium LT2
caguccgcgcgcuuuuuug

SEQ ID NO: 3753491 - RNA, 21 nt, Salmonella typhimurium LT2
caguccgguggcgaaaacgcu

SEQ ID NO: 3753492 - RNA, 16 nt, Salmonella typhimurium LT2
caguccuccggcugaa

SEQ ID NO: 3753493 - RNA, 14 nt, Salmonella typhimurium LT2
caguccugccccug

SEQ ID NO: 3753494 - RNA, 21 nt, Salmonella typhimurium LT2
caguccugccccugccagcgu

SEQ ID NO: 3753495 - RNA, 13 nt, Salmonella typhimurium LT2
cagucgaacuuug

SEQ ID NO: 3753496 - RNA, 16 nt, Salmonella typhimurium LT2
cagucgauguggccuu

SEQ ID NO: 3753497 - RNA, 20 nt, Salmonella typhimurium LT2
cagucgauguggccuuccuc

SEQ ID NO: 3753498 - RNA, 13 nt, Salmonella typhimurium LT2
cagucgccaggca

SEQ ID NO: 3753499 - RNA, 20 nt, Salmonella typhimurium LT2
cagucgcgccgugcccagca

SEQ ID NO: 3753500 - RNA, 12 nt, Salmonella typhimurium LT2
cagucgcugagu

SEQ ID NO: 3753501 - RNA, 22 nt, Salmonella typhimurium LT2
cagucgggaaacucgccgccau

SEQ ID NO: 3753502 - RNA, 22 nt, Salmonella typhimurium LT2
cagucguaguggaucagcagau

SEQ ID NO: 3753503 - RNA, 23 nt, Salmonella typhimurium LT2
cagucgucaucccagucaucguc

SEQ ID NO: 3753504 - RNA, 21 nt, Salmonella typhimurium LT2
cagucucaaacgccugcauca

SEQ ID NO: 3753505 - RNA, 19 nt, Salmonella typhimurium LT2
cagucugcagaccuguucu

SEQ ID NO: 3753506 - RNA, 17 nt, Salmonella typhimurium LT2
cagugaaaaaccgaucu

SEQ ID NO: 3753507 - RNA, 18 nt, Salmonella typhimurium LT2
cagugaaaccggcgcgcc

SEQ ID NO: 3753508 - RNA, 16 nt, Salmonella typhimurium LT2
cagugaacacccugcc

SEQ ID NO: 3753509 - RNA, 22 nt, Salmonella typhimurium LT2
cagugaacguucacuaacccgc

SEQ ID NO: 3753510 - RNA, 18 nt, Salmonella typhimurium LT2
cagugaaucgcaucauaa

SEQ ID NO: 3753511 - RNA, 22 nt, Salmonella typhimurium LT2
cagugaauguccccugacagag

SEQ ID NO: 3753512 - RNA, 18 nt, Salmonella typhimurium LT2
cagugaauuaugaccaau

SEQ ID NO: 3753513 - RNA, 17 nt, Salmonella typhimurium LT2
cagugacagaggaauga

SEQ ID NO: 3753514 - RNA, 15 nt, Salmonella typhimurium LT2
cagugaccagcauca

SEQ ID NO: 3753515 - RNA, 13 nt, Salmonella typhimurium LT2
cagugauaaagcc

SEQ ID NO: 3753516 - RNA, 22 nt, Salmonella typhimurium LT2
cagugauccaucgguucucugc

SEQ ID NO: 3753517 - RNA, 16 nt, Salmonella typhimurium LT2
cagugauggauuucac

SEQ ID NO: 3753518 - RNA, 23 nt, Salmonella typhimurium LT2
cagugauggauuucacaaucauc

SEQ ID NO: 3753519 - RNA, 15 nt, Salmonella typhimurium LT2
cagugauuacaaaau

SEQ ID NO: 3753520 - RNA, 20 nt, Salmonella typhimurium LT2
cagugauuacaaaaugugca

SEQ ID NO: 3753521 - RNA, 17 nt, Salmonella typhimurium LT2
cagugcaaacucaccug

SEQ ID NO: 3753522 - RNA, 13 nt, Salmonella typhimurium LT2
cagugcaaaggcc

SEQ ID NO: 3753523 - RNA, 16 nt, Salmonella typhimurium LT2
cagugcaacagagagc

SEQ ID NO: 3753524 - RNA, 14 nt, Salmonella typhimurium LT2
cagugcaacgccuu

SEQ ID NO: 3753525 - RNA, 23 nt, Salmonella typhimurium LT2
cagugcaguauugcaccaggaag

SEQ ID NO: 3753526 - RNA, 22 nt, Salmonella typhimurium LT2
cagugccaguuaagcaacugau

SEQ ID NO: 3753527 - RNA, 23 nt, Salmonella typhimurium LT2
cagugccgccagaaucaccucuu

SEQ ID NO: 3753528 - RNA, 24 nt, Salmonella typhimurium LT2
cagugccgguugccugauggcgcu

SEQ ID NO: 3753529 - RNA, 20 nt, Salmonella typhimurium LT2
cagugcggcaaccaccagca

SEQ ID NO: 3753530 - RNA, 16 nt, Salmonella typhimurium LT2
caguggaacaaacgca

SEQ ID NO: 3753531 - RNA, 17 nt, Salmonella typhimurium LT2
caguggacgauaagcac

SEQ ID NO: 3753532 - RNA, 20 nt, Salmonella typhimurium LT2
cagugggcgucaaaaucccg

SEQ ID NO: 3753533 - RNA, 22 nt, Salmonella typhimurium LT2
caguggucguuagccagauggc

SEQ ID NO: 3753534 - RNA, 16 nt, Salmonella typhimurium LT2
caguguaaacgccaga

SEQ ID NO: 3753535 - RNA, 20 nt, Salmonella typhimurium LT2
caguguuaaucucacgcuca

SEQ ID NO: 3753536 - RNA, 18 nt, Salmonella typhimurium LT2
caguguuuauuaaaacuc

SEQ ID NO: 3753537 - RNA, 19 nt, Salmonella typhimurium LT2
caguuaacagaaugcugaa

SEQ ID NO: 3753538 - RNA, 22 nt, Salmonella typhimurium LT2
caguuaauucguccccagcgau

SEQ ID NO: 3753539 - RNA, 20 nt, Salmonella typhimurium LT2
caguuaccgcacacgcaaaa

SEQ ID NO: 3753540 - RNA, 22 nt, Salmonella typhimurium LT2
caguuaccgcacacgcaaaaaa

SEQ ID NO: 3753541 - RNA, 18 nt, Salmonella typhimurium LT2
caguuacguuugcagcgg

SEQ ID NO: 3753542 - RNA, 12 nt, Salmonella typhimurium LT2
caguuagcuuca

SEQ ID NO: 3753543 - RNA, 19 nt, Salmonella typhimurium LT2
caguuagcuucagcaaacg

SEQ ID NO: 3753544 - RNA, 23 nt, Salmonella typhimurium LT2
caguuauagcgcagauugaggcu

SEQ ID NO: 3753545 - RNA, 22 nt, Salmonella typhimurium LT2
caguuauuaaucaagcccagcu

SEQ ID NO: 3753546 - RNA, 16 nt, Salmonella typhimurium LT2
caguucaaucagguua

SEQ ID NO: 3753547 - RNA, 21 nt, Salmonella typhimurium LT2
caguucaaugugcggagaaga

SEQ ID NO: 3753548 - RNA, 16 nt, Salmonella typhimurium LT2
caguucaccggcggcc

SEQ ID NO: 3753549 - RNA, 16 nt, Salmonella typhimurium LT2
caguucacgccgccgc

SEQ ID NO: 3753550 - RNA, 16 nt, Salmonella typhimurium LT2
caguucacgcgccgcc

SEQ ID NO: 3753551 - RNA, 19 nt, Salmonella typhimurium LT2
caguucacuccuaagagaa

SEQ ID NO: 3753552 - RNA, 14 nt, Salmonella typhimurium LT2
caguucagaaacgg

SEQ ID NO: 3753553 - RNA, 14 nt, Salmonella typhimurium LT2
caguucagccgcca

SEQ ID NO: 3753554 - RNA, 16 nt, Salmonella typhimurium LT2
caguucagccgccagu

SEQ ID NO: 3753555 - RNA, 18 nt, Salmonella typhimurium LT2
caguucaggaacaucagc

SEQ ID NO: 3753556 - RNA, 18 nt, Salmonella typhimurium LT2
caguucauaagucaucca

SEQ ID NO: 3753557 - RNA, 23 nt, Salmonella typhimurium LT2
caguucauauuugcuggcuugcu

SEQ ID NO: 3753558 - RNA, 17 nt, Salmonella typhimurium LT2
caguucauccacgcggg

SEQ ID NO: 3753559 - RNA, 19 nt, Salmonella typhimurium LT2
caguucauccacgucauaa

SEQ ID NO: 3753560 - RNA, 17 nt, Salmonella typhimurium LT2
caguucauccagcagca

SEQ ID NO: 3753561 - RNA, 12 nt, Salmonella typhimurium LT2
caguucauuaac

SEQ ID NO: 3753562 - RNA, 17 nt, Salmonella typhimurium LT2
caguucauucgccacca

SEQ ID NO: 3753563 - RNA, 16 nt, Salmonella typhimurium LT2
caguucauuucaggca

SEQ ID NO: 3753564 - RNA, 19 nt, Salmonella typhimurium LT2
caguuccgcaaagcccauc

SEQ ID NO: 3753565 - RNA, 21 nt, Salmonella typhimurium LT2
caguuccgcacgaacggucag

SEQ ID NO: 3753566 - RNA, 19 nt, Salmonella typhimurium LT2
caguucgccacggucggca

SEQ ID NO: 3753567 - RNA, 22 nt, Salmonella typhimurium LT2
caguucgccguugauuuucagg

SEQ ID NO: 3753568 - RNA, 21 nt, Salmonella typhimurium LT2
caguucgccuucuucaucuuc

SEQ ID NO: 3753569 - RNA, 15 nt, Salmonella typhimurium LT2
caguucguaauuuaa

SEQ ID NO: 3753570 - RNA, 17 nt, Salmonella typhimurium LT2
caguugaccaaacagca

SEQ ID NO: 3753571 - RNA, 14 nt, Salmonella typhimurium LT2
caguugccaggguu

SEQ ID NO: 3753572 - RNA, 20 nt, Salmonella typhimurium LT2
caguugcgacuguucaucaa

SEQ ID NO: 3753573 - RNA, 13 nt, Salmonella typhimurium LT2
caguugcgcgucu

SEQ ID NO: 3753574 - RNA, 18 nt, Salmonella typhimurium LT2
caguuggcgaccgcugca

SEQ ID NO: 3753575 - RNA, 19 nt, Salmonella typhimurium LT2
caguuggcguaccaucagc

SEQ ID NO: 3753576 - RNA, 22 nt, Salmonella typhimurium LT2
caguuggcuugccagcagauuu

SEQ ID NO: 3753577 - RNA, 23 nt, Salmonella typhimurium LT2
caguugguuagagcacaucacuc

SEQ ID NO: 3753578 - RNA, 15 nt, Salmonella typhimurium LT2
caguuguccauuuuc

SEQ ID NO: 3753579 - RNA, 16 nt, Salmonella typhimurium LT2
caguuguuccagcagc

SEQ ID NO: 3753580 - RNA, 16 nt, Salmonella typhimurium LT2
caguuuaaagccaauc

SEQ ID NO: 3753581 - RNA, 21 nt, Salmonella typhimurium LT2
caguuuacccagcgaaugcug

SEQ ID NO: 3753582 - RNA, 12 nt, Salmonella typhimurium LT2
caguuuacgcag

SEQ ID NO: 3753583 - RNA, 19 nt, Salmonella typhimurium LT2
cauaccgccgcccagcaca

SEQ ID NO: 3753584 - RNA, 19 nt, Salmonella typhimurium LT2
cauaccgcuuuacccggcg

SEQ ID NO: 3753585 - RNA, 18 nt, Salmonella typhimurium LT2
cauaccggacuccaggca

SEQ ID NO: 3753586 - RNA, 15 nt, Salmonella typhimurium LT2
cauaccggagccugg

SEQ ID NO: 3753587 - RNA, 19 nt, Salmonella typhimurium LT2
cauaccggugcgccccagc

SEQ ID NO: 3753588 - RNA, 21 nt, Salmonella typhimurium LT2
cauaccggugcgccccagcau

SEQ ID NO: 3753589 - RNA, 14 nt, Salmonella typhimurium LT2
cauaccgucaccac

SEQ ID NO: 3753590 - RNA, 15 nt, Salmonella typhimurium LT2
cauaccguuucaacu

SEQ ID NO: 3753591 - RNA, 14 nt, Salmonella typhimurium LT2
cauaccuccucucu

SEQ ID NO: 3753592 - RNA, 19 nt, Salmonella typhimurium LT2
cauaccugcggccaugauc

SEQ ID NO: 3753593 - RNA, 14 nt, Salmonella typhimurium LT2
cauacgcagcacuu

SEQ ID NO: 3753594 - RNA, 16 nt, Salmonella typhimurium LT2
cauacgcccacgcggc

SEQ ID NO: 3753595 - RNA, 14 nt, Salmonella typhimurium LT2
cauacgcgcaugaa

SEQ ID NO: 3753596 - RNA, 13 nt, Salmonella typhimurium LT2
cauacggucgaua

SEQ ID NO: 3753597 - RNA, 17 nt, Salmonella typhimurium LT2
cauacguuuaaagcgcu

SEQ ID NO: 3753598 - RNA, 12 nt, Salmonella typhimurium LT2
cauacucacauu

SEQ ID NO: 3753599 - RNA, 16 nt, Salmonella typhimurium LT2
cauacucacgaauaag

SEQ ID NO: 3753600 - RNA, 17 nt, Salmonella typhimurium LT2
cauacucacgaauaaga

SEQ ID NO: 3753601 - RNA, 23 nt, Salmonella typhimurium LT2
cauacugaagauaaacagcagcg

SEQ ID NO: 3753602 - RNA, 20 nt, Salmonella typhimurium LT2
cauacugcuuuuucggcuca

SEQ ID NO: 3753603 - RNA, 18 nt, Salmonella typhimurium LT2
cauacuuuuccagcgccu

SEQ ID NO: 3753604 - RNA, 14 nt, Salmonella typhimurium LT2
cauagaaaaagaac

SEQ ID NO: 3753605 - RNA, 23 nt, Salmonella typhimurium LT2
cauagaaaaagaacugcaaauac

SEQ ID NO: 3753606 - RNA, 17 nt, Salmonella typhimurium LT2
cauagaaaucagcaggu

SEQ ID NO: 3753607 - RNA, 12 nt, Salmonella typhimurium LT2
cauagaaccacu

SEQ ID NO: 3753608 - RNA, 13 nt, Salmonella typhimurium LT2
cauagaauuucag

SEQ ID NO: 3753609 - RNA, 17 nt, Salmonella typhimurium LT2
cauagagaucacgcugu

SEQ ID NO: 3753610 - RNA, 23 nt, Salmonella typhimurium LT2
cauagagcgggucaacgccaagc

SEQ ID NO: 3753611 - RNA, 15 nt, Salmonella typhimurium LT2
cauagauaccuucuu

SEQ ID NO: 3753612 - RNA, 17 nt, Salmonella typhimurium LT2
cauagauaccuucuuca

SEQ ID NO: 3753613 - RNA, 21 nt, Salmonella typhimurium LT2
cauagaucuuugggccggaua

SEQ ID NO: 3753614 - RNA, 19 nt, Salmonella typhimurium LT2
cauagcaaaguacuggaau

SEQ ID NO: 3753615 - RNA, 12 nt, Salmonella typhimurium LT2
cauagcaucacc

SEQ ID NO: 3753616 - RNA, 22 nt, Salmonella typhimurium LT2
cauagccaguggaacaaacgca

SEQ ID NO: 3753617 - RNA, 14 nt, Salmonella typhimurium LT2
cauagccgccaccc

SEQ ID NO: 3753618 - RNA, 22 nt, Salmonella typhimurium LT2
cauagccggcgauagcgcccca

SEQ ID NO: 3753619 - RNA, 13 nt, Salmonella typhimurium LT2
cauagccuaauga

SEQ ID NO: 3753620 - RNA, 20 nt, Salmonella typhimurium LT2
cauagcgcaacgcuucuucg

SEQ ID NO: 3753621 - RNA, 18 nt, Salmonella typhimurium LT2
cauagcgccaucagacau

SEQ ID NO: 3753622 - RNA, 15 nt, Salmonella typhimurium LT2
cauagcgccccagua

SEQ ID NO: 3753623 - RNA, 20 nt, Salmonella typhimurium LT2
cauagcggacuaaauuccug

SEQ ID NO: 3753624 - RNA, 22 nt, Salmonella typhimurium LT2
cauagcguugauaugcucgaca

SEQ ID NO: 3753625 - RNA, 21 nt, Salmonella typhimurium LT2
cauagcguuuaaaaagcugca

SEQ ID NO: 3753626 - RNA, 21 nt, Salmonella typhimurium LT2
cauagcuaaauuaaaaauaau

SEQ ID NO: 3753627 - RNA, 21 nt, Salmonella typhimurium LT2
cauagcuuacuuuuagaacua

SEQ ID NO: 3753628 - RNA, 14 nt, Salmonella typhimurium LT2
cauaggccagcguu

SEQ ID NO: 3753629 - RNA, 14 nt, Salmonella typhimurium LT2
cauaguaaauuguu

SEQ ID NO: 3753630 - RNA, 22 nt, Salmonella typhimurium LT2
cauagucgcuccccauaaaaau

SEQ ID NO: 3753631 - RNA, 15 nt, Salmonella typhimurium LT2
cauagucgcuuuuca

SEQ ID NO: 3753632 - RNA, 17 nt, Salmonella typhimurium LT2
cauagugacgcuguaca

SEQ ID NO: 3753633 - RNA, 20 nt, Salmonella typhimurium LT2
cauauaaaucaguuguacuu

SEQ ID NO: 3753634 - RNA, 18 nt, Salmonella typhimurium LT2
cauauaaauuucauccau

SEQ ID NO: 3753635 - RNA, 11 nt, Salmonella typhimurium LT2
cauauaacaga

SEQ ID NO: 3753636 - RNA, 20 nt, Salmonella typhimurium LT2
cauauaacagaauaagccag

SEQ ID NO: 3753637 - RNA, 15 nt, Salmonella typhimurium LT2
cauauaaggcccaua

SEQ ID NO: 3753638 - RNA, 14 nt, Salmonella typhimurium LT2
cauauaauacuuau

SEQ ID NO: 3753639 - RNA, 14 nt, Salmonella typhimurium LT2
cauauacauaugga

SEQ ID NO: 3753640 - RNA, 22 nt, Salmonella typhimurium LT2
cauauacgccacggccagcagc

SEQ ID NO: 3753641 - RNA, 14 nt, Salmonella typhimurium LT2
cauauagccgcgca

SEQ ID NO: 3753642 - RNA, 18 nt, Salmonella typhimurium LT2
cauauagugcgugacaau

SEQ ID NO: 3753643 - RNA, 21 nt, Salmonella typhimurium LT2
cauauaugccggguggcggcu

SEQ ID NO: 3753644 - RNA, 22 nt, Salmonella typhimurium LT2
cauaucaguggggccuuuuuaa

SEQ ID NO: 3753645 - RNA, 13 nt, Salmonella typhimurium LT2
cauaucaguugcc

SEQ ID NO: 3753646 - RNA, 16 nt, Salmonella typhimurium LT2
cauauccaagccccuc

SEQ ID NO: 3753647 - RNA, 15 nt, Salmonella typhimurium LT2
cauauccaccaccag

SEQ ID NO: 3753648 - RNA, 11 nt, Salmonella typhimurium LT2
cauauccagcc

SEQ ID NO: 3753649 - RNA, 13 nt, Salmonella typhimurium LT2
cauauccagcgcc

SEQ ID NO: 3753650 - RNA, 19 nt, Salmonella typhimurium LT2
cauaucguacugcuuuaau

SEQ ID NO: 3753651 - RNA, 16 nt, Salmonella typhimurium LT2
cauaucuggacgggcc

SEQ ID NO: 3753652 - RNA, 23 nt, Salmonella typhimurium LT2
cauaucuggcgaggcuuuguccu

SEQ ID NO: 3753653 - RNA, 19 nt, Salmonella typhimurium LT2
cauaucuguuuggcaaggg

SEQ ID NO: 3753654 - RNA, 20 nt, Salmonella typhimurium LT2
cauaugaguuauguauuuaa

SEQ ID NO: 3753655 - RNA, 21 nt, Salmonella typhimurium LT2
cauaugaguuauguauuuaau

SEQ ID NO: 3753656 - RNA, 14 nt, Salmonella typhimurium LT2
cauaugcgcggcga

SEQ ID NO: 3753657 - RNA, 14 nt, Salmonella typhimurium LT2
cauauggcguuccg

SEQ ID NO: 3753658 - RNA, 18 nt, Salmonella typhimurium LT2
cauauuaucgcgcugaau

SEQ ID NO: 3753659 - RNA, 21 nt, Salmonella typhimurium LT2
cauauucaccagagcaucaau

SEQ ID NO: 3753660 - RNA, 22 nt, Salmonella typhimurium LT2
cauauuccagccacacgacggu

SEQ ID NO: 3753661 - RNA, 16 nt, Salmonella typhimurium LT2
cauauucgucuucauc

SEQ ID NO: 3753662 - RNA, 14 nt, Salmonella typhimurium LT2
cauauucugcgaaa

SEQ ID NO: 3753663 - RNA, 21 nt, Salmonella typhimurium LT2
cauauugacauuugcucccuu

SEQ ID NO: 3753664 - RNA, 14 nt, Salmonella typhimurium LT2
cauauugcgccgca

SEQ ID NO: 3753665 - RNA, 20 nt, Salmonella typhimurium LT2
cauauugcgcuucacuaacu

SEQ ID NO: 3753666 - RNA, 20 nt, Salmonella typhimurium LT2
cauauugcguaucguaagcc

SEQ ID NO: 3753667 - RNA, 20 nt, Salmonella typhimurium LT2
cauauugguccgguaacagc

SEQ ID NO: 3753668 - RNA, 19 nt, Salmonella typhimurium LT2
cauauuguagguuuuccuc

SEQ ID NO: 3753669 - RNA, 22 nt, Salmonella typhimurium LT2
cauauuuaaauaucggcucaau

SEQ ID NO: 3753670 - RNA, 19 nt, Salmonella typhimurium LT2
cauauuuaugcagcgcguc

SEQ ID NO: 3753671 - RNA, 17 nt, Salmonella typhimurium LT2
cauauuucgaucggcca

SEQ ID NO: 3753672 - RNA, 19 nt, Salmonella typhimurium LT2
cauauuuucaacggcauca

SEQ ID NO: 3753673 - RNA, 13 nt, Salmonella typhimurium LT2
cauauuuuuaugc

SEQ ID NO: 3753674 - RNA, 15 nt, Salmonella typhimurium LT2
cauauuuuucacaca

SEQ ID NO: 3753675 - RNA, 18 nt, Salmonella typhimurium LT2
cauauuuuucacacauaa

SEQ ID NO: 3753676 - RNA, 21 nt, Salmonella typhimurium LT2
caucaaaacuggaaacgcauc

SEQ ID NO: 3753677 - RNA, 17 nt, Salmonella typhimurium LT2
caucaaaauuaccuuua

SEQ ID NO: 3753678 - RNA, 14 nt, Salmonella typhimurium LT2
caucaaacagcggc

SEQ ID NO: 3753679 - RNA, 14 nt, Salmonella typhimurium LT2
caucaaacuuuuaa

SEQ ID NO: 3753680 - RNA, 16 nt, Salmonella typhimurium LT2
caucaaacuuuuaaau

SEQ ID NO: 3753681 - RNA, 19 nt, Salmonella typhimurium LT2
caucaaagaaauacccuuc

SEQ ID NO: 3753682 - RNA, 15 nt, Salmonella typhimurium LT2
caucaaauaauacgc

SEQ ID NO: 3753683 - RNA, 18 nt, Salmonella typhimurium LT2
caucaaauacgcgcgccg

SEQ ID NO: 3753684 - RNA, 18 nt, Salmonella typhimurium LT2
caucaaauagguauguaa

SEQ ID NO: 3753685 - RNA, 20 nt, Salmonella typhimurium LT2
caucaaaugaacacaaaaaa

SEQ ID NO: 3753686 - RNA, 15 nt, Salmonella typhimurium LT2
caucaacagcaggca

SEQ ID NO: 3753687 - RNA, 18 nt, Salmonella typhimurium LT2
cauccaguggugaaaaag

SEQ ID NO: 3753688 - RNA, 14 nt, Salmonella typhimurium LT2
cauccaucagcgcg

SEQ ID NO: 3753689 - RNA, 15 nt, Salmonella typhimurium LT2
cauccaugcggcaga

SEQ ID NO: 3753690 - RNA, 18 nt, Salmonella typhimurium LT2
cauccauugcgccacgga

SEQ ID NO: 3753691 - RNA, 15 nt, Salmonella typhimurium LT2
caucccacccagcaa

SEQ ID NO: 3753692 - RNA, 16 nt, Salmonella typhimurium LT2
caucccaccggaaaug

SEQ ID NO: 3753693 - RNA, 16 nt, Salmonella typhimurium LT2
caucccauccgggcca

SEQ ID NO: 3753694 - RNA, 14 nt, Salmonella typhimurium LT2
caucccaugcacca

SEQ ID NO: 3753695 - RNA, 22 nt, Salmonella typhimurium LT2
cauccccacaggaucaccgcca

SEQ ID NO: 3753696 - RNA, 12 nt, Salmonella typhimurium LT2
caucccccagcc

SEQ ID NO: 3753697 - RNA, 16 nt, Salmonella typhimurium LT2
cauccccccgccgcug

SEQ ID NO: 3753698 - RNA, 19 nt, Salmonella typhimurium LT2
cauccccgcguuaagcccc

SEQ ID NO: 3753699 - RNA, 22 nt, Salmonella typhimurium LT2
caucccgauuucgcuccacugg

SEQ ID NO: 3753700 - RNA, 23 nt, Salmonella typhimurium LT2
caucccgauuucgcuccacuggc

SEQ ID NO: 3753701 - RNA, 12 nt, Salmonella typhimurium LT2
caucccggcaac

SEQ ID NO: 3753702 - RNA, 13 nt, Salmonella typhimurium LT2
cauccgagaccag

SEQ ID NO: 3753703 - RNA, 21 nt, Salmonella typhimurium LT2
cauccgauuucauggucaucg

SEQ ID NO: 3753704 - RNA, 23 nt, Salmonella typhimurium LT2
cauccgauuucauggucaucgca

SEQ ID NO: 3753705 - RNA, 17 nt, Salmonella typhimurium LT2
cauccgccagcgccucu

SEQ ID NO: 3753706 - RNA, 19 nt, Salmonella typhimurium LT2
cauccgccagcgccucuuc

SEQ ID NO: 3753707 - RNA, 17 nt, Salmonella typhimurium LT2
cauccgcccgacaucaa

SEQ ID NO: 3753708 - RNA, 15 nt, Salmonella typhimurium LT2
cauccgcgcuuucug

SEQ ID NO: 3753709 - RNA, 21 nt, Salmonella typhimurium LT2
cauccgcuucggacuccugac

SEQ ID NO: 3753710 - RNA, 13 nt, Salmonella typhimurium LT2
cauccggcaaucc

SEQ ID NO: 3753711 - RNA, 15 nt, Salmonella typhimurium LT2
cauccggcaauuuau

SEQ ID NO: 3753712 - RNA, 15 nt, Salmonella typhimurium LT2
cauccggcacgguca

SEQ ID NO: 3753713 - RNA, 23 nt, Salmonella typhimurium LT2
cauccggcacggucaaucaucag

SEQ ID NO: 3753714 - RNA, 13 nt, Salmonella typhimurium LT2
cauccggcaucuc

SEQ ID NO: 3753715 - RNA, 18 nt, Salmonella typhimurium LT2
cauccggcauuuaugcug

SEQ ID NO: 3753716 - RNA, 16 nt, Salmonella typhimurium LT2
cauccggcgcugauga

SEQ ID NO: 3753717 - RNA, 21 nt, Salmonella typhimurium LT2
cauccggcugcgucgcuuccu

SEQ ID NO: 3753718 - RNA, 17 nt, Salmonella typhimurium LT2
cauccgggccaacggca

SEQ ID NO: 3753719 - RNA, 15 nt, Salmonella typhimurium LT2
cauccgguuuuaaau

SEQ ID NO: 3753720 - RNA, 23 nt, Salmonella typhimurium LT2
cauccgucguguagccuucgccu

SEQ ID NO: 3753721 - RNA, 15 nt, Salmonella typhimurium LT2
cauccucaaugguuu

SEQ ID NO: 3753722 - RNA, 18 nt, Salmonella typhimurium LT2
cauccucaauguuaacua

SEQ ID NO: 3753723 - RNA, 14 nt, Salmonella typhimurium LT2
cauccucacgcaac

SEQ ID NO: 3753724 - RNA, 13 nt, Salmonella typhimurium LT2
cauccucauuuug

SEQ ID NO: 3753725 - RNA, 22 nt, Salmonella typhimurium LT2
cauccuccauccagguaacaua

SEQ ID NO: 3753726 - RNA, 19 nt, Salmonella typhimurium LT2
cauccucuuggguuauuuc

SEQ ID NO: 3753727 - RNA, 13 nt, Salmonella typhimurium LT2
cauccucuuuccg

SEQ ID NO: 3753728 - RNA, 23 nt, Salmonella typhimurium LT2
cauccugaagcggcgcaauuuuc

SEQ ID NO: 3753729 - RNA, 15 nt, Salmonella typhimurium LT2
cauccugcaaaagga

SEQ ID NO: 3753730 - RNA, 17 nt, Salmonella typhimurium LT2
cauccugcaacucaaaa

SEQ ID NO: 3753731 - RNA, 16 nt, Salmonella typhimurium LT2
cauccuguaccaccac

SEQ ID NO: 3753732 - RNA, 17 nt, Salmonella typhimurium LT2
cauccugugggaugcgu

SEQ ID NO: 3753733 - RNA, 20 nt, Salmonella typhimurium LT2
cauccuguggguucaucgcc

SEQ ID NO: 3753734 - RNA, 21 nt, Salmonella typhimurium LT2
cauccuguggguucaucgcca

SEQ ID NO: 3753735 - RNA, 19 nt, Salmonella typhimurium LT2
cauccuguucauccacaga

SEQ ID NO: 3753736 - RNA, 23 nt, Salmonella typhimurium LT2
cauccuguuuuuucagcgcgccg

SEQ ID NO: 3753737 - RNA, 23 nt, Salmonella typhimurium LT2
caucgacaagcuaauccccagcg

SEQ ID NO: 3753738 - RNA, 15 nt, Salmonella typhimurium LT2
caucgacagacuuca

SEQ ID NO: 3753739 - RNA, 21 nt, Salmonella typhimurium LT2
caucgacaguaccagcagaac

SEQ ID NO: 3753740 - RNA, 21 nt, Salmonella typhimurium LT2
caucgacauagcugaauaaaa

SEQ ID NO: 3753741 - RNA, 15 nt, Salmonella typhimurium LT2
caucgacccccacca

SEQ ID NO: 3753742 - RNA, 19 nt, Salmonella typhimurium LT2
caucgacgaaauggugugc

SEQ ID NO: 3753743 - RNA, 23 nt, Salmonella typhimurium LT2
caucgagccaacguauaaaaugg

SEQ ID NO: 3753744 - RNA, 21 nt, Salmonella typhimurium LT2
caucgagcuuugacgacccgc

SEQ ID NO: 3753745 - RNA, 17 nt, Salmonella typhimurium LT2
caucgauuuccugauga

SEQ ID NO: 3753746 - RNA, 18 nt, Salmonella typhimurium LT2
caucgauuuccugaugac

SEQ ID NO: 3753747 - RNA, 20 nt, Salmonella typhimurium LT2
caucgauuuuagcgcaucgc

SEQ ID NO: 3753748 - RNA, 17 nt, Salmonella typhimurium LT2
caucgcacucuccggcu

SEQ ID NO: 3753749 - RNA, 21 nt, Salmonella typhimurium LT2
caucgccaacgccaaccggcu

SEQ ID NO: 3753750 - RNA, 19 nt, Salmonella typhimurium LT2
caucgccacagacgaagag

SEQ ID NO: 3753751 - RNA, 21 nt, Salmonella typhimurium LT2
caucgccacuaccagcguacc

SEQ ID NO: 3753752 - RNA, 13 nt, Salmonella typhimurium LT2
caucgccagccau

SEQ ID NO: 3753753 - RNA, 18 nt, Salmonella typhimurium LT2
caucgccauuaaaagcca

SEQ ID NO: 3753754 - RNA, 12 nt, Salmonella typhimurium LT2
caucgcccaggu

SEQ ID NO: 3753755 - RNA, 15 nt, Salmonella typhimurium LT2
caucgcccgccccca

SEQ ID NO: 3753756 - RNA, 17 nt, Salmonella typhimurium LT2
caucgccgauuccugcu

SEQ ID NO: 3753757 - RNA, 19 nt, Salmonella typhimurium LT2
caucgccgcaaugaccaca

SEQ ID NO: 3753758 - RNA, 14 nt, Salmonella typhimurium LT2
caucgccgccucgc

SEQ ID NO: 3753759 - RNA, 14 nt, Salmonella typhimurium LT2
caucgccgcgccgu

SEQ ID NO: 3753760 - RNA, 21 nt, Salmonella typhimurium LT2
caucgccgugaucgaggcgcu

SEQ ID NO: 3753761 - RNA, 19 nt, Salmonella typhimurium LT2
caucgccugaucgcgcaga

SEQ ID NO: 3753762 - RNA, 13 nt, Salmonella typhimurium LT2
caucgccugauga

SEQ ID NO: 3753763 - RNA, 21 nt, Salmonella typhimurium LT2
caucgcgaucaucagcacgcc

SEQ ID NO: 3753764 - RNA, 22 nt, Salmonella typhimurium LT2
caucgcgccaaacgggcaagcc

SEQ ID NO: 3753765 - RNA, 16 nt, Salmonella typhimurium LT2
caucgcgccaucggcu

SEQ ID NO: 3753766 - RNA, 16 nt, Salmonella typhimurium LT2
caucgcgccgcuggcg

SEQ ID NO: 3753767 - RNA, 22 nt, Salmonella typhimurium LT2
caucgcuaaguugaacgguaaa

SEQ ID NO: 3753768 - RNA, 13 nt, Salmonella typhimurium LT2
caucgcucaaaac

SEQ ID NO: 3753769 - RNA, 13 nt, Salmonella typhimurium LT2
caucgcucgcgcc

SEQ ID NO: 3753770 - RNA, 18 nt, Salmonella typhimurium LT2
caucgcuucuacagccac

SEQ ID NO: 3753771 - RNA, 13 nt, Salmonella typhimurium LT2
caucgcuugccca

SEQ ID NO: 3753772 - RNA, 16 nt, Salmonella typhimurium LT2
caucgcuugcccagca

SEQ ID NO: 3753773 - RNA, 16 nt, Salmonella typhimurium LT2
caucgcuuucagcuuu

SEQ ID NO: 3753774 - RNA, 20 nt, Salmonella typhimurium LT2
caucgcuuugagcagcgcca

SEQ ID NO: 3753775 - RNA, 17 nt, Salmonella typhimurium LT2
caucgcuuuuugcagau

SEQ ID NO: 3753776 - RNA, 12 nt, Salmonella typhimurium LT2
caucggaaaaau

SEQ ID NO: 3753777 - RNA, 14 nt, Salmonella typhimurium LT2
caucggcaaacgcc

SEQ ID NO: 3753778 - RNA, 13 nt, Salmonella typhimurium LT2
caucggcaaagcc

SEQ ID NO: 3753779 - RNA, 17 nt, Salmonella typhimurium LT2
caucggcaaagcccuga

SEQ ID NO: 3753780 - RNA, 22 nt, Salmonella typhimurium LT2
caucggcacacuuucgcccggc

SEQ ID NO: 3753781 - RNA, 15 nt, Salmonella typhimurium LT2
caucggcacagccag

SEQ ID NO: 3753782 - RNA, 16 nt, Salmonella typhimurium LT2
caucggcacagccagu

SEQ ID NO: 3753783 - RNA, 14 nt, Salmonella typhimurium LT2
caucggcacauuag

SEQ ID NO: 3753784 - RNA, 21 nt, Salmonella typhimurium LT2
caucggcacguaguaaugcau

SEQ ID NO: 3753785 - RNA, 20 nt, Salmonella typhimurium LT2
caucggcgcgcuggcgugau

SEQ ID NO: 3753786 - RNA, 21 nt, Salmonella typhimurium LT2
caucgggacggcggucgcuga

SEQ ID NO: 3753787 - RNA, 15 nt, Salmonella typhimurium LT2
caucgggcaauggca

SEQ ID NO: 3753788 - RNA, 20 nt, Salmonella typhimurium LT2
caucgggcauuucaggcacu

SEQ ID NO: 3753789 - RNA, 15 nt, Salmonella typhimurium LT2
caucgguaagcgcaa

SEQ ID NO: 3753790 - RNA, 15 nt, Salmonella typhimurium LT2
caucggucaguguuu

SEQ ID NO: 3753791 - RNA, 15 nt, Salmonella typhimurium LT2
caugcccacaggcag

SEQ ID NO: 3753792 - RNA, 20 nt, Salmonella typhimurium LT2
caugcccacaggcagggcga

SEQ ID NO: 3753793 - RNA, 13 nt, Salmonella typhimurium LT2
caugcccaccgga

SEQ ID NO: 3753794 - RNA, 18 nt, Salmonella typhimurium LT2
caugcccaguucaaucaa

SEQ ID NO: 3753795 - RNA, 14 nt, Salmonella typhimurium LT2
caugcccggcggcg

SEQ ID NO: 3753796 - RNA, 16 nt, Salmonella typhimurium LT2
caugccgcaggccgga

SEQ ID NO: 3753797 - RNA, 16 nt, Salmonella typhimurium LT2
caugccgccauuuuau

SEQ ID NO: 3753798 - RNA, 21 nt, Salmonella typhimurium LT2
caugccgccugccgcgccgcc

SEQ ID NO: 3753799 - RNA, 19 nt, Salmonella typhimurium LT2
caugccggcuuuccgcacc

SEQ ID NO: 3753800 - RNA, 18 nt, Salmonella typhimurium LT2
caugccguauuuaugcua

SEQ ID NO: 3753801 - RNA, 18 nt, Salmonella typhimurium LT2
caugccucgaaaauauau

SEQ ID NO: 3753802 - RNA, 16 nt, Salmonella typhimurium LT2
caugccugauggcgca

SEQ ID NO: 3753803 - RNA, 23 nt, Salmonella typhimurium LT2
caugcgacgugucgcguaacgcc

SEQ ID NO: 3753804 - RNA, 18 nt, Salmonella typhimurium LT2
caugcgcagaaacugauc

SEQ ID NO: 3753805 - RNA, 22 nt, Salmonella typhimurium LT2
caugcgcgucccggcagugcau

SEQ ID NO: 3753806 - RNA, 14 nt, Salmonella typhimurium LT2
caugcgcuuuuuca

SEQ ID NO: 3753807 - RNA, 14 nt, Salmonella typhimurium LT2
caugcggaugcugc

SEQ ID NO: 3753808 - RNA, 18 nt, Salmonella typhimurium LT2
caugcggaugcugcgcca

SEQ ID NO: 3753809 - RNA, 15 nt, Salmonella typhimurium LT2
caugcgggagcuugg

SEQ ID NO: 3753810 - RNA, 22 nt, Salmonella typhimurium LT2
caugcgggggaaucuuauuuuc

SEQ ID NO: 3753811 - RNA, 23 nt, Salmonella typhimurium LT2
caugcgggggaaucuuauuuucc

SEQ ID NO: 3753812 - RNA, 18 nt, Salmonella typhimurium LT2
caugcgggugacgcuggc

SEQ ID NO: 3753813 - RNA, 19 nt, Salmonella typhimurium LT2
caugcggugcaugaauauc

SEQ ID NO: 3753814 - RNA, 23 nt, Salmonella typhimurium LT2
caugcgugcgccgcgagugcagg

SEQ ID NO: 3753815 - RNA, 19 nt, Salmonella typhimurium LT2
caugcguugaaaaccugca

SEQ ID NO: 3753816 - RNA, 13 nt, Salmonella typhimurium LT2
caugcuauauuuu

SEQ ID NO: 3753817 - RNA, 16 nt, Salmonella typhimurium LT2
caugcucauaauggac

SEQ ID NO: 3753818 - RNA, 20 nt, Salmonella typhimurium LT2
caugcucauuuugauaaauc

SEQ ID NO: 3753819 - RNA, 17 nt, Salmonella typhimurium LT2
caugcuccgccccgccu

SEQ ID NO: 3753820 - RNA, 19 nt, Salmonella typhimurium LT2
caugcucgcuuuccauuac

SEQ ID NO: 3753821 - RNA, 23 nt, Salmonella typhimurium LT2
caugcucgcuuuccauuacgcuu

SEQ ID NO: 3753822 - RNA, 13 nt, Salmonella typhimurium LT2
caugcuggcuaaa

SEQ ID NO: 3753823 - RNA, 12 nt, Salmonella typhimurium LT2
caugcugguugg

SEQ ID NO: 3753824 - RNA, 15 nt, Salmonella typhimurium LT2
caugcuuaucgccaa

SEQ ID NO: 3753825 - RNA, 15 nt, Salmonella typhimurium LT2
caugcuucucaaaga

SEQ ID NO: 3753826 - RNA, 13 nt, Salmonella typhimurium LT2
cauggaaauaaag

SEQ ID NO: 3753827 - RNA, 12 nt, Salmonella typhimurium LT2
cauggaagaaaa

SEQ ID NO: 3753828 - RNA, 18 nt, Salmonella typhimurium LT2
cauggaagaaaauauaau

SEQ ID NO: 3753829 - RNA, 22 nt, Salmonella typhimurium LT2
cauggagagcgauaaacucagc

SEQ ID NO: 3753830 - RNA, 19 nt, Salmonella typhimurium LT2
cauggagauuggcucuuug

SEQ ID NO: 3753831 - RNA, 20 nt, Salmonella typhimurium LT2
cauggcagauaaaccacgcc

SEQ ID NO: 3753832 - RNA, 14 nt, Salmonella typhimurium LT2
cauggcagcagggu

SEQ ID NO: 3753833 - RNA, 17 nt, Salmonella typhimurium LT2
cauggcagccccggcau

SEQ ID NO: 3753834 - RNA, 18 nt, Salmonella typhimurium LT2
cauggcaggcagcacaau

SEQ ID NO: 3753835 - RNA, 13 nt, Salmonella typhimurium LT2
cauggcagggcga

SEQ ID NO: 3753836 - RNA, 15 nt, Salmonella typhimurium LT2
cauggcgaagugcag

SEQ ID NO: 3753837 - RNA, 17 nt, Salmonella typhimurium LT2
cauggcgaagugcagcg

SEQ ID NO: 3753838 - RNA, 15 nt, Salmonella typhimurium LT2
cauggcgauuaccca

SEQ ID NO: 3753839 - RNA, 17 nt, Salmonella typhimurium LT2
cauggcgauuacccagu

SEQ ID NO: 3753840 - RNA, 13 nt, Salmonella typhimurium LT2
cauggcgccacca

SEQ ID NO: 3753841 - RNA, 15 nt, Salmonella typhimurium LT2
cauggcgccaccagc

SEQ ID NO: 3753842 - RNA, 17 nt, Salmonella typhimurium LT2
cauggcggccagauggc

SEQ ID NO: 3753843 - RNA, 18 nt, Salmonella typhimurium LT2
cauggcggccagauggca

SEQ ID NO: 3753844 - RNA, 13 nt, Salmonella typhimurium LT2
cauggggaacagg

SEQ ID NO: 3753845 - RNA, 18 nt, Salmonella typhimurium LT2
caugguaggccugauaag

SEQ ID NO: 3753846 - RNA, 15 nt, Salmonella typhimurium LT2
cauggugaugaucgc

SEQ ID NO: 3753847 - RNA, 22 nt, Salmonella typhimurium LT2
caugguggagucuaaaaauaau

SEQ ID NO: 3753848 - RNA, 14 nt, Salmonella typhimurium LT2
caugguguucagau

SEQ ID NO: 3753849 - RNA, 22 nt, Salmonella typhimurium LT2
caugguuaaaaucacuaagacc

SEQ ID NO: 3753850 - RNA, 13 nt, Salmonella typhimurium LT2
caugguugaaaaa

SEQ ID NO: 3753851 - RNA, 18 nt, Salmonella typhimurium LT2
cauguaaaauagcgccgu

SEQ ID NO: 3753852 - RNA, 18 nt, Salmonella typhimurium LT2
cauguacgaaagcgcgau

SEQ ID NO: 3753853 - RNA, 23 nt, Salmonella typhimurium LT2
cauguacgaaagcgcgaucaauu

SEQ ID NO: 3753854 - RNA, 21 nt, Salmonella typhimurium LT2
cauguagcgcggcagcgcgca

SEQ ID NO: 3753855 - RNA, 17 nt, Salmonella typhimurium LT2
caugucaagguggugcu

SEQ ID NO: 3753856 - RNA, 17 nt, Salmonella typhimurium LT2
cauguccggcgacucca

SEQ ID NO: 3753857 - RNA, 23 nt, Salmonella typhimurium LT2
cauguccggcgacuccagaauau

SEQ ID NO: 3753858 - RNA, 17 nt, Salmonella typhimurium LT2
cauguccggugauauug

SEQ ID NO: 3753859 - RNA, 23 nt, Salmonella typhimurium LT2
caugucggccuuuuugcgccgcg

SEQ ID NO: 3753860 - RNA, 13 nt, Salmonella typhimurium LT2
caugucguuagaa

SEQ ID NO: 3753861 - RNA, 22 nt, Salmonella typhimurium LT2
caugucuucauguacccguuuc

SEQ ID NO: 3753862 - RNA, 21 nt, Salmonella typhimurium LT2
caugucuucgcgcguggugcu

SEQ ID NO: 3753863 - RNA, 16 nt, Salmonella typhimurium LT2
caugugguaggcuuca

SEQ ID NO: 3753864 - RNA, 17 nt, Salmonella typhimurium LT2
cauguuaaauacgccgc

SEQ ID NO: 3753865 - RNA, 15 nt, Salmonella typhimurium LT2
cauguuaaugauucc

SEQ ID NO: 3753866 - RNA, 19 nt, Salmonella typhimurium LT2
cauguucccaugucagcgc

SEQ ID NO: 3753867 - RNA, 14 nt, Salmonella typhimurium LT2
cauguuccggcaga

SEQ ID NO: 3753868 - RNA, 22 nt, Salmonella typhimurium LT2
cauguugaucguaaaaugaaaa

SEQ ID NO: 3753869 - RNA, 23 nt, Salmonella typhimurium LT2
cauguugaucguaaaaugaaaaa

SEQ ID NO: 3753870 - RNA, 17 nt, Salmonella typhimurium LT2
cauguugccaugaucca

SEQ ID NO: 3753871 - RNA, 21 nt, Salmonella typhimurium LT2
cauguuuuauacucaaaaaau

SEQ ID NO: 3753872 - RNA, 18 nt, Salmonella typhimurium LT2
cauguuuuguauuaauug

SEQ ID NO: 3753873 - RNA, 10 nt, Salmonella typhimurium LT2
cauuaaaaaa

SEQ ID NO: 3753874 - RNA, 12 nt, Salmonella typhimurium LT2
cauuaaaaaaac

SEQ ID NO: 3753875 - RNA, 13 nt, Salmonella typhimurium LT2
cauuaaaaaaacg

SEQ ID NO: 3753876 - RNA, 12 nt, Salmonella typhimurium LT2
cauuaaaaugau

SEQ ID NO: 3753877 - RNA, 23 nt, Salmonella typhimurium LT2
cauuaaagagcgaaugcgcgcca

SEQ ID NO: 3753878 - RNA, 19 nt, Salmonella typhimurium LT2
cauuaaaugcgcccagccc

SEQ ID NO: 3753879 - RNA, 22 nt, Salmonella typhimurium LT2
cauuaacaucagaaaaaagcca

SEQ ID NO: 3753880 - RNA, 15 nt, Salmonella typhimurium LT2
cauuaacgccgugcu

SEQ ID NO: 3753881 - RNA, 16 nt, Salmonella typhimurium LT2
cauuaacggcaacagu

SEQ ID NO: 3753882 - RNA, 18 nt, Salmonella typhimurium LT2
cauuaauacaggccagca

SEQ ID NO: 3753883 - RNA, 19 nt, Salmonella typhimurium LT2
cauuaauaugcgcaaucac

SEQ ID NO: 3753884 - RNA, 14 nt, Salmonella typhimurium LT2
cauuaauauuuuau

SEQ ID NO: 3753885 - RNA, 20 nt, Salmonella typhimurium LT2
cauuaaucaguucaggaaca

SEQ ID NO: 3753886 - RNA, 21 nt, Salmonella typhimurium LT2
cauuaaucaguucaggaacau

SEQ ID NO: 3753887 - RNA, 22 nt, Salmonella typhimurium LT2
cauuaaucaguucaggaacauc

SEQ ID NO: 3753888 - RNA, 23 nt, Salmonella typhimurium LT2
cauuaauccccggcgaaagaaaa

SEQ ID NO: 3753889 - RNA, 13 nt, Salmonella typhimurium LT2
cauuaaucgccau

SEQ ID NO: 3753890 - RNA, 20 nt, Salmonella typhimurium LT2
cauuaaugccguuauacauc

SEQ ID NO: 3753891 - RNA, 23 nt, Salmonella typhimurium LT2
cauuaauggcgauaauagaaccg

SEQ ID NO: 3753892 - RNA, 18 nt, Salmonella typhimurium LT2
cauuaaugucaugaagcu

SEQ ID NO: 3753893 - RNA, 18 nt, Salmonella typhimurium LT2
cauuacaauguacagaau

SEQ ID NO: 3753894 - RNA, 17 nt, Salmonella typhimurium LT2
cauuacaggcaucuucc

SEQ ID NO: 3753895 - RNA, 18 nt, Salmonella typhimurium LT2
cauuucaggcaaaggaau

SEQ ID NO: 3753896 - RNA, 17 nt, Salmonella typhimurium LT2
cauuucaggcacuggcu

SEQ ID NO: 3753897 - RNA, 18 nt, Salmonella typhimurium LT2
cauuucccaauaguuuau

SEQ ID NO: 3753898 - RNA, 18 nt, Salmonella typhimurium LT2
cauuucccuuccccuuuc

SEQ ID NO: 3753899 - RNA, 23 nt, Salmonella typhimurium LT2
cauuucccuuccccuuucaccag

SEQ ID NO: 3753900 - RNA, 18 nt, Salmonella typhimurium LT2
cauuuccgccgccuucug

SEQ ID NO: 3753901 - RNA, 17 nt, Salmonella typhimurium LT2
cauuuccggcggcaacc

SEQ ID NO: 3753902 - RNA, 14 nt, Salmonella typhimurium LT2
cauuuccugcauua

SEQ ID NO: 3753903 - RNA, 20 nt, Salmonella typhimurium LT2
cauuucucgcacaccagauu

SEQ ID NO: 3753904 - RNA, 16 nt, Salmonella typhimurium LT2
cauuucugccugcuuc

SEQ ID NO: 3753905 - RNA, 21 nt, Salmonella typhimurium LT2
cauuucuucaagcguuuccag

SEQ ID NO: 3753906 - RNA, 14 nt, Salmonella typhimurium LT2
cauuucuuccagca

SEQ ID NO: 3753907 - RNA, 14 nt, Salmonella typhimurium LT2
cauuucuucuucaa

SEQ ID NO: 3753908 - RNA, 13 nt, Salmonella typhimurium LT2
cauuucuugcauc

SEQ ID NO: 3753909 - RNA, 20 nt, Salmonella typhimurium LT2
cauuucuugcaucaggcagu

SEQ ID NO: 3753910 - RNA, 19 nt, Salmonella typhimurium LT2
cauuugaacucuuccagau

SEQ ID NO: 3753911 - RNA, 17 nt, Salmonella typhimurium LT2
cauuugauuccagccuu

SEQ ID NO: 3753912 - RNA, 13 nt, Salmonella typhimurium LT2
cauuugccgcgcc

SEQ ID NO: 3753913 - RNA, 14 nt, Salmonella typhimurium LT2
cauuugccugccgc

SEQ ID NO: 3753914 - RNA, 16 nt, Salmonella typhimurium LT2
cauuugcgcacggcgc

SEQ ID NO: 3753915 - RNA, 18 nt, Salmonella typhimurium LT2
cauuugcgcuuucagcgc

SEQ ID NO: 3753916 - RNA, 16 nt, Salmonella typhimurium LT2
cauuuguacaaaaaau

SEQ ID NO: 3753917 - RNA, 20 nt, Salmonella typhimurium LT2
cauuuguacaaaaaauguga

SEQ ID NO: 3753918 - RNA, 18 nt, Salmonella typhimurium LT2
cauuugucgcuguuaauu

SEQ ID NO: 3753919 - RNA, 21 nt, Salmonella typhimurium LT2
cauuuuaucgacacuauuuuu

SEQ ID NO: 3753920 - RNA, 15 nt, Salmonella typhimurium LT2
cauuuuaucuuuugu

SEQ ID NO: 3753921 - RNA, 19 nt, Salmonella typhimurium LT2
cauuuuauucauauuuaua

SEQ ID NO: 3753922 - RNA, 14 nt, Salmonella typhimurium LT2
cauuuucaccugga

SEQ ID NO: 3753923 - RNA, 18 nt, Salmonella typhimurium LT2
cauuuucaccuggaugcu

SEQ ID NO: 3753924 - RNA, 17 nt, Salmonella typhimurium LT2
cauuuuccgcugucuau

SEQ ID NO: 3753925 - RNA, 20 nt, Salmonella typhimurium LT2
cauuuuccgcugucuaucca

SEQ ID NO: 3753926 - RNA, 19 nt, Salmonella typhimurium LT2
cauuuuccggcgacgcuuu

SEQ ID NO: 3753927 - RNA, 16 nt, Salmonella typhimurium LT2
cauuuucuuucaucaa

SEQ ID NO: 3753928 - RNA, 18 nt, Salmonella typhimurium LT2
cauuuuggccgcuuuagu

SEQ ID NO: 3753929 - RNA, 19 nt, Salmonella typhimurium LT2
cauuuugguuggcgacuuc

SEQ ID NO: 3753930 - RNA, 22 nt, Salmonella typhimurium LT2
cauuuuguauucgcagggcugc

SEQ ID NO: 3753931 - RNA, 17 nt, Salmonella typhimurium LT2
cauuuuuacaccccuga

SEQ ID NO: 3753932 - RNA, 21 nt, Salmonella typhimurium LT2
cauuuuuacucagcacauuca

SEQ ID NO: 3753933 - RNA, 21 nt, Salmonella typhimurium LT2
cauuuuuccagccauuuuuuu

SEQ ID NO: 3753934 - RNA, 19 nt, Salmonella typhimurium LT2
cauuuuuuaugcccgcguu

SEQ ID NO: 3753935 - RNA, 17 nt, Salmonella typhimurium LT2
cauuuuuugacaacaaa

SEQ ID NO: 3753936 - RNA, 14 nt, Salmonella typhimurium LT2
cauuuuuuggugau

SEQ ID NO: 3753937 - RNA, 15 nt, Salmonella typhimurium LT2
cauuuuuuucagccu

SEQ ID NO: 3753938 - RNA, 15 nt, Salmonella typhimurium LT2
ccaaaaaaucagcaa

SEQ ID NO: 3753939 - RNA, 16 nt, Salmonella typhimurium LT2
ccaaaacccaccagca

SEQ ID NO: 3753940 - RNA, 13 nt, Salmonella typhimurium LT2
ccaaaagcgccac

SEQ ID NO: 3753941 - RNA, 19 nt, Salmonella typhimurium LT2
ccaaaagcgccacgcguca

SEQ ID NO: 3753942 - RNA, 17 nt, Salmonella typhimurium LT2
ccaaaauagauaaucgc

SEQ ID NO: 3753943 - RNA, 20 nt, Salmonella typhimurium LT2
ccaaaauccagggaaaccau

SEQ ID NO: 3753944 - RNA, 21 nt, Salmonella typhimurium LT2
ccaaaauggcaaguaaaauaa

SEQ ID NO: 3753945 - RNA, 12 nt, Salmonella typhimurium LT2
ccaaacugcgga

SEQ ID NO: 3753946 - RNA, 19 nt, Salmonella typhimurium LT2
ccaaacugcggaauuuuau

SEQ ID NO: 3753947 - RNA, 15 nt, Salmonella typhimurium LT2
ccaaagaaacgcuga

SEQ ID NO: 3753948 - RNA, 19 nt, Salmonella typhimurium LT2
ccaaagauaaacgacagcg

SEQ ID NO: 3753949 - RNA, 14 nt, Salmonella typhimurium LT2
ccaaagauaagacc

SEQ ID NO: 3753950 - RNA, 19 nt, Salmonella typhimurium LT2
ccaaagcaaucgccagcgc

SEQ ID NO: 3753951 - RNA, 23 nt, Salmonella typhimurium LT2
ccaaagcaccauucuucaacaau

SEQ ID NO: 3753952 - RNA, 14 nt, Salmonella typhimurium LT2
ccaaagcagcugcu

SEQ ID NO: 3753953 - RNA, 18 nt, Salmonella typhimurium LT2
ccaaagcccgcaaacaga

SEQ ID NO: 3753954 - RNA, 20 nt, Salmonella typhimurium LT2
ccaaagcccgcaaacagagc

SEQ ID NO: 3753955 - RNA, 18 nt, Salmonella typhimurium LT2
ccaaaguuaaucagcgcu

SEQ ID NO: 3753956 - RNA, 23 nt, Salmonella typhimurium LT2
ccaaauaaucccgcauauuuuuc

SEQ ID NO: 3753957 - RNA, 16 nt, Salmonella typhimurium LT2
ccaaauagcgccagac

SEQ ID NO: 3753958 - RNA, 17 nt, Salmonella typhimurium LT2
ccaaauaguccagcagc

SEQ ID NO: 3753959 - RNA, 18 nt, Salmonella typhimurium LT2
ccaaauaguccagcagcc

SEQ ID NO: 3753960 - RNA, 12 nt, Salmonella typhimurium LT2
ccaaauauuucu

SEQ ID NO: 3753961 - RNA, 15 nt, Salmonella typhimurium LT2
ccaaaucgucagccg

SEQ ID NO: 3753962 - RNA, 16 nt, Salmonella typhimurium LT2
ccaacaaacgcucauu

SEQ ID NO: 3753963 - RNA, 15 nt, Salmonella typhimurium LT2
ccaacaaaguggauu

SEQ ID NO: 3753964 - RNA, 14 nt, Salmonella typhimurium LT2
ccaacaacccauuc

SEQ ID NO: 3753965 - RNA, 19 nt, Salmonella typhimurium LT2
ccaacaaggauauccgcca

SEQ ID NO: 3753966 - RNA, 19 nt, Salmonella typhimurium LT2
ccaacaaugccacgccccu

SEQ ID NO: 3753967 - RNA, 19 nt, Salmonella typhimurium LT2
ccaacacaucgacaugcag

SEQ ID NO: 3753968 - RNA, 14 nt, Salmonella typhimurium LT2
ccaacaccagcacu

SEQ ID NO: 3753969 - RNA, 23 nt, Salmonella typhimurium LT2
ccaacacggcgcucaggaucgcc

SEQ ID NO: 3753970 - RNA, 18 nt, Salmonella typhimurium LT2
ccaacagcaauguuucaa

SEQ ID NO: 3753971 - RNA, 19 nt, Salmonella typhimurium LT2
ccaacagccgccuguuuga

SEQ ID NO: 3753972 - RNA, 22 nt, Salmonella typhimurium LT2
ccaacaggaacaucguguccug

SEQ ID NO: 3753973 - RNA, 21 nt, Salmonella typhimurium LT2
ccaacagggcggccuccuggc

SEQ ID NO: 3753974 - RNA, 21 nt, Salmonella typhimurium LT2
ccaacaucaguucagaaacgg

SEQ ID NO: 3753975 - RNA, 18 nt, Salmonella typhimurium LT2
ccaaccacuacugcguca

SEQ ID NO: 3753976 - RNA, 19 nt, Salmonella typhimurium LT2
ccaaccaucggcacacuuu

SEQ ID NO: 3753977 - RNA, 23 nt, Salmonella typhimurium LT2
ccaacccgaccaggacaaaaggc

SEQ ID NO: 3753978 - RNA, 15 nt, Salmonella typhimurium LT2
ccaaccgaacaauau

SEQ ID NO: 3753979 - RNA, 23 nt, Salmonella typhimurium LT2
ccaaccgcgacggggcgcagaaa

SEQ ID NO: 3753980 - RNA, 18 nt, Salmonella typhimurium LT2
ccaaccuacgcgccacgu

SEQ ID NO: 3753981 - RNA, 18 nt, Salmonella typhimurium LT2
ccaacgacccccaccaug

SEQ ID NO: 3753982 - RNA, 17 nt, Salmonella typhimurium LT2
ccaacgauauucgcugg

SEQ ID NO: 3753983 - RNA, 18 nt, Salmonella typhimurium LT2
ccaacgauauucgcuggu

SEQ ID NO: 3753984 - RNA, 18 nt, Salmonella typhimurium LT2
ccaacgcaaugcgauaag

SEQ ID NO: 3753985 - RNA, 21 nt, Salmonella typhimurium LT2
ccaacgccaaccggcugacgu

SEQ ID NO: 3753986 - RNA, 15 nt, Salmonella typhimurium LT2
ccaacgcccaacugu

SEQ ID NO: 3753987 - RNA, 12 nt, Salmonella typhimurium LT2
ccaacgccgccc

SEQ ID NO: 3753988 - RNA, 14 nt, Salmonella typhimurium LT2
ccaacggcgacgcc

SEQ ID NO: 3753989 - RNA, 16 nt, Salmonella typhimurium LT2
ccaacgguacgacgcc

SEQ ID NO: 3753990 - RNA, 14 nt, Salmonella typhimurium LT2
ccaacguauaaaau

SEQ ID NO: 3753991 - RNA, 19 nt, Salmonella typhimurium LT2
ccaacguugugcuccgccg

SEQ ID NO: 3753992 - RNA, 16 nt, Salmonella typhimurium LT2
ccaacugcauuucaua

SEQ ID NO: 3753993 - RNA, 15 nt, Salmonella typhimurium LT2
ccaacugccaaacca

SEQ ID NO: 3753994 - RNA, 14 nt, Salmonella typhimurium LT2
ccaacugccagcgg

SEQ ID NO: 3753995 - RNA, 15 nt, Salmonella typhimurium LT2
ccaacugcgccugaa

SEQ ID NO: 3753996 - RNA, 16 nt, Salmonella typhimurium LT2
ccaacugcgccugaag

SEQ ID NO: 3753997 - RNA, 20 nt, Salmonella typhimurium LT2
ccaacugucgccauccugac

SEQ ID NO: 3753998 - RNA, 24 nt, Salmonella typhimurium LT2
ccaacuuuacuuaguaucauauuu

SEQ ID NO: 3753999 - RNA, 19 nt, Salmonella typhimurium LT2
ccacccgcgcgcuuuccac

SEQ ID NO: 3754000 - RNA, 19 nt, Salmonella typhimurium LT2
ccacccgcugauaaaauuc

SEQ ID NO: 3754001 - RNA, 13 nt, Salmonella typhimurium LT2
ccacccuggcgca

SEQ ID NO: 3754002 - RNA, 18 nt, Salmonella typhimurium LT2
ccaccgcauuuucagcuu

SEQ ID NO: 3754003 - RNA, 12 nt, Salmonella typhimurium LT2
ccaccgccagaa

SEQ ID NO: 3754004 - RNA, 16 nt, Salmonella typhimurium LT2
ccaccgccagacgccc

SEQ ID NO: 3754005 - RNA, 16 nt, Salmonella typhimurium LT2
ccaccgcgcgcuuaau

SEQ ID NO: 3754006 - RNA, 14 nt, Salmonella typhimurium LT2
ccaccggaccgccg

SEQ ID NO: 3754007 - RNA, 19 nt, Salmonella typhimurium LT2
ccaccggaccuaauaacca

SEQ ID NO: 3754008 - RNA, 12 nt, Salmonella typhimurium LT2
ccaccggcagcg

SEQ ID NO: 3754009 - RNA, 15 nt, Salmonella typhimurium LT2
ccaccggcagcgucg

SEQ ID NO: 3754010 - RNA, 24 nt, Salmonella typhimurium LT2
ccaccgggcaacccggcuaaauga

SEQ ID NO: 3754011 - RNA, 15 nt, Salmonella typhimurium LT2
ccaccggggaucaag

SEQ ID NO: 3754012 - RNA, 18 nt, Salmonella typhimurium LT2
ccaccgguggcaucaagc

SEQ ID NO: 3754013 - RNA, 17 nt, Salmonella typhimurium LT2
ccaccgguuuuuuccug

SEQ ID NO: 3754014 - RNA, 21 nt, Salmonella typhimurium LT2
ccaccgguuuuuuccugcaca

SEQ ID NO: 3754015 - RNA, 22 nt, Salmonella typhimurium LT2
ccaccguaugugcgccgugcag

SEQ ID NO: 3754016 - RNA, 14 nt, Salmonella typhimurium LT2
ccaccguauuuuuu

SEQ ID NO: 3754017 - RNA, 14 nt, Salmonella typhimurium LT2
ccaccgucuugcug

SEQ ID NO: 3754018 - RNA, 13 nt, Salmonella typhimurium LT2
ccaccguuauuuc

SEQ ID NO: 3754019 - RNA, 21 nt, Salmonella typhimurium LT2
ccaccguuuaaucgcccugcg

SEQ ID NO: 3754020 - RNA, 23 nt, Salmonella typhimurium LT2
ccaccucuuuuaacgaacgcgcg

SEQ ID NO: 3754021 - RNA, 12 nt, Salmonella typhimurium LT2
ccaccugcagca

SEQ ID NO: 3754022 - RNA, 15 nt, Salmonella typhimurium LT2
ccaccugcagcagcu

SEQ ID NO: 3754023 - RNA, 21 nt, Salmonella typhimurium LT2
ccaccugccaggcuucgcgca

SEQ ID NO: 3754024 - RNA, 15 nt, Salmonella typhimurium LT2
ccaccugccaguccg

SEQ ID NO: 3754025 - RNA, 18 nt, Salmonella typhimurium LT2
ccaccuguucgccuucgu

SEQ ID NO: 3754026 - RNA, 18 nt, Salmonella typhimurium LT2
ccaccuuaaacuugccgu

SEQ ID NO: 3754027 - RNA, 15 nt, Salmonella typhimurium LT2
ccaccuuccagggua

SEQ ID NO: 3754028 - RNA, 19 nt, Salmonella typhimurium LT2
ccaccuucucuuuaugcgu

SEQ ID NO: 3754029 - RNA, 15 nt, Salmonella typhimurium LT2
ccaccuuucugcucc

SEQ ID NO: 3754030 - RNA, 23 nt, Salmonella typhimurium LT2
ccaccuuugaaaaucacaucgcc

SEQ ID NO: 3754031 - RNA, 17 nt, Salmonella typhimurium LT2
ccaccuuugacgccugc

SEQ ID NO: 3754032 - RNA, 21 nt, Salmonella typhimurium LT2
ccaccuuugacgccugcaucc

SEQ ID NO: 3754033 - RNA, 13 nt, Salmonella typhimurium LT2
ccacgaaagucug

SEQ ID NO: 3754034 - RNA, 11 nt, Salmonella typhimurium LT2
ccacgacaauc

SEQ ID NO: 3754035 - RNA, 18 nt, Salmonella typhimurium LT2
ccacgacgaccgccagag

SEQ ID NO: 3754036 - RNA, 16 nt, Salmonella typhimurium LT2
ccacgagaaauccaca

SEQ ID NO: 3754037 - RNA, 17 nt, Salmonella typhimurium LT2
ccacgaguggcgcggaa

SEQ ID NO: 3754038 - RNA, 20 nt, Salmonella typhimurium LT2
ccacgaguggcgcggaaagc

SEQ ID NO: 3754039 - RNA, 17 nt, Salmonella typhimurium LT2
ccacgauaaucccggcu

SEQ ID NO: 3754040 - RNA, 23 nt, Salmonella typhimurium LT2
ccacgauaaucccggcuuucucc

SEQ ID NO: 3754041 - RNA, 17 nt, Salmonella typhimurium LT2
ccacgcaggcgaccucg

SEQ ID NO: 3754042 - RNA, 21 nt, Salmonella typhimurium LT2
ccacgcauaaugagcgcuuga

SEQ ID NO: 3754043 - RNA, 22 nt, Salmonella typhimurium LT2
ccacgcauaaugagcgcuugau

SEQ ID NO: 3754044 - RNA, 13 nt, Salmonella typhimurium LT2
ccacgccagccag

SEQ ID NO: 3754045 - RNA, 15 nt, Salmonella typhimurium LT2
ccacgccaucgcggc

SEQ ID NO: 3754046 - RNA, 17 nt, Salmonella typhimurium LT2
ccacgccaucgcggcgc

SEQ ID NO: 3754047 - RNA, 18 nt, Salmonella typhimurium LT2
ccacgccauggccgcagc

SEQ ID NO: 3754048 - RNA, 15 nt, Salmonella typhimurium LT2
ccacgcccagcgccg

SEQ ID NO: 3754049 - RNA, 13 nt, Salmonella typhimurium LT2
ccacgcccagcua

SEQ ID NO: 3754050 - RNA, 13 nt, Salmonella typhimurium LT2
ccacgcccgccgc

SEQ ID NO: 3754051 - RNA, 18 nt, Salmonella typhimurium LT2
ccacgcccgccgccagca

SEQ ID NO: 3754052 - RNA, 16 nt, Salmonella typhimurium LT2
ccacgccgaguaauuu

SEQ ID NO: 3754053 - RNA, 19 nt, Salmonella typhimurium LT2
ccacgccguagcugcgcgc

SEQ ID NO: 3754054 - RNA, 20 nt, Salmonella typhimurium LT2
ccacgcgaugcaaccccuga

SEQ ID NO: 3754055 - RNA, 19 nt, Salmonella typhimurium LT2
ccacgcggcguacgcugca

SEQ ID NO: 3754056 - RNA, 21 nt, Salmonella typhimurium LT2
ccacgcguacgguuacaaccc

SEQ ID NO: 3754057 - RNA, 15 nt, Salmonella typhimurium LT2
ccacgcgucagguua

SEQ ID NO: 3754058 - RNA, 22 nt, Salmonella typhimurium LT2
ccacgcuaacguccgccgucag

SEQ ID NO: 3754059 - RNA, 22 nt, Salmonella typhimurium LT2
ccacgcugauacguaacaugac

SEQ ID NO: 3754060 - RNA, 17 nt, Salmonella typhimurium LT2
ccacgcuucccagcguc

SEQ ID NO: 3754061 - RNA, 17 nt, Salmonella typhimurium LT2
ccacggaauacgacgcg

SEQ ID NO: 3754062 - RNA, 19 nt, Salmonella typhimurium LT2
ccacggauaagccagcccu

SEQ ID NO: 3754063 - RNA, 19 nt, Salmonella typhimurium LT2
ccacggauggccucugcca

SEQ ID NO: 3754064 - RNA, 21 nt, Salmonella typhimurium LT2
ccacggauuuaauccaccaca

SEQ ID NO: 3754065 - RNA, 18 nt, Salmonella typhimurium LT2
ccacggcauguucugccg

SEQ ID NO: 3754066 - RNA, 16 nt, Salmonella typhimurium LT2
ccacggccagcagcca

SEQ ID NO: 3754067 - RNA, 16 nt, Salmonella typhimurium LT2
ccacggccccgggcga

SEQ ID NO: 3754068 - RNA, 18 nt, Salmonella typhimurium LT2
ccacggccccgggcgacc

SEQ ID NO: 3754069 - RNA, 18 nt, Salmonella typhimurium LT2
ccacggcgcacacgccca

SEQ ID NO: 3754070 - RNA, 11 nt, Salmonella typhimurium LT2
ccacggcgucc

SEQ ID NO: 3754071 - RNA, 15 nt, Salmonella typhimurium LT2
ccacggcguccugcg

SEQ ID NO: 3754072 - RNA, 21 nt, Salmonella typhimurium LT2
ccacggcguguugaaguccuc

SEQ ID NO: 3754073 - RNA, 15 nt, Salmonella typhimurium LT2
ccacggcuucagcgg

SEQ ID NO: 3754074 - RNA, 23 nt, Salmonella typhimurium LT2
ccacggguagagcuuuuuauuac

SEQ ID NO: 3754075 - RNA, 20 nt, Salmonella typhimurium LT2
ccacgguaauuuacaaccgu

SEQ ID NO: 3754076 - RNA, 15 nt, Salmonella typhimurium LT2
ccacgguguaccccg

SEQ ID NO: 3754077 - RNA, 18 nt, Salmonella typhimurium LT2
ccacgguuaucuggcgca

SEQ ID NO: 3754078 - RNA, 17 nt, Salmonella typhimurium LT2
ccacgguucacggccaa

SEQ ID NO: 3754079 - RNA, 22 nt, Salmonella typhimurium LT2
ccacgguucacggccaaagcgc

SEQ ID NO: 3754080 - RNA, 18 nt, Salmonella typhimurium LT2
ccacguaacucggcagcg

SEQ ID NO: 3754081 - RNA, 14 nt, Salmonella typhimurium LT2
ccacgucagcccaa

SEQ ID NO: 3754082 - RNA, 21 nt, Salmonella typhimurium LT2
ccacgucagcccaaaacgcgc

SEQ ID NO: 3754083 - RNA, 21 nt, Salmonella typhimurium LT2
ccacguucggcguguagccaa

SEQ ID NO: 3754084 - RNA, 23 nt, Salmonella typhimurium LT2
ccacguugucggcucauccagca

SEQ ID NO: 3754085 - RNA, 14 nt, Salmonella typhimurium LT2
ccacuaacagugcg

SEQ ID NO: 3754086 - RNA, 21 nt, Salmonella typhimurium LT2
ccacuaacuggcaaucaugcg

SEQ ID NO: 3754087 - RNA, 13 nt, Salmonella typhimurium LT2
ccacuaccgccac

SEQ ID NO: 3754088 - RNA, 15 nt, Salmonella typhimurium LT2
ccacuacgcagcucc

SEQ ID NO: 3754089 - RNA, 20 nt, Salmonella typhimurium LT2
ccacucacgcucgcggaagc

SEQ ID NO: 3754090 - RNA, 16 nt, Salmonella typhimurium LT2
ccacucauccagcaaa

SEQ ID NO: 3754091 - RNA, 16 nt, Salmonella typhimurium LT2
ccacuccggugcccau

SEQ ID NO: 3754092 - RNA, 23 nt, Salmonella typhimurium LT2
ccacucggagguuuucucaucca

SEQ ID NO: 3754093 - RNA, 22 nt, Salmonella typhimurium LT2
ccacucggcgagcaguacgccu

SEQ ID NO: 3754094 - RNA, 13 nt, Salmonella typhimurium LT2
ccacucuccagca

SEQ ID NO: 3754095 - RNA, 15 nt, Salmonella typhimurium LT2
ccacucuccagcauc

SEQ ID NO: 3754096 - RNA, 14 nt, Salmonella typhimurium LT2
ccacucuuccagca

SEQ ID NO: 3754097 - RNA, 17 nt, Salmonella typhimurium LT2
ccacucuuuuaaggccc

SEQ ID NO: 3754098 - RNA, 15 nt, Salmonella typhimurium LT2
ccacugaccugcugg

SEQ ID NO: 3754099 - RNA, 20 nt, Salmonella typhimurium LT2
ccacugaguuucaccgccag

SEQ ID NO: 3754100 - RNA, 22 nt, Salmonella typhimurium LT2
ccacugauaguccaucaccucu

SEQ ID NO: 3754101 - RNA, 14 nt, Salmonella typhimurium LT2
ccacugcacgccag

SEQ ID NO: 3754102 - RNA, 13 nt, Salmonella typhimurium LT2
ccacugcaucucu

SEQ ID NO: 3754103 - RNA, 15 nt, Salmonella typhimurium LT2
ccagaugucaguaac

SEQ ID NO: 3754104 - RNA, 18 nt, Salmonella typhimurium LT2
ccagaugucaguaacagu

SEQ ID NO: 3754105 - RNA, 16 nt, Salmonella typhimurium LT2
ccagaugucgccagau

SEQ ID NO: 3754106 - RNA, 17 nt, Salmonella typhimurium LT2
ccagauuacugcccuga

SEQ ID NO: 3754107 - RNA, 14 nt, Salmonella typhimurium LT2
ccagauuaucggcc

SEQ ID NO: 3754108 - RNA, 19 nt, Salmonella typhimurium LT2
ccagauuaucggccagcgc

SEQ ID NO: 3754109 - RNA, 23 nt, Salmonella typhimurium LT2
ccagcaaaucaauuugauggcua

SEQ ID NO: 3754110 - RNA, 12 nt, Salmonella typhimurium LT2
ccagcaaaucgc

SEQ ID NO: 3754111 - RNA, 22 nt, Salmonella typhimurium LT2
ccagcaacagcgcguccagcgg

SEQ ID NO: 3754112 - RNA, 18 nt, Salmonella typhimurium LT2
ccagcaacgagccgucgc

SEQ ID NO: 3754113 - RNA, 13 nt, Salmonella typhimurium LT2
ccagcaacgccag

SEQ ID NO: 3754114 - RNA, 13 nt, Salmonella typhimurium LT2
ccagcaacgccgc

SEQ ID NO: 3754115 - RNA, 22 nt, Salmonella typhimurium LT2
ccagcaacguauuccacggaau

SEQ ID NO: 3754116 - RNA, 23 nt, Salmonella typhimurium LT2
ccagcaaggagacgcccgucacc

SEQ ID NO: 3754117 - RNA, 19 nt, Salmonella typhimurium LT2
ccagcaaggcugccgccag

SEQ ID NO: 3754118 - RNA, 15 nt, Salmonella typhimurium LT2
ccagcaaugccgccg

SEQ ID NO: 3754119 - RNA, 16 nt, Salmonella typhimurium LT2
ccagcaaugccgccgc

SEQ ID NO: 3754120 - RNA, 12 nt, Salmonella typhimurium LT2
ccagcacagccc

SEQ ID NO: 3754121 - RNA, 17 nt, Salmonella typhimurium LT2
ccagcacagcccaguaa

SEQ ID NO: 3754122 - RNA, 13 nt, Salmonella typhimurium LT2
ccagcacagcggu

SEQ ID NO: 3754123 - RNA, 19 nt, Salmonella typhimurium LT2
ccagcacaggcgucccggu

SEQ ID NO: 3754124 - RNA, 19 nt, Salmonella typhimurium LT2
ccagcacagguacaggccg

SEQ ID NO: 3754125 - RNA, 21 nt, Salmonella typhimurium LT2
ccagcacagguacaggccgcc

SEQ ID NO: 3754126 - RNA, 24 nt, Salmonella typhimurium LT2
ccagcacauuacaggcaucuucca

SEQ ID NO: 3754127 - RNA, 12 nt, Salmonella typhimurium LT2
ccagcaccagca

SEQ ID NO: 3754128 - RNA, 16 nt, Salmonella typhimurium LT2
ccagcaccagcagcgc

SEQ ID NO: 3754129 - RNA, 14 nt, Salmonella typhimurium LT2
ccagcaccagcagu

SEQ ID NO: 3754130 - RNA, 15 nt, Salmonella typhimurium LT2
ccagcaccagcagug

SEQ ID NO: 3754131 - RNA, 22 nt, Salmonella typhimurium LT2
ccagcaccaucuuuuccggcag

SEQ ID NO: 3754132 - RNA, 13 nt, Salmonella typhimurium LT2
ccagcaccauggc

SEQ ID NO: 3754133 - RNA, 15 nt, Salmonella typhimurium LT2
ccagcaccauggcua

SEQ ID NO: 3754134 - RNA, 16 nt, Salmonella typhimurium LT2
ccagcacgagugccag

SEQ ID NO: 3754135 - RNA, 15 nt, Salmonella typhimurium LT2
ccagcacgcacagcg

SEQ ID NO: 3754136 - RNA, 12 nt, Salmonella typhimurium LT2
ccagcacgccuu

SEQ ID NO: 3754137 - RNA, 14 nt, Salmonella typhimurium LT2
ccagcacuaacagc

SEQ ID NO: 3754138 - RNA, 16 nt, Salmonella typhimurium LT2
ccagcacuaacagcag

SEQ ID NO: 3754139 - RNA, 17 nt, Salmonella typhimurium LT2
ccagcacuaacagcagc

SEQ ID NO: 3754140 - RNA, 19 nt, Salmonella typhimurium LT2
ccagcagaauaacaucuuc

SEQ ID NO: 3754141 - RNA, 22 nt, Salmonella typhimurium LT2
ccagcagcacaaaaaucaugcu

SEQ ID NO: 3754142 - RNA, 12 nt, Salmonella typhimurium LT2
ccagcagcagcu

SEQ ID NO: 3754143 - RNA, 23 nt, Salmonella typhimurium LT2
ccagcagcauaaaaccgccgccc

SEQ ID NO: 3754144 - RNA, 21 nt, Salmonella typhimurium LT2
ccagcagccaugccagcgcgg

SEQ ID NO: 3754145 - RNA, 22 nt, Salmonella typhimurium LT2
ccagcagcgccaguuuuucccg

SEQ ID NO: 3754146 - RNA, 11 nt, Salmonella typhimurium LT2
ccagcagcgcg

SEQ ID NO: 3754147 - RNA, 15 nt, Salmonella typhimurium LT2
ccagcagcgcggcgu

SEQ ID NO: 3754148 - RNA, 21 nt, Salmonella typhimurium LT2
ccagcagcgcggcgucgccgc

SEQ ID NO: 3754149 - RNA, 12 nt, Salmonella typhimurium LT2
ccagcagggcaa

SEQ ID NO: 3754150 - RNA, 16 nt, Salmonella typhimurium LT2
ccagcagggccacaac

SEQ ID NO: 3754151 - RNA, 22 nt, Salmonella typhimurium LT2
ccagcagggcguuuuccagcgc

SEQ ID NO: 3754152 - RNA, 23 nt, Salmonella typhimurium LT2
ccagcagguaaacagacaauuag

SEQ ID NO: 3754153 - RNA, 21 nt, Salmonella typhimurium LT2
ccagcagguggaucugaaucu

SEQ ID NO: 3754154 - RNA, 14 nt, Salmonella typhimurium LT2
ccagcauaaugagc

SEQ ID NO: 3754155 - RNA, 14 nt, Salmonella typhimurium LT2
ccagcauagucgcu

SEQ ID NO: 3754156 - RNA, 15 nt, Salmonella typhimurium LT2
ccagcauauaaauac

SEQ ID NO: 3754157 - RNA, 16 nt, Salmonella typhimurium LT2
ccagcaucacaucaaa

SEQ ID NO: 3754158 - RNA, 22 nt, Salmonella typhimurium LT2
ccagcaucaugggcucaucaaa

SEQ ID NO: 3754159 - RNA, 15 nt, Salmonella typhimurium LT2
ccagcaucauuuuuu

SEQ ID NO: 3754160 - RNA, 13 nt, Salmonella typhimurium LT2
ccagcaucccgcu

SEQ ID NO: 3754161 - RNA, 17 nt, Salmonella typhimurium LT2
ccagcaucgaccaggau

SEQ ID NO: 3754162 - RNA, 16 nt, Salmonella typhimurium LT2
ccagcaucgcccgggc

SEQ ID NO: 3754163 - RNA, 12 nt, Salmonella typhimurium LT2
ccagcaucgccg

SEQ ID NO: 3754164 - RNA, 18 nt, Salmonella typhimurium LT2
ccagcaucucacguacaa

SEQ ID NO: 3754165 - RNA, 21 nt, Salmonella typhimurium LT2
ccagcaugaucauacugccgc

SEQ ID NO: 3754166 - RNA, 14 nt, Salmonella typhimurium LT2
ccagcaugcccgcc

SEQ ID NO: 3754167 - RNA, 16 nt, Salmonella typhimurium LT2
ccagcauggcggucag

SEQ ID NO: 3754168 - RNA, 14 nt, Salmonella typhimurium LT2
ccagcauggcgucg

SEQ ID NO: 3754169 - RNA, 18 nt, Salmonella typhimurium LT2
ccagcauggcgucggcga

SEQ ID NO: 3754170 - RNA, 23 nt, Salmonella typhimurium LT2
ccagcauuaccagcaauaacagg

SEQ ID NO: 3754171 - RNA, 14 nt, Salmonella typhimurium LT2
ccagcauugauuuu

SEQ ID NO: 3754172 - RNA, 11 nt, Salmonella typhimurium LT2
ccagcauuucu

SEQ ID NO: 3754173 - RNA, 16 nt, Salmonella typhimurium LT2
ccagcauuucuucaag

SEQ ID NO: 3754174 - RNA, 13 nt, Salmonella typhimurium LT2
ccagccacgcgug

SEQ ID NO: 3754175 - RNA, 15 nt, Salmonella typhimurium LT2
ccagccacugcgcca

SEQ ID NO: 3754176 - RNA, 22 nt, Salmonella typhimurium LT2
ccagccaguccgugugcggcgu

SEQ ID NO: 3754177 - RNA, 17 nt, Salmonella typhimurium LT2
ccagccauaaaugcuga

SEQ ID NO: 3754178 - RNA, 19 nt, Salmonella typhimurium LT2
ccagccauucgaauucuga

SEQ ID NO: 3754179 - RNA, 21 nt, Salmonella typhimurium LT2
ccagccauucgaauucugaua

SEQ ID NO: 3754180 - RNA, 20 nt, Salmonella typhimurium LT2
ccagccauugcccggccucc

SEQ ID NO: 3754181 - RNA, 12 nt, Salmonella typhimurium LT2
ccagccccagaa

SEQ ID NO: 3754182 - RNA, 13 nt, Salmonella typhimurium LT2
ccagccccagccc

SEQ ID NO: 3754183 - RNA, 14 nt, Salmonella typhimurium LT2
ccagccccagcccu

SEQ ID NO: 3754184 - RNA, 17 nt, Salmonella typhimurium LT2
ccagcccccagccgauc

SEQ ID NO: 3754185 - RNA, 18 nt, Salmonella typhimurium LT2
ccagccccgaugucgcca

SEQ ID NO: 3754186 - RNA, 21 nt, Salmonella typhimurium LT2
ccagccccuucgcuguccauu

SEQ ID NO: 3754187 - RNA, 19 nt, Salmonella typhimurium LT2
ccagcccggcgcacacccu

SEQ ID NO: 3754188 - RNA, 20 nt, Salmonella typhimurium LT2
ccagcccggcgcacacccug

SEQ ID NO: 3754189 - RNA, 21 nt, Salmonella typhimurium LT2
ccagcccggcgcacacccugc

SEQ ID NO: 3754190 - RNA, 22 nt, Salmonella typhimurium LT2
ccagcccggcgcacacccugca

SEQ ID NO: 3754191 - RNA, 23 nt, Salmonella typhimurium LT2
ccagcccggcgcacacccugcag

SEQ ID NO: 3754192 - RNA, 16 nt, Salmonella typhimurium LT2
ccagcccuaaaaauag

SEQ ID NO: 3754193 - RNA, 15 nt, Salmonella typhimurium LT2
ccagcccugccacca

SEQ ID NO: 3754194 - RNA, 17 nt, Salmonella typhimurium LT2
ccagcccugccaccagc

SEQ ID NO: 3754195 - RNA, 22 nt, Salmonella typhimurium LT2
ccagcccugcgaucaucauucc

SEQ ID NO: 3754196 - RNA, 16 nt, Salmonella typhimurium LT2
ccagcccuuccgccgg

SEQ ID NO: 3754197 - RNA, 22 nt, Salmonella typhimurium LT2
ccagccgacaggcgcgaaacgc

SEQ ID NO: 3754198 - RNA, 15 nt, Salmonella typhimurium LT2
ccagccgaucaucac

SEQ ID NO: 3754199 - RNA, 18 nt, Salmonella typhimurium LT2
ccagccgaucaucacgaa

SEQ ID NO: 3754200 - RNA, 16 nt, Salmonella typhimurium LT2
ccagccgaucaucgua

SEQ ID NO: 3754201 - RNA, 15 nt, Salmonella typhimurium LT2
ccagccgaucuauuu

SEQ ID NO: 3754202 - RNA, 12 nt, Salmonella typhimurium LT2
ccagccgcccgc

SEQ ID NO: 3754203 - RNA, 13 nt, Salmonella typhimurium LT2
ccagccgccgccg

SEQ ID NO: 3754204 - RNA, 21 nt, Salmonella typhimurium LT2
ccagccgcgccaucuccuccu

SEQ ID NO: 3754205 - RNA, 13 nt, Salmonella typhimurium LT2
ccagccgcuuaau

SEQ ID NO: 3754206 - RNA, 18 nt, Salmonella typhimurium LT2
ccagccgcuuuccgccgc

SEQ ID NO: 3754207 - RNA, 14 nt, Salmonella typhimurium LT2
ccagcuugccgucg

SEQ ID NO: 3754208 - RNA, 19 nt, Salmonella typhimurium LT2
ccagcuuguuauccaucag

SEQ ID NO: 3754209 - RNA, 15 nt, Salmonella typhimurium LT2
ccaggaaagagggca

SEQ ID NO: 3754210 - RNA, 21 nt, Salmonella typhimurium LT2
ccaggaagaguaucucucugg

SEQ ID NO: 3754211 - RNA, 17 nt, Salmonella typhimurium LT2
ccaggaauuuucccaua

SEQ ID NO: 3754212 - RNA, 22 nt, Salmonella typhimurium LT2
ccaggagacaauaucucccggu

SEQ ID NO: 3754213 - RNA, 15 nt, Salmonella typhimurium LT2
ccaggagagcaccuu

SEQ ID NO: 3754214 - RNA, 15 nt, Salmonella typhimurium LT2
ccaggagauaucaaa

SEQ ID NO: 3754215 - RNA, 16 nt, Salmonella typhimurium LT2
ccaggauaaugguguc

SEQ ID NO: 3754216 - RNA, 19 nt, Salmonella typhimurium LT2
ccaggauaauggugucuuu

SEQ ID NO: 3754217 - RNA, 22 nt, Salmonella typhimurium LT2
ccaggauccguucaucggcaua

SEQ ID NO: 3754218 - RNA, 14 nt, Salmonella typhimurium LT2
ccaggaucgccgcu

SEQ ID NO: 3754219 - RNA, 20 nt, Salmonella typhimurium LT2
ccaggaugauguucaucgcu

SEQ ID NO: 3754220 - RNA, 17 nt, Salmonella typhimurium LT2
ccaggaugccaaccacc

SEQ ID NO: 3754221 - RNA, 19 nt, Salmonella typhimurium LT2
ccaggaugccaaccaccgc

SEQ ID NO: 3754222 - RNA, 13 nt, Salmonella typhimurium LT2
ccaggauggcggc

SEQ ID NO: 3754223 - RNA, 21 nt, Salmonella typhimurium LT2
ccaggcaaagauccaccaggu

SEQ ID NO: 3754224 - RNA, 21 nt, Salmonella typhimurium LT2
ccaggcaaccugucaguaccu

SEQ ID NO: 3754225 - RNA, 17 nt, Salmonella typhimurium LT2
ccaggcaaucagcagcc

SEQ ID NO: 3754226 - RNA, 19 nt, Salmonella typhimurium LT2
ccaggcaaugccccgccgc

SEQ ID NO: 3754227 - RNA, 21 nt, Salmonella typhimurium LT2
ccaggcauagaaaaagaacug

SEQ ID NO: 3754228 - RNA, 11 nt, Salmonella typhimurium LT2
ccaggcauccg

SEQ ID NO: 3754229 - RNA, 14 nt, Salmonella typhimurium LT2
ccaggcaucgacgc

SEQ ID NO: 3754230 - RNA, 20 nt, Salmonella typhimurium LT2
ccaggcaucgacgccagcgg

SEQ ID NO: 3754231 - RNA, 14 nt, Salmonella typhimurium LT2
ccaggccacggcug

SEQ ID NO: 3754232 - RNA, 14 nt, Salmonella typhimurium LT2
ccaggccccugcca

SEQ ID NO: 3754233 - RNA, 13 nt, Salmonella typhimurium LT2
ccaggccgcgccg

SEQ ID NO: 3754234 - RNA, 18 nt, Salmonella typhimurium LT2
ccaggccggcauaaugau

SEQ ID NO: 3754235 - RNA, 20 nt, Salmonella typhimurium LT2
ccaggccgucggcgccagcc

SEQ ID NO: 3754236 - RNA, 17 nt, Salmonella typhimurium LT2
ccaggcgaccagaugca

SEQ ID NO: 3754237 - RNA, 16 nt, Salmonella typhimurium LT2
ccaggcgauaccgcgc

SEQ ID NO: 3754238 - RNA, 13 nt, Salmonella typhimurium LT2
ccaggcgcgaugc

SEQ ID NO: 3754239 - RNA, 20 nt, Salmonella typhimurium LT2
ccaggcgcuauucccaggca

SEQ ID NO: 3754240 - RNA, 14 nt, Salmonella typhimurium LT2
ccaggcgcucgccg

SEQ ID NO: 3754241 - RNA, 18 nt, Salmonella typhimurium LT2
ccaggcggauaaaacaga

SEQ ID NO: 3754242 - RNA, 20 nt, Salmonella typhimurium LT2
ccaggcguaagaucccaggg

SEQ ID NO: 3754243 - RNA, 22 nt, Salmonella typhimurium LT2
ccaggcguuauuggcgcagcca

SEQ ID NO: 3754244 - RNA, 14 nt, Salmonella typhimurium LT2
ccaggcuauccagc

SEQ ID NO: 3754245 - RNA, 18 nt, Salmonella typhimurium LT2
ccaggcuauccagcucac

SEQ ID NO: 3754246 - RNA, 14 nt, Salmonella typhimurium LT2
ccaggcuggcgcag

SEQ ID NO: 3754247 - RNA, 16 nt, Salmonella typhimurium LT2
ccaggcuuagccgccg

SEQ ID NO: 3754248 - RNA, 22 nt, Salmonella typhimurium LT2
ccaggcuuccugcgcugucacc

SEQ ID NO: 3754249 - RNA, 21 nt, Salmonella typhimurium LT2
ccaggcuuuaaauucagcacc

SEQ ID NO: 3754250 - RNA, 21 nt, Salmonella typhimurium LT2
ccaggcuuuaguuuccgguaa

SEQ ID NO: 3754251 - RNA, 15 nt, Salmonella typhimurium LT2
ccagggaaugccaua

SEQ ID NO: 3754252 - RNA, 21 nt, Salmonella typhimurium LT2
ccagggauuuugcuuuuucgg

SEQ ID NO: 3754253 - RNA, 19 nt, Salmonella typhimurium LT2
ccagggcgaugcccccaga

SEQ ID NO: 3754254 - RNA, 20 nt, Salmonella typhimurium LT2
ccagggcgggauccccugcu

SEQ ID NO: 3754255 - RNA, 21 nt, Salmonella typhimurium LT2
ccaggggaugauuuucaggca

SEQ ID NO: 3754256 - RNA, 21 nt, Salmonella typhimurium LT2
ccaggggcgaguuaagcgccc

SEQ ID NO: 3754257 - RNA, 22 nt, Salmonella typhimurium LT2
ccagguaacauacaaaaaguac

SEQ ID NO: 3754258 - RNA, 20 nt, Salmonella typhimurium LT2
ccagguauucuaacugaucc

SEQ ID NO: 3754259 - RNA, 21 nt, Salmonella typhimurium LT2
ccaggucaaaauuaaucgcca

SEQ ID NO: 3754260 - RNA, 21 nt, Salmonella typhimurium LT2
ccaggucagcggagaguugaa

SEQ ID NO: 3754261 - RNA, 17 nt, Salmonella typhimurium LT2
ccaggucaucaccucca

SEQ ID NO: 3754262 - RNA, 18 nt, Salmonella typhimurium LT2
ccagguccgacuucaugc

SEQ ID NO: 3754263 - RNA, 16 nt, Salmonella typhimurium LT2
ccaggucgcccagcca

SEQ ID NO: 3754264 - RNA, 24 nt, Salmonella typhimurium LT2
ccaggucugaugagcgcagcgacu

SEQ ID NO: 3754265 - RNA, 20 nt, Salmonella typhimurium LT2
ccaggugacuuugcccuuuu

SEQ ID NO: 3754266 - RNA, 16 nt, Salmonella typhimurium LT2
ccagguggggugggcg

SEQ ID NO: 3754267 - RNA, 18 nt, Salmonella typhimurium LT2
ccaggugucguuaaugcu

SEQ ID NO: 3754268 - RNA, 18 nt, Salmonella typhimurium LT2
ccagguuaucgguaauuu

SEQ ID NO: 3754269 - RNA, 18 nt, Salmonella typhimurium LT2
ccagguuauucaggugga

SEQ ID NO: 3754270 - RNA, 20 nt, Salmonella typhimurium LT2
ccaguaaaaucgggccuccg

SEQ ID NO: 3754271 - RNA, 14 nt, Salmonella typhimurium LT2
ccaguaacgcgucc

SEQ ID NO: 3754272 - RNA, 14 nt, Salmonella typhimurium LT2
ccaguaaugccaua

SEQ ID NO: 3754273 - RNA, 17 nt, Salmonella typhimurium LT2
ccaguaaugccgugccg

SEQ ID NO: 3754274 - RNA, 14 nt, Salmonella typhimurium LT2
ccaguaauuuuucu

SEQ ID NO: 3754275 - RNA, 23 nt, Salmonella typhimurium LT2
ccaguaauuuuucucccagcaga

SEQ ID NO: 3754276 - RNA, 22 nt, Salmonella typhimurium LT2
ccaguacaaacaaauaaaucca

SEQ ID NO: 3754277 - RNA, 20 nt, Salmonella typhimurium LT2
ccaguacaacaauugugaug

SEQ ID NO: 3754278 - RNA, 16 nt, Salmonella typhimurium LT2
ccaguacaagcaggcu

SEQ ID NO: 3754279 - RNA, 18 nt, Salmonella typhimurium LT2
ccaguacagcacgccgga

SEQ ID NO: 3754280 - RNA, 16 nt, Salmonella typhimurium LT2
ccaguaccgacgccau

SEQ ID NO: 3754281 - RNA, 15 nt, Salmonella typhimurium LT2
ccaguaccgccgccg

SEQ ID NO: 3754282 - RNA, 15 nt, Salmonella typhimurium LT2
ccaguacuuucuuuu

SEQ ID NO: 3754283 - RNA, 21 nt, Salmonella typhimurium LT2
ccaguacuuuggccuaacagu

SEQ ID NO: 3754284 - RNA, 14 nt, Salmonella typhimurium LT2
ccaguagcgcgccc

SEQ ID NO: 3754285 - RNA, 20 nt, Salmonella typhimurium LT2
ccaguagcgcgcccaugccg

SEQ ID NO: 3754286 - RNA, 16 nt, Salmonella typhimurium LT2
ccaguagucgcgccau

SEQ ID NO: 3754287 - RNA, 17 nt, Salmonella typhimurium LT2
ccaguaucgcgccgcca

SEQ ID NO: 3754288 - RNA, 15 nt, Salmonella typhimurium LT2
ccagucaauaaaaca

SEQ ID NO: 3754289 - RNA, 16 nt, Salmonella typhimurium LT2
ccagucaauaaaacag

SEQ ID NO: 3754290 - RNA, 13 nt, Salmonella typhimurium LT2
ccagucaccagca

SEQ ID NO: 3754291 - RNA, 22 nt, Salmonella typhimurium LT2
ccagucagcaauuaacaaauaa

SEQ ID NO: 3754292 - RNA, 13 nt, Salmonella typhimurium LT2
ccagucauccggu

SEQ ID NO: 3754293 - RNA, 14 nt, Salmonella typhimurium LT2
ccagucaucgccgc

SEQ ID NO: 3754294 - RNA, 16 nt, Salmonella typhimurium LT2
ccagucaucgccgcua

SEQ ID NO: 3754295 - RNA, 20 nt, Salmonella typhimurium LT2
ccagucaucgucugcgucuu

SEQ ID NO: 3754296 - RNA, 22 nt, Salmonella typhimurium LT2
ccaguccacaucuaccagguug

SEQ ID NO: 3754297 - RNA, 13 nt, Salmonella typhimurium LT2
ccagucccagcac

SEQ ID NO: 3754298 - RNA, 14 nt, Salmonella typhimurium LT2
ccaguccgugugcg

SEQ ID NO: 3754299 - RNA, 15 nt, Salmonella typhimurium LT2
ccagucgacucaucu

SEQ ID NO: 3754300 - RNA, 18 nt, Salmonella typhimurium LT2
ccagucgacucaucuuuu

SEQ ID NO: 3754301 - RNA, 17 nt, Salmonella typhimurium LT2
ccagucgcuccaccacu

SEQ ID NO: 3754302 - RNA, 17 nt, Salmonella typhimurium LT2
ccagucggaaccggcaa

SEQ ID NO: 3754303 - RNA, 13 nt, Salmonella typhimurium LT2
ccagucggacagc

SEQ ID NO: 3754304 - RNA, 17 nt, Salmonella typhimurium LT2
ccagucguaguggauca

SEQ ID NO: 3754305 - RNA, 19 nt, Salmonella typhimurium LT2
ccagucgucaucccaguca

SEQ ID NO: 3754306 - RNA, 17 nt, Salmonella typhimurium LT2
ccagucuuccauuacaa

SEQ ID NO: 3754307 - RNA, 14 nt, Salmonella typhimurium LT2
ccagugaaaaaaag

SEQ ID NO: 3754308 - RNA, 15 nt, Salmonella typhimurium LT2
ccagugaaauaaaug

SEQ ID NO: 3754309 - RNA, 16 nt, Salmonella typhimurium LT2
ccagugaauccaccac

SEQ ID NO: 3754310 - RNA, 17 nt, Salmonella typhimurium LT2
ccagugaauccaccacg

SEQ ID NO: 3754311 - RNA, 12 nt, Salmonella typhimurium LT2
ccauccggcauc

SEQ ID NO: 3754312 - RNA, 15 nt, Salmonella typhimurium LT2
ccauccggcaucucu

SEQ ID NO: 3754313 - RNA, 12 nt, Salmonella typhimurium LT2
ccauccggcauu

SEQ ID NO: 3754314 - RNA, 22 nt, Salmonella typhimurium LT2
ccauccucauuuuguugcucca

SEQ ID NO: 3754315 - RNA, 23 nt, Salmonella typhimurium LT2
ccaucgacgaaauggugugcaug

SEQ ID NO: 3754316 - RNA, 21 nt, Salmonella typhimurium LT2
ccaucgccagcacuuccugcu

SEQ ID NO: 3754317 - RNA, 19 nt, Salmonella typhimurium LT2
ccaucgccaguaccgacgc

SEQ ID NO: 3754318 - RNA, 22 nt, Salmonella typhimurium LT2
ccaucgcgaauuucaaucgcca

SEQ ID NO: 3754319 - RNA, 23 nt, Salmonella typhimurium LT2
ccaucgcgaauuucaaucgccag

SEQ ID NO: 3754320 - RNA, 18 nt, Salmonella typhimurium LT2
ccaucgcgccaucggcuu

SEQ ID NO: 3754321 - RNA, 14 nt, Salmonella typhimurium LT2
ccaucgcgccgcug

SEQ ID NO: 3754322 - RNA, 23 nt, Salmonella typhimurium LT2
ccaucgcggcgcaaaucgccauc

SEQ ID NO: 3754323 - RNA, 23 nt, Salmonella typhimurium LT2
ccaucgcguugcaaucgccugaa

SEQ ID NO: 3754324 - RNA, 19 nt, Salmonella typhimurium LT2
ccaucgcuuucagcuuuuu

SEQ ID NO: 3754325 - RNA, 16 nt, Salmonella typhimurium LT2
ccaucggaguccagca

SEQ ID NO: 3754326 - RNA, 17 nt, Salmonella typhimurium LT2
ccaucggcaaacgccgc

SEQ ID NO: 3754327 - RNA, 19 nt, Salmonella typhimurium LT2
ccaucggcaaacgccgccu

SEQ ID NO: 3754328 - RNA, 21 nt, Salmonella typhimurium LT2
ccaucggcacacuacgcagcg

SEQ ID NO: 3754329 - RNA, 22 nt, Salmonella typhimurium LT2
ccaucggcgauucaucgacaaa

SEQ ID NO: 3754330 - RNA, 15 nt, Salmonella typhimurium LT2
ccaucgguucucugc

SEQ ID NO: 3754331 - RNA, 19 nt, Salmonella typhimurium LT2
ccaucgguucucugccauc

SEQ ID NO: 3754332 - RNA, 23 nt, Salmonella typhimurium LT2
ccaucgguucucugccaucaucc

SEQ ID NO: 3754333 - RNA, 19 nt, Salmonella typhimurium LT2
ccaucuaaaucaaucacuu

SEQ ID NO: 3754334 - RNA, 16 nt, Salmonella typhimurium LT2
ccaucuaacacaaauu

SEQ ID NO: 3754335 - RNA, 22 nt, Salmonella typhimurium LT2
ccaucuccugacugccgccggc

SEQ ID NO: 3754336 - RNA, 16 nt, Salmonella typhimurium LT2
ccaucucuuccgcggu

SEQ ID NO: 3754337 - RNA, 18 nt, Salmonella typhimurium LT2
ccaucucuuuaaaaauaa

SEQ ID NO: 3754338 - RNA, 24 nt, Salmonella typhimurium LT2
ccaucuggcgguuugacggcugca

SEQ ID NO: 3754339 - RNA, 13 nt, Salmonella typhimurium LT2
ccaucuucaagcu

SEQ ID NO: 3754340 - RNA, 14 nt, Salmonella typhimurium LT2
ccaucuucaagcuu

SEQ ID NO: 3754341 - RNA, 15 nt, Salmonella typhimurium LT2
ccaucuuccagcauc

SEQ ID NO: 3754342 - RNA, 14 nt, Salmonella typhimurium LT2
ccaucuuuuuccug

SEQ ID NO: 3754343 - RNA, 14 nt, Salmonella typhimurium LT2
ccaucuuuuuucac

SEQ ID NO: 3754344 - RNA, 13 nt, Salmonella typhimurium LT2
ccaugaaaaaaac

SEQ ID NO: 3754345 - RNA, 21 nt, Salmonella typhimurium LT2
ccaugaagcgauuuauccacc

SEQ ID NO: 3754346 - RNA, 22 nt, Salmonella typhimurium LT2
ccaugaccaccagcgcgaccgg

SEQ ID NO: 3754347 - RNA, 18 nt, Salmonella typhimurium LT2
ccaugacgcaccguggaa

SEQ ID NO: 3754348 - RNA, 15 nt, Salmonella typhimurium LT2
ccaugagcgaaacuc

SEQ ID NO: 3754349 - RNA, 16 nt, Salmonella typhimurium LT2
ccaugaguucaauaug

SEQ ID NO: 3754350 - RNA, 15 nt, Salmonella typhimurium LT2
ccaugaucgccgcca

SEQ ID NO: 3754351 - RNA, 14 nt, Salmonella typhimurium LT2
ccaugauggcguaa

SEQ ID NO: 3754352 - RNA, 22 nt, Salmonella typhimurium LT2
ccaugaugggcaagcguagucc

SEQ ID NO: 3754353 - RNA, 14 nt, Salmonella typhimurium LT2
ccaugauucauccc

SEQ ID NO: 3754354 - RNA, 19 nt, Salmonella typhimurium LT2
ccaugauucaucccgcugu

SEQ ID NO: 3754355 - RNA, 16 nt, Salmonella typhimurium LT2
ccaugcauaaugcagc

SEQ ID NO: 3754356 - RNA, 17 nt, Salmonella typhimurium LT2
ccaugcauaaugcagcc

SEQ ID NO: 3754357 - RNA, 18 nt, Salmonella typhimurium LT2
ccaugcauaaugcagcca

SEQ ID NO: 3754358 - RNA, 19 nt, Salmonella typhimurium LT2
ccaugcaugacgcaggcgc

SEQ ID NO: 3754359 - RNA, 13 nt, Salmonella typhimurium LT2
ccaugccagcagu

SEQ ID NO: 3754360 - RNA, 19 nt, Salmonella typhimurium LT2
ccaugcccaguucaaucaa

SEQ ID NO: 3754361 - RNA, 12 nt, Salmonella typhimurium LT2
ccaugcccggcg

SEQ ID NO: 3754362 - RNA, 17 nt, Salmonella typhimurium LT2
ccaugcccggcggcggc

SEQ ID NO: 3754363 - RNA, 22 nt, Salmonella typhimurium LT2
ccaugcccggcggcggcgggga

SEQ ID NO: 3754364 - RNA, 16 nt, Salmonella typhimurium LT2
ccaugccgaagacucc

SEQ ID NO: 3754365 - RNA, 22 nt, Salmonella typhimurium LT2
ccaugccgaagacuccccugca

SEQ ID NO: 3754366 - RNA, 12 nt, Salmonella typhimurium LT2
ccaugccgcgcc

SEQ ID NO: 3754367 - RNA, 22 nt, Salmonella typhimurium LT2
ccaugccggcuuuccgcaccgc

SEQ ID NO: 3754368 - RNA, 21 nt, Salmonella typhimurium LT2
ccaugcggcugaguucaggca

SEQ ID NO: 3754369 - RNA, 22 nt, Salmonella typhimurium LT2
ccaugcuauccgccgccagcca

SEQ ID NO: 3754370 - RNA, 13 nt, Salmonella typhimurium LT2
ccaugcugguugg

SEQ ID NO: 3754371 - RNA, 15 nt, Salmonella typhimurium LT2
ccauggccgcagccc

SEQ ID NO: 3754372 - RNA, 21 nt, Salmonella typhimurium LT2
ccauggguuauccucuccuga

SEQ ID NO: 3754373 - RNA, 19 nt, Salmonella typhimurium LT2
ccaugguucccgccacuga

SEQ ID NO: 3754374 - RNA, 18 nt, Salmonella typhimurium LT2
ccaugucagcgcaaagcc

SEQ ID NO: 3754375 - RNA, 13 nt, Salmonella typhimurium LT2
ccauguucaguuc

SEQ ID NO: 3754376 - RNA, 15 nt, Salmonella typhimurium LT2
ccauguucauaaagu

SEQ ID NO: 3754377 - RNA, 14 nt, Salmonella typhimurium LT2
ccauguugagcgcu

SEQ ID NO: 3754378 - RNA, 22 nt, Salmonella typhimurium LT2
ccauguugaucguaaaaugaaa

SEQ ID NO: 3754379 - RNA, 18 nt, Salmonella typhimurium LT2
ccauguugcguaaauaaa

SEQ ID NO: 3754380 - RNA, 19 nt, Salmonella typhimurium LT2
ccauguugcguaaauaaau

SEQ ID NO: 3754381 - RNA, 15 nt, Salmonella typhimurium LT2
ccauuaauauuuuau

SEQ ID NO: 3754382 - RNA, 13 nt, Salmonella typhimurium LT2
ccauuaaugcagg

SEQ ID NO: 3754383 - RNA, 13 nt, Salmonella typhimurium LT2
ccauuaaugccgc

SEQ ID NO: 3754384 - RNA, 16 nt, Salmonella typhimurium LT2
ccauuacgcuuaucgg

SEQ ID NO: 3754385 - RNA, 13 nt, Salmonella typhimurium LT2
ccauuagcuguug

SEQ ID NO: 3754386 - RNA, 13 nt, Salmonella typhimurium LT2
ccauuaugccgca

SEQ ID NO: 3754387 - RNA, 16 nt, Salmonella typhimurium LT2
ccauuauuuauuuuca

SEQ ID NO: 3754388 - RNA, 15 nt, Salmonella typhimurium LT2
ccauucaacacauuc

SEQ ID NO: 3754389 - RNA, 21 nt, Salmonella typhimurium LT2
ccauucccagcgcccccagca

SEQ ID NO: 3754390 - RNA, 15 nt, Salmonella typhimurium LT2
ccauuccccacgcca

SEQ ID NO: 3754391 - RNA, 12 nt, Salmonella typhimurium LT2
ccauuccccagc

SEQ ID NO: 3754392 - RNA, 18 nt, Salmonella typhimurium LT2
ccauucccguaaaagaag

SEQ ID NO: 3754393 - RNA, 15 nt, Salmonella typhimurium LT2
ccauuccgccaacgg

SEQ ID NO: 3754394 - RNA, 15 nt, Salmonella typhimurium LT2
ccauuccuauuuucu

SEQ ID NO: 3754395 - RNA, 15 nt, Salmonella typhimurium LT2
ccauucgcccaguca

SEQ ID NO: 3754396 - RNA, 15 nt, Salmonella typhimurium LT2
ccauucgcucgauaa

SEQ ID NO: 3754397 - RNA, 22 nt, Salmonella typhimurium LT2
ccauucguaauagcgucuaaau

SEQ ID NO: 3754398 - RNA, 20 nt, Salmonella typhimurium LT2
ccauucuucgucgucaucac

SEQ ID NO: 3754399 - RNA, 13 nt, Salmonella typhimurium LT2
ccauugcccgcug

SEQ ID NO: 3754400 - RNA, 20 nt, Salmonella typhimurium LT2
ccauugccgcgacaaaaagc

SEQ ID NO: 3754401 - RNA, 19 nt, Salmonella typhimurium LT2
ccauugcgccacggauggc

SEQ ID NO: 3754402 - RNA, 16 nt, Salmonella typhimurium LT2
ccauugcugucgacaa

SEQ ID NO: 3754403 - RNA, 21 nt, Salmonella typhimurium LT2
ccauuggcuauuuuuugcugg

SEQ ID NO: 3754404 - RNA, 15 nt, Salmonella typhimurium LT2
ccauuggucaucauc

SEQ ID NO: 3754405 - RNA, 11 nt, Salmonella typhimurium LT2
ccauuucacaa

SEQ ID NO: 3754406 - RNA, 20 nt, Salmonella typhimurium LT2
ccauuuccgcugucgccccu

SEQ ID NO: 3754407 - RNA, 20 nt, Salmonella typhimurium LT2
ccauuuccguuuucagguua

SEQ ID NO: 3754408 - RNA, 21 nt, Salmonella typhimurium LT2
ccauuucgccuauuuucucuu

SEQ ID NO: 3754409 - RNA, 14 nt, Salmonella typhimurium LT2
ccauuugccagaua

SEQ ID NO: 3754410 - RNA, 16 nt, Salmonella typhimurium LT2
ccauuugccugccgca

SEQ ID NO: 3754411 - RNA, 14 nt, Salmonella typhimurium LT2
ccauuugcgacauc

SEQ ID NO: 3754412 - RNA, 23 nt, Salmonella typhimurium LT2
ccauuuuccuauggacauuggcc

SEQ ID NO: 3754413 - RNA, 18 nt, Salmonella typhimurium LT2
ccauuuugguuacuauuu

SEQ ID NO: 3754414 - RNA, 23 nt, Salmonella typhimurium LT2
ccauuuugguuacuauuuuucac

SEQ ID NO: 3754415 - RNA, 12 nt, Salmonella typhimurium LT2
cccaggcgcgca

SEQ ID NO: 3754416 - RNA, 19 nt, Salmonella typhimurium LT2
cccaggcgcgcagcugcca

SEQ ID NO: 3754417 - RNA, 18 nt, Salmonella typhimurium LT2
cccaggcgcuauucccag

SEQ ID NO: 3754418 - RNA, 18 nt, Salmonella typhimurium LT2
cccaggcuggcgcagccg

SEQ ID NO: 3754419 - RNA, 13 nt, Salmonella typhimurium LT2
cccagggaugcgc

SEQ ID NO: 3754420 - RNA, 15 nt, Salmonella typhimurium LT2
cccagggcacgcucu

SEQ ID NO: 3754421 - RNA, 22 nt, Salmonella typhimurium LT2
cccaggggcgaguuaagcgccc

SEQ ID NO: 3754422 - RNA, 18 nt, Salmonella typhimurium LT2
cccaggucacgcccgccg

SEQ ID NO: 3754423 - RNA, 18 nt, Salmonella typhimurium LT2
cccaggucgccgauguca

SEQ ID NO: 3754424 - RNA, 21 nt, Salmonella typhimurium LT2
cccagguuugaggcuugcagc

SEQ ID NO: 3754425 - RNA, 19 nt, Salmonella typhimurium LT2
cccaguaaauuaacgcgaa

SEQ ID NO: 3754426 - RNA, 16 nt, Salmonella typhimurium LT2
cccaguaauccggcaa

SEQ ID NO: 3754427 - RNA, 18 nt, Salmonella typhimurium LT2
cccaguaauccggcaacu

SEQ ID NO: 3754428 - RNA, 16 nt, Salmonella typhimurium LT2
cccaguacggcgcgaa

SEQ ID NO: 3754429 - RNA, 12 nt, Salmonella typhimurium LT2
cccaguagccau

SEQ ID NO: 3754430 - RNA, 14 nt, Salmonella typhimurium LT2
cccagucacggcuc

SEQ ID NO: 3754431 - RNA, 18 nt, Salmonella typhimurium LT2
cccagucuuccugcggua

SEQ ID NO: 3754432 - RNA, 17 nt, Salmonella typhimurium LT2
cccagugccaccagccg

SEQ ID NO: 3754433 - RNA, 20 nt, Salmonella typhimurium LT2
cccagugccaccagccggag

SEQ ID NO: 3754434 - RNA, 15 nt, Salmonella typhimurium LT2
cccaguuucaucauc

SEQ ID NO: 3754435 - RNA, 19 nt, Salmonella typhimurium LT2
cccaguuucaucaucgccg

SEQ ID NO: 3754436 - RNA, 14 nt, Salmonella typhimurium LT2
cccauaaaaauggc

SEQ ID NO: 3754437 - RNA, 21 nt, Salmonella typhimurium LT2
cccauaaugcauguggagaug

SEQ ID NO: 3754438 - RNA, 20 nt, Salmonella typhimurium LT2
cccauacacaccagcaggaa

SEQ ID NO: 3754439 - RNA, 12 nt, Salmonella typhimurium LT2
cccauaccagcg

SEQ ID NO: 3754440 - RNA, 22 nt, Salmonella typhimurium LT2
cccauacugacggcgcucuuua

SEQ ID NO: 3754441 - RNA, 17 nt, Salmonella typhimurium LT2
cccauagcaaaguacug

SEQ ID NO: 3754442 - RNA, 20 nt, Salmonella typhimurium LT2
cccauauugauggccacauc

SEQ ID NO: 3754443 - RNA, 14 nt, Salmonella typhimurium LT2
cccaucagcgccag

SEQ ID NO: 3754444 - RNA, 18 nt, Salmonella typhimurium LT2
cccaucagggaaaaaugu

SEQ ID NO: 3754445 - RNA, 21 nt, Salmonella typhimurium LT2
cccaucauugacuucaacgca

SEQ ID NO: 3754446 - RNA, 21 nt, Salmonella typhimurium LT2
cccauccgggccacucuccag

SEQ ID NO: 3754447 - RNA, 16 nt, Salmonella typhimurium LT2
cccauccgugcgauaa

SEQ ID NO: 3754448 - RNA, 22 nt, Salmonella typhimurium LT2
cccaucgaugggccgaguaauc

SEQ ID NO: 3754449 - RNA, 17 nt, Salmonella typhimurium LT2
cccaucucaggccgaca

SEQ ID NO: 3754450 - RNA, 16 nt, Salmonella typhimurium LT2
cccaugacauucccau

SEQ ID NO: 3754451 - RNA, 13 nt, Salmonella typhimurium LT2
cccaugaucaggc

SEQ ID NO: 3754452 - RNA, 21 nt, Salmonella typhimurium LT2
cccaugccgccugccgcgccg

SEQ ID NO: 3754453 - RNA, 20 nt, Salmonella typhimurium LT2
cccauguugagcgcuugcug

SEQ ID NO: 3754454 - RNA, 14 nt, Salmonella typhimurium LT2
cccauuaagcggga

SEQ ID NO: 3754455 - RNA, 12 nt, Salmonella typhimurium LT2
cccauugaaauc

SEQ ID NO: 3754456 - RNA, 19 nt, Salmonella typhimurium LT2
cccauugaaaucgccucau

SEQ ID NO: 3754457 - RNA, 15 nt, Salmonella typhimurium LT2
cccauugucaucagu

SEQ ID NO: 3754458 - RNA, 23 nt, Salmonella typhimurium LT2
cccauuguucuuucauuuuaccu

SEQ ID NO: 3754459 - RNA, 20 nt, Salmonella typhimurium LT2
cccauuuccguuaaucuggu

SEQ ID NO: 3754460 - RNA, 24 nt, Salmonella typhimurium LT2
cccauuucuggacgggcuaucaau

SEQ ID NO: 3754461 - RNA, 13 nt, Salmonella typhimurium LT2
cccauuuuccgcu

SEQ ID NO: 3754462 - RNA, 20 nt, Salmonella typhimurium LT2
cccauuuuuuguauccacca

SEQ ID NO: 3754463 - RNA, 22 nt, Salmonella typhimurium LT2
ccccaaucccaccacuucgcca

SEQ ID NO: 3754464 - RNA, 17 nt, Salmonella typhimurium LT2
ccccaaucuugcguacc

SEQ ID NO: 3754465 - RNA, 15 nt, Salmonella typhimurium LT2
ccccaauugcugcau

SEQ ID NO: 3754466 - RNA, 15 nt, Salmonella typhimurium LT2
ccccaauuugcuguu

SEQ ID NO: 3754467 - RNA, 18 nt, Salmonella typhimurium LT2
ccccacaaucccgccaga

SEQ ID NO: 3754468 - RNA, 12 nt, Salmonella typhimurium LT2
ccccaccauguc

SEQ ID NO: 3754469 - RNA, 13 nt, Salmonella typhimurium LT2
ccccaccgccaga

SEQ ID NO: 3754470 - RNA, 23 nt, Salmonella typhimurium LT2
ccccacgauacgucccugcuggc

SEQ ID NO: 3754471 - RNA, 13 nt, Salmonella typhimurium LT2
ccccacgcccgcc

SEQ ID NO: 3754472 - RNA, 14 nt, Salmonella typhimurium LT2
ccccacuaccgcca

SEQ ID NO: 3754473 - RNA, 19 nt, Salmonella typhimurium LT2
ccccagaaucccgccuugc

SEQ ID NO: 3754474 - RNA, 16 nt, Salmonella typhimurium LT2
ccccagauagcccucu

SEQ ID NO: 3754475 - RNA, 20 nt, Salmonella typhimurium LT2
ccccagaugccguagccaag

SEQ ID NO: 3754476 - RNA, 13 nt, Salmonella typhimurium LT2
ccccagcaccaac

SEQ ID NO: 3754477 - RNA, 18 nt, Salmonella typhimurium LT2
ccccagcacgacagagau

SEQ ID NO: 3754478 - RNA, 19 nt, Salmonella typhimurium LT2
ccccagccauaauacaauc

SEQ ID NO: 3754479 - RNA, 13 nt, Salmonella typhimurium LT2
ccccagccgccac

SEQ ID NO: 3754480 - RNA, 15 nt, Salmonella typhimurium LT2
ccccagcgccagccg

SEQ ID NO: 3754481 - RNA, 18 nt, Salmonella typhimurium LT2
ccccagcgguaccaccag

SEQ ID NO: 3754482 - RNA, 17 nt, Salmonella typhimurium LT2
ccccagcguaccacgcc

SEQ ID NO: 3754483 - RNA, 13 nt, Salmonella typhimurium LT2
ccccagcugcggc

SEQ ID NO: 3754484 - RNA, 19 nt, Salmonella typhimurium LT2
ccccaggccacccaccgac

SEQ ID NO: 3754485 - RNA, 20 nt, Salmonella typhimurium LT2
ccccagguaaauccgccagu

SEQ ID NO: 3754486 - RNA, 19 nt, Salmonella typhimurium LT2
ccccauaagcaaaggcggu

SEQ ID NO: 3754487 - RNA, 19 nt, Salmonella typhimurium LT2
ccccauauugaucgggauu

SEQ ID NO: 3754488 - RNA, 16 nt, Salmonella typhimurium LT2
ccccaucgccagcacu

SEQ ID NO: 3754489 - RNA, 13 nt, Salmonella typhimurium LT2
ccccaucuccaga

SEQ ID NO: 3754490 - RNA, 15 nt, Salmonella typhimurium LT2
ccccaugugccuugc

SEQ ID NO: 3754491 - RNA, 12 nt, Salmonella typhimurium LT2
ccccauuugaac

SEQ ID NO: 3754492 - RNA, 20 nt, Salmonella typhimurium LT2
cccccaaaaugccgcccauc

SEQ ID NO: 3754493 - RNA, 12 nt, Salmonella typhimurium LT2
cccccaccaugu

SEQ ID NO: 3754494 - RNA, 23 nt, Salmonella typhimurium LT2
cccccacucuucaaacucuccug

SEQ ID NO: 3754495 - RNA, 17 nt, Salmonella typhimurium LT2
cccccagacucgacgcg

SEQ ID NO: 3754496 - RNA, 20 nt, Salmonella typhimurium LT2
cccccagauagaaccacgca

SEQ ID NO: 3754497 - RNA, 20 nt, Salmonella typhimurium LT2
cccccagggaugcgccacag

SEQ ID NO: 3754498 - RNA, 14 nt, Salmonella typhimurium LT2
cccccaucgccagc

SEQ ID NO: 3754499 - RNA, 21 nt, Salmonella typhimurium LT2
cccccaucgccagcacuuccu

SEQ ID NO: 3754500 - RNA, 16 nt, Salmonella typhimurium LT2
cccccauggagagcga

SEQ ID NO: 3754501 - RNA, 17 nt, Salmonella typhimurium LT2
cccccauugccccaugu

SEQ ID NO: 3754502 - RNA, 12 nt, Salmonella typhimurium LT2
ccccccagccau

SEQ ID NO: 3754503 - RNA, 14 nt, Salmonella typhimurium LT2
cccccgagccagaa

SEQ ID NO: 3754504 - RNA, 17 nt, Salmonella typhimurium LT2
cccccuccauacccuau

SEQ ID NO: 3754505 - RNA, 13 nt, Salmonella typhimurium LT2
cccccucggcagc

SEQ ID NO: 3754506 - RNA, 20 nt, Salmonella typhimurium LT2
cccccugccacaaccgcccc

SEQ ID NO: 3754507 - RNA, 19 nt, Salmonella typhimurium LT2
ccccgaguaacaccgcggc

SEQ ID NO: 3754508 - RNA, 17 nt, Salmonella typhimurium LT2
ccccgauaaaccaggca

SEQ ID NO: 3754509 - RNA, 18 nt, Salmonella typhimurium LT2
ccccgauaaaccaggcag

SEQ ID NO: 3754510 - RNA, 22 nt, Salmonella typhimurium LT2
ccccgaugucgccacgccgccc

SEQ ID NO: 3754511 - RNA, 16 nt, Salmonella typhimurium LT2
ccccgauucgcaugaa

SEQ ID NO: 3754512 - RNA, 12 nt, Salmonella typhimurium LT2
ccccgcagcgaa

SEQ ID NO: 3754513 - RNA, 21 nt, Salmonella typhimurium LT2
ccccgcaucgcccgcccccaa

SEQ ID NO: 3754514 - RNA, 20 nt, Salmonella typhimurium LT2
ccccgccauaauacacaaua

SEQ ID NO: 3754515 - RNA, 19 nt, Salmonella typhimurium LT2
ccccgccaucagacaggca

SEQ ID NO: 3754516 - RNA, 14 nt, Salmonella typhimurium LT2
ccccgccauccggc

SEQ ID NO: 3754517 - RNA, 18 nt, Salmonella typhimurium LT2
ccccgccaucuucacgca

SEQ ID NO: 3754518 - RNA, 13 nt, Salmonella typhimurium LT2
ccccgccccagca

SEQ ID NO: 3754519 - RNA, 21 nt, Salmonella typhimurium LT2
cccggccguuaccguggcggc

SEQ ID NO: 3754520 - RNA, 18 nt, Salmonella typhimurium LT2
cccggccuacacaucauc

SEQ ID NO: 3754521 - RNA, 22 nt, Salmonella typhimurium LT2
cccggccuacacaucaucuuua

SEQ ID NO: 3754522 - RNA, 15 nt, Salmonella typhimurium LT2
cccggcgaccacauu

SEQ ID NO: 3754523 - RNA, 23 nt, Salmonella typhimurium LT2
cccggcgauccguagcccuggaa

SEQ ID NO: 3754524 - RNA, 12 nt, Salmonella typhimurium LT2
cccggcgcagcg

SEQ ID NO: 3754525 - RNA, 16 nt, Salmonella typhimurium LT2
cccggcgccagcucaa

SEQ ID NO: 3754526 - RNA, 18 nt, Salmonella typhimurium LT2
cccggcgccauccggcag

SEQ ID NO: 3754527 - RNA, 18 nt, Salmonella typhimurium LT2
cccggcggauaaaucauc

SEQ ID NO: 3754528 - RNA, 21 nt, Salmonella typhimurium LT2
cccggcggcgcgaugccugcc

SEQ ID NO: 3754529 - RNA, 19 nt, Salmonella typhimurium LT2
cccggcgggcaaccuucaa

SEQ ID NO: 3754530 - RNA, 19 nt, Salmonella typhimurium LT2
cccggcguaauccagcuuc

SEQ ID NO: 3754531 - RNA, 17 nt, Salmonella typhimurium LT2
cccggcguauagcgcuu

SEQ ID NO: 3754532 - RNA, 13 nt, Salmonella typhimurium LT2
cccggcgucggaa

SEQ ID NO: 3754533 - RNA, 20 nt, Salmonella typhimurium LT2
cccggcguuuugccgggcgu

SEQ ID NO: 3754534 - RNA, 21 nt, Salmonella typhimurium LT2
cccggcguuuugccgggcguu

SEQ ID NO: 3754535 - RNA, 22 nt, Salmonella typhimurium LT2
cccggcugccauuaucaccauu

SEQ ID NO: 3754536 - RNA, 14 nt, Salmonella typhimurium LT2
cccgguaaacgcuu

SEQ ID NO: 3754537 - RNA, 17 nt, Salmonella typhimurium LT2
cccgguaaacgcuuuuu

SEQ ID NO: 3754538 - RNA, 18 nt, Salmonella typhimurium LT2
cccggucaacgcgccgcc

SEQ ID NO: 3754539 - RNA, 19 nt, Salmonella typhimurium LT2
cccggucacauucucuucu

SEQ ID NO: 3754540 - RNA, 13 nt, Salmonella typhimurium LT2
cccggucggcgca

SEQ ID NO: 3754541 - RNA, 17 nt, Salmonella typhimurium LT2
cccggugagcgccgcgc

SEQ ID NO: 3754542 - RNA, 22 nt, Salmonella typhimurium LT2
cccgguggcgccaugcuuuccg

SEQ ID NO: 3754543 - RNA, 17 nt, Salmonella typhimurium LT2
cccgguggcgcugcgcu

SEQ ID NO: 3754544 - RNA, 19 nt, Salmonella typhimurium LT2
cccggugucaaagcgccag

SEQ ID NO: 3754545 - RNA, 22 nt, Salmonella typhimurium LT2
cccgguucgccgcuucaaaaac

SEQ ID NO: 3754546 - RNA, 23 nt, Salmonella typhimurium LT2
cccgguuugggcgcgaaacugcu

SEQ ID NO: 3754547 - RNA, 14 nt, Salmonella typhimurium LT2
cccguacugaaccc

SEQ ID NO: 3754548 - RNA, 16 nt, Salmonella typhimurium LT2
cccguagccugauaaa

SEQ ID NO: 3754549 - RNA, 21 nt, Salmonella typhimurium LT2
cccguauguaaacgcauuagu

SEQ ID NO: 3754550 - RNA, 22 nt, Salmonella typhimurium LT2
cccguauucuuugcgccuuauu

SEQ ID NO: 3754551 - RNA, 22 nt, Salmonella typhimurium LT2
cccgucaggcgcccgagcgccg

SEQ ID NO: 3754552 - RNA, 17 nt, Salmonella typhimurium LT2
cccgucagucgccagaa

SEQ ID NO: 3754553 - RNA, 19 nt, Salmonella typhimurium LT2
cccgucaucuucuaccuga

SEQ ID NO: 3754554 - RNA, 14 nt, Salmonella typhimurium LT2
cccgucaugcuuca

SEQ ID NO: 3754555 - RNA, 13 nt, Salmonella typhimurium LT2
cccguccgcgcuc

SEQ ID NO: 3754556 - RNA, 16 nt, Salmonella typhimurium LT2
cccgucgccuguuucu

SEQ ID NO: 3754557 - RNA, 21 nt, Salmonella typhimurium LT2
cccgucgccuguuucugcgcc

SEQ ID NO: 3754558 - RNA, 14 nt, Salmonella typhimurium LT2
cccgucucuuuauc

SEQ ID NO: 3754559 - RNA, 15 nt, Salmonella typhimurium LT2
cccgugacgcaggcg

SEQ ID NO: 3754560 - RNA, 19 nt, Salmonella typhimurium LT2
cccgugcgcgucgccugaa

SEQ ID NO: 3754561 - RNA, 14 nt, Salmonella typhimurium LT2
cccguggcugcgcc

SEQ ID NO: 3754562 - RNA, 22 nt, Salmonella typhimurium LT2
cccguggugggguucccgagcg

SEQ ID NO: 3754563 - RNA, 14 nt, Salmonella typhimurium LT2
cccguuaaauacca

SEQ ID NO: 3754564 - RNA, 22 nt, Salmonella typhimurium LT2
cccguucacguuuuuacucuug

SEQ ID NO: 3754565 - RNA, 12 nt, Salmonella typhimurium LT2
cccguuccagcu

SEQ ID NO: 3754566 - RNA, 21 nt, Salmonella typhimurium LT2
cccguuccaggcgaucucguu

SEQ ID NO: 3754567 - RNA, 18 nt, Salmonella typhimurium LT2
cccguuggcuuuuguagg

SEQ ID NO: 3754568 - RNA, 19 nt, Salmonella typhimurium LT2
cccguuuuucauccagcgg

SEQ ID NO: 3754569 - RNA, 20 nt, Salmonella typhimurium LT2
cccguuuuucauccagcggu

SEQ ID NO: 3754570 - RNA, 15 nt, Salmonella typhimurium LT2
cccguuuuuuccagu

SEQ ID NO: 3754571 - RNA, 23 nt, Salmonella typhimurium LT2
cccguuuuuuccagugccgccag

SEQ ID NO: 3754572 - RNA, 20 nt, Salmonella typhimurium LT2
cccuaaaaauagcaccaggc

SEQ ID NO: 3754573 - RNA, 15 nt, Salmonella typhimurium LT2
cccuaaagcucauca

SEQ ID NO: 3754574 - RNA, 14 nt, Salmonella typhimurium LT2
cccuaagccuaagu

SEQ ID NO: 3754575 - RNA, 16 nt, Salmonella typhimurium LT2
cccuaaggucacgccg

SEQ ID NO: 3754576 - RNA, 20 nt, Salmonella typhimurium LT2
cccuacgcugacgcgaucgc

SEQ ID NO: 3754577 - RNA, 20 nt, Salmonella typhimurium LT2
cccucaacgcccugcuccca

SEQ ID NO: 3754578 - RNA, 21 nt, Salmonella typhimurium LT2
cccucaacgcccugcucccac

SEQ ID NO: 3754579 - RNA, 22 nt, Salmonella typhimurium LT2
cccucaacgcccugcucccaca

SEQ ID NO: 3754580 - RNA, 14 nt, Salmonella typhimurium LT2
cccucaacgcgccc

SEQ ID NO: 3754581 - RNA, 17 nt, Salmonella typhimurium LT2
cccucauuauccagugc

SEQ ID NO: 3754582 - RNA, 13 nt, Salmonella typhimurium LT2
cccuccagccagc

SEQ ID NO: 3754583 - RNA, 16 nt, Salmonella typhimurium LT2
cccuccagccagcgcc

SEQ ID NO: 3754584 - RNA, 15 nt, Salmonella typhimurium LT2
cccuccaguagcagc

SEQ ID NO: 3754585 - RNA, 12 nt, Salmonella typhimurium LT2
cccuccgccaua

SEQ ID NO: 3754586 - RNA, 17 nt, Salmonella typhimurium LT2
cccucgacaggaguaua

SEQ ID NO: 3754587 - RNA, 22 nt, Salmonella typhimurium LT2
cccucgauuaccguguuuaccu

SEQ ID NO: 3754588 - RNA, 13 nt, Salmonella typhimurium LT2
cccucgcaccaac

SEQ ID NO: 3754589 - RNA, 22 nt, Salmonella typhimurium LT2
cccucugaagcgcuucaccggc

SEQ ID NO: 3754590 - RNA, 22 nt, Salmonella typhimurium LT2
cccugaaaccccuuuagcggca

SEQ ID NO: 3754591 - RNA, 14 nt, Salmonella typhimurium LT2
cccugaacugguaa

SEQ ID NO: 3754592 - RNA, 20 nt, Salmonella typhimurium LT2
cccugaaucgccucaacgcu

SEQ ID NO: 3754593 - RNA, 14 nt, Salmonella typhimurium LT2
cccugacaauacug

SEQ ID NO: 3754594 - RNA, 21 nt, Salmonella typhimurium LT2
cccugacgauacauaaaaugu

SEQ ID NO: 3754595 - RNA, 16 nt, Salmonella typhimurium LT2
cccugacgggcucguu

SEQ ID NO: 3754596 - RNA, 14 nt, Salmonella typhimurium LT2
cccugagcaaucag

SEQ ID NO: 3754597 - RNA, 17 nt, Salmonella typhimurium LT2
cccugauaaugugagau

SEQ ID NO: 3754598 - RNA, 21 nt, Salmonella typhimurium LT2
cccugauauacaaaacccaua

SEQ ID NO: 3754599 - RNA, 23 nt, Salmonella typhimurium LT2
cccugauauacaaaacccauauc

SEQ ID NO: 3754600 - RNA, 13 nt, Salmonella typhimurium LT2
cccugaucccaca

SEQ ID NO: 3754601 - RNA, 20 nt, Salmonella typhimurium LT2
cccugaugcguauccagcgc

SEQ ID NO: 3754602 - RNA, 23 nt, Salmonella typhimurium LT2
cccugauggcgcgccacuucuuu

SEQ ID NO: 3754603 - RNA, 16 nt, Salmonella typhimurium LT2
cccugcaaaaguuuga

SEQ ID NO: 3754604 - RNA, 14 nt, Salmonella typhimurium LT2
cccugcaacgccug

SEQ ID NO: 3754605 - RNA, 15 nt, Salmonella typhimurium LT2
cccugcagaccuggc

SEQ ID NO: 3754606 - RNA, 15 nt, Salmonella typhimurium LT2
cccugcagaugcugc

SEQ ID NO: 3754607 - RNA, 17 nt, Salmonella typhimurium LT2
cccugccacaaccgccc

SEQ ID NO: 3754608 - RNA, 13 nt, Salmonella typhimurium LT2
cccugcccaugaa

SEQ ID NO: 3754609 - RNA, 13 nt, Salmonella typhimurium LT2
cccugcccgccag

SEQ ID NO: 3754610 - RNA, 19 nt, Salmonella typhimurium LT2
cccugccgaaaugaaagcu

SEQ ID NO: 3754611 - RNA, 22 nt, Salmonella typhimurium LT2
cccugcgaacagcgcuccacgc

SEQ ID NO: 3754612 - RNA, 13 nt, Salmonella typhimurium LT2
cccugcgccagac

SEQ ID NO: 3754613 - RNA, 16 nt, Salmonella typhimurium LT2
cccugcgccagacgcg

SEQ ID NO: 3754614 - RNA, 19 nt, Salmonella typhimurium LT2
cccugcgccagcauggcgu

SEQ ID NO: 3754615 - RNA, 21 nt, Salmonella typhimurium LT2
cccugcgcuucuauccacugg

SEQ ID NO: 3754616 - RNA, 18 nt, Salmonella typhimurium LT2
cccugcgguagcgccgau

SEQ ID NO: 3754617 - RNA, 21 nt, Salmonella typhimurium LT2
cccugcgucgcguaccagcgc

SEQ ID NO: 3754618 - RNA, 13 nt, Salmonella typhimurium LT2
cccugcuccugcc

SEQ ID NO: 3754619 - RNA, 16 nt, Salmonella typhimurium LT2
cccugcuguuccagug

SEQ ID NO: 3754620 - RNA, 14 nt, Salmonella typhimurium LT2
cccuggcccggucg

SEQ ID NO: 3754621 - RNA, 23 nt, Salmonella typhimurium LT2
cccuggcgaauaaaauucagcgc

SEQ ID NO: 3754622 - RNA, 22 nt, Salmonella typhimurium LT2
ccgauaaagcgaccgaucauca

SEQ ID NO: 3754623 - RNA, 20 nt, Salmonella typhimurium LT2
ccgauaaaguggcauccgaa

SEQ ID NO: 3754624 - RNA, 21 nt, Salmonella typhimurium LT2
ccgauaaccagcgcgccgcca

SEQ ID NO: 3754625 - RNA, 21 nt, Salmonella typhimurium LT2
ccgauaagcaagcgccaucgg

SEQ ID NO: 3754626 - RNA, 18 nt, Salmonella typhimurium LT2
ccgauaauacgcgcgauu

SEQ ID NO: 3754627 - RNA, 14 nt, Salmonella typhimurium LT2
ccgauaaucaccag

SEQ ID NO: 3754628 - RNA, 15 nt, Salmonella typhimurium LT2
ccgauaaucaccagc

SEQ ID NO: 3754629 - RNA, 18 nt, Salmonella typhimurium LT2
ccgauaaucaccagcccg

SEQ ID NO: 3754630 - RNA, 17 nt, Salmonella typhimurium LT2
ccgauaauuaagccggu

SEQ ID NO: 3754631 - RNA, 18 nt, Salmonella typhimurium LT2
ccgauaccgccagcccca

SEQ ID NO: 3754632 - RNA, 15 nt, Salmonella typhimurium LT2
ccgauagcgccgcgc

SEQ ID NO: 3754633 - RNA, 22 nt, Salmonella typhimurium LT2
ccgauagcgcggaauaucaauu

SEQ ID NO: 3754634 - RNA, 19 nt, Salmonella typhimurium LT2
ccgauagucuccgccaccu

SEQ ID NO: 3754635 - RNA, 21 nt, Salmonella typhimurium LT2
ccgauaguguaaacgcgccau

SEQ ID NO: 3754636 - RNA, 21 nt, Salmonella typhimurium LT2
ccgauauauugucggccugau

SEQ ID NO: 3754637 - RNA, 16 nt, Salmonella typhimurium LT2
ccgaucaccagcgcau

SEQ ID NO: 3754638 - RNA, 13 nt, Salmonella typhimurium LT2
ccgaucacggcga

SEQ ID NO: 3754639 - RNA, 22 nt, Salmonella typhimurium LT2
ccgaucacggcgaaucgccugu

SEQ ID NO: 3754640 - RNA, 23 nt, Salmonella typhimurium LT2
ccgaucagcaccacgcccggauc

SEQ ID NO: 3754641 - RNA, 17 nt, Salmonella typhimurium LT2
ccgaucaggccgcagac

SEQ ID NO: 3754642 - RNA, 18 nt, Salmonella typhimurium LT2
ccgaucguagcaucucuu

SEQ ID NO: 3754643 - RNA, 14 nt, Salmonella typhimurium LT2
ccgaugacgcuccu

SEQ ID NO: 3754644 - RNA, 18 nt, Salmonella typhimurium LT2
ccgaugacgcuccugaau

SEQ ID NO: 3754645 - RNA, 17 nt, Salmonella typhimurium LT2
ccgaugccgccgcaaca

SEQ ID NO: 3754646 - RNA, 17 nt, Salmonella typhimurium LT2
ccgauggacucccaggu

SEQ ID NO: 3754647 - RNA, 11 nt, Salmonella typhimurium LT2
ccgauggcgcu

SEQ ID NO: 3754648 - RNA, 18 nt, Salmonella typhimurium LT2
ccgauggcguaagcuuau

SEQ ID NO: 3754649 - RNA, 21 nt, Salmonella typhimurium LT2
ccgaugguuaaagguuguuuc

SEQ ID NO: 3754650 - RNA, 13 nt, Salmonella typhimurium LT2
ccgauucccaguc

SEQ ID NO: 3754651 - RNA, 15 nt, Salmonella typhimurium LT2
ccgauucgcgcguca

SEQ ID NO: 3754652 - RNA, 18 nt, Salmonella typhimurium LT2
ccgauucugccaguucac

SEQ ID NO: 3754653 - RNA, 15 nt, Salmonella typhimurium LT2
ccgauuucagcgugg

SEQ ID NO: 3754654 - RNA, 16 nt, Salmonella typhimurium LT2
ccgauuucagcguggc

SEQ ID NO: 3754655 - RNA, 21 nt, Salmonella typhimurium LT2
ccgauuucguucuuucugcca

SEQ ID NO: 3754656 - RNA, 12 nt, Salmonella typhimurium LT2
ccgauuuuucgg

SEQ ID NO: 3754657 - RNA, 16 nt, Salmonella typhimurium LT2
ccgauuuuuuaucucg

SEQ ID NO: 3754658 - RNA, 12 nt, Salmonella typhimurium LT2
ccgcaaaaccuu

SEQ ID NO: 3754659 - RNA, 21 nt, Salmonella typhimurium LT2
ccgcaaaaccuucauaaauac

SEQ ID NO: 3754660 - RNA, 16 nt, Salmonella typhimurium LT2
ccgcaaacagagcgcc

SEQ ID NO: 3754661 - RNA, 15 nt, Salmonella typhimurium LT2
ccgcaaacgccgaag

SEQ ID NO: 3754662 - RNA, 22 nt, Salmonella typhimurium LT2
ccgcaaacgccgugaacgccaa

SEQ ID NO: 3754663 - RNA, 22 nt, Salmonella typhimurium LT2
ccgcaaacucaggagcuaaaua

SEQ ID NO: 3754664 - RNA, 17 nt, Salmonella typhimurium LT2
ccgcaaccaaagccggc

SEQ ID NO: 3754665 - RNA, 13 nt, Salmonella typhimurium LT2
ccgcaacgccgau

SEQ ID NO: 3754666 - RNA, 23 nt, Salmonella typhimurium LT2
ccgcaauaacgccgauaaccagc

SEQ ID NO: 3754667 - RNA, 20 nt, Salmonella typhimurium LT2
ccgcaauacagcccgccagc

SEQ ID NO: 3754668 - RNA, 19 nt, Salmonella typhimurium LT2
ccgcaaucagcguuucgcc

SEQ ID NO: 3754669 - RNA, 21 nt, Salmonella typhimurium LT2
ccgcaauccuggcuucaaccu

SEQ ID NO: 3754670 - RNA, 15 nt, Salmonella typhimurium LT2
ccgcaaucgcugccu

SEQ ID NO: 3754671 - RNA, 23 nt, Salmonella typhimurium LT2
ccgcaaucgcugccuugagugac

SEQ ID NO: 3754672 - RNA, 18 nt, Salmonella typhimurium LT2
ccgcaaugaccacaaauu

SEQ ID NO: 3754673 - RNA, 16 nt, Salmonella typhimurium LT2
ccgcacacagcggaaa

SEQ ID NO: 3754674 - RNA, 21 nt, Salmonella typhimurium LT2
ccgcacagauuacaaggaaug

SEQ ID NO: 3754675 - RNA, 13 nt, Salmonella typhimurium LT2
ccgcacagcagac

SEQ ID NO: 3754676 - RNA, 23 nt, Salmonella typhimurium LT2
ccgcacagcagacaaccgacgca

SEQ ID NO: 3754677 - RNA, 13 nt, Salmonella typhimurium LT2
ccgcacaucggca

SEQ ID NO: 3754678 - RNA, 19 nt, Salmonella typhimurium LT2
ccgcacccgaaagucaaaa

SEQ ID NO: 3754679 - RNA, 17 nt, Salmonella typhimurium LT2
ccgcaccuggguauucc

SEQ ID NO: 3754680 - RNA, 21 nt, Salmonella typhimurium LT2
ccgcaccuggguauuccacug

SEQ ID NO: 3754681 - RNA, 14 nt, Salmonella typhimurium LT2
ccgcaccuggucua

SEQ ID NO: 3754682 - RNA, 20 nt, Salmonella typhimurium LT2
ccgcacgaacggucaggacg

SEQ ID NO: 3754683 - RNA, 20 nt, Salmonella typhimurium LT2
ccgcacgguuagccggaaga

SEQ ID NO: 3754684 - RNA, 23 nt, Salmonella typhimurium LT2
ccgcacucgcgcuucagcccgaa

SEQ ID NO: 3754685 - RNA, 12 nt, Salmonella typhimurium LT2
ccgcacugcauc

SEQ ID NO: 3754686 - RNA, 15 nt, Salmonella typhimurium LT2
ccgcagaagccgguc

SEQ ID NO: 3754687 - RNA, 23 nt, Salmonella typhimurium LT2
ccgcagacuuuagccauucccga

SEQ ID NO: 3754688 - RNA, 19 nt, Salmonella typhimurium LT2
ccgcagauauuuccggcaa

SEQ ID NO: 3754689 - RNA, 16 nt, Salmonella typhimurium LT2
ccgcagcaggcgggcu

SEQ ID NO: 3754690 - RNA, 18 nt, Salmonella typhimurium LT2
ccgcagcauuuccgccgc

SEQ ID NO: 3754691 - RNA, 21 nt, Salmonella typhimurium LT2
ccgcagcauuuccgccgccuu

SEQ ID NO: 3754692 - RNA, 12 nt, Salmonella typhimurium LT2
ccgcagcccgcc

SEQ ID NO: 3754693 - RNA, 14 nt, Salmonella typhimurium LT2
ccgcagccgacgca

SEQ ID NO: 3754694 - RNA, 15 nt, Salmonella typhimurium LT2
ccgcagccgacgcau

SEQ ID NO: 3754695 - RNA, 17 nt, Salmonella typhimurium LT2
ccgcagccuaguucugc

SEQ ID NO: 3754696 - RNA, 15 nt, Salmonella typhimurium LT2
ccgcagccugauggc

SEQ ID NO: 3754697 - RNA, 13 nt, Salmonella typhimurium LT2
ccgcagcgccaua

SEQ ID NO: 3754698 - RNA, 21 nt, Salmonella typhimurium LT2
ccgcagcgccgacguuaucgc

SEQ ID NO: 3754699 - RNA, 12 nt, Salmonella typhimurium LT2
ccgcagcggcuc

SEQ ID NO: 3754700 - RNA, 22 nt, Salmonella typhimurium LT2
ccgcaggacagcgacauccucu

SEQ ID NO: 3754701 - RNA, 14 nt, Salmonella typhimurium LT2
ccgcaggccggaua

SEQ ID NO: 3754702 - RNA, 17 nt, Salmonella typhimurium LT2
ccgcaggcucuuuuucu

SEQ ID NO: 3754703 - RNA, 17 nt, Salmonella typhimurium LT2
ccgcaggucggacaguu

SEQ ID NO: 3754704 - RNA, 14 nt, Salmonella typhimurium LT2
ccgcaguuuuccag

SEQ ID NO: 3754705 - RNA, 15 nt, Salmonella typhimurium LT2
ccgcaguuuuccagc

SEQ ID NO: 3754706 - RNA, 18 nt, Salmonella typhimurium LT2
ccgcauaccgaacagaaa

SEQ ID NO: 3754707 - RNA, 15 nt, Salmonella typhimurium LT2
ccgcauagacgugcg

SEQ ID NO: 3754708 - RNA, 14 nt, Salmonella typhimurium LT2
ccgcauauuuuucu

SEQ ID NO: 3754709 - RNA, 14 nt, Salmonella typhimurium LT2
ccgcaucaaugccc

SEQ ID NO: 3754710 - RNA, 18 nt, Salmonella typhimurium LT2
ccgcaucagcaacgcgcc

SEQ ID NO: 3754711 - RNA, 11 nt, Salmonella typhimurium LT2
ccgcaucccca

SEQ ID NO: 3754712 - RNA, 19 nt, Salmonella typhimurium LT2
ccgcauccccauagacagu

SEQ ID NO: 3754713 - RNA, 14 nt, Salmonella typhimurium LT2
ccgcauccggcaau

SEQ ID NO: 3754714 - RNA, 20 nt, Salmonella typhimurium LT2
ccgcauccuguuuuuucagc

SEQ ID NO: 3754715 - RNA, 15 nt, Salmonella typhimurium LT2
ccgcauuaacugccu

SEQ ID NO: 3754716 - RNA, 21 nt, Salmonella typhimurium LT2
ccgcauuaacugccuguuaac

SEQ ID NO: 3754717 - RNA, 17 nt, Salmonella typhimurium LT2
ccgcauuuucucgcgca

SEQ ID NO: 3754718 - RNA, 16 nt, Salmonella typhimurium LT2
ccgcauuuugcuucac

SEQ ID NO: 3754719 - RNA, 15 nt, Salmonella typhimurium LT2
ccgcauuuuuccagc

SEQ ID NO: 3754720 - RNA, 17 nt, Salmonella typhimurium LT2
ccgccaaacgccgcaac

SEQ ID NO: 3754721 - RNA, 16 nt, Salmonella typhimurium LT2
ccgccaaacgcgguca

SEQ ID NO: 3754722 - RNA, 24 nt, Salmonella typhimurium LT2
ccgccaaacugcgcgccgcccugc

SEQ ID NO: 3754723 - RNA, 14 nt, Salmonella typhimurium LT2
ccgccaaagcgccc

SEQ ID NO: 3754724 - RNA, 18 nt, Salmonella typhimurium LT2
ccgccaaagcgguccggc

SEQ ID NO: 3754725 - RNA, 23 nt, Salmonella typhimurium LT2
ccgccaacgccaacauagccaca

SEQ ID NO: 3754726 - RNA, 16 nt, Salmonella typhimurium LT2
ccgccuaacagcgccg

SEQ ID NO: 3754727 - RNA, 16 nt, Salmonella typhimurium LT2
ccgccuaccagcacau

SEQ ID NO: 3754728 - RNA, 14 nt, Salmonella typhimurium LT2
ccgccucaauugcc

SEQ ID NO: 3754729 - RNA, 14 nt, Salmonella typhimurium LT2
ccgccuccaggccg

SEQ ID NO: 3754730 - RNA, 13 nt, Salmonella typhimurium LT2
ccgccucgcgcac

SEQ ID NO: 3754731 - RNA, 19 nt, Salmonella typhimurium LT2
ccgccucgcgcaccccggc

SEQ ID NO: 3754732 - RNA, 21 nt, Salmonella typhimurium LT2
ccgccucgcgcaccccggcca

SEQ ID NO: 3754733 - RNA, 18 nt, Salmonella typhimurium LT2
ccgccugaugcuggcaga

SEQ ID NO: 3754734 - RNA, 13 nt, Salmonella typhimurium LT2
ccgccugccagau

SEQ ID NO: 3754735 - RNA, 22 nt, Salmonella typhimurium LT2
ccgccugccagauccaacacau

SEQ ID NO: 3754736 - RNA, 14 nt, Salmonella typhimurium LT2
ccgccugccgcgcc

SEQ ID NO: 3754737 - RNA, 15 nt, Salmonella typhimurium LT2
ccgccugccgcgccg

SEQ ID NO: 3754738 - RNA, 16 nt, Salmonella typhimurium LT2
ccgccugcgccuugac

SEQ ID NO: 3754739 - RNA, 15 nt, Salmonella typhimurium LT2
ccgccugcuccgggc

SEQ ID NO: 3754740 - RNA, 15 nt, Salmonella typhimurium LT2
ccgccuggcgcgacu

SEQ ID NO: 3754741 - RNA, 17 nt, Salmonella typhimurium LT2
ccgccuucagcgcgccc

SEQ ID NO: 3754742 - RNA, 13 nt, Salmonella typhimurium LT2
ccgccuucugcac

SEQ ID NO: 3754743 - RNA, 21 nt, Salmonella typhimurium LT2
ccgccuugcggcgccaggaca

SEQ ID NO: 3754744 - RNA, 12 nt, Salmonella typhimurium LT2
ccgccuugcugc

SEQ ID NO: 3754745 - RNA, 16 nt, Salmonella typhimurium LT2
ccgccuuguccggccu

SEQ ID NO: 3754746 - RNA, 20 nt, Salmonella typhimurium LT2
ccgccuuuuauaauaaaagc

SEQ ID NO: 3754747 - RNA, 23 nt, Salmonella typhimurium LT2
ccgcgacaaaaagcgcgccgaaa

SEQ ID NO: 3754748 - RNA, 23 nt, Salmonella typhimurium LT2
ccgcgacaugguuuccagcgaau

SEQ ID NO: 3754749 - RNA, 17 nt, Salmonella typhimurium LT2
ccgcgagaacuuccgcc

SEQ ID NO: 3754750 - RNA, 21 nt, Salmonella typhimurium LT2
ccgcgagcguucaaaaucaaa

SEQ ID NO: 3754751 - RNA, 21 nt, Salmonella typhimurium LT2
ccgcgagugcaggaucaccgg

SEQ ID NO: 3754752 - RNA, 23 nt, Salmonella typhimurium LT2
ccgcgauaaagaauagccugggc

SEQ ID NO: 3754753 - RNA, 15 nt, Salmonella typhimurium LT2
ccgcgauaaccauca

SEQ ID NO: 3754754 - RNA, 16 nt, Salmonella typhimurium LT2
ccgcgauacggauagc

SEQ ID NO: 3754755 - RNA, 21 nt, Salmonella typhimurium LT2
ccgcgauagaccacgccauca

SEQ ID NO: 3754756 - RNA, 23 nt, Salmonella typhimurium LT2
ccgcgauagaccacgccaucaac

SEQ ID NO: 3754757 - RNA, 23 nt, Salmonella typhimurium LT2
ccgcgauagguugaauaaccaua

SEQ ID NO: 3754758 - RNA, 13 nt, Salmonella typhimurium LT2
ccgcgaucgcugg

SEQ ID NO: 3754759 - RNA, 17 nt, Salmonella typhimurium LT2
ccgcgaugaucgucgcg

SEQ ID NO: 3754760 - RNA, 17 nt, Salmonella typhimurium LT2
ccgcgauuuagcguugg

SEQ ID NO: 3754761 - RNA, 23 nt, Salmonella typhimurium LT2
ccgcgcaaagcaauaccacgccc

SEQ ID NO: 3754762 - RNA, 24 nt, Salmonella typhimurium LT2
ccgcgcaauaugaaaccgcccugc

SEQ ID NO: 3754763 - RNA, 19 nt, Salmonella typhimurium LT2
ccgcgcaaucgccgaucgc

SEQ ID NO: 3754764 - RNA, 13 nt, Salmonella typhimurium LT2
ccgcgcacgcgcg

SEQ ID NO: 3754765 - RNA, 21 nt, Salmonella typhimurium LT2
ccgcgcagaaucacuucaucc

SEQ ID NO: 3754766 - RNA, 12 nt, Salmonella typhimurium LT2
ccgcgcagcgcc

SEQ ID NO: 3754767 - RNA, 16 nt, Salmonella typhimurium LT2
ccgcgcagcgccagaa

SEQ ID NO: 3754768 - RNA, 15 nt, Salmonella typhimurium LT2
ccgcgcaguuucuua

SEQ ID NO: 3754769 - RNA, 15 nt, Salmonella typhimurium LT2
ccgcgcauggccaua

SEQ ID NO: 3754770 - RNA, 20 nt, Salmonella typhimurium LT2
ccgcgccaccgggccgucag

SEQ ID NO: 3754771 - RNA, 12 nt, Salmonella typhimurium LT2
ccgcgccagcca

SEQ ID NO: 3754772 - RNA, 16 nt, Salmonella typhimurium LT2
ccgcgccauccacccc

SEQ ID NO: 3754773 - RNA, 22 nt, Salmonella typhimurium LT2
ccgcgcccaguuucuucaggcc

SEQ ID NO: 3754774 - RNA, 13 nt, Salmonella typhimurium LT2
ccgcgccgcccca

SEQ ID NO: 3754775 - RNA, 11 nt, Salmonella typhimurium LT2
ccgcgccgccg

SEQ ID NO: 3754776 - RNA, 16 nt, Salmonella typhimurium LT2
ccgcgccgcugagaaa

SEQ ID NO: 3754777 - RNA, 16 nt, Salmonella typhimurium LT2
ccgcgccggucgccag

SEQ ID NO: 3754778 - RNA, 12 nt, Salmonella typhimurium LT2
ccgcgccgucgg

SEQ ID NO: 3754779 - RNA, 17 nt, Salmonella typhimurium LT2
ccgcgccuaccagcgcu

SEQ ID NO: 3754780 - RNA, 18 nt, Salmonella typhimurium LT2
ccgcgccugggcggcaac

SEQ ID NO: 3754781 - RNA, 23 nt, Salmonella typhimurium LT2
ccgcgccugggcggcaacccgcu

SEQ ID NO: 3754782 - RNA, 21 nt, Salmonella typhimurium LT2
ccgcgccuucgcggugauccc

SEQ ID NO: 3754783 - RNA, 16 nt, Salmonella typhimurium LT2
ccgcgcgacagagcca

SEQ ID NO: 3754784 - RNA, 15 nt, Salmonella typhimurium LT2
ccgcgcgcauauggc

SEQ ID NO: 3754785 - RNA, 20 nt, Salmonella typhimurium LT2
ccgcgcgccagcggacucca

SEQ ID NO: 3754786 - RNA, 13 nt, Salmonella typhimurium LT2
ccgcgcgccgccu

SEQ ID NO: 3754787 - RNA, 14 nt, Salmonella typhimurium LT2
ccgcgcgccgccuc

SEQ ID NO: 3754788 - RNA, 15 nt, Salmonella typhimurium LT2
ccgcgcgcuuuccac

SEQ ID NO: 3754789 - RNA, 16 nt, Salmonella typhimurium LT2
ccgcgcggaucgccau

SEQ ID NO: 3754790 - RNA, 22 nt, Salmonella typhimurium LT2
ccgcgcuagugccgccaggcaa

SEQ ID NO: 3754791 - RNA, 14 nt, Salmonella typhimurium LT2
ccgcgcucaacaca

SEQ ID NO: 3754792 - RNA, 14 nt, Salmonella typhimurium LT2
ccgcgcucgcguaa

SEQ ID NO: 3754793 - RNA, 17 nt, Salmonella typhimurium LT2
ccgcgcucgugauugau

SEQ ID NO: 3754794 - RNA, 16 nt, Salmonella typhimurium LT2
ccgcgcugaucgccac

SEQ ID NO: 3754795 - RNA, 19 nt, Salmonella typhimurium LT2
ccgcgcuggauagcgagaa

SEQ ID NO: 3754796 - RNA, 19 nt, Salmonella typhimurium LT2
ccgcgcuggcugaaccccu

SEQ ID NO: 3754797 - RNA, 15 nt, Salmonella typhimurium LT2
ccgcggcgaucacca

SEQ ID NO: 3754798 - RNA, 17 nt, Salmonella typhimurium LT2
ccgcggcgaucuccuga

SEQ ID NO: 3754799 - RNA, 20 nt, Salmonella typhimurium LT2
ccgcggcggacagcggcagc

SEQ ID NO: 3754800 - RNA, 16 nt, Salmonella typhimurium LT2
ccgcggcgguuauccu

SEQ ID NO: 3754801 - RNA, 13 nt, Salmonella typhimurium LT2
ccgcgguccagcc

SEQ ID NO: 3754802 - RNA, 14 nt, Salmonella typhimurium LT2
ccgcguaaucgcga

SEQ ID NO: 3754803 - RNA, 13 nt, Salmonella typhimurium LT2
ccgcguaaugacu

SEQ ID NO: 3754804 - RNA, 19 nt, Salmonella typhimurium LT2
ccgcguacaggaagccggu

SEQ ID NO: 3754805 - RNA, 20 nt, Salmonella typhimurium LT2
ccgcguaccugugcagguac

SEQ ID NO: 3754806 - RNA, 19 nt, Salmonella typhimurium LT2
ccgcguagcccagcgccgc

SEQ ID NO: 3754807 - RNA, 18 nt, Salmonella typhimurium LT2
ccgcgucacgaccggcga

SEQ ID NO: 3754808 - RNA, 16 nt, Salmonella typhimurium LT2
ccgcgucguucgacga

SEQ ID NO: 3754809 - RNA, 20 nt, Salmonella typhimurium LT2
ccgcgugaacaccacugaaa

SEQ ID NO: 3754810 - RNA, 20 nt, Salmonella typhimurium LT2
ccgcgugggacguuuggcuu

SEQ ID NO: 3754811 - RNA, 20 nt, Salmonella typhimurium LT2
ccgcguucgcauauucugcg

SEQ ID NO: 3754812 - RNA, 13 nt, Salmonella typhimurium LT2
ccgcguucugcug

SEQ ID NO: 3754813 - RNA, 17 nt, Salmonella typhimurium LT2
ccgcguucugcugugcc

SEQ ID NO: 3754814 - RNA, 18 nt, Salmonella typhimurium LT2
ccgcguucugcugugccg

SEQ ID NO: 3754815 - RNA, 24 nt, Salmonella typhimurium LT2
ccgcguugccaaaacgcucgcgcu

SEQ ID NO: 3754816 - RNA, 14 nt, Salmonella typhimurium LT2
ccgcguuggcggcu

SEQ ID NO: 3754817 - RNA, 18 nt, Salmonella typhimurium LT2
ccgcguuuaagccccugg

SEQ ID NO: 3754818 - RNA, 17 nt, Salmonella typhimurium LT2
ccgcguuucucgccggu

SEQ ID NO: 3754819 - RNA, 19 nt, Salmonella typhimurium LT2
ccgcuaaaugggcaggaga

SEQ ID NO: 3754820 - RNA, 18 nt, Salmonella typhimurium LT2
ccgcuacaauccaggacg

SEQ ID NO: 3754821 - RNA, 14 nt, Salmonella typhimurium LT2
ccgcuacuccgccc

SEQ ID NO: 3754822 - RNA, 23 nt, Salmonella typhimurium LT2
ccgcuauaaaaauuauaacguga

SEQ ID NO: 3754823 - RNA, 23 nt, Salmonella typhimurium LT2
ccgcuauaagcggcgucauccgg

SEQ ID NO: 3754824 - RNA, 23 nt, Salmonella typhimurium LT2
ccgcuaugcaauuguuccugcgu

SEQ ID NO: 3754825 - RNA, 18 nt, Salmonella typhimurium LT2
ccgcucaauaauauccug

SEQ ID NO: 3754826 - RNA, 22 nt, Salmonella typhimurium LT2
ccgcucacgguuucuacuucca

SEQ ID NO: 3754827 - RNA, 17 nt, Salmonella typhimurium LT2
ccgcucacuaccgccgc

SEQ ID NO: 3754828 - RNA, 20 nt, Salmonella typhimurium LT2
ccgcucacuaccgccgcgag

SEQ ID NO: 3754829 - RNA, 17 nt, Salmonella typhimurium LT2
ccgcuccgcgcauccug

SEQ ID NO: 3754830 - RNA, 11 nt, Salmonella typhimurium LT2
ccggauuuagc

SEQ ID NO: 3754831 - RNA, 22 nt, Salmonella typhimurium LT2
ccggcaaacgggcgaccgucgg

SEQ ID NO: 3754832 - RNA, 23 nt, Salmonella typhimurium LT2
ccggcaaaggaauuacggacgau

SEQ ID NO: 3754833 - RNA, 18 nt, Salmonella typhimurium LT2
ccggcaaccugagcgcga

SEQ ID NO: 3754834 - RNA, 13 nt, Salmonella typhimurium LT2
ccggcaagcgcug

SEQ ID NO: 3754835 - RNA, 17 nt, Salmonella typhimurium LT2
ccggcaagggucuuaac

SEQ ID NO: 3754836 - RNA, 15 nt, Salmonella typhimurium LT2
ccggcaauucaauca

SEQ ID NO: 3754837 - RNA, 14 nt, Salmonella typhimurium LT2
ccggcacacagaau

SEQ ID NO: 3754838 - RNA, 20 nt, Salmonella typhimurium LT2
ccggcacaccggccauugcc

SEQ ID NO: 3754839 - RNA, 16 nt, Salmonella typhimurium LT2
ccggcacauccagcug

SEQ ID NO: 3754840 - RNA, 15 nt, Salmonella typhimurium LT2
ccggcaccacgcaca

SEQ ID NO: 3754841 - RNA, 17 nt, Salmonella typhimurium LT2
ccggcaccucguccaga

SEQ ID NO: 3754842 - RNA, 22 nt, Salmonella typhimurium LT2
ccggcacgauggucucaaucgc

SEQ ID NO: 3754843 - RNA, 20 nt, Salmonella typhimurium LT2
ccggcacugcgccuugcccc

SEQ ID NO: 3754844 - RNA, 18 nt, Salmonella typhimurium LT2
ccggcacuguucggggau

SEQ ID NO: 3754845 - RNA, 20 nt, Salmonella typhimurium LT2
ccggcagcgucguccagccc

SEQ ID NO: 3754846 - RNA, 20 nt, Salmonella typhimurium LT2
ccggcaggcagcgccagcgg

SEQ ID NO: 3754847 - RNA, 11 nt, Salmonella typhimurium LT2
ccggcaggcau

SEQ ID NO: 3754848 - RNA, 23 nt, Salmonella typhimurium LT2
ccggcagggucguacuaaagagc

SEQ ID NO: 3754849 - RNA, 19 nt, Salmonella typhimurium LT2
ccggcagucgggcgaacgc

SEQ ID NO: 3754850 - RNA, 21 nt, Salmonella typhimurium LT2
ccggcaguuuaagcgccgaca

SEQ ID NO: 3754851 - RNA, 15 nt, Salmonella typhimurium LT2
ccggcaucacgccgg

SEQ ID NO: 3754852 - RNA, 21 nt, Salmonella typhimurium LT2
ccggcaucauucugcaggcgg

SEQ ID NO: 3754853 - RNA, 14 nt, Salmonella typhimurium LT2
ccggcaucggcagc

SEQ ID NO: 3754854 - RNA, 22 nt, Salmonella typhimurium LT2
ccggcaucucaucuugcaagaa

SEQ ID NO: 3754855 - RNA, 17 nt, Salmonella typhimurium LT2
ccggcaugacaucagaa

SEQ ID NO: 3754856 - RNA, 20 nt, Salmonella typhimurium LT2
ccggcaugucgccagccagu

SEQ ID NO: 3754857 - RNA, 14 nt, Salmonella typhimurium LT2
ccggcauucgcaca

SEQ ID NO: 3754858 - RNA, 15 nt, Salmonella typhimurium LT2
ccggccaccgccugc

SEQ ID NO: 3754859 - RNA, 18 nt, Salmonella typhimurium LT2
ccggccauugccgcgccg

SEQ ID NO: 3754860 - RNA, 17 nt, Salmonella typhimurium LT2
ccggccccgcgccagcc

SEQ ID NO: 3754861 - RNA, 12 nt, Salmonella typhimurium LT2
ccggcccuuccg

SEQ ID NO: 3754862 - RNA, 23 nt, Salmonella typhimurium LT2
ccggccuacaccguuucugaucu

SEQ ID NO: 3754863 - RNA, 21 nt, Salmonella typhimurium LT2
ccggccuacagcugauugaug

SEQ ID NO: 3754864 - RNA, 15 nt, Salmonella typhimurium LT2
ccggccugacgcagc

SEQ ID NO: 3754865 - RNA, 20 nt, Salmonella typhimurium LT2
ccggcgaaaucgugcgcccc

SEQ ID NO: 3754866 - RNA, 19 nt, Salmonella typhimurium LT2
ccggcgaacgcuggcuggg

SEQ ID NO: 3754867 - RNA, 17 nt, Salmonella typhimurium LT2
ccggcgaauagcgccag

SEQ ID NO: 3754868 - RNA, 19 nt, Salmonella typhimurium LT2
ccggcgaccacuagcgccg

SEQ ID NO: 3754869 - RNA, 18 nt, Salmonella typhimurium LT2
ccggcgacgcuuucaccu

SEQ ID NO: 3754870 - RNA, 21 nt, Salmonella typhimurium LT2
ccggcgacguauucccccuga

SEQ ID NO: 3754871 - RNA, 17 nt, Salmonella typhimurium LT2
ccggcgagcgaugcugc

SEQ ID NO: 3754872 - RNA, 18 nt, Salmonella typhimurium LT2
ccggcgcaaacacggcug

SEQ ID NO: 3754873 - RNA, 14 nt, Salmonella typhimurium LT2
ccggcgcagacggc

SEQ ID NO: 3754874 - RNA, 19 nt, Salmonella typhimurium LT2
ccggcgccagcucaacgcc

SEQ ID NO: 3754875 - RNA, 13 nt, Salmonella typhimurium LT2
ccggcgccgccga

SEQ ID NO: 3754876 - RNA, 14 nt, Salmonella typhimurium LT2
ccggcgccuccagc

SEQ ID NO: 3754877 - RNA, 15 nt, Salmonella typhimurium LT2
ccggcgcgcgccagc

SEQ ID NO: 3754878 - RNA, 13 nt, Salmonella typhimurium LT2
ccggcgcggcauc

SEQ ID NO: 3754879 - RNA, 12 nt, Salmonella typhimurium LT2
ccggcgcggcgc

SEQ ID NO: 3754880 - RNA, 15 nt, Salmonella typhimurium LT2
ccggcgcggcgcgca

SEQ ID NO: 3754881 - RNA, 13 nt, Salmonella typhimurium LT2
ccggcgcgggcau

SEQ ID NO: 3754882 - RNA, 16 nt, Salmonella typhimurium LT2
ccggcgcgggcgagau

SEQ ID NO: 3754883 - RNA, 20 nt, Salmonella typhimurium LT2
ccggcgcguuaauaccgugc

SEQ ID NO: 3754884 - RNA, 20 nt, Salmonella typhimurium LT2
ccggcgcguuuuggcagaca

SEQ ID NO: 3754885 - RNA, 18 nt, Salmonella typhimurium LT2
ccggcgcuaaccagcgcu

SEQ ID NO: 3754886 - RNA, 14 nt, Salmonella typhimurium LT2
ccggcggaauagcu

SEQ ID NO: 3754887 - RNA, 23 nt, Salmonella typhimurium LT2
ccggcggcaaaggcauggcaggu

SEQ ID NO: 3754888 - RNA, 14 nt, Salmonella typhimurium LT2
ccggcggcagaugc

SEQ ID NO: 3754889 - RNA, 11 nt, Salmonella typhimurium LT2
ccggcggcagu

SEQ ID NO: 3754890 - RNA, 23 nt, Salmonella typhimurium LT2
ccggcgggguuuuuuuaugcguu

SEQ ID NO: 3754891 - RNA, 23 nt, Salmonella typhimurium LT2
ccggcggucgauuuugccuucaa

SEQ ID NO: 3754892 - RNA, 15 nt, Salmonella typhimurium LT2
ccggcguaauccagc

SEQ ID NO: 3754893 - RNA, 14 nt, Salmonella typhimurium LT2
ccggcguagcgcgc

SEQ ID NO: 3754894 - RNA, 20 nt, Salmonella typhimurium LT2
ccggcguauugguacaacgc

SEQ ID NO: 3754895 - RNA, 18 nt, Salmonella typhimurium LT2
ccggcgucacaccauauc

SEQ ID NO: 3754896 - RNA, 18 nt, Salmonella typhimurium LT2
ccggcgucauacugccaa

SEQ ID NO: 3754897 - RNA, 23 nt, Salmonella typhimurium LT2
ccggcgucccuuucccuuccagc

SEQ ID NO: 3754898 - RNA, 14 nt, Salmonella typhimurium LT2
ccggcguccggcgc

SEQ ID NO: 3754899 - RNA, 22 nt, Salmonella typhimurium LT2
ccggcgugaugcguaccgcgcu

SEQ ID NO: 3754900 - RNA, 13 nt, Salmonella typhimurium LT2
ccggcgugccgau

SEQ ID NO: 3754901 - RNA, 18 nt, Salmonella typhimurium LT2
ccggcgugguggcgucaa

SEQ ID NO: 3754902 - RNA, 16 nt, Salmonella typhimurium LT2
ccggcguguaaaccgc

SEQ ID NO: 3754903 - RNA, 21 nt, Salmonella typhimurium LT2
ccggcgugugucccggacaau

SEQ ID NO: 3754904 - RNA, 22 nt, Salmonella typhimurium LT2
ccggcguuucguuuagcgccug

SEQ ID NO: 3754905 - RNA, 17 nt, Salmonella typhimurium LT2
ccggcguuuucagaucc

SEQ ID NO: 3754906 - RNA, 19 nt, Salmonella typhimurium LT2
ccggcguuuuuagugacag

SEQ ID NO: 3754907 - RNA, 14 nt, Salmonella typhimurium LT2
ccggcuaugccgga

SEQ ID NO: 3754908 - RNA, 19 nt, Salmonella typhimurium LT2
ccggcuaugccggaggaua

SEQ ID NO: 3754909 - RNA, 18 nt, Salmonella typhimurium LT2
ccggcucgccacggccaa

SEQ ID NO: 3754910 - RNA, 11 nt, Salmonella typhimurium LT2
ccggcucgccu

SEQ ID NO: 3754911 - RNA, 23 nt, Salmonella typhimurium LT2
ccggcugaacguuguauaaacag

SEQ ID NO: 3754912 - RNA, 19 nt, Salmonella typhimurium LT2
ccggcugccauuaucacca

SEQ ID NO: 3754913 - RNA, 13 nt, Salmonella typhimurium LT2
ccggcugccgaua

SEQ ID NO: 3754914 - RNA, 15 nt, Salmonella typhimurium LT2
ccggcuggcuauagu

SEQ ID NO: 3754915 - RNA, 17 nt, Salmonella typhimurium LT2
ccggcuguuuugcuucu

SEQ ID NO: 3754916 - RNA, 15 nt, Salmonella typhimurium LT2
ccggcuuauccggcc

SEQ ID NO: 3754917 - RNA, 11 nt, Salmonella typhimurium LT2
ccggcuucagc

SEQ ID NO: 3754918 - RNA, 19 nt, Salmonella typhimurium LT2
ccggcuucuccaccauauc

SEQ ID NO: 3754919 - RNA, 17 nt, Salmonella typhimurium LT2
ccggcuucuggcuaccg

SEQ ID NO: 3754920 - RNA, 19 nt, Salmonella typhimurium LT2
ccggcuucuuccggccccg

SEQ ID NO: 3754921 - RNA, 19 nt, Salmonella typhimurium LT2
ccggcuuuaacccugugga

SEQ ID NO: 3754922 - RNA, 17 nt, Salmonella typhimurium LT2
ccggcuuuccgcaccgc

SEQ ID NO: 3754923 - RNA, 22 nt, Salmonella typhimurium LT2
ccggcuuuuuuauaucaggcaa

SEQ ID NO: 3754924 - RNA, 22 nt, Salmonella typhimurium LT2
ccgggaacagaauaacgucgcg

SEQ ID NO: 3754925 - RNA, 22 nt, Salmonella typhimurium LT2
ccgggaacagguuuccggcaga

SEQ ID NO: 3754926 - RNA, 16 nt, Salmonella typhimurium LT2
ccgggaagaaggcucc

SEQ ID NO: 3754927 - RNA, 23 nt, Salmonella typhimurium LT2
ccgggagaaaacgcggccuggaa

SEQ ID NO: 3754928 - RNA, 17 nt, Salmonella typhimurium LT2
ccgggagaacgccgggc

SEQ ID NO: 3754929 - RNA, 22 nt, Salmonella typhimurium LT2
ccgggagaacgccgggccugcc

SEQ ID NO: 3754930 - RNA, 22 nt, Salmonella typhimurium LT2
ccgggagagaguugagccagau

SEQ ID NO: 3754931 - RNA, 16 nt, Salmonella typhimurium LT2
ccgggaucagcggcug

SEQ ID NO: 3754932 - RNA, 20 nt, Salmonella typhimurium LT2
ccgggaucgggacauguuca

SEQ ID NO: 3754933 - RNA, 22 nt, Salmonella typhimurium LT2
ccgggcagcaucucgauuacag

SEQ ID NO: 3754934 - RNA, 13 nt, Salmonella typhimurium LT2
ccgggcauggcuc

SEQ ID NO: 3754935 - RNA, 17 nt, Salmonella typhimurium LT2
ccgggccaaugccgccu

SEQ ID NO: 3754936 - RNA, 12 nt, Salmonella typhimurium LT2
ccgggccacucu

SEQ ID NO: 3754937 - RNA, 17 nt, Salmonella typhimurium LT2
ccgggccacucuccagc

SEQ ID NO: 3754938 - RNA, 20 nt, Salmonella typhimurium LT2
ccgggccaucuuuuuucacu

SEQ ID NO: 3754939 - RNA, 18 nt, Salmonella typhimurium LT2
ccgggccgacaggcggca

SEQ ID NO: 3754940 - RNA, 20 nt, Salmonella typhimurium LT2
ccgggccgacaggcggcagc

SEQ ID NO: 3754941 - RNA, 13 nt, Salmonella typhimurium LT2
ccgggccgucagg

SEQ ID NO: 3754942 - RNA, 17 nt, Salmonella typhimurium LT2
ccgggcgacacgcgcgc

SEQ ID NO: 3754943 - RNA, 18 nt, Salmonella typhimurium LT2
ccgggcgacacgcgcgcu

SEQ ID NO: 3754944 - RNA, 13 nt, Salmonella typhimurium LT2
ccgggcgaccacc

SEQ ID NO: 3754945 - RNA, 17 nt, Salmonella typhimurium LT2
ccgggcgauaucacgga

SEQ ID NO: 3754946 - RNA, 15 nt, Salmonella typhimurium LT2
ccgggcgcccggccu

SEQ ID NO: 3754947 - RNA, 16 nt, Salmonella typhimurium LT2
ccgggcgucacccgcc

SEQ ID NO: 3754948 - RNA, 22 nt, Salmonella typhimurium LT2
ccgggcgucacccgccggcagu

SEQ ID NO: 3754949 - RNA, 21 nt, Salmonella typhimurium LT2
ccgggcugaacgccaggccgu

SEQ ID NO: 3754950 - RNA, 18 nt, Salmonella typhimurium LT2
ccggggaucguucugcug

SEQ ID NO: 3754951 - RNA, 16 nt, Salmonella typhimurium LT2
ccggggccagcgccag

SEQ ID NO: 3754952 - RNA, 21 nt, Salmonella typhimurium LT2
ccggggugacggcaacggcga

SEQ ID NO: 3754953 - RNA, 22 nt, Salmonella typhimurium LT2
ccgggguggauggcgcgggcag

SEQ ID NO: 3754954 - RNA, 20 nt, Salmonella typhimurium LT2
ccgggguucgaauccccgcc

SEQ ID NO: 3754955 - RNA, 17 nt, Salmonella typhimurium LT2
ccggguaaacgcagcgu

SEQ ID NO: 3754956 - RNA, 17 nt, Salmonella typhimurium LT2
ccggguauucaucggca

SEQ ID NO: 3754957 - RNA, 19 nt, Salmonella typhimurium LT2
ccggguauucaucggcaca

SEQ ID NO: 3754958 - RNA, 21 nt, Salmonella typhimurium LT2
ccgggucagaaaagcuucguu

SEQ ID NO: 3754959 - RNA, 16 nt, Salmonella typhimurium LT2
ccggguggcagcguga

SEQ ID NO: 3754960 - RNA, 18 nt, Salmonella typhimurium LT2
ccggguggcggcuacgcc

SEQ ID NO: 3754961 - RNA, 18 nt, Salmonella typhimurium LT2
ccggguguucgauaccgu

SEQ ID NO: 3754962 - RNA, 20 nt, Salmonella typhimurium LT2
ccggguucagcgacaggcug

SEQ ID NO: 3754963 - RNA, 14 nt, Salmonella typhimurium LT2
ccggguucgcggca

SEQ ID NO: 3754964 - RNA, 16 nt, Salmonella typhimurium LT2
ccgguaaacaugcugg

SEQ ID NO: 3754965 - RNA, 20 nt, Salmonella typhimurium LT2
ccgguaaacgcuccggcagg

SEQ ID NO: 3754966 - RNA, 22 nt, Salmonella typhimurium LT2
ccgguaaacgcuccggcaggca

SEQ ID NO: 3754967 - RNA, 18 nt, Salmonella typhimurium LT2
ccgguaaagcagugcagu

SEQ ID NO: 3754968 - RNA, 19 nt, Salmonella typhimurium LT2
ccgguaaagcagugcagua

SEQ ID NO: 3754969 - RNA, 19 nt, Salmonella typhimurium LT2
ccgguaaagugacggcgcu

SEQ ID NO: 3754970 - RNA, 20 nt, Salmonella typhimurium LT2
ccgguaaaucaacaaccggc

SEQ ID NO: 3754971 - RNA, 23 nt, Salmonella typhimurium LT2
ccgguaagaaugcgcgucaggcc

SEQ ID NO: 3754972 - RNA, 13 nt, Salmonella typhimurium LT2
ccgguaaggcagg

SEQ ID NO: 3754973 - RNA, 16 nt, Salmonella typhimurium LT2
ccgguaaggcaggcaa

SEQ ID NO: 3754974 - RNA, 18 nt, Salmonella typhimurium LT2
ccgguacgggcagcggcu

SEQ ID NO: 3754975 - RNA, 13 nt, Salmonella typhimurium LT2
ccgguagcguggu

SEQ ID NO: 3754976 - RNA, 13 nt, Salmonella typhimurium LT2
ccgguauccagcg

SEQ ID NO: 3754977 - RNA, 22 nt, Salmonella typhimurium LT2
ccgguaugacgcuugagcgccu

SEQ ID NO: 3754978 - RNA, 23 nt, Salmonella typhimurium LT2
ccgguaugacgcuugagcgccuu

SEQ ID NO: 3754979 - RNA, 21 nt, Salmonella typhimurium LT2
ccggucaauacaucacgcaac

SEQ ID NO: 3754980 - RNA, 14 nt, Salmonella typhimurium LT2
ccggucaggcagca

SEQ ID NO: 3754981 - RNA, 20 nt, Salmonella typhimurium LT2
ccggucauguuccaacaaug

SEQ ID NO: 3754982 - RNA, 21 nt, Salmonella typhimurium LT2
ccggucgcgccagcgaccacc

SEQ ID NO: 3754983 - RNA, 12 nt, Salmonella typhimurium LT2
ccggucggcgca

SEQ ID NO: 3754984 - RNA, 15 nt, Salmonella typhimurium LT2
ccggucggcgcgucg

SEQ ID NO: 3754985 - RNA, 19 nt, Salmonella typhimurium LT2
ccggugaaaaacaucggca

SEQ ID NO: 3754986 - RNA, 19 nt, Salmonella typhimurium LT2
ccggugcgagaaaaagcaa

SEQ ID NO: 3754987 - RNA, 14 nt, Salmonella typhimurium LT2
ccggugcgccccag

SEQ ID NO: 3754988 - RNA, 15 nt, Salmonella typhimurium LT2
ccggugcgccccagc

SEQ ID NO: 3754989 - RNA, 19 nt, Salmonella typhimurium LT2
ccggugcggcaagcgcgcu

SEQ ID NO: 3754990 - RNA, 16 nt, Salmonella typhimurium LT2
ccgguggcgccgcgcc

SEQ ID NO: 3754991 - RNA, 17 nt, Salmonella typhimurium LT2
ccgguggcgcugcgcuu

SEQ ID NO: 3754992 - RNA, 20 nt, Salmonella typhimurium LT2
ccgguggcgguaccggcauu

SEQ ID NO: 3754993 - RNA, 15 nt, Salmonella typhimurium LT2
ccgguguaaaaaaug

SEQ ID NO: 3754994 - RNA, 13 nt, Salmonella typhimurium LT2
ccgguuagcgccg

SEQ ID NO: 3754995 - RNA, 15 nt, Salmonella typhimurium LT2
ccgguuagcgccgcg

SEQ ID NO: 3754996 - RNA, 19 nt, Salmonella typhimurium LT2
ccgguuagcgccgcguggc

SEQ ID NO: 3754997 - RNA, 16 nt, Salmonella typhimurium LT2
ccgguuauaccgccau

SEQ ID NO: 3754998 - RNA, 13 nt, Salmonella typhimurium LT2
ccgguugcgcgcu

SEQ ID NO: 3754999 - RNA, 12 nt, Salmonella typhimurium LT2
ccgguugcgcug

SEQ ID NO: 3755000 - RNA, 20 nt, Salmonella typhimurium LT2
ccgguuugggcgcgaaacug

SEQ ID NO: 3755001 - RNA, 21 nt, Salmonella typhimurium LT2
ccgguuuuacuauugccgaua

SEQ ID NO: 3755002 - RNA, 13 nt, Salmonella typhimurium LT2
ccgguuuuuuaau

SEQ ID NO: 3755003 - RNA, 12 nt, Salmonella typhimurium LT2
ccguaaacaggc

SEQ ID NO: 3755004 - RNA, 14 nt, Salmonella typhimurium LT2
ccguaaaccgcguu

SEQ ID NO: 3755005 - RNA, 16 nt, Salmonella typhimurium LT2
ccguaacgcuccugga

SEQ ID NO: 3755006 - RNA, 14 nt, Salmonella typhimurium LT2
ccguaauagcaaua

SEQ ID NO: 3755007 - RNA, 16 nt, Salmonella typhimurium LT2
ccguaauccaauguuu

SEQ ID NO: 3755008 - RNA, 15 nt, Salmonella typhimurium LT2
ccguaccuccagcga

SEQ ID NO: 3755009 - RNA, 16 nt, Salmonella typhimurium LT2
ccguacuccagcccau

SEQ ID NO: 3755010 - RNA, 23 nt, Salmonella typhimurium LT2
ccguacucuuucggcgccugaug

SEQ ID NO: 3755011 - RNA, 22 nt, Salmonella typhimurium LT2
ccguagauaagcgccacgucgg

SEQ ID NO: 3755012 - RNA, 14 nt, Salmonella typhimurium LT2
ccguagaucgccag

SEQ ID NO: 3755013 - RNA, 23 nt, Salmonella typhimurium LT2
ccguagccaacacaucagcaacu

SEQ ID NO: 3755014 - RNA, 18 nt, Salmonella typhimurium LT2
ccguagcguuaugcgcuu

SEQ ID NO: 3755015 - RNA, 16 nt, Salmonella typhimurium LT2
ccguagcuccagaccu

SEQ ID NO: 3755016 - RNA, 19 nt, Salmonella typhimurium LT2
ccguaggccggauaagacg

SEQ ID NO: 3755017 - RNA, 16 nt, Salmonella typhimurium LT2
ccguaguagguaucca

SEQ ID NO: 3755018 - RNA, 17 nt, Salmonella typhimurium LT2
ccguauccgccaccaug

SEQ ID NO: 3755019 - RNA, 21 nt, Salmonella typhimurium LT2
ccguaucguugaccgugaccu

SEQ ID NO: 3755020 - RNA, 18 nt, Salmonella typhimurium LT2
ccguauggucggcgugcc

SEQ ID NO: 3755021 - RNA, 12 nt, Salmonella typhimurium LT2
ccgucacaaagc

SEQ ID NO: 3755022 - RNA, 15 nt, Salmonella typhimurium LT2
ccgucaccacgcgca

SEQ ID NO: 3755023 - RNA, 19 nt, Salmonella typhimurium LT2
ccgucaccacgcgcacgcc

SEQ ID NO: 3755024 - RNA, 14 nt, Salmonella typhimurium LT2
ccgucaccgccagu

SEQ ID NO: 3755025 - RNA, 23 nt, Salmonella typhimurium LT2
ccgucacguagucuucgucguag

SEQ ID NO: 3755026 - RNA, 21 nt, Salmonella typhimurium LT2
ccgucagacgauauucaagcu

SEQ ID NO: 3755027 - RNA, 17 nt, Salmonella typhimurium LT2
ccgucagauucugcggu

SEQ ID NO: 3755028 - RNA, 23 nt, Salmonella typhimurium LT2
ccgucagcaacaccaccgcccgc

SEQ ID NO: 3755029 - RNA, 18 nt, Salmonella typhimurium LT2
ccgucagcaccagcgaga

SEQ ID NO: 3755030 - RNA, 13 nt, Salmonella typhimurium LT2
ccgucagcgcaug

SEQ ID NO: 3755031 - RNA, 23 nt, Salmonella typhimurium LT2
ccgucaggcuugccgcgccagac

SEQ ID NO: 3755032 - RNA, 16 nt, Salmonella typhimurium LT2
ccgucagucgccagaa

SEQ ID NO: 3755033 - RNA, 18 nt, Salmonella typhimurium LT2
ccgucagugagcccuccu

SEQ ID NO: 3755034 - RNA, 21 nt, Salmonella typhimurium LT2
ccgucauaaaaucaaucugca

SEQ ID NO: 3755035 - RNA, 19 nt, Salmonella typhimurium LT2
ccgucauauagccgcgcag

SEQ ID NO: 3755036 - RNA, 13 nt, Salmonella typhimurium LT2
ccgucauggugau

SEQ ID NO: 3755037 - RNA, 13 nt, Salmonella typhimurium LT2
ccguccaggccug

SEQ ID NO: 3755038 - RNA, 17 nt, Salmonella typhimurium LT2
ccuacacaaaaucauuc

SEQ ID NO: 3755039 - RNA, 14 nt, Salmonella typhimurium LT2
ccuacaccaccagc

SEQ ID NO: 3755040 - RNA, 17 nt, Salmonella typhimurium LT2
ccuacaccaccagcccg

SEQ ID NO: 3755041 - RNA, 22 nt, Salmonella typhimurium LT2
ccuacagguugucgcaacgugu

SEQ ID NO: 3755042 - RNA, 16 nt, Salmonella typhimurium LT2
ccuaccagcacaugau

SEQ ID NO: 3755043 - RNA, 21 nt, Salmonella typhimurium LT2
ccuaccagcgcgccagcgcca

SEQ ID NO: 3755044 - RNA, 22 nt, Salmonella typhimurium LT2
ccuaccagcgcgccagcgccaa

SEQ ID NO: 3755045 - RNA, 13 nt, Salmonella typhimurium LT2
ccuaccgaggcag

SEQ ID NO: 3755046 - RNA, 11 nt, Salmonella typhimurium LT2
ccuaccgccau

SEQ ID NO: 3755047 - RNA, 15 nt, Salmonella typhimurium LT2
ccuaccugccgccau

SEQ ID NO: 3755048 - RNA, 15 nt, Salmonella typhimurium LT2
ccuacgcgccacguc

SEQ ID NO: 3755049 - RNA, 15 nt, Salmonella typhimurium LT2
ccuacggugugccug

SEQ ID NO: 3755050 - RNA, 20 nt, Salmonella typhimurium LT2
ccuagaugaaugacugucca

SEQ ID NO: 3755051 - RNA, 11 nt, Salmonella typhimurium LT2
ccuauaaugcg

SEQ ID NO: 3755052 - RNA, 22 nt, Salmonella typhimurium LT2
ccuaucaggcguugaccgcuuc

SEQ ID NO: 3755053 - RNA, 16 nt, Salmonella typhimurium LT2
ccuauuaucggcacca

SEQ ID NO: 3755054 - RNA, 21 nt, Salmonella typhimurium LT2
ccuauuucaguacagccaaaa

SEQ ID NO: 3755055 - RNA, 19 nt, Salmonella typhimurium LT2
ccuauuuuaaauucccagc

SEQ ID NO: 3755056 - RNA, 13 nt, Salmonella typhimurium LT2
ccucaaaacgggc

SEQ ID NO: 3755057 - RNA, 17 nt, Salmonella typhimurium LT2
ccucaaaauagguguug

SEQ ID NO: 3755058 - RNA, 13 nt, Salmonella typhimurium LT2
ccucaaaccagga

SEQ ID NO: 3755059 - RNA, 18 nt, Salmonella typhimurium LT2
ccucaacauugccggcau

SEQ ID NO: 3755060 - RNA, 19 nt, Salmonella typhimurium LT2
ccucaaucggcgauaaacc

SEQ ID NO: 3755061 - RNA, 20 nt, Salmonella typhimurium LT2
ccucacacugauggcagacc

SEQ ID NO: 3755062 - RNA, 16 nt, Salmonella typhimurium LT2
ccucaccguccgccag

SEQ ID NO: 3755063 - RNA, 17 nt, Salmonella typhimurium LT2
ccucaccguccgccagg

SEQ ID NO: 3755064 - RNA, 13 nt, Salmonella typhimurium LT2
ccucacugccgac

SEQ ID NO: 3755065 - RNA, 13 nt, Salmonella typhimurium LT2
ccucacuguugau

SEQ ID NO: 3755066 - RNA, 19 nt, Salmonella typhimurium LT2
ccucagauguaucgcgcuu

SEQ ID NO: 3755067 - RNA, 12 nt, Salmonella typhimurium LT2
ccucagcaaaac

SEQ ID NO: 3755068 - RNA, 23 nt, Salmonella typhimurium LT2
ccucagcaaaacggauaauaucu

SEQ ID NO: 3755069 - RNA, 19 nt, Salmonella typhimurium LT2
ccucagcaaugauuuuuag

SEQ ID NO: 3755070 - RNA, 13 nt, Salmonella typhimurium LT2
ccucagccacggu

SEQ ID NO: 3755071 - RNA, 17 nt, Salmonella typhimurium LT2
ccucaggcgcacgaccu

SEQ ID NO: 3755072 - RNA, 14 nt, Salmonella typhimurium LT2
ccucagguaucaua

SEQ ID NO: 3755073 - RNA, 18 nt, Salmonella typhimurium LT2
ccucagucgcuuguaccg

SEQ ID NO: 3755074 - RNA, 19 nt, Salmonella typhimurium LT2
ccucauacagcccgcgcag

SEQ ID NO: 3755075 - RNA, 13 nt, Salmonella typhimurium LT2
ccucauauuugua

SEQ ID NO: 3755076 - RNA, 13 nt, Salmonella typhimurium LT2
ccucaucaccuac

SEQ ID NO: 3755077 - RNA, 22 nt, Salmonella typhimurium LT2
ccucauccccaacaucaugucc

SEQ ID NO: 3755078 - RNA, 18 nt, Salmonella typhimurium LT2
ccucaucccggcuuaaau

SEQ ID NO: 3755079 - RNA, 18 nt, Salmonella typhimurium LT2
ccucaucccguagcguca

SEQ ID NO: 3755080 - RNA, 12 nt, Salmonella typhimurium LT2
ccucauccgcau

SEQ ID NO: 3755081 - RNA, 17 nt, Salmonella typhimurium LT2
ccucaucggcaaacauc

SEQ ID NO: 3755082 - RNA, 22 nt, Salmonella typhimurium LT2
ccucaugcuuaucgccaaacca

SEQ ID NO: 3755083 - RNA, 14 nt, Salmonella typhimurium LT2
ccucauuaaaaaaa

SEQ ID NO: 3755084 - RNA, 17 nt, Salmonella typhimurium LT2
ccucauuaaaaaaacau

SEQ ID NO: 3755085 - RNA, 20 nt, Salmonella typhimurium LT2
ccucauuuuguugcuccagc

SEQ ID NO: 3755086 - RNA, 12 nt, Salmonella typhimurium LT2
ccuccagcgagg

SEQ ID NO: 3755087 - RNA, 20 nt, Salmonella typhimurium LT2
ccuccagcgaggccucuccu

SEQ ID NO: 3755088 - RNA, 17 nt, Salmonella typhimurium LT2
ccuccagcuccgcguau

SEQ ID NO: 3755089 - RNA, 23 nt, Salmonella typhimurium LT2
ccuccaucaguucggcgcgccag

SEQ ID NO: 3755090 - RNA, 21 nt, Salmonella typhimurium LT2
ccuccauggcuugucgccaac

SEQ ID NO: 3755091 - RNA, 21 nt, Salmonella typhimurium LT2
ccucccagaagaucgccggaa

SEQ ID NO: 3755092 - RNA, 13 nt, Salmonella typhimurium LT2
ccucccaguuccc

SEQ ID NO: 3755093 - RNA, 18 nt, Salmonella typhimurium LT2
ccuccccaggcgcuauuc

SEQ ID NO: 3755094 - RNA, 11 nt, Salmonella typhimurium LT2
ccucccuuucu

SEQ ID NO: 3755095 - RNA, 15 nt, Salmonella typhimurium LT2
ccuccgaagagaccu

SEQ ID NO: 3755096 - RNA, 16 nt, Salmonella typhimurium LT2
ccuccgcagcuucauc

SEQ ID NO: 3755097 - RNA, 11 nt, Salmonella typhimurium LT2
ccuccgcccgg

SEQ ID NO: 3755098 - RNA, 21 nt, Salmonella typhimurium LT2
ccuccgcguagcccagcgccg

SEQ ID NO: 3755099 - RNA, 18 nt, Salmonella typhimurium LT2
ccuccggcgagcgaugcu

SEQ ID NO: 3755100 - RNA, 13 nt, Salmonella typhimurium LT2
ccuccggcgcgaa

SEQ ID NO: 3755101 - RNA, 15 nt, Salmonella typhimurium LT2
ccuccggcgcggcgc

SEQ ID NO: 3755102 - RNA, 18 nt, Salmonella typhimurium LT2
ccuccggcuaugccggag

SEQ ID NO: 3755103 - RNA, 18 nt, Salmonella typhimurium LT2
ccuccucgacguuuucca

SEQ ID NO: 3755104 - RNA, 18 nt, Salmonella typhimurium LT2
ccuccucucuuccuccug

SEQ ID NO: 3755105 - RNA, 18 nt, Salmonella typhimurium LT2
ccuccugaauagcuuuca

SEQ ID NO: 3755106 - RNA, 23 nt, Salmonella typhimurium LT2
ccuccugauaaccuauuuugcaa

SEQ ID NO: 3755107 - RNA, 12 nt, Salmonella typhimurium LT2
ccuccugauauc

SEQ ID NO: 3755108 - RNA, 13 nt, Salmonella typhimurium LT2
ccucgaaugcugg

SEQ ID NO: 3755109 - RNA, 13 nt, Salmonella typhimurium LT2
ccucgaccccuuc

SEQ ID NO: 3755110 - RNA, 20 nt, Salmonella typhimurium LT2
ccucgacuaaaggcagcgcg

SEQ ID NO: 3755111 - RNA, 22 nt, Salmonella typhimurium LT2
ccucgacuaaaggcagcgcgcu

SEQ ID NO: 3755112 - RNA, 20 nt, Salmonella typhimurium LT2
ccucgauggcauuguccuuu

SEQ ID NO: 3755113 - RNA, 12 nt, Salmonella typhimurium LT2
ccucgcagacug

SEQ ID NO: 3755114 - RNA, 13 nt, Salmonella typhimurium LT2
ccucgccauugau

SEQ ID NO: 3755115 - RNA, 13 nt, Salmonella typhimurium LT2
ccucgcccgcgau

SEQ ID NO: 3755116 - RNA, 15 nt, Salmonella typhimurium LT2
ccucgcuaaugcccg

SEQ ID NO: 3755117 - RNA, 21 nt, Salmonella typhimurium LT2
ccucgcucaccggccccggaa

SEQ ID NO: 3755118 - RNA, 19 nt, Salmonella typhimurium LT2
ccucgcugacgccagccag

SEQ ID NO: 3755119 - RNA, 13 nt, Salmonella typhimurium LT2
ccucggcgacguc

SEQ ID NO: 3755120 - RNA, 17 nt, Salmonella typhimurium LT2
ccucggucgagcuuuug

SEQ ID NO: 3755121 - RNA, 20 nt, Salmonella typhimurium LT2
ccucggucgagcuuuugcug

SEQ ID NO: 3755122 - RNA, 21 nt, Salmonella typhimurium LT2
ccucgguggccuuguagcgcu

SEQ ID NO: 3755123 - RNA, 17 nt, Salmonella typhimurium LT2
ccucgguggcgguccaa

SEQ ID NO: 3755124 - RNA, 16 nt, Salmonella typhimurium LT2
ccucguccagaugggc

SEQ ID NO: 3755125 - RNA, 17 nt, Salmonella typhimurium LT2
ccucguccugauccggc

SEQ ID NO: 3755126 - RNA, 22 nt, Salmonella typhimurium LT2
ccucguguaccauuguuuacuu

SEQ ID NO: 3755127 - RNA, 19 nt, Salmonella typhimurium LT2
ccucguucggcgcaccugu

SEQ ID NO: 3755128 - RNA, 23 nt, Salmonella typhimurium LT2
ccucguuugcugagcagccagcc

SEQ ID NO: 3755129 - RNA, 13 nt, Salmonella typhimurium LT2
ccucuaaauguug

SEQ ID NO: 3755130 - RNA, 22 nt, Salmonella typhimurium LT2
ccucuaaauguuggauugcauc

SEQ ID NO: 3755131 - RNA, 22 nt, Salmonella typhimurium LT2
ccucuauaguaaauugacgcuu

SEQ ID NO: 3755132 - RNA, 20 nt, Salmonella typhimurium LT2
ccucuauccggaggccuucu

SEQ ID NO: 3755133 - RNA, 23 nt, Salmonella typhimurium LT2
ccucucaccgugguuaccgccag

SEQ ID NO: 3755134 - RNA, 12 nt, Salmonella typhimurium LT2
ccucucacugga

SEQ ID NO: 3755135 - RNA, 22 nt, Salmonella typhimurium LT2
ccucucccgaacugucugaauc

SEQ ID NO: 3755136 - RNA, 12 nt, Salmonella typhimurium LT2
ccucucgccaaa

SEQ ID NO: 3755137 - RNA, 14 nt, Salmonella typhimurium LT2
ccucucuuccuccu

SEQ ID NO: 3755138 - RNA, 21 nt, Salmonella typhimurium LT2
ccucugagaacuauuugccug

SEQ ID NO: 3755139 - RNA, 23 nt, Salmonella typhimurium LT2
ccucugccguagcguacuuucaa

SEQ ID NO: 3755140 - RNA, 19 nt, Salmonella typhimurium LT2
ccucugcgggcuccggacg

SEQ ID NO: 3755141 - RNA, 11 nt, Salmonella typhimurium LT2
ccucugcugcg

SEQ ID NO: 3755142 - RNA, 14 nt, Salmonella typhimurium LT2
ccugccgccuccag

SEQ ID NO: 3755143 - RNA, 17 nt, Salmonella typhimurium LT2
ccugccgcgaucgcggc

SEQ ID NO: 3755144 - RNA, 22 nt, Salmonella typhimurium LT2
ccugccgcgcccaguuucuuca

SEQ ID NO: 3755145 - RNA, 15 nt, Salmonella typhimurium LT2
ccugccgcgccgccg

SEQ ID NO: 3755146 - RNA, 17 nt, Salmonella typhimurium LT2
ccugccggaaaaugcgc

SEQ ID NO: 3755147 - RNA, 15 nt, Salmonella typhimurium LT2
ccugccggguuuaau

SEQ ID NO: 3755148 - RNA, 21 nt, Salmonella typhimurium LT2
ccugccguaccguugccgccg

SEQ ID NO: 3755149 - RNA, 23 nt, Salmonella typhimurium LT2
ccugccgucaaacuuaaugccug

SEQ ID NO: 3755150 - RNA, 15 nt, Salmonella typhimurium LT2
ccugccguuuuuaac

SEQ ID NO: 3755151 - RNA, 23 nt, Salmonella typhimurium LT2
ccugccugaagcgcaguguuaau

SEQ ID NO: 3755152 - RNA, 15 nt, Salmonella typhimurium LT2
ccugccugaucgcca

SEQ ID NO: 3755153 - RNA, 10 nt, Salmonella typhimurium LT2
ccugccuguu

SEQ ID NO: 3755154 - RNA, 21 nt, Salmonella typhimurium LT2
ccugcgaaaagcgugcgccuu

SEQ ID NO: 3755155 - RNA, 21 nt, Salmonella typhimurium LT2
ccugcgaagaugagccacacg

SEQ ID NO: 3755156 - RNA, 19 nt, Salmonella typhimurium LT2
ccugcgacuuuuccaccac

SEQ ID NO: 3755157 - RNA, 21 nt, Salmonella typhimurium LT2
ccugcgccagcaccauggcua

SEQ ID NO: 3755158 - RNA, 23 nt, Salmonella typhimurium LT2
ccugcgccaguucauccagcagc

SEQ ID NO: 3755159 - RNA, 17 nt, Salmonella typhimurium LT2
ccugcgccuuaaaaaga

SEQ ID NO: 3755160 - RNA, 14 nt, Salmonella typhimurium LT2
ccugcgccuugacg

SEQ ID NO: 3755161 - RNA, 23 nt, Salmonella typhimurium LT2
ccugcgcgacgcccaccaguccc

SEQ ID NO: 3755162 - RNA, 14 nt, Salmonella typhimurium LT2
ccugcgcgccugac

SEQ ID NO: 3755163 - RNA, 22 nt, Salmonella typhimurium LT2
ccugcgcguucggguuuuccug

SEQ ID NO: 3755164 - RNA, 13 nt, Salmonella typhimurium LT2
ccugcgcuaacga

SEQ ID NO: 3755165 - RNA, 14 nt, Salmonella typhimurium LT2
ccugcgcugacggc

SEQ ID NO: 3755166 - RNA, 20 nt, Salmonella typhimurium LT2
ccugcgcugucaccagcagc

SEQ ID NO: 3755167 - RNA, 15 nt, Salmonella typhimurium LT2
ccugcgcuuugacau

SEQ ID NO: 3755168 - RNA, 19 nt, Salmonella typhimurium LT2
ccugcggacgcagcucaua

SEQ ID NO: 3755169 - RNA, 21 nt, Salmonella typhimurium LT2
ccugcggauuuuucgccagua

SEQ ID NO: 3755170 - RNA, 20 nt, Salmonella typhimurium LT2
ccugcggccaugaucgccgc

SEQ ID NO: 3755171 - RNA, 23 nt, Salmonella typhimurium LT2
ccugcggccaugaucgccgccau

SEQ ID NO: 3755172 - RNA, 17 nt, Salmonella typhimurium LT2
ccugcggcgcgcccggc

SEQ ID NO: 3755173 - RNA, 16 nt, Salmonella typhimurium LT2
ccugcggcguggaaaa

SEQ ID NO: 3755174 - RNA, 14 nt, Salmonella typhimurium LT2
ccugcgggagcugu

SEQ ID NO: 3755175 - RNA, 17 nt, Salmonella typhimurium LT2
ccugcgguaaucgccgc

SEQ ID NO: 3755176 - RNA, 20 nt, Salmonella typhimurium LT2
ccugcgguaaucgccgcgac

SEQ ID NO: 3755177 - RNA, 18 nt, Salmonella typhimurium LT2
ccugcgguacggccagcg

SEQ ID NO: 3755178 - RNA, 14 nt, Salmonella typhimurium LT2
ccugcgucacagac

SEQ ID NO: 3755179 - RNA, 20 nt, Salmonella typhimurium LT2
ccugcgucauccccaggcug

SEQ ID NO: 3755180 - RNA, 18 nt, Salmonella typhimurium LT2
ccugcgucgcuucgccaa

SEQ ID NO: 3755181 - RNA, 18 nt, Salmonella typhimurium LT2
ccugcguuaaacgcugug

SEQ ID NO: 3755182 - RNA, 17 nt, Salmonella typhimurium LT2
ccugcucaggcugaccg

SEQ ID NO: 3755183 - RNA, 12 nt, Salmonella typhimurium LT2
ccugcuccacca

SEQ ID NO: 3755184 - RNA, 14 nt, Salmonella typhimurium LT2
ccugcuccaccagc

SEQ ID NO: 3755185 - RNA, 15 nt, Salmonella typhimurium LT2
ccugcucccacagcu

SEQ ID NO: 3755186 - RNA, 14 nt, Salmonella typhimurium LT2
ccugcuccgggcgg

SEQ ID NO: 3755187 - RNA, 21 nt, Salmonella typhimurium LT2
ccugcugacuacgguugccuu

SEQ ID NO: 3755188 - RNA, 20 nt, Salmonella typhimurium LT2
ccugcugcaacgucgcgccc

SEQ ID NO: 3755189 - RNA, 19 nt, Salmonella typhimurium LT2
ccugcugcagacugccggc

SEQ ID NO: 3755190 - RNA, 18 nt, Salmonella typhimurium LT2
ccugcugccaucgcuucu

SEQ ID NO: 3755191 - RNA, 12 nt, Salmonella typhimurium LT2
ccugcugcggua

SEQ ID NO: 3755192 - RNA, 22 nt, Salmonella typhimurium LT2
ccugcuguugcggaauacacga

SEQ ID NO: 3755193 - RNA, 22 nt, Salmonella typhimurium LT2
ccugcuucagacaacgccgccu

SEQ ID NO: 3755194 - RNA, 20 nt, Salmonella typhimurium LT2
ccugcuuggccugaagcugc

SEQ ID NO: 3755195 - RNA, 18 nt, Salmonella typhimurium LT2
ccugcuugucgaucauca

SEQ ID NO: 3755196 - RNA, 17 nt, Salmonella typhimurium LT2
ccuggaaaaaagcgccc

SEQ ID NO: 3755197 - RNA, 16 nt, Salmonella typhimurium LT2
ccuggaagacuucacg

SEQ ID NO: 3755198 - RNA, 23 nt, Salmonella typhimurium LT2
ccuggaaguugaagaaaaacccc

SEQ ID NO: 3755199 - RNA, 22 nt, Salmonella typhimurium LT2
ccuggaauagcgugggcagacc

SEQ ID NO: 3755200 - RNA, 20 nt, Salmonella typhimurium LT2
ccuggaauuaaucacaaugu

SEQ ID NO: 3755201 - RNA, 20 nt, Salmonella typhimurium LT2
ccuggacccacaagcccgga

SEQ ID NO: 3755202 - RNA, 14 nt, Salmonella typhimurium LT2
ccuggacgcgagcc

SEQ ID NO: 3755203 - RNA, 16 nt, Salmonella typhimurium LT2
ccuggagagcagcgcc

SEQ ID NO: 3755204 - RNA, 18 nt, Salmonella typhimurium LT2
ccuggagagcagcgccag

SEQ ID NO: 3755205 - RNA, 14 nt, Salmonella typhimurium LT2
ccuggagaucagca

SEQ ID NO: 3755206 - RNA, 18 nt, Salmonella typhimurium LT2
ccuggagaucagcauggu

SEQ ID NO: 3755207 - RNA, 17 nt, Salmonella typhimurium LT2
ccuggagcguaagcgcg

SEQ ID NO: 3755208 - RNA, 24 nt, Salmonella typhimurium LT2
ccuggagugacuaaaagacgccau

SEQ ID NO: 3755209 - RNA, 16 nt, Salmonella typhimurium LT2
ccuggauaaaucgccc

SEQ ID NO: 3755210 - RNA, 23 nt, Salmonella typhimurium LT2
ccuggauacguuccagcagcgca

SEQ ID NO: 3755211 - RNA, 19 nt, Salmonella typhimurium LT2
ccuggaugcuuaaaauccc

SEQ ID NO: 3755212 - RNA, 11 nt, Salmonella typhimurium LT2
ccuggcaaagc

SEQ ID NO: 3755213 - RNA, 13 nt, Salmonella typhimurium LT2
ccuggcaagaccc

SEQ ID NO: 3755214 - RNA, 16 nt, Salmonella typhimurium LT2
ccuggcagccgcguug

SEQ ID NO: 3755215 - RNA, 20 nt, Salmonella typhimurium LT2
ccuggcaguucccuacucuc

SEQ ID NO: 3755216 - RNA, 12 nt, Salmonella typhimurium LT2
ccuggccggaaa

SEQ ID NO: 3755217 - RNA, 21 nt, Salmonella typhimurium LT2
ccuggccgguaaauuucacuu

SEQ ID NO: 3755218 - RNA, 14 nt, Salmonella typhimurium LT2
ccuggcgaauaaaa

SEQ ID NO: 3755219 - RNA, 19 nt, Salmonella typhimurium LT2
ccuggcgaauaaaauucag

SEQ ID NO: 3755220 - RNA, 19 nt, Salmonella typhimurium LT2
ccuggcgaucaucgcaggc

SEQ ID NO: 3755221 - RNA, 12 nt, Salmonella typhimurium LT2
ccuggcggauac

SEQ ID NO: 3755222 - RNA, 21 nt, Salmonella typhimurium LT2
ccuggcguaguacgcgcgccg

SEQ ID NO: 3755223 - RNA, 16 nt, Salmonella typhimurium LT2
ccuggcguaugcuuuc

SEQ ID NO: 3755224 - RNA, 20 nt, Salmonella typhimurium LT2
ccuggcguaugcuuucagca

SEQ ID NO: 3755225 - RNA, 14 nt, Salmonella typhimurium LT2
ccuggcuaucccga

SEQ ID NO: 3755226 - RNA, 20 nt, Salmonella typhimurium LT2
ccuggcugaaagcaaccaga

SEQ ID NO: 3755227 - RNA, 20 nt, Salmonella typhimurium LT2
ccuggcugucggcagaaccu

SEQ ID NO: 3755228 - RNA, 19 nt, Salmonella typhimurium LT2
ccuggcuucaaccuccugc

SEQ ID NO: 3755229 - RNA, 20 nt, Salmonella typhimurium LT2
ccuggcuucaaccuccugca

SEQ ID NO: 3755230 - RNA, 17 nt, Salmonella typhimurium LT2
ccugggccgccacgacc

SEQ ID NO: 3755231 - RNA, 21 nt, Salmonella typhimurium LT2
ccugggccgccacgaccugca

SEQ ID NO: 3755232 - RNA, 20 nt, Salmonella typhimurium LT2
ccugggucagcgucaucggc

SEQ ID NO: 3755233 - RNA, 14 nt, Salmonella typhimurium LT2
ccugguacaucgcg

SEQ ID NO: 3755234 - RNA, 22 nt, Salmonella typhimurium LT2
ccugguccggaauagagauaga

SEQ ID NO: 3755235 - RNA, 20 nt, Salmonella typhimurium LT2
ccuggucuauucguucucug

SEQ ID NO: 3755236 - RNA, 20 nt, Salmonella typhimurium LT2
ccuggugcgggucaaaagcg

SEQ ID NO: 3755237 - RNA, 20 nt, Salmonella typhimurium LT2
ccuggugggguucccgagcg

SEQ ID NO: 3755238 - RNA, 17 nt, Salmonella typhimurium LT2
ccuguaaaccgccucca

SEQ ID NO: 3755239 - RNA, 16 nt, Salmonella typhimurium LT2
ccuguaacaacuguuu

SEQ ID NO: 3755240 - RNA, 13 nt, Salmonella typhimurium LT2
ccuguaacagggg

SEQ ID NO: 3755241 - RNA, 19 nt, Salmonella typhimurium LT2
ccuguaaccuuaaaaggcg

SEQ ID NO: 3755242 - RNA, 20 nt, Salmonella typhimurium LT2
ccuguaaccuuaaaaggcgc

SEQ ID NO: 3755243 - RNA, 15 nt, Salmonella typhimurium LT2
ccuguaaugccgccu

SEQ ID NO: 3755244 - RNA, 15 nt, Salmonella typhimurium LT2
ccuguaccaccacgc

SEQ ID NO: 3755245 - RNA, 12 nt, Salmonella typhimurium LT2
ccuucuucaucu

SEQ ID NO: 3755246 - RNA, 17 nt, Salmonella typhimurium LT2
ccuucuucgccgucaua

SEQ ID NO: 3755247 - RNA, 18 nt, Salmonella typhimurium LT2
ccuucuugcucaaaaagc

SEQ ID NO: 3755248 - RNA, 21 nt, Salmonella typhimurium LT2
ccuucuuuauucacuuuuucu

SEQ ID NO: 3755249 - RNA, 20 nt, Salmonella typhimurium LT2
ccuugacaggaaacagguac

SEQ ID NO: 3755250 - RNA, 20 nt, Salmonella typhimurium LT2
ccuugagcgccuggacccac

SEQ ID NO: 3755251 - RNA, 22 nt, Salmonella typhimurium LT2
ccuugaucaggaaaucuuccag

SEQ ID NO: 3755252 - RNA, 14 nt, Salmonella typhimurium LT2
ccuugcaaaccggg

SEQ ID NO: 3755253 - RNA, 18 nt, Salmonella typhimurium LT2
ccuugccagugaaaaaaa

SEQ ID NO: 3755254 - RNA, 20 nt, Salmonella typhimurium LT2
ccuugcccguauugaagcga

SEQ ID NO: 3755255 - RNA, 19 nt, Salmonella typhimurium LT2
ccuugccgccgcgaugcau

SEQ ID NO: 3755256 - RNA, 16 nt, Salmonella typhimurium LT2
ccuugcgaagaccgca

SEQ ID NO: 3755257 - RNA, 16 nt, Salmonella typhimurium LT2
ccuugcgguugcagca

SEQ ID NO: 3755258 - RNA, 17 nt, Salmonella typhimurium LT2
ccuugcuuaacagaauu

SEQ ID NO: 3755259 - RNA, 23 nt, Salmonella typhimurium LT2
ccuuguaacgggugaucuuuaua

SEQ ID NO: 3755260 - RNA, 12 nt, Salmonella typhimurium LT2
ccuuguaucauu

SEQ ID NO: 3755261 - RNA, 22 nt, Salmonella typhimurium LT2
ccuuguccauguaaacuccauu

SEQ ID NO: 3755262 - RNA, 13 nt, Salmonella typhimurium LT2
ccuugucguaaua

SEQ ID NO: 3755263 - RNA, 14 nt, Salmonella typhimurium LT2
ccuuguugcggaug

SEQ ID NO: 3755264 - RNA, 19 nt, Salmonella typhimurium LT2
ccuuuaaccucuuuuucau

SEQ ID NO: 3755265 - RNA, 12 nt, Salmonella typhimurium LT2
ccuuuaagcuga

SEQ ID NO: 3755266 - RNA, 12 nt, Salmonella typhimurium LT2
ccuuuacaaucg

SEQ ID NO: 3755267 - RNA, 18 nt, Salmonella typhimurium LT2
ccuuuacaugaaaaauag

SEQ ID NO: 3755268 - RNA, 16 nt, Salmonella typhimurium LT2
ccuuuacccaccagcc

SEQ ID NO: 3755269 - RNA, 14 nt, Salmonella typhimurium LT2
ccuuuacgcugccu

SEQ ID NO: 3755270 - RNA, 20 nt, Salmonella typhimurium LT2
ccuuuacuauagauauuaaa

SEQ ID NO: 3755271 - RNA, 18 nt, Salmonella typhimurium LT2
ccuuuacugacaauaagu

SEQ ID NO: 3755272 - RNA, 14 nt, Salmonella typhimurium LT2
ccuuuaucugcccu

SEQ ID NO: 3755273 - RNA, 20 nt, Salmonella typhimurium LT2
ccuuuaucuugaccugacug

SEQ ID NO: 3755274 - RNA, 23 nt, Salmonella typhimurium LT2
ccuuucaccagaaugagcggaac

SEQ ID NO: 3755275 - RNA, 13 nt, Salmonella typhimurium LT2
ccuuucacgccga

SEQ ID NO: 3755276 - RNA, 16 nt, Salmonella typhimurium LT2
ccuuucagacuucaau

SEQ ID NO: 3755277 - RNA, 16 nt, Salmonella typhimurium LT2
ccuuucgcaaauggca

SEQ ID NO: 3755278 - RNA, 21 nt, Salmonella typhimurium LT2
ccuuucguaguuggcaacccg

SEQ ID NO: 3755279 - RNA, 19 nt, Salmonella typhimurium LT2
ccuuucgugcacuucaugc

SEQ ID NO: 3755280 - RNA, 21 nt, Salmonella typhimurium LT2
ccuuucucugguuucccugcc

SEQ ID NO: 3755281 - RNA, 15 nt, Salmonella typhimurium LT2
ccuuucuguucuuug

SEQ ID NO: 3755282 - RNA, 16 nt, Salmonella typhimurium LT2
ccuuucuuauuuuuuu

SEQ ID NO: 3755283 - RNA, 14 nt, Salmonella typhimurium LT2
ccuuugagaaagcu

SEQ ID NO: 3755284 - RNA, 15 nt, Salmonella typhimurium LT2
ccuuugccuucgccg

SEQ ID NO: 3755285 - RNA, 21 nt, Salmonella typhimurium LT2
ccuuugcgcgcgauauccacc

SEQ ID NO: 3755286 - RNA, 23 nt, Salmonella typhimurium LT2
ccuuuggaggagagcgucaugaa

SEQ ID NO: 3755287 - RNA, 14 nt, Salmonella typhimurium LT2
ccuuuggccaccag

SEQ ID NO: 3755288 - RNA, 13 nt, Salmonella typhimurium LT2
ccuuugucaucca

SEQ ID NO: 3755289 - RNA, 23 nt, Salmonella typhimurium LT2
ccuuugucgaaauugccgcccgu

SEQ ID NO: 3755290 - RNA, 16 nt, Salmonella typhimurium LT2
ccuuuuaauuuucugu

SEQ ID NO: 3755291 - RNA, 16 nt, Salmonella typhimurium LT2
ccuuuuagcacuuuaa

SEQ ID NO: 3755292 - RNA, 22 nt, Salmonella typhimurium LT2
ccuuuuagcgcguuaccgcuca

SEQ ID NO: 3755293 - RNA, 16 nt, Salmonella typhimurium LT2
ccuuuuccucuucuug

SEQ ID NO: 3755294 - RNA, 23 nt, Salmonella typhimurium LT2
ccuuuucgcagcaauucugcugg

SEQ ID NO: 3755295 - RNA, 16 nt, Salmonella typhimurium LT2
ccuuuucguacauguc

SEQ ID NO: 3755296 - RNA, 14 nt, Salmonella typhimurium LT2
ccuuuugacgcuuc

SEQ ID NO: 3755297 - RNA, 19 nt, Salmonella typhimurium LT2
ccuuuuuauggcccgccag

SEQ ID NO: 3755298 - RNA, 13 nt, Salmonella typhimurium LT2
ccuuuuucaauuu

SEQ ID NO: 3755299 - RNA, 20 nt, Salmonella typhimurium LT2
ccuuuuucaauuuccaguuu

SEQ ID NO: 3755300 - RNA, 19 nt, Salmonella typhimurium LT2
ccuuuuucauccucaacca

SEQ ID NO: 3755301 - RNA, 19 nt, Salmonella typhimurium LT2
ccuuuuugaccgucaucca

SEQ ID NO: 3755302 - RNA, 15 nt, Salmonella typhimurium LT2
ccuuuuugcagcgcg

SEQ ID NO: 3755303 - RNA, 19 nt, Salmonella typhimurium LT2
ccuuuuugcauucgcuccu

SEQ ID NO: 3755304 - RNA, 17 nt, Salmonella typhimurium LT2
ccuuuuuuauugccuga

SEQ ID NO: 3755305 - RNA, 22 nt, Salmonella typhimurium LT2
ccuuuuuucaccggcacccagu

SEQ ID NO: 3755306 - RNA, 22 nt, Salmonella typhimurium LT2
ccuuuuuugguuauccagcagc

SEQ ID NO: 3755307 - RNA, 23 nt, Salmonella typhimurium LT2
ccuuuuuugguuauccagcagcc

SEQ ID NO: 3755308 - RNA, 13 nt, Salmonella typhimurium LT2
ccuuuuuuguauu

SEQ ID NO: 3755309 - RNA, 13 nt, Salmonella typhimurium LT2
ccuuuuuugugaa

SEQ ID NO: 3755310 - RNA, 17 nt, Salmonella typhimurium LT2
ccuuuuuugugaauauc

SEQ ID NO: 3755311 - RNA, 13 nt, Salmonella typhimurium LT2
cgaaaaaaagaug

SEQ ID NO: 3755312 - RNA, 22 nt, Salmonella typhimurium LT2
cgaaaacguugacuuaaaaagc

SEQ ID NO: 3755313 - RNA, 15 nt, Salmonella typhimurium LT2
cgaaaauagccugaa

SEQ ID NO: 3755314 - RNA, 19 nt, Salmonella typhimurium LT2
cgaaacacgaauaauucuc

SEQ ID NO: 3755315 - RNA, 14 nt, Salmonella typhimurium LT2
cgaaacaggcggca

SEQ ID NO: 3755316 - RNA, 16 nt, Salmonella typhimurium LT2
cgaaacaggcggcaga

SEQ ID NO: 3755317 - RNA, 17 nt, Salmonella typhimurium LT2
cgaaacagggcaaggau

SEQ ID NO: 3755318 - RNA, 13 nt, Salmonella typhimurium LT2
cgaaacccaaaua

SEQ ID NO: 3755319 - RNA, 16 nt, Salmonella typhimurium LT2
cgaaacccaaauaacc

SEQ ID NO: 3755320 - RNA, 15 nt, Salmonella typhimurium LT2
cgaaaccgauuuucu

SEQ ID NO: 3755321 - RNA, 20 nt, Salmonella typhimurium LT2
cgaaaccggcggcgacuggc

SEQ ID NO: 3755322 - RNA, 19 nt, Salmonella typhimurium LT2
cgaaacgcauacgcagcac

SEQ ID NO: 3755323 - RNA, 21 nt, Salmonella typhimurium LT2
cgaaacgccuuauccggccua

SEQ ID NO: 3755324 - RNA, 23 nt, Salmonella typhimurium LT2
cgaaacgcgcgcgaauauguucu

SEQ ID NO: 3755325 - RNA, 12 nt, Salmonella typhimurium LT2
cgaaacugccua

SEQ ID NO: 3755326 - RNA, 22 nt, Salmonella typhimurium LT2
cgaaagcguaucacccugccaa

SEQ ID NO: 3755327 - RNA, 13 nt, Salmonella typhimurium LT2
cgaaauaaucagg

SEQ ID NO: 3755328 - RNA, 16 nt, Salmonella typhimurium LT2
cgaaaucaucaauggc

SEQ ID NO: 3755329 - RNA, 15 nt, Salmonella typhimurium LT2
cgaaauccaccagcg

SEQ ID NO: 3755330 - RNA, 23 nt, Salmonella typhimurium LT2
cgaaaucucgcuaaucaucagcg

SEQ ID NO: 3755331 - RNA, 15 nt, Salmonella typhimurium LT2
cgaaaugaccaccgc

SEQ ID NO: 3755332 - RNA, 22 nt, Salmonella typhimurium LT2
cgaaaugaccaccgcaucggca

SEQ ID NO: 3755333 - RNA, 17 nt, Salmonella typhimurium LT2
cgaaauggccauccauu

SEQ ID NO: 3755334 - RNA, 18 nt, Salmonella typhimurium LT2
cgaaauuaacgacauuuu

SEQ ID NO: 3755335 - RNA, 14 nt, Salmonella typhimurium LT2
cgaaauugccgccc

SEQ ID NO: 3755336 - RNA, 18 nt, Salmonella typhimurium LT2
cgaaauuuauucaucgau

SEQ ID NO: 3755337 - RNA, 21 nt, Salmonella typhimurium LT2
cgaacagaaaaaaugcaccgc

SEQ ID NO: 3755338 - RNA, 11 nt, Salmonella typhimurium LT2
cgaacaggcgu

SEQ ID NO: 3755339 - RNA, 19 nt, Salmonella typhimurium LT2
cgaacaggcucagcgccac

SEQ ID NO: 3755340 - RNA, 20 nt, Salmonella typhimurium LT2
cgaacagguuauuguugcua

SEQ ID NO: 3755341 - RNA, 19 nt, Salmonella typhimurium LT2
cgaacaguguaaacgccag

SEQ ID NO: 3755342 - RNA, 22 nt, Salmonella typhimurium LT2
cgaacauccuugcacgccaaaa

SEQ ID NO: 3755343 - RNA, 11 nt, Salmonella typhimurium LT2
cgaacaucugc

SEQ ID NO: 3755344 - RNA, 12 nt, Salmonella typhimurium LT2
cgaacauuggaa

SEQ ID NO: 3755345 - RNA, 13 nt, Salmonella typhimurium LT2
cgaacauuucagc

SEQ ID NO: 3755346 - RNA, 17 nt, Salmonella typhimurium LT2
cgaacauuucagcgcca

SEQ ID NO: 3755347 - RNA, 15 nt, Salmonella typhimurium LT2
cgaaccacggcuuca

SEQ ID NO: 3755348 - RNA, 21 nt, Salmonella typhimurium LT2
cgaaccacggcuucagcggcg

SEQ ID NO: 3755349 - RNA, 14 nt, Salmonella typhimurium LT2
cgacaucacgcaaa

SEQ ID NO: 3755350 - RNA, 12 nt, Salmonella typhimurium LT2
cgacaucagaug

SEQ ID NO: 3755351 - RNA, 14 nt, Salmonella typhimurium LT2
cgacaucagccagc

SEQ ID NO: 3755352 - RNA, 17 nt, Salmonella typhimurium LT2
cgacaucagccagccgc

SEQ ID NO: 3755353 - RNA, 19 nt, Salmonella typhimurium LT2
cgacaucagccagccgcca

SEQ ID NO: 3755354 - RNA, 12 nt, Salmonella typhimurium LT2
cgacauccgcca

SEQ ID NO: 3755355 - RNA, 15 nt, Salmonella typhimurium LT2
cgacaucgccaccgc

SEQ ID NO: 3755356 - RNA, 16 nt, Salmonella typhimurium LT2
cgacaucgcuuccgua

SEQ ID NO: 3755357 - RNA, 17 nt, Salmonella typhimurium LT2
cgacaucuuuuccugaa

SEQ ID NO: 3755358 - RNA, 16 nt, Salmonella typhimurium LT2
cgacauggcugagaau

SEQ ID NO: 3755359 - RNA, 19 nt, Salmonella typhimurium LT2
cgacaugguuuccagcgaa

SEQ ID NO: 3755360 - RNA, 21 nt, Salmonella typhimurium LT2
cgacauuaacgaugccuuaug

SEQ ID NO: 3755361 - RNA, 19 nt, Salmonella typhimurium LT2
cgaccaaacaagaucgccg

SEQ ID NO: 3755362 - RNA, 17 nt, Salmonella typhimurium LT2
cgaccaacagcaucaca

SEQ ID NO: 3755363 - RNA, 12 nt, Salmonella typhimurium LT2
cgaccaccagcu

SEQ ID NO: 3755364 - RNA, 15 nt, Salmonella typhimurium LT2
cgaccacuagcgccg

SEQ ID NO: 3755365 - RNA, 21 nt, Salmonella typhimurium LT2
cgaccacuucaacgccgcgcu

SEQ ID NO: 3755366 - RNA, 22 nt, Salmonella typhimurium LT2
cgaccacuucaacgccgcgcuu

SEQ ID NO: 3755367 - RNA, 19 nt, Salmonella typhimurium LT2
cgaccagaaucaucauguc

SEQ ID NO: 3755368 - RNA, 18 nt, Salmonella typhimurium LT2
cgaccagagauaccuuug

SEQ ID NO: 3755369 - RNA, 23 nt, Salmonella typhimurium LT2
cgaccagcaaaaagaaucgccag

SEQ ID NO: 3755370 - RNA, 13 nt, Salmonella typhimurium LT2
cgaccagccugcc

SEQ ID NO: 3755371 - RNA, 17 nt, Salmonella typhimurium LT2
cgaccagcgcaccaaag

SEQ ID NO: 3755372 - RNA, 16 nt, Salmonella typhimurium LT2
cgaccaggaucagacc

SEQ ID NO: 3755373 - RNA, 19 nt, Salmonella typhimurium LT2
cgaccagguaauggacgca

SEQ ID NO: 3755374 - RNA, 21 nt, Salmonella typhimurium LT2
cgaccagugcaacagagagca

SEQ ID NO: 3755375 - RNA, 19 nt, Salmonella typhimurium LT2
cgaccaguuauucggcaua

SEQ ID NO: 3755376 - RNA, 13 nt, Salmonella typhimurium LT2
cgaccauucuuuc

SEQ ID NO: 3755377 - RNA, 18 nt, Salmonella typhimurium LT2
cgaccccaauagcgaucg

SEQ ID NO: 3755378 - RNA, 18 nt, Salmonella typhimurium LT2
cgacccccaccaugucaa

SEQ ID NO: 3755379 - RNA, 22 nt, Salmonella typhimurium LT2
cgaccgcgauaaccaucaguuc

SEQ ID NO: 3755380 - RNA, 17 nt, Salmonella typhimurium LT2
cgaccgcucggaagugc

SEQ ID NO: 3755381 - RNA, 21 nt, Salmonella typhimurium LT2
cgaccggauuggucugauuca

SEQ ID NO: 3755382 - RNA, 18 nt, Salmonella typhimurium LT2
cgaccggcacgguuaaug

SEQ ID NO: 3755383 - RNA, 20 nt, Salmonella typhimurium LT2
cgaccggcacucaccucuuc

SEQ ID NO: 3755384 - RNA, 11 nt, Salmonella typhimurium LT2
cgaccggcagc

SEQ ID NO: 3755385 - RNA, 11 nt, Salmonella typhimurium LT2
cgaccggcucg

SEQ ID NO: 3755386 - RNA, 19 nt, Salmonella typhimurium LT2
cgaccggcucgcuguucgc

SEQ ID NO: 3755387 - RNA, 22 nt, Salmonella typhimurium LT2
cgaccggcucgcuguucgccag

SEQ ID NO: 3755388 - RNA, 22 nt, Salmonella typhimurium LT2
cgaccguauccgccaccaugau

SEQ ID NO: 3755389 - RNA, 21 nt, Salmonella typhimurium LT2
cgaccgucgggccauucccca

SEQ ID NO: 3755390 - RNA, 14 nt, Salmonella typhimurium LT2
cgaccguuuccgcc

SEQ ID NO: 3755391 - RNA, 16 nt, Salmonella typhimurium LT2
cgaccuggugcucaau

SEQ ID NO: 3755392 - RNA, 16 nt, Salmonella typhimurium LT2
cgaccugguggcgaac

SEQ ID NO: 3755393 - RNA, 14 nt, Salmonella typhimurium LT2
cgaccuucacgccg

SEQ ID NO: 3755394 - RNA, 14 nt, Salmonella typhimurium LT2
cgacgaccgccaga

SEQ ID NO: 3755395 - RNA, 13 nt, Salmonella typhimurium LT2
cgacgacuucacc

SEQ ID NO: 3755396 - RNA, 15 nt, Salmonella typhimurium LT2
cgacgaucagcgcca

SEQ ID NO: 3755397 - RNA, 14 nt, Salmonella typhimurium LT2
cgacgcacuccaga

SEQ ID NO: 3755398 - RNA, 17 nt, Salmonella typhimurium LT2
cgacgcauuucuccuga

SEQ ID NO: 3755399 - RNA, 19 nt, Salmonella typhimurium LT2
cgacgccaaacccgccaca

SEQ ID NO: 3755400 - RNA, 13 nt, Salmonella typhimurium LT2
cgacgccaaccgc

SEQ ID NO: 3755401 - RNA, 13 nt, Salmonella typhimurium LT2
cgacgccaggcgg

SEQ ID NO: 3755402 - RNA, 15 nt, Salmonella typhimurium LT2
cgacgcccaauccgg

SEQ ID NO: 3755403 - RNA, 14 nt, Salmonella typhimurium LT2
cgacgcccaccagu

SEQ ID NO: 3755404 - RNA, 13 nt, Salmonella typhimurium LT2
cgacgcccgcuug

SEQ ID NO: 3755405 - RNA, 16 nt, Salmonella typhimurium LT2
cgacgccgauaaagcc

SEQ ID NO: 3755406 - RNA, 18 nt, Salmonella typhimurium LT2
cgacgccgucucuuuuug

SEQ ID NO: 3755407 - RNA, 17 nt, Salmonella typhimurium LT2
cgacgccguuuccggug

SEQ ID NO: 3755408 - RNA, 19 nt, Salmonella typhimurium LT2
cgacgcgccacuuccagcg

SEQ ID NO: 3755409 - RNA, 14 nt, Salmonella typhimurium LT2
cgacgcgcugcggu

SEQ ID NO: 3755410 - RNA, 17 nt, Salmonella typhimurium LT2
cgacgcggcuccggcuu

SEQ ID NO: 3755411 - RNA, 17 nt, Salmonella typhimurium LT2
cgacgcguggcaucuua

SEQ ID NO: 3755412 - RNA, 12 nt, Salmonella typhimurium LT2
cgacgcucauua

SEQ ID NO: 3755413 - RNA, 13 nt, Salmonella typhimurium LT2
cgacgcugccaca

SEQ ID NO: 3755414 - RNA, 13 nt, Salmonella typhimurium LT2
cgacgcugucaau

SEQ ID NO: 3755415 - RNA, 23 nt, Salmonella typhimurium LT2
cgacggagauuaacagcgcgacc

SEQ ID NO: 3755416 - RNA, 15 nt, Salmonella typhimurium LT2
cgacggcaggcggca

SEQ ID NO: 3755417 - RNA, 17 nt, Salmonella typhimurium LT2
cgacggcaggcggcaau

SEQ ID NO: 3755418 - RNA, 18 nt, Salmonella typhimurium LT2
cgacggccaguugcgcag

SEQ ID NO: 3755419 - RNA, 17 nt, Salmonella typhimurium LT2
cgacggccaguugcuuc

SEQ ID NO: 3755420 - RNA, 17 nt, Salmonella typhimurium LT2
cgacggcgaccagcaaa

SEQ ID NO: 3755421 - RNA, 23 nt, Salmonella typhimurium LT2
cgacggcuucuucacgcagcgcc

SEQ ID NO: 3755422 - RNA, 22 nt, Salmonella typhimurium LT2
cgacgggaugcgauguaaaaau

SEQ ID NO: 3755423 - RNA, 22 nt, Salmonella typhimurium LT2
cgacgguacaaaccccacccgc

SEQ ID NO: 3755424 - RNA, 23 nt, Salmonella typhimurium LT2
cgacgguacaaaccccacccgcu

SEQ ID NO: 3755425 - RNA, 18 nt, Salmonella typhimurium LT2
cgacguaacuaucuguuc

SEQ ID NO: 3755426 - RNA, 17 nt, Salmonella typhimurium LT2
cgacguccacaccuucc

SEQ ID NO: 3755427 - RNA, 13 nt, Salmonella typhimurium LT2
cgacgucuuucuu

SEQ ID NO: 3755428 - RNA, 15 nt, Salmonella typhimurium LT2
cgacgugacucagcg

SEQ ID NO: 3755429 - RNA, 17 nt, Salmonella typhimurium LT2
cgacguuaacgccgcca

SEQ ID NO: 3755430 - RNA, 20 nt, Salmonella typhimurium LT2
cgacguucgauacuauaacg

SEQ ID NO: 3755431 - RNA, 15 nt, Salmonella typhimurium LT2
cgacguugccaggcg

SEQ ID NO: 3755432 - RNA, 20 nt, Salmonella typhimurium LT2
cgacguuguucgcuucuucu

SEQ ID NO: 3755433 - RNA, 18 nt, Salmonella typhimurium LT2
cgacuaccggcaccagca

SEQ ID NO: 3755434 - RNA, 21 nt, Salmonella typhimurium LT2
cgacuacgguaaaccaggcca

SEQ ID NO: 3755435 - RNA, 15 nt, Salmonella typhimurium LT2
cgacuaucgccgccc

SEQ ID NO: 3755436 - RNA, 17 nt, Salmonella typhimurium LT2
cgacucacgguuuuuau

SEQ ID NO: 3755437 - RNA, 16 nt, Salmonella typhimurium LT2
cgacucauaaugucuc

SEQ ID NO: 3755438 - RNA, 19 nt, Salmonella typhimurium LT2
cgacucaucuuuuacaggc

SEQ ID NO: 3755439 - RNA, 15 nt, Salmonella typhimurium LT2
cgacucauuacgcca

SEQ ID NO: 3755440 - RNA, 14 nt, Salmonella typhimurium LT2
cgacucauucagca

SEQ ID NO: 3755441 - RNA, 12 nt, Salmonella typhimurium LT2
cgacucccaggc

SEQ ID NO: 3755442 - RNA, 17 nt, Salmonella typhimurium LT2
cgacucccccagauucu

SEQ ID NO: 3755443 - RNA, 20 nt, Salmonella typhimurium LT2
cgacucccccagauucugau

SEQ ID NO: 3755444 - RNA, 13 nt, Salmonella typhimurium LT2
cgacucucccggc

SEQ ID NO: 3755445 - RNA, 16 nt, Salmonella typhimurium LT2
cgacugaccagaccga

SEQ ID NO: 3755446 - RNA, 18 nt, Salmonella typhimurium LT2
cgacuggcgugaccgaua

SEQ ID NO: 3755447 - RNA, 15 nt, Salmonella typhimurium LT2
cgacugguaacggcg

SEQ ID NO: 3755448 - RNA, 21 nt, Salmonella typhimurium LT2
cgacugucgaaaccagcauaa

SEQ ID NO: 3755449 - RNA, 14 nt, Salmonella typhimurium LT2
cgacuuauccggcc

SEQ ID NO: 3755450 - RNA, 16 nt, Salmonella typhimurium LT2
cgacuuaucuuccacg

SEQ ID NO: 3755451 - RNA, 20 nt, Salmonella typhimurium LT2
cgacuucaaucgccaaaucc

SEQ ID NO: 3755452 - RNA, 14 nt, Salmonella typhimurium LT2
cgacuucacgcugc

SEQ ID NO: 3755453 - RNA, 22 nt, Salmonella typhimurium LT2
cgacuucacgcugcauaaaacu

SEQ ID NO: 3755454 - RNA, 16 nt, Salmonella typhimurium LT2
cgauagagaguuccuc

SEQ ID NO: 3755455 - RNA, 18 nt, Salmonella typhimurium LT2
cgauagagaguuccuccu

SEQ ID NO: 3755456 - RNA, 20 nt, Salmonella typhimurium LT2
cgauagagaguuccuccugg

SEQ ID NO: 3755457 - RNA, 17 nt, Salmonella typhimurium LT2
cgauagagcgcggucag

SEQ ID NO: 3755458 - RNA, 15 nt, Salmonella typhimurium LT2
cgauagcgaacggcg

SEQ ID NO: 3755459 - RNA, 19 nt, Salmonella typhimurium LT2
cgauagcgacggcgcgcca

SEQ ID NO: 3755460 - RNA, 12 nt, Salmonella typhimurium LT2
cgauagcgccgc

SEQ ID NO: 3755461 - RNA, 17 nt, Salmonella typhimurium LT2
cgauaggugacuuuccu

SEQ ID NO: 3755462 - RNA, 16 nt, Salmonella typhimurium LT2
cgauagucagcgcaau

SEQ ID NO: 3755463 - RNA, 22 nt, Salmonella typhimurium LT2
cgauauaagcgccgucauccgc

SEQ ID NO: 3755464 - RNA, 13 nt, Salmonella typhimurium LT2
cgauauagcgcau

SEQ ID NO: 3755465 - RNA, 21 nt, Salmonella typhimurium LT2
cgauauagcgcauggcggcca

SEQ ID NO: 3755466 - RNA, 22 nt, Salmonella typhimurium LT2
cgauaucaacgucuugccauga

SEQ ID NO: 3755467 - RNA, 14 nt, Salmonella typhimurium LT2
cgauaucaucuugc

SEQ ID NO: 3755468 - RNA, 16 nt, Salmonella typhimurium LT2
cgauaucgccuggugu

SEQ ID NO: 3755469 - RNA, 19 nt, Salmonella typhimurium LT2
cgauauucaagcuguugga

SEQ ID NO: 3755470 - RNA, 16 nt, Salmonella typhimurium LT2
cgauauucacacgcuc

SEQ ID NO: 3755471 - RNA, 21 nt, Salmonella typhimurium LT2
cgauauuguccgucagcgcau

SEQ ID NO: 3755472 - RNA, 22 nt, Salmonella typhimurium LT2
cgauauuguccgucagcgcaug

SEQ ID NO: 3755473 - RNA, 15 nt, Salmonella typhimurium LT2
cgaucacagacagau

SEQ ID NO: 3755474 - RNA, 15 nt, Salmonella typhimurium LT2
cgaucaccacgccuu

SEQ ID NO: 3755475 - RNA, 12 nt, Salmonella typhimurium LT2
cgaucaccagca

SEQ ID NO: 3755476 - RNA, 14 nt, Salmonella typhimurium LT2
cgaucaccagcgca

SEQ ID NO: 3755477 - RNA, 15 nt, Salmonella typhimurium LT2
cgaucaccagcgcau

SEQ ID NO: 3755478 - RNA, 21 nt, Salmonella typhimurium LT2
cgaucacccacaucagcggca

SEQ ID NO: 3755479 - RNA, 17 nt, Salmonella typhimurium LT2
cgaucaccgcauagaua

SEQ ID NO: 3755480 - RNA, 19 nt, Salmonella typhimurium LT2
cgaucacggcgaaucgccu

SEQ ID NO: 3755481 - RNA, 21 nt, Salmonella typhimurium LT2
cgaucaggcgucagcggcuga

SEQ ID NO: 3755482 - RNA, 13 nt, Salmonella typhimurium LT2
cgauccagaccgg

SEQ ID NO: 3755483 - RNA, 18 nt, Salmonella typhimurium LT2
cgaucccaauugaucggc

SEQ ID NO: 3755484 - RNA, 22 nt, Salmonella typhimurium LT2
cgaucccaauugaucggccagc

SEQ ID NO: 3755485 - RNA, 19 nt, Salmonella typhimurium LT2
cgaucccgggcgauaaacc

SEQ ID NO: 3755486 - RNA, 14 nt, Salmonella typhimurium LT2
cgaucccuaauaaa

SEQ ID NO: 3755487 - RNA, 17 nt, Salmonella typhimurium LT2
cgauccgaagaacagau

SEQ ID NO: 3755488 - RNA, 21 nt, Salmonella typhimurium LT2
cgauccuuccggcgccuccag

SEQ ID NO: 3755489 - RNA, 21 nt, Salmonella typhimurium LT2
cgaucgaacgcuaaaucgccg

SEQ ID NO: 3755490 - RNA, 23 nt, Salmonella typhimurium LT2
cgaucgagucaggcgccagaguc

SEQ ID NO: 3755491 - RNA, 23 nt, Salmonella typhimurium LT2
cgaucgcuggacgucgucaccac

SEQ ID NO: 3755492 - RNA, 23 nt, Salmonella typhimurium LT2
cgaucguaaucacccgcuuccag

SEQ ID NO: 3755493 - RNA, 15 nt, Salmonella typhimurium LT2
cgaucguccgccucc

SEQ ID NO: 3755494 - RNA, 18 nt, Salmonella typhimurium LT2
cgaucguccgccuccggc

SEQ ID NO: 3755495 - RNA, 21 nt, Salmonella typhimurium LT2
cgaucguuauuaagcagacug

SEQ ID NO: 3755496 - RNA, 12 nt, Salmonella typhimurium LT2
cgaucuauuuca

SEQ ID NO: 3755497 - RNA, 19 nt, Salmonella typhimurium LT2
cgaucugguuguccaccag

SEQ ID NO: 3755498 - RNA, 14 nt, Salmonella typhimurium LT2
cgaucuguuaucac

SEQ ID NO: 3755499 - RNA, 13 nt, Salmonella typhimurium LT2
cgaucuucuccag

SEQ ID NO: 3755500 - RNA, 23 nt, Salmonella typhimurium LT2
cgaugacagcaggaacggcagga

SEQ ID NO: 3755501 - RNA, 14 nt, Salmonella typhimurium LT2
cgaugacucauauu

SEQ ID NO: 3755502 - RNA, 14 nt, Salmonella typhimurium LT2
cgaugacucccagu

SEQ ID NO: 3755503 - RNA, 17 nt, Salmonella typhimurium LT2
cgaugagauaauaaaug

SEQ ID NO: 3755504 - RNA, 13 nt, Salmonella typhimurium LT2
cgaugagcaaagu

SEQ ID NO: 3755505 - RNA, 19 nt, Salmonella typhimurium LT2
cgaugagcgccagcaacag

SEQ ID NO: 3755506 - RNA, 16 nt, Salmonella typhimurium LT2
cgaugaguucaguaug

SEQ ID NO: 3755507 - RNA, 23 nt, Salmonella typhimurium LT2
cgaugaucgucgcgaucgcgcca

SEQ ID NO: 3755508 - RNA, 21 nt, Salmonella typhimurium LT2
cgaugaucuugcucaauaaua

SEQ ID NO: 3755509 - RNA, 19 nt, Salmonella typhimurium LT2
cgaugaugauuaaugcugc

SEQ ID NO: 3755510 - RNA, 21 nt, Salmonella typhimurium LT2
cgaugcauaugcacagcgcua

SEQ ID NO: 3755511 - RNA, 18 nt, Salmonella typhimurium LT2
cgaugccaugaacgaccc

SEQ ID NO: 3755512 - RNA, 19 nt, Salmonella typhimurium LT2
cgaugccguuuuaacguca

SEQ ID NO: 3755513 - RNA, 18 nt, Salmonella typhimurium LT2
cgaugccuuaugcccggc

SEQ ID NO: 3755514 - RNA, 19 nt, Salmonella typhimurium LT2
cgaugcgcguuuuccacca

SEQ ID NO: 3755515 - RNA, 15 nt, Salmonella typhimurium LT2
cgaugcgcuuuucca

SEQ ID NO: 3755516 - RNA, 23 nt, Salmonella typhimurium LT2
cgaugcgguucaacgcgcugcag

SEQ ID NO: 3755517 - RNA, 19 nt, Salmonella typhimurium LT2
cgaugcucagggcauccgc

SEQ ID NO: 3755518 - RNA, 21 nt, Salmonella typhimurium LT2
cgaugcugaauagccagcccc

SEQ ID NO: 3755519 - RNA, 14 nt, Salmonella typhimurium LT2
cgaugcugcuucag

SEQ ID NO: 3755520 - RNA, 20 nt, Salmonella typhimurium LT2
cgaugcuggugaagacgcug

SEQ ID NO: 3755521 - RNA, 13 nt, Salmonella typhimurium LT2
cgauggaaagaac

SEQ ID NO: 3755522 - RNA, 21 nt, Salmonella typhimurium LT2
cgauggcuuucuaccugcaau

SEQ ID NO: 3755523 - RNA, 13 nt, Salmonella typhimurium LT2
cgauggugccgac

SEQ ID NO: 3755524 - RNA, 19 nt, Salmonella typhimurium LT2
cgauguaagaggccguagc

SEQ ID NO: 3755525 - RNA, 14 nt, Salmonella typhimurium LT2
cgauguaucacguu

SEQ ID NO: 3755526 - RNA, 18 nt, Salmonella typhimurium LT2
cgauguauuuauccacgc

SEQ ID NO: 3755527 - RNA, 14 nt, Salmonella typhimurium LT2
cgaugugcugggga

SEQ ID NO: 3755528 - RNA, 15 nt, Salmonella typhimurium LT2
cgauguuugccacgc

SEQ ID NO: 3755529 - RNA, 16 nt, Salmonella typhimurium LT2
cgauuaacgcauguuc

SEQ ID NO: 3755530 - RNA, 17 nt, Salmonella typhimurium LT2
cgauuaaugcuccaaua

SEQ ID NO: 3755531 - RNA, 19 nt, Salmonella typhimurium LT2
cgauucaccgugccaccgg

SEQ ID NO: 3755532 - RNA, 14 nt, Salmonella typhimurium LT2
cgauucaucgacaa

SEQ ID NO: 3755533 - RNA, 16 nt, Salmonella typhimurium LT2
cgauucccgaucuuca

SEQ ID NO: 3755534 - RNA, 14 nt, Salmonella typhimurium LT2
cgauucguuucucu

SEQ ID NO: 3755535 - RNA, 20 nt, Salmonella typhimurium LT2
cgauucucugaggguguuca

SEQ ID NO: 3755536 - RNA, 15 nt, Salmonella typhimurium LT2
cgauucugaauaaua

SEQ ID NO: 3755537 - RNA, 22 nt, Salmonella typhimurium LT2
cgauucugccaguucacgccgc

SEQ ID NO: 3755538 - RNA, 20 nt, Salmonella typhimurium LT2
cgauucugggguucaauagc

SEQ ID NO: 3755539 - RNA, 21 nt, Salmonella typhimurium LT2
cgauuggccgucucuuucaug

SEQ ID NO: 3755540 - RNA, 15 nt, Salmonella typhimurium LT2
cgauuggucaauaag

SEQ ID NO: 3755541 - RNA, 13 nt, Salmonella typhimurium LT2
cgauugucaucau

SEQ ID NO: 3755542 - RNA, 15 nt, Salmonella typhimurium LT2
cgauuuauccaccgc

SEQ ID NO: 3755543 - RNA, 12 nt, Salmonella typhimurium LT2
cgauuuauucuu

SEQ ID NO: 3755544 - RNA, 21 nt, Salmonella typhimurium LT2
cgauuuauucuuugucugucg

SEQ ID NO: 3755545 - RNA, 22 nt, Salmonella typhimurium LT2
cgauuucacgaauaucgacguu

SEQ ID NO: 3755546 - RNA, 15 nt, Salmonella typhimurium LT2
cgauuugcgcucgcg

SEQ ID NO: 3755547 - RNA, 16 nt, Salmonella typhimurium LT2
cgauuuuaugcauggu

SEQ ID NO: 3755548 - RNA, 15 nt, Salmonella typhimurium LT2
cgauuuuuacgccau

SEQ ID NO: 3755549 - RNA, 19 nt, Salmonella typhimurium LT2
cgauuuuugaucucuuuag

SEQ ID NO: 3755550 - RNA, 14 nt, Salmonella typhimurium LT2
cgcaaaaccuucau

SEQ ID NO: 3755551 - RNA, 20 nt, Salmonella typhimurium LT2
cgcaaaacucugagcauaca

SEQ ID NO: 3755552 - RNA, 15 nt, Salmonella typhimurium LT2
cgcaaaagcgcgccc

SEQ ID NO: 3755553 - RNA, 15 nt, Salmonella typhimurium LT2
cgcaaacaguacgcc

SEQ ID NO: 3755554 - RNA, 12 nt, Salmonella typhimurium LT2
cgcaaaccgcuu

SEQ ID NO: 3755555 - RNA, 14 nt, Salmonella typhimurium LT2
cgcaaacgccguga

SEQ ID NO: 3755556 - RNA, 16 nt, Salmonella typhimurium LT2
cgcaaacgccgugaac

SEQ ID NO: 3755557 - RNA, 17 nt, Salmonella typhimurium LT2
cgcaaacgcuggcauaa

SEQ ID NO: 3755558 - RNA, 13 nt, Salmonella typhimurium LT2
cgcagccgccauc

SEQ ID NO: 3755559 - RNA, 17 nt, Salmonella typhimurium LT2
cgcagccgccauccggc

SEQ ID NO: 3755560 - RNA, 20 nt, Salmonella typhimurium LT2
cgcagccgccauccggcaca

SEQ ID NO: 3755561 - RNA, 16 nt, Salmonella typhimurium LT2
cgcagccgcucaauaa

SEQ ID NO: 3755562 - RNA, 18 nt, Salmonella typhimurium LT2
cgcagccuaguucugcgc

SEQ ID NO: 3755563 - RNA, 20 nt, Salmonella typhimurium LT2
cgcagccuaguucugcgcca

SEQ ID NO: 3755564 - RNA, 16 nt, Salmonella typhimurium LT2
cgcagcgaaaauccag

SEQ ID NO: 3755565 - RNA, 22 nt, Salmonella typhimurium LT2
cgcagcgaaaauccaguaauuu

SEQ ID NO: 3755566 - RNA, 18 nt, Salmonella typhimurium LT2
cgcagcgccaucaggccu

SEQ ID NO: 3755567 - RNA, 17 nt, Salmonella typhimurium LT2
cgcagcgcccagcagcu

SEQ ID NO: 3755568 - RNA, 14 nt, Salmonella typhimurium LT2
cgcagcgccuucgc

SEQ ID NO: 3755569 - RNA, 14 nt, Salmonella typhimurium LT2
cgcagcgcgcgacc

SEQ ID NO: 3755570 - RNA, 21 nt, Salmonella typhimurium LT2
cgcagcgcgcugcaaaaugau

SEQ ID NO: 3755571 - RNA, 22 nt, Salmonella typhimurium LT2
cgcagcgcgcugcaaaaugaug

SEQ ID NO: 3755572 - RNA, 19 nt, Salmonella typhimurium LT2
cgcagcgcuuugccgcugc

SEQ ID NO: 3755573 - RNA, 12 nt, Salmonella typhimurium LT2
cgcagcggcggu

SEQ ID NO: 3755574 - RNA, 13 nt, Salmonella typhimurium LT2
cgcagcggcugcg

SEQ ID NO: 3755575 - RNA, 20 nt, Salmonella typhimurium LT2
cgcagcguugauccgugccc

SEQ ID NO: 3755576 - RNA, 22 nt, Salmonella typhimurium LT2
cgcagcugccacaccacaugcg

SEQ ID NO: 3755577 - RNA, 15 nt, Salmonella typhimurium LT2
cgcaggacagcgaca

SEQ ID NO: 3755578 - RNA, 13 nt, Salmonella typhimurium LT2
cgcaggagggagg

SEQ ID NO: 3755579 - RNA, 22 nt, Salmonella typhimurium LT2
cgcaggcauuaaaaaaacguag

SEQ ID NO: 3755580 - RNA, 12 nt, Salmonella typhimurium LT2
cgcaggccaaac

SEQ ID NO: 3755581 - RNA, 22 nt, Salmonella typhimurium LT2
cgcaggcccgauaagcgccgcg

SEQ ID NO: 3755582 - RNA, 16 nt, Salmonella typhimurium LT2
cgcaggcggcuggcgu

SEQ ID NO: 3755583 - RNA, 18 nt, Salmonella typhimurium LT2
cgcaggcggucagcacag

SEQ ID NO: 3755584 - RNA, 20 nt, Salmonella typhimurium LT2
cgcaggcggucagcacagcg

SEQ ID NO: 3755585 - RNA, 16 nt, Salmonella typhimurium LT2
cgcaggcuaacgcgcc

SEQ ID NO: 3755586 - RNA, 13 nt, Salmonella typhimurium LT2
cgcaggcucgucg

SEQ ID NO: 3755587 - RNA, 23 nt, Salmonella typhimurium LT2
cgcaggcucgucguuuguccaac

SEQ ID NO: 3755588 - RNA, 19 nt, Salmonella typhimurium LT2
cgcagggcgauauccagcg

SEQ ID NO: 3755589 - RNA, 16 nt, Salmonella typhimurium LT2
cgcaggggggaaauga

SEQ ID NO: 3755590 - RNA, 21 nt, Salmonella typhimurium LT2
cgcaggucauuggggacgcgc

SEQ ID NO: 3755591 - RNA, 14 nt, Salmonella typhimurium LT2
cgcagguuuuacuu

SEQ ID NO: 3755592 - RNA, 16 nt, Salmonella typhimurium LT2
cgcaguaaacuccucu

SEQ ID NO: 3755593 - RNA, 16 nt, Salmonella typhimurium LT2
cgcagucaagcuugcc

SEQ ID NO: 3755594 - RNA, 16 nt, Salmonella typhimurium LT2
cgcagugaccagcauc

SEQ ID NO: 3755595 - RNA, 17 nt, Salmonella typhimurium LT2
cgcagugaccagcauca

SEQ ID NO: 3755596 - RNA, 13 nt, Salmonella typhimurium LT2
cgcaguuagcgca

SEQ ID NO: 3755597 - RNA, 19 nt, Salmonella typhimurium LT2
cgcaguucauccacgcggg

SEQ ID NO: 3755598 - RNA, 19 nt, Salmonella typhimurium LT2
cgcaguuuacgcagcgccu

SEQ ID NO: 3755599 - RNA, 18 nt, Salmonella typhimurium LT2
cgcaguuuuccagcgccu

SEQ ID NO: 3755600 - RNA, 14 nt, Salmonella typhimurium LT2
cgcauaaaaaauga

SEQ ID NO: 3755601 - RNA, 14 nt, Salmonella typhimurium LT2
cgcauaagcgcgaa

SEQ ID NO: 3755602 - RNA, 16 nt, Salmonella typhimurium LT2
cgcauaagcuuauaaa

SEQ ID NO: 3755603 - RNA, 16 nt, Salmonella typhimurium LT2
cgcauaauagcgccag

SEQ ID NO: 3755604 - RNA, 22 nt, Salmonella typhimurium LT2
cgcauaauagcgccagaacugc

SEQ ID NO: 3755605 - RNA, 17 nt, Salmonella typhimurium LT2
cgcauaaugagcgcuug

SEQ ID NO: 3755606 - RNA, 16 nt, Salmonella typhimurium LT2
cgcauaauuacgccca

SEQ ID NO: 3755607 - RNA, 14 nt, Salmonella typhimurium LT2
cgcauacaucgcag

SEQ ID NO: 3755608 - RNA, 22 nt, Salmonella typhimurium LT2
cgcauacaucgcagacauggca

SEQ ID NO: 3755609 - RNA, 18 nt, Salmonella typhimurium LT2
cgcauaccgaacagaaaa

SEQ ID NO: 3755610 - RNA, 13 nt, Salmonella typhimurium LT2
cgcauaccgcuuu

SEQ ID NO: 3755611 - RNA, 15 nt, Salmonella typhimurium LT2
cgcauacgcagcacu

SEQ ID NO: 3755612 - RNA, 17 nt, Salmonella typhimurium LT2
cgcauacgcagcacuuu

SEQ ID NO: 3755613 - RNA, 19 nt, Salmonella typhimurium LT2
cgcauacucuuggagagca

SEQ ID NO: 3755614 - RNA, 20 nt, Salmonella typhimurium LT2
cgcauagagaccauagacuc

SEQ ID NO: 3755615 - RNA, 21 nt, Salmonella typhimurium LT2
cgcauagauauaaacgcccga

SEQ ID NO: 3755616 - RNA, 21 nt, Salmonella typhimurium LT2
cgcauaggcuuugcugagcgc

SEQ ID NO: 3755617 - RNA, 21 nt, Salmonella typhimurium LT2
cgcauagguugauauaaaacg

SEQ ID NO: 3755618 - RNA, 14 nt, Salmonella typhimurium LT2
cgcauaucccacug

SEQ ID NO: 3755619 - RNA, 13 nt, Salmonella typhimurium LT2
cgcauauuuuuua

SEQ ID NO: 3755620 - RNA, 20 nt, Salmonella typhimurium LT2
cgcaucaaauacgcgcgccg

SEQ ID NO: 3755621 - RNA, 15 nt, Salmonella typhimurium LT2
cgcaucaagcccaug

SEQ ID NO: 3755622 - RNA, 15 nt, Salmonella typhimurium LT2
cgcaucaccgcgcac

SEQ ID NO: 3755623 - RNA, 22 nt, Salmonella typhimurium LT2
cgcaucacgcgaagcggcguca

SEQ ID NO: 3755624 - RNA, 18 nt, Salmonella typhimurium LT2
cgcaucaggaucuucauc

SEQ ID NO: 3755625 - RNA, 11 nt, Salmonella typhimurium LT2
cgcaucaggca

SEQ ID NO: 3755626 - RNA, 15 nt, Salmonella typhimurium LT2
cgcaucauucaucuc

SEQ ID NO: 3755627 - RNA, 16 nt, Salmonella typhimurium LT2
cgcauccacguaaaua

SEQ ID NO: 3755628 - RNA, 13 nt, Salmonella typhimurium LT2
cgcauccagccac

SEQ ID NO: 3755629 - RNA, 14 nt, Salmonella typhimurium LT2
cgcauccggccagc

SEQ ID NO: 3755630 - RNA, 16 nt, Salmonella typhimurium LT2
cgcauccgucaaaaug

SEQ ID NO: 3755631 - RNA, 23 nt, Salmonella typhimurium LT2
cgcauccuguaccaccacgccuu

SEQ ID NO: 3755632 - RNA, 23 nt, Salmonella typhimurium LT2
cgcauccuguuuuuucagcgcgc

SEQ ID NO: 3755633 - RNA, 15 nt, Salmonella typhimurium LT2
cgcaucgcccugcca

SEQ ID NO: 3755634 - RNA, 15 nt, Salmonella typhimurium LT2
cgcaucgggaaacgg

SEQ ID NO: 3755635 - RNA, 21 nt, Salmonella typhimurium LT2
cgcaucgggucgcgugccgca

SEQ ID NO: 3755636 - RNA, 22 nt, Salmonella typhimurium LT2
cgcaucguggccgauauugccu

SEQ ID NO: 3755637 - RNA, 15 nt, Salmonella typhimurium LT2
cgcaugacccaggca

SEQ ID NO: 3755638 - RNA, 14 nt, Salmonella typhimurium LT2
cgcauggccugaua

SEQ ID NO: 3755639 - RNA, 16 nt, Salmonella typhimurium LT2
cgcauggcggccagau

SEQ ID NO: 3755640 - RNA, 17 nt, Salmonella typhimurium LT2
cgcauggcguggauagc

SEQ ID NO: 3755641 - RNA, 21 nt, Salmonella typhimurium LT2
cgcauuauauuggcuggccug

SEQ ID NO: 3755642 - RNA, 14 nt, Salmonella typhimurium LT2
cgcauuauucggcu

SEQ ID NO: 3755643 - RNA, 12 nt, Salmonella typhimurium LT2
cgcauucauaag

SEQ ID NO: 3755644 - RNA, 13 nt, Salmonella typhimurium LT2
cgcauucucgccg

SEQ ID NO: 3755645 - RNA, 16 nt, Salmonella typhimurium LT2
cgcauucucgccguga

SEQ ID NO: 3755646 - RNA, 19 nt, Salmonella typhimurium LT2
cgcauugcgucccagcaca

SEQ ID NO: 3755647 - RNA, 16 nt, Salmonella typhimurium LT2
cgcauugguaaauccg

SEQ ID NO: 3755648 - RNA, 17 nt, Salmonella typhimurium LT2
cgcauugguaucggcag

SEQ ID NO: 3755649 - RNA, 23 nt, Salmonella typhimurium LT2
cgcauuuaaucgccugcgcgccu

SEQ ID NO: 3755650 - RNA, 17 nt, Salmonella typhimurium LT2
cgcauuuuuaagcuggc

SEQ ID NO: 3755651 - RNA, 15 nt, Salmonella typhimurium LT2
cgcauuuuuaucaga

SEQ ID NO: 3755652 - RNA, 14 nt, Salmonella typhimurium LT2
cgcauuuuuaucgg

SEQ ID NO: 3755653 - RNA, 19 nt, Salmonella typhimurium LT2
cgcauuuuuucuucaguuc

SEQ ID NO: 3755654 - RNA, 16 nt, Salmonella typhimurium LT2
cgccaaaagaggcagc

SEQ ID NO: 3755655 - RNA, 14 nt, Salmonella typhimurium LT2
cgccaaaccacacc

SEQ ID NO: 3755656 - RNA, 14 nt, Salmonella typhimurium LT2
cgccaaacgggcaa

SEQ ID NO: 3755657 - RNA, 18 nt, Salmonella typhimurium LT2
cgccaaagcagcugcugg

SEQ ID NO: 3755658 - RNA, 23 nt, Salmonella typhimurium LT2
cgccaaagcagugaauccccaga

SEQ ID NO: 3755659 - RNA, 15 nt, Salmonella typhimurium LT2
cgccaaagcgcugcu

SEQ ID NO: 3755660 - RNA, 18 nt, Salmonella typhimurium LT2
cgccaaagcgcugcugcu

SEQ ID NO: 3755661 - RNA, 20 nt, Salmonella typhimurium LT2
cgccaaagggauaagaaaga

SEQ ID NO: 3755662 - RNA, 20 nt, Salmonella typhimurium LT2
cgccagcgccgggauauccu

SEQ ID NO: 3755663 - RNA, 15 nt, Salmonella typhimurium LT2
cgccagcgccucuuc

SEQ ID NO: 3755664 - RNA, 12 nt, Salmonella typhimurium LT2
cgccagcgcgac

SEQ ID NO: 3755665 - RNA, 15 nt, Salmonella typhimurium LT2
cgccagcgcgguggc

SEQ ID NO: 3755666 - RNA, 22 nt, Salmonella typhimurium LT2
cgccagcgcgguuuccacaccu

SEQ ID NO: 3755667 - RNA, 19 nt, Salmonella typhimurium LT2
cgccagcgcugacaucauc

SEQ ID NO: 3755668 - RNA, 19 nt, Salmonella typhimurium LT2
cgccagcggacuccacgga

SEQ ID NO: 3755669 - RNA, 13 nt, Salmonella typhimurium LT2
cgccagcggcagc

SEQ ID NO: 3755670 - RNA, 16 nt, Salmonella typhimurium LT2
cgccagcggccacagc

SEQ ID NO: 3755671 - RNA, 12 nt, Salmonella typhimurium LT2
cgccagcggcgc

SEQ ID NO: 3755672 - RNA, 18 nt, Salmonella typhimurium LT2
cgccagcggcgccaucac

SEQ ID NO: 3755673 - RNA, 21 nt, Salmonella typhimurium LT2
cgccagcggcgccaucaccau

SEQ ID NO: 3755674 - RNA, 19 nt, Salmonella typhimurium LT2
cgccagcgucucagcaggc

SEQ ID NO: 3755675 - RNA, 20 nt, Salmonella typhimurium LT2
cgccagcguuucacuuucaa

SEQ ID NO: 3755676 - RNA, 18 nt, Salmonella typhimurium LT2
cgccagcuaauuuuacuu

SEQ ID NO: 3755677 - RNA, 21 nt, Salmonella typhimurium LT2
cgccagcucaugcgcggcggg

SEQ ID NO: 3755678 - RNA, 21 nt, Salmonella typhimurium LT2
cgccagcucauuaauaaccca

SEQ ID NO: 3755679 - RNA, 12 nt, Salmonella typhimurium LT2
cgccagcucugc

SEQ ID NO: 3755680 - RNA, 15 nt, Salmonella typhimurium LT2
cgccagcugcgcgcu

SEQ ID NO: 3755681 - RNA, 23 nt, Salmonella typhimurium LT2
cgccagcuuaucgaccagcguua

SEQ ID NO: 3755682 - RNA, 17 nt, Salmonella typhimurium LT2
cgccaggauaauaauga

SEQ ID NO: 3755683 - RNA, 17 nt, Salmonella typhimurium LT2
cgccaggauugccugau

SEQ ID NO: 3755684 - RNA, 13 nt, Salmonella typhimurium LT2
cgccaggcaaccu

SEQ ID NO: 3755685 - RNA, 14 nt, Salmonella typhimurium LT2
cgccaggcacgccg

SEQ ID NO: 3755686 - RNA, 18 nt, Salmonella typhimurium LT2
cgccaggccacggcugua

SEQ ID NO: 3755687 - RNA, 15 nt, Salmonella typhimurium LT2
cgccaggcgcugcgu

SEQ ID NO: 3755688 - RNA, 14 nt, Salmonella typhimurium LT2
cgccaggcuaagau

SEQ ID NO: 3755689 - RNA, 19 nt, Salmonella typhimurium LT2
cgccaggucucauagcgcc

SEQ ID NO: 3755690 - RNA, 21 nt, Salmonella typhimurium LT2
cgccaggucucauagcgcccc

SEQ ID NO: 3755691 - RNA, 19 nt, Salmonella typhimurium LT2
cgccaguacuuuggccuaa

SEQ ID NO: 3755692 - RNA, 14 nt, Salmonella typhimurium LT2
cgccaguaucggca

SEQ ID NO: 3755693 - RNA, 17 nt, Salmonella typhimurium LT2
cgccaguaucggcagga

SEQ ID NO: 3755694 - RNA, 18 nt, Salmonella typhimurium LT2
cgccagucaccagcagca

SEQ ID NO: 3755695 - RNA, 14 nt, Salmonella typhimurium LT2
cgccagucaucgcc

SEQ ID NO: 3755696 - RNA, 15 nt, Salmonella typhimurium LT2
cgccagucccagcac

SEQ ID NO: 3755697 - RNA, 15 nt, Salmonella typhimurium LT2
cgccaguccggucga

SEQ ID NO: 3755698 - RNA, 15 nt, Salmonella typhimurium LT2
cgccagucggucaac

SEQ ID NO: 3755699 - RNA, 16 nt, Salmonella typhimurium LT2
cgccagugaauccacc

SEQ ID NO: 3755700 - RNA, 17 nt, Salmonella typhimurium LT2
cgccagugaugccaaac

SEQ ID NO: 3755701 - RNA, 19 nt, Salmonella typhimurium LT2
cgccaguucaauauccagc

SEQ ID NO: 3755702 - RNA, 17 nt, Salmonella typhimurium LT2
cgccaguucauccagca

SEQ ID NO: 3755703 - RNA, 19 nt, Salmonella typhimurium LT2
cgccaguucauccagcagc

SEQ ID NO: 3755704 - RNA, 22 nt, Salmonella typhimurium LT2
cgccaguucauucgccaccagg

SEQ ID NO: 3755705 - RNA, 15 nt, Salmonella typhimurium LT2
cgccaguuggcguac

SEQ ID NO: 3755706 - RNA, 17 nt, Salmonella typhimurium LT2
cgccaguuucuuuuucc

SEQ ID NO: 3755707 - RNA, 19 nt, Salmonella typhimurium LT2
cgccaguuugguuaauucc

SEQ ID NO: 3755708 - RNA, 16 nt, Salmonella typhimurium LT2
cgccaguuuuuauacu

SEQ ID NO: 3755709 - RNA, 23 nt, Salmonella typhimurium LT2
cgccaguuuuugcgccauugccg

SEQ ID NO: 3755710 - RNA, 22 nt, Salmonella typhimurium LT2
cgccauaaaaaacaccugucug

SEQ ID NO: 3755711 - RNA, 18 nt, Salmonella typhimurium LT2
cgccauaaaucagaucca

SEQ ID NO: 3755712 - RNA, 18 nt, Salmonella typhimurium LT2
cgccauaaaucgcggcga

SEQ ID NO: 3755713 - RNA, 14 nt, Salmonella typhimurium LT2
cgccauaauacaca

SEQ ID NO: 3755714 - RNA, 19 nt, Salmonella typhimurium LT2
cgccauaaugcuuaauuca

SEQ ID NO: 3755715 - RNA, 21 nt, Salmonella typhimurium LT2
cgccauaaugcuuaauucaua

SEQ ID NO: 3755716 - RNA, 21 nt, Salmonella typhimurium LT2
cgccauaauggcccagcguac

SEQ ID NO: 3755717 - RNA, 14 nt, Salmonella typhimurium LT2
cgccauauacgcca

SEQ ID NO: 3755718 - RNA, 20 nt, Salmonella typhimurium LT2
cgccaucaacuccuccggcg

SEQ ID NO: 3755719 - RNA, 20 nt, Salmonella typhimurium LT2
cgccaucaauuuugcgccua

SEQ ID NO: 3755720 - RNA, 17 nt, Salmonella typhimurium LT2
cgccaucaccaggucaa

SEQ ID NO: 3755721 - RNA, 21 nt, Salmonella typhimurium LT2
cgccaucacgcccggaugcgc

SEQ ID NO: 3755722 - RNA, 17 nt, Salmonella typhimurium LT2
cgccaucagacauuguu

SEQ ID NO: 3755723 - RNA, 16 nt, Salmonella typhimurium LT2
cgccaucagcaucauc

SEQ ID NO: 3755724 - RNA, 17 nt, Salmonella typhimurium LT2
cgccaucaggcaaucuu

SEQ ID NO: 3755725 - RNA, 14 nt, Salmonella typhimurium LT2
cgccaucaggcacu

SEQ ID NO: 3755726 - RNA, 22 nt, Salmonella typhimurium LT2
cgccaucaggcaugaccugccg

SEQ ID NO: 3755727 - RNA, 14 nt, Salmonella typhimurium LT2
cgccaucaggccua

SEQ ID NO: 3755728 - RNA, 16 nt, Salmonella typhimurium LT2
cgccaucaggccuacg

SEQ ID NO: 3755729 - RNA, 19 nt, Salmonella typhimurium LT2
cgccaucaggcuggguaac

SEQ ID NO: 3755730 - RNA, 20 nt, Salmonella typhimurium LT2
cgccaucaugcagccggcga

SEQ ID NO: 3755731 - RNA, 21 nt, Salmonella typhimurium LT2
cgccaucaugcccacaggcag

SEQ ID NO: 3755732 - RNA, 15 nt, Salmonella typhimurium LT2
cgccauccaccagga

SEQ ID NO: 3755733 - RNA, 13 nt, Salmonella typhimurium LT2
cgccauccggcaa

SEQ ID NO: 3755734 - RNA, 14 nt, Salmonella typhimurium LT2
cgccauccggcaaa

SEQ ID NO: 3755735 - RNA, 14 nt, Salmonella typhimurium LT2
cgccauccggcaau

SEQ ID NO: 3755736 - RNA, 17 nt, Salmonella typhimurium LT2
cgccauccggcaauccg

SEQ ID NO: 3755737 - RNA, 16 nt, Salmonella typhimurium LT2
cgccauccggcaauuu

SEQ ID NO: 3755738 - RNA, 17 nt, Salmonella typhimurium LT2
cgccauccggcacaaaa

SEQ ID NO: 3755739 - RNA, 19 nt, Salmonella typhimurium LT2
cgccauccggcacggucaa

SEQ ID NO: 3755740 - RNA, 14 nt, Salmonella typhimurium LT2
cgccauccggcaga

SEQ ID NO: 3755741 - RNA, 16 nt, Salmonella typhimurium LT2
cgccauccggcagaua

SEQ ID NO: 3755742 - RNA, 13 nt, Salmonella typhimurium LT2
cgccauccggcau

SEQ ID NO: 3755743 - RNA, 15 nt, Salmonella typhimurium LT2
cgccauccggcauuu

SEQ ID NO: 3755744 - RNA, 14 nt, Salmonella typhimurium LT2
cgccauccggccuc

SEQ ID NO: 3755745 - RNA, 13 nt, Salmonella typhimurium LT2
cgccauccggcga

SEQ ID NO: 3755746 - RNA, 22 nt, Salmonella typhimurium LT2
cgccauccgguaaacaugcugg

SEQ ID NO: 3755747 - RNA, 15 nt, Salmonella typhimurium LT2
cgccauccugcaccg

SEQ ID NO: 3755748 - RNA, 17 nt, Salmonella typhimurium LT2
cgccaucgacagcgcca

SEQ ID NO: 3755749 - RNA, 16 nt, Salmonella typhimurium LT2
cgccaucgacauauug

SEQ ID NO: 3755750 - RNA, 12 nt, Salmonella typhimurium LT2
cgccaucgccag

SEQ ID NO: 3755751 - RNA, 19 nt, Salmonella typhimurium LT2
cgccaucgccgccucgcgu

SEQ ID NO: 3755752 - RNA, 18 nt, Salmonella typhimurium LT2
cgccaucucauucgccag

SEQ ID NO: 3755753 - RNA, 17 nt, Salmonella typhimurium LT2
cgccaucuccaucauuu

SEQ ID NO: 3755754 - RNA, 16 nt, Salmonella typhimurium LT2
cgccaucuccggcagc

SEQ ID NO: 3755755 - RNA, 16 nt, Salmonella typhimurium LT2
cgccaucuucacgcag

SEQ ID NO: 3755756 - RNA, 21 nt, Salmonella typhimurium LT2
cgccaugaccugggcgccaga

SEQ ID NO: 3755757 - RNA, 14 nt, Salmonella typhimurium LT2
cgccaugauccagc

SEQ ID NO: 3755758 - RNA, 18 nt, Salmonella typhimurium LT2
cgccaugauucaucccgc

SEQ ID NO: 3755759 - RNA, 15 nt, Salmonella typhimurium LT2
cgccaugccgcgccu

SEQ ID NO: 3755760 - RNA, 20 nt, Salmonella typhimurium LT2
cgccaugcgggugacgcugg

SEQ ID NO: 3755761 - RNA, 21 nt, Salmonella typhimurium LT2
cgccaugcgggugacgcuggc

SEQ ID NO: 3755762 - RNA, 17 nt, Salmonella typhimurium LT2
cgccaugcuuuccgggc

SEQ ID NO: 3755763 - RNA, 15 nt, Salmonella typhimurium LT2
cgccauucacggcga

SEQ ID NO: 3755764 - RNA, 15 nt, Salmonella typhimurium LT2
cgccauuccgcagaa

SEQ ID NO: 3755765 - RNA, 16 nt, Salmonella typhimurium LT2
cgccauugcgggagcu

SEQ ID NO: 3755766 - RNA, 19 nt, Salmonella typhimurium LT2
cgccgacccccuccuugua

SEQ ID NO: 3755767 - RNA, 17 nt, Salmonella typhimurium LT2
cgccgacgcauccgcca

SEQ ID NO: 3755768 - RNA, 13 nt, Salmonella typhimurium LT2
cgccgagccgccc

SEQ ID NO: 3755769 - RNA, 15 nt, Salmonella typhimurium LT2
cgccgagccgcccuu

SEQ ID NO: 3755770 - RNA, 13 nt, Salmonella typhimurium LT2
cgccgagcgccgu

SEQ ID NO: 3755771 - RNA, 19 nt, Salmonella typhimurium LT2
cgccgaguaauuugaacau

SEQ ID NO: 3755772 - RNA, 17 nt, Salmonella typhimurium LT2
cgccgauaacacggcug

SEQ ID NO: 3755773 - RNA, 15 nt, Salmonella typhimurium LT2
cgccgauaaucggcg

SEQ ID NO: 3755774 - RNA, 14 nt, Salmonella typhimurium LT2
cgccgauacugccc

SEQ ID NO: 3755775 - RNA, 14 nt, Salmonella typhimurium LT2
cgccgauagcggcg

SEQ ID NO: 3755776 - RNA, 17 nt, Salmonella typhimurium LT2
cgccgauagcggcggcg

SEQ ID NO: 3755777 - RNA, 19 nt, Salmonella typhimurium LT2
cgccgauagcggcggcgcg

SEQ ID NO: 3755778 - RNA, 15 nt, Salmonella typhimurium LT2
cgccgaucagcacca

SEQ ID NO: 3755779 - RNA, 21 nt, Salmonella typhimurium LT2
cgccgaugaccaguggcguaa

SEQ ID NO: 3755780 - RNA, 14 nt, Salmonella typhimurium LT2
cgccgaugccgccg

SEQ ID NO: 3755781 - RNA, 21 nt, Salmonella typhimurium LT2
cgccgauuaaugcuccaauaa

SEQ ID NO: 3755782 - RNA, 15 nt, Salmonella typhimurium LT2
cgccgauuccugcug

SEQ ID NO: 3755783 - RNA, 13 nt, Salmonella typhimurium LT2
cgccgauuucuuc

SEQ ID NO: 3755784 - RNA, 19 nt, Salmonella typhimurium LT2
cgccgcaaacgccgagccg

SEQ ID NO: 3755785 - RNA, 18 nt, Salmonella typhimurium LT2
cgccgcaaugccgccugc

SEQ ID NO: 3755786 - RNA, 22 nt, Salmonella typhimurium LT2
cgccgcaauuccugacugcgcg

SEQ ID NO: 3755787 - RNA, 12 nt, Salmonella typhimurium LT2
cgccgcacagaa

SEQ ID NO: 3755788 - RNA, 15 nt, Salmonella typhimurium LT2
cgccgcacaucggca

SEQ ID NO: 3755789 - RNA, 20 nt, Salmonella typhimurium LT2
cgccgcagccugauggcgac

SEQ ID NO: 3755790 - RNA, 18 nt, Salmonella typhimurium LT2
cgccgcagcgccugcgcc

SEQ ID NO: 3755791 - RNA, 18 nt, Salmonella typhimurium LT2
cgccgcaggccaucauac

SEQ ID NO: 3755792 - RNA, 23 nt, Salmonella typhimurium LT2
cgccgcaggccaucauaccgcca

SEQ ID NO: 3755793 - RNA, 16 nt, Salmonella typhimurium LT2
cgccgcaucauacaua

SEQ ID NO: 3755794 - RNA, 19 nt, Salmonella typhimurium LT2
cgccgcauccuguaccacc

SEQ ID NO: 3755795 - RNA, 20 nt, Salmonella typhimurium LT2
cgccgcaucuuuugccgcgg

SEQ ID NO: 3755796 - RNA, 21 nt, Salmonella typhimurium LT2
cgccgccaaaaacaaacgauu

SEQ ID NO: 3755797 - RNA, 22 nt, Salmonella typhimurium LT2
cgccgccaaacugcgcgccgcc

SEQ ID NO: 3755798 - RNA, 14 nt, Salmonella typhimurium LT2
cgccgccaacgcca

SEQ ID NO: 3755799 - RNA, 12 nt, Salmonella typhimurium LT2
cgccgccaccaa

SEQ ID NO: 3755800 - RNA, 13 nt, Salmonella typhimurium LT2
cgccgccaccaaa

SEQ ID NO: 3755801 - RNA, 21 nt, Salmonella typhimurium LT2
cgccgccaccauguugcgcag

SEQ ID NO: 3755802 - RNA, 22 nt, Salmonella typhimurium LT2
cgccgccaccauguugcgcagc

SEQ ID NO: 3755803 - RNA, 20 nt, Salmonella typhimurium LT2
cgccgccagauagccgcgcu

SEQ ID NO: 3755804 - RNA, 13 nt, Salmonella typhimurium LT2
cgccgccagccau

SEQ ID NO: 3755805 - RNA, 17 nt, Salmonella typhimurium LT2
cgccgccagugagguga

SEQ ID NO: 3755806 - RNA, 14 nt, Salmonella typhimurium LT2
cgccgccaucaacg

SEQ ID NO: 3755807 - RNA, 12 nt, Salmonella typhimurium LT2
cgccgccauccg

SEQ ID NO: 3755808 - RNA, 17 nt, Salmonella typhimurium LT2
cgccgccauccggcaca

SEQ ID NO: 3755809 - RNA, 14 nt, Salmonella typhimurium LT2
cgccgccaucggcg

SEQ ID NO: 3755810 - RNA, 20 nt, Salmonella typhimurium LT2
cgccgcccaaugcggcuuua

SEQ ID NO: 3755811 - RNA, 23 nt, Salmonella typhimurium LT2
cgccgcccaucgggccgcucagc

SEQ ID NO: 3755812 - RNA, 22 nt, Salmonella typhimurium LT2
cgccgccccaaaucucccccgg

SEQ ID NO: 3755813 - RNA, 13 nt, Salmonella typhimurium LT2
cgccgcccggcuu

SEQ ID NO: 3755814 - RNA, 18 nt, Salmonella typhimurium LT2
cgccgcccugcaucaugc

SEQ ID NO: 3755815 - RNA, 13 nt, Salmonella typhimurium LT2
cgccgccgacagg

SEQ ID NO: 3755816 - RNA, 15 nt, Salmonella typhimurium LT2
cgccgccgacaggau

SEQ ID NO: 3755817 - RNA, 13 nt, Salmonella typhimurium LT2
cgccgccgccagg

SEQ ID NO: 3755818 - RNA, 23 nt, Salmonella typhimurium LT2
cgccgccgggaucagcggcugca

SEQ ID NO: 3755819 - RNA, 18 nt, Salmonella typhimurium LT2
cgccgccguccaggccug

SEQ ID NO: 3755820 - RNA, 15 nt, Salmonella typhimurium LT2
cgccgccgugccuga

SEQ ID NO: 3755821 - RNA, 16 nt, Salmonella typhimurium LT2
cgccgccuaucgccag

SEQ ID NO: 3755822 - RNA, 23 nt, Salmonella typhimurium LT2
cgccgccucccccucaaucggcg

SEQ ID NO: 3755823 - RNA, 14 nt, Salmonella typhimurium LT2
cgccgccuccgccg

SEQ ID NO: 3755824 - RNA, 15 nt, Salmonella typhimurium LT2
cgccgccuccgccgc

SEQ ID NO: 3755825 - RNA, 16 nt, Salmonella typhimurium LT2
cgccgccuccgccgcu

SEQ ID NO: 3755826 - RNA, 21 nt, Salmonella typhimurium LT2
cgccgccucgcgauccgccag

SEQ ID NO: 3755827 - RNA, 20 nt, Salmonella typhimurium LT2
cgccgccucuucaaacggca

SEQ ID NO: 3755828 - RNA, 15 nt, Salmonella typhimurium LT2
cgccgccugcacggc

SEQ ID NO: 3755829 - RNA, 16 nt, Salmonella typhimurium LT2
cgccgccugcgccagc

SEQ ID NO: 3755830 - RNA, 12 nt, Salmonella typhimurium LT2
cgccgccugcuc

SEQ ID NO: 3755831 - RNA, 16 nt, Salmonella typhimurium LT2
cgccgccugcuccggg

SEQ ID NO: 3755832 - RNA, 16 nt, Salmonella typhimurium LT2
cgccgccuucugcacc

SEQ ID NO: 3755833 - RNA, 22 nt, Salmonella typhimurium LT2
cgccgcgauacggauagcguca

SEQ ID NO: 3755834 - RNA, 20 nt, Salmonella typhimurium LT2
cgccgcgauguuugcucgcc

SEQ ID NO: 3755835 - RNA, 16 nt, Salmonella typhimurium LT2
cgccgcgcaggcgaua

SEQ ID NO: 3755836 - RNA, 13 nt, Salmonella typhimurium LT2
cgccgcgccaccg

SEQ ID NO: 3755837 - RNA, 17 nt, Salmonella typhimurium LT2
cgccgcgcccagcagca

SEQ ID NO: 3755838 - RNA, 16 nt, Salmonella typhimurium LT2
cgccgcgcucgcguaa

SEQ ID NO: 3755839 - RNA, 14 nt, Salmonella typhimurium LT2
cgccgcgggcagca

SEQ ID NO: 3755840 - RNA, 17 nt, Salmonella typhimurium LT2
cgccgcgggcagcagca

SEQ ID NO: 3755841 - RNA, 14 nt, Salmonella typhimurium LT2
cgccgcggucgcac

SEQ ID NO: 3755842 - RNA, 18 nt, Salmonella typhimurium LT2
cgccgcggucgcacagaa

SEQ ID NO: 3755843 - RNA, 16 nt, Salmonella typhimurium LT2
cgccgcuacucagccc

SEQ ID NO: 3755844 - RNA, 16 nt, Salmonella typhimurium LT2
cgccgcuacugccgcc

SEQ ID NO: 3755845 - RNA, 17 nt, Salmonella typhimurium LT2
cgccgcuacugccgcca

SEQ ID NO: 3755846 - RNA, 19 nt, Salmonella typhimurium LT2
cgccgcuaucgaccagcac

SEQ ID NO: 3755847 - RNA, 21 nt, Salmonella typhimurium LT2
cgccgcuaucgccgacccggc

SEQ ID NO: 3755848 - RNA, 19 nt, Salmonella typhimurium LT2
cgccgcuccguacgcguca

SEQ ID NO: 3755849 - RNA, 18 nt, Salmonella typhimurium LT2
cgccgcucuucagcgucc

SEQ ID NO: 3755850 - RNA, 12 nt, Salmonella typhimurium LT2
cgccgcugaucc

SEQ ID NO: 3755851 - RNA, 13 nt, Salmonella typhimurium LT2
cgccgcugcguau

SEQ ID NO: 3755852 - RNA, 13 nt, Salmonella typhimurium LT2
cgccgcuggcggg

SEQ ID NO: 3755853 - RNA, 15 nt, Salmonella typhimurium LT2
cgccgcuggcgggca

SEQ ID NO: 3755854 - RNA, 13 nt, Salmonella typhimurium LT2
cgccgcuuccccc

SEQ ID NO: 3755855 - RNA, 19 nt, Salmonella typhimurium LT2
cgccgcuucgucgucgucc

SEQ ID NO: 3755856 - RNA, 17 nt, Salmonella typhimurium LT2
cgccgcuuuaaucacca

SEQ ID NO: 3755857 - RNA, 21 nt, Salmonella typhimurium LT2
cgccgcuuuaaucaccauggc

SEQ ID NO: 3755858 - RNA, 17 nt, Salmonella typhimurium LT2
cgccgcuuuuuccgccg

SEQ ID NO: 3755859 - RNA, 20 nt, Salmonella typhimurium LT2
cgccggaaaaccggucauau

SEQ ID NO: 3755860 - RNA, 19 nt, Salmonella typhimurium LT2
cgccggaaagaaacgccgc

SEQ ID NO: 3755861 - RNA, 20 nt, Salmonella typhimurium LT2
cgccggaaagaaacgccgcg

SEQ ID NO: 3755862 - RNA, 23 nt, Salmonella typhimurium LT2
cgccggaaagaaacgccgcgcaa

SEQ ID NO: 3755863 - RNA, 24 nt, Salmonella typhimurium LT2
cgccggaaagcuggucgagauacu

SEQ ID NO: 3755864 - RNA, 15 nt, Salmonella typhimurium LT2
cgccggaaauuugca

SEQ ID NO: 3755865 - RNA, 19 nt, Salmonella typhimurium LT2
cgccggaaucgcgauccag

SEQ ID NO: 3755866 - RNA, 20 nt, Salmonella typhimurium LT2
cgccggacaguucgccaacg

SEQ ID NO: 3755867 - RNA, 22 nt, Salmonella typhimurium LT2
cgccggacuccagcaacgccgc

SEQ ID NO: 3755868 - RNA, 18 nt, Salmonella typhimurium LT2
cgccggacugacguugcg

SEQ ID NO: 3755869 - RNA, 20 nt, Salmonella typhimurium LT2
cgccggagagcauuuguagc

SEQ ID NO: 3755870 - RNA, 16 nt, Salmonella typhimurium LT2
cgccuuaucaggccug

SEQ ID NO: 3755871 - RNA, 20 nt, Salmonella typhimurium LT2
cgccuuauccgaccuacaag

SEQ ID NO: 3755872 - RNA, 15 nt, Salmonella typhimurium LT2
cgccuuauccggccu

SEQ ID NO: 3755873 - RNA, 16 nt, Salmonella typhimurium LT2
cgccuuauccggccug

SEQ ID NO: 3755874 - RNA, 17 nt, Salmonella typhimurium LT2
cgccuuauucgguuuau

SEQ ID NO: 3755875 - RNA, 23 nt, Salmonella typhimurium LT2
cgccuucacacugcgccgccagc

SEQ ID NO: 3755876 - RNA, 23 nt, Salmonella typhimurium LT2
cgccuucaggcaucagauaaaca

SEQ ID NO: 3755877 - RNA, 18 nt, Salmonella typhimurium LT2
cgccuucagugauaaagc

SEQ ID NO: 3755878 - RNA, 14 nt, Salmonella typhimurium LT2
cgccuuccugccag

SEQ ID NO: 3755879 - RNA, 13 nt, Salmonella typhimurium LT2
cgccuucgccggc

SEQ ID NO: 3755880 - RNA, 19 nt, Salmonella typhimurium LT2
cgccuucgccuuccagugc

SEQ ID NO: 3755881 - RNA, 21 nt, Salmonella typhimurium LT2
cgccuucucgauuucacgaua

SEQ ID NO: 3755882 - RNA, 15 nt, Salmonella typhimurium LT2
cgccuucuucaccca

SEQ ID NO: 3755883 - RNA, 14 nt, Salmonella typhimurium LT2
cgccuucuucaucu

SEQ ID NO: 3755884 - RNA, 16 nt, Salmonella typhimurium LT2
cgccuucuucaucuuc

SEQ ID NO: 3755885 - RNA, 19 nt, Salmonella typhimurium LT2
cgccuugacgauaugcugc

SEQ ID NO: 3755886 - RNA, 23 nt, Salmonella typhimurium LT2
cgccuugccccagcggucagcga

SEQ ID NO: 3755887 - RNA, 14 nt, Salmonella typhimurium LT2
cgccuugcggcggc

SEQ ID NO: 3755888 - RNA, 15 nt, Salmonella typhimurium LT2
cgccuugcggcggcg

SEQ ID NO: 3755889 - RNA, 15 nt, Salmonella typhimurium LT2
cgccuuguccggccu

SEQ ID NO: 3755890 - RNA, 17 nt, Salmonella typhimurium LT2
cgccuuguugcggauga

SEQ ID NO: 3755891 - RNA, 15 nt, Salmonella typhimurium LT2
cgccuuguuuaucag

SEQ ID NO: 3755892 - RNA, 15 nt, Salmonella typhimurium LT2
cgccuuucacgccga

SEQ ID NO: 3755893 - RNA, 15 nt, Salmonella typhimurium LT2
cgccuuucagauggu

SEQ ID NO: 3755894 - RNA, 17 nt, Salmonella typhimurium LT2
cgccuuucuucacgaua

SEQ ID NO: 3755895 - RNA, 20 nt, Salmonella typhimurium LT2
cgccuuugccaagaaacgca

SEQ ID NO: 3755896 - RNA, 12 nt, Salmonella typhimurium LT2
cgcgaaaacagc

SEQ ID NO: 3755897 - RNA, 16 nt, Salmonella typhimurium LT2
cgcgaaauagugggga

SEQ ID NO: 3755898 - RNA, 22 nt, Salmonella typhimurium LT2
cgcgaaaucaaagaccuccgcc

SEQ ID NO: 3755899 - RNA, 18 nt, Salmonella typhimurium LT2
cgcgaaaugucccgauau

SEQ ID NO: 3755900 - RNA, 18 nt, Salmonella typhimurium LT2
cgcgaacgccaggccaaa

SEQ ID NO: 3755901 - RNA, 13 nt, Salmonella typhimurium LT2
cgcgaacgcgaug

SEQ ID NO: 3755902 - RNA, 13 nt, Salmonella typhimurium LT2
cgcgaagcggcgc

SEQ ID NO: 3755903 - RNA, 20 nt, Salmonella typhimurium LT2
cgcgaauagccagacagccc

SEQ ID NO: 3755904 - RNA, 14 nt, Salmonella typhimurium LT2
cgcgaauauguucu

SEQ ID NO: 3755905 - RNA, 20 nt, Salmonella typhimurium LT2
cgcgaaucgacaauccgcca

SEQ ID NO: 3755906 - RNA, 21 nt, Salmonella typhimurium LT2
cgcgaaucgacaauccgccac

SEQ ID NO: 3755907 - RNA, 24 nt, Salmonella typhimurium LT2
cgcgaaucgacaauccgccacgcu

SEQ ID NO: 3755908 - RNA, 19 nt, Salmonella typhimurium LT2
cgcgaauuaugacgggaaa

SEQ ID NO: 3755909 - RNA, 15 nt, Salmonella typhimurium LT2
cgcgaauuucaaucg

SEQ ID NO: 3755910 - RNA, 18 nt, Salmonella typhimurium LT2
cgcgaauuucaaucgcca

SEQ ID NO: 3755911 - RNA, 15 nt, Salmonella typhimurium LT2
cgcgacaacgccgga

SEQ ID NO: 3755912 - RNA, 21 nt, Salmonella typhimurium LT2
cgcgacaacgccggaccagac

SEQ ID NO: 3755913 - RNA, 24 nt, Salmonella typhimurium LT2
cgcgacaauaugauccucguugac

SEQ ID NO: 3755914 - RNA, 16 nt, Salmonella typhimurium LT2
cgcgacagucgcagag

SEQ ID NO: 3755915 - RNA, 15 nt, Salmonella typhimurium LT2
cgcgacauccgcuuu

SEQ ID NO: 3755916 - RNA, 14 nt, Salmonella typhimurium LT2
cgcgacauggcgaa

SEQ ID NO: 3755917 - RNA, 18 nt, Salmonella typhimurium LT2
cgcgaccagcgcaccaaa

SEQ ID NO: 3755918 - RNA, 21 nt, Salmonella typhimurium LT2
cgcgaccagcgugaccgguaa

SEQ ID NO: 3755919 - RNA, 17 nt, Salmonella typhimurium LT2
cgcgacccauugccgga

SEQ ID NO: 3755920 - RNA, 18 nt, Salmonella typhimurium LT2
cgcgaccgcaucaaugcc

SEQ ID NO: 3755921 - RNA, 21 nt, Salmonella typhimurium LT2
cgcgaccggaucaauaaacag

SEQ ID NO: 3755922 - RNA, 16 nt, Salmonella typhimurium LT2
cgcgacgcccaccagu

SEQ ID NO: 3755923 - RNA, 21 nt, Salmonella typhimurium LT2
cgcgacgcccaccagucccug

SEQ ID NO: 3755924 - RNA, 16 nt, Salmonella typhimurium LT2
cgcgacgcuuaucagc

SEQ ID NO: 3755925 - RNA, 20 nt, Salmonella typhimurium LT2
cgcgacgcuuaucagcccua

SEQ ID NO: 3755926 - RNA, 20 nt, Salmonella typhimurium LT2
cgcgacucccaggcgcgcag

SEQ ID NO: 3755927 - RNA, 16 nt, Salmonella typhimurium LT2
cgcgacuucaaucgcc

SEQ ID NO: 3755928 - RNA, 19 nt, Salmonella typhimurium LT2
cgcgacuuuggcuuuaucc

SEQ ID NO: 3755929 - RNA, 19 nt, Salmonella typhimurium LT2
cgcgagaaaauagaggaaa

SEQ ID NO: 3755930 - RNA, 14 nt, Salmonella typhimurium LT2
cgcgagaacugcug

SEQ ID NO: 3755931 - RNA, 16 nt, Salmonella typhimurium LT2
cgcgagaacugcugca

SEQ ID NO: 3755932 - RNA, 21 nt, Salmonella typhimurium LT2
cgcgagaagcccggccacagc

SEQ ID NO: 3755933 - RNA, 24 nt, Salmonella typhimurium LT2
cgcgagaaucgccaggaucgccgc

SEQ ID NO: 3755934 - RNA, 19 nt, Salmonella typhimurium LT2
cgcgagcguucaaaaucaa

SEQ ID NO: 3755935 - RNA, 13 nt, Salmonella typhimurium LT2
cgcgagugauccc

SEQ ID NO: 3755936 - RNA, 22 nt, Salmonella typhimurium LT2
cgcgaguguaaagauuaauaau

SEQ ID NO: 3755937 - RNA, 23 nt, Salmonella typhimurium LT2
cgcgauaauaauuaccacgcagc

SEQ ID NO: 3755938 - RNA, 16 nt, Salmonella typhimurium LT2
cgcgauacugccgccc

SEQ ID NO: 3755939 - RNA, 15 nt, Salmonella typhimurium LT2
cgcgauagcgcugag

SEQ ID NO: 3755940 - RNA, 17 nt, Salmonella typhimurium LT2
cgcgaucaucagcacgc

SEQ ID NO: 3755941 - RNA, 20 nt, Salmonella typhimurium LT2
cgcgauccaacaauuauaua

SEQ ID NO: 3755942 - RNA, 12 nt, Salmonella typhimurium LT2
cgcgauccgcca

SEQ ID NO: 3755943 - RNA, 14 nt, Salmonella typhimurium LT2
cgcgauccgccagc

SEQ ID NO: 3755944 - RNA, 22 nt, Salmonella typhimurium LT2
cgcgauccucauacagcccgcg

SEQ ID NO: 3755945 - RNA, 17 nt, Salmonella typhimurium LT2
cgcgaucgcgccagccu

SEQ ID NO: 3755946 - RNA, 15 nt, Salmonella typhimurium LT2
cgcgaugacucauau

SEQ ID NO: 3755947 - RNA, 22 nt, Salmonella typhimurium LT2
cgcgaugaucgucgcgaucgcg

SEQ ID NO: 3755948 - RNA, 12 nt, Salmonella typhimurium LT2
cgcgaugcccca

SEQ ID NO: 3755949 - RNA, 22 nt, Salmonella typhimurium LT2
cgcgaugcgcuugcuccgcaga

SEQ ID NO: 3755950 - RNA, 18 nt, Salmonella typhimurium LT2
cgcgauguuugcucgcca

SEQ ID NO: 3755951 - RNA, 18 nt, Salmonella typhimurium LT2
cgcgcaaagggugaaauc

SEQ ID NO: 3755952 - RNA, 18 nt, Salmonella typhimurium LT2
cgcgcaaccgcaucacgc

SEQ ID NO: 3755953 - RNA, 23 nt, Salmonella typhimurium LT2
cgcgcaaccgcaucacgcgaagc

SEQ ID NO: 3755954 - RNA, 14 nt, Salmonella typhimurium LT2
cgcgcaaucagcac

SEQ ID NO: 3755955 - RNA, 21 nt, Salmonella typhimurium LT2
cgcgcaaucagcaccgcgcgc

SEQ ID NO: 3755956 - RNA, 19 nt, Salmonella typhimurium LT2
cgcgcaaucauuaccggac

SEQ ID NO: 3755957 - RNA, 15 nt, Salmonella typhimurium LT2
cgcgcaaucgggccu

SEQ ID NO: 3755958 - RNA, 17 nt, Salmonella typhimurium LT2
cgcgcacaugcagcgca

SEQ ID NO: 3755959 - RNA, 15 nt, Salmonella typhimurium LT2
cgcgcaccccggcca

SEQ ID NO: 3755960 - RNA, 13 nt, Salmonella typhimurium LT2
cgcgcacgcgcgc

SEQ ID NO: 3755961 - RNA, 16 nt, Salmonella typhimurium LT2
cgcgcagaaucagcgu

SEQ ID NO: 3755962 - RNA, 18 nt, Salmonella typhimurium LT2
cgcgcagaaucagcgugc

SEQ ID NO: 3755963 - RNA, 23 nt, Salmonella typhimurium LT2
cgcgcagccagggaacuccagca

SEQ ID NO: 3755964 - RNA, 15 nt, Salmonella typhimurium LT2
cgcgcagcggcgcca

SEQ ID NO: 3755965 - RNA, 12 nt, Salmonella typhimurium LT2
cgcgcagcugcc

SEQ ID NO: 3755966 - RNA, 12 nt, Salmonella typhimurium LT2
cgcgcaggcgau

SEQ ID NO: 3755967 - RNA, 14 nt, Salmonella typhimurium LT2
cgcgcauaccgcuu

SEQ ID NO: 3755968 - RNA, 15 nt, Salmonella typhimurium LT2
cgcgcaucaacgcca

SEQ ID NO: 3755969 - RNA, 20 nt, Salmonella typhimurium LT2
cgcgcaucccacaccacacg

SEQ ID NO: 3755970 - RNA, 23 nt, Salmonella typhimurium LT2
cgcgcaucgggccguccggcaaa

SEQ ID NO: 3755971 - RNA, 17 nt, Salmonella typhimurium LT2
cgcgcauggcagggcga

SEQ ID NO: 3755972 - RNA, 17 nt, Salmonella typhimurium LT2
cgcgccaaugcgaaaau

SEQ ID NO: 3755973 - RNA, 19 nt, Salmonella typhimurium LT2
cgcgccaauggccgccccc

SEQ ID NO: 3755974 - RNA, 13 nt, Salmonella typhimurium LT2
cgcggacagcaga

SEQ ID NO: 3755975 - RNA, 20 nt, Salmonella typhimurium LT2
cgcggaggguuuugccguca

SEQ ID NO: 3755976 - RNA, 17 nt, Salmonella typhimurium LT2
cgcggauaugcagcagc

SEQ ID NO: 3755977 - RNA, 19 nt, Salmonella typhimurium LT2
cgcggauauggcggcggcu

SEQ ID NO: 3755978 - RNA, 20 nt, Salmonella typhimurium LT2
cgcggaucagacggcugacc

SEQ ID NO: 3755979 - RNA, 22 nt, Salmonella typhimurium LT2
cgcggaucgucgccuugcgaca

SEQ ID NO: 3755980 - RNA, 17 nt, Salmonella typhimurium LT2
cgcggaucgugauaacg

SEQ ID NO: 3755981 - RNA, 22 nt, Salmonella typhimurium LT2
cgcggaucgugauaacgcgaug

SEQ ID NO: 3755982 - RNA, 15 nt, Salmonella typhimurium LT2
cgcggcaaccagccc

SEQ ID NO: 3755983 - RNA, 22 nt, Salmonella typhimurium LT2
cgcggcaauuucacugucgcca

SEQ ID NO: 3755984 - RNA, 22 nt, Salmonella typhimurium LT2
cgcggcacacaacacggcggcu

SEQ ID NO: 3755985 - RNA, 13 nt, Salmonella typhimurium LT2
cgcggcacacagc

SEQ ID NO: 3755986 - RNA, 14 nt, Salmonella typhimurium LT2
cgcggcagcgcgca

SEQ ID NO: 3755987 - RNA, 13 nt, Salmonella typhimurium LT2
cgcggcagcgcug

SEQ ID NO: 3755988 - RNA, 14 nt, Salmonella typhimurium LT2
cgcggcagcgcugc

SEQ ID NO: 3755989 - RNA, 20 nt, Salmonella typhimurium LT2
cgcggcaucguagucaggca

SEQ ID NO: 3755990 - RNA, 21 nt, Salmonella typhimurium LT2
cgcggcaucguagucaggcag

SEQ ID NO: 3755991 - RNA, 15 nt, Salmonella typhimurium LT2
cgcggcauuaaaugc

SEQ ID NO: 3755992 - RNA, 14 nt, Salmonella typhimurium LT2
cgcggcccaaccac

SEQ ID NO: 3755993 - RNA, 18 nt, Salmonella typhimurium LT2
cgcggccuccggcgcgaa

SEQ ID NO: 3755994 - RNA, 19 nt, Salmonella typhimurium LT2
cgcggccuuugccuucgcc

SEQ ID NO: 3755995 - RNA, 16 nt, Salmonella typhimurium LT2
cgcggcgaaccggcau

SEQ ID NO: 3755996 - RNA, 20 nt, Salmonella typhimurium LT2
cgcggcgaaccggcaucggc

SEQ ID NO: 3755997 - RNA, 21 nt, Salmonella typhimurium LT2
cgcggcgacggacucgcgcag

SEQ ID NO: 3755998 - RNA, 20 nt, Salmonella typhimurium LT2
cgcggcgcccauuccgccug

SEQ ID NO: 3755999 - RNA, 17 nt, Salmonella typhimurium LT2
cgcggcgcuacggcgca

SEQ ID NO: 3756000 - RNA, 14 nt, Salmonella typhimurium LT2
cgcggcgcucgcca

SEQ ID NO: 3756001 - RNA, 15 nt, Salmonella typhimurium LT2
cgcggcgcucgccag

SEQ ID NO: 3756002 - RNA, 13 nt, Salmonella typhimurium LT2
cgcggcggaccgc

SEQ ID NO: 3756003 - RNA, 15 nt, Salmonella typhimurium LT2
cgcggcgguucaucc

SEQ ID NO: 3756004 - RNA, 13 nt, Salmonella typhimurium LT2
cgcggcguaccgc

SEQ ID NO: 3756005 - RNA, 19 nt, Salmonella typhimurium LT2
cgcggcguaccgcgcgccc

SEQ ID NO: 3756006 - RNA, 16 nt, Salmonella typhimurium LT2
cgcggcgucgccgccg

SEQ ID NO: 3756007 - RNA, 17 nt, Salmonella typhimurium LT2
cgcggcguucugcgcca

SEQ ID NO: 3756008 - RNA, 21 nt, Salmonella typhimurium LT2
cgcggcuaccgaaggcgcuuu

SEQ ID NO: 3756009 - RNA, 14 nt, Salmonella typhimurium LT2
cgcggcucaccagc

SEQ ID NO: 3756010 - RNA, 13 nt, Salmonella typhimurium LT2
cgcggcuccggcu

SEQ ID NO: 3756011 - RNA, 15 nt, Salmonella typhimurium LT2
cgcggcugccggacu

SEQ ID NO: 3756012 - RNA, 20 nt, Salmonella typhimurium LT2
cgcggcuguucaccacguua

SEQ ID NO: 3756013 - RNA, 19 nt, Salmonella typhimurium LT2
cgcggcuucaucaccaucg

SEQ ID NO: 3756014 - RNA, 24 nt, Salmonella typhimurium LT2
cgcggcuucaucaccaucgccgga

SEQ ID NO: 3756015 - RNA, 18 nt, Salmonella typhimurium LT2
cgcgggccgcggcgcgca

SEQ ID NO: 3756016 - RNA, 14 nt, Salmonella typhimurium LT2
cgcgggccugccug

SEQ ID NO: 3756017 - RNA, 22 nt, Salmonella typhimurium LT2
cgcgggcgguauuauccgccgc

SEQ ID NO: 3756018 - RNA, 12 nt, Salmonella typhimurium LT2
cgcgggcuggcu

SEQ ID NO: 3756019 - RNA, 15 nt, Salmonella typhimurium LT2
cgcgggcuggcuggc

SEQ ID NO: 3756020 - RNA, 16 nt, Salmonella typhimurium LT2
cgcgggcuucacguug

SEQ ID NO: 3756021 - RNA, 12 nt, Salmonella typhimurium LT2
cgcggggaacau

SEQ ID NO: 3756022 - RNA, 18 nt, Salmonella typhimurium LT2
cgcgguauuucgccgccg

SEQ ID NO: 3756023 - RNA, 12 nt, Salmonella typhimurium LT2
cgcggucagcgg

SEQ ID NO: 3756024 - RNA, 18 nt, Salmonella typhimurium LT2
cgcggucagcggcgcgcc

SEQ ID NO: 3756025 - RNA, 19 nt, Salmonella typhimurium LT2
cgcggucagcggcgcgccg

SEQ ID NO: 3756026 - RNA, 21 nt, Salmonella typhimurium LT2
cgcggucauaucuggacgggc

SEQ ID NO: 3756027 - RNA, 16 nt, Salmonella typhimurium LT2
cgcggucgucaucggc

SEQ ID NO: 3756028 - RNA, 23 nt, Salmonella typhimurium LT2
cgcggugacuuuggccggcuucu

SEQ ID NO: 3756029 - RNA, 14 nt, Salmonella typhimurium LT2
cgcgguggcgcaca

SEQ ID NO: 3756030 - RNA, 17 nt, Salmonella typhimurium LT2
cgcgguggguagcggca

SEQ ID NO: 3756031 - RNA, 17 nt, Salmonella typhimurium LT2
cgcgguugacggcuacu

SEQ ID NO: 3756032 - RNA, 15 nt, Salmonella typhimurium LT2
cgcgguuuccacacc

SEQ ID NO: 3756033 - RNA, 23 nt, Salmonella typhimurium LT2
cgcgguuuucccuuuuggcgcag

SEQ ID NO: 3756034 - RNA, 19 nt, Salmonella typhimurium LT2
cgcguaaauaccuuccggc

SEQ ID NO: 3756035 - RNA, 20 nt, Salmonella typhimurium LT2
cgcguaaauccacauuccag

SEQ ID NO: 3756036 - RNA, 17 nt, Salmonella typhimurium LT2
cgcguaaccccugcccg

SEQ ID NO: 3756037 - RNA, 19 nt, Salmonella typhimurium LT2
cgcguaaccccugcccgcg

SEQ ID NO: 3756038 - RNA, 23 nt, Salmonella typhimurium LT2
cgcguaaguuugcguacucagca

SEQ ID NO: 3756039 - RNA, 20 nt, Salmonella typhimurium LT2
cgcguaaucucccacccgcg

SEQ ID NO: 3756040 - RNA, 13 nt, Salmonella typhimurium LT2
cgcguaccagcgc

SEQ ID NO: 3756041 - RNA, 22 nt, Salmonella typhimurium LT2
cgcguacccugcgugaacgacc

SEQ ID NO: 3756042 - RNA, 16 nt, Salmonella typhimurium LT2
cgcguagcccagcgcc

SEQ ID NO: 3756043 - RNA, 18 nt, Salmonella typhimurium LT2
cgcguagcccagcgccgc

SEQ ID NO: 3756044 - RNA, 17 nt, Salmonella typhimurium LT2
cgcguagccucgcuucu

SEQ ID NO: 3756045 - RNA, 16 nt, Salmonella typhimurium LT2
cgcguagcgccaacau

SEQ ID NO: 3756046 - RNA, 21 nt, Salmonella typhimurium LT2
cgcguagguguuacgcggguc

SEQ ID NO: 3756047 - RNA, 19 nt, Salmonella typhimurium LT2
cgcguagguuggcugaggc

SEQ ID NO: 3756048 - RNA, 20 nt, Salmonella typhimurium LT2
cgcguagguuggcugaggcg

SEQ ID NO: 3756049 - RNA, 15 nt, Salmonella typhimurium LT2
cgcguauaacgccgc

SEQ ID NO: 3756050 - RNA, 19 nt, Salmonella typhimurium LT2
cgcguauaacgccgccccc

SEQ ID NO: 3756051 - RNA, 13 nt, Salmonella typhimurium LT2
cgcguaucgucag

SEQ ID NO: 3756052 - RNA, 20 nt, Salmonella typhimurium LT2
cgcguaucuuugauggagau

SEQ ID NO: 3756053 - RNA, 17 nt, Salmonella typhimurium LT2
cgcguauucucaaccag

SEQ ID NO: 3756054 - RNA, 19 nt, Salmonella typhimurium LT2
cgcguauucucaaccagcc

SEQ ID NO: 3756055 - RNA, 12 nt, Salmonella typhimurium LT2
cgcgucagcgcc

SEQ ID NO: 3756056 - RNA, 17 nt, Salmonella typhimurium LT2
cgcgucagcgccuccgc

SEQ ID NO: 3756057 - RNA, 14 nt, Salmonella typhimurium LT2
cgcgucagggcgau

SEQ ID NO: 3756058 - RNA, 18 nt, Salmonella typhimurium LT2
cgcgucagggcgauaaua

SEQ ID NO: 3756059 - RNA, 21 nt, Salmonella typhimurium LT2
cgcgucagugaauguccccug

SEQ ID NO: 3756060 - RNA, 17 nt, Salmonella typhimurium LT2
cgcgucaucggcgcgcu

SEQ ID NO: 3756061 - RNA, 15 nt, Salmonella typhimurium LT2
cgcguccagcccgcu

SEQ ID NO: 3756062 - RNA, 23 nt, Salmonella typhimurium LT2
cgcgucccauggggggcgcguug

SEQ ID NO: 3756063 - RNA, 14 nt, Salmonella typhimurium LT2
cgcgucccucucca

SEQ ID NO: 3756064 - RNA, 12 nt, Salmonella typhimurium LT2
cgcguccggggc

SEQ ID NO: 3756065 - RNA, 19 nt, Salmonella typhimurium LT2
cgcguccggggccagcgcc

SEQ ID NO: 3756066 - RNA, 17 nt, Salmonella typhimurium LT2
cgcgucgaccagacgaa

SEQ ID NO: 3756067 - RNA, 18 nt, Salmonella typhimurium LT2
cgcgucgcagguuaucgg

SEQ ID NO: 3756068 - RNA, 15 nt, Salmonella typhimurium LT2
cgcgucgcauccggc

SEQ ID NO: 3756069 - RNA, 12 nt, Salmonella typhimurium LT2
cgcgucgccauc

SEQ ID NO: 3756070 - RNA, 14 nt, Salmonella typhimurium LT2
cgcgucggacaggg

SEQ ID NO: 3756071 - RNA, 16 nt, Salmonella typhimurium LT2
cgcgucggcgcgggga

SEQ ID NO: 3756072 - RNA, 16 nt, Salmonella typhimurium LT2
cgcgucguucgacgac

SEQ ID NO: 3756073 - RNA, 20 nt, Salmonella typhimurium LT2
cgcgucuuaucuggccuaca

SEQ ID NO: 3756074 - RNA, 18 nt, Salmonella typhimurium LT2
cgcgugaccaucgcguug

SEQ ID NO: 3756075 - RNA, 23 nt, Salmonella typhimurium LT2
cgcgugacgcaguaauacgccgc

SEQ ID NO: 3756076 - RNA, 17 nt, Salmonella typhimurium LT2
cgcgugauacaggcauc

SEQ ID NO: 3756077 - RNA, 15 nt, Salmonella typhimurium LT2
cgcgugcaagggaag

SEQ ID NO: 3756078 - RNA, 15 nt, Salmonella typhimurium LT2
cgcucgccauaucuu

SEQ ID NO: 3756079 - RNA, 14 nt, Salmonella typhimurium LT2
cgcucgccauugcg

SEQ ID NO: 3756080 - RNA, 13 nt, Salmonella typhimurium LT2
cgcucgcccauca

SEQ ID NO: 3756081 - RNA, 14 nt, Salmonella typhimurium LT2
cgcucgcccgcagc

SEQ ID NO: 3756082 - RNA, 16 nt, Salmonella typhimurium LT2
cgcucgcccuucgggc

SEQ ID NO: 3756083 - RNA, 16 nt, Salmonella typhimurium LT2
cgcucgccgccucccc

SEQ ID NO: 3756084 - RNA, 18 nt, Salmonella typhimurium LT2
cgcucgcggaagcgaccg

SEQ ID NO: 3756085 - RNA, 23 nt, Salmonella typhimurium LT2
cgcucgcucaucacaucgcgcag

SEQ ID NO: 3756086 - RNA, 23 nt, Salmonella typhimurium LT2
cgcucgcuggugccaaucuccag

SEQ ID NO: 3756087 - RNA, 20 nt, Salmonella typhimurium LT2
cgcucggcagcagcgcgccg

SEQ ID NO: 3756088 - RNA, 13 nt, Salmonella typhimurium LT2
cgcucggcauaca

SEQ ID NO: 3756089 - RNA, 22 nt, Salmonella typhimurium LT2
cgcucggcauacaccgccagcg

SEQ ID NO: 3756090 - RNA, 13 nt, Salmonella typhimurium LT2
cgcucggccagau

SEQ ID NO: 3756091 - RNA, 16 nt, Salmonella typhimurium LT2
cgcucggccagauaac

SEQ ID NO: 3756092 - RNA, 23 nt, Salmonella typhimurium LT2
cgcucggccagauaacgcgcaua

SEQ ID NO: 3756093 - RNA, 16 nt, Salmonella typhimurium LT2
cgcucguaggccagcg

SEQ ID NO: 3756094 - RNA, 21 nt, Salmonella typhimurium LT2
cgcucgucgcgacguccgcca

SEQ ID NO: 3756095 - RNA, 22 nt, Salmonella typhimurium LT2
cgcucgugauugauucgcgcca

SEQ ID NO: 3756096 - RNA, 23 nt, Salmonella typhimurium LT2
cgcucguuaacccaaauccgcau

SEQ ID NO: 3756097 - RNA, 18 nt, Salmonella typhimurium LT2
cgcucuaucaccgcccgc

SEQ ID NO: 3756098 - RNA, 18 nt, Salmonella typhimurium LT2
cgcucuaucgccgcccgc

SEQ ID NO: 3756099 - RNA, 17 nt, Salmonella typhimurium LT2
cgcucuccgccgcgggc

SEQ ID NO: 3756100 - RNA, 22 nt, Salmonella typhimurium LT2
cgcucucgccacgcuccaucau

SEQ ID NO: 3756101 - RNA, 18 nt, Salmonella typhimurium LT2
cgcucucuuuuggcgaca

SEQ ID NO: 3756102 - RNA, 13 nt, Salmonella typhimurium LT2
cgcucugccuuuu

SEQ ID NO: 3756103 - RNA, 13 nt, Salmonella typhimurium LT2
cgcucuuccgcca

SEQ ID NO: 3756104 - RNA, 15 nt, Salmonella typhimurium LT2
cgcucuuccgccagc

SEQ ID NO: 3756105 - RNA, 21 nt, Salmonella typhimurium LT2
cgcucuucgccaaucgccgcc

SEQ ID NO: 3756106 - RNA, 15 nt, Salmonella typhimurium LT2
cgcucuuuacauaau

SEQ ID NO: 3756107 - RNA, 21 nt, Salmonella typhimurium LT2
cgcugaaaaccgcaucaagcc

SEQ ID NO: 3756108 - RNA, 21 nt, Salmonella typhimurium LT2
cgcugaaaggcauuucuaccg

SEQ ID NO: 3756109 - RNA, 13 nt, Salmonella typhimurium LT2
cgcugaacaaccc

SEQ ID NO: 3756110 - RNA, 13 nt, Salmonella typhimurium LT2
cgcugaagacugg

SEQ ID NO: 3756111 - RNA, 14 nt, Salmonella typhimurium LT2
cgcugaauggcaac

SEQ ID NO: 3756112 - RNA, 15 nt, Salmonella typhimurium LT2
cgcugacacgcgcag

SEQ ID NO: 3756113 - RNA, 23 nt, Salmonella typhimurium LT2
cgcugacaucauccacggcauca

SEQ ID NO: 3756114 - RNA, 16 nt, Salmonella typhimurium LT2
cgcugaccaucaacaa

SEQ ID NO: 3756115 - RNA, 20 nt, Salmonella typhimurium LT2
cgcugacgccagccagccgu

SEQ ID NO: 3756116 - RNA, 13 nt, Salmonella typhimurium LT2
cgcugacgcgauc

SEQ ID NO: 3756117 - RNA, 14 nt, Salmonella typhimurium LT2
cgcugacggcggca

SEQ ID NO: 3756118 - RNA, 13 nt, Salmonella typhimurium LT2
cgcugacguugcg

SEQ ID NO: 3756119 - RNA, 20 nt, Salmonella typhimurium LT2
cgcugacguuggccgccgga

SEQ ID NO: 3756120 - RNA, 14 nt, Salmonella typhimurium LT2
cgcugacucaucac

SEQ ID NO: 3756121 - RNA, 20 nt, Salmonella typhimurium LT2
cgcugagcggcucauccagc

SEQ ID NO: 3756122 - RNA, 14 nt, Salmonella typhimurium LT2
cgcugaggccugca

SEQ ID NO: 3756123 - RNA, 15 nt, Salmonella typhimurium LT2
cgcugaguggcgggc

SEQ ID NO: 3756124 - RNA, 17 nt, Salmonella typhimurium LT2
cgcugaguggcgggcgu

SEQ ID NO: 3756125 - RNA, 22 nt, Salmonella typhimurium LT2
cgcugagugguucgccauccag

SEQ ID NO: 3756126 - RNA, 16 nt, Salmonella typhimurium LT2
cgcugaguuucucccg

SEQ ID NO: 3756127 - RNA, 19 nt, Salmonella typhimurium LT2
cgcugaguuucucccgcca

SEQ ID NO: 3756128 - RNA, 23 nt, Salmonella typhimurium LT2
cgcugaguuucucccgccagaug

SEQ ID NO: 3756129 - RNA, 16 nt, Salmonella typhimurium LT2
cgcugauagccacggc

SEQ ID NO: 3756130 - RNA, 13 nt, Salmonella typhimurium LT2
cgcugaucgccac

SEQ ID NO: 3756131 - RNA, 14 nt, Salmonella typhimurium LT2
cgcugaugacgcgc

SEQ ID NO: 3756132 - RNA, 23 nt, Salmonella typhimurium LT2
cgcugauucuacucugcucgcca

SEQ ID NO: 3756133 - RNA, 16 nt, Salmonella typhimurium LT2
cgcugauuuguuaucu

SEQ ID NO: 3756134 - RNA, 14 nt, Salmonella typhimurium LT2
cgcugcaacccgcc

SEQ ID NO: 3756135 - RNA, 16 nt, Salmonella typhimurium LT2
cgcugcaacccgccgc

SEQ ID NO: 3756136 - RNA, 19 nt, Salmonella typhimurium LT2
cgcugcaacccgccgccau

SEQ ID NO: 3756137 - RNA, 14 nt, Salmonella typhimurium LT2
cgcugcacaaucgc

SEQ ID NO: 3756138 - RNA, 14 nt, Salmonella typhimurium LT2
cgcugcaguuuauu

SEQ ID NO: 3756139 - RNA, 18 nt, Salmonella typhimurium LT2
cgcugcauaaaacugagu

SEQ ID NO: 3756140 - RNA, 23 nt, Salmonella typhimurium LT2
cgcugccacaauggcaggcagca

SEQ ID NO: 3756141 - RNA, 21 nt, Salmonella typhimurium LT2
cgcugccacacucucuccagu

SEQ ID NO: 3756142 - RNA, 14 nt, Salmonella typhimurium LT2
cgcugccacccggc

SEQ ID NO: 3756143 - RNA, 16 nt, Salmonella typhimurium LT2
cgcugccgcccuuucc

SEQ ID NO: 3756144 - RNA, 19 nt, Salmonella typhimurium LT2
cgcugccgcccuuucccga

SEQ ID NO: 3756145 - RNA, 19 nt, Salmonella typhimurium LT2
cgcugccggaaagccccag

SEQ ID NO: 3756146 - RNA, 21 nt, Salmonella typhimurium LT2
cgcugccuuuaauugccugac

SEQ ID NO: 3756147 - RNA, 14 nt, Salmonella typhimurium LT2
cgcugcgcaggcgu

SEQ ID NO: 3756148 - RNA, 14 nt, Salmonella typhimurium LT2
cgcugcgccagauc

SEQ ID NO: 3756149 - RNA, 17 nt, Salmonella typhimurium LT2
cgcugcgccgcgccgcc

SEQ ID NO: 3756150 - RNA, 18 nt, Salmonella typhimurium LT2
cgcugcgccugcugccag

SEQ ID NO: 3756151 - RNA, 18 nt, Salmonella typhimurium LT2
cgcugcgcucaucagacc

SEQ ID NO: 3756152 - RNA, 17 nt, Salmonella typhimurium LT2
cgcugcgcucgcccuuc

SEQ ID NO: 3756153 - RNA, 20 nt, Salmonella typhimurium LT2
cgcugcgcuuaccaggccua

SEQ ID NO: 3756154 - RNA, 19 nt, Salmonella typhimurium LT2
cgcugcgcuuaccgggccu

SEQ ID NO: 3756155 - RNA, 17 nt, Salmonella typhimurium LT2
cgcugcgcuuauccggc

SEQ ID NO: 3756156 - RNA, 19 nt, Salmonella typhimurium LT2
cgcugcgcuuauccggccu

SEQ ID NO: 3756157 - RNA, 22 nt, Salmonella typhimurium LT2
cgcugcggcguggcgcauucca

SEQ ID NO: 3756158 - RNA, 17 nt, Salmonella typhimurium LT2
cgcugcggucaggaaug

SEQ ID NO: 3756159 - RNA, 17 nt, Salmonella typhimurium LT2
cgcugcguuugccgccu

SEQ ID NO: 3756160 - RNA, 20 nt, Salmonella typhimurium LT2
cgcugcugaccuuaauccag

SEQ ID NO: 3756161 - RNA, 18 nt, Salmonella typhimurium LT2
cgcugcuguaacagacgc

SEQ ID NO: 3756162 - RNA, 22 nt, Salmonella typhimurium LT2
cgcugcuguaacagacgcaggc

SEQ ID NO: 3756163 - RNA, 13 nt, Salmonella typhimurium LT2
cgcuggaaagcgg

SEQ ID NO: 3756164 - RNA, 15 nt, Salmonella typhimurium LT2
cgcuggaaagcggca

SEQ ID NO: 3756165 - RNA, 23 nt, Salmonella typhimurium LT2
cgcuggaaguacgccucgcgcac

SEQ ID NO: 3756166 - RNA, 16 nt, Salmonella typhimurium LT2
cgcuggaauaaacggu

SEQ ID NO: 3756167 - RNA, 14 nt, Salmonella typhimurium LT2
cgcuggaaucaucc

SEQ ID NO: 3756168 - RNA, 20 nt, Salmonella typhimurium LT2
cgcuggaaugcgcgcgugac

SEQ ID NO: 3756169 - RNA, 13 nt, Salmonella typhimurium LT2
cgcuggacauuaa

SEQ ID NO: 3756170 - RNA, 23 nt, Salmonella typhimurium LT2
cgcuggagccuguuccagcugcg

SEQ ID NO: 3756171 - RNA, 23 nt, Salmonella typhimurium LT2
cgcuggcaauaaagcagggcggc

SEQ ID NO: 3756172 - RNA, 16 nt, Salmonella typhimurium LT2
cgcuggcacaggaugu

SEQ ID NO: 3756173 - RNA, 18 nt, Salmonella typhimurium LT2
cgcuggccgguugggcgc

SEQ ID NO: 3756174 - RNA, 15 nt, Salmonella typhimurium LT2
cgcuggccuccagca

SEQ ID NO: 3756175 - RNA, 16 nt, Salmonella typhimurium LT2
cgcuggccuccagcac

SEQ ID NO: 3756176 - RNA, 20 nt, Salmonella typhimurium LT2
cgcuggcgcaaagaaggcau

SEQ ID NO: 3756177 - RNA, 16 nt, Salmonella typhimurium LT2
cgcuggcgcgccugcu

SEQ ID NO: 3756178 - RNA, 12 nt, Salmonella typhimurium LT2
cgcuggcgcugc

SEQ ID NO: 3756179 - RNA, 15 nt, Salmonella typhimurium LT2
cgcuggcggcaggcc

SEQ ID NO: 3756180 - RNA, 17 nt, Salmonella typhimurium LT2
cgcuggcguccagccug

SEQ ID NO: 3756181 - RNA, 23 nt, Salmonella typhimurium LT2
cgcuggcugaaccccuguucaaa

SEQ ID NO: 3756182 - RNA, 23 nt, Salmonella typhimurium LT2
cggaaagaagaauaagccggaug

SEQ ID NO: 3756183 - RNA, 15 nt, Salmonella typhimurium LT2
cggaaagaauaaucg

SEQ ID NO: 3756184 - RNA, 20 nt, Salmonella typhimurium LT2
cggaaaggacguucuucucc

SEQ ID NO: 3756185 - RNA, 22 nt, Salmonella typhimurium LT2
cggaaaggacuuaucaggccua

SEQ ID NO: 3756186 - RNA, 23 nt, Salmonella typhimurium LT2
cggaaaucacaaacaccaccagu

SEQ ID NO: 3756187 - RNA, 15 nt, Salmonella typhimurium LT2
cggaacaguccagga

SEQ ID NO: 3756188 - RNA, 21 nt, Salmonella typhimurium LT2
cggaacaguccaggaaagagg

SEQ ID NO: 3756189 - RNA, 19 nt, Salmonella typhimurium LT2
cggaaccaaaauagauaau

SEQ ID NO: 3756190 - RNA, 16 nt, Salmonella typhimurium LT2
cggaacccagcaaauc

SEQ ID NO: 3756191 - RNA, 16 nt, Salmonella typhimurium LT2
cggaaccgaccgcgau

SEQ ID NO: 3756192 - RNA, 20 nt, Salmonella typhimurium LT2
cggaacggggaaccagcacg

SEQ ID NO: 3756193 - RNA, 12 nt, Salmonella typhimurium LT2
cggaacguccag

SEQ ID NO: 3756194 - RNA, 22 nt, Salmonella typhimurium LT2
cggaacgucuuuuuccagcagc

SEQ ID NO: 3756195 - RNA, 16 nt, Salmonella typhimurium LT2
cggaacuggugaaaca

SEQ ID NO: 3756196 - RNA, 17 nt, Salmonella typhimurium LT2
cggaagacuggcgcagc

SEQ ID NO: 3756197 - RNA, 19 nt, Salmonella typhimurium LT2
cggaagacuggcgcagcaa

SEQ ID NO: 3756198 - RNA, 18 nt, Salmonella typhimurium LT2
cggaagcagauaccagcc

SEQ ID NO: 3756199 - RNA, 16 nt, Salmonella typhimurium LT2
cggaauaauguaaaaa

SEQ ID NO: 3756200 - RNA, 20 nt, Salmonella typhimurium LT2
cggaauaauguaaaaaaaua

SEQ ID NO: 3756201 - RNA, 20 nt, Salmonella typhimurium LT2
cggaauagacggccugcaaa

SEQ ID NO: 3756202 - RNA, 15 nt, Salmonella typhimurium LT2
cggaauaucuuuuuu

SEQ ID NO: 3756203 - RNA, 19 nt, Salmonella typhimurium LT2
cggaauaugcgcuuuuuuc

SEQ ID NO: 3756204 - RNA, 14 nt, Salmonella typhimurium LT2
cggaauccaccaua

SEQ ID NO: 3756205 - RNA, 20 nt, Salmonella typhimurium LT2
cggaauccccgccgccagua

SEQ ID NO: 3756206 - RNA, 18 nt, Salmonella typhimurium LT2
cggaaucggacacuugca

SEQ ID NO: 3756207 - RNA, 24 nt, Salmonella typhimurium LT2
cggaaugacaaacgccaccgcuac

SEQ ID NO: 3756208 - RNA, 19 nt, Salmonella typhimurium LT2
cggaaugaccugagcgugc

SEQ ID NO: 3756209 - RNA, 15 nt, Salmonella typhimurium LT2
cggaaugaugugcua

SEQ ID NO: 3756210 - RNA, 17 nt, Salmonella typhimurium LT2
cggaaugaugugcuauu

SEQ ID NO: 3756211 - RNA, 13 nt, Salmonella typhimurium LT2
cggaaugcccacg

SEQ ID NO: 3756212 - RNA, 23 nt, Salmonella typhimurium LT2
cggaaugccguauaccagcguca

SEQ ID NO: 3756213 - RNA, 23 nt, Salmonella typhimurium LT2
cggaauucuguucaguggcguag

SEQ ID NO: 3756214 - RNA, 13 nt, Salmonella typhimurium LT2
cggaauugguaga

SEQ ID NO: 3756215 - RNA, 15 nt, Salmonella typhimurium LT2
cggacacccgcagcc

SEQ ID NO: 3756216 - RNA, 16 nt, Salmonella typhimurium LT2
cggacacgcucauaaa

SEQ ID NO: 3756217 - RNA, 20 nt, Salmonella typhimurium LT2
cggacacggcgucaaaucca

SEQ ID NO: 3756218 - RNA, 12 nt, Salmonella typhimurium LT2
cggacacuaauu

SEQ ID NO: 3756219 - RNA, 14 nt, Salmonella typhimurium LT2
cggacacuugcagc

SEQ ID NO: 3756220 - RNA, 15 nt, Salmonella typhimurium LT2
cggacagcagaauau

SEQ ID NO: 3756221 - RNA, 12 nt, Salmonella typhimurium LT2
cggacagcagca

SEQ ID NO: 3756222 - RNA, 15 nt, Salmonella typhimurium LT2
cggacagcggcagcg

SEQ ID NO: 3756223 - RNA, 15 nt, Salmonella typhimurium LT2
cggaccccucuucuu

SEQ ID NO: 3756224 - RNA, 19 nt, Salmonella typhimurium LT2
cggaccgauaacaggaacg

SEQ ID NO: 3756225 - RNA, 20 nt, Salmonella typhimurium LT2
cggacgagcgcgucagcgcc

SEQ ID NO: 3756226 - RNA, 21 nt, Salmonella typhimurium LT2
cggacgauagccaugcccggc

SEQ ID NO: 3756227 - RNA, 12 nt, Salmonella typhimurium LT2
cggacgcaucgc

SEQ ID NO: 3756228 - RNA, 20 nt, Salmonella typhimurium LT2
cggacgcugacgccaggcca

SEQ ID NO: 3756229 - RNA, 14 nt, Salmonella typhimurium LT2
cggacggcgcagcg

SEQ ID NO: 3756230 - RNA, 16 nt, Salmonella typhimurium LT2
cggacguggggguuca

SEQ ID NO: 3756231 - RNA, 16 nt, Salmonella typhimurium LT2
cggacuaauacuugcc

SEQ ID NO: 3756232 - RNA, 16 nt, Salmonella typhimurium LT2
cggacuagacagccuc

SEQ ID NO: 3756233 - RNA, 13 nt, Salmonella typhimurium LT2
cggacucagggug

SEQ ID NO: 3756234 - RNA, 23 nt, Salmonella typhimurium LT2
cggacugauaccgcguuugcgca

SEQ ID NO: 3756235 - RNA, 12 nt, Salmonella typhimurium LT2
cggacugcucgc

SEQ ID NO: 3756236 - RNA, 11 nt, Salmonella typhimurium LT2
cggacugcugg

SEQ ID NO: 3756237 - RNA, 21 nt, Salmonella typhimurium LT2
cggacugggcugauacgccug

SEQ ID NO: 3756238 - RNA, 21 nt, Salmonella typhimurium LT2
cggagagagcaacuggcaaua

SEQ ID NO: 3756239 - RNA, 21 nt, Salmonella typhimurium LT2
cggagagaguauaagcgccgc

SEQ ID NO: 3756240 - RNA, 16 nt, Salmonella typhimurium LT2
cggagagaugccgcca

SEQ ID NO: 3756241 - RNA, 18 nt, Salmonella typhimurium LT2
cggagagaugccgccagu

SEQ ID NO: 3756242 - RNA, 21 nt, Salmonella typhimurium LT2
cggagagcauuuguagcggca

SEQ ID NO: 3756243 - RNA, 18 nt, Salmonella typhimurium LT2
cggagagucgcaccgcgc

SEQ ID NO: 3756244 - RNA, 21 nt, Salmonella typhimurium LT2
cggagaguucauagcgcacaa

SEQ ID NO: 3756245 - RNA, 21 nt, Salmonella typhimurium LT2
cggagaucagcaguugcgacu

SEQ ID NO: 3756246 - RNA, 15 nt, Salmonella typhimurium LT2
cggagaucuccagau

SEQ ID NO: 3756247 - RNA, 16 nt, Salmonella typhimurium LT2
cggagauggcgaagga

SEQ ID NO: 3756248 - RNA, 18 nt, Salmonella typhimurium LT2
cggagauuaacagcgcga

SEQ ID NO: 3756249 - RNA, 20 nt, Salmonella typhimurium LT2
cggagauuaacagcgcgacc

SEQ ID NO: 3756250 - RNA, 20 nt, Salmonella typhimurium LT2
cggagccaaaagaaguggca

SEQ ID NO: 3756251 - RNA, 18 nt, Salmonella typhimurium LT2
cggagccgccauccggca

SEQ ID NO: 3756252 - RNA, 19 nt, Salmonella typhimurium LT2
cggaggaauccaugaccgu

SEQ ID NO: 3756253 - RNA, 23 nt, Salmonella typhimurium LT2
cggaggaccugauuaaucagcuc

SEQ ID NO: 3756254 - RNA, 23 nt, Salmonella typhimurium LT2
cggaggauauuuauuaguguuau

SEQ ID NO: 3756255 - RNA, 21 nt, Salmonella typhimurium LT2
cggaggccagauucaccacca

SEQ ID NO: 3756256 - RNA, 16 nt, Salmonella typhimurium LT2
cggaggggaccuaaug

SEQ ID NO: 3756257 - RNA, 21 nt, Salmonella typhimurium LT2
cggagggggaggcaggcaaca

SEQ ID NO: 3756258 - RNA, 14 nt, Salmonella typhimurium LT2
cggaguccagcaac

SEQ ID NO: 3756259 - RNA, 14 nt, Salmonella typhimurium LT2
cggaguugaugguu

SEQ ID NO: 3756260 - RNA, 19 nt, Salmonella typhimurium LT2
cggauaaaaacccugccga

SEQ ID NO: 3756261 - RNA, 12 nt, Salmonella typhimurium LT2
cggauaaauguu

SEQ ID NO: 3756262 - RNA, 13 nt, Salmonella typhimurium LT2
cggauaaauguuu

SEQ ID NO: 3756263 - RNA, 14 nt, Salmonella typhimurium LT2
cggauaagacgcua

SEQ ID NO: 3756264 - RNA, 18 nt, Salmonella typhimurium LT2
cggauaagcaaagcgcca

SEQ ID NO: 3756265 - RNA, 19 nt, Salmonella typhimurium LT2
cggauaagcaaagcgccau

SEQ ID NO: 3756266 - RNA, 19 nt, Salmonella typhimurium LT2
cggauaagcauuagcgcca

SEQ ID NO: 3756267 - RNA, 20 nt, Salmonella typhimurium LT2
cggauaagcauuagcgccau

SEQ ID NO: 3756268 - RNA, 18 nt, Salmonella typhimurium LT2
cggauaagcgcagcgcca

SEQ ID NO: 3756269 - RNA, 19 nt, Salmonella typhimurium LT2
cggauaagcguagcgcauc

SEQ ID NO: 3756270 - RNA, 18 nt, Salmonella typhimurium LT2
cggauaagcguagcgcca

SEQ ID NO: 3756271 - RNA, 19 nt, Salmonella typhimurium LT2
cggauaagcgucagcgcca

SEQ ID NO: 3756272 - RNA, 19 nt, Salmonella typhimurium LT2
cggauaagcguuagcgcca

SEQ ID NO: 3756273 - RNA, 18 nt, Salmonella typhimurium LT2
cggauaaggcgcagccgc

SEQ ID NO: 3756274 - RNA, 21 nt, Salmonella typhimurium LT2
cggauaaggcgcagccgccau

SEQ ID NO: 3756275 - RNA, 22 nt, Salmonella typhimurium LT2
cggauaaggcgcagccgccauc

SEQ ID NO: 3756276 - RNA, 20 nt, Salmonella typhimurium LT2
cggauaaggcggagccgcca

SEQ ID NO: 3756277 - RNA, 24 nt, Salmonella typhimurium LT2
cggauaaggcguucacgccgccau

SEQ ID NO: 3756278 - RNA, 23 nt, Salmonella typhimurium LT2
cggauaagguguuuacgccgcca

SEQ ID NO: 3756279 - RNA, 14 nt, Salmonella typhimurium LT2
cggauaauaucuuu

SEQ ID NO: 3756280 - RNA, 21 nt, Salmonella typhimurium LT2
cggauacaagguauccgccau

SEQ ID NO: 3756281 - RNA, 18 nt, Salmonella typhimurium LT2
cggauaccguccaccagc

SEQ ID NO: 3756282 - RNA, 19 nt, Salmonella typhimurium LT2
cggauaccguccaccagca

SEQ ID NO: 3756283 - RNA, 23 nt, Salmonella typhimurium LT2
cggauagacuuaggaauacccag

SEQ ID NO: 3756284 - RNA, 22 nt, Salmonella typhimurium LT2
cggauagcaacgcgaagcagcu

SEQ ID NO: 3756285 - RNA, 15 nt, Salmonella typhimurium LT2
cggcaggccggcagc

SEQ ID NO: 3756286 - RNA, 17 nt, Salmonella typhimurium LT2
cggcaggccggcagccu

SEQ ID NO: 3756287 - RNA, 13 nt, Salmonella typhimurium LT2
cggcaggccgugg

SEQ ID NO: 3756288 - RNA, 16 nt, Salmonella typhimurium LT2
cggcaggcgucauagc

SEQ ID NO: 3756289 - RNA, 18 nt, Salmonella typhimurium LT2
cggcagguagucauauuc

SEQ ID NO: 3756290 - RNA, 20 nt, Salmonella typhimurium LT2
cggcaguaacuucagcauca

SEQ ID NO: 3756291 - RNA, 18 nt, Salmonella typhimurium LT2
cggcaguaagccagcggg

SEQ ID NO: 3756292 - RNA, 20 nt, Salmonella typhimurium LT2
cggcaguaagccagcgggcg

SEQ ID NO: 3756293 - RNA, 20 nt, Salmonella typhimurium LT2
cggcaguccuugcagccaga

SEQ ID NO: 3756294 - RNA, 16 nt, Salmonella typhimurium LT2
cggcagucgcuacaac

SEQ ID NO: 3756295 - RNA, 22 nt, Salmonella typhimurium LT2
cggcaguggcauguucccaugu

SEQ ID NO: 3756296 - RNA, 19 nt, Salmonella typhimurium LT2
cggcauaaaacgggucgcu

SEQ ID NO: 3756297 - RNA, 16 nt, Salmonella typhimurium LT2
cggcauaacccgccgc

SEQ ID NO: 3756298 - RNA, 20 nt, Salmonella typhimurium LT2
cggcauaagccagcccugcc

SEQ ID NO: 3756299 - RNA, 12 nt, Salmonella typhimurium LT2
cggcauacagcg

SEQ ID NO: 3756300 - RNA, 23 nt, Salmonella typhimurium LT2
cggcauacaggccgccgggucag

SEQ ID NO: 3756301 - RNA, 16 nt, Salmonella typhimurium LT2
cggcauaugcaggucg

SEQ ID NO: 3756302 - RNA, 19 nt, Salmonella typhimurium LT2
cggcauaugcaggucgcgc

SEQ ID NO: 3756303 - RNA, 23 nt, Salmonella typhimurium LT2
cggcaucaauaacggcaacguca

SEQ ID NO: 3756304 - RNA, 14 nt, Salmonella typhimurium LT2
cggcaucaggaaaa

SEQ ID NO: 3756305 - RNA, 17 nt, Salmonella typhimurium LT2
cggcaucccaggcgucc

SEQ ID NO: 3756306 - RNA, 18 nt, Salmonella typhimurium LT2
cggcaucccuuucauuuu

SEQ ID NO: 3756307 - RNA, 17 nt, Salmonella typhimurium LT2
cggcaucggcagcguca

SEQ ID NO: 3756308 - RNA, 19 nt, Salmonella typhimurium LT2
cggcaucguagucaggcag

SEQ ID NO: 3756309 - RNA, 19 nt, Salmonella typhimurium LT2
cggcaucucuucguucagg

SEQ ID NO: 3756310 - RNA, 20 nt, Salmonella typhimurium LT2
cggcaucuuuaaccgccugc

SEQ ID NO: 3756311 - RNA, 22 nt, Salmonella typhimurium LT2
cggcaucuuuaaccgccugcuc

SEQ ID NO: 3756312 - RNA, 23 nt, Salmonella typhimurium LT2
cggcauggacguguuccgcgucu

SEQ ID NO: 3756313 - RNA, 13 nt, Salmonella typhimurium LT2
cggcauggucagc

SEQ ID NO: 3756314 - RNA, 15 nt, Salmonella typhimurium LT2
cggcauggucagcau

SEQ ID NO: 3756315 - RNA, 16 nt, Salmonella typhimurium LT2
cggcaugucgccagcc

SEQ ID NO: 3756316 - RNA, 17 nt, Salmonella typhimurium LT2
cggcauuagcaugggcu

SEQ ID NO: 3756317 - RNA, 17 nt, Salmonella typhimurium LT2
cggcauucacgucgcgc

SEQ ID NO: 3756318 - RNA, 20 nt, Salmonella typhimurium LT2
cggcauucacgucgcgcgcc

SEQ ID NO: 3756319 - RNA, 22 nt, Salmonella typhimurium LT2
cggcauucgcacacuauuccgc

SEQ ID NO: 3756320 - RNA, 18 nt, Salmonella typhimurium LT2
cggcauugcagcgcgugg

SEQ ID NO: 3756321 - RNA, 20 nt, Salmonella typhimurium LT2
cggcauuucaccgccaauaa

SEQ ID NO: 3756322 - RNA, 12 nt, Salmonella typhimurium LT2
cggcauuuuuaa

SEQ ID NO: 3756323 - RNA, 22 nt, Salmonella typhimurium LT2
cggccaaagcgcgacuggaacg

SEQ ID NO: 3756324 - RNA, 14 nt, Salmonella typhimurium LT2
cggccaaagggagc

SEQ ID NO: 3756325 - RNA, 16 nt, Salmonella typhimurium LT2
cggccacagcgccaga

SEQ ID NO: 3756326 - RNA, 14 nt, Salmonella typhimurium LT2
cggccaccaggccu

SEQ ID NO: 3756327 - RNA, 17 nt, Salmonella typhimurium LT2
cggccacgcuaaaguca

SEQ ID NO: 3756328 - RNA, 16 nt, Salmonella typhimurium LT2
cggccagaaccugcuc

SEQ ID NO: 3756329 - RNA, 17 nt, Salmonella typhimurium LT2
cggccagaaugcccagc

SEQ ID NO: 3756330 - RNA, 21 nt, Salmonella typhimurium LT2
cggccagauaguggcugaggc

SEQ ID NO: 3756331 - RNA, 17 nt, Salmonella typhimurium LT2
cggccagcaagcggcga

SEQ ID NO: 3756332 - RNA, 19 nt, Salmonella typhimurium LT2
cggccagcgagucgccgcu

SEQ ID NO: 3756333 - RNA, 20 nt, Salmonella typhimurium LT2
cggccaguucuuguaguuuu

SEQ ID NO: 3756334 - RNA, 20 nt, Salmonella typhimurium LT2
cggccaucaugcaggccgga

SEQ ID NO: 3756335 - RNA, 23 nt, Salmonella typhimurium LT2
cggccauuccauaacccggcuga

SEQ ID NO: 3756336 - RNA, 22 nt, Salmonella typhimurium LT2
cggcccaaccacuacugcguca

SEQ ID NO: 3756337 - RNA, 15 nt, Salmonella typhimurium LT2
cggcccacgcgcaga

SEQ ID NO: 3756338 - RNA, 13 nt, Salmonella typhimurium LT2
cggcccaggcauc

SEQ ID NO: 3756339 - RNA, 22 nt, Salmonella typhimurium LT2
cggcccaggcaucgacgccagc

SEQ ID NO: 3756340 - RNA, 14 nt, Salmonella typhimurium LT2
cggccccgggcgac

SEQ ID NO: 3756341 - RNA, 13 nt, Salmonella typhimurium LT2
cggcccgcgcuga

SEQ ID NO: 3756342 - RNA, 23 nt, Salmonella typhimurium LT2
cggcccgcuucauuggcgucugc

SEQ ID NO: 3756343 - RNA, 20 nt, Salmonella typhimurium LT2
cggcccguacugaacccggg

SEQ ID NO: 3756344 - RNA, 18 nt, Salmonella typhimurium LT2
cggcccgugccagcuauc

SEQ ID NO: 3756345 - RNA, 14 nt, Salmonella typhimurium LT2
cggccgaggcagcg

SEQ ID NO: 3756346 - RNA, 22 nt, Salmonella typhimurium LT2
cggccgcaguuuuccagcgccu

SEQ ID NO: 3756347 - RNA, 15 nt, Salmonella typhimurium LT2
cggccggaugccagu

SEQ ID NO: 3756348 - RNA, 17 nt, Salmonella typhimurium LT2
cggccuacaaagccaaa

SEQ ID NO: 3756349 - RNA, 20 nt, Salmonella typhimurium LT2
cggccuacaagccgccucgc

SEQ ID NO: 3756350 - RNA, 15 nt, Salmonella typhimurium LT2
cggccuacacaagcu

SEQ ID NO: 3756351 - RNA, 18 nt, Salmonella typhimurium LT2
cggccuacacaucaucuu

SEQ ID NO: 3756352 - RNA, 22 nt, Salmonella typhimurium LT2
cggccuacauucucuuucgcug

SEQ ID NO: 3756353 - RNA, 21 nt, Salmonella typhimurium LT2
cggccuccaaaugaugcuuuc

SEQ ID NO: 3756354 - RNA, 15 nt, Salmonella typhimurium LT2
cggccuccaccaccu

SEQ ID NO: 3756355 - RNA, 17 nt, Salmonella typhimurium LT2
cggccuccgcagcuuca

SEQ ID NO: 3756356 - RNA, 13 nt, Salmonella typhimurium LT2
cggccuccgguga

SEQ ID NO: 3756357 - RNA, 16 nt, Salmonella typhimurium LT2
cggccugcaggcaacg

SEQ ID NO: 3756358 - RNA, 14 nt, Salmonella typhimurium LT2
cggccugcgcugga

SEQ ID NO: 3756359 - RNA, 13 nt, Salmonella typhimurium LT2
cggccugcggcga

SEQ ID NO: 3756360 - RNA, 22 nt, Salmonella typhimurium LT2
cggccugcggugguggggccua

SEQ ID NO: 3756361 - RNA, 18 nt, Salmonella typhimurium LT2
cggccugcuuuaacgcgc

SEQ ID NO: 3756362 - RNA, 17 nt, Salmonella typhimurium LT2
cggccugucuccgcagc

SEQ ID NO: 3756363 - RNA, 18 nt, Salmonella typhimurium LT2
cggccuuugccuucgccg

SEQ ID NO: 3756364 - RNA, 20 nt, Salmonella typhimurium LT2
cggcgaaaaaccaggcaaca

SEQ ID NO: 3756365 - RNA, 14 nt, Salmonella typhimurium LT2
cggcgaaacgccuu

SEQ ID NO: 3756366 - RNA, 22 nt, Salmonella typhimurium LT2
cggcgaaacgccuuauccggcc

SEQ ID NO: 3756367 - RNA, 20 nt, Salmonella typhimurium LT2
cggcgaaagaaaauugucca

SEQ ID NO: 3756368 - RNA, 20 nt, Salmonella typhimurium LT2
cggcgaaaucgugcgcccca

SEQ ID NO: 3756369 - RNA, 16 nt, Salmonella typhimurium LT2
cggcgaacaggcguaa

SEQ ID NO: 3756370 - RNA, 19 nt, Salmonella typhimurium LT2
cggcgaaccggcaucggca

SEQ ID NO: 3756371 - RNA, 21 nt, Salmonella typhimurium LT2
cggcgaaccggcaucggcagc

SEQ ID NO: 3756372 - RNA, 14 nt, Salmonella typhimurium LT2
cggcgaacgcgcgc

SEQ ID NO: 3756373 - RNA, 17 nt, Salmonella typhimurium LT2
cggcgaacgcgcgcgcu

SEQ ID NO: 3756374 - RNA, 16 nt, Salmonella typhimurium LT2
cggcgaacgcuggcug

SEQ ID NO: 3756375 - RNA, 15 nt, Salmonella typhimurium LT2
cggcgaaggucgcgc

SEQ ID NO: 3756376 - RNA, 17 nt, Salmonella typhimurium LT2
cggcgaauagucgccgc

SEQ ID NO: 3756377 - RNA, 14 nt, Salmonella typhimurium LT2
cggcgaaucaccga

SEQ ID NO: 3756378 - RNA, 16 nt, Salmonella typhimurium LT2
cggcgacaagaauaug

SEQ ID NO: 3756379 - RNA, 14 nt, Salmonella typhimurium LT2
cggcgacaggcaca

SEQ ID NO: 3756380 - RNA, 20 nt, Salmonella typhimurium LT2
cggcgaccuucacgccgcca

SEQ ID NO: 3756381 - RNA, 21 nt, Salmonella typhimurium LT2
cggcgaccuucacgccgccaa

SEQ ID NO: 3756382 - RNA, 20 nt, Salmonella typhimurium LT2
cggcgacgcccgccaucugc

SEQ ID NO: 3756383 - RNA, 20 nt, Salmonella typhimurium LT2
cggcgacggacucgcgcaga

SEQ ID NO: 3756384 - RNA, 16 nt, Salmonella typhimurium LT2
cggcgacgugacgcgc

SEQ ID NO: 3756385 - RNA, 20 nt, Salmonella typhimurium LT2
cggcgacgugacgcgccagc

SEQ ID NO: 3756386 - RNA, 15 nt, Salmonella typhimurium LT2
cggcgagcaguacgc

SEQ ID NO: 3756387 - RNA, 13 nt, Salmonella typhimurium LT2
cggcgagcggcua

SEQ ID NO: 3756388 - RNA, 22 nt, Salmonella typhimurium LT2
cggcucaccagcugacgcagca

SEQ ID NO: 3756389 - RNA, 20 nt, Salmonella typhimurium LT2
cggcucauccagcagcauga

SEQ ID NO: 3756390 - RNA, 11 nt, Salmonella typhimurium LT2
cggcuccagau

SEQ ID NO: 3756391 - RNA, 14 nt, Salmonella typhimurium LT2
cggcuccagcgcca

SEQ ID NO: 3756392 - RNA, 16 nt, Salmonella typhimurium LT2
cggcuccagcgccagc

SEQ ID NO: 3756393 - RNA, 17 nt, Salmonella typhimurium LT2
cggcuccagcgccagcu

SEQ ID NO: 3756394 - RNA, 12 nt, Salmonella typhimurium LT2
cggcuccggcaa

SEQ ID NO: 3756395 - RNA, 19 nt, Salmonella typhimurium LT2
cggcucgguuuauccccgc

SEQ ID NO: 3756396 - RNA, 23 nt, Salmonella typhimurium LT2
cggcugaccugaacgccuaccgc

SEQ ID NO: 3756397 - RNA, 22 nt, Salmonella typhimurium LT2
cggcugacgauacucagcccca

SEQ ID NO: 3756398 - RNA, 18 nt, Salmonella typhimurium LT2
cggcugacgcccaucagc

SEQ ID NO: 3756399 - RNA, 18 nt, Salmonella typhimurium LT2
cggcugaguucaggcacg

SEQ ID NO: 3756400 - RNA, 23 nt, Salmonella typhimurium LT2
cggcugaguucaggcacgugcau

SEQ ID NO: 3756401 - RNA, 16 nt, Salmonella typhimurium LT2
cggcugcacaaaauac

SEQ ID NO: 3756402 - RNA, 18 nt, Salmonella typhimurium LT2
cggcugcacaaaauacug

SEQ ID NO: 3756403 - RNA, 13 nt, Salmonella typhimurium LT2
cggcugccugccg

SEQ ID NO: 3756404 - RNA, 19 nt, Salmonella typhimurium LT2
cggcugcgccuuauccggc

SEQ ID NO: 3756405 - RNA, 21 nt, Salmonella typhimurium LT2
cggcugcgccuuauccggccu

SEQ ID NO: 3756406 - RNA, 12 nt, Salmonella typhimurium LT2
cggcugcggauu

SEQ ID NO: 3756407 - RNA, 21 nt, Salmonella typhimurium LT2
cggcugcgucgcuuccuguuc

SEQ ID NO: 3756408 - RNA, 19 nt, Salmonella typhimurium LT2
cggcuggacaugcuccgcc

SEQ ID NO: 3756409 - RNA, 21 nt, Salmonella typhimurium LT2
cggcuggacaugcuccgcccc

SEQ ID NO: 3756410 - RNA, 19 nt, Salmonella typhimurium LT2
cggcuggacgucaugccgc

SEQ ID NO: 3756411 - RNA, 22 nt, Salmonella typhimurium LT2
cggcuggacgucaugccgccac

SEQ ID NO: 3756412 - RNA, 17 nt, Salmonella typhimurium LT2
cggcuguagccagccug

SEQ ID NO: 3756413 - RNA, 13 nt, Salmonella typhimurium LT2
cggcugucaucaa

SEQ ID NO: 3756414 - RNA, 22 nt, Salmonella typhimurium LT2
cggcuguguccgccaugugcug

SEQ ID NO: 3756415 - RNA, 16 nt, Salmonella typhimurium LT2
cggcuguguucauccc

SEQ ID NO: 3756416 - RNA, 19 nt, Salmonella typhimurium LT2
cggcuuaaugcccggcccg

SEQ ID NO: 3756417 - RNA, 13 nt, Salmonella typhimurium LT2
cggcuuacccuga

SEQ ID NO: 3756418 - RNA, 20 nt, Salmonella typhimurium LT2
cggcuuacugcuucgcgccu

SEQ ID NO: 3756419 - RNA, 21 nt, Salmonella typhimurium LT2
cggcuuauccggccugcacga

SEQ ID NO: 3756420 - RNA, 12 nt, Salmonella typhimurium LT2
cggcuucaucac

SEQ ID NO: 3756421 - RNA, 16 nt, Salmonella typhimurium LT2
cggcuucgcuggucag

SEQ ID NO: 3756422 - RNA, 15 nt, Salmonella typhimurium LT2
cggcuucuccaccau

SEQ ID NO: 3756423 - RNA, 17 nt, Salmonella typhimurium LT2
cggcuugagcaccacgc

SEQ ID NO: 3756424 - RNA, 19 nt, Salmonella typhimurium LT2
cggcuugaguuuuccgcca

SEQ ID NO: 3756425 - RNA, 18 nt, Salmonella typhimurium LT2
cggcuugccaagcaggaa

SEQ ID NO: 3756426 - RNA, 16 nt, Salmonella typhimurium LT2
cggcuugugagcgucg

SEQ ID NO: 3756427 - RNA, 18 nt, Salmonella typhimurium LT2
cggcuugugagcgucgcg

SEQ ID NO: 3756428 - RNA, 20 nt, Salmonella typhimurium LT2
cggcuuuaucgcccguaccg

SEQ ID NO: 3756429 - RNA, 22 nt, Salmonella typhimurium LT2
cggcuuucacaccguuauccgg

SEQ ID NO: 3756430 - RNA, 13 nt, Salmonella typhimurium LT2
cggcuuuccagcu

SEQ ID NO: 3756431 - RNA, 12 nt, Salmonella typhimurium LT2
cgggaaaagcau

SEQ ID NO: 3756432 - RNA, 12 nt, Salmonella typhimurium LT2
cgggaacagaau

SEQ ID NO: 3756433 - RNA, 13 nt, Salmonella typhimurium LT2
cgggaacagccac

SEQ ID NO: 3756434 - RNA, 13 nt, Salmonella typhimurium LT2
cgggaacaugcau

SEQ ID NO: 3756435 - RNA, 14 nt, Salmonella typhimurium LT2
cgggaacugacagc

SEQ ID NO: 3756436 - RNA, 17 nt, Salmonella typhimurium LT2
cgggaacugacagcagu

SEQ ID NO: 3756437 - RNA, 15 nt, Salmonella typhimurium LT2
cgggaaguaaggcau

SEQ ID NO: 3756438 - RNA, 14 nt, Salmonella typhimurium LT2
cgggaaugcgucgg

SEQ ID NO: 3756439 - RNA, 19 nt, Salmonella typhimurium LT2
cgggacaaacccccagcca

SEQ ID NO: 3756440 - RNA, 17 nt, Salmonella typhimurium LT2
cgggacggcggccagca

SEQ ID NO: 3756441 - RNA, 23 nt, Salmonella typhimurium LT2
cgggacugguggcaagauaagcc

SEQ ID NO: 3756442 - RNA, 18 nt, Salmonella typhimurium LT2
cgggagauuguuaucgac

SEQ ID NO: 3756443 - RNA, 18 nt, Salmonella typhimurium LT2
cgggaggcggucuggauu

SEQ ID NO: 3756444 - RNA, 18 nt, Salmonella typhimurium LT2
cgggagguucaccaccac

SEQ ID NO: 3756445 - RNA, 15 nt, Salmonella typhimurium LT2
cgggauaaccaccgc

SEQ ID NO: 3756446 - RNA, 14 nt, Salmonella typhimurium LT2
cgggauauaaaauu

SEQ ID NO: 3756447 - RNA, 14 nt, Salmonella typhimurium LT2
cgggauauccucuu

SEQ ID NO: 3756448 - RNA, 16 nt, Salmonella typhimurium LT2
cgggaucagcgcgcuc

SEQ ID NO: 3756449 - RNA, 17 nt, Salmonella typhimurium LT2
cgggauccccugcuccu

SEQ ID NO: 3756450 - RNA, 18 nt, Salmonella typhimurium LT2
cgggauccccugcuccug

SEQ ID NO: 3756451 - RNA, 15 nt, Salmonella typhimurium LT2
cgggaucgccaucac

SEQ ID NO: 3756452 - RNA, 19 nt, Salmonella typhimurium LT2
cgggaucguaacaggucac

SEQ ID NO: 3756453 - RNA, 21 nt, Salmonella typhimurium LT2
cgggaucucgcacaucaugau

SEQ ID NO: 3756454 - RNA, 20 nt, Salmonella typhimurium LT2
cgggcaaacagcacuacagc

SEQ ID NO: 3756455 - RNA, 17 nt, Salmonella typhimurium LT2
cgggcaaccuucaaguu

SEQ ID NO: 3756456 - RNA, 14 nt, Salmonella typhimurium LT2
cgggcaagcgaagc

SEQ ID NO: 3756457 - RNA, 17 nt, Salmonella typhimurium LT2
cgggcaaugccaccagc

SEQ ID NO: 3756458 - RNA, 20 nt, Salmonella typhimurium LT2
cgggcaaugccacugcccuc

SEQ ID NO: 3756459 - RNA, 13 nt, Salmonella typhimurium LT2
cgggcaaugcccg

SEQ ID NO: 3756460 - RNA, 22 nt, Salmonella typhimurium LT2
cgggcagacaugaccgcacagc

SEQ ID NO: 3756461 - RNA, 23 nt, Salmonella typhimurium LT2
cgggcagacauuugcgcacggcg

SEQ ID NO: 3756462 - RNA, 21 nt, Salmonella typhimurium LT2
cgggcagcagcagcagcagac

SEQ ID NO: 3756463 - RNA, 23 nt, Salmonella typhimurium LT2
cgggcaggcuuccacgcacgccg

SEQ ID NO: 3756464 - RNA, 19 nt, Salmonella typhimurium LT2
cgggcaguccggcggcagc

SEQ ID NO: 3756465 - RNA, 21 nt, Salmonella typhimurium LT2
cgggcauucccagaaaggcgc

SEQ ID NO: 3756466 - RNA, 17 nt, Salmonella typhimurium LT2
cgggccacucuccagca

SEQ ID NO: 3756467 - RNA, 20 nt, Salmonella typhimurium LT2
cgggccauuccccauacagc

SEQ ID NO: 3756468 - RNA, 21 nt, Salmonella typhimurium LT2
cgggccgccaucuccggcagc

SEQ ID NO: 3756469 - RNA, 20 nt, Salmonella typhimurium LT2
cgggccgcgcugcgccugcu

SEQ ID NO: 3756470 - RNA, 13 nt, Salmonella typhimurium LT2
cgggccgcggcgg

SEQ ID NO: 3756471 - RNA, 19 nt, Salmonella typhimurium LT2
cgggccguccggcaaaccc

SEQ ID NO: 3756472 - RNA, 19 nt, Salmonella typhimurium LT2
cgggccguggccaggaaua

SEQ ID NO: 3756473 - RNA, 16 nt, Salmonella typhimurium LT2
cgggccuacagguaca

SEQ ID NO: 3756474 - RNA, 12 nt, Salmonella typhimurium LT2
cgggccuccgcg

SEQ ID NO: 3756475 - RNA, 22 nt, Salmonella typhimurium LT2
cgggccugauaagcacaggcca

SEQ ID NO: 3756476 - RNA, 12 nt, Salmonella typhimurium LT2
cgggccugugcc

SEQ ID NO: 3756477 - RNA, 18 nt, Salmonella typhimurium LT2
cgggcgaacuucaccagc

SEQ ID NO: 3756478 - RNA, 15 nt, Salmonella typhimurium LT2
cgggcgaagccugac

SEQ ID NO: 3756479 - RNA, 14 nt, Salmonella typhimurium LT2
cgggcgacacgcgc

SEQ ID NO: 3756480 - RNA, 16 nt, Salmonella typhimurium LT2
cgggcgaccgucgggc

SEQ ID NO: 3756481 - RNA, 16 nt, Salmonella typhimurium LT2
cgggcgauaaaccagc

SEQ ID NO: 3756482 - RNA, 15 nt, Salmonella typhimurium LT2
cgggcgauaaccucu

SEQ ID NO: 3756483 - RNA, 22 nt, Salmonella typhimurium LT2
cgggcgauagagaccgcuuuag

SEQ ID NO: 3756484 - RNA, 12 nt, Salmonella typhimurium LT2
cgggcgccacgu

SEQ ID NO: 3756485 - RNA, 15 nt, Salmonella typhimurium LT2
cgggcgcgcgcgcag

SEQ ID NO: 3756486 - RNA, 17 nt, Salmonella typhimurium LT2
cgggcggcugucccaga

SEQ ID NO: 3756487 - RNA, 19 nt, Salmonella typhimurium LT2
cgggcguauagccaggcag

SEQ ID NO: 3756488 - RNA, 22 nt, Salmonella typhimurium LT2
cgggcguuucacauuccggcgc

SEQ ID NO: 3756489 - RNA, 23 nt, Salmonella typhimurium LT2
cgggcguuucacauuccggcgcg

SEQ ID NO: 3756490 - RNA, 19 nt, Salmonella typhimurium LT2
cgggcguuugugcgcgcca

SEQ ID NO: 3756491 - RNA, 18 nt, Salmonella typhimurium LT2
cgggcuauaggccaucac

SEQ ID NO: 3756492 - RNA, 22 nt, Salmonella typhimurium LT2
cggucgagcuuuugcugcgcca

SEQ ID NO: 3756493 - RNA, 17 nt, Salmonella typhimurium LT2
cggucgccuaauccgcc

SEQ ID NO: 3756494 - RNA, 12 nt, Salmonella typhimurium LT2
cggucgcgccag

SEQ ID NO: 3756495 - RNA, 17 nt, Salmonella typhimurium LT2
cggucgcgccagcgacc

SEQ ID NO: 3756496 - RNA, 21 nt, Salmonella typhimurium LT2
cggucgcguuauaaccgccaa

SEQ ID NO: 3756497 - RNA, 13 nt, Salmonella typhimurium LT2
cggucgcugauaa

SEQ ID NO: 3756498 - RNA, 22 nt, Salmonella typhimurium LT2
cggucgcuucccagugaaucca

SEQ ID NO: 3756499 - RNA, 14 nt, Salmonella typhimurium LT2
cggucgcuucgccu

SEQ ID NO: 3756500 - RNA, 20 nt, Salmonella typhimurium LT2
cggucgcuuuuugcgccagc

SEQ ID NO: 3756501 - RNA, 14 nt, Salmonella typhimurium LT2
cggucggcgcgucg

SEQ ID NO: 3756502 - RNA, 21 nt, Salmonella typhimurium LT2
cggucgggauauaugcaaaac

SEQ ID NO: 3756503 - RNA, 13 nt, Salmonella typhimurium LT2
cggucugacggcc

SEQ ID NO: 3756504 - RNA, 23 nt, Salmonella typhimurium LT2
cggucugauaagcgcagcgccau

SEQ ID NO: 3756505 - RNA, 22 nt, Salmonella typhimurium LT2
cggucugcuucagccacuggcu

SEQ ID NO: 3756506 - RNA, 19 nt, Salmonella typhimurium LT2
cggucuggauuuggcugcc

SEQ ID NO: 3756507 - RNA, 20 nt, Salmonella typhimurium LT2
cggucuuaucaaauuugccc

SEQ ID NO: 3756508 - RNA, 18 nt, Salmonella typhimurium LT2
cggugaaacuguuuuacg

SEQ ID NO: 3756509 - RNA, 19 nt, Salmonella typhimurium LT2
cggugaaugcgcggcugcg

SEQ ID NO: 3756510 - RNA, 18 nt, Salmonella typhimurium LT2
cggugaccugcauuuccc

SEQ ID NO: 3756511 - RNA, 21 nt, Salmonella typhimurium LT2
cggugaccugcauuucccauc

SEQ ID NO: 3756512 - RNA, 19 nt, Salmonella typhimurium LT2
cggugacggaaaccagcau

SEQ ID NO: 3756513 - RNA, 22 nt, Salmonella typhimurium LT2
cggugacuucgcagcccaucgc

SEQ ID NO: 3756514 - RNA, 13 nt, Salmonella typhimurium LT2
cggugagaaacgc

SEQ ID NO: 3756515 - RNA, 13 nt, Salmonella typhimurium LT2
cggugagcgccgc

SEQ ID NO: 3756516 - RNA, 15 nt, Salmonella typhimurium LT2
cggugaguuuuaccg

SEQ ID NO: 3756517 - RNA, 14 nt, Salmonella typhimurium LT2
cggugaucccacca

SEQ ID NO: 3756518 - RNA, 19 nt, Salmonella typhimurium LT2
cggugaucccaccaggagu

SEQ ID NO: 3756519 - RNA, 13 nt, Salmonella typhimurium LT2
cggugaucuccuc

SEQ ID NO: 3756520 - RNA, 15 nt, Salmonella typhimurium LT2
cggugaucuccucgc

SEQ ID NO: 3756521 - RNA, 19 nt, Salmonella typhimurium LT2
cggugccgaaaucaucaau

SEQ ID NO: 3756522 - RNA, 16 nt, Salmonella typhimurium LT2
cggugccgcugcugac

SEQ ID NO: 3756523 - RNA, 23 nt, Salmonella typhimurium LT2
cggugccguuaauuuucacgcac

SEQ ID NO: 3756524 - RNA, 16 nt, Salmonella typhimurium LT2
cggugccugccgccuc

SEQ ID NO: 3756525 - RNA, 16 nt, Salmonella typhimurium LT2
cggugcgucacgccuu

SEQ ID NO: 3756526 - RNA, 17 nt, Salmonella typhimurium LT2
cgguggcgccgcgccac

SEQ ID NO: 3756527 - RNA, 18 nt, Salmonella typhimurium LT2
cgguggcgcuccagccgu

SEQ ID NO: 3756528 - RNA, 21 nt, Salmonella typhimurium LT2
cgguggcgcugcgcuuaccgg

SEQ ID NO: 3756529 - RNA, 15 nt, Salmonella typhimurium LT2
cgguguaaacaggcu

SEQ ID NO: 3756530 - RNA, 19 nt, Salmonella typhimurium LT2
cgguguacaucgcgcugac

SEQ ID NO: 3756531 - RNA, 15 nt, Salmonella typhimurium LT2
cgguguaccccgccu

SEQ ID NO: 3756532 - RNA, 18 nt, Salmonella typhimurium LT2
cgguguaccccgccugac

SEQ ID NO: 3756533 - RNA, 14 nt, Salmonella typhimurium LT2
cgguguagcuggca

SEQ ID NO: 3756534 - RNA, 18 nt, Salmonella typhimurium LT2
cggugucaaagcgccaga

SEQ ID NO: 3756535 - RNA, 19 nt, Salmonella typhimurium LT2
cggugucaaagcgccagau

SEQ ID NO: 3756536 - RNA, 15 nt, Salmonella typhimurium LT2
cgguguccaucaggc

SEQ ID NO: 3756537 - RNA, 22 nt, Salmonella typhimurium LT2
cgguuaacaccaguuuauccgc

SEQ ID NO: 3756538 - RNA, 13 nt, Salmonella typhimurium LT2
cgguuacaugcug

SEQ ID NO: 3756539 - RNA, 13 nt, Salmonella typhimurium LT2
cgguuacuccuua

SEQ ID NO: 3756540 - RNA, 20 nt, Salmonella typhimurium LT2
cgguucacggccaaagcgcg

SEQ ID NO: 3756541 - RNA, 21 nt, Salmonella typhimurium LT2
cgguucacggccaaagcgcga

SEQ ID NO: 3756542 - RNA, 14 nt, Salmonella typhimurium LT2
cgguucauccugcg

SEQ ID NO: 3756543 - RNA, 13 nt, Salmonella typhimurium LT2
cgguuccagcggc

SEQ ID NO: 3756544 - RNA, 19 nt, Salmonella typhimurium LT2
cgguuccggcauaaauaau

SEQ ID NO: 3756545 - RNA, 22 nt, Salmonella typhimurium LT2
cgguucgccgcagccuaguucu

SEQ ID NO: 3756546 - RNA, 14 nt, Salmonella typhimurium LT2
cgguucggcugccc

SEQ ID NO: 3756547 - RNA, 15 nt, Salmonella typhimurium LT2
cgguucucugccauc

SEQ ID NO: 3756548 - RNA, 22 nt, Salmonella typhimurium LT2
cgguucuucccacuccgcccag

SEQ ID NO: 3756549 - RNA, 17 nt, Salmonella typhimurium LT2
cgguugauaaucgcuau

SEQ ID NO: 3756550 - RNA, 17 nt, Salmonella typhimurium LT2
cgguugccacucuucca

SEQ ID NO: 3756551 - RNA, 20 nt, Salmonella typhimurium LT2
cgguugccagggaaugccau

SEQ ID NO: 3756552 - RNA, 19 nt, Salmonella typhimurium LT2
cgguugccugcgucauccc

SEQ ID NO: 3756553 - RNA, 18 nt, Salmonella typhimurium LT2
cgguuggaucucaccacu

SEQ ID NO: 3756554 - RNA, 22 nt, Salmonella typhimurium LT2
cgguuggccagcauggcgguca

SEQ ID NO: 3756555 - RNA, 17 nt, Salmonella typhimurium LT2
cgguuggccuacaagau

SEQ ID NO: 3756556 - RNA, 20 nt, Salmonella typhimurium LT2
cgguuguccacugaccggaa

SEQ ID NO: 3756557 - RNA, 20 nt, Salmonella typhimurium LT2
cgguuguucuuccagcguca

SEQ ID NO: 3756558 - RNA, 21 nt, Salmonella typhimurium LT2
cgguuuaguaguaaucgauac

SEQ ID NO: 3756559 - RNA, 15 nt, Salmonella typhimurium LT2
cgguuucaguucgua

SEQ ID NO: 3756560 - RNA, 14 nt, Salmonella typhimurium LT2
cgguuucgaccagc

SEQ ID NO: 3756561 - RNA, 15 nt, Salmonella typhimurium LT2
cgguuucgaccagca

SEQ ID NO: 3756562 - RNA, 20 nt, Salmonella typhimurium LT2
cgguuugggcgcgaaacugc

SEQ ID NO: 3756563 - RNA, 15 nt, Salmonella typhimurium LT2
cgguuuuaacaaccc

SEQ ID NO: 3756564 - RNA, 21 nt, Salmonella typhimurium LT2
cgguuuuacuauugccgauaa

SEQ ID NO: 3756565 - RNA, 22 nt, Salmonella typhimurium LT2
cgguuuuauaguagcgcgcgcu

SEQ ID NO: 3756566 - RNA, 17 nt, Salmonella typhimurium LT2
cgguuuuauccccuuca

SEQ ID NO: 3756567 - RNA, 22 nt, Salmonella typhimurium LT2
cgguuuuauccccuucaggaau

SEQ ID NO: 3756568 - RNA, 16 nt, Salmonella typhimurium LT2
cgguuuucacuggcau

SEQ ID NO: 3756569 - RNA, 13 nt, Salmonella typhimurium LT2
cgguuuugcgcug

SEQ ID NO: 3756570 - RNA, 16 nt, Salmonella typhimurium LT2
cgguuuuuauggaagg

SEQ ID NO: 3756571 - RNA, 13 nt, Salmonella typhimurium LT2
cgguuuuuccgcu

SEQ ID NO: 3756572 - RNA, 21 nt, Salmonella typhimurium LT2
cgguuuuuuuguggccugcuu

SEQ ID NO: 3756573 - RNA, 23 nt, Salmonella typhimurium LT2
cgguuuuuuuguggccugcuuaa

SEQ ID NO: 3756574 - RNA, 18 nt, Salmonella typhimurium LT2
cguaaaaaaacaucauaa

SEQ ID NO: 3756575 - RNA, 15 nt, Salmonella typhimurium LT2
cguaaaacaacagcg

SEQ ID NO: 3756576 - RNA, 18 nt, Salmonella typhimurium LT2
cguaaaacaacagcggcg

SEQ ID NO: 3756577 - RNA, 14 nt, Salmonella typhimurium LT2
cguaaaagacgaag

SEQ ID NO: 3756578 - RNA, 16 nt, Salmonella typhimurium LT2
cguaaaaucagcagcg

SEQ ID NO: 3756579 - RNA, 20 nt, Salmonella typhimurium LT2
cguaaaccccuucaccacuu

SEQ ID NO: 3756580 - RNA, 16 nt, Salmonella typhimurium LT2
cguaaacgcucgcuua

SEQ ID NO: 3756581 - RNA, 16 nt, Salmonella typhimurium LT2
cguaaacggcagccgc

SEQ ID NO: 3756582 - RNA, 19 nt, Salmonella typhimurium LT2
cguaaacggcagccgccac

SEQ ID NO: 3756583 - RNA, 14 nt, Salmonella typhimurium LT2
cguaaagcauggcu

SEQ ID NO: 3756584 - RNA, 22 nt, Salmonella typhimurium LT2
cguaaagggaaggucauuauca

SEQ ID NO: 3756585 - RNA, 15 nt, Salmonella typhimurium LT2
cguaaaguucccagc

SEQ ID NO: 3756586 - RNA, 23 nt, Salmonella typhimurium LT2
cguaaauccuccaucaugggcgc

SEQ ID NO: 3756587 - RNA, 22 nt, Salmonella typhimurium LT2
cguaaaucugaaauaaaagcaa

SEQ ID NO: 3756588 - RNA, 17 nt, Salmonella typhimurium LT2
cguaaauucccuccaga

SEQ ID NO: 3756589 - RNA, 18 nt, Salmonella typhimurium LT2
cguaacagacgcaucuuu

SEQ ID NO: 3756590 - RNA, 14 nt, Salmonella typhimurium LT2
cguaaccggccagc

SEQ ID NO: 3756591 - RNA, 22 nt, Salmonella typhimurium LT2
cguaacgccgucggcagccaga

SEQ ID NO: 3756592 - RNA, 20 nt, Salmonella typhimurium LT2
cguaacggcugacgcccauc

SEQ ID NO: 3756593 - RNA, 20 nt, Salmonella typhimurium LT2
cguaacgugcuccagcgccu

SEQ ID NO: 3756594 - RNA, 15 nt, Salmonella typhimurium LT2
cguaacucggcagcg

SEQ ID NO: 3756595 - RNA, 12 nt, Salmonella typhimurium LT2
cgucacaacagc

SEQ ID NO: 3756596 - RNA, 14 nt, Salmonella typhimurium LT2
cgucacagaccccg

SEQ ID NO: 3756597 - RNA, 13 nt, Salmonella typhimurium LT2
cgucaccagcagg

SEQ ID NO: 3756598 - RNA, 16 nt, Salmonella typhimurium LT2
cgucacccgccggcag

SEQ ID NO: 3756599 - RNA, 13 nt, Salmonella typhimurium LT2
cgucaccggcggc

SEQ ID NO: 3756600 - RNA, 18 nt, Salmonella typhimurium LT2
cgucaccgggcugcagcc

SEQ ID NO: 3756601 - RNA, 14 nt, Salmonella typhimurium LT2
cgucaccugauagc

SEQ ID NO: 3756602 - RNA, 14 nt, Salmonella typhimurium LT2
cgucacgaccggcg

SEQ ID NO: 3756603 - RNA, 15 nt, Salmonella typhimurium LT2
cgucacgauaguuuu

SEQ ID NO: 3756604 - RNA, 17 nt, Salmonella typhimurium LT2
cgucacgcaacaggccg

SEQ ID NO: 3756605 - RNA, 21 nt, Salmonella typhimurium LT2
cgucacgccgacgacaggcag

SEQ ID NO: 3756606 - RNA, 12 nt, Salmonella typhimurium LT2
cgucacgcggcu

SEQ ID NO: 3756607 - RNA, 18 nt, Salmonella typhimurium LT2
cgucacggcgacggccag

SEQ ID NO: 3756608 - RNA, 15 nt, Salmonella typhimurium LT2
cgucacgguuuaucc

SEQ ID NO: 3756609 - RNA, 16 nt, Salmonella typhimurium LT2
cgucacgguuuauccc

SEQ ID NO: 3756610 - RNA, 14 nt, Salmonella typhimurium LT2
cgucacuaacucca

SEQ ID NO: 3756611 - RNA, 12 nt, Salmonella typhimurium LT2
cgucacucccug

SEQ ID NO: 3756612 - RNA, 17 nt, Salmonella typhimurium LT2
cgucacucccugcguca

SEQ ID NO: 3756613 - RNA, 22 nt, Salmonella typhimurium LT2
cgucacugucagcaucagugga

SEQ ID NO: 3756614 - RNA, 18 nt, Salmonella typhimurium LT2
cgucagaccggcaaucaa

SEQ ID NO: 3756615 - RNA, 17 nt, Salmonella typhimurium LT2
cgucagacggcuccagc

SEQ ID NO: 3756616 - RNA, 19 nt, Salmonella typhimurium LT2
cgucagacggcuccagcgc

SEQ ID NO: 3756617 - RNA, 18 nt, Salmonella typhimurium LT2
cgucagauuauggcuaca

SEQ ID NO: 3756618 - RNA, 15 nt, Salmonella typhimurium LT2
cgucagcaccagcga

SEQ ID NO: 3756619 - RNA, 16 nt, Salmonella typhimurium LT2
cgucagcaccagcgag

SEQ ID NO: 3756620 - RNA, 20 nt, Salmonella typhimurium LT2
cgucagccacuucuuccagc

SEQ ID NO: 3756621 - RNA, 19 nt, Salmonella typhimurium LT2
cgucagcccaaaacgcgcc

SEQ ID NO: 3756622 - RNA, 14 nt, Salmonella typhimurium LT2
cgucagccgugagc

SEQ ID NO: 3756623 - RNA, 11 nt, Salmonella typhimurium LT2
cgucagcgcca

SEQ ID NO: 3756624 - RNA, 15 nt, Salmonella typhimurium LT2
cgucagcgccauccg

SEQ ID NO: 3756625 - RNA, 13 nt, Salmonella typhimurium LT2
cgucagcgccucc

SEQ ID NO: 3756626 - RNA, 15 nt, Salmonella typhimurium LT2
cgucagcgcgcgcuu

SEQ ID NO: 3756627 - RNA, 16 nt, Salmonella typhimurium LT2
cgucagcguuuccggc

SEQ ID NO: 3756628 - RNA, 15 nt, Salmonella typhimurium LT2
cgucaggaacgcggc

SEQ ID NO: 3756629 - RNA, 22 nt, Salmonella typhimurium LT2
cgucaggcgaagcuccgggcuc

SEQ ID NO: 3756630 - RNA, 18 nt, Salmonella typhimurium LT2
cgucaggguuuucaggaa

SEQ ID NO: 3756631 - RNA, 18 nt, Salmonella typhimurium LT2
cgucagguuuaaucggcg

SEQ ID NO: 3756632 - RNA, 13 nt, Salmonella typhimurium LT2
cgucauaaucgcg

SEQ ID NO: 3756633 - RNA, 21 nt, Salmonella typhimurium LT2
cgucauagcaggagauauagc

SEQ ID NO: 3756634 - RNA, 16 nt, Salmonella typhimurium LT2
cgucauagccgcgcgu

SEQ ID NO: 3756635 - RNA, 18 nt, Salmonella typhimurium LT2
cgucauauagccgcgcag

SEQ ID NO: 3756636 - RNA, 12 nt, Salmonella typhimurium LT2
cgucaucaugcu

SEQ ID NO: 3756637 - RNA, 22 nt, Salmonella typhimurium LT2
cgucaucauuaccuuuuccggc

SEQ ID NO: 3756638 - RNA, 12 nt, Salmonella typhimurium LT2
cgucaucauugc

SEQ ID NO: 3756639 - RNA, 13 nt, Salmonella typhimurium LT2
cgucauccggcaa

SEQ ID NO: 3756640 - RNA, 19 nt, Salmonella typhimurium LT2
cgucauccggcaagcgcug

SEQ ID NO: 3756641 - RNA, 17 nt, Salmonella typhimurium LT2
cgucauccggcaaucaa

SEQ ID NO: 3756642 - RNA, 20 nt, Salmonella typhimurium LT2
cgucauccggcaaucaaacu

SEQ ID NO: 3756643 - RNA, 15 nt, Salmonella typhimurium LT2
cgucaucgacauuaa

SEQ ID NO: 3756644 - RNA, 18 nt, Salmonella typhimurium LT2
cgucaucgggcuguuauu

SEQ ID NO: 3756645 - RNA, 21 nt, Salmonella typhimurium LT2
cgucaugcuguuaccguaagc

SEQ ID NO: 3756646 - RNA, 15 nt, Salmonella typhimurium LT2
cgucaugucucagac

SEQ ID NO: 3756647 - RNA, 14 nt, Salmonella typhimurium LT2
cgucauucaccgug

SEQ ID NO: 3756648 - RNA, 17 nt, Salmonella typhimurium LT2
cgucauucauggcgcgc

SEQ ID NO: 3756649 - RNA, 13 nt, Salmonella typhimurium LT2
cgucauucuggua

SEQ ID NO: 3756650 - RNA, 16 nt, Salmonella typhimurium LT2
cgucauuuuuaucgac

SEQ ID NO: 3756651 - RNA, 19 nt, Salmonella typhimurium LT2
cguccaacacgcugcguaa

SEQ ID NO: 3756652 - RNA, 13 nt, Salmonella typhimurium LT2
cguccacaccuuc

SEQ ID NO: 3756653 - RNA, 14 nt, Salmonella typhimurium LT2
cguccacaccuucc

SEQ ID NO: 3756654 - RNA, 21 nt, Salmonella typhimurium LT2
cguccacacgccuggccaggc

SEQ ID NO: 3756655 - RNA, 11 nt, Salmonella typhimurium LT2
cguccaccagc

SEQ ID NO: 3756656 - RNA, 15 nt, Salmonella typhimurium LT2
cguccaccagcacag

SEQ ID NO: 3756657 - RNA, 18 nt, Salmonella typhimurium LT2
cguccacggacaucggcu

SEQ ID NO: 3756658 - RNA, 13 nt, Salmonella typhimurium LT2
cguccagauccac

SEQ ID NO: 3756659 - RNA, 22 nt, Salmonella typhimurium LT2
cguccagccagcguuucuggaa

SEQ ID NO: 3756660 - RNA, 19 nt, Salmonella typhimurium LT2
cguccagcgcgugaaccgu

SEQ ID NO: 3756661 - RNA, 11 nt, Salmonella typhimurium LT2
cguccagcggc

SEQ ID NO: 3756662 - RNA, 12 nt, Salmonella typhimurium LT2
cguccaggccug

SEQ ID NO: 3756663 - RNA, 23 nt, Salmonella typhimurium LT2
cguccaguccugccccugccagc

SEQ ID NO: 3756664 - RNA, 14 nt, Salmonella typhimurium LT2
cguccauaagcgcg

SEQ ID NO: 3756665 - RNA, 21 nt, Salmonella typhimurium LT2
cguccaugaccaccagcgcga

SEQ ID NO: 3756666 - RNA, 20 nt, Salmonella typhimurium LT2
cgucccaccacgcagccaug

SEQ ID NO: 3756667 - RNA, 15 nt, Salmonella typhimurium LT2
cgucccacgcgccgc

SEQ ID NO: 3756668 - RNA, 23 nt, Salmonella typhimurium LT2
cgucccacgcgccgccgaacaga

SEQ ID NO: 3756669 - RNA, 15 nt, Salmonella typhimurium LT2
cguccccagcgaucc

SEQ ID NO: 3756670 - RNA, 18 nt, Salmonella typhimurium LT2
cguccccuggacgcgagc

SEQ ID NO: 3756671 - RNA, 23 nt, Salmonella typhimurium LT2
cgucccgacgaauaacaaaauga

SEQ ID NO: 3756672 - RNA, 16 nt, Salmonella typhimurium LT2
cgucccggcauuauaa

SEQ ID NO: 3756673 - RNA, 16 nt, Salmonella typhimurium LT2
cgucccggucggcgca

SEQ ID NO: 3756674 - RNA, 17 nt, Salmonella typhimurium LT2
cgucccggucggcgcau

SEQ ID NO: 3756675 - RNA, 22 nt, Salmonella typhimurium LT2
cgucccggucggcgcauggcgu

SEQ ID NO: 3756676 - RNA, 15 nt, Salmonella typhimurium LT2
cgucccugcaacgcc

SEQ ID NO: 3756677 - RNA, 14 nt, Salmonella typhimurium LT2
cgucccuuccgcca

SEQ ID NO: 3756678 - RNA, 20 nt, Salmonella typhimurium LT2
cgucccuuccgccaccaggu

SEQ ID NO: 3756679 - RNA, 18 nt, Salmonella typhimurium LT2
cguccgcagccgacgcau

SEQ ID NO: 3756680 - RNA, 14 nt, Salmonella typhimurium LT2
cguccgccaggccc

SEQ ID NO: 3756681 - RNA, 17 nt, Salmonella typhimurium LT2
cguccgccaggcccaug

SEQ ID NO: 3756682 - RNA, 12 nt, Salmonella typhimurium LT2
cguccgccuccg

SEQ ID NO: 3756683 - RNA, 20 nt, Salmonella typhimurium LT2
cguccgccuuugacgccggg

SEQ ID NO: 3756684 - RNA, 12 nt, Salmonella typhimurium LT2
cguccgcucacg

SEQ ID NO: 3756685 - RNA, 16 nt, Salmonella typhimurium LT2
cguccggaaaauccuc

SEQ ID NO: 3756686 - RNA, 14 nt, Salmonella typhimurium LT2
cguccggcagucgg

SEQ ID NO: 3756687 - RNA, 14 nt, Salmonella typhimurium LT2
cguccggcaucaca

SEQ ID NO: 3756688 - RNA, 19 nt, Salmonella typhimurium LT2
cguccgggccugauaagca

SEQ ID NO: 3756689 - RNA, 18 nt, Salmonella typhimurium LT2
cguccggggccagcgcca

SEQ ID NO: 3756690 - RNA, 16 nt, Salmonella typhimurium LT2
cguccguuagcuggca

SEQ ID NO: 3756691 - RNA, 22 nt, Salmonella typhimurium LT2
cguccguucugauacucguagc

SEQ ID NO: 3756692 - RNA, 19 nt, Salmonella typhimurium LT2
cguccugcaacccauauuc

SEQ ID NO: 3756693 - RNA, 22 nt, Salmonella typhimurium LT2
cguccugcgcgacgcccaccag

SEQ ID NO: 3756694 - RNA, 15 nt, Salmonella typhimurium LT2
cgucgaaugacgcgc

SEQ ID NO: 3756695 - RNA, 19 nt, Salmonella typhimurium LT2
cgucgacaaagccaacgcc

SEQ ID NO: 3756696 - RNA, 20 nt, Salmonella typhimurium LT2
cgucgacaaagccaacgccg

SEQ ID NO: 3756697 - RNA, 21 nt, Salmonella typhimurium LT2
cgucgacaaagccaacgccgc

SEQ ID NO: 3756698 - RNA, 15 nt, Salmonella typhimurium LT2
cgucgaccauacgca

SEQ ID NO: 3756699 - RNA, 12 nt, Salmonella typhimurium LT2
cgucgagcgcgg

SEQ ID NO: 3756700 - RNA, 19 nt, Salmonella typhimurium LT2
cgugcaaaaucacgcggcg

SEQ ID NO: 3756701 - RNA, 19 nt, Salmonella typhimurium LT2
cgugcaagggaaggcgccc

SEQ ID NO: 3756702 - RNA, 15 nt, Salmonella typhimurium LT2
cgugcagcgccgccu

SEQ ID NO: 3756703 - RNA, 13 nt, Salmonella typhimurium LT2
cgugcaggccgga

SEQ ID NO: 3756704 - RNA, 15 nt, Salmonella typhimurium LT2
cgugcaggcgccgcc

SEQ ID NO: 3756705 - RNA, 20 nt, Salmonella typhimurium LT2
cgugcaugggauacgccagc

SEQ ID NO: 3756706 - RNA, 16 nt, Salmonella typhimurium LT2
cgugcauuaaaauaau

SEQ ID NO: 3756707 - RNA, 20 nt, Salmonella typhimurium LT2
cgugccagaaacaagaagca

SEQ ID NO: 3756708 - RNA, 12 nt, Salmonella typhimurium LT2
cgugccagcguc

SEQ ID NO: 3756709 - RNA, 20 nt, Salmonella typhimurium LT2
cgugccaugaccauucgcac

SEQ ID NO: 3756710 - RNA, 15 nt, Salmonella typhimurium LT2
cgugccguccggcau

SEQ ID NO: 3756711 - RNA, 18 nt, Salmonella typhimurium LT2
cgugccuuccaucggccc

SEQ ID NO: 3756712 - RNA, 13 nt, Salmonella typhimurium LT2
cgugccuuccgca

SEQ ID NO: 3756713 - RNA, 20 nt, Salmonella typhimurium LT2
cgugccuuccgcaauacagc

SEQ ID NO: 3756714 - RNA, 15 nt, Salmonella typhimurium LT2
cgugcgccguccugc

SEQ ID NO: 3756715 - RNA, 23 nt, Salmonella typhimurium LT2
cgugcgcggcacacuuucaucag

SEQ ID NO: 3756716 - RNA, 17 nt, Salmonella typhimurium LT2
cgugcggcggccucuuc

SEQ ID NO: 3756717 - RNA, 19 nt, Salmonella typhimurium LT2
cgugcggcuguguucaucc

SEQ ID NO: 3756718 - RNA, 19 nt, Salmonella typhimurium LT2
cgugcgguauaucacgcca

SEQ ID NO: 3756719 - RNA, 20 nt, Salmonella typhimurium LT2
cgugcgguauaucacgccau

SEQ ID NO: 3756720 - RNA, 15 nt, Salmonella typhimurium LT2
cgugcgucauccggc

SEQ ID NO: 3756721 - RNA, 15 nt, Salmonella typhimurium LT2
cgugcucucaacaua

SEQ ID NO: 3756722 - RNA, 18 nt, Salmonella typhimurium LT2
cgugcucuucguggaacu

SEQ ID NO: 3756723 - RNA, 20 nt, Salmonella typhimurium LT2
cguggaaaaauuccgcagag

SEQ ID NO: 3756724 - RNA, 20 nt, Salmonella typhimurium LT2
cguggaaaacagcgccggca

SEQ ID NO: 3756725 - RNA, 12 nt, Salmonella typhimurium LT2
cguggaaaagag

SEQ ID NO: 3756726 - RNA, 17 nt, Salmonella typhimurium LT2
cguggaacugcagcgcg

SEQ ID NO: 3756727 - RNA, 14 nt, Salmonella typhimurium LT2
cguggauagccauc

SEQ ID NO: 3756728 - RNA, 14 nt, Salmonella typhimurium LT2
cguggcaaucagca

SEQ ID NO: 3756729 - RNA, 15 nt, Salmonella typhimurium LT2
cguggcaaucagcaa

SEQ ID NO: 3756730 - RNA, 11 nt, Salmonella typhimurium LT2
cguggcaucuu

SEQ ID NO: 3756731 - RNA, 12 nt, Salmonella typhimurium LT2
cguggcaucuua

SEQ ID NO: 3756732 - RNA, 21 nt, Salmonella typhimurium LT2
cguggcauucgcuugcccggc

SEQ ID NO: 3756733 - RNA, 22 nt, Salmonella typhimurium LT2
cguggccagcaugcccgccagc

SEQ ID NO: 3756734 - RNA, 21 nt, Salmonella typhimurium LT2
cguggccgauauugccuucac

SEQ ID NO: 3756735 - RNA, 18 nt, Salmonella typhimurium LT2
cguggcgcugggccgacg

SEQ ID NO: 3756736 - RNA, 19 nt, Salmonella typhimurium LT2
cguggcggaaaauccgcau

SEQ ID NO: 3756737 - RNA, 22 nt, Salmonella typhimurium LT2
cguggcguuuucauuagccgcc

SEQ ID NO: 3756738 - RNA, 16 nt, Salmonella typhimurium LT2
cguggggguucaaguc

SEQ ID NO: 3756739 - RNA, 22 nt, Salmonella typhimurium LT2
cguggggguucaaguccccccc

SEQ ID NO: 3756740 - RNA, 22 nt, Salmonella typhimurium LT2
cgugguaaagaagccgccgcca

SEQ ID NO: 3756741 - RNA, 18 nt, Salmonella typhimurium LT2
cgugguaaauacgcugcg

SEQ ID NO: 3756742 - RNA, 15 nt, Salmonella typhimurium LT2
cgugguaucgcggca

SEQ ID NO: 3756743 - RNA, 21 nt, Salmonella typhimurium LT2
cguggugauucaaauccugga

SEQ ID NO: 3756744 - RNA, 14 nt, Salmonella typhimurium LT2
cguggugccgguug

SEQ ID NO: 3756745 - RNA, 14 nt, Salmonella typhimurium LT2
cguggugggguucc

SEQ ID NO: 3756746 - RNA, 17 nt, Salmonella typhimurium LT2
cguggugggguucccga

SEQ ID NO: 3756747 - RNA, 13 nt, Salmonella typhimurium LT2
cgugguuuccggc

SEQ ID NO: 3756748 - RNA, 19 nt, Salmonella typhimurium LT2
cgugguuuguugcgcgacc

SEQ ID NO: 3756749 - RNA, 12 nt, Salmonella typhimurium LT2
cguguaaaugac

SEQ ID NO: 3756750 - RNA, 19 nt, Salmonella typhimurium LT2
cguguaaccaccuggguca

SEQ ID NO: 3756751 - RNA, 16 nt, Salmonella typhimurium LT2
cguguaaggcaaucgc

SEQ ID NO: 3756752 - RNA, 21 nt, Salmonella typhimurium LT2
cguguacauuaucaaacguca

SEQ ID NO: 3756753 - RNA, 18 nt, Salmonella typhimurium LT2
cguguacggccugauaac

SEQ ID NO: 3756754 - RNA, 20 nt, Salmonella typhimurium LT2
cguguauuccagucgcucca

SEQ ID NO: 3756755 - RNA, 22 nt, Salmonella typhimurium LT2
cguguauuccagucgcuccacc

SEQ ID NO: 3756756 - RNA, 22 nt, Salmonella typhimurium LT2
cgugucgcguaacgccuccacc

SEQ ID NO: 3756757 - RNA, 15 nt, Salmonella typhimurium LT2
cgugucugaaugagu

SEQ ID NO: 3756758 - RNA, 19 nt, Salmonella typhimurium LT2
cguguucuguacuuccggc

SEQ ID NO: 3756759 - RNA, 20 nt, Salmonella typhimurium LT2
cguguugauuaaugcgauaa

SEQ ID NO: 3756760 - RNA, 18 nt, Salmonella typhimurium LT2
cguuaaauaccagcaccu

SEQ ID NO: 3756761 - RNA, 22 nt, Salmonella typhimurium LT2
cguuaacccaaauccgcauuuc

SEQ ID NO: 3756762 - RNA, 14 nt, Salmonella typhimurium LT2
cguuaacccggcau

SEQ ID NO: 3756763 - RNA, 15 nt, Salmonella typhimurium LT2
cguuaacccggcauu

SEQ ID NO: 3756764 - RNA, 22 nt, Salmonella typhimurium LT2
cguuaaccgucuggcugccauc

SEQ ID NO: 3756765 - RNA, 19 nt, Salmonella typhimurium LT2
cguuaacugccggguuaaa

SEQ ID NO: 3756766 - RNA, 13 nt, Salmonella typhimurium LT2
cguuaaucggcac

SEQ ID NO: 3756767 - RNA, 17 nt, Salmonella typhimurium LT2
cguuaauucauggccau

SEQ ID NO: 3756768 - RNA, 15 nt, Salmonella typhimurium LT2
cguuaauuuucacgc

SEQ ID NO: 3756769 - RNA, 23 nt, Salmonella typhimurium LT2
cguuacaucuccuggucuggcuc

SEQ ID NO: 3756770 - RNA, 23 nt, Salmonella typhimurium LT2
cguuacauuuuuggugacguguu

SEQ ID NO: 3756771 - RNA, 12 nt, Salmonella typhimurium LT2
cguuaccagcau

SEQ ID NO: 3756772 - RNA, 12 nt, Salmonella typhimurium LT2
cguuacccuccu

SEQ ID NO: 3756773 - RNA, 17 nt, Salmonella typhimurium LT2
cguuaccgcucaaacgc

SEQ ID NO: 3756774 - RNA, 15 nt, Salmonella typhimurium LT2
cguuaccggcaggcu

SEQ ID NO: 3756775 - RNA, 16 nt, Salmonella typhimurium LT2
cguuaccgggcaaaca

SEQ ID NO: 3756776 - RNA, 14 nt, Salmonella typhimurium LT2
cguuacgcaucugc

SEQ ID NO: 3756777 - RNA, 13 nt, Salmonella typhimurium LT2
cguuacgcauuuc

SEQ ID NO: 3756778 - RNA, 15 nt, Salmonella typhimurium LT2
cguuacgcgcugcaa

SEQ ID NO: 3756779 - RNA, 16 nt, Salmonella typhimurium LT2
cguuacgcggugcgcc

SEQ ID NO: 3756780 - RNA, 20 nt, Salmonella typhimurium LT2
cguuacggcugaagcugccg

SEQ ID NO: 3756781 - RNA, 18 nt, Salmonella typhimurium LT2
cguuacgggaacagaauu

SEQ ID NO: 3756782 - RNA, 14 nt, Salmonella typhimurium LT2
cguuacuccgcgau

SEQ ID NO: 3756783 - RNA, 16 nt, Salmonella typhimurium LT2
cguuagccuaaaugcu

SEQ ID NO: 3756784 - RNA, 22 nt, Salmonella typhimurium LT2
cguuagcgccaccgggcauuuc

SEQ ID NO: 3756785 - RNA, 14 nt, Salmonella typhimurium LT2
cguuagcuggcugu

SEQ ID NO: 3756786 - RNA, 22 nt, Salmonella typhimurium LT2
cguuaggaaagcaguaacgcau

SEQ ID NO: 3756787 - RNA, 18 nt, Salmonella typhimurium LT2
cguuauccagcagccaca

SEQ ID NO: 3756788 - RNA, 18 nt, Salmonella typhimurium LT2
cguuaucguagugccaca

SEQ ID NO: 3756789 - RNA, 23 nt, Salmonella typhimurium LT2
cguuaucguagugccacaacgcc

SEQ ID NO: 3756790 - RNA, 17 nt, Salmonella typhimurium LT2
cguuaucugaccuacag

SEQ ID NO: 3756791 - RNA, 22 nt, Salmonella typhimurium LT2
cguuaugcgcuugcgcaauuuc

SEQ ID NO: 3756792 - RNA, 21 nt, Salmonella typhimurium LT2
cguuaugggaagggugacggc

SEQ ID NO: 3756793 - RNA, 14 nt, Salmonella typhimurium LT2
cguuauucgcuggc

SEQ ID NO: 3756794 - RNA, 18 nt, Salmonella typhimurium LT2
cguucaaaaucaaacaga

SEQ ID NO: 3756795 - RNA, 22 nt, Salmonella typhimurium LT2
cguucaaaaucaaacagaauau

SEQ ID NO: 3756796 - RNA, 17 nt, Salmonella typhimurium LT2
cguucaaagccgccauc

SEQ ID NO: 3756797 - RNA, 17 nt, Salmonella typhimurium LT2
cguucaccgcacugacg

SEQ ID NO: 3756798 - RNA, 21 nt, Salmonella typhimurium LT2
cguucacgcugccacccggca

SEQ ID NO: 3756799 - RNA, 15 nt, Salmonella typhimurium LT2
cguucacguaaucgc

SEQ ID NO: 3756800 - RNA, 17 nt, Salmonella typhimurium LT2
cguucacguaaucgccg

SEQ ID NO: 3756801 - RNA, 18 nt, Salmonella typhimurium LT2
cguucacguaaucgccgu

SEQ ID NO: 3756802 - RNA, 21 nt, Salmonella typhimurium LT2
cguucagauaggcgcgaaaug

SEQ ID NO: 3756803 - RNA, 17 nt, Salmonella typhimurium LT2
cguucagcauauccagc

SEQ ID NO: 3756804 - RNA, 23 nt, Salmonella typhimurium LT2
cuaaacaauuugcccagcgcugg

SEQ ID NO: 3756805 - RNA, 11 nt, Salmonella typhimurium LT2
cuaaaccggcg

SEQ ID NO: 3756806 - RNA, 18 nt, Salmonella typhimurium LT2
cuaaaccggcggaauagc

SEQ ID NO: 3756807 - RNA, 18 nt, Salmonella typhimurium LT2
cuaaacucaucuuuauuc

SEQ ID NO: 3756808 - RNA, 23 nt, Salmonella typhimurium LT2
cuaaagagggugaaccaaagcaa

SEQ ID NO: 3756809 - RNA, 11 nt, Salmonella typhimurium LT2
cuaaagcucau

SEQ ID NO: 3756810 - RNA, 19 nt, Salmonella typhimurium LT2
cuaaagcucaucaauaaua

SEQ ID NO: 3756811 - RNA, 19 nt, Salmonella typhimurium LT2
cuaaagucagcauaaaaaa

SEQ ID NO: 3756812 - RNA, 20 nt, Salmonella typhimurium LT2
cuaaaguuuauuuaggauuu

SEQ ID NO: 3756813 - RNA, 17 nt, Salmonella typhimurium LT2
cuaaauaaauaccaaag

SEQ ID NO: 3756814 - RNA, 20 nt, Salmonella typhimurium LT2
cuaaauaaauaccaaagaac

SEQ ID NO: 3756815 - RNA, 15 nt, Salmonella typhimurium LT2
cuaaaucauaccagc

SEQ ID NO: 3756816 - RNA, 22 nt, Salmonella typhimurium LT2
cuaaaugacgcgcgagaacugc

SEQ ID NO: 3756817 - RNA, 23 nt, Salmonella typhimurium LT2
cuaaaugacgcgcgagaacugcu

SEQ ID NO: 3756818 - RNA, 17 nt, Salmonella typhimurium LT2
cuaaaugcauagcccca

SEQ ID NO: 3756819 - RNA, 18 nt, Salmonella typhimurium LT2
cuaaaugcauagccccag

SEQ ID NO: 3756820 - RNA, 20 nt, Salmonella typhimurium LT2
cuaaaugcauagccccagcg

SEQ ID NO: 3756821 - RNA, 14 nt, Salmonella typhimurium LT2
cuaaauuaaaaaua

SEQ ID NO: 3756822 - RNA, 15 nt, Salmonella typhimurium LT2
cuaaauuaaaaauaa

SEQ ID NO: 3756823 - RNA, 21 nt, Salmonella typhimurium LT2
cuaaauugggaugaugccaca

SEQ ID NO: 3756824 - RNA, 23 nt, Salmonella typhimurium LT2
cuaacagucgcgccgugcccagc

SEQ ID NO: 3756825 - RNA, 13 nt, Salmonella typhimurium LT2
cuaaccaggaccc

SEQ ID NO: 3756826 - RNA, 13 nt, Salmonella typhimurium LT2
cuaacgccugcau

SEQ ID NO: 3756827 - RNA, 21 nt, Salmonella typhimurium LT2
cuaacgcgucuuaucuggccu

SEQ ID NO: 3756828 - RNA, 14 nt, Salmonella typhimurium LT2
cuaacgggcugacc

SEQ ID NO: 3756829 - RNA, 15 nt, Salmonella typhimurium LT2
cuaacgucagcgcca

SEQ ID NO: 3756830 - RNA, 18 nt, Salmonella typhimurium LT2
cuaacgugaaccuccugu

SEQ ID NO: 3756831 - RNA, 21 nt, Salmonella typhimurium LT2
cuaacuggucaaacaaaucau

SEQ ID NO: 3756832 - RNA, 14 nt, Salmonella typhimurium LT2
cuaagaauuuaauc

SEQ ID NO: 3756833 - RNA, 18 nt, Salmonella typhimurium LT2
cuaagaccagcaccaucu

SEQ ID NO: 3756834 - RNA, 14 nt, Salmonella typhimurium LT2
cuaagaccagcauc

SEQ ID NO: 3756835 - RNA, 22 nt, Salmonella typhimurium LT2
cuaagaugacugcuuuuucuag

SEQ ID NO: 3756836 - RNA, 17 nt, Salmonella typhimurium LT2
cuaagccaguucucaau

SEQ ID NO: 3756837 - RNA, 20 nt, Salmonella typhimurium LT2
cuaagggguugaugccgacc

SEQ ID NO: 3756838 - RNA, 20 nt, Salmonella typhimurium LT2
cuaagguugaaagaccuaaa

SEQ ID NO: 3756839 - RNA, 14 nt, Salmonella typhimurium LT2
cuaaguaaggagga

SEQ ID NO: 3756840 - RNA, 15 nt, Salmonella typhimurium LT2
cuaagugagcauuac

SEQ ID NO: 3756841 - RNA, 19 nt, Salmonella typhimurium LT2
cuaaguuaaccgguaugaa

SEQ ID NO: 3756842 - RNA, 18 nt, Salmonella typhimurium LT2
cuaauaaaauaacuauaa

SEQ ID NO: 3756843 - RNA, 20 nt, Salmonella typhimurium LT2
cuaauaaaauaacuauaauu

SEQ ID NO: 3756844 - RNA, 14 nt, Salmonella typhimurium LT2
cuaauaacacaaua

SEQ ID NO: 3756845 - RNA, 13 nt, Salmonella typhimurium LT2
cuaauauccagcc

SEQ ID NO: 3756846 - RNA, 20 nt, Salmonella typhimurium LT2
cuaaucagcaacuuuuccgc

SEQ ID NO: 3756847 - RNA, 16 nt, Salmonella typhimurium LT2
cuaauccccauuuuuu

SEQ ID NO: 3756848 - RNA, 23 nt, Salmonella typhimurium LT2
cuaauccccauuuuuuucagccu

SEQ ID NO: 3756849 - RNA, 22 nt, Salmonella typhimurium LT2
cuaauccccccuuuuuugcugg

SEQ ID NO: 3756850 - RNA, 19 nt, Salmonella typhimurium LT2
cuaauccggccugucagga

SEQ ID NO: 3756851 - RNA, 23 nt, Salmonella typhimurium LT2
cuaaucgcgacgacgcugguucc

SEQ ID NO: 3756852 - RNA, 21 nt, Salmonella typhimurium LT2
cuaaugaacggaggucaugga

SEQ ID NO: 3756853 - RNA, 17 nt, Salmonella typhimurium LT2
cuaaugacauagugcaa

SEQ ID NO: 3756854 - RNA, 15 nt, Salmonella typhimurium LT2
cuaaugagccagaug

SEQ ID NO: 3756855 - RNA, 13 nt, Salmonella typhimurium LT2
cuaaugccuggca

SEQ ID NO: 3756856 - RNA, 14 nt, Salmonella typhimurium LT2
cuaaugccuggcag

SEQ ID NO: 3756857 - RNA, 16 nt, Salmonella typhimurium LT2
cuaauggcgguugcca

SEQ ID NO: 3756858 - RNA, 13 nt, Salmonella typhimurium LT2
cuaaugucagcuc

SEQ ID NO: 3756859 - RNA, 13 nt, Salmonella typhimurium LT2
cuaauuaaaaaga

SEQ ID NO: 3756860 - RNA, 17 nt, Salmonella typhimurium LT2
cuaauuaaaaagagaaa

SEQ ID NO: 3756861 - RNA, 21 nt, Salmonella typhimurium LT2
cuaauuaaaaagagaaaaaau

SEQ ID NO: 3756862 - RNA, 14 nt, Salmonella typhimurium LT2
cuaauuaauucuaa

SEQ ID NO: 3756863 - RNA, 15 nt, Salmonella typhimurium LT2
cuaauucuucguagg

SEQ ID NO: 3756864 - RNA, 19 nt, Salmonella typhimurium LT2
cuaauugcccccuuuuuau

SEQ ID NO: 3756865 - RNA, 23 nt, Salmonella typhimurium LT2
cuaauugcccccuuuuuauucau

SEQ ID NO: 3756866 - RNA, 23 nt, Salmonella typhimurium LT2
cuaauugccuggcagcuugccuu

SEQ ID NO: 3756867 - RNA, 20 nt, Salmonella typhimurium LT2
cuaauuuauugccacgccau

SEQ ID NO: 3756868 - RNA, 21 nt, Salmonella typhimurium LT2
cuaauuugagucgcagcacau

SEQ ID NO: 3756869 - RNA, 13 nt, Salmonella typhimurium LT2
cuaauuuuacuuu

SEQ ID NO: 3756870 - RNA, 18 nt, Salmonella typhimurium LT2
cuaauuuuacuuucauuc

SEQ ID NO: 3756871 - RNA, 15 nt, Salmonella typhimurium LT2
cuaauuuucagggug

SEQ ID NO: 3756872 - RNA, 21 nt, Salmonella typhimurium LT2
cuacaaauuacacaauaucaa

SEQ ID NO: 3756873 - RNA, 22 nt, Salmonella typhimurium LT2
cuacaaauuacacaauaucaau

SEQ ID NO: 3756874 - RNA, 13 nt, Salmonella typhimurium LT2
cuacaacucagcg

SEQ ID NO: 3756875 - RNA, 20 nt, Salmonella typhimurium LT2
cuacaauccaggacguccug

SEQ ID NO: 3756876 - RNA, 22 nt, Salmonella typhimurium LT2
cuacacacucggugcauuuguc

SEQ ID NO: 3756877 - RNA, 19 nt, Salmonella typhimurium LT2
cuacacagcgcgaguauuc

SEQ ID NO: 3756878 - RNA, 14 nt, Salmonella typhimurium LT2
cuacaccaccagcc

SEQ ID NO: 3756879 - RNA, 19 nt, Salmonella typhimurium LT2
cuacaccccuucuggagaa

SEQ ID NO: 3756880 - RNA, 18 nt, Salmonella typhimurium LT2
cuacaccguauccggccu

SEQ ID NO: 3756881 - RNA, 19 nt, Salmonella typhimurium LT2
cuacaccguauccggccug

SEQ ID NO: 3756882 - RNA, 22 nt, Salmonella typhimurium LT2
cuacaccguauccggccugcag

SEQ ID NO: 3756883 - RNA, 22 nt, Salmonella typhimurium LT2
cuacaccguuucugaucuguuu

SEQ ID NO: 3756884 - RNA, 22 nt, Salmonella typhimurium LT2
cuacagacgcauuaaaaugaug

SEQ ID NO: 3756885 - RNA, 16 nt, Salmonella typhimurium LT2
cuacagcaucccgcuc

SEQ ID NO: 3756886 - RNA, 16 nt, Salmonella typhimurium LT2
cuacaggcgucacggc

SEQ ID NO: 3756887 - RNA, 21 nt, Salmonella typhimurium LT2
cuacaggucgacgugaacugc

SEQ ID NO: 3756888 - RNA, 12 nt, Salmonella typhimurium LT2
cuacauacugcu

SEQ ID NO: 3756889 - RNA, 18 nt, Salmonella typhimurium LT2
cuacauagcuauauuuuu

SEQ ID NO: 3756890 - RNA, 19 nt, Salmonella typhimurium LT2
cuacaucuccuuaacacaa

SEQ ID NO: 3756891 - RNA, 20 nt, Salmonella typhimurium LT2
cuacaugccaacuuuacuua

SEQ ID NO: 3756892 - RNA, 16 nt, Salmonella typhimurium LT2
cuacaugucuccucag

SEQ ID NO: 3756893 - RNA, 15 nt, Salmonella typhimurium LT2
cuacauuaaugucau

SEQ ID NO: 3756894 - RNA, 18 nt, Salmonella typhimurium LT2
cuacauuaaugucaugaa

SEQ ID NO: 3756895 - RNA, 16 nt, Salmonella typhimurium LT2
cuacauuccaucaugu

SEQ ID NO: 3756896 - RNA, 18 nt, Salmonella typhimurium LT2
cuaccacagaaaucgccg

SEQ ID NO: 3756897 - RNA, 19 nt, Salmonella typhimurium LT2
cuaccacucccaaauuuug

SEQ ID NO: 3756898 - RNA, 20 nt, Salmonella typhimurium LT2
cuaccagcgcgccagcgcca

SEQ ID NO: 3756899 - RNA, 22 nt, Salmonella typhimurium LT2
cuaccagcgcgccagcgccaau

SEQ ID NO: 3756900 - RNA, 21 nt, Salmonella typhimurium LT2
cuaccagcgcuauccaggccg

SEQ ID NO: 3756901 - RNA, 12 nt, Salmonella typhimurium LT2
cuaccaggauag

SEQ ID NO: 3756902 - RNA, 13 nt, Salmonella typhimurium LT2
cuaccauaaugau

SEQ ID NO: 3756903 - RNA, 11 nt, Salmonella typhimurium LT2
cuaccaucggc

SEQ ID NO: 3756904 - RNA, 16 nt, Salmonella typhimurium LT2
cuaccauuacccgaac

SEQ ID NO: 3756905 - RNA, 18 nt, Salmonella typhimurium LT2
cuaccauugauaccaaua

SEQ ID NO: 3756906 - RNA, 20 nt, Salmonella typhimurium LT2
cuaccgccguuucguugcca

SEQ ID NO: 3756907 - RNA, 13 nt, Salmonella typhimurium LT2
cuauuuucucuuc

SEQ ID NO: 3756908 - RNA, 19 nt, Salmonella typhimurium LT2
cuauuuucucuuccacaaa

SEQ ID NO: 3756909 - RNA, 23 nt, Salmonella typhimurium LT2
cuauuuucugcucgggccagcuc

SEQ ID NO: 3756910 - RNA, 11 nt, Salmonella typhimurium LT2
cuauuuuucac

SEQ ID NO: 3756911 - RNA, 13 nt, Salmonella typhimurium LT2
cucaaaaagagga

SEQ ID NO: 3756912 - RNA, 15 nt, Salmonella typhimurium LT2
cucaaaaagaggaaa

SEQ ID NO: 3756913 - RNA, 15 nt, Salmonella typhimurium LT2
cucaaaccccagauu

SEQ ID NO: 3756914 - RNA, 18 nt, Salmonella typhimurium LT2
cucaaagcguuauuugca

SEQ ID NO: 3756915 - RNA, 16 nt, Salmonella typhimurium LT2
cucaacaaacuuaauu

SEQ ID NO: 3756916 - RNA, 17 nt, Salmonella typhimurium LT2
cucaacaaacuuaauua

SEQ ID NO: 3756917 - RNA, 20 nt, Salmonella typhimurium LT2
cucaacagcgcggcaggccg

SEQ ID NO: 3756918 - RNA, 14 nt, Salmonella typhimurium LT2
cucaacaucauuaa

SEQ ID NO: 3756919 - RNA, 16 nt, Salmonella typhimurium LT2
cucaacauugccggca

SEQ ID NO: 3756920 - RNA, 22 nt, Salmonella typhimurium LT2
cucaacauugccggcaucauuc

SEQ ID NO: 3756921 - RNA, 14 nt, Salmonella typhimurium LT2
cucaaccagcaaug

SEQ ID NO: 3756922 - RNA, 12 nt, Salmonella typhimurium LT2
cucaaccagccg

SEQ ID NO: 3756923 - RNA, 15 nt, Salmonella typhimurium LT2
cucaaccgcgcggcg

SEQ ID NO: 3756924 - RNA, 15 nt, Salmonella typhimurium LT2
cucaacgcccugcuc

SEQ ID NO: 3756925 - RNA, 18 nt, Salmonella typhimurium LT2
cucaacgccuuuacaauc

SEQ ID NO: 3756926 - RNA, 22 nt, Salmonella typhimurium LT2
cucaacgcguucauccagcgcg

SEQ ID NO: 3756927 - RNA, 23 nt, Salmonella typhimurium LT2
cucaacgcguucauccagcgcgc

SEQ ID NO: 3756928 - RNA, 16 nt, Salmonella typhimurium LT2
cucaacgcucauaccu

SEQ ID NO: 3756929 - RNA, 20 nt, Salmonella typhimurium LT2
cucaacugcgggaaguagca

SEQ ID NO: 3756930 - RNA, 12 nt, Salmonella typhimurium LT2
cucaacuggaug

SEQ ID NO: 3756931 - RNA, 14 nt, Salmonella typhimurium LT2
cucaagcgccgccg

SEQ ID NO: 3756932 - RNA, 15 nt, Salmonella typhimurium LT2
cucaagcgccgccgc

SEQ ID NO: 3756933 - RNA, 16 nt, Salmonella typhimurium LT2
cucaagcguucucacg

SEQ ID NO: 3756934 - RNA, 20 nt, Salmonella typhimurium LT2
cucaagcguucucacggucu

SEQ ID NO: 3756935 - RNA, 21 nt, Salmonella typhimurium LT2
cucaagcuguagcguuuccac

SEQ ID NO: 3756936 - RNA, 22 nt, Salmonella typhimurium LT2
cucaaggcaauagaccagcggc

SEQ ID NO: 3756937 - RNA, 20 nt, Salmonella typhimurium LT2
cucaaguuauguuaucccca

SEQ ID NO: 3756938 - RNA, 19 nt, Salmonella typhimurium LT2
cucaauaauacgauguauc

SEQ ID NO: 3756939 - RNA, 14 nt, Salmonella typhimurium LT2
cucaauagcggcgc

SEQ ID NO: 3756940 - RNA, 19 nt, Salmonella typhimurium LT2
cucaauaucgccuaccgga

SEQ ID NO: 3756941 - RNA, 17 nt, Salmonella typhimurium LT2
cucaauaugccaggcau

SEQ ID NO: 3756942 - RNA, 16 nt, Salmonella typhimurium LT2
cucaauauuaucuucg

SEQ ID NO: 3756943 - RNA, 18 nt, Salmonella typhimurium LT2
cucaaucauugucauuaa

SEQ ID NO: 3756944 - RNA, 15 nt, Salmonella typhimurium LT2
cucacaaugccgccc

SEQ ID NO: 3756945 - RNA, 19 nt, Salmonella typhimurium LT2
cucacagaaucaucaggcu

SEQ ID NO: 3756946 - RNA, 19 nt, Salmonella typhimurium LT2
cucacauauucaauaauau

SEQ ID NO: 3756947 - RNA, 19 nt, Salmonella typhimurium LT2
cucacauucauaaaagauc

SEQ ID NO: 3756948 - RNA, 20 nt, Salmonella typhimurium LT2
cucacauucauugccgccag

SEQ ID NO: 3756949 - RNA, 15 nt, Salmonella typhimurium LT2
cucaccccuucuuua

SEQ ID NO: 3756950 - RNA, 17 nt, Salmonella typhimurium LT2
cucaccgagacugcccg

SEQ ID NO: 3756951 - RNA, 13 nt, Salmonella typhimurium LT2
cucaccgcccagg

SEQ ID NO: 3756952 - RNA, 18 nt, Salmonella typhimurium LT2
cucaccgccggacaguuc

SEQ ID NO: 3756953 - RNA, 21 nt, Salmonella typhimurium LT2
cucaccgugguuaccgccaga

SEQ ID NO: 3756954 - RNA, 19 nt, Salmonella typhimurium LT2
cucaccuccgccaccagcg

SEQ ID NO: 3756955 - RNA, 16 nt, Salmonella typhimurium LT2
cucaccugcucgcccu

SEQ ID NO: 3756956 - RNA, 22 nt, Salmonella typhimurium LT2
cucaccuuuuuauuuacugccg

SEQ ID NO: 3756957 - RNA, 18 nt, Salmonella typhimurium LT2
cucacgaauaagaaucag

SEQ ID NO: 3756958 - RNA, 19 nt, Salmonella typhimurium LT2
cucacgauaacgcagcgcg

SEQ ID NO: 3756959 - RNA, 16 nt, Salmonella typhimurium LT2
cucacgcaacaacagg

SEQ ID NO: 3756960 - RNA, 14 nt, Salmonella typhimurium LT2
cucacgcucauagc

SEQ ID NO: 3756961 - RNA, 15 nt, Salmonella typhimurium LT2
cucacgcucauagcc

SEQ ID NO: 3756962 - RNA, 18 nt, Salmonella typhimurium LT2
cucacgcucauagccgcu

SEQ ID NO: 3756963 - RNA, 12 nt, Salmonella typhimurium LT2
cucacggagaaa

SEQ ID NO: 3756964 - RNA, 23 nt, Salmonella typhimurium LT2
cucacggagaaaagcgaaaauaa

SEQ ID NO: 3756965 - RNA, 22 nt, Salmonella typhimurium LT2
cucacgggcguagucagcgacg

SEQ ID NO: 3756966 - RNA, 21 nt, Salmonella typhimurium LT2
cucacgguuucuacuuccacc

SEQ ID NO: 3756967 - RNA, 17 nt, Salmonella typhimurium LT2
cucacuuuucuuuccug

SEQ ID NO: 3756968 - RNA, 18 nt, Salmonella typhimurium LT2
cucacuuuucuuuccugc

SEQ ID NO: 3756969 - RNA, 22 nt, Salmonella typhimurium LT2
cucagaccgaucucaugcaacu

SEQ ID NO: 3756970 - RNA, 18 nt, Salmonella typhimurium LT2
cucagaucggcagacagu

SEQ ID NO: 3756971 - RNA, 20 nt, Salmonella typhimurium LT2
cucagcaaaacggauaauau

SEQ ID NO: 3756972 - RNA, 24 nt, Salmonella typhimurium LT2
cucagcaaaaucacgcacacgucu

SEQ ID NO: 3756973 - RNA, 13 nt, Salmonella typhimurium LT2
cucagccaggcgc

SEQ ID NO: 3756974 - RNA, 17 nt, Salmonella typhimurium LT2
cucagccagguauuuag

SEQ ID NO: 3756975 - RNA, 19 nt, Salmonella typhimurium LT2
cucagccaggucugaacca

SEQ ID NO: 3756976 - RNA, 14 nt, Salmonella typhimurium LT2
cucagcgccccagc

SEQ ID NO: 3756977 - RNA, 17 nt, Salmonella typhimurium LT2
cucagcgccccagccaa

SEQ ID NO: 3756978 - RNA, 19 nt, Salmonella typhimurium LT2
cucagcgccccagccaaag

SEQ ID NO: 3756979 - RNA, 15 nt, Salmonella typhimurium LT2
cucagcgcggcagcc

SEQ ID NO: 3756980 - RNA, 18 nt, Salmonella typhimurium LT2
cucagcgucugcacgcca

SEQ ID NO: 3756981 - RNA, 18 nt, Salmonella typhimurium LT2
cucaggcaagacacagcg

SEQ ID NO: 3756982 - RNA, 12 nt, Salmonella typhimurium LT2
cucaggcaguaa

SEQ ID NO: 3756983 - RNA, 13 nt, Salmonella typhimurium LT2
cucaggcgagccc

SEQ ID NO: 3756984 - RNA, 23 nt, Salmonella typhimurium LT2
cucagggucaucguuauucgcug

SEQ ID NO: 3756985 - RNA, 19 nt, Salmonella typhimurium LT2
cucaggguccccauauccc

SEQ ID NO: 3756986 - RNA, 17 nt, Salmonella typhimurium LT2
cucaggguuuucuaccg

SEQ ID NO: 3756987 - RNA, 22 nt, Salmonella typhimurium LT2
cucagguuauacugugacgaca

SEQ ID NO: 3756988 - RNA, 15 nt, Salmonella typhimurium LT2
cucagguucgggcca

SEQ ID NO: 3756989 - RNA, 18 nt, Salmonella typhimurium LT2
cucagguucgggccaccu

SEQ ID NO: 3756990 - RNA, 16 nt, Salmonella typhimurium LT2
cucaguccagccgccg

SEQ ID NO: 3756991 - RNA, 20 nt, Salmonella typhimurium LT2
cucaguccagccgccgcgcg

SEQ ID NO: 3756992 - RNA, 18 nt, Salmonella typhimurium LT2
cucaguucauuauuucau

SEQ ID NO: 3756993 - RNA, 18 nt, Salmonella typhimurium LT2
cucaguugcguucccagu

SEQ ID NO: 3756994 - RNA, 14 nt, Salmonella typhimurium LT2
cucaguuuccagcc

SEQ ID NO: 3756995 - RNA, 18 nt, Salmonella typhimurium LT2
cucauaaauugcagcgac

SEQ ID NO: 3756996 - RNA, 20 nt, Salmonella typhimurium LT2
cucauaacggcuuaacgcca

SEQ ID NO: 3756997 - RNA, 16 nt, Salmonella typhimurium LT2
cucauaaugauggggu

SEQ ID NO: 3756998 - RNA, 13 nt, Salmonella typhimurium LT2
cucauacccuucc

SEQ ID NO: 3756999 - RNA, 15 nt, Salmonella typhimurium LT2
cucauacccuuccag

SEQ ID NO: 3757000 - RNA, 15 nt, Salmonella typhimurium LT2
cucauaccgccgccc

SEQ ID NO: 3757001 - RNA, 18 nt, Salmonella typhimurium LT2
cucauaccgccgcccagc

SEQ ID NO: 3757002 - RNA, 13 nt, Salmonella typhimurium LT2
cucauagacugcc

SEQ ID NO: 3757003 - RNA, 16 nt, Salmonella typhimurium LT2
cucauagccgcuuucc

SEQ ID NO: 3757004 - RNA, 14 nt, Salmonella typhimurium LT2
cucauauacccugc

SEQ ID NO: 3757005 - RNA, 15 nt, Salmonella typhimurium LT2
cucauauacccugcg

SEQ ID NO: 3757006 - RNA, 16 nt, Salmonella typhimurium LT2
cucauauuccagccac

SEQ ID NO: 3757007 - RNA, 16 nt, Salmonella typhimurium LT2
cucaucaaacagcggc

SEQ ID NO: 3757008 - RNA, 14 nt, Salmonella typhimurium LT2
cucaucaaacaggg

SEQ ID NO: 3757009 - RNA, 17 nt, Salmonella typhimurium LT2
cucaucaaggaacacgg

SEQ ID NO: 3757010 - RNA, 13 nt, Salmonella typhimurium LT2
cucaucaauaaua

SEQ ID NO: 3757011 - RNA, 21 nt, Salmonella typhimurium LT2
cuccgccagcaaugccgccgc

SEQ ID NO: 3757012 - RNA, 16 nt, Salmonella typhimurium LT2
cuccgcccggugcuca

SEQ ID NO: 3757013 - RNA, 19 nt, Salmonella typhimurium LT2
cuccgcccggugcucaaua

SEQ ID NO: 3757014 - RNA, 19 nt, Salmonella typhimurium LT2
cuccgccgauaagcguugu

SEQ ID NO: 3757015 - RNA, 16 nt, Salmonella typhimurium LT2
cuccgccgcuaucgcc

SEQ ID NO: 3757016 - RNA, 21 nt, Salmonella typhimurium LT2
cuccgccgcuuuaucguaacc

SEQ ID NO: 3757017 - RNA, 19 nt, Salmonella typhimurium LT2
cuccgccggagcaucauuu

SEQ ID NO: 3757018 - RNA, 14 nt, Salmonella typhimurium LT2
cuccgccugcgguu

SEQ ID NO: 3757019 - RNA, 14 nt, Salmonella typhimurium LT2
cuccgcgcauguaa

SEQ ID NO: 3757020 - RNA, 14 nt, Salmonella typhimurium LT2
cuccgcgcuggcaa

SEQ ID NO: 3757021 - RNA, 15 nt, Salmonella typhimurium LT2
cuccgcgcuggcaau

SEQ ID NO: 3757022 - RNA, 21 nt, Salmonella typhimurium LT2
cuccgcuauaaaaauuauaac

SEQ ID NO: 3757023 - RNA, 12 nt, Salmonella typhimurium LT2
cuccgcuuccac

SEQ ID NO: 3757024 - RNA, 23 nt, Salmonella typhimurium LT2
cuccggcgcgaacggcaucuacu

SEQ ID NO: 3757025 - RNA, 17 nt, Salmonella typhimurium LT2
cuccggcgcgccgcugg

SEQ ID NO: 3757026 - RNA, 15 nt, Salmonella typhimurium LT2
cuccggcgcugcgcu

SEQ ID NO: 3757027 - RNA, 16 nt, Salmonella typhimurium LT2
cuccggcucgucccgc

SEQ ID NO: 3757028 - RNA, 21 nt, Salmonella typhimurium LT2
cuccggcuuaaugcauggcag

SEQ ID NO: 3757029 - RNA, 16 nt, Salmonella typhimurium LT2
cuccgggcgguucggc

SEQ ID NO: 3757030 - RNA, 22 nt, Salmonella typhimurium LT2
cuccggguugccugauggcgcu

SEQ ID NO: 3757031 - RNA, 21 nt, Salmonella typhimurium LT2
cuccgguaucgccggcagacg

SEQ ID NO: 3757032 - RNA, 15 nt, Salmonella typhimurium LT2
cuccuaagagaaaac

SEQ ID NO: 3757033 - RNA, 21 nt, Salmonella typhimurium LT2
cuccuauuaucggcaccaucu

SEQ ID NO: 3757034 - RNA, 22 nt, Salmonella typhimurium LT2
cuccuccaucaguucggcgcgc

SEQ ID NO: 3757035 - RNA, 19 nt, Salmonella typhimurium LT2
cuccuccccggcgacccgc

SEQ ID NO: 3757036 - RNA, 13 nt, Salmonella typhimurium LT2
cuccuccggcuuc

SEQ ID NO: 3757037 - RNA, 18 nt, Salmonella typhimurium LT2
cuccucgcaggcucgucg

SEQ ID NO: 3757038 - RNA, 22 nt, Salmonella typhimurium LT2
cuccugaaucgccgucagugag

SEQ ID NO: 3757039 - RNA, 15 nt, Salmonella typhimurium LT2
cuccugacugccgcc

SEQ ID NO: 3757040 - RNA, 21 nt, Salmonella typhimurium LT2
cuccugcaaucgcucuugcac

SEQ ID NO: 3757041 - RNA, 15 nt, Salmonella typhimurium LT2
cuccugcgccagccg

SEQ ID NO: 3757042 - RNA, 13 nt, Salmonella typhimurium LT2
cuccugcucccag

SEQ ID NO: 3757043 - RNA, 15 nt, Salmonella typhimurium LT2
cuccuggauuuuacc

SEQ ID NO: 3757044 - RNA, 20 nt, Salmonella typhimurium LT2
cuccugguccguaaccuggc

SEQ ID NO: 3757045 - RNA, 17 nt, Salmonella typhimurium LT2
cuccugugcucccgcgc

SEQ ID NO: 3757046 - RNA, 16 nt, Salmonella typhimurium LT2
cuccuucuucgccguc

SEQ ID NO: 3757047 - RNA, 23 nt, Salmonella typhimurium LT2
cuccuucuucgccgucauaaaac

SEQ ID NO: 3757048 - RNA, 23 nt, Salmonella typhimurium LT2
cuccuuguaagggaggugcucuc

SEQ ID NO: 3757049 - RNA, 12 nt, Salmonella typhimurium LT2
cucgaaccaacg

SEQ ID NO: 3757050 - RNA, 18 nt, Salmonella typhimurium LT2
cucgacauagguucugcg

SEQ ID NO: 3757051 - RNA, 19 nt, Salmonella typhimurium LT2
cucgacauagguucugcga

SEQ ID NO: 3757052 - RNA, 16 nt, Salmonella typhimurium LT2
cucgaccuggugcuca

SEQ ID NO: 3757053 - RNA, 16 nt, Salmonella typhimurium LT2
cucgacguccagcgcg

SEQ ID NO: 3757054 - RNA, 21 nt, Salmonella typhimurium LT2
cucgacguuuuccaucaccau

SEQ ID NO: 3757055 - RNA, 19 nt, Salmonella typhimurium LT2
cucgacuaaaggcagcgcg

SEQ ID NO: 3757056 - RNA, 20 nt, Salmonella typhimurium LT2
cucgacuaaaggcagcgcgc

SEQ ID NO: 3757057 - RNA, 20 nt, Salmonella typhimurium LT2
cucgacuuuucacuuauaaa

SEQ ID NO: 3757058 - RNA, 17 nt, Salmonella typhimurium LT2
cucgagcauuugcgcuu

SEQ ID NO: 3757059 - RNA, 21 nt, Salmonella typhimurium LT2
cucgaggaacuguucagccag

SEQ ID NO: 3757060 - RNA, 16 nt, Salmonella typhimurium LT2
cucgauaacuuucggg

SEQ ID NO: 3757061 - RNA, 22 nt, Salmonella typhimurium LT2
cucgauaauauccgacgccugu

SEQ ID NO: 3757062 - RNA, 20 nt, Salmonella typhimurium LT2
cucgauaaucccggcgcgcg

SEQ ID NO: 3757063 - RNA, 19 nt, Salmonella typhimurium LT2
cucgauagcguuuuccagc

SEQ ID NO: 3757064 - RNA, 13 nt, Salmonella typhimurium LT2
cucgaugauaaag

SEQ ID NO: 3757065 - RNA, 22 nt, Salmonella typhimurium LT2
cucgauuccugacgcacagugu

SEQ ID NO: 3757066 - RNA, 15 nt, Salmonella typhimurium LT2
cucgcaagauuccag

SEQ ID NO: 3757067 - RNA, 14 nt, Salmonella typhimurium LT2
cucgcacaccagau

SEQ ID NO: 3757068 - RNA, 15 nt, Salmonella typhimurium LT2
cucgcacauaucgca

SEQ ID NO: 3757069 - RNA, 20 nt, Salmonella typhimurium LT2
cucgcacugauagccgccag

SEQ ID NO: 3757070 - RNA, 21 nt, Salmonella typhimurium LT2
cucgcaggccaaacagcggcu

SEQ ID NO: 3757071 - RNA, 17 nt, Salmonella typhimurium LT2
cucgcagguacgacacc

SEQ ID NO: 3757072 - RNA, 14 nt, Salmonella typhimurium LT2
cucgcauccuccau

SEQ ID NO: 3757073 - RNA, 20 nt, Salmonella typhimurium LT2
cucgccaaagcgcugcugcu

SEQ ID NO: 3757074 - RNA, 18 nt, Salmonella typhimurium LT2
cucgccaauauccccagc

SEQ ID NO: 3757075 - RNA, 11 nt, Salmonella typhimurium LT2
cucgccagcgc

SEQ ID NO: 3757076 - RNA, 12 nt, Salmonella typhimurium LT2
cucgccagcgca

SEQ ID NO: 3757077 - RNA, 13 nt, Salmonella typhimurium LT2
cucgccauaaaga

SEQ ID NO: 3757078 - RNA, 19 nt, Salmonella typhimurium LT2
cucgccauugcguaaacgc

SEQ ID NO: 3757079 - RNA, 14 nt, Salmonella typhimurium LT2
cucgcccagcgccu

SEQ ID NO: 3757080 - RNA, 13 nt, Salmonella typhimurium LT2
cucgccccuucgg

SEQ ID NO: 3757081 - RNA, 14 nt, Salmonella typhimurium LT2
cucgcccgcagcaa

SEQ ID NO: 3757082 - RNA, 14 nt, Salmonella typhimurium LT2
cucgcccgccagau

SEQ ID NO: 3757083 - RNA, 11 nt, Salmonella typhimurium LT2
cucgccgccgg

SEQ ID NO: 3757084 - RNA, 13 nt, Salmonella typhimurium LT2
cucgccgccuccc

SEQ ID NO: 3757085 - RNA, 15 nt, Salmonella typhimurium LT2
cucgccgccuccccc

SEQ ID NO: 3757086 - RNA, 23 nt, Salmonella typhimurium LT2
cucgccgcguuuaagccccuggc

SEQ ID NO: 3757087 - RNA, 17 nt, Salmonella typhimurium LT2
cucgccggaaagaaacg

SEQ ID NO: 3757088 - RNA, 23 nt, Salmonella typhimurium LT2
cucgccggauggcgacgcguagc

SEQ ID NO: 3757089 - RNA, 18 nt, Salmonella typhimurium LT2
cucgccgguagccagcca

SEQ ID NO: 3757090 - RNA, 21 nt, Salmonella typhimurium LT2
cucgccgguuuuuuuacucug

SEQ ID NO: 3757091 - RNA, 22 nt, Salmonella typhimurium LT2
cucgccguuaugcagcggaauu

SEQ ID NO: 3757092 - RNA, 22 nt, Salmonella typhimurium LT2
cucgcgcaucaggaucuucauc

SEQ ID NO: 3757093 - RNA, 15 nt, Salmonella typhimurium LT2
cucgcgccuucgccg

SEQ ID NO: 3757094 - RNA, 17 nt, Salmonella typhimurium LT2
cucgcgcucaaaaaagg

SEQ ID NO: 3757095 - RNA, 15 nt, Salmonella typhimurium LT2
cucgcggcggaccgc

SEQ ID NO: 3757096 - RNA, 22 nt, Salmonella typhimurium LT2
cucgcuaauauccaccagccca

SEQ ID NO: 3757097 - RNA, 22 nt, Salmonella typhimurium LT2
cucgcuaaugcccggcgcggca

SEQ ID NO: 3757098 - RNA, 19 nt, Salmonella typhimurium LT2
cucgcuauauacccccugc

SEQ ID NO: 3757099 - RNA, 23 nt, Salmonella typhimurium LT2
cucgcucaucacaucgcgcagca

SEQ ID NO: 3757100 - RNA, 17 nt, Salmonella typhimurium LT2
cucgcucgcccaucacu

SEQ ID NO: 3757101 - RNA, 16 nt, Salmonella typhimurium LT2
cucgcucgcccgcguu

SEQ ID NO: 3757102 - RNA, 14 nt, Salmonella typhimurium LT2
cucgcugacgccag

SEQ ID NO: 3757103 - RNA, 22 nt, Salmonella typhimurium LT2
cucgcugauacgcuggcacagg

SEQ ID NO: 3757104 - RNA, 19 nt, Salmonella typhimurium LT2
cucgcugcgcucgcccuuc

SEQ ID NO: 3757105 - RNA, 22 nt, Salmonella typhimurium LT2
cucgcuuaaugaggccaccagu

SEQ ID NO: 3757106 - RNA, 16 nt, Salmonella typhimurium LT2
cucgcuuacgcggcgc

SEQ ID NO: 3757107 - RNA, 16 nt, Salmonella typhimurium LT2
cucggauagcuacgau

SEQ ID NO: 3757108 - RNA, 21 nt, Salmonella typhimurium LT2
cucggcagcaauacgcccgcc

SEQ ID NO: 3757109 - RNA, 17 nt, Salmonella typhimurium LT2
cucggcauacaccgcca

SEQ ID NO: 3757110 - RNA, 21 nt, Salmonella typhimurium LT2
cucggcauacaccgccagcgu

SEQ ID NO: 3757111 - RNA, 13 nt, Salmonella typhimurium LT2
cucggcgagcagu

SEQ ID NO: 3757112 - RNA, 20 nt, Salmonella typhimurium LT2
cucggcgagcaguacgccug

SEQ ID NO: 3757113 - RNA, 22 nt, Salmonella typhimurium LT2
cucggcgaggacccguggcugc

SEQ ID NO: 3757114 - RNA, 18 nt, Salmonella typhimurium LT2
cugaaaggcgucagccgc

SEQ ID NO: 3757115 - RNA, 19 nt, Salmonella typhimurium LT2
cugaaauaaaagcaaugua

SEQ ID NO: 3757116 - RNA, 15 nt, Salmonella typhimurium LT2
cugaaauagccccgu

SEQ ID NO: 3757117 - RNA, 24 nt, Salmonella typhimurium LT2
cugaacagcggcggcacggcguca

SEQ ID NO: 3757118 - RNA, 14 nt, Salmonella typhimurium LT2
cugaacaucgccgu

SEQ ID NO: 3757119 - RNA, 20 nt, Salmonella typhimurium LT2
cugaaccagcggcaccagca

SEQ ID NO: 3757120 - RNA, 21 nt, Salmonella typhimurium LT2
cugaacgcaguuuaucagaag

SEQ ID NO: 3757121 - RNA, 16 nt, Salmonella typhimurium LT2
cugaacgccaggccgu

SEQ ID NO: 3757122 - RNA, 18 nt, Salmonella typhimurium LT2
cugaacgcccggcgcgac

SEQ ID NO: 3757123 - RNA, 16 nt, Salmonella typhimurium LT2
cugaacgguuuauacc

SEQ ID NO: 3757124 - RNA, 15 nt, Salmonella typhimurium LT2
cugaacguauggcau

SEQ ID NO: 3757125 - RNA, 20 nt, Salmonella typhimurium LT2
cugaacguuuuagcauguaa

SEQ ID NO: 3757126 - RNA, 17 nt, Salmonella typhimurium LT2
cugaacuauaggaaaau

SEQ ID NO: 3757127 - RNA, 20 nt, Salmonella typhimurium LT2
cugaacuauaggaaaauaau

SEQ ID NO: 3757128 - RNA, 18 nt, Salmonella typhimurium LT2
cugaagaaaaggaauacc

SEQ ID NO: 3757129 - RNA, 17 nt, Salmonella typhimurium LT2
cugaagacgaaacgcuu

SEQ ID NO: 3757130 - RNA, 15 nt, Salmonella typhimurium LT2
cugaagacuggcaag

SEQ ID NO: 3757131 - RNA, 22 nt, Salmonella typhimurium LT2
cugaagagcgacuaagaggugc

SEQ ID NO: 3757132 - RNA, 14 nt, Salmonella typhimurium LT2
cugaagauaaaauu

SEQ ID NO: 3757133 - RNA, 17 nt, Salmonella typhimurium LT2
cugaagauaaacagcag

SEQ ID NO: 3757134 - RNA, 12 nt, Salmonella typhimurium LT2
cugaagcccgcg

SEQ ID NO: 3757135 - RNA, 16 nt, Salmonella typhimurium LT2
cugaagcccuuuagua

SEQ ID NO: 3757136 - RNA, 23 nt, Salmonella typhimurium LT2
cugaagcgcuucaccggcgugcg

SEQ ID NO: 3757137 - RNA, 14 nt, Salmonella typhimurium LT2
cugaagcggcgcaa

SEQ ID NO: 3757138 - RNA, 20 nt, Salmonella typhimurium LT2
cugaagcggcgcaauuuucc

SEQ ID NO: 3757139 - RNA, 14 nt, Salmonella typhimurium LT2
cugaagcguaaaaa

SEQ ID NO: 3757140 - RNA, 15 nt, Salmonella typhimurium LT2
cugaaggacaagcug

SEQ ID NO: 3757141 - RNA, 17 nt, Salmonella typhimurium LT2
cugaaggacaagcugcg

SEQ ID NO: 3757142 - RNA, 20 nt, Salmonella typhimurium LT2
cugaaguaauguucaggguu

SEQ ID NO: 3757143 - RNA, 21 nt, Salmonella typhimurium LT2
cugaaguaucgacgcagacaa

SEQ ID NO: 3757144 - RNA, 15 nt, Salmonella typhimurium LT2
cugaauaaauugaau

SEQ ID NO: 3757145 - RNA, 17 nt, Salmonella typhimurium LT2
cugaauaacagcaccau

SEQ ID NO: 3757146 - RNA, 19 nt, Salmonella typhimurium LT2
cugaauaacagcaccauua

SEQ ID NO: 3757147 - RNA, 14 nt, Salmonella typhimurium LT2
cugaauaacccgca

SEQ ID NO: 3757148 - RNA, 11 nt, Salmonella typhimurium LT2
cugaauaaucg

SEQ ID NO: 3757149 - RNA, 17 nt, Salmonella typhimurium LT2
cugaauacccaacugua

SEQ ID NO: 3757150 - RNA, 16 nt, Salmonella typhimurium LT2
cugaauaccugcccca

SEQ ID NO: 3757151 - RNA, 18 nt, Salmonella typhimurium LT2
cugaauaccuucacaaaa

SEQ ID NO: 3757152 - RNA, 13 nt, Salmonella typhimurium LT2
cugaauagccagc

SEQ ID NO: 3757153 - RNA, 15 nt, Salmonella typhimurium LT2
cugaauagccagccc

SEQ ID NO: 3757154 - RNA, 18 nt, Salmonella typhimurium LT2
cugaauauggccaguccc

SEQ ID NO: 3757155 - RNA, 19 nt, Salmonella typhimurium LT2
cugaauauucggcuccaga

SEQ ID NO: 3757156 - RNA, 22 nt, Salmonella typhimurium LT2
cugaauauucggcuccagauug

SEQ ID NO: 3757157 - RNA, 18 nt, Salmonella typhimurium LT2
cugaaucaauagcugggu

SEQ ID NO: 3757158 - RNA, 22 nt, Salmonella typhimurium LT2
cugaaucaaugcaucuucacug

SEQ ID NO: 3757159 - RNA, 16 nt, Salmonella typhimurium LT2
cugaaucagcaucuua

SEQ ID NO: 3757160 - RNA, 20 nt, Salmonella typhimurium LT2
cugaaucuugcgcagcauau

SEQ ID NO: 3757161 - RNA, 14 nt, Salmonella typhimurium LT2
cugaaugaagccuu

SEQ ID NO: 3757162 - RNA, 15 nt, Salmonella typhimurium LT2
cugaaugaagccuua

SEQ ID NO: 3757163 - RNA, 20 nt, Salmonella typhimurium LT2
cugaaugccauccagcacca

SEQ ID NO: 3757164 - RNA, 14 nt, Salmonella typhimurium LT2
cugaaugccauccc

SEQ ID NO: 3757165 - RNA, 14 nt, Salmonella typhimurium LT2
cugaaugcucucau

SEQ ID NO: 3757166 - RNA, 12 nt, Salmonella typhimurium LT2
cugaauucgcca

SEQ ID NO: 3757167 - RNA, 16 nt, Salmonella typhimurium LT2
cugaauucgccaccag

SEQ ID NO: 3757168 - RNA, 17 nt, Salmonella typhimurium LT2
cugaauucgccaccagc

SEQ ID NO: 3757169 - RNA, 14 nt, Salmonella typhimurium LT2
cugaauuucacgcu

SEQ ID NO: 3757170 - RNA, 22 nt, Salmonella typhimurium LT2
cugacaaaucggcuccggcaaa

SEQ ID NO: 3757171 - RNA, 17 nt, Salmonella typhimurium LT2
cugacaaauuauaaacu

SEQ ID NO: 3757172 - RNA, 18 nt, Salmonella typhimurium LT2
cugacacagaggaauauu

SEQ ID NO: 3757173 - RNA, 21 nt, Salmonella typhimurium LT2
cugacagaauauaggagagcg

SEQ ID NO: 3757174 - RNA, 18 nt, Salmonella typhimurium LT2
cugacagccaaacugcug

SEQ ID NO: 3757175 - RNA, 23 nt, Salmonella typhimurium LT2
cugacaggccggauuagcgacag

SEQ ID NO: 3757176 - RNA, 18 nt, Salmonella typhimurium LT2
cugacagggucgcaauac

SEQ ID NO: 3757177 - RNA, 15 nt, Salmonella typhimurium LT2
cugacaggucggcgu

SEQ ID NO: 3757178 - RNA, 15 nt, Salmonella typhimurium LT2
cugacagugacggca

SEQ ID NO: 3757179 - RNA, 17 nt, Salmonella typhimurium LT2
cugacauuccuuuuaau

SEQ ID NO: 3757180 - RNA, 19 nt, Salmonella typhimurium LT2
cugaccaagcgucagcaug

SEQ ID NO: 3757181 - RNA, 14 nt, Salmonella typhimurium LT2
cugaccaaggcaaa

SEQ ID NO: 3757182 - RNA, 13 nt, Salmonella typhimurium LT2
cugaccagaccga

SEQ ID NO: 3757183 - RNA, 23 nt, Salmonella typhimurium LT2
cugaccaguuguuccgcgcugau

SEQ ID NO: 3757184 - RNA, 14 nt, Salmonella typhimurium LT2
cugaccaucaaucc

SEQ ID NO: 3757185 - RNA, 16 nt, Salmonella typhimurium LT2
cugaccgcguuuccac

SEQ ID NO: 3757186 - RNA, 13 nt, Salmonella typhimurium LT2
cugaccgcuccag

SEQ ID NO: 3757187 - RNA, 21 nt, Salmonella typhimurium LT2
cugaccguugaucuccgcgca

SEQ ID NO: 3757188 - RNA, 13 nt, Salmonella typhimurium LT2
cugaccuacaggc

SEQ ID NO: 3757189 - RNA, 22 nt, Salmonella typhimurium LT2
cugaccugcugguuauuaucca

SEQ ID NO: 3757190 - RNA, 18 nt, Salmonella typhimurium LT2
cugacgaaaacccgccac

SEQ ID NO: 3757191 - RNA, 21 nt, Salmonella typhimurium LT2
cugacgaaaacccgccaccau

SEQ ID NO: 3757192 - RNA, 20 nt, Salmonella typhimurium LT2
cugacgaccauugccaaugc

SEQ ID NO: 3757193 - RNA, 21 nt, Salmonella typhimurium LT2
cugacgaccauugccaaugcc

SEQ ID NO: 3757194 - RNA, 17 nt, Salmonella typhimurium LT2
cugacgaucaaccgguu

SEQ ID NO: 3757195 - RNA, 14 nt, Salmonella typhimurium LT2
cugacgcagcagcu

SEQ ID NO: 3757196 - RNA, 13 nt, Salmonella typhimurium LT2
cugacgccaccac

SEQ ID NO: 3757197 - RNA, 13 nt, Salmonella typhimurium LT2
cugacgccagcca

SEQ ID NO: 3757198 - RNA, 14 nt, Salmonella typhimurium LT2
cugacgccagccag

SEQ ID NO: 3757199 - RNA, 16 nt, Salmonella typhimurium LT2
cugacgccaggccauc

SEQ ID NO: 3757200 - RNA, 14 nt, Salmonella typhimurium LT2
cugacgcgaucgcc

SEQ ID NO: 3757201 - RNA, 18 nt, Salmonella typhimurium LT2
cugacgcgccagcucauu

SEQ ID NO: 3757202 - RNA, 17 nt, Salmonella typhimurium LT2
cugacgcggacgccacc

SEQ ID NO: 3757203 - RNA, 14 nt, Salmonella typhimurium LT2
cugacgcugagcgg

SEQ ID NO: 3757204 - RNA, 17 nt, Salmonella typhimurium LT2
cugacggcagccacgcc

SEQ ID NO: 3757205 - RNA, 23 nt, Salmonella typhimurium LT2
cugacggccugucuccgcagcag

SEQ ID NO: 3757206 - RNA, 16 nt, Salmonella typhimurium LT2
cugacggcgcugucac

SEQ ID NO: 3757207 - RNA, 19 nt, Salmonella typhimurium LT2
cugacgggcauuguuaauc

SEQ ID NO: 3757208 - RNA, 16 nt, Salmonella typhimurium LT2
cugacggggcgcgugc

SEQ ID NO: 3757209 - RNA, 22 nt, Salmonella typhimurium LT2
cugacggugauguuggcccgga

SEQ ID NO: 3757210 - RNA, 16 nt, Salmonella typhimurium LT2
cugacggugguaaauc

SEQ ID NO: 3757211 - RNA, 18 nt, Salmonella typhimurium LT2
cugacggugguaaaucag

SEQ ID NO: 3757212 - RNA, 17 nt, Salmonella typhimurium LT2
cugacguaaauucugau

SEQ ID NO: 3757213 - RNA, 22 nt, Salmonella typhimurium LT2
cugacgugaugauaggucagcg

SEQ ID NO: 3757214 - RNA, 16 nt, Salmonella typhimurium LT2
cugacguuacgcggug

SEQ ID NO: 3757215 - RNA, 17 nt, Salmonella typhimurium LT2
cugacguugcgaaucag

SEQ ID NO: 3757216 - RNA, 19 nt, Salmonella typhimurium LT2
cugacuacgguugccuuuc

SEQ ID NO: 3757217 - RNA, 15 nt, Salmonella typhimurium LT2
cugacuauccacagc

SEQ ID NO: 3757218 - RNA, 12 nt, Salmonella typhimurium LT2
cugauugagcau

SEQ ID NO: 3757219 - RNA, 19 nt, Salmonella typhimurium LT2
cugauuuaaucgcuucaau

SEQ ID NO: 3757220 - RNA, 20 nt, Salmonella typhimurium LT2
cugcaaaaagccuugcugaa

SEQ ID NO: 3757221 - RNA, 23 nt, Salmonella typhimurium LT2
cugcaaaaguuugaccagcaaua

SEQ ID NO: 3757222 - RNA, 19 nt, Salmonella typhimurium LT2
cugcaaacgcggcgccagc

SEQ ID NO: 3757223 - RNA, 17 nt, Salmonella typhimurium LT2
cugcaaagcaucugccg

SEQ ID NO: 3757224 - RNA, 19 nt, Salmonella typhimurium LT2
cugcaaauaccacaucaga

SEQ ID NO: 3757225 - RNA, 17 nt, Salmonella typhimurium LT2
cugcaacaacucgagca

SEQ ID NO: 3757226 - RNA, 20 nt, Salmonella typhimurium LT2
cugcaacagaagaguuaacu

SEQ ID NO: 3757227 - RNA, 17 nt, Salmonella typhimurium LT2
cugcaacagcaccagca

SEQ ID NO: 3757228 - RNA, 14 nt, Salmonella typhimurium LT2
cugcaacgacgcgg

SEQ ID NO: 3757229 - RNA, 14 nt, Salmonella typhimurium LT2
cugcaacgccagau

SEQ ID NO: 3757230 - RNA, 16 nt, Salmonella typhimurium LT2
cugcaacgucgcgccc

SEQ ID NO: 3757231 - RNA, 14 nt, Salmonella typhimurium LT2
cugcaacucuccca

SEQ ID NO: 3757232 - RNA, 13 nt, Salmonella typhimurium LT2
cugcaagggaauc

SEQ ID NO: 3757233 - RNA, 17 nt, Salmonella typhimurium LT2
cugcaauagcagaucgc

SEQ ID NO: 3757234 - RNA, 18 nt, Salmonella typhimurium LT2
cugcaaucgcucuugcac

SEQ ID NO: 3757235 - RNA, 20 nt, Salmonella typhimurium LT2
cugcaaugguaaaacgcugg

SEQ ID NO: 3757236 - RNA, 23 nt, Salmonella typhimurium LT2
cugcaaugugcaggcuuuuucau

SEQ ID NO: 3757237 - RNA, 22 nt, Salmonella typhimurium LT2
cugcaauguuuucagcaaauaa

SEQ ID NO: 3757238 - RNA, 17 nt, Salmonella typhimurium LT2
cugcacaauaccaauaa

SEQ ID NO: 3757239 - RNA, 14 nt, Salmonella typhimurium LT2
cugcacaaucgcca

SEQ ID NO: 3757240 - RNA, 17 nt, Salmonella typhimurium LT2
cugcacaaucgccagcc

SEQ ID NO: 3757241 - RNA, 19 nt, Salmonella typhimurium LT2
cugcacaaucgccagcccc

SEQ ID NO: 3757242 - RNA, 20 nt, Salmonella typhimurium LT2
cugcaccaaauccuccagcg

SEQ ID NO: 3757243 - RNA, 22 nt, Salmonella typhimurium LT2
cugcaccaaauccuccagcggc

SEQ ID NO: 3757244 - RNA, 12 nt, Salmonella typhimurium LT2
cugcaccaauca

SEQ ID NO: 3757245 - RNA, 23 nt, Salmonella typhimurium LT2
cugcaccaggagcaaaccgaccc

SEQ ID NO: 3757246 - RNA, 17 nt, Salmonella typhimurium LT2
cugcacccggagagaaa

SEQ ID NO: 3757247 - RNA, 24 nt, Salmonella typhimurium LT2
cugcaccuuuuuuuccagcgucug

SEQ ID NO: 3757248 - RNA, 17 nt, Salmonella typhimurium LT2
cugcacgaaauguagag

SEQ ID NO: 3757249 - RNA, 19 nt, Salmonella typhimurium LT2
cugcacgagagaccaugcu

SEQ ID NO: 3757250 - RNA, 18 nt, Salmonella typhimurium LT2
cugcacgccaauaauuuc

SEQ ID NO: 3757251 - RNA, 15 nt, Salmonella typhimurium LT2
cugcacggcauacuc

SEQ ID NO: 3757252 - RNA, 16 nt, Salmonella typhimurium LT2
cugcacguaccugcuc

SEQ ID NO: 3757253 - RNA, 16 nt, Salmonella typhimurium LT2
cugcacucgauggcuu

SEQ ID NO: 3757254 - RNA, 22 nt, Salmonella typhimurium LT2
cugcacuuuaaaccacaccuga

SEQ ID NO: 3757255 - RNA, 19 nt, Salmonella typhimurium LT2
cugcacuuuaagcggcagc

SEQ ID NO: 3757256 - RNA, 17 nt, Salmonella typhimurium LT2
cugcagaauaagcuccg

SEQ ID NO: 3757257 - RNA, 21 nt, Salmonella typhimurium LT2
cugcagaaucccgauaaucaa

SEQ ID NO: 3757258 - RNA, 13 nt, Salmonella typhimurium LT2
cugcagcagcuuc

SEQ ID NO: 3757259 - RNA, 15 nt, Salmonella typhimurium LT2
cugcagcuccgcaau

SEQ ID NO: 3757260 - RNA, 21 nt, Salmonella typhimurium LT2
cugcaggaaucgaaccugcaa

SEQ ID NO: 3757261 - RNA, 11 nt, Salmonella typhimurium LT2
cugcaggccaa

SEQ ID NO: 3757262 - RNA, 23 nt, Salmonella typhimurium LT2
cugcaguuuugcauucugcaacu

SEQ ID NO: 3757263 - RNA, 22 nt, Salmonella typhimurium LT2
cugcauaaacgcggccaucacg

SEQ ID NO: 3757264 - RNA, 15 nt, Salmonella typhimurium LT2
cugcauaauccaacg

SEQ ID NO: 3757265 - RNA, 12 nt, Salmonella typhimurium LT2
cugcauauuuuu

SEQ ID NO: 3757266 - RNA, 15 nt, Salmonella typhimurium LT2
cugcauauuuuucau

SEQ ID NO: 3757267 - RNA, 17 nt, Salmonella typhimurium LT2
cugcauauuuuucauuc

SEQ ID NO: 3757268 - RNA, 15 nt, Salmonella typhimurium LT2
cugcaucgacauccg

SEQ ID NO: 3757269 - RNA, 17 nt, Salmonella typhimurium LT2
cugcaucgugagcgcgu

SEQ ID NO: 3757270 - RNA, 19 nt, Salmonella typhimurium LT2
cugcaucguuugcaguucc

SEQ ID NO: 3757271 - RNA, 15 nt, Salmonella typhimurium LT2
cugcaucucauuaag

SEQ ID NO: 3757272 - RNA, 22 nt, Salmonella typhimurium LT2
cugcauuguuccugcuggcaaa

SEQ ID NO: 3757273 - RNA, 16 nt, Salmonella typhimurium LT2
cugccaacauggggag

SEQ ID NO: 3757274 - RNA, 19 nt, Salmonella typhimurium LT2
cugccaacgauauucgcug

SEQ ID NO: 3757275 - RNA, 22 nt, Salmonella typhimurium LT2
cugccaacgauauucgcugguc

SEQ ID NO: 3757276 - RNA, 20 nt, Salmonella typhimurium LT2
cugccacaaccgcccccaac

SEQ ID NO: 3757277 - RNA, 19 nt, Salmonella typhimurium LT2
cugccacaauuugcagauu

SEQ ID NO: 3757278 - RNA, 17 nt, Salmonella typhimurium LT2
cugccacacucucucca

SEQ ID NO: 3757279 - RNA, 20 nt, Salmonella typhimurium LT2
cugccaccacgcggccuccg

SEQ ID NO: 3757280 - RNA, 23 nt, Salmonella typhimurium LT2
cugccaccacgcggccuccggcg

SEQ ID NO: 3757281 - RNA, 20 nt, Salmonella typhimurium LT2
cugccacgcuuuuccuucca

SEQ ID NO: 3757282 - RNA, 20 nt, Salmonella typhimurium LT2
cugccagcaccagcagcgca

SEQ ID NO: 3757283 - RNA, 15 nt, Salmonella typhimurium LT2
cugccagcgaaccgc

SEQ ID NO: 3757284 - RNA, 16 nt, Salmonella typhimurium LT2
cugccaggauccguuc

SEQ ID NO: 3757285 - RNA, 21 nt, Salmonella typhimurium LT2
cugccaggcauaccuccucuc

SEQ ID NO: 3757286 - RNA, 15 nt, Salmonella typhimurium LT2
cugccaggccaucug

SEQ ID NO: 3757287 - RNA, 20 nt, Salmonella typhimurium LT2
cugccagggccaaucagaau

SEQ ID NO: 3757288 - RNA, 19 nt, Salmonella typhimurium LT2
cugccaguaguugaauaac

SEQ ID NO: 3757289 - RNA, 12 nt, Salmonella typhimurium LT2
cugccagucgcu

SEQ ID NO: 3757290 - RNA, 16 nt, Salmonella typhimurium LT2
cugccagucugcccgg

SEQ ID NO: 3757291 - RNA, 19 nt, Salmonella typhimurium LT2
cugccagucugcccggcaa

SEQ ID NO: 3757292 - RNA, 21 nt, Salmonella typhimurium LT2
cugccaguucacgccgccgcc

SEQ ID NO: 3757293 - RNA, 16 nt, Salmonella typhimurium LT2
cugccauuaucaccau

SEQ ID NO: 3757294 - RNA, 18 nt, Salmonella typhimurium LT2
cugccauuguuccggcga

SEQ ID NO: 3757295 - RNA, 14 nt, Salmonella typhimurium LT2
cugccauuucugcu

SEQ ID NO: 3757296 - RNA, 22 nt, Salmonella typhimurium LT2
cugcccaaauaaaagccgccau

SEQ ID NO: 3757297 - RNA, 16 nt, Salmonella typhimurium LT2
cugcccacccgggccg

SEQ ID NO: 3757298 - RNA, 14 nt, Salmonella typhimurium LT2
cugcccauuucagc

SEQ ID NO: 3757299 - RNA, 18 nt, Salmonella typhimurium LT2
cugccccgccacagccgc

SEQ ID NO: 3757300 - RNA, 20 nt, Salmonella typhimurium LT2
cugccccgccacagccgcau

SEQ ID NO: 3757301 - RNA, 21 nt, Salmonella typhimurium LT2
cugcccgccacccuccgggcc

SEQ ID NO: 3757302 - RNA, 22 nt, Salmonella typhimurium LT2
cugcccgccaggguaucaucaa

SEQ ID NO: 3757303 - RNA, 22 nt, Salmonella typhimurium LT2
cugcccgucuaaccgggccuga

SEQ ID NO: 3757304 - RNA, 17 nt, Salmonella typhimurium LT2
cugccgaugaucccggc

SEQ ID NO: 3757305 - RNA, 16 nt, Salmonella typhimurium LT2
cugccgauugccgcuc

SEQ ID NO: 3757306 - RNA, 22 nt, Salmonella typhimurium LT2
cugccgauugccgcucagcucg

SEQ ID NO: 3757307 - RNA, 17 nt, Salmonella typhimurium LT2
cugccgcaaacgccugc

SEQ ID NO: 3757308 - RNA, 19 nt, Salmonella typhimurium LT2
cugccgcaaacgccugcuc

SEQ ID NO: 3757309 - RNA, 19 nt, Salmonella typhimurium LT2
cugccgcagccgcucaggg

SEQ ID NO: 3757310 - RNA, 18 nt, Salmonella typhimurium LT2
cugccgccagcaguugca

SEQ ID NO: 3757311 - RNA, 17 nt, Salmonella typhimurium LT2
cugccgcccuuucccga

SEQ ID NO: 3757312 - RNA, 22 nt, Salmonella typhimurium LT2
cugccgccggcuucuuccggcc

SEQ ID NO: 3757313 - RNA, 21 nt, Salmonella typhimurium LT2
cugccgccgucaucugcgccg

SEQ ID NO: 3757314 - RNA, 17 nt, Salmonella typhimurium LT2
cugccgcgccugauuca

SEQ ID NO: 3757315 - RNA, 16 nt, Salmonella typhimurium LT2
cugccgcgccuuuacc

SEQ ID NO: 3757316 - RNA, 16 nt, Salmonella typhimurium LT2
cugccggaaaacguga

SEQ ID NO: 3757317 - RNA, 20 nt, Salmonella typhimurium LT2
cugccggauggagcggcgcu

SEQ ID NO: 3757318 - RNA, 13 nt, Salmonella typhimurium LT2
cugccggcaaaac

SEQ ID NO: 3757319 - RNA, 14 nt, Salmonella typhimurium LT2
cugccggucggcgu

SEQ ID NO: 3757320 - RNA, 19 nt, Salmonella typhimurium LT2
cugccggucggcgucugau

SEQ ID NO: 3757321 - RNA, 15 nt, Salmonella typhimurium LT2
cugcuccugcggcgu

SEQ ID NO: 3757322 - RNA, 16 nt, Salmonella typhimurium LT2
cugcucgauaccuucc

SEQ ID NO: 3757323 - RNA, 21 nt, Salmonella typhimurium LT2
cugcucggcuaucgccacuac

SEQ ID NO: 3757324 - RNA, 22 nt, Salmonella typhimurium LT2
cugcucgggccagcucuuuucu

SEQ ID NO: 3757325 - RNA, 19 nt, Salmonella typhimurium LT2
cugcucguaaguuuccugc

SEQ ID NO: 3757326 - RNA, 21 nt, Salmonella typhimurium LT2
cugcucguuaaauccucccau

SEQ ID NO: 3757327 - RNA, 20 nt, Salmonella typhimurium LT2
cugcucuaccaacugagcua

SEQ ID NO: 3757328 - RNA, 19 nt, Salmonella typhimurium LT2
cugcucuuugacaaacgcc

SEQ ID NO: 3757329 - RNA, 17 nt, Salmonella typhimurium LT2
cugcugaaaugccuggu

SEQ ID NO: 3757330 - RNA, 15 nt, Salmonella typhimurium LT2
cugcugaacacaaug

SEQ ID NO: 3757331 - RNA, 14 nt, Salmonella typhimurium LT2
cugcugacauuccu

SEQ ID NO: 3757332 - RNA, 17 nt, Salmonella typhimurium LT2
cugcugaccaaacugcg

SEQ ID NO: 3757333 - RNA, 20 nt, Salmonella typhimurium LT2
cugcugaccaaacugcggaa

SEQ ID NO: 3757334 - RNA, 18 nt, Salmonella typhimurium LT2
cugcugaccuuaauccag

SEQ ID NO: 3757335 - RNA, 16 nt, Salmonella typhimurium LT2
cugcugagugacgggc

SEQ ID NO: 3757336 - RNA, 11 nt, Salmonella typhimurium LT2
cugcugauaau

SEQ ID NO: 3757337 - RNA, 23 nt, Salmonella typhimurium LT2
cugcugauauuuucaccuccacg

SEQ ID NO: 3757338 - RNA, 19 nt, Salmonella typhimurium LT2
cugcugcaaauauucgcca

SEQ ID NO: 3757339 - RNA, 16 nt, Salmonella typhimurium LT2
cugcugcauccgcgcu

SEQ ID NO: 3757340 - RNA, 17 nt, Salmonella typhimurium LT2
cugcugcccuggaaccu

SEQ ID NO: 3757341 - RNA, 22 nt, Salmonella typhimurium LT2
cugcugcgcggccagaaccugc

SEQ ID NO: 3757342 - RNA, 20 nt, Salmonella typhimurium LT2
cugcugcgcuuuccaggcca

SEQ ID NO: 3757343 - RNA, 12 nt, Salmonella typhimurium LT2
cugcugcucccu

SEQ ID NO: 3757344 - RNA, 13 nt, Salmonella typhimurium LT2
cugcugcuugcuu

SEQ ID NO: 3757345 - RNA, 21 nt, Salmonella typhimurium LT2
cugcugcuugcuuuucaucac

SEQ ID NO: 3757346 - RNA, 16 nt, Salmonella typhimurium LT2
cugcuggcaaaacgca

SEQ ID NO: 3757347 - RNA, 22 nt, Salmonella typhimurium LT2
cugcuguaacagacgcaggccg

SEQ ID NO: 3757348 - RNA, 16 nt, Salmonella typhimurium LT2
cugcuguaccucuugc

SEQ ID NO: 3757349 - RNA, 20 nt, Salmonella typhimurium LT2
cugcuguagcgucucaucaa

SEQ ID NO: 3757350 - RNA, 15 nt, Salmonella typhimurium LT2
cugcuguagcugucc

SEQ ID NO: 3757351 - RNA, 22 nt, Salmonella typhimurium LT2
cugcugucaucgauacgaccgc

SEQ ID NO: 3757352 - RNA, 16 nt, Salmonella typhimurium LT2
cugcuguccgccagca

SEQ ID NO: 3757353 - RNA, 22 nt, Salmonella typhimurium LT2
cugcugucuguauacucagacg

SEQ ID NO: 3757354 - RNA, 17 nt, Salmonella typhimurium LT2
cugcuguguccagguca

SEQ ID NO: 3757355 - RNA, 14 nt, Salmonella typhimurium LT2
cugcuuaaacagaa

SEQ ID NO: 3757356 - RNA, 20 nt, Salmonella typhimurium LT2
cugcuuaaggcaaacaaggc

SEQ ID NO: 3757357 - RNA, 17 nt, Salmonella typhimurium LT2
cugcuuagcucaucagc

SEQ ID NO: 3757358 - RNA, 21 nt, Salmonella typhimurium LT2
cugcuuaucgauaucugccug

SEQ ID NO: 3757359 - RNA, 15 nt, Salmonella typhimurium LT2
cugcuuauucuuuuc

SEQ ID NO: 3757360 - RNA, 16 nt, Salmonella typhimurium LT2
cugcuuauucuuuuca

SEQ ID NO: 3757361 - RNA, 16 nt, Salmonella typhimurium LT2
cugcuucagccacugg

SEQ ID NO: 3757362 - RNA, 16 nt, Salmonella typhimurium LT2
cugcuucaguaaaucc

SEQ ID NO: 3757363 - RNA, 20 nt, Salmonella typhimurium LT2
cugcuucaguaaaucccgca

SEQ ID NO: 3757364 - RNA, 15 nt, Salmonella typhimurium LT2
cugcuucgcuggcgu

SEQ ID NO: 3757365 - RNA, 22 nt, Salmonella typhimurium LT2
cugcuucuggagaguauuuccu

SEQ ID NO: 3757366 - RNA, 19 nt, Salmonella typhimurium LT2
cugcuugucgaucaucaga

SEQ ID NO: 3757367 - RNA, 20 nt, Salmonella typhimurium LT2
cugcuuguuuaauggcagaa

SEQ ID NO: 3757368 - RNA, 19 nt, Salmonella typhimurium LT2
cugcuuucuuacaccucgc

SEQ ID NO: 3757369 - RNA, 15 nt, Salmonella typhimurium LT2
cugcuuuuccggcag

SEQ ID NO: 3757370 - RNA, 16 nt, Salmonella typhimurium LT2
cugcuuuuccggcagc

SEQ ID NO: 3757371 - RNA, 17 nt, Salmonella typhimurium LT2
cuggaaagcucuucaug

SEQ ID NO: 3757372 - RNA, 14 nt, Salmonella typhimurium LT2
cuggaaaggccgcg

SEQ ID NO: 3757373 - RNA, 20 nt, Salmonella typhimurium LT2
cuggaacaaaccgacuuuca

SEQ ID NO: 3757374 - RNA, 20 nt, Salmonella typhimurium LT2
cuggaacaggugcgagaggu

SEQ ID NO: 3757375 - RNA, 21 nt, Salmonella typhimurium LT2
cuggaacugaucguggccaca

SEQ ID NO: 3757376 - RNA, 22 nt, Salmonella typhimurium LT2
cuggaagaaaucguugccuuug

SEQ ID NO: 3757377 - RNA, 19 nt, Salmonella typhimurium LT2
cuggaagccccucuuauug

SEQ ID NO: 3757378 - RNA, 19 nt, Salmonella typhimurium LT2
cuggaaggcuucggucaga

SEQ ID NO: 3757379 - RNA, 23 nt, Salmonella typhimurium LT2
cuggaaggcuucggucagauccu

SEQ ID NO: 3757380 - RNA, 17 nt, Salmonella typhimurium LT2
cuggacaaaccacagug

SEQ ID NO: 3757381 - RNA, 20 nt, Salmonella typhimurium LT2
cuggacauauuccagaagcg

SEQ ID NO: 3757382 - RNA, 16 nt, Salmonella typhimurium LT2
cuggacaugcuccgcc

SEQ ID NO: 3757383 - RNA, 22 nt, Salmonella typhimurium LT2
cuggacaugcuccgccccgccu

SEQ ID NO: 3757384 - RNA, 17 nt, Salmonella typhimurium LT2
cuggagaccaccggcaa

SEQ ID NO: 3757385 - RNA, 19 nt, Salmonella typhimurium LT2
cuggagagcagcgccagcg

SEQ ID NO: 3757386 - RNA, 15 nt, Salmonella typhimurium LT2
cuggagaucagcaug

SEQ ID NO: 3757387 - RNA, 16 nt, Salmonella typhimurium LT2
cuggaggaacagcgcc

SEQ ID NO: 3757388 - RNA, 17 nt, Salmonella typhimurium LT2
cuggaggaacagcgccg

SEQ ID NO: 3757389 - RNA, 21 nt, Salmonella typhimurium LT2
cuggaguuuaaacacucucca

SEQ ID NO: 3757390 - RNA, 18 nt, Salmonella typhimurium LT2
cuggauaagcgcagcgcc

SEQ ID NO: 3757391 - RNA, 20 nt, Salmonella typhimurium LT2
cuggauaagcgcagcgccau

SEQ ID NO: 3757392 - RNA, 20 nt, Salmonella typhimurium LT2
cuggauagagcaucaaccuc

SEQ ID NO: 3757393 - RNA, 19 nt, Salmonella typhimurium LT2
cuggauagcaccauaaacg

SEQ ID NO: 3757394 - RNA, 22 nt, Salmonella typhimurium LT2
cuggauagccucguugauuugu

SEQ ID NO: 3757395 - RNA, 16 nt, Salmonella typhimurium LT2
cuggauagucuucaag

SEQ ID NO: 3757396 - RNA, 16 nt, Salmonella typhimurium LT2
cuggaucagauucccc

SEQ ID NO: 3757397 - RNA, 22 nt, Salmonella typhimurium LT2
cuggaucaggcgcuugcgccgc

SEQ ID NO: 3757398 - RNA, 22 nt, Salmonella typhimurium LT2
cuggaucgugcggcgaagcauc

SEQ ID NO: 3757399 - RNA, 14 nt, Salmonella typhimurium LT2
cuggaugacacagg

SEQ ID NO: 3757400 - RNA, 16 nt, Salmonella typhimurium LT2
cuggaugacugaauua

SEQ ID NO: 3757401 - RNA, 16 nt, Salmonella typhimurium LT2
cuggaugcuuaaaauc

SEQ ID NO: 3757402 - RNA, 22 nt, Salmonella typhimurium LT2
cuggauuagucugccauuuccu

SEQ ID NO: 3757403 - RNA, 16 nt, Salmonella typhimurium LT2
cuggauugcagagaag

SEQ ID NO: 3757404 - RNA, 18 nt, Salmonella typhimurium LT2
cuggauuuaacggagcaa

SEQ ID NO: 3757405 - RNA, 13 nt, Salmonella typhimurium LT2
cuggcaaaacgca

SEQ ID NO: 3757406 - RNA, 22 nt, Salmonella typhimurium LT2
cuggcaagaccgauagagacug

SEQ ID NO: 3757407 - RNA, 14 nt, Salmonella typhimurium LT2
cuggcaagcgccag

SEQ ID NO: 3757408 - RNA, 19 nt, Salmonella typhimurium LT2
cuggcaauaaagcagggcg

SEQ ID NO: 3757409 - RNA, 11 nt, Salmonella typhimurium LT2
cuggcagagac

SEQ ID NO: 3757410 - RNA, 13 nt, Salmonella typhimurium LT2
cuggcagccucgu

SEQ ID NO: 3757411 - RNA, 18 nt, Salmonella typhimurium LT2
cuggcagcgccugacggc

SEQ ID NO: 3757412 - RNA, 19 nt, Salmonella typhimurium LT2
cuggcagcgccugacggcg

SEQ ID NO: 3757413 - RNA, 17 nt, Salmonella typhimurium LT2
cuggcaggccaucucug

SEQ ID NO: 3757414 - RNA, 19 nt, Salmonella typhimurium LT2
cuggcauaaccgcagcgcg

SEQ ID NO: 3757415 - RNA, 21 nt, Salmonella typhimurium LT2
cuggcaugcgccccguuuccg

SEQ ID NO: 3757416 - RNA, 19 nt, Salmonella typhimurium LT2
cuggccaaagcggguuaac

SEQ ID NO: 3757417 - RNA, 18 nt, Salmonella typhimurium LT2
cuggccaauuuuucacau

SEQ ID NO: 3757418 - RNA, 14 nt, Salmonella typhimurium LT2
cuggccacagcaaa

SEQ ID NO: 3757419 - RNA, 13 nt, Salmonella typhimurium LT2
cuggccacgccga

SEQ ID NO: 3757420 - RNA, 23 nt, Salmonella typhimurium LT2
cuggccaggcauugauaaagcgc

SEQ ID NO: 3757421 - RNA, 14 nt, Salmonella typhimurium LT2
cuggccaggcuuuc

SEQ ID NO: 3757422 - RNA, 18 nt, Salmonella typhimurium LT2
cuggccaguuucaaugcc

SEQ ID NO: 3757423 - RNA, 21 nt, Salmonella typhimurium LT2
cuggccaguuucaaugcccag

SEQ ID NO: 3757424 - RNA, 18 nt, Salmonella typhimurium LT2
cuggugccaaucuccagc

SEQ ID NO: 3757425 - RNA, 19 nt, Salmonella typhimurium LT2
cuggugcccgcaaaaccuu

SEQ ID NO: 3757426 - RNA, 19 nt, Salmonella typhimurium LT2
cuggugcgacaccacgcag

SEQ ID NO: 3757427 - RNA, 11 nt, Salmonella typhimurium LT2
cuggugcgccu

SEQ ID NO: 3757428 - RNA, 18 nt, Salmonella typhimurium LT2
cuggugcucaaucagaau

SEQ ID NO: 3757429 - RNA, 13 nt, Salmonella typhimurium LT2
cuggugggguucc

SEQ ID NO: 3757430 - RNA, 16 nt, Salmonella typhimurium LT2
cuggugggguucccga

SEQ ID NO: 3757431 - RNA, 16 nt, Salmonella typhimurium LT2
cuggugugaacaucac

SEQ ID NO: 3757432 - RNA, 20 nt, Salmonella typhimurium LT2
cugguguuuuuuucaucuuu

SEQ ID NO: 3757433 - RNA, 21 nt, Salmonella typhimurium LT2
cugguuaacccgguuuauccc

SEQ ID NO: 3757434 - RNA, 15 nt, Salmonella typhimurium LT2
cugguuaauaauuuu

SEQ ID NO: 3757435 - RNA, 20 nt, Salmonella typhimurium LT2
cugguuaaugaccugccgcg

SEQ ID NO: 3757436 - RNA, 22 nt, Salmonella typhimurium LT2
cugguuaaugccuucgccgccg

SEQ ID NO: 3757437 - RNA, 14 nt, Salmonella typhimurium LT2
cugguucgaaucca

SEQ ID NO: 3757438 - RNA, 17 nt, Salmonella typhimurium LT2
cugguucgaauccaggu

SEQ ID NO: 3757439 - RNA, 16 nt, Salmonella typhimurium LT2
cugguugcugaucagc

SEQ ID NO: 3757440 - RNA, 14 nt, Salmonella typhimurium LT2
cugguuggcgcgcu

SEQ ID NO: 3757441 - RNA, 18 nt, Salmonella typhimurium LT2
cugguuguccaccagcgc

SEQ ID NO: 3757442 - RNA, 15 nt, Salmonella typhimurium LT2
cugguugugguccaa

SEQ ID NO: 3757443 - RNA, 21 nt, Salmonella typhimurium LT2
cugguuucggcaucccaggcg

SEQ ID NO: 3757444 - RNA, 15 nt, Salmonella typhimurium LT2
cuguaaacagaugcu

SEQ ID NO: 3757445 - RNA, 16 nt, Salmonella typhimurium LT2
cuguaaacagaugcuc

SEQ ID NO: 3757446 - RNA, 14 nt, Salmonella typhimurium LT2
cuguaaaccgccuc

SEQ ID NO: 3757447 - RNA, 20 nt, Salmonella typhimurium LT2
cuguaaaccgccuccaggcc

SEQ ID NO: 3757448 - RNA, 17 nt, Salmonella typhimurium LT2
cuguaaauagugcgcua

SEQ ID NO: 3757449 - RNA, 23 nt, Salmonella typhimurium LT2
cuguaaaucgcgcccgacauggc

SEQ ID NO: 3757450 - RNA, 14 nt, Salmonella typhimurium LT2
cuguaaaucugccg

SEQ ID NO: 3757451 - RNA, 18 nt, Salmonella typhimurium LT2
cuguaacaacuguuuuuc

SEQ ID NO: 3757452 - RNA, 15 nt, Salmonella typhimurium LT2
cuguaacacacuggu

SEQ ID NO: 3757453 - RNA, 20 nt, Salmonella typhimurium LT2
cuguaacagacgcaggccgu

SEQ ID NO: 3757454 - RNA, 14 nt, Salmonella typhimurium LT2
cuguaacaguaucc

SEQ ID NO: 3757455 - RNA, 15 nt, Salmonella typhimurium LT2
cuguaaccuacgcca

SEQ ID NO: 3757456 - RNA, 21 nt, Salmonella typhimurium LT2
cuguaacggcgcgauuuuuuc

SEQ ID NO: 3757457 - RNA, 17 nt, Salmonella typhimurium LT2
cuguaacuucggccagc

SEQ ID NO: 3757458 - RNA, 13 nt, Salmonella typhimurium LT2
cuguaaugaggca

SEQ ID NO: 3757459 - RNA, 17 nt, Salmonella typhimurium LT2
cuguaaugggcaauaaa

SEQ ID NO: 3757460 - RNA, 16 nt, Salmonella typhimurium LT2
cuguaauuucgcuggc

SEQ ID NO: 3757461 - RNA, 14 nt, Salmonella typhimurium LT2
cuguacauaacauc

SEQ ID NO: 3757462 - RNA, 16 nt, Salmonella typhimurium LT2
cuguacauaacaucuc

SEQ ID NO: 3757463 - RNA, 13 nt, Salmonella typhimurium LT2
cuguacauaucca

SEQ ID NO: 3757464 - RNA, 12 nt, Salmonella typhimurium LT2
cuguaccaccac

SEQ ID NO: 3757465 - RNA, 15 nt, Salmonella typhimurium LT2
cuguaccgccauccg

SEQ ID NO: 3757466 - RNA, 18 nt, Salmonella typhimurium LT2
cuguaccugauccagcuc

SEQ ID NO: 3757467 - RNA, 22 nt, Salmonella typhimurium LT2
cuguaccugauggacaauccgc

SEQ ID NO: 3757468 - RNA, 14 nt, Salmonella typhimurium LT2
cuguacgcccagcc

SEQ ID NO: 3757469 - RNA, 16 nt, Salmonella typhimurium LT2
cuguacggaauaagcg

SEQ ID NO: 3757470 - RNA, 16 nt, Salmonella typhimurium LT2
cuguacuuuaaccgga

SEQ ID NO: 3757471 - RNA, 17 nt, Salmonella typhimurium LT2
cuguagauaccuacuuu

SEQ ID NO: 3757472 - RNA, 23 nt, Salmonella typhimurium LT2
cuguagauagcuauccacgcaga

SEQ ID NO: 3757473 - RNA, 20 nt, Salmonella typhimurium LT2
cuguagcaguggagaggcca

SEQ ID NO: 3757474 - RNA, 14 nt, Salmonella typhimurium LT2
cuguagccagccug

SEQ ID NO: 3757475 - RNA, 22 nt, Salmonella typhimurium LT2
cuguagccagccugaacgggug

SEQ ID NO: 3757476 - RNA, 20 nt, Salmonella typhimurium LT2
cuguagcgcuuuggagguca

SEQ ID NO: 3757477 - RNA, 18 nt, Salmonella typhimurium LT2
cuguagcgcuuuuuccag

SEQ ID NO: 3757478 - RNA, 20 nt, Salmonella typhimurium LT2
cuguagcgucucaucaaaaa

SEQ ID NO: 3757479 - RNA, 15 nt, Salmonella typhimurium LT2
cuguagcucagguuc

SEQ ID NO: 3757480 - RNA, 18 nt, Salmonella typhimurium LT2
cuguaggaucaaccaccu

SEQ ID NO: 3757481 - RNA, 14 nt, Salmonella typhimurium LT2
cuguaggccggaua

SEQ ID NO: 3757482 - RNA, 20 nt, Salmonella typhimurium LT2
cuguagguucgguaugccuu

SEQ ID NO: 3757483 - RNA, 20 nt, Salmonella typhimurium LT2
cuguagugaggcugguugug

SEQ ID NO: 3757484 - RNA, 16 nt, Salmonella typhimurium LT2
cuguauaaauaaaauu

SEQ ID NO: 3757485 - RNA, 16 nt, Salmonella typhimurium LT2
cuguaugugcucgucg

SEQ ID NO: 3757486 - RNA, 19 nt, Salmonella typhimurium LT2
cuguauuuucuaucuuuuu

SEQ ID NO: 3757487 - RNA, 13 nt, Salmonella typhimurium LT2
cugucaccagcag

SEQ ID NO: 3757488 - RNA, 16 nt, Salmonella typhimurium LT2
cugucaccagcagcau

SEQ ID NO: 3757489 - RNA, 18 nt, Salmonella typhimurium LT2
cugucacguuuuaucgag

SEQ ID NO: 3757490 - RNA, 16 nt, Salmonella typhimurium LT2
cugucaucaaugagcg

SEQ ID NO: 3757491 - RNA, 20 nt, Salmonella typhimurium LT2
cugucauugggagcaaagcu

SEQ ID NO: 3757492 - RNA, 23 nt, Salmonella typhimurium LT2
cugucauugggagcaaagcucac

SEQ ID NO: 3757493 - RNA, 15 nt, Salmonella typhimurium LT2
cuguccacgacagaa

SEQ ID NO: 3757494 - RNA, 18 nt, Salmonella typhimurium LT2
cuguccacgacagaaccc

SEQ ID NO: 3757495 - RNA, 21 nt, Salmonella typhimurium LT2
cuguccgcaaagacaacgacc

SEQ ID NO: 3757496 - RNA, 20 nt, Salmonella typhimurium LT2
cuguccgcccaacaccagca

SEQ ID NO: 3757497 - RNA, 23 nt, Salmonella typhimurium LT2
cuguccgcccaacaccagcacug

SEQ ID NO: 3757498 - RNA, 23 nt, Salmonella typhimurium LT2
cuguccugacggcgacgcgccgu

SEQ ID NO: 3757499 - RNA, 16 nt, Salmonella typhimurium LT2
cugucgaaaccagcau

SEQ ID NO: 3757500 - RNA, 22 nt, Salmonella typhimurium LT2
cugucgaaaccagcauaaugag

SEQ ID NO: 3757501 - RNA, 19 nt, Salmonella typhimurium LT2
cugucgacuggccuuuuuu

SEQ ID NO: 3757502 - RNA, 16 nt, Salmonella typhimurium LT2
cugucgauaaacucau

SEQ ID NO: 3757503 - RNA, 19 nt, Salmonella typhimurium LT2
cugucgauaauauccagca

SEQ ID NO: 3757504 - RNA, 15 nt, Salmonella typhimurium LT2
cugucgaugcggauc

SEQ ID NO: 3757505 - RNA, 18 nt, Salmonella typhimurium LT2
cugucgauuuccggcggc

SEQ ID NO: 3757506 - RNA, 14 nt, Salmonella typhimurium LT2
cugucgccaggcca

SEQ ID NO: 3757507 - RNA, 20 nt, Salmonella typhimurium LT2
cugucgccgguuagcgccgc

SEQ ID NO: 3757508 - RNA, 17 nt, Salmonella typhimurium LT2
cugucgccgucaauguc

SEQ ID NO: 3757509 - RNA, 23 nt, Salmonella typhimurium LT2
cugucgcuaaagcacuccccggc

SEQ ID NO: 3757510 - RNA, 16 nt, Salmonella typhimurium LT2
cugucgggagccucuu

SEQ ID NO: 3757511 - RNA, 16 nt, Salmonella typhimurium LT2
cugucgucaccagcag

SEQ ID NO: 3757512 - RNA, 17 nt, Salmonella typhimurium LT2
cugucguguccuugcca

SEQ ID NO: 3757513 - RNA, 14 nt, Salmonella typhimurium LT2
cugucguuuguagg

SEQ ID NO: 3757514 - RNA, 21 nt, Salmonella typhimurium LT2
cugucucauuguguacaucca

SEQ ID NO: 3757515 - RNA, 19 nt, Salmonella typhimurium LT2
cugucugaaucaaugcauc

SEQ ID NO: 3757516 - RNA, 18 nt, Salmonella typhimurium LT2
cugucuuagugaaauacc

SEQ ID NO: 3757517 - RNA, 15 nt, Salmonella typhimurium LT2
cugucuuguuuuucu

SEQ ID NO: 3757518 - RNA, 16 nt, Salmonella typhimurium LT2
cugucuuguuuuucug

SEQ ID NO: 3757519 - RNA, 23 nt, Salmonella typhimurium LT2
cugugaggcgucuuccagcauuc

SEQ ID NO: 3757520 - RNA, 21 nt, Salmonella typhimurium LT2
cugugauccauguugccauga

SEQ ID NO: 3757521 - RNA, 17 nt, Salmonella typhimurium LT2
cugugcaaaauuacuuc

SEQ ID NO: 3757522 - RNA, 18 nt, Salmonella typhimurium LT2
cugugcauaucuggcgag

SEQ ID NO: 3757523 - RNA, 20 nt, Salmonella typhimurium LT2
cugugccagcucguuauuuc

SEQ ID NO: 3757524 - RNA, 21 nt, Salmonella typhimurium LT2
cugugccagcucguuauuucc

SEQ ID NO: 3757525 - RNA, 20 nt, Salmonella typhimurium LT2
cugugccaguaccgccgccg

SEQ ID NO: 3757526 - RNA, 19 nt, Salmonella typhimurium LT2
cugugccauauucucuggc

SEQ ID NO: 3757527 - RNA, 18 nt, Salmonella typhimurium LT2
cugugcgaagguggcgga

SEQ ID NO: 3757528 - RNA, 19 nt, Salmonella typhimurium LT2
cuuaucccacaacuguucu

SEQ ID NO: 3757529 - RNA, 13 nt, Salmonella typhimurium LT2
cuuaucccagccg

SEQ ID NO: 3757530 - RNA, 19 nt, Salmonella typhimurium LT2
cuuauccgaccuacaagau

SEQ ID NO: 3757531 - RNA, 21 nt, Salmonella typhimurium LT2
cuuauccgacgcguuucacau

SEQ ID NO: 3757532 - RNA, 15 nt, Salmonella typhimurium LT2
cuuauccgacguggc

SEQ ID NO: 3757533 - RNA, 13 nt, Salmonella typhimurium LT2
cuuauccggccua

SEQ ID NO: 3757534 - RNA, 19 nt, Salmonella typhimurium LT2
cuuauccggccuauagcua

SEQ ID NO: 3757535 - RNA, 20 nt, Salmonella typhimurium LT2
cuuauccggccugcaggcaa

SEQ ID NO: 3757536 - RNA, 23 nt, Salmonella typhimurium LT2
cuuauccggcuuauccggccugc

SEQ ID NO: 3757537 - RNA, 16 nt, Salmonella typhimurium LT2
cuuaucgccaaagaua

SEQ ID NO: 3757538 - RNA, 17 nt, Salmonella typhimurium LT2
cuuaucgccaaagauau

SEQ ID NO: 3757539 - RNA, 15 nt, Salmonella typhimurium LT2
cuuaucgccccagcc

SEQ ID NO: 3757540 - RNA, 22 nt, Salmonella typhimurium LT2
cuuaucgggcccguugccuggc

SEQ ID NO: 3757541 - RNA, 18 nt, Salmonella typhimurium LT2
cuuaucgggccuacaaga

SEQ ID NO: 3757542 - RNA, 20 nt, Salmonella typhimurium LT2
cuuaucgggccuacaagaau

SEQ ID NO: 3757543 - RNA, 14 nt, Salmonella typhimurium LT2
cuuaucugcugcug

SEQ ID NO: 3757544 - RNA, 22 nt, Salmonella typhimurium LT2
cuuaugaaaccccaaaucagca

SEQ ID NO: 3757545 - RNA, 18 nt, Salmonella typhimurium LT2
cuuauguaagcucccggg

SEQ ID NO: 3757546 - RNA, 14 nt, Salmonella typhimurium LT2
cuuauuauuuuuuc

SEQ ID NO: 3757547 - RNA, 18 nt, Salmonella typhimurium LT2
cuuauuauuuuuucuuua

SEQ ID NO: 3757548 - RNA, 22 nt, Salmonella typhimurium LT2
cuuauuauuuuuucuuuaauua

SEQ ID NO: 3757549 - RNA, 21 nt, Salmonella typhimurium LT2
cuuauucacagcguaagaauu

SEQ ID NO: 3757550 - RNA, 12 nt, Salmonella typhimurium LT2
cuuauucaggcg

SEQ ID NO: 3757551 - RNA, 16 nt, Salmonella typhimurium LT2
cuuauugucgccgccg

SEQ ID NO: 3757552 - RNA, 23 nt, Salmonella typhimurium LT2
cuuauugugccgcggcuucauca

SEQ ID NO: 3757553 - RNA, 15 nt, Salmonella typhimurium LT2
cuuauuguuuuuuaa

SEQ ID NO: 3757554 - RNA, 17 nt, Salmonella typhimurium LT2
cuuauuguuuuuuaaga

SEQ ID NO: 3757555 - RNA, 18 nt, Salmonella typhimurium LT2
cuuauuguuuuuuaagac

SEQ ID NO: 3757556 - RNA, 17 nt, Salmonella typhimurium LT2
cuuauuuggguaauaaa

SEQ ID NO: 3757557 - RNA, 20 nt, Salmonella typhimurium LT2
cuuauuuuauuuuuauauuc

SEQ ID NO: 3757558 - RNA, 19 nt, Salmonella typhimurium LT2
cuucaaaaccgcacugcau

SEQ ID NO: 3757559 - RNA, 14 nt, Salmonella typhimurium LT2
cuucaacagcggcg

SEQ ID NO: 3757560 - RNA, 18 nt, Salmonella typhimurium LT2
cuucaacagcucgccaug

SEQ ID NO: 3757561 - RNA, 20 nt, Salmonella typhimurium LT2
cuucaaccauugucuucuac

SEQ ID NO: 3757562 - RNA, 19 nt, Salmonella typhimurium LT2
cuucaaccguuucuuuuuc

SEQ ID NO: 3757563 - RNA, 21 nt, Salmonella typhimurium LT2
cuucaaccguuucuuuuucga

SEQ ID NO: 3757564 - RNA, 15 nt, Salmonella typhimurium LT2
cuucaacggucucag

SEQ ID NO: 3757565 - RNA, 14 nt, Salmonella typhimurium LT2
cuucaagaaucaau

SEQ ID NO: 3757566 - RNA, 14 nt, Salmonella typhimurium LT2
cuucaagccaggcu

SEQ ID NO: 3757567 - RNA, 18 nt, Salmonella typhimurium LT2
cuucaagccaggcuuuaa

SEQ ID NO: 3757568 - RNA, 23 nt, Salmonella typhimurium LT2
cuucaaggcucaauacgcauaau

SEQ ID NO: 3757569 - RNA, 18 nt, Salmonella typhimurium LT2
cuucaaugcgccccgucu

SEQ ID NO: 3757570 - RNA, 23 nt, Salmonella typhimurium LT2
cuucaaugggaaaaauuugaucu

SEQ ID NO: 3757571 - RNA, 11 nt, Salmonella typhimurium LT2
cuucaauguua

SEQ ID NO: 3757572 - RNA, 23 nt, Salmonella typhimurium LT2
cuucaauuccuggaacuggcucc

SEQ ID NO: 3757573 - RNA, 20 nt, Salmonella typhimurium LT2
cuucacaaaaaguauuguuu

SEQ ID NO: 3757574 - RNA, 14 nt, Salmonella typhimurium LT2
cuucacaaucagcg

SEQ ID NO: 3757575 - RNA, 19 nt, Salmonella typhimurium LT2
cuucacccagacugugaug

SEQ ID NO: 3757576 - RNA, 18 nt, Salmonella typhimurium LT2
cuucaccgagaaauuuag

SEQ ID NO: 3757577 - RNA, 14 nt, Salmonella typhimurium LT2
cuucaccggcgugc

SEQ ID NO: 3757578 - RNA, 20 nt, Salmonella typhimurium LT2
cuucaccucagucgcuugua

SEQ ID NO: 3757579 - RNA, 15 nt, Salmonella typhimurium LT2
cuucaccuuucgccg

SEQ ID NO: 3757580 - RNA, 20 nt, Salmonella typhimurium LT2
cuucaccuuucgccgccaga

SEQ ID NO: 3757581 - RNA, 14 nt, Salmonella typhimurium LT2
cuucacgcagcgcc

SEQ ID NO: 3757582 - RNA, 13 nt, Salmonella typhimurium LT2
cuucacgccaucg

SEQ ID NO: 3757583 - RNA, 19 nt, Salmonella typhimurium LT2
cuucacgccauuccagcug

SEQ ID NO: 3757584 - RNA, 20 nt, Salmonella typhimurium LT2
cuucacgccauuccagcugg

SEQ ID NO: 3757585 - RNA, 21 nt, Salmonella typhimurium LT2
cuucacgccauuccagcuggg

SEQ ID NO: 3757586 - RNA, 19 nt, Salmonella typhimurium LT2
cuucacgcgaagcgccgau

SEQ ID NO: 3757587 - RNA, 14 nt, Salmonella typhimurium LT2
cuucacgcuaaucc

SEQ ID NO: 3757588 - RNA, 13 nt, Salmonella typhimurium LT2
cuucacgcuggug

SEQ ID NO: 3757589 - RNA, 18 nt, Salmonella typhimurium LT2
cuucacguugacgcaaac

SEQ ID NO: 3757590 - RNA, 21 nt, Salmonella typhimurium LT2
cuucacguugacgcaaacugc

SEQ ID NO: 3757591 - RNA, 23 nt, Salmonella typhimurium LT2
cuucacguugacgcaaacugcca

SEQ ID NO: 3757592 - RNA, 15 nt, Salmonella typhimurium LT2
cuucacuaaaaacag

SEQ ID NO: 3757593 - RNA, 21 nt, Salmonella typhimurium LT2
cuucacucugggauuugcgaa

SEQ ID NO: 3757594 - RNA, 16 nt, Salmonella typhimurium LT2
cuucagacaacgccgc

SEQ ID NO: 3757595 - RNA, 23 nt, Salmonella typhimurium LT2
cuucagagagaugucgcaauaaa

SEQ ID NO: 3757596 - RNA, 14 nt, Salmonella typhimurium LT2
cuucagcaaacggc

SEQ ID NO: 3757597 - RNA, 15 nt, Salmonella typhimurium LT2
cuucagcaacccuuu

SEQ ID NO: 3757598 - RNA, 16 nt, Salmonella typhimurium LT2
cuucagcaacguuuug

SEQ ID NO: 3757599 - RNA, 14 nt, Salmonella typhimurium LT2
cuucagcagcgaga

SEQ ID NO: 3757600 - RNA, 13 nt, Salmonella typhimurium LT2
cuucagccggaua

SEQ ID NO: 3757601 - RNA, 18 nt, Salmonella typhimurium LT2
cuucagccugaaucagca

SEQ ID NO: 3757602 - RNA, 17 nt, Salmonella typhimurium LT2
cuucagcgacaucguca

SEQ ID NO: 3757603 - RNA, 19 nt, Salmonella typhimurium LT2
cuucagcuucacgaagucu

SEQ ID NO: 3757604 - RNA, 19 nt, Salmonella typhimurium LT2
cuucagucuacuacacacu

SEQ ID NO: 3757605 - RNA, 18 nt, Salmonella typhimurium LT2
cuucaguucagccgccag

SEQ ID NO: 3757606 - RNA, 19 nt, Salmonella typhimurium LT2
cuucauaaaacccgcuucg

SEQ ID NO: 3757607 - RNA, 12 nt, Salmonella typhimurium LT2
cuucauaaauac

SEQ ID NO: 3757608 - RNA, 23 nt, Salmonella typhimurium LT2
cuucauauuaaauuccggcucgc

SEQ ID NO: 3757609 - RNA, 17 nt, Salmonella typhimurium LT2
cuucauauuccgaaugu

SEQ ID NO: 3757610 - RNA, 22 nt, Salmonella typhimurium LT2
cuucauauuguagguuuuccuc

SEQ ID NO: 3757611 - RNA, 14 nt, Salmonella typhimurium LT2
cuucaucagccagc

SEQ ID NO: 3757612 - RNA, 17 nt, Salmonella typhimurium LT2
cuucaucagccagcauc

SEQ ID NO: 3757613 - RNA, 17 nt, Salmonella typhimurium LT2
cuucaucaguaacugac

SEQ ID NO: 3757614 - RNA, 13 nt, Salmonella typhimurium LT2
cuucaucaucagc

SEQ ID NO: 3757615 - RNA, 16 nt, Salmonella typhimurium LT2
cuucaucauucaucca

SEQ ID NO: 3757616 - RNA, 14 nt, Salmonella typhimurium LT2
cuucauccacgccg

SEQ ID NO: 3757617 - RNA, 15 nt, Salmonella typhimurium LT2
cuucaucccacucaa

SEQ ID NO: 3757618 - RNA, 14 nt, Salmonella typhimurium LT2
cuucaucccagcua

SEQ ID NO: 3757619 - RNA, 16 nt, Salmonella typhimurium LT2
cuucaucccauccggg

SEQ ID NO: 3757620 - RNA, 17 nt, Salmonella typhimurium LT2
cuucauccgcucccgcu

SEQ ID NO: 3757621 - RNA, 18 nt, Salmonella typhimurium LT2
cuucaucgcgccuccccu

SEQ ID NO: 3757622 - RNA, 14 nt, Salmonella typhimurium LT2
cuucaucuucaccu

SEQ ID NO: 3757623 - RNA, 14 nt, Salmonella typhimurium LT2
cuucaugcagcccg

SEQ ID NO: 3757624 - RNA, 18 nt, Salmonella typhimurium LT2
cuucaugguacagaucca

SEQ ID NO: 3757625 - RNA, 22 nt, Salmonella typhimurium LT2
cuucaugugguaggcuucaacc

SEQ ID NO: 3757626 - RNA, 14 nt, Salmonella typhimurium LT2
cuucauucaugcuu

SEQ ID NO: 3757627 - RNA, 24 nt, Salmonella typhimurium LT2
cuucauuuauggguuccaguugca

SEQ ID NO: 3757628 - RNA, 14 nt, Salmonella typhimurium LT2
cuuccaccaccucc

SEQ ID NO: 3757629 - RNA, 23 nt, Salmonella typhimurium LT2
cuuccaccauucgcgcauacucu

SEQ ID NO: 3757630 - RNA, 20 nt, Salmonella typhimurium LT2
cuuccacccgggaagcccuu

SEQ ID NO: 3757631 - RNA, 14 nt, Salmonella typhimurium LT2
cuuccacgcacgcc

SEQ ID NO: 3757632 - RNA, 19 nt, Salmonella typhimurium LT2
cuucucaggcgagcccugu

SEQ ID NO: 3757633 - RNA, 21 nt, Salmonella typhimurium LT2
cuucucccaacagacgaucua

SEQ ID NO: 3757634 - RNA, 14 nt, Salmonella typhimurium LT2
cuucucgcaggcca

SEQ ID NO: 3757635 - RNA, 12 nt, Salmonella typhimurium LT2
cuucugaaaacc

SEQ ID NO: 3757636 - RNA, 17 nt, Salmonella typhimurium LT2
cuucugacagugacggc

SEQ ID NO: 3757637 - RNA, 16 nt, Salmonella typhimurium LT2
cuucugacucgcugau

SEQ ID NO: 3757638 - RNA, 20 nt, Salmonella typhimurium LT2
cuucugauaagcgcagcguc

SEQ ID NO: 3757639 - RNA, 20 nt, Salmonella typhimurium LT2
cuucugcgccuuuggcagga

SEQ ID NO: 3757640 - RNA, 13 nt, Salmonella typhimurium LT2
cuucuggcucaga

SEQ ID NO: 3757641 - RNA, 18 nt, Salmonella typhimurium LT2
cuucugguagccagacau

SEQ ID NO: 3757642 - RNA, 18 nt, Salmonella typhimurium LT2
cuucugugauacuguagg

SEQ ID NO: 3757643 - RNA, 18 nt, Salmonella typhimurium LT2
cuucuucaguuccgccag

SEQ ID NO: 3757644 - RNA, 21 nt, Salmonella typhimurium LT2
cuucuucauauuugcuauaaa

SEQ ID NO: 3757645 - RNA, 24 nt, Salmonella typhimurium LT2
cuucuucaucggucagagcauaaa

SEQ ID NO: 3757646 - RNA, 13 nt, Salmonella typhimurium LT2
cuucuucaucuuc

SEQ ID NO: 3757647 - RNA, 15 nt, Salmonella typhimurium LT2
cuucuuccagcggca

SEQ ID NO: 3757648 - RNA, 24 nt, Salmonella typhimurium LT2
cuucuucgcgcauuucugcugcaa

SEQ ID NO: 3757649 - RNA, 17 nt, Salmonella typhimurium LT2
cuucuucgcguuuuucg

SEQ ID NO: 3757650 - RNA, 17 nt, Salmonella typhimurium LT2
cuucuucgcucucgcca

SEQ ID NO: 3757651 - RNA, 22 nt, Salmonella typhimurium LT2
cuucuucgucgucuucauccca

SEQ ID NO: 3757652 - RNA, 23 nt, Salmonella typhimurium LT2
cuucuugcggugagaaacgcgcc

SEQ ID NO: 3757653 - RNA, 17 nt, Salmonella typhimurium LT2
cuucuugcugacgaucg

SEQ ID NO: 3757654 - RNA, 23 nt, Salmonella typhimurium LT2
cuucuuuaaccgcgccagagggg

SEQ ID NO: 3757655 - RNA, 17 nt, Salmonella typhimurium LT2
cuucuuuaccagugaca

SEQ ID NO: 3757656 - RNA, 21 nt, Salmonella typhimurium LT2
cuucuuucagguuccacgucu

SEQ ID NO: 3757657 - RNA, 18 nt, Salmonella typhimurium LT2
cuucuuugcgcgucucuc

SEQ ID NO: 3757658 - RNA, 13 nt, Salmonella typhimurium LT2
cuucuuuuacugc

SEQ ID NO: 3757659 - RNA, 15 nt, Salmonella typhimurium LT2
cuugacaggaaacag

SEQ ID NO: 3757660 - RNA, 15 nt, Salmonella typhimurium LT2
cuugaccgccugauc

SEQ ID NO: 3757661 - RNA, 17 nt, Salmonella typhimurium LT2
cuugagcaaaacacagc

SEQ ID NO: 3757662 - RNA, 21 nt, Salmonella typhimurium LT2
cuugagcaaaacacagcucaa

SEQ ID NO: 3757663 - RNA, 17 nt, Salmonella typhimurium LT2
cuugaguuuuccgccau

SEQ ID NO: 3757664 - RNA, 23 nt, Salmonella typhimurium LT2
cuugauacgcuucggcuccagcg

SEQ ID NO: 3757665 - RNA, 21 nt, Salmonella typhimurium LT2
cuugauagcgaucagcgccac

SEQ ID NO: 3757666 - RNA, 15 nt, Salmonella typhimurium LT2
cuugauccggcugau

SEQ ID NO: 3757667 - RNA, 15 nt, Salmonella typhimurium LT2
cuugaucucucccug

SEQ ID NO: 3757668 - RNA, 18 nt, Salmonella typhimurium LT2
cuugauggaaaacgcauc

SEQ ID NO: 3757669 - RNA, 17 nt, Salmonella typhimurium LT2
cuugauguagucgcuca

SEQ ID NO: 3757670 - RNA, 18 nt, Salmonella typhimurium LT2
cuugauucugcagcgagc

SEQ ID NO: 3757671 - RNA, 18 nt, Salmonella typhimurium LT2
cuugcaacccauacagcc

SEQ ID NO: 3757672 - RNA, 19 nt, Salmonella typhimurium LT2
cuugccacuacgcagcucc

SEQ ID NO: 3757673 - RNA, 14 nt, Salmonella typhimurium LT2
cuugccacuggccu

SEQ ID NO: 3757674 - RNA, 19 nt, Salmonella typhimurium LT2
cuugccacuggccucccag

SEQ ID NO: 3757675 - RNA, 12 nt, Salmonella typhimurium LT2
cuugccagcgca

SEQ ID NO: 3757676 - RNA, 14 nt, Salmonella typhimurium LT2
cuugccagugaaaa

SEQ ID NO: 3757677 - RNA, 17 nt, Salmonella typhimurium LT2
cuugccaugaaaacgaa

SEQ ID NO: 3757678 - RNA, 21 nt, Salmonella typhimurium LT2
cuugcccagcauauuaacagu

SEQ ID NO: 3757679 - RNA, 15 nt, Salmonella typhimurium LT2
cuugcccauucgccg

SEQ ID NO: 3757680 - RNA, 21 nt, Salmonella typhimurium LT2
cuugcccuguuucgcaggccg

SEQ ID NO: 3757681 - RNA, 17 nt, Salmonella typhimurium LT2
cuugccgaauuuacugu

SEQ ID NO: 3757682 - RNA, 22 nt, Salmonella typhimurium LT2
cuugccgcgccagacgcccuuc

SEQ ID NO: 3757683 - RNA, 17 nt, Salmonella typhimurium LT2
cuugccgggccuggcau

SEQ ID NO: 3757684 - RNA, 19 nt, Salmonella typhimurium LT2
cuugccguuuuucucauca

SEQ ID NO: 3757685 - RNA, 20 nt, Salmonella typhimurium LT2
cuugccucacccugaaaucc

SEQ ID NO: 3757686 - RNA, 19 nt, Salmonella typhimurium LT2
cuugccugcuuuuucauca

SEQ ID NO: 3757687 - RNA, 15 nt, Salmonella typhimurium LT2
cuugcgacauguugu

SEQ ID NO: 3757688 - RNA, 23 nt, Salmonella typhimurium LT2
cuugcgcaucgcaucagggcgac

SEQ ID NO: 3757689 - RNA, 13 nt, Salmonella typhimurium LT2
cuugcgcauggcc

SEQ ID NO: 3757690 - RNA, 13 nt, Salmonella typhimurium LT2
cuugcgccgccau

SEQ ID NO: 3757691 - RNA, 21 nt, Salmonella typhimurium LT2
cuugcgcguccgccuuugacg

SEQ ID NO: 3757692 - RNA, 18 nt, Salmonella typhimurium LT2
cuugcggcgccaggacaa

SEQ ID NO: 3757693 - RNA, 17 nt, Salmonella typhimurium LT2
cuugcggggagaaugcg

SEQ ID NO: 3757694 - RNA, 21 nt, Salmonella typhimurium LT2
cuugcggugagaaacgcgcca

SEQ ID NO: 3757695 - RNA, 16 nt, Salmonella typhimurium LT2
cuugcgguugcagcaa

SEQ ID NO: 3757696 - RNA, 22 nt, Salmonella typhimurium LT2
cuugcucaaaaagcucaagcgc

SEQ ID NO: 3757697 - RNA, 16 nt, Salmonella typhimurium LT2
cuugcugcuaugaaaa

SEQ ID NO: 3757698 - RNA, 20 nt, Salmonella typhimurium LT2
cuugcuggccuguucaagug

SEQ ID NO: 3757699 - RNA, 11 nt, Salmonella typhimurium LT2
cuugcuuuauu

SEQ ID NO: 3757700 - RNA, 16 nt, Salmonella typhimurium LT2
cuugcuuuauuuuuaa

SEQ ID NO: 3757701 - RNA, 17 nt, Salmonella typhimurium LT2
cuugcuuuucaucacca

SEQ ID NO: 3757702 - RNA, 21 nt, Salmonella typhimurium LT2
cuuggagagcaucaucugcca

SEQ ID NO: 3757703 - RNA, 16 nt, Salmonella typhimurium LT2
cuuggcgaucaccagc

SEQ ID NO: 3757704 - RNA, 19 nt, Salmonella typhimurium LT2
cuuggcgaucaccagcacc

SEQ ID NO: 3757705 - RNA, 22 nt, Salmonella typhimurium LT2
cuuggguauagagcaaucuggc

SEQ ID NO: 3757706 - RNA, 22 nt, Salmonella typhimurium LT2
cuuguaaaaaugccugugccag

SEQ ID NO: 3757707 - RNA, 13 nt, Salmonella typhimurium LT2
cuuguaagccgga

SEQ ID NO: 3757708 - RNA, 14 nt, Salmonella typhimurium LT2
cuuguaagggaggu

SEQ ID NO: 3757709 - RNA, 17 nt, Salmonella typhimurium LT2
cuuguaagggaggugcu

SEQ ID NO: 3757710 - RNA, 17 nt, Salmonella typhimurium LT2
cuuguagaaaagaaggg

SEQ ID NO: 3757711 - RNA, 19 nt, Salmonella typhimurium LT2
cuuguaggcccgauaagca

SEQ ID NO: 3757712 - RNA, 13 nt, Salmonella typhimurium LT2
cuuguaggccgga

SEQ ID NO: 3757713 - RNA, 20 nt, Salmonella typhimurium LT2
cuugucacgaaguuccagua

SEQ ID NO: 3757714 - RNA, 13 nt, Salmonella typhimurium LT2
cuuguccggccua

SEQ ID NO: 3757715 - RNA, 21 nt, Salmonella typhimurium LT2
cuugucggaacucacuugucu

SEQ ID NO: 3757716 - RNA, 14 nt, Salmonella typhimurium LT2
cuugugagggcaaa

SEQ ID NO: 3757717 - RNA, 22 nt, Salmonella typhimurium LT2
cuugugauaucugacuuauucg

SEQ ID NO: 3757718 - RNA, 15 nt, Salmonella typhimurium LT2
cuugugcgcccaucu

SEQ ID NO: 3757719 - RNA, 16 nt, Salmonella typhimurium LT2
cuugugcuuccagcuc

SEQ ID NO: 3757720 - RNA, 22 nt, Salmonella typhimurium LT2
cuugugcuuccagcuccaucca

SEQ ID NO: 3757721 - RNA, 24 nt, Salmonella typhimurium LT2
cuugugcuuccagcuccauccacc

SEQ ID NO: 3757722 - RNA, 14 nt, Salmonella typhimurium LT2
cuuguguaggccgg

SEQ ID NO: 3757723 - RNA, 22 nt, Salmonella typhimurium LT2
cuuguguggagguuucuucauc

SEQ ID NO: 3757724 - RNA, 23 nt, Salmonella typhimurium LT2
cuuguguggagguuucuucauca

SEQ ID NO: 3757725 - RNA, 20 nt, Salmonella typhimurium LT2
cuuguuauccaucagccagg

SEQ ID NO: 3757726 - RNA, 24 nt, Salmonella typhimurium LT2
cuuguuauccuaaaucugccauca

SEQ ID NO: 3757727 - RNA, 16 nt, Salmonella typhimurium LT2
cuuguucgcaggucaa

SEQ ID NO: 3757728 - RNA, 14 nt, Salmonella typhimurium LT2
cuuguugcggauga

SEQ ID NO: 3757729 - RNA, 14 nt, Salmonella typhimurium LT2
cuuuaaacuuuuuu

SEQ ID NO: 3757730 - RNA, 16 nt, Salmonella typhimurium LT2
cuuuaaaugccuguuu

SEQ ID NO: 3757731 - RNA, 14 nt, Salmonella typhimurium LT2
cuuuaaauucagca

SEQ ID NO: 3757732 - RNA, 13 nt, Salmonella typhimurium LT2
cuuuaaccucuuu

SEQ ID NO: 3757733 - RNA, 16 nt, Salmonella typhimurium LT2
cuuuaaccucuuuuuc

SEQ ID NO: 3757734 - RNA, 23 nt, Salmonella typhimurium LT2
cuuuaacgccuucauauuaaauu

SEQ ID NO: 3757735 - RNA, 16 nt, Salmonella typhimurium LT2
cuuugcgcuccugcuc

SEQ ID NO: 3757736 - RNA, 21 nt, Salmonella typhimurium LT2
cuuugcguaaaaaaacaucau

SEQ ID NO: 3757737 - RNA, 15 nt, Salmonella typhimurium LT2
cuuuggcaaaaaagg

SEQ ID NO: 3757738 - RNA, 22 nt, Salmonella typhimurium LT2
cuuuggcaggccucuaucuucu

SEQ ID NO: 3757739 - RNA, 16 nt, Salmonella typhimurium LT2
cuuuggcgacuuuuuu

SEQ ID NO: 3757740 - RNA, 14 nt, Salmonella typhimurium LT2
cuuugggcgccauu

SEQ ID NO: 3757741 - RNA, 19 nt, Salmonella typhimurium LT2
cuuugguugccugcagaau

SEQ ID NO: 3757742 - RNA, 20 nt, Salmonella typhimurium LT2
cuuuguaaauacugaacuau

SEQ ID NO: 3757743 - RNA, 21 nt, Salmonella typhimurium LT2
cuuuguaucccuuucaaaaaa

SEQ ID NO: 3757744 - RNA, 21 nt, Salmonella typhimurium LT2
cuuugucagagggccaaagau

SEQ ID NO: 3757745 - RNA, 21 nt, Salmonella typhimurium LT2
cuuugucgaaauugccgcccg

SEQ ID NO: 3757746 - RNA, 17 nt, Salmonella typhimurium LT2
cuuuguugaucucauug

SEQ ID NO: 3757747 - RNA, 17 nt, Salmonella typhimurium LT2
cuuuguuggcugcacuc

SEQ ID NO: 3757748 - RNA, 16 nt, Salmonella typhimurium LT2
cuuuguuuaaaaauuu

SEQ ID NO: 3757749 - RNA, 19 nt, Salmonella typhimurium LT2
cuuuuaaaauaaaucggca

SEQ ID NO: 3757750 - RNA, 12 nt, Salmonella typhimurium LT2
cuuuuaaacggc

SEQ ID NO: 3757751 - RNA, 15 nt, Salmonella typhimurium LT2
cuuuuaacgcuuccg

SEQ ID NO: 3757752 - RNA, 14 nt, Salmonella typhimurium LT2
cuuuuaauuuucug

SEQ ID NO: 3757753 - RNA, 16 nt, Salmonella typhimurium LT2
cuuuuacagggcggca

SEQ ID NO: 3757754 - RNA, 14 nt, Salmonella typhimurium LT2
cuuuuaccggcgaa

SEQ ID NO: 3757755 - RNA, 22 nt, Salmonella typhimurium LT2
cuuuuaccggcgaagucgccau

SEQ ID NO: 3757756 - RNA, 19 nt, Salmonella typhimurium LT2
cuuuuagaacuaucugaaa

SEQ ID NO: 3757757 - RNA, 14 nt, Salmonella typhimurium LT2
cuuuuagcaccaga

SEQ ID NO: 3757758 - RNA, 22 nt, Salmonella typhimurium LT2
cuuuuauccccacuaccgccac

SEQ ID NO: 3757759 - RNA, 12 nt, Salmonella typhimurium LT2
cuuuuaugaagg

SEQ ID NO: 3757760 - RNA, 21 nt, Salmonella typhimurium LT2
cuuuuaugggaaaauuccugg

SEQ ID NO: 3757761 - RNA, 22 nt, Salmonella typhimurium LT2
cuuuuauuauuuugauaaucau

SEQ ID NO: 3757762 - RNA, 12 nt, Salmonella typhimurium LT2
cuuuuauuuugg

SEQ ID NO: 3757763 - RNA, 19 nt, Salmonella typhimurium LT2
cuuuucauccacagcgcca

SEQ ID NO: 3757764 - RNA, 17 nt, Salmonella typhimurium LT2
cuuuuccaggcgaccag

SEQ ID NO: 3757765 - RNA, 18 nt, Salmonella typhimurium LT2
cuuuucccgccagcugcg

SEQ ID NO: 3757766 - RNA, 21 nt, Salmonella typhimurium LT2
cuuuuccgccucgcgcacccg

SEQ ID NO: 3757767 - RNA, 15 nt, Salmonella typhimurium LT2
cuuuuccugcugcca

SEQ ID NO: 3757768 - RNA, 12 nt, Salmonella typhimurium LT2
cuuuuccuucca

SEQ ID NO: 3757769 - RNA, 17 nt, Salmonella typhimurium LT2
cuuuucgcagcaauucu

SEQ ID NO: 3757770 - RNA, 18 nt, Salmonella typhimurium LT2
cuuuucggguguccacuc

SEQ ID NO: 3757771 - RNA, 13 nt, Salmonella typhimurium LT2
cuuuucucccggc

SEQ ID NO: 3757772 - RNA, 22 nt, Salmonella typhimurium LT2
cuuuucucucuucgucauacuc

SEQ ID NO: 3757773 - RNA, 12 nt, Salmonella typhimurium LT2
cuuuugagcagc

SEQ ID NO: 3757774 - RNA, 21 nt, Salmonella typhimurium LT2
cuuuugauacucugcuuuuuc

SEQ ID NO: 3757775 - RNA, 13 nt, Salmonella typhimurium LT2
cuuuugccgcgcc

SEQ ID NO: 3757776 - RNA, 23 nt, Salmonella typhimurium LT2
cuuuugccgugacuuccgucucc

SEQ ID NO: 3757777 - RNA, 16 nt, Salmonella typhimurium LT2
cuuuugcgccuuccag

SEQ ID NO: 3757778 - RNA, 22 nt, Salmonella typhimurium LT2
cuuuugcuucaauagguuggcu

SEQ ID NO: 3757779 - RNA, 18 nt, Salmonella typhimurium LT2
cuuuuggcggccagcgug

SEQ ID NO: 3757780 - RNA, 16 nt, Salmonella typhimurium LT2
cuuuugggccgcgcag

SEQ ID NO: 3757781 - RNA, 23 nt, Salmonella typhimurium LT2
cuuuuggggccgauaccggcaac

SEQ ID NO: 3757782 - RNA, 15 nt, Salmonella typhimurium LT2
cuuuugguuuuucaa

SEQ ID NO: 3757783 - RNA, 19 nt, Salmonella typhimurium LT2
cuuuugucguccccuggac

SEQ ID NO: 3757784 - RNA, 21 nt, Salmonella typhimurium LT2
cuuuuuaauucacaacugaag

SEQ ID NO: 3757785 - RNA, 20 nt, Salmonella typhimurium LT2
cuuuuuaccggcgaccacua

SEQ ID NO: 3757786 - RNA, 19 nt, Salmonella typhimurium LT2
cuuuuuacucagggcgaaa

SEQ ID NO: 3757787 - RNA, 16 nt, Salmonella typhimurium LT2
cuuuuuaggcuauaaa

SEQ ID NO: 3757788 - RNA, 16 nt, Salmonella typhimurium LT2
cuuuuuauauaagcau

SEQ ID NO: 3757789 - RNA, 13 nt, Salmonella typhimurium LT2
cuuuuuauucaua

SEQ ID NO: 3757790 - RNA, 17 nt, Salmonella typhimurium LT2
cuuuuuauuuacugccg

SEQ ID NO: 3757791 - RNA, 15 nt, Salmonella typhimurium LT2
cuuuuucaacagcac

SEQ ID NO: 3757792 - RNA, 16 nt, Salmonella typhimurium LT2
cuuuuucaauuuccag

SEQ ID NO: 3757793 - RNA, 23 nt, Salmonella typhimurium LT2
cuuuuuccagcagcuccagagcg

SEQ ID NO: 3757794 - RNA, 15 nt, Salmonella typhimurium LT2
cuuuuucccacugcg

SEQ ID NO: 3757795 - RNA, 16 nt, Salmonella typhimurium LT2
cuuuuucccggugcgu

SEQ ID NO: 3757796 - RNA, 20 nt, Salmonella typhimurium LT2
cuuuuucgcucuuaucaccg

SEQ ID NO: 3757797 - RNA, 20 nt, Salmonella typhimurium LT2
cuuuuucuuaagcugagccu

SEQ ID NO: 3757798 - RNA, 23 nt, Salmonella typhimurium LT2
cuuuuugaucuaaaaauuacauc

SEQ ID NO: 3757799 - RNA, 13 nt, Salmonella typhimurium LT2
cuuuuugcauucg

SEQ ID NO: 3757800 - RNA, 20 nt, Salmonella typhimurium LT2
cuuuuugcauucgcuccuca

SEQ ID NO: 3757801 - RNA, 20 nt, Salmonella typhimurium LT2
cuuuuugcgacacgcugcau

SEQ ID NO: 3757802 - RNA, 18 nt, Salmonella typhimurium LT2
cuuuuugcgccgcgaaca

SEQ ID NO: 3757803 - RNA, 21 nt, Salmonella typhimurium LT2
cuuuuuuauggccaaccagau

SEQ ID NO: 3757804 - RNA, 18 nt, Salmonella typhimurium LT2
cuuuuuugccuuucagau

SEQ ID NO: 3757805 - RNA, 21 nt, Salmonella typhimurium LT2
cuuuuuuguauuaacggcgcu

SEQ ID NO: 3757806 - RNA, 17 nt, Salmonella typhimurium LT2
cuuuuuuuaugccuggg

SEQ ID NO: 3757807 - RNA, 11 nt, Salmonella typhimurium LT2
cuuuuuuucaa

SEQ ID NO: 3757808 - RNA, 20 nt, Salmonella typhimurium LT2
gaaaaaaacgcauugcagca

SEQ ID NO: 3757809 - RNA, 14 nt, Salmonella typhimurium LT2
gaaaaaaauccagu

SEQ ID NO: 3757810 - RNA, 13 nt, Salmonella typhimurium LT2
gaaaaaauacuga

SEQ ID NO: 3757811 - RNA, 13 nt, Salmonella typhimurium LT2
gaaaaaauuacag

SEQ ID NO: 3757812 - RNA, 18 nt, Salmonella typhimurium LT2
gaaaaaauuacagccgcg

SEQ ID NO: 3757813 - RNA, 21 nt, Salmonella typhimurium LT2
gaaaaacauauuaugcucaug

SEQ ID NO: 3757814 - RNA, 15 nt, Salmonella typhimurium LT2
gaaaaacaucggcaa

SEQ ID NO: 3757815 - RNA, 18 nt, Salmonella typhimurium LT2
gaaaaagaaaccuccgca

SEQ ID NO: 3757816 - RNA, 14 nt, Salmonella typhimurium LT2
gaaaaagggaaaag

SEQ ID NO: 3757817 - RNA, 17 nt, Salmonella typhimurium LT2
gaaaaagugauaaauau

SEQ ID NO: 3757818 - RNA, 23 nt, Salmonella typhimurium LT2
gaaaaauaguggcuggcguccgc

SEQ ID NO: 3757819 - RNA, 21 nt, Salmonella typhimurium LT2
gaaaaauccggcaggcagccg

SEQ ID NO: 3757820 - RNA, 17 nt, Salmonella typhimurium LT2
gaaaaaucuggcguuuc

SEQ ID NO: 3757821 - RNA, 23 nt, Salmonella typhimurium LT2
gaaaaaugaauaccaaaucucaa

SEQ ID NO: 3757822 - RNA, 15 nt, Salmonella typhimurium LT2
gaaaaauuccgcaga

SEQ ID NO: 3757823 - RNA, 13 nt, Salmonella typhimurium LT2
gaaaaauuugauc

SEQ ID NO: 3757824 - RNA, 13 nt, Salmonella typhimurium LT2
gaaaaauuuuccu

SEQ ID NO: 3757825 - RNA, 21 nt, Salmonella typhimurium LT2
gaaaacaccagggauuuugcu

SEQ ID NO: 3757826 - RNA, 15 nt, Salmonella typhimurium LT2
gaaaacagcgccggc

SEQ ID NO: 3757827 - RNA, 18 nt, Salmonella typhimurium LT2
gaaaaccacaaucacagc

SEQ ID NO: 3757828 - RNA, 21 nt, Salmonella typhimurium LT2
gaaaaccauaauaaugccaaa

SEQ ID NO: 3757829 - RNA, 18 nt, Salmonella typhimurium LT2
gaaaaccugcaaaaaaag

SEQ ID NO: 3757830 - RNA, 19 nt, Salmonella typhimurium LT2
gaaaaccugcaaaaaaaga

SEQ ID NO: 3757831 - RNA, 23 nt, Salmonella typhimurium LT2
gaaaaccugcaaaaaaagaaaaa

SEQ ID NO: 3757832 - RNA, 22 nt, Salmonella typhimurium LT2
gaaaacgaaucgaaucguucgc

SEQ ID NO: 3757833 - RNA, 18 nt, Salmonella typhimurium LT2
gaaaacgccugcgucuaa

SEQ ID NO: 3757834 - RNA, 17 nt, Salmonella typhimurium LT2
gaaaacgugauugcuga

SEQ ID NO: 3757835 - RNA, 19 nt, Salmonella typhimurium LT2
gaaaacgugauugcugaca

SEQ ID NO: 3757836 - RNA, 14 nt, Salmonella typhimurium LT2
gaaaacuuuccaac

SEQ ID NO: 3757837 - RNA, 14 nt, Salmonella typhimurium LT2
gaaaagcagaggcc

SEQ ID NO: 3757838 - RNA, 20 nt, Salmonella typhimurium LT2
gaaaagcgcgucgaaugacg

SEQ ID NO: 3757839 - RNA, 20 nt, Salmonella typhimurium LT2
gaaaucucgcuaaucaucag

SEQ ID NO: 3757840 - RNA, 22 nt, Salmonella typhimurium LT2
gaaaugagugcgccaaccugcu

SEQ ID NO: 3757841 - RNA, 16 nt, Salmonella typhimurium LT2
gaaaugauaagugaua

SEQ ID NO: 3757842 - RNA, 19 nt, Salmonella typhimurium LT2
gaaaugcccauccacgcca

SEQ ID NO: 3757843 - RNA, 17 nt, Salmonella typhimurium LT2
gaaaugccggauggcgu

SEQ ID NO: 3757844 - RNA, 19 nt, Salmonella typhimurium LT2
gaaaugcgaauccggcggc

SEQ ID NO: 3757845 - RNA, 22 nt, Salmonella typhimurium LT2
gaaaugcgacaucucaggcaag

SEQ ID NO: 3757846 - RNA, 24 nt, Salmonella typhimurium LT2
gaaaugcggguccugaucggcggc

SEQ ID NO: 3757847 - RNA, 19 nt, Salmonella typhimurium LT2
gaaauggcugacaucuuca

SEQ ID NO: 3757848 - RNA, 17 nt, Salmonella typhimurium LT2
gaaauggguaucuucau

SEQ ID NO: 3757849 - RNA, 18 nt, Salmonella typhimurium LT2
gaaaugguuccaggcgcg

SEQ ID NO: 3757850 - RNA, 15 nt, Salmonella typhimurium LT2
gaaauguucucagcc

SEQ ID NO: 3757851 - RNA, 17 nt, Salmonella typhimurium LT2
gaaauucgcgccagucc

SEQ ID NO: 3757852 - RNA, 17 nt, Salmonella typhimurium LT2
gaaauucugcaggccaa

SEQ ID NO: 3757853 - RNA, 22 nt, Salmonella typhimurium LT2
gaaauuuaggucaaaaaagcga

SEQ ID NO: 3757854 - RNA, 13 nt, Salmonella typhimurium LT2
gaaauuugcagcg

SEQ ID NO: 3757855 - RNA, 19 nt, Salmonella typhimurium LT2
gaacaaacagaccgccaug

SEQ ID NO: 3757856 - RNA, 19 nt, Salmonella typhimurium LT2
gaacaagcugauuuuucgc

SEQ ID NO: 3757857 - RNA, 10 nt, Salmonella typhimurium LT2
gaacaaggcu

SEQ ID NO: 3757858 - RNA, 20 nt, Salmonella typhimurium LT2
gaacaaguucuucgaagcac

SEQ ID NO: 3757859 - RNA, 23 nt, Salmonella typhimurium LT2
gaacaauaccguuagcgucaauc

SEQ ID NO: 3757860 - RNA, 17 nt, Salmonella typhimurium LT2
gaacaauaugcgcauca

SEQ ID NO: 3757861 - RNA, 20 nt, Salmonella typhimurium LT2
gaacaaugccauuuuugcau

SEQ ID NO: 3757862 - RNA, 18 nt, Salmonella typhimurium LT2
gaacacagcaugaauaac

SEQ ID NO: 3757863 - RNA, 15 nt, Salmonella typhimurium LT2
gaacacauuuccaac

SEQ ID NO: 3757864 - RNA, 17 nt, Salmonella typhimurium LT2
gaacacggcaugaagca

SEQ ID NO: 3757865 - RNA, 22 nt, Salmonella typhimurium LT2
gaacacgguguaguacacaauc

SEQ ID NO: 3757866 - RNA, 14 nt, Salmonella typhimurium LT2
gaacagaagcgccg

SEQ ID NO: 3757867 - RNA, 14 nt, Salmonella typhimurium LT2
gaacagacggcggc

SEQ ID NO: 3757868 - RNA, 15 nt, Salmonella typhimurium LT2
gaacagacggcggcu

SEQ ID NO: 3757869 - RNA, 16 nt, Salmonella typhimurium LT2
gaacagccagaagccc

SEQ ID NO: 3757870 - RNA, 20 nt, Salmonella typhimurium LT2
gaacagcgacggcuucacug

SEQ ID NO: 3757871 - RNA, 16 nt, Salmonella typhimurium LT2
gaacagcggcggcacg

SEQ ID NO: 3757872 - RNA, 13 nt, Salmonella typhimurium LT2
gaacaggcagcgu

SEQ ID NO: 3757873 - RNA, 19 nt, Salmonella typhimurium LT2
gaacaggccaaacccugcg

SEQ ID NO: 3757874 - RNA, 18 nt, Salmonella typhimurium LT2
gaacaggcgugggggagu

SEQ ID NO: 3757875 - RNA, 18 nt, Salmonella typhimurium LT2
gaacaggcuuuucaggcu

SEQ ID NO: 3757876 - RNA, 21 nt, Salmonella typhimurium LT2
gaacagguaguuaccguauuc

SEQ ID NO: 3757877 - RNA, 17 nt, Salmonella typhimurium LT2
gaacaguccaggaaaga

SEQ ID NO: 3757878 - RNA, 20 nt, Salmonella typhimurium LT2
gaacagucccaccagcgcgg

SEQ ID NO: 3757879 - RNA, 22 nt, Salmonella typhimurium LT2
gaacagucccaccagcgcggca

SEQ ID NO: 3757880 - RNA, 20 nt, Salmonella typhimurium LT2
gaacaucagccagcagcuca

SEQ ID NO: 3757881 - RNA, 17 nt, Salmonella typhimurium LT2
gaacaucaucuucuguc

SEQ ID NO: 3757882 - RNA, 10 nt, Salmonella typhimurium LT2
gaacaucggu

SEQ ID NO: 3757883 - RNA, 19 nt, Salmonella typhimurium LT2
gaacaucgguuuguucaua

SEQ ID NO: 3757884 - RNA, 17 nt, Salmonella typhimurium LT2
gaacaucuuucugaaca

SEQ ID NO: 3757885 - RNA, 13 nt, Salmonella typhimurium LT2
gaacaugcauguu

SEQ ID NO: 3757886 - RNA, 13 nt, Salmonella typhimurium LT2
gaacauggcuucg

SEQ ID NO: 3757887 - RNA, 14 nt, Salmonella typhimurium LT2
gaacauuacauccu

SEQ ID NO: 3757888 - RNA, 20 nt, Salmonella typhimurium LT2
gaacauugaagguauccagc

SEQ ID NO: 3757889 - RNA, 18 nt, Salmonella typhimurium LT2
gaacauuggaauauccgc

SEQ ID NO: 3757890 - RNA, 16 nt, Salmonella typhimurium LT2
gaacauuucaucuauc

SEQ ID NO: 3757891 - RNA, 21 nt, Salmonella typhimurium LT2
gaaccaauaguauggagcagg

SEQ ID NO: 3757892 - RNA, 21 nt, Salmonella typhimurium LT2
gaaccagcggcaccagcacga

SEQ ID NO: 3757893 - RNA, 18 nt, Salmonella typhimurium LT2
gaaccagucgguaucguu

SEQ ID NO: 3757894 - RNA, 18 nt, Salmonella typhimurium LT2
gaaccaucauuaauauaa

SEQ ID NO: 3757895 - RNA, 18 nt, Salmonella typhimurium LT2
gaaccaucgacccccacc

SEQ ID NO: 3757896 - RNA, 19 nt, Salmonella typhimurium LT2
gaaccaucgacccccacca

SEQ ID NO: 3757897 - RNA, 12 nt, Salmonella typhimurium LT2
gaacccaggcac

SEQ ID NO: 3757898 - RNA, 14 nt, Salmonella typhimurium LT2
gaacccaucaggga

SEQ ID NO: 3757899 - RNA, 16 nt, Salmonella typhimurium LT2
gaacccgaccgucuuu

SEQ ID NO: 3757900 - RNA, 18 nt, Salmonella typhimurium LT2
gaacccggguaggcugcu

SEQ ID NO: 3757901 - RNA, 14 nt, Salmonella typhimurium LT2
gaaccggcaucggc

SEQ ID NO: 3757902 - RNA, 15 nt, Salmonella typhimurium LT2
gaaccggcaucggca

SEQ ID NO: 3757903 - RNA, 18 nt, Salmonella typhimurium LT2
gaaccguaaacgccugca

SEQ ID NO: 3757904 - RNA, 19 nt, Salmonella typhimurium LT2
gaaccguaaacgccugcac

SEQ ID NO: 3757905 - RNA, 20 nt, Salmonella typhimurium LT2
gaaccguaaacgccugcacc

SEQ ID NO: 3757906 - RNA, 19 nt, Salmonella typhimurium LT2
gaaccgucuuguacaggcg

SEQ ID NO: 3757907 - RNA, 22 nt, Salmonella typhimurium LT2
gaaccguugcgcccaucaucau

SEQ ID NO: 3757908 - RNA, 22 nt, Salmonella typhimurium LT2
gaaccucaccguccgccaggcc

SEQ ID NO: 3757909 - RNA, 15 nt, Salmonella typhimurium LT2
gaaccugcgccgguu

SEQ ID NO: 3757910 - RNA, 20 nt, Salmonella typhimurium LT2
gaacgacucacgcgcgcuuu

SEQ ID NO: 3757911 - RNA, 20 nt, Salmonella typhimurium LT2
gaacgacugaguauuggcaa

SEQ ID NO: 3757912 - RNA, 15 nt, Salmonella typhimurium LT2
gaacgagaggaggag

SEQ ID NO: 3757913 - RNA, 20 nt, Salmonella typhimurium LT2
gaacgaguacguaaugcgaa

SEQ ID NO: 3757914 - RNA, 14 nt, Salmonella typhimurium LT2
gaacgccagcggcg

SEQ ID NO: 3757915 - RNA, 12 nt, Salmonella typhimurium LT2
gaacgccaggcc

SEQ ID NO: 3757916 - RNA, 22 nt, Salmonella typhimurium LT2
gaacgccgccugcgccagcgcc

SEQ ID NO: 3757917 - RNA, 23 nt, Salmonella typhimurium LT2
gaacgccgccugcgccagcgccg

SEQ ID NO: 3757918 - RNA, 17 nt, Salmonella typhimurium LT2
gaacgccggaacccgcg

SEQ ID NO: 3757919 - RNA, 14 nt, Salmonella typhimurium LT2
gaacgccuuauccg

SEQ ID NO: 3757920 - RNA, 16 nt, Salmonella typhimurium LT2
gaacgcggcuuauccg

SEQ ID NO: 3757921 - RNA, 22 nt, Salmonella typhimurium LT2
gaacgcuaucggcauaggcuau

SEQ ID NO: 3757922 - RNA, 18 nt, Salmonella typhimurium LT2
gaacgcuggcacuuuccg

SEQ ID NO: 3757923 - RNA, 15 nt, Salmonella typhimurium LT2
gaacgcuggcugggu

SEQ ID NO: 3757924 - RNA, 15 nt, Salmonella typhimurium LT2
gaacgcuuccgggcu

SEQ ID NO: 3757925 - RNA, 15 nt, Salmonella typhimurium LT2
gaacggcauaaucug

SEQ ID NO: 3757926 - RNA, 22 nt, Salmonella typhimurium LT2
gaacggcuccacgccggagagc

SEQ ID NO: 3757927 - RNA, 20 nt, Salmonella typhimurium LT2
gaacgguaacaggaagcagc

SEQ ID NO: 3757928 - RNA, 16 nt, Salmonella typhimurium LT2
gaacguucauggguua

SEQ ID NO: 3757929 - RNA, 18 nt, Salmonella typhimurium LT2
gaacuacugauuccugcc

SEQ ID NO: 3757930 - RNA, 16 nt, Salmonella typhimurium LT2
gaacuauaggaaaaua

SEQ ID NO: 3757931 - RNA, 12 nt, Salmonella typhimurium LT2
gaacuccagcag

SEQ ID NO: 3757932 - RNA, 20 nt, Salmonella typhimurium LT2
gaacucggucaggguaauag

SEQ ID NO: 3757933 - RNA, 17 nt, Salmonella typhimurium LT2
gaacucgucuuauccgg

SEQ ID NO: 3757934 - RNA, 16 nt, Salmonella typhimurium LT2
gaacucugcuuuuauu

SEQ ID NO: 3757935 - RNA, 13 nt, Salmonella typhimurium LT2
gaacucuuucaga

SEQ ID NO: 3757936 - RNA, 20 nt, Salmonella typhimurium LT2
gaacugauggcgcuaagcca

SEQ ID NO: 3757937 - RNA, 13 nt, Salmonella typhimurium LT2
gaacugcagcgcg

SEQ ID NO: 3757938 - RNA, 20 nt, Salmonella typhimurium LT2
gaacugcccggagccaaugu

SEQ ID NO: 3757939 - RNA, 19 nt, Salmonella typhimurium LT2
gaacugcguaagcaucccc

SEQ ID NO: 3757940 - RNA, 18 nt, Salmonella typhimurium LT2
gaacuggcugauaaagcu

SEQ ID NO: 3757941 - RNA, 14 nt, Salmonella typhimurium LT2
gaacuggugaaaca

SEQ ID NO: 3757942 - RNA, 22 nt, Salmonella typhimurium LT2
gaacugguuugucgauuugcug

SEQ ID NO: 3757943 - RNA, 11 nt, Salmonella typhimurium LT2
gaauaaacaca

SEQ ID NO: 3757944 - RNA, 16 nt, Salmonella typhimurium LT2
gaauaacaucuuccau

SEQ ID NO: 3757945 - RNA, 14 nt, Salmonella typhimurium LT2
gaauaaccaucgga

SEQ ID NO: 3757946 - RNA, 18 nt, Salmonella typhimurium LT2
gaauaaccucaacgucgc

SEQ ID NO: 3757947 - RNA, 13 nt, Salmonella typhimurium LT2
gaauaaccucccg

SEQ ID NO: 3757948 - RNA, 19 nt, Salmonella typhimurium LT2
gaauaagcugaaugguaaa

SEQ ID NO: 3757949 - RNA, 18 nt, Salmonella typhimurium LT2
gaauaauacacgcgacaa

SEQ ID NO: 3757950 - RNA, 15 nt, Salmonella typhimurium LT2
gaauaaucccggcgc

SEQ ID NO: 3757951 - RNA, 21 nt, Salmonella typhimurium LT2
gaauaaucgccggacggcgca

SEQ ID NO: 3757952 - RNA, 15 nt, Salmonella typhimurium LT2
gaauaaucucaucgc

SEQ ID NO: 3757953 - RNA, 16 nt, Salmonella typhimurium LT2
gaauaaucucugcgac

SEQ ID NO: 3757954 - RNA, 16 nt, Salmonella typhimurium LT2
gaauaauuucggcggc

SEQ ID NO: 3757955 - RNA, 16 nt, Salmonella typhimurium LT2
gaauaccaaaucucaa

SEQ ID NO: 3757956 - RNA, 20 nt, Salmonella typhimurium LT2
gaauaccaaaucucaagagu

SEQ ID NO: 3757957 - RNA, 20 nt, Salmonella typhimurium LT2
gaauaccaagucucaagagu

SEQ ID NO: 3757958 - RNA, 20 nt, Salmonella typhimurium LT2
gaauaccagaaucaccgaca

SEQ ID NO: 3757959 - RNA, 15 nt, Salmonella typhimurium LT2
gaauacccaacugua

SEQ ID NO: 3757960 - RNA, 15 nt, Salmonella typhimurium LT2
gaauacccagcucag

SEQ ID NO: 3757961 - RNA, 19 nt, Salmonella typhimurium LT2
gaauacccagcucagcuuu

SEQ ID NO: 3757962 - RNA, 13 nt, Salmonella typhimurium LT2
gaauaccuucuuc

SEQ ID NO: 3757963 - RNA, 17 nt, Salmonella typhimurium LT2
gaauaccuugauaacug

SEQ ID NO: 3757964 - RNA, 17 nt, Salmonella typhimurium LT2
gaauacggagaacggca

SEQ ID NO: 3757965 - RNA, 19 nt, Salmonella typhimurium LT2
gaauacgugugcugacggc

SEQ ID NO: 3757966 - RNA, 22 nt, Salmonella typhimurium LT2
gaauagacggccugcaaacgaa

SEQ ID NO: 3757967 - RNA, 17 nt, Salmonella typhimurium LT2
gaauagaggcgcuggcg

SEQ ID NO: 3757968 - RNA, 12 nt, Salmonella typhimurium LT2
gaauagcaggca

SEQ ID NO: 3757969 - RNA, 19 nt, Salmonella typhimurium LT2
gaauagccugggcaaggcu

SEQ ID NO: 3757970 - RNA, 15 nt, Salmonella typhimurium LT2
gaauagcgccagggu

SEQ ID NO: 3757971 - RNA, 20 nt, Salmonella typhimurium LT2
gaauagcggcuaaucaccac

SEQ ID NO: 3757972 - RNA, 15 nt, Salmonella typhimurium LT2
gaauagcguauuuuu

SEQ ID NO: 3757973 - RNA, 23 nt, Salmonella typhimurium LT2
gaauaguauugccgucaaaggcu

SEQ ID NO: 3757974 - RNA, 19 nt, Salmonella typhimurium LT2
gaauaguuacggacaugcg

SEQ ID NO: 3757975 - RNA, 21 nt, Salmonella typhimurium LT2
gaauauauucuuuguuuaaaa

SEQ ID NO: 3757976 - RNA, 22 nt, Salmonella typhimurium LT2
gaauaucacuaucaguuuuggc

SEQ ID NO: 3757977 - RNA, 23 nt, Salmonella typhimurium LT2
gaauaugagauugugcuuuagcu

SEQ ID NO: 3757978 - RNA, 18 nt, Salmonella typhimurium LT2
gaauaugagcacagccca

SEQ ID NO: 3757979 - RNA, 12 nt, Salmonella typhimurium LT2
gaauauggaaag

SEQ ID NO: 3757980 - RNA, 16 nt, Salmonella typhimurium LT2
gaauauggcggugagg

SEQ ID NO: 3757981 - RNA, 16 nt, Salmonella typhimurium LT2
gaauauucauuuccag

SEQ ID NO: 3757982 - RNA, 18 nt, Salmonella typhimurium LT2
gaauauucggcuccagau

SEQ ID NO: 3757983 - RNA, 14 nt, Salmonella typhimurium LT2
gaaucaauuucuac

SEQ ID NO: 3757984 - RNA, 20 nt, Salmonella typhimurium LT2
gaaucacauccgccagcgcc

SEQ ID NO: 3757985 - RNA, 12 nt, Salmonella typhimurium LT2
gaaucaccgaca

SEQ ID NO: 3757986 - RNA, 17 nt, Salmonella typhimurium LT2
gaaucaccgacagcacc

SEQ ID NO: 3757987 - RNA, 19 nt, Salmonella typhimurium LT2
gaaucaccgacagcaccgc

SEQ ID NO: 3757988 - RNA, 18 nt, Salmonella typhimurium LT2
gaaucacuucauccggau

SEQ ID NO: 3757989 - RNA, 14 nt, Salmonella typhimurium LT2
gaaucagaugcuca

SEQ ID NO: 3757990 - RNA, 18 nt, Salmonella typhimurium LT2
gaaucagcaacacaauca

SEQ ID NO: 3757991 - RNA, 22 nt, Salmonella typhimurium LT2
gaaucagcaacacaaucaggcg

SEQ ID NO: 3757992 - RNA, 16 nt, Salmonella typhimurium LT2
gaauccaggccagaua

SEQ ID NO: 3757993 - RNA, 11 nt, Salmonella typhimurium LT2
gaauccaggua

SEQ ID NO: 3757994 - RNA, 16 nt, Salmonella typhimurium LT2
gaauccagguacccca

SEQ ID NO: 3757995 - RNA, 14 nt, Salmonella typhimurium LT2
gaauccccaucucc

SEQ ID NO: 3757996 - RNA, 16 nt, Salmonella typhimurium LT2
gaauccccaucuccag

SEQ ID NO: 3757997 - RNA, 20 nt, Salmonella typhimurium LT2
gaaucccgucguagccacca

SEQ ID NO: 3757998 - RNA, 19 nt, Salmonella typhimurium LT2
gaauccguugaucguccau

SEQ ID NO: 3757999 - RNA, 18 nt, Salmonella typhimurium LT2
gaauccucccggaugcac

SEQ ID NO: 3758000 - RNA, 20 nt, Salmonella typhimurium LT2
gaauccuucccccaccacca

SEQ ID NO: 3758001 - RNA, 13 nt, Salmonella typhimurium LT2
gaaucgaaccugc

SEQ ID NO: 3758002 - RNA, 18 nt, Salmonella typhimurium LT2
gaaucgaauacagcgccu

SEQ ID NO: 3758003 - RNA, 17 nt, Salmonella typhimurium LT2
gaaucgacaauccgcca

SEQ ID NO: 3758004 - RNA, 14 nt, Salmonella typhimurium LT2
gaaucgccaggcgc

SEQ ID NO: 3758005 - RNA, 19 nt, Salmonella typhimurium LT2
gaaucgccaggcgcagcaa

SEQ ID NO: 3758006 - RNA, 15 nt, Salmonella typhimurium LT2
gaaucgccgucagug

SEQ ID NO: 3758007 - RNA, 14 nt, Salmonella typhimurium LT2
gaaucgcgucguuc

SEQ ID NO: 3758008 - RNA, 15 nt, Salmonella typhimurium LT2
gaaucguucgccagu

SEQ ID NO: 3758009 - RNA, 23 nt, Salmonella typhimurium LT2
gaaucuauuauuaaucugguauc

SEQ ID NO: 3758010 - RNA, 18 nt, Salmonella typhimurium LT2
gaaucucgcugccggaaa

SEQ ID NO: 3758011 - RNA, 23 nt, Salmonella typhimurium LT2
gaaucuggucggugauauauuca

SEQ ID NO: 3758012 - RNA, 14 nt, Salmonella typhimurium LT2
gaaugaagccuuag

SEQ ID NO: 3758013 - RNA, 17 nt, Salmonella typhimurium LT2
gaaugaaggauuguacu

SEQ ID NO: 3758014 - RNA, 14 nt, Salmonella typhimurium LT2
gaaugacaaaccgg

SEQ ID NO: 3758015 - RNA, 21 nt, Salmonella typhimurium LT2
gaaugacgggccuacgcgcau

SEQ ID NO: 3758016 - RNA, 21 nt, Salmonella typhimurium LT2
gaaugagcaaugagauccacu

SEQ ID NO: 3758017 - RNA, 15 nt, Salmonella typhimurium LT2
gaaugaugugcuauu

SEQ ID NO: 3758018 - RNA, 23 nt, Salmonella typhimurium LT2
gaaugauugccggauggcggcgu

SEQ ID NO: 3758019 - RNA, 17 nt, Salmonella typhimurium LT2
gaaugcagaccucugcu

SEQ ID NO: 3758020 - RNA, 20 nt, Salmonella typhimurium LT2
gaaugcccacgcuucccagc

SEQ ID NO: 3758021 - RNA, 18 nt, Salmonella typhimurium LT2
gaaugccggauggcggcg

SEQ ID NO: 3758022 - RNA, 19 nt, Salmonella typhimurium LT2
gaaugccguauaccagcgu

SEQ ID NO: 3758023 - RNA, 21 nt, Salmonella typhimurium LT2
gaaugcgcgucaggccagggu

SEQ ID NO: 3758024 - RNA, 23 nt, Salmonella typhimurium LT2
gaaugcugacggauucuuccucu

SEQ ID NO: 3758025 - RNA, 23 nt, Salmonella typhimurium LT2
gaaugcuucgccacgaccuacac

SEQ ID NO: 3758026 - RNA, 17 nt, Salmonella typhimurium LT2
gaauggcgaaccacggc

SEQ ID NO: 3758027 - RNA, 14 nt, Salmonella typhimurium LT2
gaauggcugcuuuu

SEQ ID NO: 3758028 - RNA, 23 nt, Salmonella typhimurium LT2
gaauggggauaaugacauccaga

SEQ ID NO: 3758029 - RNA, 15 nt, Salmonella typhimurium LT2
gaauguagcgaccuu

SEQ ID NO: 3758030 - RNA, 17 nt, Salmonella typhimurium LT2
gaauuaauggucagauc

SEQ ID NO: 3758031 - RNA, 15 nt, Salmonella typhimurium LT2
gaauuaucaggguua

SEQ ID NO: 3758032 - RNA, 15 nt, Salmonella typhimurium LT2
gaauuaugacggaug

SEQ ID NO: 3758033 - RNA, 13 nt, Salmonella typhimurium LT2
gaauuauuaccaa

SEQ ID NO: 3758034 - RNA, 16 nt, Salmonella typhimurium LT2
gaauuccaguccuuuc

SEQ ID NO: 3758035 - RNA, 21 nt, Salmonella typhimurium LT2
gaauuccuuuuuccgccaccu

SEQ ID NO: 3758036 - RNA, 21 nt, Salmonella typhimurium LT2
gaauugacgauaucaucuugc

SEQ ID NO: 3758037 - RNA, 13 nt, Salmonella typhimurium LT2
gaauugauaaaga

SEQ ID NO: 3758038 - RNA, 20 nt, Salmonella typhimurium LT2
gaauugccgugguaucgaaa

SEQ ID NO: 3758039 - RNA, 11 nt, Salmonella typhimurium LT2
gaauugcgcca

SEQ ID NO: 3758040 - RNA, 14 nt, Salmonella typhimurium LT2
gaauugguagacgc

SEQ ID NO: 3758041 - RNA, 21 nt, Salmonella typhimurium LT2
gaauuguccacccucccagaa

SEQ ID NO: 3758042 - RNA, 16 nt, Salmonella typhimurium LT2
gaauuuacucgccaau

SEQ ID NO: 3758043 - RNA, 17 nt, Salmonella typhimurium LT2
gaauuuagcacccagga

SEQ ID NO: 3758044 - RNA, 22 nt, Salmonella typhimurium LT2
gaauuuaucaauaaccgccagc

SEQ ID NO: 3758045 - RNA, 17 nt, Salmonella typhimurium LT2
gaauuucaaucaucaua

SEQ ID NO: 3758046 - RNA, 19 nt, Salmonella typhimurium LT2
gaauuucuacacagcgcga

SEQ ID NO: 3758047 - RNA, 15 nt, Salmonella typhimurium LT2
gacauaagaguccau

SEQ ID NO: 3758048 - RNA, 14 nt, Salmonella typhimurium LT2
gacauagccgccac

SEQ ID NO: 3758049 - RNA, 17 nt, Salmonella typhimurium LT2
gacaucacguucgcgca

SEQ ID NO: 3758050 - RNA, 22 nt, Salmonella typhimurium LT2
gacaucacguucgcgcauaccu

SEQ ID NO: 3758051 - RNA, 17 nt, Salmonella typhimurium LT2
gacaucauccacggcau

SEQ ID NO: 3758052 - RNA, 19 nt, Salmonella typhimurium LT2
gacaucaucgaccuuaauu

SEQ ID NO: 3758053 - RNA, 18 nt, Salmonella typhimurium LT2
gacauccagcauuucgac

SEQ ID NO: 3758054 - RNA, 13 nt, Salmonella typhimurium LT2
gacauccauccgg

SEQ ID NO: 3758055 - RNA, 16 nt, Salmonella typhimurium LT2
gacaucccagacaaaa

SEQ ID NO: 3758056 - RNA, 14 nt, Salmonella typhimurium LT2
gacauccgccaucc

SEQ ID NO: 3758057 - RNA, 13 nt, Salmonella typhimurium LT2
gacaucggcacgc

SEQ ID NO: 3758058 - RNA, 23 nt, Salmonella typhimurium LT2
gacaucgucacaauaugguuauc

SEQ ID NO: 3758059 - RNA, 14 nt, Salmonella typhimurium LT2
gacaugaccgcaca

SEQ ID NO: 3758060 - RNA, 19 nt, Salmonella typhimurium LT2
gacaugagauaaugcuuuc

SEQ ID NO: 3758061 - RNA, 17 nt, Salmonella typhimurium LT2
gacaugcaaugccguua

SEQ ID NO: 3758062 - RNA, 12 nt, Salmonella typhimurium LT2
gacaugcagauc

SEQ ID NO: 3758063 - RNA, 15 nt, Salmonella typhimurium LT2
gacauggaguuccag

SEQ ID NO: 3758064 - RNA, 17 nt, Salmonella typhimurium LT2
gacauggcaauggcuuc

SEQ ID NO: 3758065 - RNA, 19 nt, Salmonella typhimurium LT2
gacauggucgaacaucugc

SEQ ID NO: 3758066 - RNA, 24 nt, Salmonella typhimurium LT2
gacauguucgaacaugccgacaga

SEQ ID NO: 3758067 - RNA, 19 nt, Salmonella typhimurium LT2
gacauuaacgaugccuuau

SEQ ID NO: 3758068 - RNA, 12 nt, Salmonella typhimurium LT2
gacauucccugc

SEQ ID NO: 3758069 - RNA, 14 nt, Salmonella typhimurium LT2
gacauucgggacaa

SEQ ID NO: 3758070 - RNA, 14 nt, Salmonella typhimurium LT2
gacauugcgcggcg

SEQ ID NO: 3758071 - RNA, 13 nt, Salmonella typhimurium LT2
gaccaaaccugcg

SEQ ID NO: 3758072 - RNA, 13 nt, Salmonella typhimurium LT2
gaccaagcgucag

SEQ ID NO: 3758073 - RNA, 20 nt, Salmonella typhimurium LT2
gaccaauauccgcaggcgac

SEQ ID NO: 3758074 - RNA, 20 nt, Salmonella typhimurium LT2
gaccaaugacgcuauccgca

SEQ ID NO: 3758075 - RNA, 20 nt, Salmonella typhimurium LT2
gaccaaugcuggcaggcgcg

SEQ ID NO: 3758076 - RNA, 14 nt, Salmonella typhimurium LT2
gaccacaaagagug

SEQ ID NO: 3758077 - RNA, 17 nt, Salmonella typhimurium LT2
gaccacaaagagugcca

SEQ ID NO: 3758078 - RNA, 23 nt, Salmonella typhimurium LT2
gaccacagauaaaacaaaaggcc

SEQ ID NO: 3758079 - RNA, 19 nt, Salmonella typhimurium LT2
gaccaccaggauaauggug

SEQ ID NO: 3758080 - RNA, 15 nt, Salmonella typhimurium LT2
gaccaccauccggca

SEQ ID NO: 3758081 - RNA, 16 nt, Salmonella typhimurium LT2
gaccaccauccggcaa

SEQ ID NO: 3758082 - RNA, 15 nt, Salmonella typhimurium LT2
gaccacccgcggcca

SEQ ID NO: 3758083 - RNA, 22 nt, Salmonella typhimurium LT2
gaccaccgaagaauuuaucaau

SEQ ID NO: 3758084 - RNA, 13 nt, Salmonella typhimurium LT2
gaccaccgcgcua

SEQ ID NO: 3758085 - RNA, 22 nt, Salmonella typhimurium LT2
gaccaccgcgcuagugccgcca

SEQ ID NO: 3758086 - RNA, 15 nt, Salmonella typhimurium LT2
gaccacgaaucagga

SEQ ID NO: 3758087 - RNA, 18 nt, Salmonella typhimurium LT2
gaccacgacgccggagac

SEQ ID NO: 3758088 - RNA, 13 nt, Salmonella typhimurium LT2
gaccacgccagcc

SEQ ID NO: 3758089 - RNA, 17 nt, Salmonella typhimurium LT2
gaccacgccagccagcc

SEQ ID NO: 3758090 - RNA, 19 nt, Salmonella typhimurium LT2
gaccacgccaucaacagcg

SEQ ID NO: 3758091 - RNA, 14 nt, Salmonella typhimurium LT2
gaccacgccgccgc

SEQ ID NO: 3758092 - RNA, 13 nt, Salmonella typhimurium LT2
gaccacuagcgcc

SEQ ID NO: 3758093 - RNA, 23 nt, Salmonella typhimurium LT2
gaccagaaccucacggagaaaag

SEQ ID NO: 3758094 - RNA, 21 nt, Salmonella typhimurium LT2
gaccagauaaucaaacgcgcc

SEQ ID NO: 3758095 - RNA, 12 nt, Salmonella typhimurium LT2
gaccagcaucag

SEQ ID NO: 3758096 - RNA, 18 nt, Salmonella typhimurium LT2
gaccagcaucagaauaau

SEQ ID NO: 3758097 - RNA, 21 nt, Salmonella typhimurium LT2
gaccagcgcaaacaacccggc

SEQ ID NO: 3758098 - RNA, 13 nt, Salmonella typhimurium LT2
gaccaggaucaga

SEQ ID NO: 3758099 - RNA, 15 nt, Salmonella typhimurium LT2
gaccaggaucagacc

SEQ ID NO: 3758100 - RNA, 17 nt, Salmonella typhimurium LT2
gaccagguugccagcgg

SEQ ID NO: 3758101 - RNA, 17 nt, Salmonella typhimurium LT2
gaccaguaagagaacaa

SEQ ID NO: 3758102 - RNA, 19 nt, Salmonella typhimurium LT2
gaccaguaagagaacaaua

SEQ ID NO: 3758103 - RNA, 18 nt, Salmonella typhimurium LT2
gaccagugaacgucugca

SEQ ID NO: 3758104 - RNA, 14 nt, Salmonella typhimurium LT2
gaccaguuauucgg

SEQ ID NO: 3758105 - RNA, 16 nt, Salmonella typhimurium LT2
gaccaguuauucggca

SEQ ID NO: 3758106 - RNA, 23 nt, Salmonella typhimurium LT2
gaccaguugcaggcauagcggac

SEQ ID NO: 3758107 - RNA, 18 nt, Salmonella typhimurium LT2
gaccauaaauagccgacc

SEQ ID NO: 3758108 - RNA, 19 nt, Salmonella typhimurium LT2
gaccauaaauagccgaccg

SEQ ID NO: 3758109 - RNA, 15 nt, Salmonella typhimurium LT2
gaccauaauuuccgg

SEQ ID NO: 3758110 - RNA, 19 nt, Salmonella typhimurium LT2
gaccauacgcagcauuucg

SEQ ID NO: 3758111 - RNA, 12 nt, Salmonella typhimurium LT2
gaccauacuaau

SEQ ID NO: 3758112 - RNA, 14 nt, Salmonella typhimurium LT2
gaccauauucacgc

SEQ ID NO: 3758113 - RNA, 19 nt, Salmonella typhimurium LT2
gaccauauucacgcagcuu

SEQ ID NO: 3758114 - RNA, 23 nt, Salmonella typhimurium LT2
gaccauccacgggcuaaaugccc

SEQ ID NO: 3758115 - RNA, 13 nt, Salmonella typhimurium LT2
gaccauccagaca

SEQ ID NO: 3758116 - RNA, 18 nt, Salmonella typhimurium LT2
gaccauccagacaugcac

SEQ ID NO: 3758117 - RNA, 16 nt, Salmonella typhimurium LT2
gaccaugcauauaaga

SEQ ID NO: 3758118 - RNA, 17 nt, Salmonella typhimurium LT2
gaccauuacccaccgga

SEQ ID NO: 3758119 - RNA, 16 nt, Salmonella typhimurium LT2
gacccacuaacugccg

SEQ ID NO: 3758120 - RNA, 11 nt, Salmonella typhimurium LT2
gacccagcgcg

SEQ ID NO: 3758121 - RNA, 14 nt, Salmonella typhimurium LT2
gacccagcggcaga

SEQ ID NO: 3758122 - RNA, 23 nt, Salmonella typhimurium LT2
gacccauaguuucauauccgaca

SEQ ID NO: 3758123 - RNA, 14 nt, Salmonella typhimurium LT2
gaccccaauagcga

SEQ ID NO: 3758124 - RNA, 12 nt, Salmonella typhimurium LT2
gaccccgccagg

SEQ ID NO: 3758125 - RNA, 13 nt, Salmonella typhimurium LT2
gaccccgccaggc

SEQ ID NO: 3758126 - RNA, 14 nt, Salmonella typhimurium LT2
gaccccgccaggcg

SEQ ID NO: 3758127 - RNA, 14 nt, Salmonella typhimurium LT2
gaccccucuucuuu

SEQ ID NO: 3758128 - RNA, 21 nt, Salmonella typhimurium LT2
gaccccuggguagaguaaccc

SEQ ID NO: 3758129 - RNA, 13 nt, Salmonella typhimurium LT2
gacccgaaccugc

SEQ ID NO: 3758130 - RNA, 22 nt, Salmonella typhimurium LT2
gacccgcaaaccacgucugcgc

SEQ ID NO: 3758131 - RNA, 21 nt, Salmonella typhimurium LT2
gacccgcuuccaguuuugcca

SEQ ID NO: 3758132 - RNA, 16 nt, Salmonella typhimurium LT2
gacccggcguuuucag

SEQ ID NO: 3758133 - RNA, 17 nt, Salmonella typhimurium LT2
gacccguggcugcgccu

SEQ ID NO: 3758134 - RNA, 16 nt, Salmonella typhimurium LT2
gacccucccugcgcuu

SEQ ID NO: 3758135 - RNA, 13 nt, Salmonella typhimurium LT2
gaccgagucuaca

SEQ ID NO: 3758136 - RNA, 14 nt, Salmonella typhimurium LT2
gaccgauaaauacc

SEQ ID NO: 3758137 - RNA, 16 nt, Salmonella typhimurium LT2
gaccgaucucaugcaa

SEQ ID NO: 3758138 - RNA, 18 nt, Salmonella typhimurium LT2
gaccgauugacugaagau

SEQ ID NO: 3758139 - RNA, 13 nt, Salmonella typhimurium LT2
gaccgcaaaccga

SEQ ID NO: 3758140 - RNA, 14 nt, Salmonella typhimurium LT2
gaccgcacagcaga

SEQ ID NO: 3758141 - RNA, 21 nt, Salmonella typhimurium LT2
gaccgccaagcgcggacagca

SEQ ID NO: 3758142 - RNA, 18 nt, Salmonella typhimurium LT2
gaccgccgagcccgaggc

SEQ ID NO: 3758143 - RNA, 14 nt, Salmonella typhimurium LT2
gaccgccggaaauu

SEQ ID NO: 3758144 - RNA, 20 nt, Salmonella typhimurium LT2
gaccgcgccggucgccagca

SEQ ID NO: 3758145 - RNA, 17 nt, Salmonella typhimurium LT2
gaccgcuccacucgaua

SEQ ID NO: 3758146 - RNA, 23 nt, Salmonella typhimurium LT2
gaccgcuuuagccaguagcuggu

SEQ ID NO: 3758147 - RNA, 20 nt, Salmonella typhimurium LT2
gaccggaacggggaaccagc

SEQ ID NO: 3758148 - RNA, 21 nt, Salmonella typhimurium LT2
gaccgggggcuggccacugga

SEQ ID NO: 3758149 - RNA, 19 nt, Salmonella typhimurium LT2
gaccgguaagcccauggca

SEQ ID NO: 3758150 - RNA, 20 nt, Salmonella typhimurium LT2
gaccguaguagguauccagc

SEQ ID NO: 3758151 - RNA, 14 nt, Salmonella typhimurium LT2
gaccguauccgcca

SEQ ID NO: 3758152 - RNA, 20 nt, Salmonella typhimurium LT2
gacggccugucuccgcagca

SEQ ID NO: 3758153 - RNA, 22 nt, Salmonella typhimurium LT2
gacggccuuuuucgcucuuauc

SEQ ID NO: 3758154 - RNA, 21 nt, Salmonella typhimurium LT2
gacggcggcugcgaugccauc

SEQ ID NO: 3758155 - RNA, 19 nt, Salmonella typhimurium LT2
gacggcguaagucgcgcau

SEQ ID NO: 3758156 - RNA, 17 nt, Salmonella typhimurium LT2
gacggcuccagcgccag

SEQ ID NO: 3758157 - RNA, 20 nt, Salmonella typhimurium LT2
gacgggaaaucucccuggca

SEQ ID NO: 3758158 - RNA, 21 nt, Salmonella typhimurium LT2
gacgggaaaucucccuggcag

SEQ ID NO: 3758159 - RNA, 22 nt, Salmonella typhimurium LT2
gacgggcaagguuaugcagcau

SEQ ID NO: 3758160 - RNA, 23 nt, Salmonella typhimurium LT2
gacgggggcgaucagcaggucag

SEQ ID NO: 3758161 - RNA, 15 nt, Salmonella typhimurium LT2
gacgggugauuucac

SEQ ID NO: 3758162 - RNA, 17 nt, Salmonella typhimurium LT2
gacgguaccugaagcca

SEQ ID NO: 3758163 - RNA, 21 nt, Salmonella typhimurium LT2
gacggucggguggagaucgac

SEQ ID NO: 3758164 - RNA, 16 nt, Salmonella typhimurium LT2
gacgguuguuuuucag

SEQ ID NO: 3758165 - RNA, 13 nt, Salmonella typhimurium LT2
gacgguuuucacu

SEQ ID NO: 3758166 - RNA, 21 nt, Salmonella typhimurium LT2
gacguaauaccgaaauccgcu

SEQ ID NO: 3758167 - RNA, 19 nt, Salmonella typhimurium LT2
gacguagggcugccaucag

SEQ ID NO: 3758168 - RNA, 19 nt, Salmonella typhimurium LT2
gacgucacugucagcauca

SEQ ID NO: 3758169 - RNA, 20 nt, Salmonella typhimurium LT2
gacgucacugucagcaucag

SEQ ID NO: 3758170 - RNA, 18 nt, Salmonella typhimurium LT2
gacguccgccaacagccg

SEQ ID NO: 3758171 - RNA, 18 nt, Salmonella typhimurium LT2
gacgucgccauauccaag

SEQ ID NO: 3758172 - RNA, 21 nt, Salmonella typhimurium LT2
gacgucgguaaucacgucauu

SEQ ID NO: 3758173 - RNA, 15 nt, Salmonella typhimurium LT2
gacgucgucaccacg

SEQ ID NO: 3758174 - RNA, 18 nt, Salmonella typhimurium LT2
gacgucuucguacugugg

SEQ ID NO: 3758175 - RNA, 19 nt, Salmonella typhimurium LT2
gacgucuuucuucgcugca

SEQ ID NO: 3758176 - RNA, 18 nt, Salmonella typhimurium LT2
gacgugccuuccaucggc

SEQ ID NO: 3758177 - RNA, 15 nt, Salmonella typhimurium LT2
gacgugggcuacggc

SEQ ID NO: 3758178 - RNA, 16 nt, Salmonella typhimurium LT2
gacguggggguucaag

SEQ ID NO: 3758179 - RNA, 20 nt, Salmonella typhimurium LT2
gacguggggguucaaguccc

SEQ ID NO: 3758180 - RNA, 22 nt, Salmonella typhimurium LT2
gacguggggguucaaguccccc

SEQ ID NO: 3758181 - RNA, 17 nt, Salmonella typhimurium LT2
gacguguuugaugacgu

SEQ ID NO: 3758182 - RNA, 15 nt, Salmonella typhimurium LT2
gacguuauuagccgg

SEQ ID NO: 3758183 - RNA, 19 nt, Salmonella typhimurium LT2
gacguucagcauauccagc

SEQ ID NO: 3758184 - RNA, 15 nt, Salmonella typhimurium LT2
gacguuccgcgacaa

SEQ ID NO: 3758185 - RNA, 15 nt, Salmonella typhimurium LT2
gacguucgacccgca

SEQ ID NO: 3758186 - RNA, 12 nt, Salmonella typhimurium LT2
gacguugaaaaa

SEQ ID NO: 3758187 - RNA, 19 nt, Salmonella typhimurium LT2
gacguugccgcccaccugc

SEQ ID NO: 3758188 - RNA, 20 nt, Salmonella typhimurium LT2
gacguuuacgccgccauccg

SEQ ID NO: 3758189 - RNA, 18 nt, Salmonella typhimurium LT2
gacguuuggcuuauccgc

SEQ ID NO: 3758190 - RNA, 15 nt, Salmonella typhimurium LT2
gacguuuuccucguu

SEQ ID NO: 3758191 - RNA, 22 nt, Salmonella typhimurium LT2
gacuaaaaagcgcguccccggu

SEQ ID NO: 3758192 - RNA, 18 nt, Salmonella typhimurium LT2
gacuaaccuugauucccu

SEQ ID NO: 3758193 - RNA, 19 nt, Salmonella typhimurium LT2
gacuacgguaaaccaggcc

SEQ ID NO: 3758194 - RNA, 16 nt, Salmonella typhimurium LT2
gacuacguucaucagg

SEQ ID NO: 3758195 - RNA, 13 nt, Salmonella typhimurium LT2
gacuacugaaaag

SEQ ID NO: 3758196 - RNA, 13 nt, Salmonella typhimurium LT2
gacuacuuaccgg

SEQ ID NO: 3758197 - RNA, 18 nt, Salmonella typhimurium LT2
gacuacuuaccggcgcca

SEQ ID NO: 3758198 - RNA, 14 nt, Salmonella typhimurium LT2
gacuaucgccgccc

SEQ ID NO: 3758199 - RNA, 18 nt, Salmonella typhimurium LT2
gacuauuccgcaaacgcc

SEQ ID NO: 3758200 - RNA, 19 nt, Salmonella typhimurium LT2
gacucaaaaagaggaaagc

SEQ ID NO: 3758201 - RNA, 23 nt, Salmonella typhimurium LT2
gacucaaaaagaggaaagcguaa

SEQ ID NO: 3758202 - RNA, 13 nt, Salmonella typhimurium LT2
gacucagccaggu

SEQ ID NO: 3758203 - RNA, 13 nt, Salmonella typhimurium LT2
gacucagggugac

SEQ ID NO: 3758204 - RNA, 16 nt, Salmonella typhimurium LT2
gacucauccagcaucg

SEQ ID NO: 3758205 - RNA, 17 nt, Salmonella typhimurium LT2
gacucaucgccgcaaug

SEQ ID NO: 3758206 - RNA, 19 nt, Salmonella typhimurium LT2
gacucaucgccgcaaugac

SEQ ID NO: 3758207 - RNA, 21 nt, Salmonella typhimurium LT2
gacucaucuuuuacaggccgg

SEQ ID NO: 3758208 - RNA, 19 nt, Salmonella typhimurium LT2
gacucaugcgccuucugcu

SEQ ID NO: 3758209 - RNA, 15 nt, Salmonella typhimurium LT2
gacucauuacgccac

SEQ ID NO: 3758210 - RNA, 20 nt, Salmonella typhimurium LT2
gacuccacggaaucacggca

SEQ ID NO: 3758211 - RNA, 22 nt, Salmonella typhimurium LT2
gacuccccacaaucccgccaga

SEQ ID NO: 3758212 - RNA, 23 nt, Salmonella typhimurium LT2
gacuccccacaaucccgccagac

SEQ ID NO: 3758213 - RNA, 13 nt, Salmonella typhimurium LT2
gacuccccugcag

SEQ ID NO: 3758214 - RNA, 14 nt, Salmonella typhimurium LT2
gacuccccugcaga

SEQ ID NO: 3758215 - RNA, 16 nt, Salmonella typhimurium LT2
gacuccucaaccgacg

SEQ ID NO: 3758216 - RNA, 19 nt, Salmonella typhimurium LT2
gacuccucaaccgacgcga

SEQ ID NO: 3758217 - RNA, 22 nt, Salmonella typhimurium LT2
gacucgaaccaacgacccccac

SEQ ID NO: 3758218 - RNA, 23 nt, Salmonella typhimurium LT2
gacucgaaccaacgacccccacc

SEQ ID NO: 3758219 - RNA, 15 nt, Salmonella typhimurium LT2
gacucguugggugag

SEQ ID NO: 3758220 - RNA, 21 nt, Salmonella typhimurium LT2
gacucuauagcggucaaaaua

SEQ ID NO: 3758221 - RNA, 15 nt, Salmonella typhimurium LT2
gacucucuuuaauca

SEQ ID NO: 3758222 - RNA, 13 nt, Salmonella typhimurium LT2
gacucugaagcgg

SEQ ID NO: 3758223 - RNA, 18 nt, Salmonella typhimurium LT2
gacucugaagcgggaaag

SEQ ID NO: 3758224 - RNA, 19 nt, Salmonella typhimurium LT2
gacucugaagcgggaaagc

SEQ ID NO: 3758225 - RNA, 18 nt, Salmonella typhimurium LT2
gacugaaaaucaaaaaca

SEQ ID NO: 3758226 - RNA, 19 nt, Salmonella typhimurium LT2
gacugaaaaucaaaaacau

SEQ ID NO: 3758227 - RNA, 14 nt, Salmonella typhimurium LT2
gacugauaccgcgu

SEQ ID NO: 3758228 - RNA, 14 nt, Salmonella typhimurium LT2
gacugauaggcuca

SEQ ID NO: 3758229 - RNA, 14 nt, Salmonella typhimurium LT2
gacugauauccauc

SEQ ID NO: 3758230 - RNA, 12 nt, Salmonella typhimurium LT2
gacugccaccac

SEQ ID NO: 3758231 - RNA, 20 nt, Salmonella typhimurium LT2
gacugccggcaaaaccaugc

SEQ ID NO: 3758232 - RNA, 20 nt, Salmonella typhimurium LT2
gacugccguauaauccagcu

SEQ ID NO: 3758233 - RNA, 19 nt, Salmonella typhimurium LT2
gacugccuaacuggaaaaa

SEQ ID NO: 3758234 - RNA, 13 nt, Salmonella typhimurium LT2
gacugcgcgcggu

SEQ ID NO: 3758235 - RNA, 13 nt, Salmonella typhimurium LT2
gacugcuuuuucu

SEQ ID NO: 3758236 - RNA, 23 nt, Salmonella typhimurium LT2
gacuggcccugccggaaaaugcg

SEQ ID NO: 3758237 - RNA, 21 nt, Salmonella typhimurium LT2
gacuggcgaccgccaccaucc

SEQ ID NO: 3758238 - RNA, 21 nt, Salmonella typhimurium LT2
gacuggcgccgucacguucgg

SEQ ID NO: 3758239 - RNA, 21 nt, Salmonella typhimurium LT2
gacuggcuaaacaauuugccc

SEQ ID NO: 3758240 - RNA, 13 nt, Salmonella typhimurium LT2
gacuguaaaucug

SEQ ID NO: 3758241 - RNA, 20 nt, Salmonella typhimurium LT2
gacuguagauaccuacuuua

SEQ ID NO: 3758242 - RNA, 14 nt, Salmonella typhimurium LT2
gacuguccacgaca

SEQ ID NO: 3758243 - RNA, 19 nt, Salmonella typhimurium LT2
gacugucgaaaccagcaua

SEQ ID NO: 3758244 - RNA, 18 nt, Salmonella typhimurium LT2
gacugucuuguuuuucug

SEQ ID NO: 3758245 - RNA, 14 nt, Salmonella typhimurium LT2
gacuguggaagaga

SEQ ID NO: 3758246 - RNA, 17 nt, Salmonella typhimurium LT2
gacuguucacauccagc

SEQ ID NO: 3758247 - RNA, 16 nt, Salmonella typhimurium LT2
gacuguucagcugaca

SEQ ID NO: 3758248 - RNA, 17 nt, Salmonella typhimurium LT2
gacuguucagcugacaa

SEQ ID NO: 3758249 - RNA, 12 nt, Salmonella typhimurium LT2
gacuguugaaag

SEQ ID NO: 3758250 - RNA, 23 nt, Salmonella typhimurium LT2
gacuguuucauuacucguccuuc

SEQ ID NO: 3758251 - RNA, 22 nt, Salmonella typhimurium LT2
gacuuaaaguacuucacaauca

SEQ ID NO: 3758252 - RNA, 17 nt, Salmonella typhimurium LT2
gacuuaaauggcgcugu

SEQ ID NO: 3758253 - RNA, 17 nt, Salmonella typhimurium LT2
gacuuacgcagcauuag

SEQ ID NO: 3758254 - RNA, 18 nt, Salmonella typhimurium LT2
gacuuaggaauacccagc

SEQ ID NO: 3758255 - RNA, 15 nt, Salmonella typhimurium LT2
gagcaguucagcagc

SEQ ID NO: 3758256 - RNA, 15 nt, Salmonella typhimurium LT2
gagcauaaaaaucau

SEQ ID NO: 3758257 - RNA, 16 nt, Salmonella typhimurium LT2
gagcauucuacaguuu

SEQ ID NO: 3758258 - RNA, 22 nt, Salmonella typhimurium LT2
gagccauaacaacuauuuuucc

SEQ ID NO: 3758259 - RNA, 19 nt, Salmonella typhimurium LT2
gagccauuaaugcaggcag

SEQ ID NO: 3758260 - RNA, 13 nt, Salmonella typhimurium LT2
gagcccaguagcc

SEQ ID NO: 3758261 - RNA, 23 nt, Salmonella typhimurium LT2
gagcccggauccaguuccaggac

SEQ ID NO: 3758262 - RNA, 23 nt, Salmonella typhimurium LT2
gagcccuaucaccauaaucgcga

SEQ ID NO: 3758263 - RNA, 14 nt, Salmonella typhimurium LT2
gagccgccauccgg

SEQ ID NO: 3758264 - RNA, 17 nt, Salmonella typhimurium LT2
gagccgccauccggcag

SEQ ID NO: 3758265 - RNA, 15 nt, Salmonella typhimurium LT2
gagccgcgcagcgca

SEQ ID NO: 3758266 - RNA, 14 nt, Salmonella typhimurium LT2
gagccgucgccggc

SEQ ID NO: 3758267 - RNA, 17 nt, Salmonella typhimurium LT2
gagccgucgcuaucaau

SEQ ID NO: 3758268 - RNA, 21 nt, Salmonella typhimurium LT2
gagccuaaaacauuaaucgcc

SEQ ID NO: 3758269 - RNA, 17 nt, Salmonella typhimurium LT2
gagccuguuccagcugc

SEQ ID NO: 3758270 - RNA, 13 nt, Salmonella typhimurium LT2
gagcgacaaaucu

SEQ ID NO: 3758271 - RNA, 15 nt, Salmonella typhimurium LT2
gagcgacgcccugcc

SEQ ID NO: 3758272 - RNA, 20 nt, Salmonella typhimurium LT2
gagcgauaaacucagcgcca

SEQ ID NO: 3758273 - RNA, 17 nt, Salmonella typhimurium LT2
gagcgauagagaguucc

SEQ ID NO: 3758274 - RNA, 15 nt, Salmonella typhimurium LT2
gagcgaugcugcuuc

SEQ ID NO: 3758275 - RNA, 13 nt, Salmonella typhimurium LT2
gagcgcaaacauc

SEQ ID NO: 3758276 - RNA, 23 nt, Salmonella typhimurium LT2
gagcgcaaucaagcucaccacca

SEQ ID NO: 3758277 - RNA, 21 nt, Salmonella typhimurium LT2
gagcgcaucaaauacgcgcgc

SEQ ID NO: 3758278 - RNA, 14 nt, Salmonella typhimurium LT2
gagcgcauccggca

SEQ ID NO: 3758279 - RNA, 17 nt, Salmonella typhimurium LT2
gagcgccagcaacagcg

SEQ ID NO: 3758280 - RNA, 22 nt, Salmonella typhimurium LT2
gagcgccgcgccuaccagcgcu

SEQ ID NO: 3758281 - RNA, 19 nt, Salmonella typhimurium LT2
gagcgccuuaucgacggcg

SEQ ID NO: 3758282 - RNA, 15 nt, Salmonella typhimurium LT2
gagcgcgaaaucaaa

SEQ ID NO: 3758283 - RNA, 14 nt, Salmonella typhimurium LT2
gagcgcgcucugcc

SEQ ID NO: 3758284 - RNA, 17 nt, Salmonella typhimurium LT2
gagcgcgcucugccuuu

SEQ ID NO: 3758285 - RNA, 17 nt, Salmonella typhimurium LT2
gagcgcggaggggcgau

SEQ ID NO: 3758286 - RNA, 22 nt, Salmonella typhimurium LT2
gagcgcgucagcgccuccgcgu

SEQ ID NO: 3758287 - RNA, 13 nt, Salmonella typhimurium LT2
gagcgcguccaga

SEQ ID NO: 3758288 - RNA, 17 nt, Salmonella typhimurium LT2
gagcgcguccagacguu

SEQ ID NO: 3758289 - RNA, 19 nt, Salmonella typhimurium LT2
gagcgcuugauccaguucg

SEQ ID NO: 3758290 - RNA, 13 nt, Salmonella typhimurium LT2
gagcgcuugcugc

SEQ ID NO: 3758291 - RNA, 23 nt, Salmonella typhimurium LT2
gagcggcaaugagcggccagcgg

SEQ ID NO: 3758292 - RNA, 20 nt, Salmonella typhimurium LT2
gagcggcauguaaagcgcca

SEQ ID NO: 3758293 - RNA, 22 nt, Salmonella typhimurium LT2
gagcggcgacuagucgcccgcu

SEQ ID NO: 3758294 - RNA, 18 nt, Salmonella typhimurium LT2
gagcggcucauccagcaa

SEQ ID NO: 3758295 - RNA, 16 nt, Salmonella typhimurium LT2
gagcgggccgucaggc

SEQ ID NO: 3758296 - RNA, 20 nt, Salmonella typhimurium LT2
gagcgggccguggccaggaa

SEQ ID NO: 3758297 - RNA, 15 nt, Salmonella typhimurium LT2
gagcggucaggccag

SEQ ID NO: 3758298 - RNA, 15 nt, Salmonella typhimurium LT2
gagcguauccagcac

SEQ ID NO: 3758299 - RNA, 18 nt, Salmonella typhimurium LT2
gagcgucuuuuaucccca

SEQ ID NO: 3758300 - RNA, 15 nt, Salmonella typhimurium LT2
gagcgugacgaccgg

SEQ ID NO: 3758301 - RNA, 19 nt, Salmonella typhimurium LT2
gagcguggaaaacagcgcc

SEQ ID NO: 3758302 - RNA, 20 nt, Salmonella typhimurium LT2
gagcguguccucugcugcga

SEQ ID NO: 3758303 - RNA, 20 nt, Salmonella typhimurium LT2
gagcguuacgggaacagaau

SEQ ID NO: 3758304 - RNA, 13 nt, Salmonella typhimurium LT2
gagcguucaaaau

SEQ ID NO: 3758305 - RNA, 15 nt, Salmonella typhimurium LT2
gagcguucaaaauca

SEQ ID NO: 3758306 - RNA, 17 nt, Salmonella typhimurium LT2
gagcguucaaaaucaaa

SEQ ID NO: 3758307 - RNA, 19 nt, Salmonella typhimurium LT2
gagcuauccggcaacauga

SEQ ID NO: 3758308 - RNA, 20 nt, Salmonella typhimurium LT2
gagcucaaaaaagccaugcc

SEQ ID NO: 3758309 - RNA, 21 nt, Salmonella typhimurium LT2
gagcugacggagcaaaucguc

SEQ ID NO: 3758310 - RNA, 15 nt, Salmonella typhimurium LT2
gagcugacggggcgc

SEQ ID NO: 3758311 - RNA, 23 nt, Salmonella typhimurium LT2
gagcugccaguucauuccgcccu

SEQ ID NO: 3758312 - RNA, 19 nt, Salmonella typhimurium LT2
gagcugcgcuuuuucauca

SEQ ID NO: 3758313 - RNA, 22 nt, Salmonella typhimurium LT2
gagcugcgcuuuuucaucaucu

SEQ ID NO: 3758314 - RNA, 12 nt, Salmonella typhimurium LT2
gagcugcugcuu

SEQ ID NO: 3758315 - RNA, 13 nt, Salmonella typhimurium LT2
gagcuggcggcgg

SEQ ID NO: 3758316 - RNA, 15 nt, Salmonella typhimurium LT2
gagcuggcggcggau

SEQ ID NO: 3758317 - RNA, 18 nt, Salmonella typhimurium LT2
gagcuguagcgaagggua

SEQ ID NO: 3758318 - RNA, 21 nt, Salmonella typhimurium LT2
gagcugugguucguucaacgu

SEQ ID NO: 3758319 - RNA, 18 nt, Salmonella typhimurium LT2
gagcuucuuggcgauuuc

SEQ ID NO: 3758320 - RNA, 21 nt, Salmonella typhimurium LT2
gaggaaaaaccgccucaauug

SEQ ID NO: 3758321 - RNA, 18 nt, Salmonella typhimurium LT2
gaggaaaaagccgccgug

SEQ ID NO: 3758322 - RNA, 19 nt, Salmonella typhimurium LT2
gaggaaauucuggcgcagc

SEQ ID NO: 3758323 - RNA, 20 nt, Salmonella typhimurium LT2
gaggaagcugcgcagcacuu

SEQ ID NO: 3758324 - RNA, 17 nt, Salmonella typhimurium LT2
gaggaauuguccacccu

SEQ ID NO: 3758325 - RNA, 18 nt, Salmonella typhimurium LT2
gaggacccguggcugcgc

SEQ ID NO: 3758326 - RNA, 17 nt, Salmonella typhimurium LT2
gaggagcgcggcggcgc

SEQ ID NO: 3758327 - RNA, 21 nt, Salmonella typhimurium LT2
gaggagcgcggcggcgcggag

SEQ ID NO: 3758328 - RNA, 23 nt, Salmonella typhimurium LT2
gaggauacggucgacaccagcga

SEQ ID NO: 3758329 - RNA, 21 nt, Salmonella typhimurium LT2
gaggauagugauauagcgcca

SEQ ID NO: 3758330 - RNA, 22 nt, Salmonella typhimurium LT2
gaggauagugauauagcgccau

SEQ ID NO: 3758331 - RNA, 14 nt, Salmonella typhimurium LT2
gaggaucaguaaca

SEQ ID NO: 3758332 - RNA, 15 nt, Salmonella typhimurium LT2
gaggaugccugcgca

SEQ ID NO: 3758333 - RNA, 16 nt, Salmonella typhimurium LT2
gaggaugcuccgccag

SEQ ID NO: 3758334 - RNA, 16 nt, Salmonella typhimurium LT2
gaggauggcgcggcaa

SEQ ID NO: 3758335 - RNA, 15 nt, Salmonella typhimurium LT2
gaggauuuucgcguc

SEQ ID NO: 3758336 - RNA, 23 nt, Salmonella typhimurium LT2
gaggauuuucgcgucggacaggg

SEQ ID NO: 3758337 - RNA, 20 nt, Salmonella typhimurium LT2
gaggcaaaaugccagcccga

SEQ ID NO: 3758338 - RNA, 21 nt, Salmonella typhimurium LT2
gaggcacgguauuaacggcga

SEQ ID NO: 3758339 - RNA, 12 nt, Salmonella typhimurium LT2
gaggcagcagga

SEQ ID NO: 3758340 - RNA, 21 nt, Salmonella typhimurium LT2
gaggcaggggcucuaaaaagg

SEQ ID NO: 3758341 - RNA, 23 nt, Salmonella typhimurium LT2
gaggcaggggcucuaaaaaggaa

SEQ ID NO: 3758342 - RNA, 18 nt, Salmonella typhimurium LT2
gaggcauccagaaugcgu

SEQ ID NO: 3758343 - RNA, 15 nt, Salmonella typhimurium LT2
gaggccaccagcgcc

SEQ ID NO: 3758344 - RNA, 23 nt, Salmonella typhimurium LT2
gaggccguuauugucaugcuaaa

SEQ ID NO: 3758345 - RNA, 15 nt, Salmonella typhimurium LT2
gaggccucuccucga

SEQ ID NO: 3758346 - RNA, 14 nt, Salmonella typhimurium LT2
gaggccuuuugcag

SEQ ID NO: 3758347 - RNA, 20 nt, Salmonella typhimurium LT2
gaggcgauagcgaacggcga

SEQ ID NO: 3758348 - RNA, 16 nt, Salmonella typhimurium LT2
gaggcgcagccgccau

SEQ ID NO: 3758349 - RNA, 15 nt, Salmonella typhimurium LT2
gaggcgcccaacgcu

SEQ ID NO: 3758350 - RNA, 21 nt, Salmonella typhimurium LT2
gaggcguagccgaaacccaac

SEQ ID NO: 3758351 - RNA, 15 nt, Salmonella typhimurium LT2
gaggcuacccagaca

SEQ ID NO: 3758352 - RNA, 16 nt, Salmonella typhimurium LT2
gaggcuuaauacagca

SEQ ID NO: 3758353 - RNA, 14 nt, Salmonella typhimurium LT2
gaggcuuuacgaug

SEQ ID NO: 3758354 - RNA, 21 nt, Salmonella typhimurium LT2
gaggcuuuacgaugagcaaag

SEQ ID NO: 3758355 - RNA, 20 nt, Salmonella typhimurium LT2
gagggugaaccaaagcaaaa

SEQ ID NO: 3758356 - RNA, 16 nt, Salmonella typhimurium LT2
gaggguggcaccgcgc

SEQ ID NO: 3758357 - RNA, 22 nt, Salmonella typhimurium LT2
gaggguguucaugcgacugccc

SEQ ID NO: 3758358 - RNA, 20 nt, Salmonella typhimurium LT2
gauaagccggauaagcguag

SEQ ID NO: 3758359 - RNA, 12 nt, Salmonella typhimurium LT2
gauaagccuccg

SEQ ID NO: 3758360 - RNA, 20 nt, Salmonella typhimurium LT2
gauaagcgaagcgucauccg

SEQ ID NO: 3758361 - RNA, 20 nt, Salmonella typhimurium LT2
gauaagcgcagcgccaucag

SEQ ID NO: 3758362 - RNA, 21 nt, Salmonella typhimurium LT2
gauaagcgcagcgccaucagg

SEQ ID NO: 3758363 - RNA, 18 nt, Salmonella typhimurium LT2
gauaagcgccacgucggc

SEQ ID NO: 3758364 - RNA, 19 nt, Salmonella typhimurium LT2
gauaagcguagcgcauccg

SEQ ID NO: 3758365 - RNA, 17 nt, Salmonella typhimurium LT2
gauaagcguagcgccau

SEQ ID NO: 3758366 - RNA, 21 nt, Salmonella typhimurium LT2
gauaagcguagcgccaucagg

SEQ ID NO: 3758367 - RNA, 23 nt, Salmonella typhimurium LT2
gauaagcguagcgccaucaggcu

SEQ ID NO: 3758368 - RNA, 20 nt, Salmonella typhimurium LT2
gauaagcguagcgccauccg

SEQ ID NO: 3758369 - RNA, 15 nt, Salmonella typhimurium LT2
gauaagcgucgccag

SEQ ID NO: 3758370 - RNA, 17 nt, Salmonella typhimurium LT2
gauaagcguuagcgcca

SEQ ID NO: 3758371 - RNA, 23 nt, Salmonella typhimurium LT2
gauaagcguuguaguuucagccc

SEQ ID NO: 3758372 - RNA, 22 nt, Salmonella typhimurium LT2
gauaagcugggcgucaacguga

SEQ ID NO: 3758373 - RNA, 15 nt, Salmonella typhimurium LT2
gauaagcuuacgcca

SEQ ID NO: 3758374 - RNA, 19 nt, Salmonella typhimurium LT2
gauaaggcguaacacguua

SEQ ID NO: 3758375 - RNA, 22 nt, Salmonella typhimurium LT2
gauaaggcguaaccgccauccg

SEQ ID NO: 3758376 - RNA, 16 nt, Salmonella typhimurium LT2
gauaaggcgugagcca

SEQ ID NO: 3758377 - RNA, 19 nt, Salmonella typhimurium LT2
gauaaggucgcuauccagc

SEQ ID NO: 3758378 - RNA, 23 nt, Salmonella typhimurium LT2
gauaagucccggaccgauugacu

SEQ ID NO: 3758379 - RNA, 21 nt, Salmonella typhimurium LT2
gauaauaaaauauuauuuuuu

SEQ ID NO: 3758380 - RNA, 17 nt, Salmonella typhimurium LT2
gauaauacauugccgca

SEQ ID NO: 3758381 - RNA, 15 nt, Salmonella typhimurium LT2
gauaauacguacgga

SEQ ID NO: 3758382 - RNA, 17 nt, Salmonella typhimurium LT2
gauaauagccucauccc

SEQ ID NO: 3758383 - RNA, 14 nt, Salmonella typhimurium LT2
gauaauagcugcgg

SEQ ID NO: 3758384 - RNA, 13 nt, Salmonella typhimurium LT2
gauaaucaccagc

SEQ ID NO: 3758385 - RNA, 14 nt, Salmonella typhimurium LT2
gauaaucagcagcg

SEQ ID NO: 3758386 - RNA, 15 nt, Salmonella typhimurium LT2
gauaaucagcagcga

SEQ ID NO: 3758387 - RNA, 16 nt, Salmonella typhimurium LT2
gauaaucagcagcgac

SEQ ID NO: 3758388 - RNA, 23 nt, Salmonella typhimurium LT2
gauaaucagcagcgacguaauga

SEQ ID NO: 3758389 - RNA, 11 nt, Salmonella typhimurium LT2
gauaauccaga

SEQ ID NO: 3758390 - RNA, 14 nt, Salmonella typhimurium LT2
gauaauccagccac

SEQ ID NO: 3758391 - RNA, 19 nt, Salmonella typhimurium LT2
gauaaugacgaucaacaga

SEQ ID NO: 3758392 - RNA, 16 nt, Salmonella typhimurium LT2
gauaaugcgcugcaca

SEQ ID NO: 3758393 - RNA, 16 nt, Salmonella typhimurium LT2
gauaaugcuuucgcca

SEQ ID NO: 3758394 - RNA, 13 nt, Salmonella typhimurium LT2
gauaauuuaucca

SEQ ID NO: 3758395 - RNA, 17 nt, Salmonella typhimurium LT2
gauaauuuuucagacgu

SEQ ID NO: 3758396 - RNA, 23 nt, Salmonella typhimurium LT2
gauacaaagccgaccgccagguc

SEQ ID NO: 3758397 - RNA, 18 nt, Salmonella typhimurium LT2
gauacaagguauccgcca

SEQ ID NO: 3758398 - RNA, 15 nt, Salmonella typhimurium LT2
gauacagaaaaccgg

SEQ ID NO: 3758399 - RNA, 15 nt, Salmonella typhimurium LT2
gauacagccaaauca

SEQ ID NO: 3758400 - RNA, 20 nt, Salmonella typhimurium LT2
gauacagccgacuauuccgc

SEQ ID NO: 3758401 - RNA, 17 nt, Salmonella typhimurium LT2
gauacaggacugacugc

SEQ ID NO: 3758402 - RNA, 21 nt, Salmonella typhimurium LT2
gauacaggacugacugcuguc

SEQ ID NO: 3758403 - RNA, 18 nt, Salmonella typhimurium LT2
gauacaggcgcuguacgc

SEQ ID NO: 3758404 - RNA, 14 nt, Salmonella typhimurium LT2
gauacaguucgaca

SEQ ID NO: 3758405 - RNA, 22 nt, Salmonella typhimurium LT2
gauacauauuucgaucggccag

SEQ ID NO: 3758406 - RNA, 13 nt, Salmonella typhimurium LT2
gauacauuuuuug

SEQ ID NO: 3758407 - RNA, 14 nt, Salmonella typhimurium LT2
gauaccaaauuacg

SEQ ID NO: 3758408 - RNA, 18 nt, Salmonella typhimurium LT2
gauaccaauucccagacc

SEQ ID NO: 3758409 - RNA, 19 nt, Salmonella typhimurium LT2
gauaccaauucccagaccc

SEQ ID NO: 3758410 - RNA, 18 nt, Salmonella typhimurium LT2
gauaccagccaacaguau

SEQ ID NO: 3758411 - RNA, 22 nt, Salmonella typhimurium LT2
gauaccagggcgaugcccccag

SEQ ID NO: 3758412 - RNA, 12 nt, Salmonella typhimurium LT2
gauaccaguaau

SEQ ID NO: 3758413 - RNA, 15 nt, Salmonella typhimurium LT2
gauacccaccagcgu

SEQ ID NO: 3758414 - RNA, 20 nt, Salmonella typhimurium LT2
gauacccagcgucccggcgu

SEQ ID NO: 3758415 - RNA, 18 nt, Salmonella typhimurium LT2
gauaccccgccaaaccgg

SEQ ID NO: 3758416 - RNA, 14 nt, Salmonella typhimurium LT2
gauaccgaagacgg

SEQ ID NO: 3758417 - RNA, 14 nt, Salmonella typhimurium LT2
gauaccgccagccc

SEQ ID NO: 3758418 - RNA, 15 nt, Salmonella typhimurium LT2
gauaccggauugcuc

SEQ ID NO: 3758419 - RNA, 18 nt, Salmonella typhimurium LT2
gauaccgucuuccuucca

SEQ ID NO: 3758420 - RNA, 24 nt, Salmonella typhimurium LT2
gauaccuaucggaagaaaacgcaa

SEQ ID NO: 3758421 - RNA, 20 nt, Salmonella typhimurium LT2
gauacgcgucaaagcacaug

SEQ ID NO: 3758422 - RNA, 16 nt, Salmonella typhimurium LT2
gauacgcuggcacagg

SEQ ID NO: 3758423 - RNA, 20 nt, Salmonella typhimurium LT2
gauacgcuucggcuccagcg

SEQ ID NO: 3758424 - RNA, 22 nt, Salmonella typhimurium LT2
gauacgcuucggcuccagcgcc

SEQ ID NO: 3758425 - RNA, 21 nt, Salmonella typhimurium LT2
gauacggcguuggcugcucuu

SEQ ID NO: 3758426 - RNA, 18 nt, Salmonella typhimurium LT2
gauacgucauaucaucca

SEQ ID NO: 3758427 - RNA, 20 nt, Salmonella typhimurium LT2
gauacgucauaucauccagc

SEQ ID NO: 3758428 - RNA, 17 nt, Salmonella typhimurium LT2
gauacgucuuacgccau

SEQ ID NO: 3758429 - RNA, 17 nt, Salmonella typhimurium LT2
gauacguucaucuuccu

SEQ ID NO: 3758430 - RNA, 13 nt, Salmonella typhimurium LT2
gauacguuccagc

SEQ ID NO: 3758431 - RNA, 14 nt, Salmonella typhimurium LT2
gauacguuccagca

SEQ ID NO: 3758432 - RNA, 19 nt, Salmonella typhimurium LT2
gauacguuccagcagcgca

SEQ ID NO: 3758433 - RNA, 17 nt, Salmonella typhimurium LT2
gauacguuugaaaugaa

SEQ ID NO: 3758434 - RNA, 14 nt, Salmonella typhimurium LT2
gauacuauaacgcu

SEQ ID NO: 3758435 - RNA, 18 nt, Salmonella typhimurium LT2
gauacucagccccaggcc

SEQ ID NO: 3758436 - RNA, 20 nt, Salmonella typhimurium LT2
gauacuccauugucggcagc

SEQ ID NO: 3758437 - RNA, 21 nt, Salmonella typhimurium LT2
gauacugcaaccgacgaacaa

SEQ ID NO: 3758438 - RNA, 12 nt, Salmonella typhimurium LT2
gauacugcaacg

SEQ ID NO: 3758439 - RNA, 18 nt, Salmonella typhimurium LT2
gauacugcgaucgccggc

SEQ ID NO: 3758440 - RNA, 22 nt, Salmonella typhimurium LT2
gauacuuauuacgguaucagcg

SEQ ID NO: 3758441 - RNA, 23 nt, Salmonella typhimurium LT2
gauagaccacgccaucaacagcg

SEQ ID NO: 3758442 - RNA, 19 nt, Salmonella typhimurium LT2
gauagacggcugaauguuc

SEQ ID NO: 3758443 - RNA, 15 nt, Salmonella typhimurium LT2
gauagagacugccgc

SEQ ID NO: 3758444 - RNA, 18 nt, Salmonella typhimurium LT2
gauagagacugccgccgu

SEQ ID NO: 3758445 - RNA, 19 nt, Salmonella typhimurium LT2
gauagagaguuccuccugg

SEQ ID NO: 3758446 - RNA, 21 nt, Salmonella typhimurium LT2
gauagagcgcggucagguuca

SEQ ID NO: 3758447 - RNA, 16 nt, Salmonella typhimurium LT2
gauagaggguugauaa

SEQ ID NO: 3758448 - RNA, 16 nt, Salmonella typhimurium LT2
gauagagguuaccggg

SEQ ID NO: 3758449 - RNA, 14 nt, Salmonella typhimurium LT2
gauagcaucuuccu

SEQ ID NO: 3758450 - RNA, 18 nt, Salmonella typhimurium LT2
gauagccaccggcagcgu

SEQ ID NO: 3758451 - RNA, 17 nt, Salmonella typhimurium LT2
gauagccauuucugccu

SEQ ID NO: 3758452 - RNA, 18 nt, Salmonella typhimurium LT2
gauagccauuucugccug

SEQ ID NO: 3758453 - RNA, 18 nt, Salmonella typhimurium LT2
gauagcccugaucccaca

SEQ ID NO: 3758454 - RNA, 12 nt, Salmonella typhimurium LT2
gauagccgccag

SEQ ID NO: 3758455 - RNA, 15 nt, Salmonella typhimurium LT2
gauagccguaaauaa

SEQ ID NO: 3758456 - RNA, 17 nt, Salmonella typhimurium LT2
gauagccguaaauaauc

SEQ ID NO: 3758457 - RNA, 17 nt, Salmonella typhimurium LT2
gauagccugccagcacc

SEQ ID NO: 3758458 - RNA, 22 nt, Salmonella typhimurium LT2
gauagccugccagcaccagcag

SEQ ID NO: 3758459 - RNA, 13 nt, Salmonella typhimurium LT2
gauagccuuccac

SEQ ID NO: 3758460 - RNA, 17 nt, Salmonella typhimurium LT2
gauagcgaucagcgcca

SEQ ID NO: 3758461 - RNA, 14 nt, Salmonella typhimurium LT2
gauagcgauuuuug

SEQ ID NO: 3758462 - RNA, 18 nt, Salmonella typhimurium LT2
gauccggcuguuccagua

SEQ ID NO: 3758463 - RNA, 17 nt, Salmonella typhimurium LT2
gauccguagacgguaac

SEQ ID NO: 3758464 - RNA, 14 nt, Salmonella typhimurium LT2
gauccguuucagaa

SEQ ID NO: 3758465 - RNA, 18 nt, Salmonella typhimurium LT2
gauccucauaaauagcca

SEQ ID NO: 3758466 - RNA, 16 nt, Salmonella typhimurium LT2
gauccuccugcagacu

SEQ ID NO: 3758467 - RNA, 20 nt, Salmonella typhimurium LT2
gauccugagaaaucaacgug

SEQ ID NO: 3758468 - RNA, 16 nt, Salmonella typhimurium LT2
gauccugcaacagcac

SEQ ID NO: 3758469 - RNA, 18 nt, Salmonella typhimurium LT2
gauccugcggcauuagca

SEQ ID NO: 3758470 - RNA, 22 nt, Salmonella typhimurium LT2
gauccuguaacgcauaagcgcg

SEQ ID NO: 3758471 - RNA, 19 nt, Salmonella typhimurium LT2
gauccuguucaaacaucag

SEQ ID NO: 3758472 - RNA, 18 nt, Salmonella typhimurium LT2
gaucgacaaaccacugcu

SEQ ID NO: 3758473 - RNA, 19 nt, Salmonella typhimurium LT2
gaucgacaaaccacugcug

SEQ ID NO: 3758474 - RNA, 13 nt, Salmonella typhimurium LT2
gaucgacaaugau

SEQ ID NO: 3758475 - RNA, 14 nt, Salmonella typhimurium LT2
gaucgacggcaaca

SEQ ID NO: 3758476 - RNA, 14 nt, Salmonella typhimurium LT2
gaucgaggcgcugg

SEQ ID NO: 3758477 - RNA, 16 nt, Salmonella typhimurium LT2
gaucgaggcgcuggcg

SEQ ID NO: 3758478 - RNA, 18 nt, Salmonella typhimurium LT2
gaucgaggcgcuggcgag

SEQ ID NO: 3758479 - RNA, 14 nt, Salmonella typhimurium LT2
gaucgaggucagca

SEQ ID NO: 3758480 - RNA, 20 nt, Salmonella typhimurium LT2
gaucgauagcgacggcgcgc

SEQ ID NO: 3758481 - RNA, 17 nt, Salmonella typhimurium LT2
gaucgccauccugcacc

SEQ ID NO: 3758482 - RNA, 17 nt, Salmonella typhimurium LT2
gaucgccaucgacagca

SEQ ID NO: 3758483 - RNA, 20 nt, Salmonella typhimurium LT2
gaucgccaucgacagcagcg

SEQ ID NO: 3758484 - RNA, 19 nt, Salmonella typhimurium LT2
gaucgccauucggauaauc

SEQ ID NO: 3758485 - RNA, 20 nt, Salmonella typhimurium LT2
gaucgcccgguugcaauucc

SEQ ID NO: 3758486 - RNA, 18 nt, Salmonella typhimurium LT2
gaucgccgacgaccggcg

SEQ ID NO: 3758487 - RNA, 14 nt, Salmonella typhimurium LT2
gaucgccgccaucg

SEQ ID NO: 3758488 - RNA, 23 nt, Salmonella typhimurium LT2
gaucgccgcugcgagcagcgaaa

SEQ ID NO: 3758489 - RNA, 14 nt, Salmonella typhimurium LT2
gaucgccuggccga

SEQ ID NO: 3758490 - RNA, 21 nt, Salmonella typhimurium LT2
gaucgccuucgccuuccagug

SEQ ID NO: 3758491 - RNA, 14 nt, Salmonella typhimurium LT2
gaucgcgccagccu

SEQ ID NO: 3758492 - RNA, 12 nt, Salmonella typhimurium LT2
gaucgcgggcaa

SEQ ID NO: 3758493 - RNA, 20 nt, Salmonella typhimurium LT2
gaucgcugagcgccaucagg

SEQ ID NO: 3758494 - RNA, 21 nt, Salmonella typhimurium LT2
gaucgcuuaacaacuccagca

SEQ ID NO: 3758495 - RNA, 22 nt, Salmonella typhimurium LT2
gaucgcuuaacaacuccagcaa

SEQ ID NO: 3758496 - RNA, 18 nt, Salmonella typhimurium LT2
gaucggaagacuggcgca

SEQ ID NO: 3758497 - RNA, 22 nt, Salmonella typhimurium LT2
gaucggagggggaggcaggcaa

SEQ ID NO: 3758498 - RNA, 23 nt, Salmonella typhimurium LT2
gaucggagggggaggcaggcaac

SEQ ID NO: 3758499 - RNA, 22 nt, Salmonella typhimurium LT2
gaucggcaaaagugugauaagc

SEQ ID NO: 3758500 - RNA, 14 nt, Salmonella typhimurium LT2
gaucggccagcaag

SEQ ID NO: 3758501 - RNA, 18 nt, Salmonella typhimurium LT2
gaucggcguuuccaugga

SEQ ID NO: 3758502 - RNA, 17 nt, Salmonella typhimurium LT2
gaucggggcgaccggcu

SEQ ID NO: 3758503 - RNA, 17 nt, Salmonella typhimurium LT2
gaucguaaucacccgcu

SEQ ID NO: 3758504 - RNA, 15 nt, Salmonella typhimurium LT2
gaucguaggcggcgg

SEQ ID NO: 3758505 - RNA, 16 nt, Salmonella typhimurium LT2
gaucguaggcggcgga

SEQ ID NO: 3758506 - RNA, 20 nt, Salmonella typhimurium LT2
gaucgucauauguugcgcuu

SEQ ID NO: 3758507 - RNA, 14 nt, Salmonella typhimurium LT2
gaucguccggcgau

SEQ ID NO: 3758508 - RNA, 18 nt, Salmonella typhimurium LT2
gaucgucggucgcguagc

SEQ ID NO: 3758509 - RNA, 21 nt, Salmonella typhimurium LT2
gaucgucuccuguaacagggg

SEQ ID NO: 3758510 - RNA, 15 nt, Salmonella typhimurium LT2
gaucgugccguccgg

SEQ ID NO: 3758511 - RNA, 14 nt, Salmonella typhimurium LT2
gaucguuuccagca

SEQ ID NO: 3758512 - RNA, 15 nt, Salmonella typhimurium LT2
gaucuaaaaauuaca

SEQ ID NO: 3758513 - RNA, 14 nt, Salmonella typhimurium LT2
gaucuauauauucu

SEQ ID NO: 3758514 - RNA, 17 nt, Salmonella typhimurium LT2
gaucuauauauucuucu

SEQ ID NO: 3758515 - RNA, 15 nt, Salmonella typhimurium LT2
gaucucauaaacgcc

SEQ ID NO: 3758516 - RNA, 23 nt, Salmonella typhimurium LT2
gaucucauaaacgccuggaguga

SEQ ID NO: 3758517 - RNA, 12 nt, Salmonella typhimurium LT2
gaucucucccug

SEQ ID NO: 3758518 - RNA, 14 nt, Salmonella typhimurium LT2
gaucugcgccgccg

SEQ ID NO: 3758519 - RNA, 15 nt, Salmonella typhimurium LT2
gaucugcgccgccgg

SEQ ID NO: 3758520 - RNA, 16 nt, Salmonella typhimurium LT2
gaucuggacgccaauu

SEQ ID NO: 3758521 - RNA, 12 nt, Salmonella typhimurium LT2
gaucuucauccc

SEQ ID NO: 3758522 - RNA, 17 nt, Salmonella typhimurium LT2
gaucuucaucccauccg

SEQ ID NO: 3758523 - RNA, 19 nt, Salmonella typhimurium LT2
gaucuucuuuaaccgcgcc

SEQ ID NO: 3758524 - RNA, 19 nt, Salmonella typhimurium LT2
gaucuugucacaauaacgc

SEQ ID NO: 3758525 - RNA, 12 nt, Salmonella typhimurium LT2
gaucuuuauaaa

SEQ ID NO: 3758526 - RNA, 15 nt, Salmonella typhimurium LT2
gaucuuuccuuuuuc

SEQ ID NO: 3758527 - RNA, 21 nt, Salmonella typhimurium LT2
gaucuuuccuuuuucaggcac

SEQ ID NO: 3758528 - RNA, 13 nt, Salmonella typhimurium LT2
gaucuuugccgcg

SEQ ID NO: 3758529 - RNA, 23 nt, Salmonella typhimurium LT2
gaucuuugccgcgcggauucucc

SEQ ID NO: 3758530 - RNA, 15 nt, Salmonella typhimurium LT2
gaucuuuuucagcac

SEQ ID NO: 3758531 - RNA, 11 nt, Salmonella typhimurium LT2
gaugaaaaaga

SEQ ID NO: 3758532 - RNA, 13 nt, Salmonella typhimurium LT2
gaugaaaaagagg

SEQ ID NO: 3758533 - RNA, 22 nt, Salmonella typhimurium LT2
gaugaaacaguccggcgaaaaa

SEQ ID NO: 3758534 - RNA, 21 nt, Salmonella typhimurium LT2
gaugaaacgacacaggccuga

SEQ ID NO: 3758535 - RNA, 12 nt, Salmonella typhimurium LT2
gaugaacaggcg

SEQ ID NO: 3758536 - RNA, 20 nt, Salmonella typhimurium LT2
gaugaaccauaucaaacagg

SEQ ID NO: 3758537 - RNA, 22 nt, Salmonella typhimurium LT2
gaugaacgaugcugauuugcca

SEQ ID NO: 3758538 - RNA, 14 nt, Salmonella typhimurium LT2
gaugaagcuacagg

SEQ ID NO: 3758539 - RNA, 14 nt, Salmonella typhimurium LT2
gaugacacuaucuc

SEQ ID NO: 3758540 - RNA, 17 nt, Salmonella typhimurium LT2
gaugacacuaucuccuu

SEQ ID NO: 3758541 - RNA, 19 nt, Salmonella typhimurium LT2
gaugacccccagauagccc

SEQ ID NO: 3758542 - RNA, 18 nt, Salmonella typhimurium LT2
gaugacccgcaauauuaa

SEQ ID NO: 3758543 - RNA, 19 nt, Salmonella typhimurium LT2
gaugaccggcuauccaugc

SEQ ID NO: 3758544 - RNA, 21 nt, Salmonella typhimurium LT2
gaugaccggcuauccaugcgu

SEQ ID NO: 3758545 - RNA, 21 nt, Salmonella typhimurium LT2
gaugacgccgcuuauagcggc

SEQ ID NO: 3758546 - RNA, 14 nt, Salmonella typhimurium LT2
gaugacgcuccuga

SEQ ID NO: 3758547 - RNA, 17 nt, Salmonella typhimurium LT2
gaugacgcuccugaauc

SEQ ID NO: 3758548 - RNA, 20 nt, Salmonella typhimurium LT2
gaugacgcugcgcuuauccg

SEQ ID NO: 3758549 - RNA, 20 nt, Salmonella typhimurium LT2
gaugacgcuucgcuuauccg

SEQ ID NO: 3758550 - RNA, 13 nt, Salmonella typhimurium LT2
gaugacguccaga

SEQ ID NO: 3758551 - RNA, 20 nt, Salmonella typhimurium LT2
gaugacuaaaucagcauccg

SEQ ID NO: 3758552 - RNA, 19 nt, Salmonella typhimurium LT2
gaugacucccaguccggua

SEQ ID NO: 3758553 - RNA, 22 nt, Salmonella typhimurium LT2
gaugacuuugacggaaccauuc

SEQ ID NO: 3758554 - RNA, 20 nt, Salmonella typhimurium LT2
gaugagcaaaccgcaaauaa

SEQ ID NO: 3758555 - RNA, 21 nt, Salmonella typhimurium LT2
gaugagcaaaccgcaaauaau

SEQ ID NO: 3758556 - RNA, 15 nt, Salmonella typhimurium LT2
gaugagcaaaguaaa

SEQ ID NO: 3758557 - RNA, 13 nt, Salmonella typhimurium LT2
gaugagcgcgaaa

SEQ ID NO: 3758558 - RNA, 24 nt, Salmonella typhimurium LT2
gaugauagccguugucauggcgcc

SEQ ID NO: 3758559 - RNA, 19 nt, Salmonella typhimurium LT2
gaugaugagaugcaggcca

SEQ ID NO: 3758560 - RNA, 23 nt, Salmonella typhimurium LT2
gaugauguuugugaccccggccu

SEQ ID NO: 3758561 - RNA, 19 nt, Salmonella typhimurium LT2
gaugauuggccuccaccgu

SEQ ID NO: 3758562 - RNA, 16 nt, Salmonella typhimurium LT2
gaugauuuaaaaguac

SEQ ID NO: 3758563 - RNA, 13 nt, Salmonella typhimurium LT2
gaugcaaauguca

SEQ ID NO: 3758564 - RNA, 20 nt, Salmonella typhimurium LT2
gaugcaggccaagcagcgcc

SEQ ID NO: 3758565 - RNA, 13 nt, Salmonella typhimurium LT2
gaugccacaggcu

SEQ ID NO: 3758566 - RNA, 16 nt, Salmonella typhimurium LT2
gauuacugcgugcugg

SEQ ID NO: 3758567 - RNA, 21 nt, Salmonella typhimurium LT2
gauuagccaggugacuuugcc

SEQ ID NO: 3758568 - RNA, 19 nt, Salmonella typhimurium LT2
gauuauacuugcugcuaug

SEQ ID NO: 3758569 - RNA, 15 nt, Salmonella typhimurium LT2
gauuaucgcggauga

SEQ ID NO: 3758570 - RNA, 16 nt, Salmonella typhimurium LT2
gauuaucggccagcgc

SEQ ID NO: 3758571 - RNA, 19 nt, Salmonella typhimurium LT2
gauuaucgucuaucacaug

SEQ ID NO: 3758572 - RNA, 16 nt, Salmonella typhimurium LT2
gauuaucguucaagac

SEQ ID NO: 3758573 - RNA, 18 nt, Salmonella typhimurium LT2
gauuauuuuaucaucagc

SEQ ID NO: 3758574 - RNA, 20 nt, Salmonella typhimurium LT2
gauucaaaaggugagaaaaa

SEQ ID NO: 3758575 - RNA, 22 nt, Salmonella typhimurium LT2
gauucaacguuucgcuaucgcc

SEQ ID NO: 3758576 - RNA, 21 nt, Salmonella typhimurium LT2
gauucaauauugaacauuuuu

SEQ ID NO: 3758577 - RNA, 14 nt, Salmonella typhimurium LT2
gauucaccaccacc

SEQ ID NO: 3758578 - RNA, 21 nt, Salmonella typhimurium LT2
gauuccauuuuugcggauggc

SEQ ID NO: 3758579 - RNA, 18 nt, Salmonella typhimurium LT2
gauuccccaaucccacca

SEQ ID NO: 3758580 - RNA, 16 nt, Salmonella typhimurium LT2
gauuccgucaugguga

SEQ ID NO: 3758581 - RNA, 13 nt, Salmonella typhimurium LT2
gauucgccagcgu

SEQ ID NO: 3758582 - RNA, 18 nt, Salmonella typhimurium LT2
gauucgccagcgugcuua

SEQ ID NO: 3758583 - RNA, 17 nt, Salmonella typhimurium LT2
gauucgcccacggauga

SEQ ID NO: 3758584 - RNA, 12 nt, Salmonella typhimurium LT2
gauucuaucugu

SEQ ID NO: 3758585 - RNA, 19 nt, Salmonella typhimurium LT2
gauucugaauaauauguaa

SEQ ID NO: 3758586 - RNA, 13 nt, Salmonella typhimurium LT2
gauucugcagcga

SEQ ID NO: 3758587 - RNA, 18 nt, Salmonella typhimurium LT2
gauugaaguucuucccac

SEQ ID NO: 3758588 - RNA, 22 nt, Salmonella typhimurium LT2
gauugaccgugccggauggcgg

SEQ ID NO: 3758589 - RNA, 22 nt, Salmonella typhimurium LT2
gauugaucucaucgaucaccca

SEQ ID NO: 3758590 - RNA, 17 nt, Salmonella typhimurium LT2
gauugauucgcgccagc

SEQ ID NO: 3758591 - RNA, 20 nt, Salmonella typhimurium LT2
gauugauuuauucacuggca

SEQ ID NO: 3758592 - RNA, 14 nt, Salmonella typhimurium LT2
gauugcaagaauau

SEQ ID NO: 3758593 - RNA, 20 nt, Salmonella typhimurium LT2
gauugccccccagccauaau

SEQ ID NO: 3758594 - RNA, 20 nt, Salmonella typhimurium LT2
gauugccgcccguacagaca

SEQ ID NO: 3758595 - RNA, 16 nt, Salmonella typhimurium LT2
gauugccggaugacgc

SEQ ID NO: 3758596 - RNA, 16 nt, Salmonella typhimurium LT2
gauugccugauggcgc

SEQ ID NO: 3758597 - RNA, 15 nt, Salmonella typhimurium LT2
gauuggcaccgacgu

SEQ ID NO: 3758598 - RNA, 17 nt, Salmonella typhimurium LT2
gauuuaaucgcuucaau

SEQ ID NO: 3758599 - RNA, 15 nt, Salmonella typhimurium LT2
gauuuagcguaaaua

SEQ ID NO: 3758600 - RNA, 23 nt, Salmonella typhimurium LT2
gauuuagcguuggcgucaucgac

SEQ ID NO: 3758601 - RNA, 16 nt, Salmonella typhimurium LT2
gauuuauucuuugucu

SEQ ID NO: 3758602 - RNA, 19 nt, Salmonella typhimurium LT2
gauuucacaaucaucgcau

SEQ ID NO: 3758603 - RNA, 12 nt, Salmonella typhimurium LT2
gauuucaucgcu

SEQ ID NO: 3758604 - RNA, 22 nt, Salmonella typhimurium LT2
gauuucaugcggugcaugaaua

SEQ ID NO: 3758605 - RNA, 24 nt, Salmonella typhimurium LT2
gauuucaugcggugcaugaauauc

SEQ ID NO: 3758606 - RNA, 22 nt, Salmonella typhimurium LT2
gauuuccagaaucaauaaaucg

SEQ ID NO: 3758607 - RNA, 16 nt, Salmonella typhimurium LT2
gauuuccauauuaacg

SEQ ID NO: 3758608 - RNA, 21 nt, Salmonella typhimurium LT2
gauuuccgggcguacuucuuu

SEQ ID NO: 3758609 - RNA, 15 nt, Salmonella typhimurium LT2
gauuucgcaacagca

SEQ ID NO: 3758610 - RNA, 16 nt, Salmonella typhimurium LT2
gauuucgcaacagcau

SEQ ID NO: 3758611 - RNA, 17 nt, Salmonella typhimurium LT2
gauuucgcuccacuggc

SEQ ID NO: 3758612 - RNA, 14 nt, Salmonella typhimurium LT2
gauuucuucuggcu

SEQ ID NO: 3758613 - RNA, 19 nt, Salmonella typhimurium LT2
gauuucuucuggcugcuga

SEQ ID NO: 3758614 - RNA, 18 nt, Salmonella typhimurium LT2
gauuugcaaccgcucuuu

SEQ ID NO: 3758615 - RNA, 16 nt, Salmonella typhimurium LT2
gauuugccgcgccuuc

SEQ ID NO: 3758616 - RNA, 14 nt, Salmonella typhimurium LT2
gauuugcgccgccg

SEQ ID NO: 3758617 - RNA, 17 nt, Salmonella typhimurium LT2
gauuugcgcucgcgcca

SEQ ID NO: 3758618 - RNA, 17 nt, Salmonella typhimurium LT2
gauuuggcugccgagca

SEQ ID NO: 3758619 - RNA, 21 nt, Salmonella typhimurium LT2
gauuuggcugccgagcagauc

SEQ ID NO: 3758620 - RNA, 23 nt, Salmonella typhimurium LT2
gauuuguacguauuuacaaauga

SEQ ID NO: 3758621 - RNA, 17 nt, Salmonella typhimurium LT2
gauuugucgcgcauugc

SEQ ID NO: 3758622 - RNA, 12 nt, Salmonella typhimurium LT2
gauuuuaaauug

SEQ ID NO: 3758623 - RNA, 17 nt, Salmonella typhimurium LT2
gauuuuaucaagucgcg

SEQ ID NO: 3758624 - RNA, 22 nt, Salmonella typhimurium LT2
gauuuucuaugugcgccagcgc

SEQ ID NO: 3758625 - RNA, 13 nt, Salmonella typhimurium LT2
gauuuucuuuaau

SEQ ID NO: 3758626 - RNA, 23 nt, Salmonella typhimurium LT2
gauuuuucugcgccaccagcgca

SEQ ID NO: 3758627 - RNA, 14 nt, Salmonella typhimurium LT2
gcaaaaaaggccag

SEQ ID NO: 3758628 - RNA, 19 nt, Salmonella typhimurium LT2
gcaaaaacaccuaacccac

SEQ ID NO: 3758629 - RNA, 23 nt, Salmonella typhimurium LT2
gcaaaaacggcgcuuuuaaaaua

SEQ ID NO: 3758630 - RNA, 18 nt, Salmonella typhimurium LT2
gcaaaaagaaucgccagg

SEQ ID NO: 3758631 - RNA, 16 nt, Salmonella typhimurium LT2
gcaaaaaucgucauca

SEQ ID NO: 3758632 - RNA, 15 nt, Salmonella typhimurium LT2
gcaaaaccagacgcc

SEQ ID NO: 3758633 - RNA, 15 nt, Salmonella typhimurium LT2
gcaaaacgccgcaga

SEQ ID NO: 3758634 - RNA, 23 nt, Salmonella typhimurium LT2
gcaaaacggauaauaucuuucuc

SEQ ID NO: 3758635 - RNA, 17 nt, Salmonella typhimurium LT2
gcaaaacgugguaaaaa

SEQ ID NO: 3758636 - RNA, 21 nt, Salmonella typhimurium LT2
gcaaaaguuugaccagcaaua

SEQ ID NO: 3758637 - RNA, 15 nt, Salmonella typhimurium LT2
gcaaaauauauaauu

SEQ ID NO: 3758638 - RNA, 22 nt, Salmonella typhimurium LT2
gcaaaauauauaauuuauagcc

SEQ ID NO: 3758639 - RNA, 19 nt, Salmonella typhimurium LT2
gcaaaauggcaauugcgcc

SEQ ID NO: 3758640 - RNA, 15 nt, Salmonella typhimurium LT2
gcaaacaacccggcu

SEQ ID NO: 3758641 - RNA, 17 nt, Salmonella typhimurium LT2
gcaaacaguacgcccgc

SEQ ID NO: 3758642 - RNA, 21 nt, Salmonella typhimurium LT2
gcaaaccgaauucguccacac

SEQ ID NO: 3758643 - RNA, 17 nt, Salmonella typhimurium LT2
gcaaaccuaccggcaua

SEQ ID NO: 3758644 - RNA, 22 nt, Salmonella typhimurium LT2
gcaaaccuauuucaguacagcc

SEQ ID NO: 3758645 - RNA, 13 nt, Salmonella typhimurium LT2
gcaaaccucuccc

SEQ ID NO: 3758646 - RNA, 12 nt, Salmonella typhimurium LT2
gcaaacgacaca

SEQ ID NO: 3758647 - RNA, 15 nt, Salmonella typhimurium LT2
gcaaacgacacauaa

SEQ ID NO: 3758648 - RNA, 15 nt, Salmonella typhimurium LT2
gcaaacgacgcugac

SEQ ID NO: 3758649 - RNA, 14 nt, Salmonella typhimurium LT2
gcaaacgccugcuc

SEQ ID NO: 3758650 - RNA, 16 nt, Salmonella typhimurium LT2
gcaaacgccugcuccg

SEQ ID NO: 3758651 - RNA, 19 nt, Salmonella typhimurium LT2
gcaaacggaauagcgccuu

SEQ ID NO: 3758652 - RNA, 16 nt, Salmonella typhimurium LT2
gcaaacggauauuuua

SEQ ID NO: 3758653 - RNA, 17 nt, Salmonella typhimurium LT2
gcaaacgguaaacgugc

SEQ ID NO: 3758654 - RNA, 22 nt, Salmonella typhimurium LT2
gcaaacgguaaacgugccacag

SEQ ID NO: 3758655 - RNA, 23 nt, Salmonella typhimurium LT2
gcaaacgguaaacgugccacagu

SEQ ID NO: 3758656 - RNA, 20 nt, Salmonella typhimurium LT2
gcaaacuacuuucggaaaaa

SEQ ID NO: 3758657 - RNA, 14 nt, Salmonella typhimurium LT2
gcaaacuuugcgcc

SEQ ID NO: 3758658 - RNA, 22 nt, Salmonella typhimurium LT2
gcaaacuuugcgccauuucaau

SEQ ID NO: 3758659 - RNA, 21 nt, Salmonella typhimurium LT2
gcaaagccaauacucaggguc

SEQ ID NO: 3758660 - RNA, 22 nt, Salmonella typhimurium LT2
gcaaagcccaucagcgccagcc

SEQ ID NO: 3758661 - RNA, 17 nt, Salmonella typhimurium LT2
gcaaagcgacgcgcggu

SEQ ID NO: 3758662 - RNA, 14 nt, Salmonella typhimurium LT2
gcaaagcgccaucc

SEQ ID NO: 3758663 - RNA, 18 nt, Salmonella typhimurium LT2
gcaaagcgggcgacgaug

SEQ ID NO: 3758664 - RNA, 19 nt, Salmonella typhimurium LT2
gcaaagcgucgcgucagca

SEQ ID NO: 3758665 - RNA, 18 nt, Salmonella typhimurium LT2
gcaaagcucaacgcaggc

SEQ ID NO: 3758666 - RNA, 17 nt, Salmonella typhimurium LT2
gcaaaggaucgcaacca

SEQ ID NO: 3758667 - RNA, 20 nt, Salmonella typhimurium LT2
gcaaagucuucauggucgga

SEQ ID NO: 3758668 - RNA, 14 nt, Salmonella typhimurium LT2
gcaaagugccaucc

SEQ ID NO: 3758669 - RNA, 12 nt, Salmonella typhimurium LT2
gcaagggcaagg

SEQ ID NO: 3758670 - RNA, 18 nt, Salmonella typhimurium LT2
gcaagggcaagggcaagg

SEQ ID NO: 3758671 - RNA, 15 nt, Salmonella typhimurium LT2
gcaagggcaaucuga

SEQ ID NO: 3758672 - RNA, 18 nt, Salmonella typhimurium LT2
gcaagucgcgggcgcuaa

SEQ ID NO: 3758673 - RNA, 23 nt, Salmonella typhimurium LT2
gcaaguucgugagcgaagcgccg

SEQ ID NO: 3758674 - RNA, 18 nt, Salmonella typhimurium LT2
gcaaguugcgccacugcc

SEQ ID NO: 3758675 - RNA, 14 nt, Salmonella typhimurium LT2
gcaauaaaaggaau

SEQ ID NO: 3758676 - RNA, 15 nt, Salmonella typhimurium LT2
gcaauaaaauauccu

SEQ ID NO: 3758677 - RNA, 24 nt, Salmonella typhimurium LT2
gcaauaaacuaaguaaggaggaau

SEQ ID NO: 3758678 - RNA, 20 nt, Salmonella typhimurium LT2
gcaauaaaguuuauuugaau

SEQ ID NO: 3758679 - RNA, 19 nt, Salmonella typhimurium LT2
gcaauaacacaggcggcgc

SEQ ID NO: 3758680 - RNA, 21 nt, Salmonella typhimurium LT2
gcaauaacacaggcggcgcua

SEQ ID NO: 3758681 - RNA, 13 nt, Salmonella typhimurium LT2
gcaauaacaggca

SEQ ID NO: 3758682 - RNA, 14 nt, Salmonella typhimurium LT2
gcaauaacaggcac

SEQ ID NO: 3758683 - RNA, 17 nt, Salmonella typhimurium LT2
gcaauacagccagcaca

SEQ ID NO: 3758684 - RNA, 21 nt, Salmonella typhimurium LT2
gcaauacagcccgccagcacc

SEQ ID NO: 3758685 - RNA, 15 nt, Salmonella typhimurium LT2
gcaauacuguaagcc

SEQ ID NO: 3758686 - RNA, 21 nt, Salmonella typhimurium LT2
gcaauaucccgccacuguccu

SEQ ID NO: 3758687 - RNA, 21 nt, Salmonella typhimurium LT2
gcaauaugaaaccgcccugca

SEQ ID NO: 3758688 - RNA, 20 nt, Salmonella typhimurium LT2
gcaauaugcgucagcgcggc

SEQ ID NO: 3758689 - RNA, 17 nt, Salmonella typhimurium LT2
gcaauauggcugcgaca

SEQ ID NO: 3758690 - RNA, 20 nt, Salmonella typhimurium LT2
gcaauauuacaaagcaguaa

SEQ ID NO: 3758691 - RNA, 20 nt, Salmonella typhimurium LT2
gcaauauuuucaaccggguu

SEQ ID NO: 3758692 - RNA, 21 nt, Salmonella typhimurium LT2
gcaaucaauacagagauauua

SEQ ID NO: 3758693 - RNA, 17 nt, Salmonella typhimurium LT2
gcaaucacaagcuguuu

SEQ ID NO: 3758694 - RNA, 14 nt, Salmonella typhimurium LT2
gcaaucacacuaca

SEQ ID NO: 3758695 - RNA, 16 nt, Salmonella typhimurium LT2
gcaaucacauacagca

SEQ ID NO: 3758696 - RNA, 19 nt, Salmonella typhimurium LT2
gcaaucacccacgucagua

SEQ ID NO: 3758697 - RNA, 22 nt, Salmonella typhimurium LT2
gcaaucacccacgucaguaaga

SEQ ID NO: 3758698 - RNA, 22 nt, Salmonella typhimurium LT2
gcaaucacguuuugcagcgcca

SEQ ID NO: 3758699 - RNA, 13 nt, Salmonella typhimurium LT2
gcaaucagcgccc

SEQ ID NO: 3758700 - RNA, 20 nt, Salmonella typhimurium LT2
gcaaucaguacgcgcgcggc

SEQ ID NO: 3758701 - RNA, 21 nt, Salmonella typhimurium LT2
gcaaucgacguugaucgccau

SEQ ID NO: 3758702 - RNA, 16 nt, Salmonella typhimurium LT2
gcaaucgagaucagac

SEQ ID NO: 3758703 - RNA, 16 nt, Salmonella typhimurium LT2
gcaaucgccagcgccu

SEQ ID NO: 3758704 - RNA, 14 nt, Salmonella typhimurium LT2
gcaaucgccugaau

SEQ ID NO: 3758705 - RNA, 15 nt, Salmonella typhimurium LT2
gcaaucgccugaaua

SEQ ID NO: 3758706 - RNA, 20 nt, Salmonella typhimurium LT2
gcaaucgccugcaacgcuuu

SEQ ID NO: 3758707 - RNA, 14 nt, Salmonella typhimurium LT2
gcaaucgcuggcgu

SEQ ID NO: 3758708 - RNA, 15 nt, Salmonella typhimurium LT2
gcaaucggcuuugac

SEQ ID NO: 3758709 - RNA, 16 nt, Salmonella typhimurium LT2
gcaaucgggccugcuc

SEQ ID NO: 3758710 - RNA, 18 nt, Salmonella typhimurium LT2
gcaaucgggccugcuccg

SEQ ID NO: 3758711 - RNA, 15 nt, Salmonella typhimurium LT2
gcaaucucuuccgcc

SEQ ID NO: 3758712 - RNA, 18 nt, Salmonella typhimurium LT2
gcaaucucuuccgcccag

SEQ ID NO: 3758713 - RNA, 15 nt, Salmonella typhimurium LT2
gcaaucuuugccgca

SEQ ID NO: 3758714 - RNA, 14 nt, Salmonella typhimurium LT2
gcaaugaaaccgcc

SEQ ID NO: 3758715 - RNA, 17 nt, Salmonella typhimurium LT2
gcaaugauaacggcgcc

SEQ ID NO: 3758716 - RNA, 14 nt, Salmonella typhimurium LT2
gcaaugauauagcc

SEQ ID NO: 3758717 - RNA, 18 nt, Salmonella typhimurium LT2
gcaaugcccgguuuuuua

SEQ ID NO: 3758718 - RNA, 16 nt, Salmonella typhimurium LT2
gcaaugccgccgccag

SEQ ID NO: 3758719 - RNA, 16 nt, Salmonella typhimurium LT2
gcaaugcgaauaacau

SEQ ID NO: 3758720 - RNA, 14 nt, Salmonella typhimurium LT2
gcaaugcgcuccag

SEQ ID NO: 3758721 - RNA, 21 nt, Salmonella typhimurium LT2
gcaaugcgcuuuuuuugcccu

SEQ ID NO: 3758722 - RNA, 23 nt, Salmonella typhimurium LT2
gcaaugcugacgacauucagcac

SEQ ID NO: 3758723 - RNA, 14 nt, Salmonella typhimurium LT2
gcaaugggaaggaa

SEQ ID NO: 3758724 - RNA, 14 nt, Salmonella typhimurium LT2
gcaauguuucaacc

SEQ ID NO: 3758725 - RNA, 11 nt, Salmonella typhimurium LT2
gcaauuaauau

SEQ ID NO: 3758726 - RNA, 22 nt, Salmonella typhimurium LT2
gcaauucagguaauacgcgucu

SEQ ID NO: 3758727 - RNA, 17 nt, Salmonella typhimurium LT2
gcaauuccggucaucgc

SEQ ID NO: 3758728 - RNA, 15 nt, Salmonella typhimurium LT2
gcaauuccugacugc

SEQ ID NO: 3758729 - RNA, 22 nt, Salmonella typhimurium LT2
gcaauucgaggagcgcggcggc

SEQ ID NO: 3758730 - RNA, 18 nt, Salmonella typhimurium LT2
gcaauugguaauuaaagg

SEQ ID NO: 3758731 - RNA, 21 nt, Salmonella typhimurium LT2
gcaauugguaauuaaaggcag

SEQ ID NO: 3758732 - RNA, 11 nt, Salmonella typhimurium LT2
gcaauuucacu

SEQ ID NO: 3758733 - RNA, 15 nt, Salmonella typhimurium LT2
gcaauuucauucacc

SEQ ID NO: 3758734 - RNA, 19 nt, Salmonella typhimurium LT2
gcaauuucauucaccaccg

SEQ ID NO: 3758735 - RNA, 23 nt, Salmonella typhimurium LT2
gcaauuugguuagggaucaucuu

SEQ ID NO: 3758736 - RNA, 18 nt, Salmonella typhimurium LT2
gcaauuuuguuaaauccc

SEQ ID NO: 3758737 - RNA, 18 nt, Salmonella typhimurium LT2
gcacaaaaagagcaauau

SEQ ID NO: 3758738 - RNA, 23 nt, Salmonella typhimurium LT2
gcacaacacgcuuuucagcgcca

SEQ ID NO: 3758739 - RNA, 12 nt, Salmonella typhimurium LT2
gcacaaccagcg

SEQ ID NO: 3758740 - RNA, 21 nt, Salmonella typhimurium LT2
gcacaacgcauuggcaaugaa

SEQ ID NO: 3758741 - RNA, 22 nt, Salmonella typhimurium LT2
gcacaauaacgaccccaauagc

SEQ ID NO: 3758742 - RNA, 14 nt, Salmonella typhimurium LT2
gcacaauaccaaua

SEQ ID NO: 3758743 - RNA, 17 nt, Salmonella typhimurium LT2
gcacaauaccaauaaga

SEQ ID NO: 3758744 - RNA, 15 nt, Salmonella typhimurium LT2
gcacaaucgccguga

SEQ ID NO: 3758745 - RNA, 13 nt, Salmonella typhimurium LT2
gcacaaucugaau

SEQ ID NO: 3758746 - RNA, 13 nt, Salmonella typhimurium LT2
gcacaauuccggc

SEQ ID NO: 3758747 - RNA, 16 nt, Salmonella typhimurium LT2
gcacacaauagcaauc

SEQ ID NO: 3758748 - RNA, 15 nt, Salmonella typhimurium LT2
gcacaccauuucaca

SEQ ID NO: 3758749 - RNA, 15 nt, Salmonella typhimurium LT2
gcacacccugcagac

SEQ ID NO: 3758750 - RNA, 20 nt, Salmonella typhimurium LT2
gcacaccggccauugccgcg

SEQ ID NO: 3758751 - RNA, 18 nt, Salmonella typhimurium LT2
gcacacgaaauccaaaca

SEQ ID NO: 3758752 - RNA, 18 nt, Salmonella typhimurium LT2
gcacacgccaaaaucgcc

SEQ ID NO: 3758753 - RNA, 18 nt, Salmonella typhimurium LT2
gcacacgcccagggcacg

SEQ ID NO: 3758754 - RNA, 22 nt, Salmonella typhimurium LT2
gcacacgcggcgcuacggcgca

SEQ ID NO: 3758755 - RNA, 21 nt, Salmonella typhimurium LT2
gcacacguauaaacgccgccg

SEQ ID NO: 3758756 - RNA, 18 nt, Salmonella typhimurium LT2
gcacacgucuacccaggu

SEQ ID NO: 3758757 - RNA, 14 nt, Salmonella typhimurium LT2
gcacacgucugagc

SEQ ID NO: 3758758 - RNA, 15 nt, Salmonella typhimurium LT2
gcacacuuucaucag

SEQ ID NO: 3758759 - RNA, 14 nt, Salmonella typhimurium LT2
gcacagaagcgccu

SEQ ID NO: 3758760 - RNA, 15 nt, Salmonella typhimurium LT2
gcacagaaucaccuu

SEQ ID NO: 3758761 - RNA, 15 nt, Salmonella typhimurium LT2
gcacagcacauagaa

SEQ ID NO: 3758762 - RNA, 12 nt, Salmonella typhimurium LT2
gcacagcccaua

SEQ ID NO: 3758763 - RNA, 15 nt, Salmonella typhimurium LT2
gcacagcccauacca

SEQ ID NO: 3758764 - RNA, 17 nt, Salmonella typhimurium LT2
gcacagcggauggcuga

SEQ ID NO: 3758765 - RNA, 12 nt, Salmonella typhimurium LT2
gcacaguuuucc

SEQ ID NO: 3758766 - RNA, 14 nt, Salmonella typhimurium LT2
gcacauaacgugcc

SEQ ID NO: 3758767 - RNA, 22 nt, Salmonella typhimurium LT2
gcacauagcugagacucaguag

SEQ ID NO: 3758768 - RNA, 20 nt, Salmonella typhimurium LT2
gcacaucaauaaauccgcgc

SEQ ID NO: 3758769 - RNA, 21 nt, Salmonella typhimurium LT2
gcacaucaugaugaucuucag

SEQ ID NO: 3758770 - RNA, 22 nt, Salmonella typhimurium LT2
gcacaucaugaugaucuucagc

SEQ ID NO: 3758771 - RNA, 16 nt, Salmonella typhimurium LT2
gcacaucaugccagcc

SEQ ID NO: 3758772 - RNA, 12 nt, Salmonella typhimurium LT2
gcacaucauuau

SEQ ID NO: 3758773 - RNA, 20 nt, Salmonella typhimurium LT2
gcagaaauaaaauacuucca

SEQ ID NO: 3758774 - RNA, 22 nt, Salmonella typhimurium LT2
gcagaacaaacagaccgccaug

SEQ ID NO: 3758775 - RNA, 15 nt, Salmonella typhimurium LT2
gcagaaccgccgcga

SEQ ID NO: 3758776 - RNA, 21 nt, Salmonella typhimurium LT2
gcagaaggccagugguaaaaa

SEQ ID NO: 3758777 - RNA, 19 nt, Salmonella typhimurium LT2
gcagaaucaggcacaaccc

SEQ ID NO: 3758778 - RNA, 19 nt, Salmonella typhimurium LT2
gcagaauuaacucaucaca

SEQ ID NO: 3758779 - RNA, 23 nt, Salmonella typhimurium LT2
gcagaauuaacucaucacagcca

SEQ ID NO: 3758780 - RNA, 21 nt, Salmonella typhimurium LT2
gcagaauuucuacacagcgcg

SEQ ID NO: 3758781 - RNA, 14 nt, Salmonella typhimurium LT2
gcagacacugccac

SEQ ID NO: 3758782 - RNA, 15 nt, Salmonella typhimurium LT2
gcagacacugccacc

SEQ ID NO: 3758783 - RNA, 20 nt, Salmonella typhimurium LT2
gcagacagacaaccagcagg

SEQ ID NO: 3758784 - RNA, 17 nt, Salmonella typhimurium LT2
gcagacauauuuucucu

SEQ ID NO: 3758785 - RNA, 22 nt, Salmonella typhimurium LT2
gcagacaugaccgcacagcaga

SEQ ID NO: 3758786 - RNA, 21 nt, Salmonella typhimurium LT2
gcagacccacuuucagcuccg

SEQ ID NO: 3758787 - RNA, 23 nt, Salmonella typhimurium LT2
gcagacccgucaggguuuucagg

SEQ ID NO: 3758788 - RNA, 20 nt, Salmonella typhimurium LT2
gcagaccuguucuguaggcu

SEQ ID NO: 3758789 - RNA, 14 nt, Salmonella typhimurium LT2
gcagacgccugccg

SEQ ID NO: 3758790 - RNA, 15 nt, Salmonella typhimurium LT2
gcagacggagaugau

SEQ ID NO: 3758791 - RNA, 17 nt, Salmonella typhimurium LT2
gcagacuaaaaagcgcg

SEQ ID NO: 3758792 - RNA, 18 nt, Salmonella typhimurium LT2
gcagacuaaaaagcgcgu

SEQ ID NO: 3758793 - RNA, 11 nt, Salmonella typhimurium LT2
gcagacucagu

SEQ ID NO: 3758794 - RNA, 14 nt, Salmonella typhimurium LT2
gcagacugccggca

SEQ ID NO: 3758795 - RNA, 14 nt, Salmonella typhimurium LT2
gcagacuguaaauc

SEQ ID NO: 3758796 - RNA, 18 nt, Salmonella typhimurium LT2
gcagacuuuagccauucc

SEQ ID NO: 3758797 - RNA, 18 nt, Salmonella typhimurium LT2
gcagacuuucugacaggu

SEQ ID NO: 3758798 - RNA, 17 nt, Salmonella typhimurium LT2
gcagagauagccagcga

SEQ ID NO: 3758799 - RNA, 13 nt, Salmonella typhimurium LT2
gcagagcccagcg

SEQ ID NO: 3758800 - RNA, 16 nt, Salmonella typhimurium LT2
gcagagcggggagacu

SEQ ID NO: 3758801 - RNA, 15 nt, Salmonella typhimurium LT2
gcagauaaaccacgc

SEQ ID NO: 3758802 - RNA, 14 nt, Salmonella typhimurium LT2
gcagauaacaggca

SEQ ID NO: 3758803 - RNA, 13 nt, Salmonella typhimurium LT2
gcagauaccagcc

SEQ ID NO: 3758804 - RNA, 19 nt, Salmonella typhimurium LT2
gcagauaccgaccgugaga

SEQ ID NO: 3758805 - RNA, 18 nt, Salmonella typhimurium LT2
gcagauacugcgcguggc

SEQ ID NO: 3758806 - RNA, 18 nt, Salmonella typhimurium LT2
gcagauccaaauggcgua

SEQ ID NO: 3758807 - RNA, 21 nt, Salmonella typhimurium LT2
gcagauccgcgauaucaauca

SEQ ID NO: 3758808 - RNA, 23 nt, Salmonella typhimurium LT2
gcagauccuuaacgucaaagcua

SEQ ID NO: 3758809 - RNA, 18 nt, Salmonella typhimurium LT2
gcagaucguagcguuuug

SEQ ID NO: 3758810 - RNA, 22 nt, Salmonella typhimurium LT2
gcagaucgucggcguucaacac

SEQ ID NO: 3758811 - RNA, 17 nt, Salmonella typhimurium LT2
gcagaucugucgccaug

SEQ ID NO: 3758812 - RNA, 23 nt, Salmonella typhimurium LT2
gcagaucugucgccaugaccugg

SEQ ID NO: 3758813 - RNA, 20 nt, Salmonella typhimurium LT2
gcagaugcugcugcgcggcc

SEQ ID NO: 3758814 - RNA, 21 nt, Salmonella typhimurium LT2
gcagaugguauaaaucacgcu

SEQ ID NO: 3758815 - RNA, 14 nt, Salmonella typhimurium LT2
gcagauuaccggca

SEQ ID NO: 3758816 - RNA, 16 nt, Salmonella typhimurium LT2
gcagcaaauacagaug

SEQ ID NO: 3758817 - RNA, 14 nt, Salmonella typhimurium LT2
gcagcaacccugcc

SEQ ID NO: 3758818 - RNA, 20 nt, Salmonella typhimurium LT2
gcagcaacugauucaaaagg

SEQ ID NO: 3758819 - RNA, 20 nt, Salmonella typhimurium LT2
gcagcaaugugcgccaggau

SEQ ID NO: 3758820 - RNA, 18 nt, Salmonella typhimurium LT2
gcagcacaaucagcgcgg

SEQ ID NO: 3758821 - RNA, 19 nt, Salmonella typhimurium LT2
gcagcacacgcuucugguu

SEQ ID NO: 3758822 - RNA, 17 nt, Salmonella typhimurium LT2
gcagcacaugcaauuug

SEQ ID NO: 3758823 - RNA, 17 nt, Salmonella typhimurium LT2
gcagcaccgguuuuucc

SEQ ID NO: 3758824 - RNA, 18 nt, Salmonella typhimurium LT2
gcagcaccgguuuuuccg

SEQ ID NO: 3758825 - RNA, 20 nt, Salmonella typhimurium LT2
gcagcaccucaauaugaaau

SEQ ID NO: 3758826 - RNA, 17 nt, Salmonella typhimurium LT2
gcagcacgagcauccag

SEQ ID NO: 3758827 - RNA, 15 nt, Salmonella typhimurium LT2
gcagcacuuucgcuu

SEQ ID NO: 3758828 - RNA, 17 nt, Salmonella typhimurium LT2
gcagcagauuaacagcu

SEQ ID NO: 3758829 - RNA, 17 nt, Salmonella typhimurium LT2
gcagcagcagcagcaga

SEQ ID NO: 3758830 - RNA, 22 nt, Salmonella typhimurium LT2
gcagcagcgcuuucuucuucac

SEQ ID NO: 3758831 - RNA, 14 nt, Salmonella typhimurium LT2
gcagcagcggaauc

SEQ ID NO: 3758832 - RNA, 15 nt, Salmonella typhimurium LT2
gcagcagcuccccgc

SEQ ID NO: 3758833 - RNA, 12 nt, Salmonella typhimurium LT2
gcagcagcuuca

SEQ ID NO: 3758834 - RNA, 17 nt, Salmonella typhimurium LT2
gcagcagcuucgccaga

SEQ ID NO: 3758835 - RNA, 19 nt, Salmonella typhimurium LT2
gcagcaggacguugccgcc

SEQ ID NO: 3758836 - RNA, 17 nt, Salmonella typhimurium LT2
gcagcauaaacaucagc

SEQ ID NO: 3758837 - RNA, 13 nt, Salmonella typhimurium LT2
gcagcaucgccau

SEQ ID NO: 3758838 - RNA, 15 nt, Salmonella typhimurium LT2
gcagcaucgccauca

SEQ ID NO: 3758839 - RNA, 17 nt, Salmonella typhimurium LT2
gcagcaucugauagccc

SEQ ID NO: 3758840 - RNA, 22 nt, Salmonella typhimurium LT2
gcagcaugauggacguuuccug

SEQ ID NO: 3758841 - RNA, 21 nt, Salmonella typhimurium LT2
gcagcauugaccaccauauuc

SEQ ID NO: 3758842 - RNA, 19 nt, Salmonella typhimurium LT2
gcagccaccccggcauaug

SEQ ID NO: 3758843 - RNA, 14 nt, Salmonella typhimurium LT2
gcagccacggcgca

SEQ ID NO: 3758844 - RNA, 17 nt, Salmonella typhimurium LT2
gcagccacggcgcacac

SEQ ID NO: 3758845 - RNA, 22 nt, Salmonella typhimurium LT2
gcagccagaaaaagggaaaagc

SEQ ID NO: 3758846 - RNA, 16 nt, Salmonella typhimurium LT2
gcagccagcccagcgc

SEQ ID NO: 3758847 - RNA, 19 nt, Salmonella typhimurium LT2
gcagccaggccauuuuuuc

SEQ ID NO: 3758848 - RNA, 22 nt, Salmonella typhimurium LT2
gcagccagggaacuccagcagg

SEQ ID NO: 3758849 - RNA, 16 nt, Salmonella typhimurium LT2
gcagccaugccagcgc

SEQ ID NO: 3758850 - RNA, 14 nt, Salmonella typhimurium LT2
gcagccccagcgcc

SEQ ID NO: 3758851 - RNA, 16 nt, Salmonella typhimurium LT2
gcagccccagcgccag

SEQ ID NO: 3758852 - RNA, 21 nt, Salmonella typhimurium LT2
gcagccccggcauccaguucc

SEQ ID NO: 3758853 - RNA, 23 nt, Salmonella typhimurium LT2
gcagcccugcgucgcguaccagc

SEQ ID NO: 3758854 - RNA, 19 nt, Salmonella typhimurium LT2
gcagccgaauggcugccuu

SEQ ID NO: 3758855 - RNA, 22 nt, Salmonella typhimurium LT2
gcagccgaggcuuaauacagca

SEQ ID NO: 3758856 - RNA, 14 nt, Salmonella typhimurium LT2
gcagccgccaccac

SEQ ID NO: 3758857 - RNA, 17 nt, Salmonella typhimurium LT2
gcagccgccauccggca

SEQ ID NO: 3758858 - RNA, 17 nt, Salmonella typhimurium LT2
gcagccgcucaggguaa

SEQ ID NO: 3758859 - RNA, 12 nt, Salmonella typhimurium LT2
gcagccggauag

SEQ ID NO: 3758860 - RNA, 13 nt, Salmonella typhimurium LT2
gcagccggauaga

SEQ ID NO: 3758861 - RNA, 16 nt, Salmonella typhimurium LT2
gcagccgguauccagc

SEQ ID NO: 3758862 - RNA, 19 nt, Salmonella typhimurium LT2
gcagccgguauccagcgcg

SEQ ID NO: 3758863 - RNA, 16 nt, Salmonella typhimurium LT2
gcagccguuucuucug

SEQ ID NO: 3758864 - RNA, 15 nt, Salmonella typhimurium LT2
gcagcgaagaucagg

SEQ ID NO: 3758865 - RNA, 18 nt, Salmonella typhimurium LT2
gcagcgauauagcgcaug

SEQ ID NO: 3758866 - RNA, 15 nt, Salmonella typhimurium LT2
gcagcgauauuucuc

SEQ ID NO: 3758867 - RNA, 18 nt, Salmonella typhimurium LT2
gcagcgauauuucuccgc

SEQ ID NO: 3758868 - RNA, 21 nt, Salmonella typhimurium LT2
gcagcgcauucguaaugcgaa

SEQ ID NO: 3758869 - RNA, 15 nt, Salmonella typhimurium LT2
gcagcgccaucaggc

SEQ ID NO: 3758870 - RNA, 18 nt, Salmonella typhimurium LT2
gcagcgccaucaggcccc

SEQ ID NO: 3758871 - RNA, 12 nt, Salmonella typhimurium LT2
gcagcgccaucc

SEQ ID NO: 3758872 - RNA, 17 nt, Salmonella typhimurium LT2
gcagcgccauccacggc

SEQ ID NO: 3758873 - RNA, 12 nt, Salmonella typhimurium LT2
gcagcgccaucu

SEQ ID NO: 3758874 - RNA, 21 nt, Salmonella typhimurium LT2
gcagcgccauugagcauucua

SEQ ID NO: 3758875 - RNA, 16 nt, Salmonella typhimurium LT2
gcagcgcccgcugucc

SEQ ID NO: 3758876 - RNA, 15 nt, Salmonella typhimurium LT2
gcagcgccuucgcuu

SEQ ID NO: 3758877 - RNA, 12 nt, Salmonella typhimurium LT2
gcaguucaucca

SEQ ID NO: 3758878 - RNA, 22 nt, Salmonella typhimurium LT2
gcaguugaaaacauugucggug

SEQ ID NO: 3758879 - RNA, 17 nt, Salmonella typhimurium LT2
gcaguugauacauuuuu

SEQ ID NO: 3758880 - RNA, 22 nt, Salmonella typhimurium LT2
gcaguugaucguaaagcgcauc

SEQ ID NO: 3758881 - RNA, 17 nt, Salmonella typhimurium LT2
gcaguugcagcguacgg

SEQ ID NO: 3758882 - RNA, 17 nt, Salmonella typhimurium LT2
gcaguugccaggccgca

SEQ ID NO: 3758883 - RNA, 17 nt, Salmonella typhimurium LT2
gcaguuuaaagccaauc

SEQ ID NO: 3758884 - RNA, 22 nt, Salmonella typhimurium LT2
gcaguuuaaagccaauccagaa

SEQ ID NO: 3758885 - RNA, 18 nt, Salmonella typhimurium LT2
gcaguuuacgcagcgccu

SEQ ID NO: 3758886 - RNA, 19 nt, Salmonella typhimurium LT2
gcaguuuugcuucaugcac

SEQ ID NO: 3758887 - RNA, 19 nt, Salmonella typhimurium LT2
gcaguuuuucugacucauu

SEQ ID NO: 3758888 - RNA, 21 nt, Salmonella typhimurium LT2
gcauaaaaaaagcgccggauu

SEQ ID NO: 3758889 - RNA, 17 nt, Salmonella typhimurium LT2
gcauaaaaaacaucaug

SEQ ID NO: 3758890 - RNA, 15 nt, Salmonella typhimurium LT2
gcauaaaaaaggcuc

SEQ ID NO: 3758891 - RNA, 15 nt, Salmonella typhimurium LT2
gcauaaaaaaugaga

SEQ ID NO: 3758892 - RNA, 19 nt, Salmonella typhimurium LT2
gcauaaaaaaugagaaagg

SEQ ID NO: 3758893 - RNA, 23 nt, Salmonella typhimurium LT2
gcauaaauaauaccguccgcgug

SEQ ID NO: 3758894 - RNA, 13 nt, Salmonella typhimurium LT2
gcauaaauaaugc

SEQ ID NO: 3758895 - RNA, 13 nt, Salmonella typhimurium LT2
gcauaaauauccg

SEQ ID NO: 3758896 - RNA, 17 nt, Salmonella typhimurium LT2
gcauaaauuggcucaga

SEQ ID NO: 3758897 - RNA, 18 nt, Salmonella typhimurium LT2
gcauaaccgcagcgcggc

SEQ ID NO: 3758898 - RNA, 19 nt, Salmonella typhimurium LT2
gcauaaccgcgcguaaauc

SEQ ID NO: 3758899 - RNA, 12 nt, Salmonella typhimurium LT2
gcauaagccuca

SEQ ID NO: 3758900 - RNA, 10 nt, Salmonella typhimurium LT2
gcauaauaug

SEQ ID NO: 3758901 - RNA, 19 nt, Salmonella typhimurium LT2
gcauaaugacguccaggcc

SEQ ID NO: 3758902 - RNA, 16 nt, Salmonella typhimurium LT2
gcauaaugcagccauc

SEQ ID NO: 3758903 - RNA, 20 nt, Salmonella typhimurium LT2
gcauaauuguggaaauaaga

SEQ ID NO: 3758904 - RNA, 22 nt, Salmonella typhimurium LT2
gcauacacgccgggcacgcuga

SEQ ID NO: 3758905 - RNA, 23 nt, Salmonella typhimurium LT2
gcauacauucuguuuucgagccu

SEQ ID NO: 3758906 - RNA, 18 nt, Salmonella typhimurium LT2
gcauaccaaguuuggcaa

SEQ ID NO: 3758907 - RNA, 12 nt, Salmonella typhimurium LT2
gcauaccgagcc

SEQ ID NO: 3758908 - RNA, 19 nt, Salmonella typhimurium LT2
gcauaccgagcccuaucac

SEQ ID NO: 3758909 - RNA, 20 nt, Salmonella typhimurium LT2
gcauaccgugugcagugaca

SEQ ID NO: 3758910 - RNA, 16 nt, Salmonella typhimurium LT2
gcauaccuccucucuu

SEQ ID NO: 3758911 - RNA, 23 nt, Salmonella typhimurium LT2
gcauacgcuuucggaucaaucac

SEQ ID NO: 3758912 - RNA, 19 nt, Salmonella typhimurium LT2
gcauacucacgaauaagaa

SEQ ID NO: 3758913 - RNA, 21 nt, Salmonella typhimurium LT2
gcauacucauuaccggcugcc

SEQ ID NO: 3758914 - RNA, 22 nt, Salmonella typhimurium LT2
gcauacucuccuccauaccuuu

SEQ ID NO: 3758915 - RNA, 18 nt, Salmonella typhimurium LT2
gcauacucuuggagagca

SEQ ID NO: 3758916 - RNA, 14 nt, Salmonella typhimurium LT2
gcauacuuccucac

SEQ ID NO: 3758917 - RNA, 17 nt, Salmonella typhimurium LT2
gcauagaauuucagggu

SEQ ID NO: 3758918 - RNA, 16 nt, Salmonella typhimurium LT2
gcauagacgugcggca

SEQ ID NO: 3758919 - RNA, 16 nt, Salmonella typhimurium LT2
gcauagccccagcgca

SEQ ID NO: 3758920 - RNA, 23 nt, Salmonella typhimurium LT2
gcauagccggauaauuuauccag

SEQ ID NO: 3758921 - RNA, 14 nt, Salmonella typhimurium LT2
gcauagcgccauca

SEQ ID NO: 3758922 - RNA, 19 nt, Salmonella typhimurium LT2
gcauagcgucaucaacaua

SEQ ID NO: 3758923 - RNA, 18 nt, Salmonella typhimurium LT2
gcauagcuguuccgcaac

SEQ ID NO: 3758924 - RNA, 14 nt, Salmonella typhimurium LT2
gcauaggccccggu

SEQ ID NO: 3758925 - RNA, 22 nt, Salmonella typhimurium LT2
gcauaguccugccgacaggcag

SEQ ID NO: 3758926 - RNA, 16 nt, Salmonella typhimurium LT2
gcauauaagcuuuucc

SEQ ID NO: 3758927 - RNA, 21 nt, Salmonella typhimurium LT2
gcauaucgauagcaucgguca

SEQ ID NO: 3758928 - RNA, 23 nt, Salmonella typhimurium LT2
gcauaucuggcgaggcuuugucc

SEQ ID NO: 3758929 - RNA, 23 nt, Salmonella typhimurium LT2
gcauaucuuacggaaaaaugucg

SEQ ID NO: 3758930 - RNA, 17 nt, Salmonella typhimurium LT2
gcauaugcacagcgcua

SEQ ID NO: 3758931 - RNA, 15 nt, Salmonella typhimurium LT2
gcauauuucuaauga

SEQ ID NO: 3758932 - RNA, 13 nt, Salmonella typhimurium LT2
gcauauuuuucua

SEQ ID NO: 3758933 - RNA, 22 nt, Salmonella typhimurium LT2
gcaucaaacucgcccagcgccu

SEQ ID NO: 3758934 - RNA, 13 nt, Salmonella typhimurium LT2
gcaucaaauaccu

SEQ ID NO: 3758935 - RNA, 16 nt, Salmonella typhimurium LT2
gcaucaaauaccuuuu

SEQ ID NO: 3758936 - RNA, 17 nt, Salmonella typhimurium LT2
gcaucaauaaaaucacc

SEQ ID NO: 3758937 - RNA, 18 nt, Salmonella typhimurium LT2
gcaucaaugcccagcgca

SEQ ID NO: 3758938 - RNA, 20 nt, Salmonella typhimurium LT2
gcaucaauggcgucaaacag

SEQ ID NO: 3758939 - RNA, 20 nt, Salmonella typhimurium LT2
gcaucaaugucgcgcucgcc

SEQ ID NO: 3758940 - RNA, 13 nt, Salmonella typhimurium LT2
gcaucacaggcuu

SEQ ID NO: 3758941 - RNA, 15 nt, Salmonella typhimurium LT2
gcaucacgcgcuggc

SEQ ID NO: 3758942 - RNA, 19 nt, Salmonella typhimurium LT2
gcaucacgcgcuggcgcgc

SEQ ID NO: 3758943 - RNA, 16 nt, Salmonella typhimurium LT2
gcaucagaacaaacuu

SEQ ID NO: 3758944 - RNA, 16 nt, Salmonella typhimurium LT2
gcaucagacuguuacg

SEQ ID NO: 3758945 - RNA, 12 nt, Salmonella typhimurium LT2
gcaucagcgacu

SEQ ID NO: 3758946 - RNA, 23 nt, Salmonella typhimurium LT2
gcaucagcgacucauucagcaac

SEQ ID NO: 3758947 - RNA, 15 nt, Salmonella typhimurium LT2
gcaucaggaaauccu

SEQ ID NO: 3758948 - RNA, 22 nt, Salmonella typhimurium LT2
gcaucaggaaauccuggauacg

SEQ ID NO: 3758949 - RNA, 13 nt, Salmonella typhimurium LT2
gcaucauaaaagg

SEQ ID NO: 3758950 - RNA, 20 nt, Salmonella typhimurium LT2
gcaucaucgguguucacaau

SEQ ID NO: 3758951 - RNA, 21 nt, Salmonella typhimurium LT2
gcaucaucgguguucacaauu

SEQ ID NO: 3758952 - RNA, 21 nt, Salmonella typhimurium LT2
gcaucaucucccaggccgcca

SEQ ID NO: 3758953 - RNA, 21 nt, Salmonella typhimurium LT2
gcaucaugauguucaucgaca

SEQ ID NO: 3758954 - RNA, 15 nt, Salmonella typhimurium LT2
gcaucauucaucucg

SEQ ID NO: 3758955 - RNA, 15 nt, Salmonella typhimurium LT2
gcaucauugaagcga

SEQ ID NO: 3758956 - RNA, 15 nt, Salmonella typhimurium LT2
gcauccacguaaaua

SEQ ID NO: 3758957 - RNA, 20 nt, Salmonella typhimurium LT2
gcauccagauguagcgcggu

SEQ ID NO: 3758958 - RNA, 19 nt, Salmonella typhimurium LT2
gcaucccgcuggcgccacc

SEQ ID NO: 3758959 - RNA, 14 nt, Salmonella typhimurium LT2
gcauccgcaagaca

SEQ ID NO: 3758960 - RNA, 14 nt, Salmonella typhimurium LT2
gcauccgccgccgc

SEQ ID NO: 3758961 - RNA, 20 nt, Salmonella typhimurium LT2
gcauccgcuuucucggcgag

SEQ ID NO: 3758962 - RNA, 16 nt, Salmonella typhimurium LT2
gcauccggcaauucaa

SEQ ID NO: 3758963 - RNA, 14 nt, Salmonella typhimurium LT2
gcauccggcaucaa

SEQ ID NO: 3758964 - RNA, 17 nt, Salmonella typhimurium LT2
gcauccggccagcgaca

SEQ ID NO: 3758965 - RNA, 17 nt, Salmonella typhimurium LT2
gcauccggcuucuggcu

SEQ ID NO: 3758966 - RNA, 16 nt, Salmonella typhimurium LT2
gcauccggggcguggc

SEQ ID NO: 3758967 - RNA, 15 nt, Salmonella typhimurium LT2
gcauccgugaccugc

SEQ ID NO: 3758968 - RNA, 14 nt, Salmonella typhimurium LT2
gcauccuccaucca

SEQ ID NO: 3758969 - RNA, 23 nt, Salmonella typhimurium LT2
gcauccugacuauugcugagcug

SEQ ID NO: 3758970 - RNA, 23 nt, Salmonella typhimurium LT2
gcauccuuaugggucacauccag

SEQ ID NO: 3758971 - RNA, 21 nt, Salmonella typhimurium LT2
gcauccuuuacuauagauauu

SEQ ID NO: 3758972 - RNA, 16 nt, Salmonella typhimurium LT2
gcaucgcccugccagu

SEQ ID NO: 3758973 - RNA, 13 nt, Salmonella typhimurium LT2
gcaucgccgggaa

SEQ ID NO: 3758974 - RNA, 19 nt, Salmonella typhimurium LT2
gcaucgccgggaacagaau

SEQ ID NO: 3758975 - RNA, 23 nt, Salmonella typhimurium LT2
gcaucgcguuauugaccaucgcc

SEQ ID NO: 3758976 - RNA, 13 nt, Salmonella typhimurium LT2
gcaucggcaucaa

SEQ ID NO: 3758977 - RNA, 22 nt, Salmonella typhimurium LT2
gcaucgguagaaugaauguagc

SEQ ID NO: 3758978 - RNA, 14 nt, Salmonella typhimurium LT2
gcaucguagucagg

SEQ ID NO: 3758979 - RNA, 14 nt, Salmonella typhimurium LT2
gcaucgucggcgau

SEQ ID NO: 3758980 - RNA, 14 nt, Salmonella typhimurium LT2
gcaucgugagcgcg

SEQ ID NO: 3758981 - RNA, 20 nt, Salmonella typhimurium LT2
gccaaauacgucgcacggau

SEQ ID NO: 3758982 - RNA, 15 nt, Salmonella typhimurium LT2
gccaaaucagcagga

SEQ ID NO: 3758983 - RNA, 16 nt, Salmonella typhimurium LT2
gccaaaucaugcccaa

SEQ ID NO: 3758984 - RNA, 21 nt, Salmonella typhimurium LT2
gccaaaucgucagccgccagu

SEQ ID NO: 3758985 - RNA, 20 nt, Salmonella typhimurium LT2
gccaaaucuguucuguccau

SEQ ID NO: 3758986 - RNA, 21 nt, Salmonella typhimurium LT2
gccaacagccgcccacaaccg

SEQ ID NO: 3758987 - RNA, 18 nt, Salmonella typhimurium LT2
gccaacaggucgaugauu

SEQ ID NO: 3758988 - RNA, 20 nt, Salmonella typhimurium LT2
gccaaccaccgcggagaucg

SEQ ID NO: 3758989 - RNA, 18 nt, Salmonella typhimurium LT2
gccaaccagauuuuucac

SEQ ID NO: 3758990 - RNA, 16 nt, Salmonella typhimurium LT2
gccaacgauacagcac

SEQ ID NO: 3758991 - RNA, 21 nt, Salmonella typhimurium LT2
gccaacgauacagcacggcag

SEQ ID NO: 3758992 - RNA, 21 nt, Salmonella typhimurium LT2
gccaacgcccgguugcgaaua

SEQ ID NO: 3758993 - RNA, 13 nt, Salmonella typhimurium LT2
gccaacgccgccc

SEQ ID NO: 3758994 - RNA, 19 nt, Salmonella typhimurium LT2
gccaacgccgcccagcgaa

SEQ ID NO: 3758995 - RNA, 16 nt, Salmonella typhimurium LT2
gccaacgccggcaaca

SEQ ID NO: 3758996 - RNA, 12 nt, Salmonella typhimurium LT2
gccaacgcguuu

SEQ ID NO: 3758997 - RNA, 17 nt, Salmonella typhimurium LT2
gccaacgcguuugcccu

SEQ ID NO: 3758998 - RNA, 21 nt, Salmonella typhimurium LT2
gccaacggcccaaucaacgca

SEQ ID NO: 3758999 - RNA, 22 nt, Salmonella typhimurium LT2
gccaacggcccaaucaacgcau

SEQ ID NO: 3759000 - RNA, 14 nt, Salmonella typhimurium LT2
gccaacguugaaaa

SEQ ID NO: 3759001 - RNA, 14 nt, Salmonella typhimurium LT2
gccaacuuuuucuu

SEQ ID NO: 3759002 - RNA, 18 nt, Salmonella typhimurium LT2
gccaacuuuuugcgcaau

SEQ ID NO: 3759003 - RNA, 19 nt, Salmonella typhimurium LT2
gccaagaccgccuaacagc

SEQ ID NO: 3759004 - RNA, 20 nt, Salmonella typhimurium LT2
gccaagaccgccuaacagcg

SEQ ID NO: 3759005 - RNA, 23 nt, Salmonella typhimurium LT2
gccaagaucgccaagcugugauu

SEQ ID NO: 3759006 - RNA, 16 nt, Salmonella typhimurium LT2
gccaagcaccuagguu

SEQ ID NO: 3759007 - RNA, 17 nt, Salmonella typhimurium LT2
gccaagcagcgccacgc

SEQ ID NO: 3759008 - RNA, 23 nt, Salmonella typhimurium LT2
gccaagcgccucgcugacgccag

SEQ ID NO: 3759009 - RNA, 12 nt, Salmonella typhimurium LT2
gccaagcgcggc

SEQ ID NO: 3759010 - RNA, 16 nt, Salmonella typhimurium LT2
gccaagcgcggcagca

SEQ ID NO: 3759011 - RNA, 19 nt, Salmonella typhimurium LT2
gccaagcgcggcagcagcu

SEQ ID NO: 3759012 - RNA, 14 nt, Salmonella typhimurium LT2
gccaagcugcaaua

SEQ ID NO: 3759013 - RNA, 16 nt, Salmonella typhimurium LT2
gccaagcugcagaauc

SEQ ID NO: 3759014 - RNA, 15 nt, Salmonella typhimurium LT2
gccaaguaacacggc

SEQ ID NO: 3759015 - RNA, 17 nt, Salmonella typhimurium LT2
gccaaguaauaaagaga

SEQ ID NO: 3759016 - RNA, 24 nt, Salmonella typhimurium LT2
gccaauacgggagagcguauccag

SEQ ID NO: 3759017 - RNA, 14 nt, Salmonella typhimurium LT2
gccaauagcaauga

SEQ ID NO: 3759018 - RNA, 17 nt, Salmonella typhimurium LT2
gccaauauagccgaugg

SEQ ID NO: 3759019 - RNA, 17 nt, Salmonella typhimurium LT2
gccaaucaacgccgcca

SEQ ID NO: 3759020 - RNA, 19 nt, Salmonella typhimurium LT2
gccaaucaacgccgccagg

SEQ ID NO: 3759021 - RNA, 20 nt, Salmonella typhimurium LT2
gccaaucaccgccagcaacg

SEQ ID NO: 3759022 - RNA, 19 nt, Salmonella typhimurium LT2
gccaaucgccgccgccagg

SEQ ID NO: 3759023 - RNA, 18 nt, Salmonella typhimurium LT2
gccaaugccugacgccac

SEQ ID NO: 3759024 - RNA, 19 nt, Salmonella typhimurium LT2
gccaaugccugacgccacc

SEQ ID NO: 3759025 - RNA, 22 nt, Salmonella typhimurium LT2
gccaauggcucaacuccgccgg

SEQ ID NO: 3759026 - RNA, 19 nt, Salmonella typhimurium LT2
gccaauguacguaaaacca

SEQ ID NO: 3759027 - RNA, 12 nt, Salmonella typhimurium LT2
gccaauguugcg

SEQ ID NO: 3759028 - RNA, 13 nt, Salmonella typhimurium LT2
gccaauuccugcc

SEQ ID NO: 3759029 - RNA, 23 nt, Salmonella typhimurium LT2
gccaauuuaugccggggcgcuuc

SEQ ID NO: 3759030 - RNA, 21 nt, Salmonella typhimurium LT2
gccacaaaggaucauuggcca

SEQ ID NO: 3759031 - RNA, 13 nt, Salmonella typhimurium LT2
gccacaaaggccu

SEQ ID NO: 3759032 - RNA, 14 nt, Salmonella typhimurium LT2
gccacaacgccuga

SEQ ID NO: 3759033 - RNA, 15 nt, Salmonella typhimurium LT2
gccacaaucugauaa

SEQ ID NO: 3759034 - RNA, 16 nt, Salmonella typhimurium LT2
gccacaauggcaggca

SEQ ID NO: 3759035 - RNA, 21 nt, Salmonella typhimurium LT2
gccacaaugggggcauaauac

SEQ ID NO: 3759036 - RNA, 18 nt, Salmonella typhimurium LT2
gccacaauugccagcagg

SEQ ID NO: 3759037 - RNA, 21 nt, Salmonella typhimurium LT2
gccacagauuguacugcgcca

SEQ ID NO: 3759038 - RNA, 13 nt, Salmonella typhimurium LT2
gccacagccaggc

SEQ ID NO: 3759039 - RNA, 12 nt, Salmonella typhimurium LT2
gccacagccgca

SEQ ID NO: 3759040 - RNA, 12 nt, Salmonella typhimurium LT2
gccacagcgcca

SEQ ID NO: 3759041 - RNA, 13 nt, Salmonella typhimurium LT2
gccacagcggaau

SEQ ID NO: 3759042 - RNA, 12 nt, Salmonella typhimurium LT2
gccacaggaacc

SEQ ID NO: 3759043 - RNA, 17 nt, Salmonella typhimurium LT2
gccacauagcauccaga

SEQ ID NO: 3759044 - RNA, 13 nt, Salmonella typhimurium LT2
gccacaucguuac

SEQ ID NO: 3759045 - RNA, 23 nt, Salmonella typhimurium LT2
gccacaucguuacccaucaccug

SEQ ID NO: 3759046 - RNA, 19 nt, Salmonella typhimurium LT2
gccacaucguuggccgcca

SEQ ID NO: 3759047 - RNA, 16 nt, Salmonella typhimurium LT2
gccacaugcggcaggc

SEQ ID NO: 3759048 - RNA, 18 nt, Salmonella typhimurium LT2
gccacaugcggcaggcuu

SEQ ID NO: 3759049 - RNA, 12 nt, Salmonella typhimurium LT2
gccaccaaaaac

SEQ ID NO: 3759050 - RNA, 14 nt, Salmonella typhimurium LT2
gccaccacaaagcg

SEQ ID NO: 3759051 - RNA, 15 nt, Salmonella typhimurium LT2
gccaccacgcccaac

SEQ ID NO: 3759052 - RNA, 13 nt, Salmonella typhimurium LT2
gccaccacucggc

SEQ ID NO: 3759053 - RNA, 16 nt, Salmonella typhimurium LT2
gccaccagcacaaugg

SEQ ID NO: 3759054 - RNA, 15 nt, Salmonella typhimurium LT2
gccaccagcgauuuu

SEQ ID NO: 3759055 - RNA, 13 nt, Salmonella typhimurium LT2
gccaccagcgcca

SEQ ID NO: 3759056 - RNA, 13 nt, Salmonella typhimurium LT2
gccaccaggaacg

SEQ ID NO: 3759057 - RNA, 16 nt, Salmonella typhimurium LT2
gccaccaucgucgcca

SEQ ID NO: 3759058 - RNA, 17 nt, Salmonella typhimurium LT2
gccaccaucgucgccag

SEQ ID NO: 3759059 - RNA, 22 nt, Salmonella typhimurium LT2
gccaccaucgucgccagaccca

SEQ ID NO: 3759060 - RNA, 18 nt, Salmonella typhimurium LT2
gccaccaucuuuuuugcg

SEQ ID NO: 3759061 - RNA, 17 nt, Salmonella typhimurium LT2
gccaccaugaucaccug

SEQ ID NO: 3759062 - RNA, 17 nt, Salmonella typhimurium LT2
gccaccaugcugguugg

SEQ ID NO: 3759063 - RNA, 15 nt, Salmonella typhimurium LT2
gccacccgccugcgc

SEQ ID NO: 3759064 - RNA, 16 nt, Salmonella typhimurium LT2
gccacccggcaaccua

SEQ ID NO: 3759065 - RNA, 13 nt, Salmonella typhimurium LT2
gccacccggcuuu

SEQ ID NO: 3759066 - RNA, 16 nt, Salmonella typhimurium LT2
gccaccgcauuuucag

SEQ ID NO: 3759067 - RNA, 15 nt, Salmonella typhimurium LT2
gccaccgccagcagu

SEQ ID NO: 3759068 - RNA, 13 nt, Salmonella typhimurium LT2
gccaccgccgcca

SEQ ID NO: 3759069 - RNA, 14 nt, Salmonella typhimurium LT2
gccaccgccgccac

SEQ ID NO: 3759070 - RNA, 17 nt, Salmonella typhimurium LT2
gccaccgcuccgcgcau

SEQ ID NO: 3759071 - RNA, 13 nt, Salmonella typhimurium LT2
gccaccggcagcg

SEQ ID NO: 3759072 - RNA, 21 nt, Salmonella typhimurium LT2
gccaccgggcaacacacgcuu

SEQ ID NO: 3759073 - RNA, 15 nt, Salmonella typhimurium LT2
gccaccgggcauggc

SEQ ID NO: 3759074 - RNA, 22 nt, Salmonella typhimurium LT2
gccaccuuaaucgacuucaugc

SEQ ID NO: 3759075 - RNA, 12 nt, Salmonella typhimurium LT2
gccaccuuccag

SEQ ID NO: 3759076 - RNA, 13 nt, Salmonella typhimurium LT2
gccaccuuccagg

SEQ ID NO: 3759077 - RNA, 15 nt, Salmonella typhimurium LT2
gccaccuuucugcuc

SEQ ID NO: 3759078 - RNA, 21 nt, Salmonella typhimurium LT2
gccaccuuugacgccugcauc

SEQ ID NO: 3759079 - RNA, 21 nt, Salmonella typhimurium LT2
gccacgacgcucaacgauuuc

SEQ ID NO: 3759080 - RNA, 19 nt, Salmonella typhimurium LT2
gccacgagccuucuggcca

SEQ ID NO: 3759081 - RNA, 14 nt, Salmonella typhimurium LT2
gccacgccaauagu

SEQ ID NO: 3759082 - RNA, 17 nt, Salmonella typhimurium LT2
gccacgccauacguccg

SEQ ID NO: 3759083 - RNA, 12 nt, Salmonella typhimurium LT2
gccacgccaucg

SEQ ID NO: 3759084 - RNA, 21 nt, Salmonella typhimurium LT2
gccacgccaucggcuaagcca

SEQ ID NO: 3759085 - RNA, 14 nt, Salmonella typhimurium LT2
gccacgccauugcu

SEQ ID NO: 3759086 - RNA, 17 nt, Salmonella typhimurium LT2
gccagcgacaucccaga

SEQ ID NO: 3759087 - RNA, 21 nt, Salmonella typhimurium LT2
gccagcgaccaccgucccagu

SEQ ID NO: 3759088 - RNA, 17 nt, Salmonella typhimurium LT2
gccagcgaucaggcguc

SEQ ID NO: 3759089 - RNA, 22 nt, Salmonella typhimurium LT2
gccagcgauccugcggcauuag

SEQ ID NO: 3759090 - RNA, 18 nt, Salmonella typhimurium LT2
gccagcgcagucagugaa

SEQ ID NO: 3759091 - RNA, 12 nt, Salmonella typhimurium LT2
gccagcgcaucc

SEQ ID NO: 3759092 - RNA, 15 nt, Salmonella typhimurium LT2
gccagcgcauccacc

SEQ ID NO: 3759093 - RNA, 17 nt, Salmonella typhimurium LT2
gccagcgcaucgauaua

SEQ ID NO: 3759094 - RNA, 14 nt, Salmonella typhimurium LT2
gccagcgccaauac

SEQ ID NO: 3759095 - RNA, 15 nt, Salmonella typhimurium LT2
gccagcgccagcagc

SEQ ID NO: 3759096 - RNA, 14 nt, Salmonella typhimurium LT2
gccagcgccggcga

SEQ ID NO: 3759097 - RNA, 18 nt, Salmonella typhimurium LT2
gccagcgccguuguccgu

SEQ ID NO: 3759098 - RNA, 16 nt, Salmonella typhimurium LT2
gccagcgcugacauca

SEQ ID NO: 3759099 - RNA, 21 nt, Salmonella typhimurium LT2
gccagcggccacagccaggcc

SEQ ID NO: 3759100 - RNA, 18 nt, Salmonella typhimurium LT2
gccagcggccagggcguc

SEQ ID NO: 3759101 - RNA, 18 nt, Salmonella typhimurium LT2
gccagcggcgccaucacc

SEQ ID NO: 3759102 - RNA, 21 nt, Salmonella typhimurium LT2
gccagcggcguuuuuuccugc

SEQ ID NO: 3759103 - RNA, 16 nt, Salmonella typhimurium LT2
gccagcgggccgguaa

SEQ ID NO: 3759104 - RNA, 21 nt, Salmonella typhimurium LT2
gccagcgggcuauaggccauc

SEQ ID NO: 3759105 - RNA, 16 nt, Salmonella typhimurium LT2
gccagcgugcguauga

SEQ ID NO: 3759106 - RNA, 19 nt, Salmonella typhimurium LT2
gccagcguggaugaacuca

SEQ ID NO: 3759107 - RNA, 19 nt, Salmonella typhimurium LT2
gccagcguuagcacauugg

SEQ ID NO: 3759108 - RNA, 16 nt, Salmonella typhimurium LT2
gccagcguugaccagc

SEQ ID NO: 3759109 - RNA, 19 nt, Salmonella typhimurium LT2
gccagcguugaccagccua

SEQ ID NO: 3759110 - RNA, 16 nt, Salmonella typhimurium LT2
gccagcuaauuuuacu

SEQ ID NO: 3759111 - RNA, 20 nt, Salmonella typhimurium LT2
gccagcucaaaucgcggcgc

SEQ ID NO: 3759112 - RNA, 21 nt, Salmonella typhimurium LT2
gccagcucaaaucgcggcgcu

SEQ ID NO: 3759113 - RNA, 15 nt, Salmonella typhimurium LT2
gccagcucaaaugac

SEQ ID NO: 3759114 - RNA, 18 nt, Salmonella typhimurium LT2
gccagcucaugcgcggcg

SEQ ID NO: 3759115 - RNA, 18 nt, Salmonella typhimurium LT2
gccagcucgucggccagc

SEQ ID NO: 3759116 - RNA, 18 nt, Salmonella typhimurium LT2
gccagcuuaucgaccagc

SEQ ID NO: 3759117 - RNA, 22 nt, Salmonella typhimurium LT2
gccaggaaccgccgaugcacaa

SEQ ID NO: 3759118 - RNA, 14 nt, Salmonella typhimurium LT2
gccaggauaucgcc

SEQ ID NO: 3759119 - RNA, 18 nt, Salmonella typhimurium LT2
gccaggauaucuuccacu

SEQ ID NO: 3759120 - RNA, 24 nt, Salmonella typhimurium LT2
gccaggcauaccuccucucuuccu

SEQ ID NO: 3759121 - RNA, 21 nt, Salmonella typhimurium LT2
gccaggcauugauaaagcgcu

SEQ ID NO: 3759122 - RNA, 22 nt, Salmonella typhimurium LT2
gccaggccguugugucccugga

SEQ ID NO: 3759123 - RNA, 14 nt, Salmonella typhimurium LT2
gccaggcgcggcgc

SEQ ID NO: 3759124 - RNA, 16 nt, Salmonella typhimurium LT2
gccaggcgcggcgcgc

SEQ ID NO: 3759125 - RNA, 17 nt, Salmonella typhimurium LT2
gccaggcuaagaucgcc

SEQ ID NO: 3759126 - RNA, 15 nt, Salmonella typhimurium LT2
gccaggcuuccugcg

SEQ ID NO: 3759127 - RNA, 19 nt, Salmonella typhimurium LT2
gccagggcaucgcgcgaga

SEQ ID NO: 3759128 - RNA, 15 nt, Salmonella typhimurium LT2
gccagggcggaagca

SEQ ID NO: 3759129 - RNA, 18 nt, Salmonella typhimurium LT2
gccagggcggaagcagau

SEQ ID NO: 3759130 - RNA, 21 nt, Salmonella typhimurium LT2
gccagggcgggauccccugcu

SEQ ID NO: 3759131 - RNA, 19 nt, Salmonella typhimurium LT2
gccaggggaugauuuucag

SEQ ID NO: 3759132 - RNA, 19 nt, Salmonella typhimurium LT2
gccagguauugagcgaaac

SEQ ID NO: 3759133 - RNA, 22 nt, Salmonella typhimurium LT2
gccagguauugagcgaaacagg

SEQ ID NO: 3759134 - RNA, 13 nt, Salmonella typhimurium LT2
gccagguccagau

SEQ ID NO: 3759135 - RNA, 22 nt, Salmonella typhimurium LT2
gccaggucugaaccacgguguc

SEQ ID NO: 3759136 - RNA, 18 nt, Salmonella typhimurium LT2
gccaggugacuuugcccu

SEQ ID NO: 3759137 - RNA, 23 nt, Salmonella typhimurium LT2
gccagguuauuucgcgcaguuag

SEQ ID NO: 3759138 - RNA, 23 nt, Salmonella typhimurium LT2
gccagguuuuacucugaucgaga

SEQ ID NO: 3759139 - RNA, 17 nt, Salmonella typhimurium LT2
gccagguuuucaggccg

SEQ ID NO: 3759140 - RNA, 19 nt, Salmonella typhimurium LT2
gccaguaacucaucgccag

SEQ ID NO: 3759141 - RNA, 18 nt, Salmonella typhimurium LT2
gccaguaagggaauaucu

SEQ ID NO: 3759142 - RNA, 17 nt, Salmonella typhimurium LT2
gccaguacagcacgccg

SEQ ID NO: 3759143 - RNA, 15 nt, Salmonella typhimurium LT2
gccaguaccgccgcc

SEQ ID NO: 3759144 - RNA, 17 nt, Salmonella typhimurium LT2
gccaguaccgccgccgg

SEQ ID NO: 3759145 - RNA, 20 nt, Salmonella typhimurium LT2
gccaguagauggcgcuaaaa

SEQ ID NO: 3759146 - RNA, 19 nt, Salmonella typhimurium LT2
gccaguagcucgccgcuga

SEQ ID NO: 3759147 - RNA, 18 nt, Salmonella typhimurium LT2
gccaguaucgcgccgcca

SEQ ID NO: 3759148 - RNA, 18 nt, Salmonella typhimurium LT2
gccagucaccagcagcac

SEQ ID NO: 3759149 - RNA, 14 nt, Salmonella typhimurium LT2
gccagucaucgccg

SEQ ID NO: 3759150 - RNA, 13 nt, Salmonella typhimurium LT2
gccaguccagguu

SEQ ID NO: 3759151 - RNA, 16 nt, Salmonella typhimurium LT2
gccagucgccaggcaa

SEQ ID NO: 3759152 - RNA, 17 nt, Salmonella typhimurium LT2
gccagucgccaggcaag

SEQ ID NO: 3759153 - RNA, 14 nt, Salmonella typhimurium LT2
gccagugacaaauu

SEQ ID NO: 3759154 - RNA, 19 nt, Salmonella typhimurium LT2
gccagugcauagcagcgcc

SEQ ID NO: 3759155 - RNA, 20 nt, Salmonella typhimurium LT2
gccagugggcgucaaaaucc

SEQ ID NO: 3759156 - RNA, 18 nt, Salmonella typhimurium LT2
gccaguuagcgaccgcgc

SEQ ID NO: 3759157 - RNA, 17 nt, Salmonella typhimurium LT2
gccaguucacgccgccg

SEQ ID NO: 3759158 - RNA, 19 nt, Salmonella typhimurium LT2
gccaguucauuccgcccug

SEQ ID NO: 3759159 - RNA, 19 nt, Salmonella typhimurium LT2
gccaguucauucgccacca

SEQ ID NO: 3759160 - RNA, 16 nt, Salmonella typhimurium LT2
gccaguucuuguaguu

SEQ ID NO: 3759161 - RNA, 20 nt, Salmonella typhimurium LT2
gccaguuguccgcuggucag

SEQ ID NO: 3759162 - RNA, 12 nt, Salmonella typhimurium LT2
gccaguuuacgc

SEQ ID NO: 3759163 - RNA, 19 nt, Salmonella typhimurium LT2
gccaguuuacgcguacucg

SEQ ID NO: 3759164 - RNA, 15 nt, Salmonella typhimurium LT2
gccaguuuguaacca

SEQ ID NO: 3759165 - RNA, 17 nt, Salmonella typhimurium LT2
gccaguuuuugcgccau

SEQ ID NO: 3759166 - RNA, 21 nt, Salmonella typhimurium LT2
gccauaaaccccgauaaacca

SEQ ID NO: 3759167 - RNA, 18 nt, Salmonella typhimurium LT2
gccauaaagcuguaccug

SEQ ID NO: 3759168 - RNA, 17 nt, Salmonella typhimurium LT2
gccauaaaugcugauga

SEQ ID NO: 3759169 - RNA, 21 nt, Salmonella typhimurium LT2
gccauaacggcuguccauccg

SEQ ID NO: 3759170 - RNA, 17 nt, Salmonella typhimurium LT2
gccauaagcgaacaggc

SEQ ID NO: 3759171 - RNA, 15 nt, Salmonella typhimurium LT2
gccauaaucgcguuu

SEQ ID NO: 3759172 - RNA, 18 nt, Salmonella typhimurium LT2
gccauaaucgcguuuucc

SEQ ID NO: 3759173 - RNA, 19 nt, Salmonella typhimurium LT2
gccauaaucgcguuuuccu

SEQ ID NO: 3759174 - RNA, 14 nt, Salmonella typhimurium LT2
gccauacacgcggc

SEQ ID NO: 3759175 - RNA, 18 nt, Salmonella typhimurium LT2
gccauacccgauaucgcu

SEQ ID NO: 3759176 - RNA, 19 nt, Salmonella typhimurium LT2
gccauaccggcgcgcgcca

SEQ ID NO: 3759177 - RNA, 20 nt, Salmonella typhimurium LT2
gccauaccggcgcgcgccag

SEQ ID NO: 3759178 - RNA, 20 nt, Salmonella typhimurium LT2
gccauacuuuuccagcgccu

SEQ ID NO: 3759179 - RNA, 14 nt, Salmonella typhimurium LT2
gccauagccggcga

SEQ ID NO: 3759180 - RNA, 17 nt, Salmonella typhimurium LT2
gccauagcguuuaaaaa

SEQ ID NO: 3759181 - RNA, 14 nt, Salmonella typhimurium LT2
gccauauacgccac

SEQ ID NO: 3759182 - RNA, 15 nt, Salmonella typhimurium LT2
gccauauaugaaauc

SEQ ID NO: 3759183 - RNA, 16 nt, Salmonella typhimurium LT2
gccauauaugaaaucg

SEQ ID NO: 3759184 - RNA, 15 nt, Salmonella typhimurium LT2
gccauauccaagccc

SEQ ID NO: 3759185 - RNA, 12 nt, Salmonella typhimurium LT2
gccauaucgccg

SEQ ID NO: 3759186 - RNA, 18 nt, Salmonella typhimurium LT2
gccauaucggcacugcuu

SEQ ID NO: 3759187 - RNA, 20 nt, Salmonella typhimurium LT2
gccauaucguucaguuucaa

SEQ ID NO: 3759188 - RNA, 15 nt, Salmonella typhimurium LT2
gccauauguuccacc

SEQ ID NO: 3759189 - RNA, 16 nt, Salmonella typhimurium LT2
gccauauucucuggcg

SEQ ID NO: 3759190 - RNA, 17 nt, Salmonella typhimurium LT2
gcccacaggcagggcga

SEQ ID NO: 3759191 - RNA, 19 nt, Salmonella typhimurium LT2
gcccacaucuguuugagaa

SEQ ID NO: 3759192 - RNA, 15 nt, Salmonella typhimurium LT2
gcccaccaucagacc

SEQ ID NO: 3759193 - RNA, 17 nt, Salmonella typhimurium LT2
gcccaccgacagauagc

SEQ ID NO: 3759194 - RNA, 13 nt, Salmonella typhimurium LT2
gcccaccugcagc

SEQ ID NO: 3759195 - RNA, 16 nt, Salmonella typhimurium LT2
gcccaccugcagcagc

SEQ ID NO: 3759196 - RNA, 17 nt, Salmonella typhimurium LT2
gcccaccugcagcagcu

SEQ ID NO: 3759197 - RNA, 13 nt, Salmonella typhimurium LT2
gcccacgcccaga

SEQ ID NO: 3759198 - RNA, 16 nt, Salmonella typhimurium LT2
gcccacgggccgccau

SEQ ID NO: 3759199 - RNA, 23 nt, Salmonella typhimurium LT2
gcccacuaacaggauguaagaca

SEQ ID NO: 3759200 - RNA, 16 nt, Salmonella typhimurium LT2
gcccacucauccagca

SEQ ID NO: 3759201 - RNA, 17 nt, Salmonella typhimurium LT2
gcccacuguggcgccac

SEQ ID NO: 3759202 - RNA, 22 nt, Salmonella typhimurium LT2
gcccacuucacauuacuuccgg

SEQ ID NO: 3759203 - RNA, 21 nt, Salmonella typhimurium LT2
gcccacuuguaccaacugcug

SEQ ID NO: 3759204 - RNA, 18 nt, Salmonella typhimurium LT2
gcccagaaagaucagcag

SEQ ID NO: 3759205 - RNA, 22 nt, Salmonella typhimurium LT2
gcccagauagcgcaucagacug

SEQ ID NO: 3759206 - RNA, 10 nt, Salmonella typhimurium LT2
gcccagcagc

SEQ ID NO: 3759207 - RNA, 21 nt, Salmonella typhimurium LT2
gcccagcauauuaacagugag

SEQ ID NO: 3759208 - RNA, 11 nt, Salmonella typhimurium LT2
gcccagcgccg

SEQ ID NO: 3759209 - RNA, 15 nt, Salmonella typhimurium LT2
gcccagcgccggaua

SEQ ID NO: 3759210 - RNA, 15 nt, Salmonella typhimurium LT2
gcccagcgccgggaa

SEQ ID NO: 3759211 - RNA, 20 nt, Salmonella typhimurium LT2
gcccagcuaaaccacggaau

SEQ ID NO: 3759212 - RNA, 22 nt, Salmonella typhimurium LT2
gcccagcucuuuaggcaggaaa

SEQ ID NO: 3759213 - RNA, 13 nt, Salmonella typhimurium LT2
gcccaggcccacg

SEQ ID NO: 3759214 - RNA, 22 nt, Salmonella typhimurium LT2
gcccaggcuuuaguuuccggua

SEQ ID NO: 3759215 - RNA, 22 nt, Salmonella typhimurium LT2
gcccaggucugaugagcgcagc

SEQ ID NO: 3759216 - RNA, 16 nt, Salmonella typhimurium LT2
gcccagguuagcagcc

SEQ ID NO: 3759217 - RNA, 19 nt, Salmonella typhimurium LT2
gcccaguccuuccggcgag

SEQ ID NO: 3759218 - RNA, 20 nt, Salmonella typhimurium LT2
gcccaguuucaucaucgccg

SEQ ID NO: 3759219 - RNA, 15 nt, Salmonella typhimurium LT2
gcccaguuucuucag

SEQ ID NO: 3759220 - RNA, 14 nt, Salmonella typhimurium LT2
gcccauaccagcgc

SEQ ID NO: 3759221 - RNA, 15 nt, Salmonella typhimurium LT2
gcccauaccagcgcg

SEQ ID NO: 3759222 - RNA, 11 nt, Salmonella typhimurium LT2
gcccauaucca

SEQ ID NO: 3759223 - RNA, 17 nt, Salmonella typhimurium LT2
gcccaucaauaccagcc

SEQ ID NO: 3759224 - RNA, 20 nt, Salmonella typhimurium LT2
gcccaucaauaccagcccca

SEQ ID NO: 3759225 - RNA, 15 nt, Salmonella typhimurium LT2
gcccaucagcgccag

SEQ ID NO: 3759226 - RNA, 19 nt, Salmonella typhimurium LT2
gcccaucaucaucggcaca

SEQ ID NO: 3759227 - RNA, 14 nt, Salmonella typhimurium LT2
gcccauccagagca

SEQ ID NO: 3759228 - RNA, 16 nt, Salmonella typhimurium LT2
gcccauccagagcagu

SEQ ID NO: 3759229 - RNA, 13 nt, Salmonella typhimurium LT2
gcccauccagcac

SEQ ID NO: 3759230 - RNA, 18 nt, Salmonella typhimurium LT2
gcccaucgccagggcuuc

SEQ ID NO: 3759231 - RNA, 16 nt, Salmonella typhimurium LT2
gcccaucgcgccauga

SEQ ID NO: 3759232 - RNA, 15 nt, Salmonella typhimurium LT2
gcccaucggcacacu

SEQ ID NO: 3759233 - RNA, 17 nt, Salmonella typhimurium LT2
gcccaugaucaggcgac

SEQ ID NO: 3759234 - RNA, 19 nt, Salmonella typhimurium LT2
gcccaugauggugaacaga

SEQ ID NO: 3759235 - RNA, 21 nt, Salmonella typhimurium LT2
gcccaugauggugaacagaau

SEQ ID NO: 3759236 - RNA, 17 nt, Salmonella typhimurium LT2
gcccauggcaggcagca

SEQ ID NO: 3759237 - RNA, 15 nt, Salmonella typhimurium LT2
gcccauggcaucaau

SEQ ID NO: 3759238 - RNA, 15 nt, Salmonella typhimurium LT2
gcccauuaugccgca

SEQ ID NO: 3759239 - RNA, 15 nt, Salmonella typhimurium LT2
gcccauucaacgggc

SEQ ID NO: 3759240 - RNA, 18 nt, Salmonella typhimurium LT2
gcccauuccgccaacggu

SEQ ID NO: 3759241 - RNA, 21 nt, Salmonella typhimurium LT2
gcccauucuucgucgucauca

SEQ ID NO: 3759242 - RNA, 15 nt, Salmonella typhimurium LT2
gcccauugaaaucgc

SEQ ID NO: 3759243 - RNA, 18 nt, Salmonella typhimurium LT2
gcccauugucaucaguau

SEQ ID NO: 3759244 - RNA, 13 nt, Salmonella typhimurium LT2
gcccauuucagca

SEQ ID NO: 3759245 - RNA, 20 nt, Salmonella typhimurium LT2
gcccauuucauggccgauca

SEQ ID NO: 3759246 - RNA, 15 nt, Salmonella typhimurium LT2
gcccauuugcgagaa

SEQ ID NO: 3759247 - RNA, 18 nt, Salmonella typhimurium LT2
gccccaacagaccgcugu

SEQ ID NO: 3759248 - RNA, 13 nt, Salmonella typhimurium LT2
gccccaacgcgcu

SEQ ID NO: 3759249 - RNA, 12 nt, Salmonella typhimurium LT2
gccccaccgcca

SEQ ID NO: 3759250 - RNA, 19 nt, Salmonella typhimurium LT2
gccccagaaaaugcucagu

SEQ ID NO: 3759251 - RNA, 18 nt, Salmonella typhimurium LT2
gccccagauacgcacggu

SEQ ID NO: 3759252 - RNA, 19 nt, Salmonella typhimurium LT2
gccccagcaccaacgccgc

SEQ ID NO: 3759253 - RNA, 16 nt, Salmonella typhimurium LT2
gccccagcaccagagc

SEQ ID NO: 3759254 - RNA, 20 nt, Salmonella typhimurium LT2
gccccagcaugagccagccc

SEQ ID NO: 3759255 - RNA, 17 nt, Salmonella typhimurium LT2
gccccagcccugugccg

SEQ ID NO: 3759256 - RNA, 16 nt, Salmonella typhimurium LT2
gccccagcgcaaacga

SEQ ID NO: 3759257 - RNA, 14 nt, Salmonella typhimurium LT2
gccccagcgccagc

SEQ ID NO: 3759258 - RNA, 15 nt, Salmonella typhimurium LT2
gccccagcgccagcu

SEQ ID NO: 3759259 - RNA, 23 nt, Salmonella typhimurium LT2
gccccaggcuauccagcucaccg

SEQ ID NO: 3759260 - RNA, 19 nt, Salmonella typhimurium LT2
gccccauuugccgcgccug

SEQ ID NO: 3759261 - RNA, 20 nt, Salmonella typhimurium LT2
gcccccaaauugaccucaug

SEQ ID NO: 3759262 - RNA, 16 nt, Salmonella typhimurium LT2
gcccccccuaagccua

SEQ ID NO: 3759263 - RNA, 15 nt, Salmonella typhimurium LT2
gccccccgcacagca

SEQ ID NO: 3759264 - RNA, 16 nt, Salmonella typhimurium LT2
gcccccuccagccagc

SEQ ID NO: 3759265 - RNA, 20 nt, Salmonella typhimurium LT2
gcccccuccagccagcgcca

SEQ ID NO: 3759266 - RNA, 13 nt, Salmonella typhimurium LT2
gcccccucggcag

SEQ ID NO: 3759267 - RNA, 17 nt, Salmonella typhimurium LT2
gccccgacaaaacgggc

SEQ ID NO: 3759268 - RNA, 22 nt, Salmonella typhimurium LT2
gccccgacuuaccaccgugccc

SEQ ID NO: 3759269 - RNA, 15 nt, Salmonella typhimurium LT2
gccccgaugucgcca

SEQ ID NO: 3759270 - RNA, 16 nt, Salmonella typhimurium LT2
gccccgcaccuguugc

SEQ ID NO: 3759271 - RNA, 17 nt, Salmonella typhimurium LT2
gccccgccacagccgca

SEQ ID NO: 3759272 - RNA, 14 nt, Salmonella typhimurium LT2
gccccgcgcgccug

SEQ ID NO: 3759273 - RNA, 21 nt, Salmonella typhimurium LT2
gccccgcuucccgaugccagc

SEQ ID NO: 3759274 - RNA, 21 nt, Salmonella typhimurium LT2
gccccgggcgaccacccgcgg

SEQ ID NO: 3759275 - RNA, 17 nt, Salmonella typhimurium LT2
gccccggucaacgcgcc

SEQ ID NO: 3759276 - RNA, 18 nt, Salmonella typhimurium LT2
gccccggucaacgcgccg

SEQ ID NO: 3759277 - RNA, 17 nt, Salmonella typhimurium LT2
gccccggugagcgccgc

SEQ ID NO: 3759278 - RNA, 23 nt, Salmonella typhimurium LT2
gccccgucagucgccagaaggca

SEQ ID NO: 3759279 - RNA, 17 nt, Salmonella typhimurium LT2
gccccuaaggcagcgag

SEQ ID NO: 3759280 - RNA, 22 nt, Salmonella typhimurium LT2
gccccucgucuucgaccgccau

SEQ ID NO: 3759281 - RNA, 22 nt, Salmonella typhimurium LT2
gccccucuuuuuauuuuauaaa

SEQ ID NO: 3759282 - RNA, 18 nt, Salmonella typhimurium LT2
gccccugagcaaucaguu

SEQ ID NO: 3759283 - RNA, 14 nt, Salmonella typhimurium LT2
gccccugcaggcga

SEQ ID NO: 3759284 - RNA, 17 nt, Salmonella typhimurium LT2
gccccuggcgcgccagc

SEQ ID NO: 3759285 - RNA, 18 nt, Salmonella typhimurium LT2
gccccuguuucgcccgcu

SEQ ID NO: 3759286 - RNA, 20 nt, Salmonella typhimurium LT2
gccccuucaucagccagcau

SEQ ID NO: 3759287 - RNA, 14 nt, Salmonella typhimurium LT2
gccccuuccgccac

SEQ ID NO: 3759288 - RNA, 20 nt, Salmonella typhimurium LT2
gccccuuucgcaaucaugcg

SEQ ID NO: 3759289 - RNA, 15 nt, Salmonella typhimurium LT2
gcccgaaucgccgcu

SEQ ID NO: 3759290 - RNA, 21 nt, Salmonella typhimurium LT2
gcccgacaucaaacugcuggc

SEQ ID NO: 3759291 - RNA, 18 nt, Salmonella typhimurium LT2
gcccgaccacgcccagcu

SEQ ID NO: 3759292 - RNA, 13 nt, Salmonella typhimurium LT2
gcccgacgcgcca

SEQ ID NO: 3759293 - RNA, 19 nt, Salmonella typhimurium LT2
gcccgagcgacgcccugcc

SEQ ID NO: 3759294 - RNA, 21 nt, Salmonella typhimurium LT2
gccgaacgauugacccgccgc

SEQ ID NO: 3759295 - RNA, 23 nt, Salmonella typhimurium LT2
gccgaacgauugacccgccgcac

SEQ ID NO: 3759296 - RNA, 18 nt, Salmonella typhimurium LT2
gccgaacgcggcuuaucc

SEQ ID NO: 3759297 - RNA, 14 nt, Salmonella typhimurium LT2
gccgaagacucccc

SEQ ID NO: 3759298 - RNA, 22 nt, Salmonella typhimurium LT2
gccgaagccauuggucaucauc

SEQ ID NO: 3759299 - RNA, 14 nt, Salmonella typhimurium LT2
gccgaagugcgcgc

SEQ ID NO: 3759300 - RNA, 16 nt, Salmonella typhimurium LT2
gccgaauauugcgcca

SEQ ID NO: 3759301 - RNA, 23 nt, Salmonella typhimurium LT2
gccgaauuuacugugauccacca

SEQ ID NO: 3759302 - RNA, 16 nt, Salmonella typhimurium LT2
gccgacaaauccuccg

SEQ ID NO: 3759303 - RNA, 14 nt, Salmonella typhimurium LT2
gccgacaaccagcg

SEQ ID NO: 3759304 - RNA, 21 nt, Salmonella typhimurium LT2
gccgacagacgccauaucgcc

SEQ ID NO: 3759305 - RNA, 21 nt, Salmonella typhimurium LT2
gccgacagcguaaugcgccag

SEQ ID NO: 3759306 - RNA, 21 nt, Salmonella typhimurium LT2
gccgacaggcagguugccgau

SEQ ID NO: 3759307 - RNA, 21 nt, Salmonella typhimurium LT2
gccgacaucacgcaaaugcag

SEQ ID NO: 3759308 - RNA, 14 nt, Salmonella typhimurium LT2
gccgacaucgccac

SEQ ID NO: 3759309 - RNA, 18 nt, Salmonella typhimurium LT2
gccgacaucgccaccgca

SEQ ID NO: 3759310 - RNA, 14 nt, Salmonella typhimurium LT2
gccgaccaauugca

SEQ ID NO: 3759311 - RNA, 15 nt, Salmonella typhimurium LT2
gccgaccaccagcuu

SEQ ID NO: 3759312 - RNA, 22 nt, Salmonella typhimurium LT2
gccgaccaguaagagaacaaua

SEQ ID NO: 3759313 - RNA, 16 nt, Salmonella typhimurium LT2
gccgaccauccagaca

SEQ ID NO: 3759314 - RNA, 13 nt, Salmonella typhimurium LT2
gccgaccgccagg

SEQ ID NO: 3759315 - RNA, 14 nt, Salmonella typhimurium LT2
gccgaccgccaggu

SEQ ID NO: 3759316 - RNA, 19 nt, Salmonella typhimurium LT2
gccgaccgccaggucggcu

SEQ ID NO: 3759317 - RNA, 16 nt, Salmonella typhimurium LT2
gccgacgauuugcgcu

SEQ ID NO: 3759318 - RNA, 23 nt, Salmonella typhimurium LT2
gccgacgauuugcgcucgcgcca

SEQ ID NO: 3759319 - RNA, 18 nt, Salmonella typhimurium LT2
gccgacgcauuucuccug

SEQ ID NO: 3759320 - RNA, 16 nt, Salmonella typhimurium LT2
gccgacgcucuuccuc

SEQ ID NO: 3759321 - RNA, 15 nt, Salmonella typhimurium LT2
gccgacuauuccgca

SEQ ID NO: 3759322 - RNA, 12 nt, Salmonella typhimurium LT2
gccgagcaucgc

SEQ ID NO: 3759323 - RNA, 20 nt, Salmonella typhimurium LT2
gccgaggcuuaauacagcaa

SEQ ID NO: 3759324 - RNA, 19 nt, Salmonella typhimurium LT2
gccgagggcauugaugguu

SEQ ID NO: 3759325 - RNA, 22 nt, Salmonella typhimurium LT2
gccgagucgguaagucugauaa

SEQ ID NO: 3759326 - RNA, 17 nt, Salmonella typhimurium LT2
gccgauaaccagcgcgc

SEQ ID NO: 3759327 - RNA, 19 nt, Salmonella typhimurium LT2
gccgauaaccagcgcgccg

SEQ ID NO: 3759328 - RNA, 21 nt, Salmonella typhimurium LT2
gccgauaaccagcgcgccgcc

SEQ ID NO: 3759329 - RNA, 22 nt, Salmonella typhimurium LT2
gccgauaaccagcgcgccgcca

SEQ ID NO: 3759330 - RNA, 13 nt, Salmonella typhimurium LT2
gccgauacugccc

SEQ ID NO: 3759331 - RNA, 15 nt, Salmonella typhimurium LT2
gccgauagcggcggc

SEQ ID NO: 3759332 - RNA, 20 nt, Salmonella typhimurium LT2
gccgauaguggucgccacgc

SEQ ID NO: 3759333 - RNA, 20 nt, Salmonella typhimurium LT2
gccgauauugcggccuuccu

SEQ ID NO: 3759334 - RNA, 22 nt, Salmonella typhimurium LT2
gccgauauugcggccuuccuga

SEQ ID NO: 3759335 - RNA, 18 nt, Salmonella typhimurium LT2
gccgaucacaacgucagc

SEQ ID NO: 3759336 - RNA, 15 nt, Salmonella typhimurium LT2
gccgaucaccagcgc

SEQ ID NO: 3759337 - RNA, 17 nt, Salmonella typhimurium LT2
gccgaucaccagcgcau

SEQ ID NO: 3759338 - RNA, 20 nt, Salmonella typhimurium LT2
gccgaucaccagcgcaucgc

SEQ ID NO: 3759339 - RNA, 13 nt, Salmonella typhimurium LT2
gccgaucagcgcc

SEQ ID NO: 3759340 - RNA, 14 nt, Salmonella typhimurium LT2
gccgaucagcgcca

SEQ ID NO: 3759341 - RNA, 12 nt, Salmonella typhimurium LT2
gccgaucaggcc

SEQ ID NO: 3759342 - RNA, 13 nt, Salmonella typhimurium LT2
gccgaucaggccg

SEQ ID NO: 3759343 - RNA, 16 nt, Salmonella typhimurium LT2
gccgaucaggccgcag

SEQ ID NO: 3759344 - RNA, 21 nt, Salmonella typhimurium LT2
gccgaugaacgaugcugauuu

SEQ ID NO: 3759345 - RNA, 15 nt, Salmonella typhimurium LT2
gccgaugaucccggc

SEQ ID NO: 3759346 - RNA, 12 nt, Salmonella typhimurium LT2
gccgaugccgcc

SEQ ID NO: 3759347 - RNA, 15 nt, Salmonella typhimurium LT2
gccgauucccgccug

SEQ ID NO: 3759348 - RNA, 21 nt, Salmonella typhimurium LT2
gccgauuuucuaugugcgcca

SEQ ID NO: 3759349 - RNA, 22 nt, Salmonella typhimurium LT2
gccgauuuucuaugugcgccag

SEQ ID NO: 3759350 - RNA, 14 nt, Salmonella typhimurium LT2
gccgcaaacgccga

SEQ ID NO: 3759351 - RNA, 22 nt, Salmonella typhimurium LT2
gccgcaaacgccugcuccgucc

SEQ ID NO: 3759352 - RNA, 17 nt, Salmonella typhimurium LT2
gccgcaaacucaggagc

SEQ ID NO: 3759353 - RNA, 18 nt, Salmonella typhimurium LT2
gccgcaaacuccaccacg

SEQ ID NO: 3759354 - RNA, 22 nt, Salmonella typhimurium LT2
gccgcaaccaaagccggcgcca

SEQ ID NO: 3759355 - RNA, 14 nt, Salmonella typhimurium LT2
gccgcaacggucgg

SEQ ID NO: 3759356 - RNA, 18 nt, Salmonella typhimurium LT2
gccgcaaugaccacaaau

SEQ ID NO: 3759357 - RNA, 21 nt, Salmonella typhimurium LT2
gccgcaaugaccacaaauucu

SEQ ID NO: 3759358 - RNA, 18 nt, Salmonella typhimurium LT2
gccgcaauuccugacugc

SEQ ID NO: 3759359 - RNA, 16 nt, Salmonella typhimurium LT2
gccgcacuccccagaa

SEQ ID NO: 3759360 - RNA, 21 nt, Salmonella typhimurium LT2
gccgcacuucacgcuccuuga

SEQ ID NO: 3759361 - RNA, 20 nt, Salmonella typhimurium LT2
gccgcagaaaauggucugcu

SEQ ID NO: 3759362 - RNA, 14 nt, Salmonella typhimurium LT2
gccgcagcccgccc

SEQ ID NO: 3759363 - RNA, 18 nt, Salmonella typhimurium LT2
gccgcagccgcucagggu

SEQ ID NO: 3759364 - RNA, 22 nt, Salmonella typhimurium LT2
gccgcagccuaguucugcgcca

SEQ ID NO: 3759365 - RNA, 12 nt, Salmonella typhimurium LT2
gccgcagcgcca

SEQ ID NO: 3759366 - RNA, 12 nt, Salmonella typhimurium LT2
gccgcagcgccg

SEQ ID NO: 3759367 - RNA, 16 nt, Salmonella typhimurium LT2
gccgcagcggcucgcg

SEQ ID NO: 3759368 - RNA, 23 nt, Salmonella typhimurium LT2
gccgcagcucauaacggcuuaac

SEQ ID NO: 3759369 - RNA, 17 nt, Salmonella typhimurium LT2
gccgcaggacagcgaca

SEQ ID NO: 3759370 - RNA, 15 nt, Salmonella typhimurium LT2
gccgcaguugccagg

SEQ ID NO: 3759371 - RNA, 12 nt, Salmonella typhimurium LT2
gccgcauaauag

SEQ ID NO: 3759372 - RNA, 18 nt, Salmonella typhimurium LT2
gccgcauccuguuuuuuc

SEQ ID NO: 3759373 - RNA, 19 nt, Salmonella typhimurium LT2
gccgccaaaaauaucgccg

SEQ ID NO: 3759374 - RNA, 19 nt, Salmonella typhimurium LT2
gccgccaaacugcgcgccg

SEQ ID NO: 3759375 - RNA, 14 nt, Salmonella typhimurium LT2
gccgccaaagcgcc

SEQ ID NO: 3759376 - RNA, 17 nt, Salmonella typhimurium LT2
gccgccaaagcgcccga

SEQ ID NO: 3759377 - RNA, 19 nt, Salmonella typhimurium LT2
gccgccaacgccggcaaca

SEQ ID NO: 3759378 - RNA, 12 nt, Salmonella typhimurium LT2
gccgccagaauc

SEQ ID NO: 3759379 - RNA, 17 nt, Salmonella typhimurium LT2
gccgccagauccuggcu

SEQ ID NO: 3759380 - RNA, 13 nt, Salmonella typhimurium LT2
gccgccagcaaua

SEQ ID NO: 3759381 - RNA, 12 nt, Salmonella typhimurium LT2
gccgccagcgac

SEQ ID NO: 3759382 - RNA, 21 nt, Salmonella typhimurium LT2
gccgccagcgucucagcaggc

SEQ ID NO: 3759383 - RNA, 21 nt, Salmonella typhimurium LT2
gccgccagcgugacccagaca

SEQ ID NO: 3759384 - RNA, 23 nt, Salmonella typhimurium LT2
gccgccagcucgucggccagcgc

SEQ ID NO: 3759385 - RNA, 18 nt, Salmonella typhimurium LT2
gccgccaguucaauaucc

SEQ ID NO: 3759386 - RNA, 17 nt, Salmonella typhimurium LT2
gccgccauaacgccggc

SEQ ID NO: 3759387 - RNA, 19 nt, Salmonella typhimurium LT2
gccgccauaggucagcgcu

SEQ ID NO: 3759388 - RNA, 22 nt, Salmonella typhimurium LT2
gccgccauccggcaauuccgca

SEQ ID NO: 3759389 - RNA, 20 nt, Salmonella typhimurium LT2
gccgccauccggcacaguau

SEQ ID NO: 3759390 - RNA, 14 nt, Salmonella typhimurium LT2
gccgccaucgccag

SEQ ID NO: 3759391 - RNA, 16 nt, Salmonella typhimurium LT2
gccgccaucgccagua

SEQ ID NO: 3759392 - RNA, 18 nt, Salmonella typhimurium LT2
gccgccaucgucgccacc

SEQ ID NO: 3759393 - RNA, 19 nt, Salmonella typhimurium LT2
gccgccaucuccggcagcg

SEQ ID NO: 3759394 - RNA, 22 nt, Salmonella typhimurium LT2
gccgccaucuccggcagcgaau

SEQ ID NO: 3759395 - RNA, 21 nt, Salmonella typhimurium LT2
gccgccauucgcuuccgccgg

SEQ ID NO: 3759396 - RNA, 24 nt, Salmonella typhimurium LT2
gccgccauuuuaucgacacuauuu

SEQ ID NO: 3759397 - RNA, 14 nt, Salmonella typhimurium LT2
gccgcccaccugca

SEQ ID NO: 3759398 - RNA, 21 nt, Salmonella typhimurium LT2
gccggauaagcauuagcgcca

SEQ ID NO: 3759399 - RNA, 22 nt, Salmonella typhimurium LT2
gccggauaagcgaagcgucauc

SEQ ID NO: 3759400 - RNA, 20 nt, Salmonella typhimurium LT2
gccggauaagcgcagcgcca

SEQ ID NO: 3759401 - RNA, 20 nt, Salmonella typhimurium LT2
gccggauaagcguagcgcca

SEQ ID NO: 3759402 - RNA, 21 nt, Salmonella typhimurium LT2
gccggauaagcgucagcgcca

SEQ ID NO: 3759403 - RNA, 21 nt, Salmonella typhimurium LT2
gccggauaagcguuagcgcca

SEQ ID NO: 3759404 - RNA, 17 nt, Salmonella typhimurium LT2
gccggauaaggcgcagc

SEQ ID NO: 3759405 - RNA, 22 nt, Salmonella typhimurium LT2
gccggauaaggcggagccgcca

SEQ ID NO: 3759406 - RNA, 16 nt, Salmonella typhimurium LT2
gccggauaaggcguaa

SEQ ID NO: 3759407 - RNA, 16 nt, Salmonella typhimurium LT2
gccggauaagguguuu

SEQ ID NO: 3759408 - RNA, 13 nt, Salmonella typhimurium LT2
gccggauagcgcu

SEQ ID NO: 3759409 - RNA, 20 nt, Salmonella typhimurium LT2
gccggauagcguagcgccau

SEQ ID NO: 3759410 - RNA, 21 nt, Salmonella typhimurium LT2
gccggauaguaucuuauccgg

SEQ ID NO: 3759411 - RNA, 17 nt, Salmonella typhimurium LT2
gccggaucgggcuucca

SEQ ID NO: 3759412 - RNA, 16 nt, Salmonella typhimurium LT2
gccggaugaccagaac

SEQ ID NO: 3759413 - RNA, 22 nt, Salmonella typhimurium LT2
gccggaugcaagacuuagccca

SEQ ID NO: 3759414 - RNA, 12 nt, Salmonella typhimurium LT2
gccggauggcgc

SEQ ID NO: 3759415 - RNA, 13 nt, Salmonella typhimurium LT2
gccggauggcggc

SEQ ID NO: 3759416 - RNA, 14 nt, Salmonella typhimurium LT2
gccggauggcggcg

SEQ ID NO: 3759417 - RNA, 22 nt, Salmonella typhimurium LT2
gccggauggcgguacagcgagc

SEQ ID NO: 3759418 - RNA, 15 nt, Salmonella typhimurium LT2
gccggauggcgucgc

SEQ ID NO: 3759419 - RNA, 15 nt, Salmonella typhimurium LT2
gccggauggcgucug

SEQ ID NO: 3759420 - RNA, 18 nt, Salmonella typhimurium LT2
gccggauggggcaucagc

SEQ ID NO: 3759421 - RNA, 13 nt, Salmonella typhimurium LT2
gccggaugguggu

SEQ ID NO: 3759422 - RNA, 16 nt, Salmonella typhimurium LT2
gccggaugugagcgca

SEQ ID NO: 3759423 - RNA, 17 nt, Salmonella typhimurium LT2
gccggaugugagcgcau

SEQ ID NO: 3759424 - RNA, 19 nt, Salmonella typhimurium LT2
gccggcaaaaccaugcacc

SEQ ID NO: 3759425 - RNA, 13 nt, Salmonella typhimurium LT2
gccggcaaagcca

SEQ ID NO: 3759426 - RNA, 13 nt, Salmonella typhimurium LT2
gccggcagccugc

SEQ ID NO: 3759427 - RNA, 15 nt, Salmonella typhimurium LT2
gccggcaucauucug

SEQ ID NO: 3759428 - RNA, 21 nt, Salmonella typhimurium LT2
gccggccgcaguuuuccagcg

SEQ ID NO: 3759429 - RNA, 23 nt, Salmonella typhimurium LT2
gccggcuaucuucuuccggcgcg

SEQ ID NO: 3759430 - RNA, 17 nt, Salmonella typhimurium LT2
gccggcuucuccaccau

SEQ ID NO: 3759431 - RNA, 23 nt, Salmonella typhimurium LT2
gccggcuucuuccggccccggga

SEQ ID NO: 3759432 - RNA, 15 nt, Salmonella typhimurium LT2
gccgggaucagcggc

SEQ ID NO: 3759433 - RNA, 18 nt, Salmonella typhimurium LT2
gccgggcauaaacuaauc

SEQ ID NO: 3759434 - RNA, 13 nt, Salmonella typhimurium LT2
gccgggccgccga

SEQ ID NO: 3759435 - RNA, 13 nt, Salmonella typhimurium LT2
gccgggcggcugu

SEQ ID NO: 3759436 - RNA, 20 nt, Salmonella typhimurium LT2
gccgggcggcuguguccgcc

SEQ ID NO: 3759437 - RNA, 23 nt, Salmonella typhimurium LT2
gccgggcggcuguguccgccaug

SEQ ID NO: 3759438 - RNA, 15 nt, Salmonella typhimurium LT2
gccgggcugaccgcu

SEQ ID NO: 3759439 - RNA, 16 nt, Salmonella typhimurium LT2
gccgggcuucauaccg

SEQ ID NO: 3759440 - RNA, 12 nt, Salmonella typhimurium LT2
gccggguuaaaa

SEQ ID NO: 3759441 - RNA, 14 nt, Salmonella typhimurium LT2
gccggguuuaaugc

SEQ ID NO: 3759442 - RNA, 20 nt, Salmonella typhimurium LT2
gccgguaaagugacggcgcu

SEQ ID NO: 3759443 - RNA, 15 nt, Salmonella typhimurium LT2
gccgguacgcagcag

SEQ ID NO: 3759444 - RNA, 17 nt, Salmonella typhimurium LT2
gccgguacgcagcaggc

SEQ ID NO: 3759445 - RNA, 20 nt, Salmonella typhimurium LT2
gccgguacgcagcaggcaga

SEQ ID NO: 3759446 - RNA, 19 nt, Salmonella typhimurium LT2
gccgguacgggcagcggcu

SEQ ID NO: 3759447 - RNA, 18 nt, Salmonella typhimurium LT2
gccgguagcuucagcggc

SEQ ID NO: 3759448 - RNA, 13 nt, Salmonella typhimurium LT2
gccgguauccagc

SEQ ID NO: 3759449 - RNA, 14 nt, Salmonella typhimurium LT2
gccggucagcguca

SEQ ID NO: 3759450 - RNA, 22 nt, Salmonella typhimurium LT2
gccggucaggauacagccgacu

SEQ ID NO: 3759451 - RNA, 21 nt, Salmonella typhimurium LT2
gccggucaugccaucccgcga

SEQ ID NO: 3759452 - RNA, 21 nt, Salmonella typhimurium LT2
gccggucuuaugcugccagcg

SEQ ID NO: 3759453 - RNA, 16 nt, Salmonella typhimurium LT2
gccgguguuaaccaga

SEQ ID NO: 3759454 - RNA, 16 nt, Salmonella typhimurium LT2
gccgguuauaccgcca

SEQ ID NO: 3759455 - RNA, 20 nt, Salmonella typhimurium LT2
gccgguuccggcauaaauaa

SEQ ID NO: 3759456 - RNA, 14 nt, Salmonella typhimurium LT2
gccgguucgcgacu

SEQ ID NO: 3759457 - RNA, 19 nt, Salmonella typhimurium LT2
gccgguucggcaucgcccg

SEQ ID NO: 3759458 - RNA, 19 nt, Salmonella typhimurium LT2
gccgguucucccaccgcgc

SEQ ID NO: 3759459 - RNA, 16 nt, Salmonella typhimurium LT2
gccgguugcgcugguu

SEQ ID NO: 3759460 - RNA, 18 nt, Salmonella typhimurium LT2
gccgguugggcgcuuaac

SEQ ID NO: 3759461 - RNA, 16 nt, Salmonella typhimurium LT2
gccgguuucauaacac

SEQ ID NO: 3759462 - RNA, 17 nt, Salmonella typhimurium LT2
gccguaaacaggcaggc

SEQ ID NO: 3759463 - RNA, 17 nt, Salmonella typhimurium LT2
gccguaaauuccuuguu

SEQ ID NO: 3759464 - RNA, 17 nt, Salmonella typhimurium LT2
gccguaaauugagugga

SEQ ID NO: 3759465 - RNA, 24 nt, Salmonella typhimurium LT2
gccguaacgugcuccagcgccugc

SEQ ID NO: 3759466 - RNA, 22 nt, Salmonella typhimurium LT2
gccguaaggcgugccgccgcga

SEQ ID NO: 3759467 - RNA, 19 nt, Salmonella typhimurium LT2
gccguaccguugccgccga

SEQ ID NO: 3759468 - RNA, 16 nt, Salmonella typhimurium LT2
gccguacuccagccca

SEQ ID NO: 3759469 - RNA, 19 nt, Salmonella typhimurium LT2
gccguacuccagcccauca

SEQ ID NO: 3759470 - RNA, 18 nt, Salmonella typhimurium LT2
gccguagcccgcuuuacc

SEQ ID NO: 3759471 - RNA, 19 nt, Salmonella typhimurium LT2
gccguaguuauccuucacg

SEQ ID NO: 3759472 - RNA, 17 nt, Salmonella typhimurium LT2
gccguauaccagcguca

SEQ ID NO: 3759473 - RNA, 19 nt, Salmonella typhimurium LT2
gccguauaccagcgucagc

SEQ ID NO: 3759474 - RNA, 23 nt, Salmonella typhimurium LT2
gccguauaccagcgucagcgggc

SEQ ID NO: 3759475 - RNA, 17 nt, Salmonella typhimurium LT2
gccgucacagagagcgu

SEQ ID NO: 3759476 - RNA, 19 nt, Salmonella typhimurium LT2
gccgucacucccugcguca

SEQ ID NO: 3759477 - RNA, 21 nt, Salmonella typhimurium LT2
gccgucaggcuugccgcgcca

SEQ ID NO: 3759478 - RNA, 17 nt, Salmonella typhimurium LT2
gccgucagugagcccuc

SEQ ID NO: 3759479 - RNA, 16 nt, Salmonella typhimurium LT2
gccgucauccagcagc

SEQ ID NO: 3759480 - RNA, 12 nt, Salmonella typhimurium LT2
gccgucccagcg

SEQ ID NO: 3759481 - RNA, 20 nt, Salmonella typhimurium LT2
gccgucgaugauggcggcua

SEQ ID NO: 3759482 - RNA, 21 nt, Salmonella typhimurium LT2
gccgucgauuuaaugccuauc

SEQ ID NO: 3759483 - RNA, 15 nt, Salmonella typhimurium LT2
gccgucgccggccug

SEQ ID NO: 3759484 - RNA, 22 nt, Salmonella typhimurium LT2
gccgucggcgauauuuccacgg

SEQ ID NO: 3759485 - RNA, 15 nt, Salmonella typhimurium LT2
gccgucggcgccagc

SEQ ID NO: 3759486 - RNA, 18 nt, Salmonella typhimurium LT2
gccgucggcgccagccac

SEQ ID NO: 3759487 - RNA, 17 nt, Salmonella typhimurium LT2
gccgucgucaccgccgc

SEQ ID NO: 3759488 - RNA, 19 nt, Salmonella typhimurium LT2
gccgucgucaccgccgcgc

SEQ ID NO: 3759489 - RNA, 17 nt, Salmonella typhimurium LT2
gccgucguucagccagc

SEQ ID NO: 3759490 - RNA, 18 nt, Salmonella typhimurium LT2
gccgucucaaccagcaau

SEQ ID NO: 3759491 - RNA, 20 nt, Salmonella typhimurium LT2
gccgucuggggaaaccugaa

SEQ ID NO: 3759492 - RNA, 13 nt, Salmonella typhimurium LT2
gccgucuucuucu

SEQ ID NO: 3759493 - RNA, 23 nt, Salmonella typhimurium LT2
gccgucuuuggcucuuagcagca

SEQ ID NO: 3759494 - RNA, 19 nt, Salmonella typhimurium LT2
gccgugaauaaaaccggca

SEQ ID NO: 3759495 - RNA, 12 nt, Salmonella typhimurium LT2
gccgugacacac

SEQ ID NO: 3759496 - RNA, 12 nt, Salmonella typhimurium LT2
gccgugauucau

SEQ ID NO: 3759497 - RNA, 21 nt, Salmonella typhimurium LT2
gccgugcccagcaucccgcug

SEQ ID NO: 3759498 - RNA, 21 nt, Salmonella typhimurium LT2
gccgugccugacguccacgga

SEQ ID NO: 3759499 - RNA, 16 nt, Salmonella typhimurium LT2
gccgugcucauccaac

SEQ ID NO: 3759500 - RNA, 22 nt, Salmonella typhimurium LT2
gccgugcucauccaacugcgcc

SEQ ID NO: 3759501 - RNA, 13 nt, Salmonella typhimurium LT2
gccugauggcgcu

SEQ ID NO: 3759502 - RNA, 22 nt, Salmonella typhimurium LT2
gccugauggcgcuacgcuuauc

SEQ ID NO: 3759503 - RNA, 17 nt, Salmonella typhimurium LT2
gccugauggcgcugcgc

SEQ ID NO: 3759504 - RNA, 21 nt, Salmonella typhimurium LT2
gccugauggcgcugcgccauc

SEQ ID NO: 3759505 - RNA, 19 nt, Salmonella typhimurium LT2
gccugauggcgcugcgcuu

SEQ ID NO: 3759506 - RNA, 18 nt, Salmonella typhimurium LT2
gccugauuucugaccgca

SEQ ID NO: 3759507 - RNA, 20 nt, Salmonella typhimurium LT2
gccugcaaaccucucccccg

SEQ ID NO: 3759508 - RNA, 20 nt, Salmonella typhimurium LT2
gccugcacggcgucauccac

SEQ ID NO: 3759509 - RNA, 14 nt, Salmonella typhimurium LT2
gccugcaggcaacg

SEQ ID NO: 3759510 - RNA, 21 nt, Salmonella typhimurium LT2
gccugcaguuuugcauucugc

SEQ ID NO: 3759511 - RNA, 20 nt, Salmonella typhimurium LT2
gccugcaugacccauuauuc

SEQ ID NO: 3759512 - RNA, 20 nt, Salmonella typhimurium LT2
gccugcaugauuaauacgua

SEQ ID NO: 3759513 - RNA, 21 nt, Salmonella typhimurium LT2
gccugccagauccaacacauc

SEQ ID NO: 3759514 - RNA, 13 nt, Salmonella typhimurium LT2
gccugccagcacc

SEQ ID NO: 3759515 - RNA, 21 nt, Salmonella typhimurium LT2
gccugcccacuuugccaugaa

SEQ ID NO: 3759516 - RNA, 15 nt, Salmonella typhimurium LT2
gccugccgcagcggc

SEQ ID NO: 3759517 - RNA, 19 nt, Salmonella typhimurium LT2
gccugccgcauguccccag

SEQ ID NO: 3759518 - RNA, 18 nt, Salmonella typhimurium LT2
gccugccgggccugcggc

SEQ ID NO: 3759519 - RNA, 19 nt, Salmonella typhimurium LT2
gccugccguaacgccgucg

SEQ ID NO: 3759520 - RNA, 16 nt, Salmonella typhimurium LT2
gccugccgucgcggcu

SEQ ID NO: 3759521 - RNA, 21 nt, Salmonella typhimurium LT2
gccugccgucgcggcuuucag

SEQ ID NO: 3759522 - RNA, 15 nt, Salmonella typhimurium LT2
gccugccguuuuuaa

SEQ ID NO: 3759523 - RNA, 18 nt, Salmonella typhimurium LT2
gccugccguuuuuaacac

SEQ ID NO: 3759524 - RNA, 15 nt, Salmonella typhimurium LT2
gccugccugaagcgc

SEQ ID NO: 3759525 - RNA, 16 nt, Salmonella typhimurium LT2
gccugcgaaacagggc

SEQ ID NO: 3759526 - RNA, 14 nt, Salmonella typhimurium LT2
gccugcgaagauga

SEQ ID NO: 3759527 - RNA, 17 nt, Salmonella typhimurium LT2
gccugcgaaugcaggcc

SEQ ID NO: 3759528 - RNA, 16 nt, Salmonella typhimurium LT2
gccugcgaucuguguc

SEQ ID NO: 3759529 - RNA, 21 nt, Salmonella typhimurium LT2
gccugcgccaguucauccagc

SEQ ID NO: 3759530 - RNA, 12 nt, Salmonella typhimurium LT2
gccugcgcggca

SEQ ID NO: 3759531 - RNA, 13 nt, Salmonella typhimurium LT2
gccugcgcggcaa

SEQ ID NO: 3759532 - RNA, 21 nt, Salmonella typhimurium LT2
gccugcgcggcaauuuccgcu

SEQ ID NO: 3759533 - RNA, 21 nt, Salmonella typhimurium LT2
gccugcggauucaggacgaga

SEQ ID NO: 3759534 - RNA, 20 nt, Salmonella typhimurium LT2
gccugcgguaaucgccgcga

SEQ ID NO: 3759535 - RNA, 16 nt, Salmonella typhimurium LT2
gccugcgucaucccca

SEQ ID NO: 3759536 - RNA, 14 nt, Salmonella typhimurium LT2
gccugcgugcgccg

SEQ ID NO: 3759537 - RNA, 22 nt, Salmonella typhimurium LT2
gccugcguuugcggaucgaucu

SEQ ID NO: 3759538 - RNA, 13 nt, Salmonella typhimurium LT2
gccugcuccacca

SEQ ID NO: 3759539 - RNA, 15 nt, Salmonella typhimurium LT2
gccugcuccaccagc

SEQ ID NO: 3759540 - RNA, 22 nt, Salmonella typhimurium LT2
gccugcuccguaucgugcugcu

SEQ ID NO: 3759541 - RNA, 22 nt, Salmonella typhimurium LT2
gccugcugcagacugccggcaa

SEQ ID NO: 3759542 - RNA, 18 nt, Salmonella typhimurium LT2
gccugcuggaaaggccgc

SEQ ID NO: 3759543 - RNA, 17 nt, Salmonella typhimurium LT2
gccugcuuaaacagaau

SEQ ID NO: 3759544 - RNA, 18 nt, Salmonella typhimurium LT2
gccugcuuaaacagaauu

SEQ ID NO: 3759545 - RNA, 18 nt, Salmonella typhimurium LT2
gccugcuuuaacgcgcca

SEQ ID NO: 3759546 - RNA, 16 nt, Salmonella typhimurium LT2
gccugcuuugaccugu

SEQ ID NO: 3759547 - RNA, 18 nt, Salmonella typhimurium LT2
gccugcuuugaccuguuu

SEQ ID NO: 3759548 - RNA, 17 nt, Salmonella typhimurium LT2
gccuggagagcagcgcc

SEQ ID NO: 3759549 - RNA, 14 nt, Salmonella typhimurium LT2
gccuggaucugcgc

SEQ ID NO: 3759550 - RNA, 22 nt, Salmonella typhimurium LT2
gccuggcagaaguccccagccg

SEQ ID NO: 3759551 - RNA, 21 nt, Salmonella typhimurium LT2
gccuggcauuuuacuucugac

SEQ ID NO: 3759552 - RNA, 17 nt, Salmonella typhimurium LT2
gccuggccuucaaucag

SEQ ID NO: 3759553 - RNA, 14 nt, Salmonella typhimurium LT2
gccuggcgcagcgc

SEQ ID NO: 3759554 - RNA, 15 nt, Salmonella typhimurium LT2
gccuggcgcagcgcu

SEQ ID NO: 3759555 - RNA, 20 nt, Salmonella typhimurium LT2
gccuggcggcagaccgcaac

SEQ ID NO: 3759556 - RNA, 16 nt, Salmonella typhimurium LT2
gccugggauaagcaga

SEQ ID NO: 3759557 - RNA, 15 nt, Salmonella typhimurium LT2
gccugggaucgcauc

SEQ ID NO: 3759558 - RNA, 18 nt, Salmonella typhimurium LT2
gccugggggggaaaccca

SEQ ID NO: 3759559 - RNA, 19 nt, Salmonella typhimurium LT2
gccugggggggaaacccac

SEQ ID NO: 3759560 - RNA, 18 nt, Salmonella typhimurium LT2
gccugguaagcgcagcgc

SEQ ID NO: 3759561 - RNA, 20 nt, Salmonella typhimurium LT2
gccugguaagcguagcgcca

SEQ ID NO: 3759562 - RNA, 20 nt, Salmonella typhimurium LT2
gccuggugcgggucaaaagc

SEQ ID NO: 3759563 - RNA, 21 nt, Salmonella typhimurium LT2
gccuggugcgggucaaaagcg

SEQ ID NO: 3759564 - RNA, 22 nt, Salmonella typhimurium LT2
gccuggugcgggucaaaagcgu

SEQ ID NO: 3759565 - RNA, 21 nt, Salmonella typhimurium LT2
gccugguggcgacgcguggca

SEQ ID NO: 3759566 - RNA, 22 nt, Salmonella typhimurium LT2
gccugguuuaagaugccggggc

SEQ ID NO: 3759567 - RNA, 19 nt, Salmonella typhimurium LT2
gccuguaaaacaacccccg

SEQ ID NO: 3759568 - RNA, 17 nt, Salmonella typhimurium LT2
gccuguaaugccgccug

SEQ ID NO: 3759569 - RNA, 18 nt, Salmonella typhimurium LT2
gccuguaccgcuucccgc

SEQ ID NO: 3759570 - RNA, 21 nt, Salmonella typhimurium LT2
gccuguaccgcuucccgcguc

SEQ ID NO: 3759571 - RNA, 16 nt, Salmonella typhimurium LT2
gccuguacuugcgccg

SEQ ID NO: 3759572 - RNA, 21 nt, Salmonella typhimurium LT2
gccuguacuugcgccgccauc

SEQ ID NO: 3759573 - RNA, 16 nt, Salmonella typhimurium LT2
gccugucaggaugaaa

SEQ ID NO: 3759574 - RNA, 13 nt, Salmonella typhimurium LT2
gccuguccggccu

SEQ ID NO: 3759575 - RNA, 20 nt, Salmonella typhimurium LT2
gccugucgccgucaauguca

SEQ ID NO: 3759576 - RNA, 19 nt, Salmonella typhimurium LT2
gccugucuccgcagcaggc

SEQ ID NO: 3759577 - RNA, 17 nt, Salmonella typhimurium LT2
gccugugccagcucguu

SEQ ID NO: 3759578 - RNA, 12 nt, Salmonella typhimurium LT2
gccuguuagggc

SEQ ID NO: 3759579 - RNA, 13 nt, Salmonella typhimurium LT2
gccuguucaucag

SEQ ID NO: 3759580 - RNA, 15 nt, Salmonella typhimurium LT2
gccuguucaucaggu

SEQ ID NO: 3759581 - RNA, 19 nt, Salmonella typhimurium LT2
gccuguucgugcguuguca

SEQ ID NO: 3759582 - RNA, 19 nt, Salmonella typhimurium LT2
gccuguucuucaguaauuu

SEQ ID NO: 3759583 - RNA, 22 nt, Salmonella typhimurium LT2
gccuguuugacgaaaucgcaua

SEQ ID NO: 3759584 - RNA, 16 nt, Salmonella typhimurium LT2
gccuuaaaaagaacaa

SEQ ID NO: 3759585 - RNA, 14 nt, Salmonella typhimurium LT2
gccuuacccggccu

SEQ ID NO: 3759586 - RNA, 23 nt, Salmonella typhimurium LT2
gccuuacggugcguggcgcuggg

SEQ ID NO: 3759587 - RNA, 13 nt, Salmonella typhimurium LT2
gccuuacguaccg

SEQ ID NO: 3759588 - RNA, 19 nt, Salmonella typhimurium LT2
gccuuaucaggccuguggu

SEQ ID NO: 3759589 - RNA, 14 nt, Salmonella typhimurium LT2
gccuuauccggccu

SEQ ID NO: 3759590 - RNA, 17 nt, Salmonella typhimurium LT2
gccuuauccggccugca

SEQ ID NO: 3759591 - RNA, 21 nt, Salmonella typhimurium LT2
gccuuauccggccugcaggca

SEQ ID NO: 3759592 - RNA, 20 nt, Salmonella typhimurium LT2
gccuuauugugccgcggcuu

SEQ ID NO: 3759593 - RNA, 13 nt, Salmonella typhimurium LT2
gccuucaauaagu

SEQ ID NO: 3759594 - RNA, 16 nt, Salmonella typhimurium LT2
gccuucaauuccugga

SEQ ID NO: 3759595 - RNA, 17 nt, Salmonella typhimurium LT2
gccuucacacugcgccg

SEQ ID NO: 3759596 - RNA, 20 nt, Salmonella typhimurium LT2
gccuucacacugcgccgcca

SEQ ID NO: 3759597 - RNA, 14 nt, Salmonella typhimurium LT2
gccuucaccccuuc

SEQ ID NO: 3759598 - RNA, 22 nt, Salmonella typhimurium LT2
gccuucacgcauucuuuuuucu

SEQ ID NO: 3759599 - RNA, 24 nt, Salmonella typhimurium LT2
gccuucagccugaaucagcaucuu

SEQ ID NO: 3759600 - RNA, 15 nt, Salmonella typhimurium LT2
gccuucagcgcgccc

SEQ ID NO: 3759601 - RNA, 13 nt, Salmonella typhimurium LT2
gccuuccagaaau

SEQ ID NO: 3759602 - RNA, 18 nt, Salmonella typhimurium LT2
gccuuccagugcggcgag

SEQ ID NO: 3759603 - RNA, 22 nt, Salmonella typhimurium LT2
gccuucccgauaaccgcguuca

SEQ ID NO: 3759604 - RNA, 15 nt, Salmonella typhimurium LT2
gcgacaccacgcagg

SEQ ID NO: 3759605 - RNA, 18 nt, Salmonella typhimurium LT2
gcgacaccacgcaggcga

SEQ ID NO: 3759606 - RNA, 19 nt, Salmonella typhimurium LT2
gcgacacgcgcgcugcgcc

SEQ ID NO: 3759607 - RNA, 20 nt, Salmonella typhimurium LT2
gcgacacgcgcgcugcgccu

SEQ ID NO: 3759608 - RNA, 12 nt, Salmonella typhimurium LT2
gcgacagcgcca

SEQ ID NO: 3759609 - RNA, 13 nt, Salmonella typhimurium LT2
gcgacagcgccau

SEQ ID NO: 3759610 - RNA, 13 nt, Salmonella typhimurium LT2
gcgacagcgcgcc

SEQ ID NO: 3759611 - RNA, 15 nt, Salmonella typhimurium LT2
gcgacaguaguauca

SEQ ID NO: 3759612 - RNA, 14 nt, Salmonella typhimurium LT2
gcgacaucagccag

SEQ ID NO: 3759613 - RNA, 18 nt, Salmonella typhimurium LT2
gcgaccaauauccgcagg

SEQ ID NO: 3759614 - RNA, 21 nt, Salmonella typhimurium LT2
gcgaccaauauccgcaggcga

SEQ ID NO: 3759615 - RNA, 14 nt, Salmonella typhimurium LT2
gcgaccacgccacc

SEQ ID NO: 3759616 - RNA, 13 nt, Salmonella typhimurium LT2
gcgaccacgccag

SEQ ID NO: 3759617 - RNA, 17 nt, Salmonella typhimurium LT2
gcgaccacgccagccag

SEQ ID NO: 3759618 - RNA, 12 nt, Salmonella typhimurium LT2
gcgaccagcgca

SEQ ID NO: 3759619 - RNA, 21 nt, Salmonella typhimurium LT2
gcgaccaguuauucggcauau

SEQ ID NO: 3759620 - RNA, 22 nt, Salmonella typhimurium LT2
gcgacccguuuuuuauucuccc

SEQ ID NO: 3759621 - RNA, 21 nt, Salmonella typhimurium LT2
gcgaccgcaucaaugcccagc

SEQ ID NO: 3759622 - RNA, 14 nt, Salmonella typhimurium LT2
gcgaccgccaccau

SEQ ID NO: 3759623 - RNA, 20 nt, Salmonella typhimurium LT2
gcgaccgcgccggucgccag

SEQ ID NO: 3759624 - RNA, 13 nt, Salmonella typhimurium LT2
gcgaccggcagcc

SEQ ID NO: 3759625 - RNA, 15 nt, Salmonella typhimurium LT2
gcgaccucaucaaac

SEQ ID NO: 3759626 - RNA, 14 nt, Salmonella typhimurium LT2
gcgacgacgcuggu

SEQ ID NO: 3759627 - RNA, 19 nt, Salmonella typhimurium LT2
gcgacgacuucacccgcgg

SEQ ID NO: 3759628 - RNA, 22 nt, Salmonella typhimurium LT2
gcgacgacuucacccgcgggcg

SEQ ID NO: 3759629 - RNA, 16 nt, Salmonella typhimurium LT2
gcgacgauagucagcg

SEQ ID NO: 3759630 - RNA, 19 nt, Salmonella typhimurium LT2
gcgacgaucagcgccacgc

SEQ ID NO: 3759631 - RNA, 16 nt, Salmonella typhimurium LT2
gcgacgcuuaucagcc

SEQ ID NO: 3759632 - RNA, 16 nt, Salmonella typhimurium LT2
gcgacggaccggcagc

SEQ ID NO: 3759633 - RNA, 16 nt, Salmonella typhimurium LT2
gcgacggacucgcgca

SEQ ID NO: 3759634 - RNA, 17 nt, Salmonella typhimurium LT2
gcgacggagcgugcugu

SEQ ID NO: 3759635 - RNA, 23 nt, Salmonella typhimurium LT2
gcgacggcaucggcaucuuccuu

SEQ ID NO: 3759636 - RNA, 22 nt, Salmonella typhimurium LT2
gcgacggcgcgccaaacggcag

SEQ ID NO: 3759637 - RNA, 21 nt, Salmonella typhimurium LT2
gcgacggcuaucgucguauua

SEQ ID NO: 3759638 - RNA, 16 nt, Salmonella typhimurium LT2
gcgacgguaaaaauau

SEQ ID NO: 3759639 - RNA, 18 nt, Salmonella typhimurium LT2
gcgacguauuacgcaggc

SEQ ID NO: 3759640 - RNA, 17 nt, Salmonella typhimurium LT2
gcgacgugacgcgccag

SEQ ID NO: 3759641 - RNA, 17 nt, Salmonella typhimurium LT2
gcgacguuaacgccgcc

SEQ ID NO: 3759642 - RNA, 14 nt, Salmonella typhimurium LT2
gcgacguuccgcga

SEQ ID NO: 3759643 - RNA, 21 nt, Salmonella typhimurium LT2
gcgacguuuucaauaucggcg

SEQ ID NO: 3759644 - RNA, 22 nt, Salmonella typhimurium LT2
gcgacuacgguaaaccaggcca

SEQ ID NO: 3759645 - RNA, 20 nt, Salmonella typhimurium LT2
gcgacuaucccucugaagcg

SEQ ID NO: 3759646 - RNA, 16 nt, Salmonella typhimurium LT2
gcgacuaucgccgccc

SEQ ID NO: 3759647 - RNA, 15 nt, Salmonella typhimurium LT2
gcgacuccaggaaca

SEQ ID NO: 3759648 - RNA, 23 nt, Salmonella typhimurium LT2
gcgacucgccguuuuaucgcccg

SEQ ID NO: 3759649 - RNA, 16 nt, Salmonella typhimurium LT2
gcgacucggugccgcu

SEQ ID NO: 3759650 - RNA, 16 nt, Salmonella typhimurium LT2
gcgacugaaaaucaaa

SEQ ID NO: 3759651 - RNA, 15 nt, Salmonella typhimurium LT2
gcgacugcugauauu

SEQ ID NO: 3759652 - RNA, 17 nt, Salmonella typhimurium LT2
gcgacugcuucgcuggc

SEQ ID NO: 3759653 - RNA, 18 nt, Salmonella typhimurium LT2
gcgacuggaacgucauca

SEQ ID NO: 3759654 - RNA, 16 nt, Salmonella typhimurium LT2
gcgacuucagauaccg

SEQ ID NO: 3759655 - RNA, 20 nt, Salmonella typhimurium LT2
gcgacuuugcgccggcaguc

SEQ ID NO: 3759656 - RNA, 11 nt, Salmonella typhimurium LT2
gcgagaaaaaa

SEQ ID NO: 3759657 - RNA, 16 nt, Salmonella typhimurium LT2
gcgagaaaaucccauu

SEQ ID NO: 3759658 - RNA, 14 nt, Salmonella typhimurium LT2
gcgagaaucgccag

SEQ ID NO: 3759659 - RNA, 17 nt, Salmonella typhimurium LT2
gcgagaaugucgccaug

SEQ ID NO: 3759660 - RNA, 13 nt, Salmonella typhimurium LT2
gcgagaccauauu

SEQ ID NO: 3759661 - RNA, 17 nt, Salmonella typhimurium LT2
gcgagaccauauugaag

SEQ ID NO: 3759662 - RNA, 15 nt, Salmonella typhimurium LT2
gcgagagaaaaaaau

SEQ ID NO: 3759663 - RNA, 23 nt, Salmonella typhimurium LT2
gcgagagaauuaacagcgcgacc

SEQ ID NO: 3759664 - RNA, 23 nt, Salmonella typhimurium LT2
gcgagauaaccaucgcgcagcca

SEQ ID NO: 3759665 - RNA, 14 nt, Salmonella typhimurium LT2
gcgagcagaaaaag

SEQ ID NO: 3759666 - RNA, 18 nt, Salmonella typhimurium LT2
gcgagcaguucagcagca

SEQ ID NO: 3759667 - RNA, 11 nt, Salmonella typhimurium LT2
gcgagcccugu

SEQ ID NO: 3759668 - RNA, 15 nt, Salmonella typhimurium LT2
gcgagccuucaacaa

SEQ ID NO: 3759669 - RNA, 19 nt, Salmonella typhimurium LT2
gcgagccuucaacaaaguu

SEQ ID NO: 3759670 - RNA, 14 nt, Salmonella typhimurium LT2
gcgagcgauagaga

SEQ ID NO: 3759671 - RNA, 19 nt, Salmonella typhimurium LT2
gcgagcgcauacgcugucc

SEQ ID NO: 3759672 - RNA, 19 nt, Salmonella typhimurium LT2
gcgagcuucucgccggaaa

SEQ ID NO: 3759673 - RNA, 22 nt, Salmonella typhimurium LT2
gcgaggaaaaucgcugcgcccg

SEQ ID NO: 3759674 - RNA, 22 nt, Salmonella typhimurium LT2
gcgaggaacaucagccagcagc

SEQ ID NO: 3759675 - RNA, 22 nt, Salmonella typhimurium LT2
gcgaggcaacagauacggcgcg

SEQ ID NO: 3759676 - RNA, 16 nt, Salmonella typhimurium LT2
gcgaggcgauaaucuu

SEQ ID NO: 3759677 - RNA, 20 nt, Salmonella typhimurium LT2
gcgaggucuggucagcgaug

SEQ ID NO: 3759678 - RNA, 18 nt, Salmonella typhimurium LT2
gcgaguaaccuuucaccu

SEQ ID NO: 3759679 - RNA, 20 nt, Salmonella typhimurium LT2
gcgagucccuaauagcgcca

SEQ ID NO: 3759680 - RNA, 15 nt, Salmonella typhimurium LT2
gcgaguuaagcgccc

SEQ ID NO: 3759681 - RNA, 18 nt, Salmonella typhimurium LT2
gcgauaaaaaacgcccag

SEQ ID NO: 3759682 - RNA, 18 nt, Salmonella typhimurium LT2
gcgauaaaaauauccgcc

SEQ ID NO: 3759683 - RNA, 13 nt, Salmonella typhimurium LT2
gcgauaaaccagc

SEQ ID NO: 3759684 - RNA, 14 nt, Salmonella typhimurium LT2
gcgauaaaccagcc

SEQ ID NO: 3759685 - RNA, 18 nt, Salmonella typhimurium LT2
gcgauaaacucagcgcca

SEQ ID NO: 3759686 - RNA, 21 nt, Salmonella typhimurium LT2
gcgauaagauccgggcuggca

SEQ ID NO: 3759687 - RNA, 16 nt, Salmonella typhimurium LT2
gcgauaauagaaccca

SEQ ID NO: 3759688 - RNA, 19 nt, Salmonella typhimurium LT2
gcgauaaucaacucuccuu

SEQ ID NO: 3759689 - RNA, 18 nt, Salmonella typhimurium LT2
gcgauaaugacgaucaac

SEQ ID NO: 3759690 - RNA, 21 nt, Salmonella typhimurium LT2
gcgauacaaggcaaucugauc

SEQ ID NO: 3759691 - RNA, 20 nt, Salmonella typhimurium LT2
gcgauacgcacaucaauaaa

SEQ ID NO: 3759692 - RNA, 22 nt, Salmonella typhimurium LT2
gcgauacgcgcguucguugaug

SEQ ID NO: 3759693 - RNA, 19 nt, Salmonella typhimurium LT2
gcgauacucucgcagcgaa

SEQ ID NO: 3759694 - RNA, 18 nt, Salmonella typhimurium LT2
gcgauacucugcccgccg

SEQ ID NO: 3759695 - RNA, 17 nt, Salmonella typhimurium LT2
gcgauacugacgagcga

SEQ ID NO: 3759696 - RNA, 23 nt, Salmonella typhimurium LT2
gcgauacugccgcccaucgccac

SEQ ID NO: 3759697 - RNA, 21 nt, Salmonella typhimurium LT2
gcgauagagaccgcuuuagcc

SEQ ID NO: 3759698 - RNA, 17 nt, Salmonella typhimurium LT2
gcgauagagcgcgguca

SEQ ID NO: 3759699 - RNA, 21 nt, Salmonella typhimurium LT2
gcgauauccacaauguugaug

SEQ ID NO: 3759700 - RNA, 16 nt, Salmonella typhimurium LT2
gcgauauccagcgcca

SEQ ID NO: 3759701 - RNA, 19 nt, Salmonella typhimurium LT2
gcgauauccagcgccagga

SEQ ID NO: 3759702 - RNA, 18 nt, Salmonella typhimurium LT2
gcgauaucugccgcgcca

SEQ ID NO: 3759703 - RNA, 20 nt, Salmonella typhimurium LT2
gcgauauguuugcgcgucgg

SEQ ID NO: 3759704 - RNA, 16 nt, Salmonella typhimurium LT2
gcgauauuuccacggu

SEQ ID NO: 3759705 - RNA, 23 nt, Salmonella typhimurium LT2
gcgauauuucuccgcccauccag

SEQ ID NO: 3759706 - RNA, 12 nt, Salmonella typhimurium LT2
gcgaucaccacg

SEQ ID NO: 3759707 - RNA, 13 nt, Salmonella typhimurium LT2
gcgaucaccagca

SEQ ID NO: 3759708 - RNA, 15 nt, Salmonella typhimurium LT2
gcgcaucauggucgu

SEQ ID NO: 3759709 - RNA, 19 nt, Salmonella typhimurium LT2
gcgcaucccacaccacacg

SEQ ID NO: 3759710 - RNA, 13 nt, Salmonella typhimurium LT2
gcgcauccggcau

SEQ ID NO: 3759711 - RNA, 19 nt, Salmonella typhimurium LT2
gcgcauccugcaaaaggaa

SEQ ID NO: 3759712 - RNA, 17 nt, Salmonella typhimurium LT2
gcgcaucgcccugccag

SEQ ID NO: 3759713 - RNA, 13 nt, Salmonella typhimurium LT2
gcgcaugcugcca

SEQ ID NO: 3759714 - RNA, 15 nt, Salmonella typhimurium LT2
gcgcauggccauaga

SEQ ID NO: 3759715 - RNA, 15 nt, Salmonella typhimurium LT2
gcgcauuccagaccc

SEQ ID NO: 3759716 - RNA, 16 nt, Salmonella typhimurium LT2
gcgcauuccagacccg

SEQ ID NO: 3759717 - RNA, 21 nt, Salmonella typhimurium LT2
gcgcauucucuguugccgccc

SEQ ID NO: 3759718 - RNA, 19 nt, Salmonella typhimurium LT2
gcgcauugcgucccagcac

SEQ ID NO: 3759719 - RNA, 20 nt, Salmonella typhimurium LT2
gcgcauugcgucccagcaca

SEQ ID NO: 3759720 - RNA, 17 nt, Salmonella typhimurium LT2
gcgcauuuucggcagcg

SEQ ID NO: 3759721 - RNA, 17 nt, Salmonella typhimurium LT2
gcgccaaaagaggcagc

SEQ ID NO: 3759722 - RNA, 18 nt, Salmonella typhimurium LT2
gcgccaaaagaggcagca

SEQ ID NO: 3759723 - RNA, 13 nt, Salmonella typhimurium LT2
gcgccaaacccga

SEQ ID NO: 3759724 - RNA, 18 nt, Salmonella typhimurium LT2
gcgccaaacgggcaagcc

SEQ ID NO: 3759725 - RNA, 20 nt, Salmonella typhimurium LT2
gcgccaaagcaaucgccagc

SEQ ID NO: 3759726 - RNA, 19 nt, Salmonella typhimurium LT2
gcgccaacggccucccagc

SEQ ID NO: 3759727 - RNA, 13 nt, Salmonella typhimurium LT2
gcgccaagcaccu

SEQ ID NO: 3759728 - RNA, 12 nt, Salmonella typhimurium LT2
gcgccaagcgcc

SEQ ID NO: 3759729 - RNA, 20 nt, Salmonella typhimurium LT2
gcgccaagcgccucgcugac

SEQ ID NO: 3759730 - RNA, 19 nt, Salmonella typhimurium LT2
gcgccaaucaccgccagca

SEQ ID NO: 3759731 - RNA, 16 nt, Salmonella typhimurium LT2
gcgccaauccaugccg

SEQ ID NO: 3759732 - RNA, 19 nt, Salmonella typhimurium LT2
gcgccaauccaugccggcu

SEQ ID NO: 3759733 - RNA, 22 nt, Salmonella typhimurium LT2
gcgccaaugcgaaaauacuccc

SEQ ID NO: 3759734 - RNA, 20 nt, Salmonella typhimurium LT2
gcgccaauugaugaaccgcu

SEQ ID NO: 3759735 - RNA, 14 nt, Salmonella typhimurium LT2
gcgccacaaaggau

SEQ ID NO: 3759736 - RNA, 22 nt, Salmonella typhimurium LT2
gcgccaccgggcaacacacgcu

SEQ ID NO: 3759737 - RNA, 16 nt, Salmonella typhimurium LT2
gcgccacgcgccaggu

SEQ ID NO: 3759738 - RNA, 13 nt, Salmonella typhimurium LT2
gcgccacgcgcuc

SEQ ID NO: 3759739 - RNA, 16 nt, Salmonella typhimurium LT2
gcgccacuucacuggc

SEQ ID NO: 3759740 - RNA, 15 nt, Salmonella typhimurium LT2
gcgccacuuccagcg

SEQ ID NO: 3759741 - RNA, 22 nt, Salmonella typhimurium LT2
gcgccacuuccagcgcgccguc

SEQ ID NO: 3759742 - RNA, 19 nt, Salmonella typhimurium LT2
gcgccagaauagcgcaguc

SEQ ID NO: 3759743 - RNA, 13 nt, Salmonella typhimurium LT2
gcgccagcaccag

SEQ ID NO: 3759744 - RNA, 14 nt, Salmonella typhimurium LT2
gcgccagcaccaug

SEQ ID NO: 3759745 - RNA, 19 nt, Salmonella typhimurium LT2
gcgccagcagcggcgaagc

SEQ ID NO: 3759746 - RNA, 14 nt, Salmonella typhimurium LT2
gcgccagcaguggg

SEQ ID NO: 3759747 - RNA, 11 nt, Salmonella typhimurium LT2
gcgccagcaug

SEQ ID NO: 3759748 - RNA, 14 nt, Salmonella typhimurium LT2
gcgccagccacaag

SEQ ID NO: 3759749 - RNA, 13 nt, Salmonella typhimurium LT2
gcgccagccagcu

SEQ ID NO: 3759750 - RNA, 20 nt, Salmonella typhimurium LT2
gcgccagccagucgccaggc

SEQ ID NO: 3759751 - RNA, 15 nt, Salmonella typhimurium LT2
gcgccagccauaacg

SEQ ID NO: 3759752 - RNA, 12 nt, Salmonella typhimurium LT2
gcgccagcccug

SEQ ID NO: 3759753 - RNA, 14 nt, Salmonella typhimurium LT2
gcgccagcccugcg

SEQ ID NO: 3759754 - RNA, 21 nt, Salmonella typhimurium LT2
gcgccagccgcgccaucuccu

SEQ ID NO: 3759755 - RNA, 12 nt, Salmonella typhimurium LT2
gcgccagccgcu

SEQ ID NO: 3759756 - RNA, 20 nt, Salmonella typhimurium LT2
gcgccagccgcuuaauguua

SEQ ID NO: 3759757 - RNA, 15 nt, Salmonella typhimurium LT2
gcgccagccggauac

SEQ ID NO: 3759758 - RNA, 21 nt, Salmonella typhimurium LT2
gcgccagcgacaucccagaca

SEQ ID NO: 3759759 - RNA, 13 nt, Salmonella typhimurium LT2
gcgccagcgccaa

SEQ ID NO: 3759760 - RNA, 17 nt, Salmonella typhimurium LT2
gcgccagcggacuccac

SEQ ID NO: 3759761 - RNA, 13 nt, Salmonella typhimurium LT2
gcgccaggaaacu

SEQ ID NO: 3759762 - RNA, 22 nt, Salmonella typhimurium LT2
gcgccaggaagguauuaaguga

SEQ ID NO: 3759763 - RNA, 16 nt, Salmonella typhimurium LT2
gcgccagucaucgccg

SEQ ID NO: 3759764 - RNA, 19 nt, Salmonella typhimurium LT2
gcgccaguccggucgacac

SEQ ID NO: 3759765 - RNA, 16 nt, Salmonella typhimurium LT2
gcgccaguucagcguc

SEQ ID NO: 3759766 - RNA, 19 nt, Salmonella typhimurium LT2
gcgccaguucauccagcag

SEQ ID NO: 3759767 - RNA, 20 nt, Salmonella typhimurium LT2
gcgccaguucauccagcagc

SEQ ID NO: 3759768 - RNA, 23 nt, Salmonella typhimurium LT2
gcgccaguuggcguaccaucagc

SEQ ID NO: 3759769 - RNA, 21 nt, Salmonella typhimurium LT2
gcgccaguuuuuccuguuccu

SEQ ID NO: 3759770 - RNA, 12 nt, Salmonella typhimurium LT2
gcgccauaaaaa

SEQ ID NO: 3759771 - RNA, 18 nt, Salmonella typhimurium LT2
gcgccauauugcuguauu

SEQ ID NO: 3759772 - RNA, 14 nt, Salmonella typhimurium LT2
gcgccaucagcauc

SEQ ID NO: 3759773 - RNA, 13 nt, Salmonella typhimurium LT2
gcgccaucaggca

SEQ ID NO: 3759774 - RNA, 15 nt, Salmonella typhimurium LT2
gcgccaucaggcacu

SEQ ID NO: 3759775 - RNA, 13 nt, Salmonella typhimurium LT2
gcgccaucaggcc

SEQ ID NO: 3759776 - RNA, 17 nt, Salmonella typhimurium LT2
gcgccaucaggccuacg

SEQ ID NO: 3759777 - RNA, 13 nt, Salmonella typhimurium LT2
gcgccaucaggcu

SEQ ID NO: 3759778 - RNA, 22 nt, Salmonella typhimurium LT2
gcgccaucccaugcaccagccc

SEQ ID NO: 3759779 - RNA, 14 nt, Salmonella typhimurium LT2
gcgccauccggcag

SEQ ID NO: 3759780 - RNA, 14 nt, Salmonella typhimurium LT2
gcgccauccggcau

SEQ ID NO: 3759781 - RNA, 16 nt, Salmonella typhimurium LT2
gcgccauccggcauca

SEQ ID NO: 3759782 - RNA, 11 nt, Salmonella typhimurium LT2
gcgccaucggc

SEQ ID NO: 3759783 - RNA, 13 nt, Salmonella typhimurium LT2
gcgccaucgggca

SEQ ID NO: 3759784 - RNA, 15 nt, Salmonella typhimurium LT2
gcgccaucgggcauu

SEQ ID NO: 3759785 - RNA, 14 nt, Salmonella typhimurium LT2
gcgccaugauccag

SEQ ID NO: 3759786 - RNA, 16 nt, Salmonella typhimurium LT2
gcgccaugauccagcg

SEQ ID NO: 3759787 - RNA, 14 nt, Salmonella typhimurium LT2
gcgccaugcgcggc

SEQ ID NO: 3759788 - RNA, 22 nt, Salmonella typhimurium LT2
gcgccauguucauaaagugcca

SEQ ID NO: 3759789 - RNA, 20 nt, Salmonella typhimurium LT2
gcgccauuaaaaaaggcagc

SEQ ID NO: 3759790 - RNA, 18 nt, Salmonella typhimurium LT2
gcgccauuaacgcgguga

SEQ ID NO: 3759791 - RNA, 15 nt, Salmonella typhimurium LT2
gcgccauuuccagcc

SEQ ID NO: 3759792 - RNA, 16 nt, Salmonella typhimurium LT2
gcgcccaacaaacgcu

SEQ ID NO: 3759793 - RNA, 14 nt, Salmonella typhimurium LT2
gcgcccaaugccga

SEQ ID NO: 3759794 - RNA, 22 nt, Salmonella typhimurium LT2
gcgcccaaugcuuagucagccu

SEQ ID NO: 3759795 - RNA, 20 nt, Salmonella typhimurium LT2
gcgcccagaggcacgguauu

SEQ ID NO: 3759796 - RNA, 12 nt, Salmonella typhimurium LT2
gcgcccagcgcc

SEQ ID NO: 3759797 - RNA, 23 nt, Salmonella typhimurium LT2
gcgcccaguuucuucaggccagc

SEQ ID NO: 3759798 - RNA, 21 nt, Salmonella typhimurium LT2
gcgcccaucaucaucggcaca

SEQ ID NO: 3759799 - RNA, 16 nt, Salmonella typhimurium LT2
gcgcccauccgcccac

SEQ ID NO: 3759800 - RNA, 12 nt, Salmonella typhimurium LT2
gcgcccccagca

SEQ ID NO: 3759801 - RNA, 14 nt, Salmonella typhimurium LT2
gcgccccggcggcg

SEQ ID NO: 3759802 - RNA, 14 nt, Salmonella typhimurium LT2
gcgccccugcgggu

SEQ ID NO: 3759803 - RNA, 20 nt, Salmonella typhimurium LT2
gcgcccgacgcgccacuucc

SEQ ID NO: 3759804 - RNA, 19 nt, Salmonella typhimurium LT2
gcgcccgaucguccgccuc

SEQ ID NO: 3759805 - RNA, 14 nt, Salmonella typhimurium LT2
gcgcccgccaccag

SEQ ID NO: 3759806 - RNA, 15 nt, Salmonella typhimurium LT2
gcgcccgccaccagc

SEQ ID NO: 3759807 - RNA, 21 nt, Salmonella typhimurium LT2
gcgcccgccaccagcacagcc

SEQ ID NO: 3759808 - RNA, 14 nt, Salmonella typhimurium LT2
gcgcccgcgcgcca

SEQ ID NO: 3759809 - RNA, 15 nt, Salmonella typhimurium LT2
gcgcccgcgcgccag

SEQ ID NO: 3759810 - RNA, 15 nt, Salmonella typhimurium LT2
gcgcccggcgcaucg

SEQ ID NO: 3759811 - RNA, 16 nt, Salmonella typhimurium LT2
gcgcccguccaugagu

SEQ ID NO: 3759812 - RNA, 20 nt, Salmonella typhimurium LT2
gcgcccuauuuggccugcag

SEQ ID NO: 3759813 - RNA, 17 nt, Salmonella typhimurium LT2
gcgcgccuuccagcaau

SEQ ID NO: 3759814 - RNA, 15 nt, Salmonella typhimurium LT2
gcgcgccuugcgcag

SEQ ID NO: 3759815 - RNA, 14 nt, Salmonella typhimurium LT2
gcgcgcgcaaagcg

SEQ ID NO: 3759816 - RNA, 13 nt, Salmonella typhimurium LT2
gcgcgcgccgccu

SEQ ID NO: 3759817 - RNA, 14 nt, Salmonella typhimurium LT2
gcgcgcgcguuaac

SEQ ID NO: 3759818 - RNA, 21 nt, Salmonella typhimurium LT2
gcgcgcggauauggcggcggc

SEQ ID NO: 3759819 - RNA, 15 nt, Salmonella typhimurium LT2
gcgcgcggaugacga

SEQ ID NO: 3759820 - RNA, 19 nt, Salmonella typhimurium LT2
gcgcgcgucaguucgucca

SEQ ID NO: 3759821 - RNA, 12 nt, Salmonella typhimurium LT2
gcgcgcuccaga

SEQ ID NO: 3759822 - RNA, 16 nt, Salmonella typhimurium LT2
gcgcgcugagcggcuc

SEQ ID NO: 3759823 - RNA, 15 nt, Salmonella typhimurium LT2
gcgcgcugccgcccu

SEQ ID NO: 3759824 - RNA, 13 nt, Salmonella typhimurium LT2
gcgcgcuggcaag

SEQ ID NO: 3759825 - RNA, 18 nt, Salmonella typhimurium LT2
gcgcgcuuucaccgccuc

SEQ ID NO: 3759826 - RNA, 21 nt, Salmonella typhimurium LT2
gcgcggaaagugccguacggc

SEQ ID NO: 3759827 - RNA, 24 nt, Salmonella typhimurium LT2
gcgcggaaggcgccucgcgcggcg

SEQ ID NO: 3759828 - RNA, 13 nt, Salmonella typhimurium LT2
gcgcggacagcag

SEQ ID NO: 3759829 - RNA, 19 nt, Salmonella typhimurium LT2
gcgcggauauggcggcggc

SEQ ID NO: 3759830 - RNA, 23 nt, Salmonella typhimurium LT2
gcgcggcacacaacacggcggcu

SEQ ID NO: 3759831 - RNA, 17 nt, Salmonella typhimurium LT2
gcgcggcacacagcacu

SEQ ID NO: 3759832 - RNA, 20 nt, Salmonella typhimurium LT2
gcgcggcacacuuucaucag

SEQ ID NO: 3759833 - RNA, 15 nt, Salmonella typhimurium LT2
gcgcggcaucagccu

SEQ ID NO: 3759834 - RNA, 20 nt, Salmonella typhimurium LT2
gcgcggccagaaugcccagc

SEQ ID NO: 3759835 - RNA, 13 nt, Salmonella typhimurium LT2
gcgcggccagcgc

SEQ ID NO: 3759836 - RNA, 21 nt, Salmonella typhimurium LT2
gcgcggccucauggcggugcu

SEQ ID NO: 3759837 - RNA, 20 nt, Salmonella typhimurium LT2
gcgcggccuuugccuucgcc

SEQ ID NO: 3759838 - RNA, 21 nt, Salmonella typhimurium LT2
gcgcggcgaucagacgcuggu

SEQ ID NO: 3759839 - RNA, 22 nt, Salmonella typhimurium LT2
gcgcggcggacaacgcuccagc

SEQ ID NO: 3759840 - RNA, 14 nt, Salmonella typhimurium LT2
gcgcggcgucgccg

SEQ ID NO: 3759841 - RNA, 16 nt, Salmonella typhimurium LT2
gcgcggcgucgccgcc

SEQ ID NO: 3759842 - RNA, 18 nt, Salmonella typhimurium LT2
gcgcggcguucugcgcca

SEQ ID NO: 3759843 - RNA, 19 nt, Salmonella typhimurium LT2
gcgcggcugccggacugcu

SEQ ID NO: 3759844 - RNA, 15 nt, Salmonella typhimurium LT2
gcgcgggaaacacua

SEQ ID NO: 3759845 - RNA, 22 nt, Salmonella typhimurium LT2
gcgcgggccugccuguuuacgg

SEQ ID NO: 3759846 - RNA, 14 nt, Salmonella typhimurium LT2
gcgcggggaacaca

SEQ ID NO: 3759847 - RNA, 17 nt, Salmonella typhimurium LT2
gcgcggggaacacgcga

SEQ ID NO: 3759848 - RNA, 20 nt, Salmonella typhimurium LT2
gcgcgguauuucgccgccgc

SEQ ID NO: 3759849 - RNA, 18 nt, Salmonella typhimurium LT2
gcgcggucgcuucgccuu

SEQ ID NO: 3759850 - RNA, 21 nt, Salmonella typhimurium LT2
gcgcgguggcuuuuuccugcc

SEQ ID NO: 3759851 - RNA, 23 nt, Salmonella typhimurium LT2
gcgcgguggcuuuuuccugccau

SEQ ID NO: 3759852 - RNA, 20 nt, Salmonella typhimurium LT2
gcgcguaaauaccuuccggc

SEQ ID NO: 3759853 - RNA, 21 nt, Salmonella typhimurium LT2
gcgcguaaauccuccaucaug

SEQ ID NO: 3759854 - RNA, 20 nt, Salmonella typhimurium LT2
gcgcguagcggucacccggc

SEQ ID NO: 3759855 - RNA, 19 nt, Salmonella typhimurium LT2
gcgcgucaacggcgcggcg

SEQ ID NO: 3759856 - RNA, 22 nt, Salmonella typhimurium LT2
gcgcgucacaauaucgagauga

SEQ ID NO: 3759857 - RNA, 22 nt, Salmonella typhimurium LT2
gcgcgucagcguguaaucgccg

SEQ ID NO: 3759858 - RNA, 13 nt, Salmonella typhimurium LT2
gcgcguccacggc

SEQ ID NO: 3759859 - RNA, 16 nt, Salmonella typhimurium LT2
gcgcguccacggcggg

SEQ ID NO: 3759860 - RNA, 13 nt, Salmonella typhimurium LT2
gcgcguccagacg

SEQ ID NO: 3759861 - RNA, 19 nt, Salmonella typhimurium LT2
gcgcguccagccagcguuu

SEQ ID NO: 3759862 - RNA, 14 nt, Salmonella typhimurium LT2
gcgcguccagcggc

SEQ ID NO: 3759863 - RNA, 17 nt, Salmonella typhimurium LT2
gcgcguccucacacuga

SEQ ID NO: 3759864 - RNA, 21 nt, Salmonella typhimurium LT2
gcgcguccucacacugauggc

SEQ ID NO: 3759865 - RNA, 17 nt, Salmonella typhimurium LT2
gcgcguccuuauaaugc

SEQ ID NO: 3759866 - RNA, 13 nt, Salmonella typhimurium LT2
gcgcguggcaaau

SEQ ID NO: 3759867 - RNA, 17 nt, Salmonella typhimurium LT2
gcgcguuccccaacagc

SEQ ID NO: 3759868 - RNA, 12 nt, Salmonella typhimurium LT2
gcgcguucgcca

SEQ ID NO: 3759869 - RNA, 23 nt, Salmonella typhimurium LT2
gcgcguugacgauuuuuaagcug

SEQ ID NO: 3759870 - RNA, 19 nt, Salmonella typhimurium LT2
gcgcguuuagcgccagcag

SEQ ID NO: 3759871 - RNA, 20 nt, Salmonella typhimurium LT2
gcgcguuuagcgccagcagc

SEQ ID NO: 3759872 - RNA, 19 nt, Salmonella typhimurium LT2
gcgcuaaacagcgccgcga

SEQ ID NO: 3759873 - RNA, 17 nt, Salmonella typhimurium LT2
gcgcuaaaugcauagcc

SEQ ID NO: 3759874 - RNA, 18 nt, Salmonella typhimurium LT2
gcgcuaaugcuuauccgg

SEQ ID NO: 3759875 - RNA, 14 nt, Salmonella typhimurium LT2
gcgcuacauacugc

SEQ ID NO: 3759876 - RNA, 22 nt, Salmonella typhimurium LT2
gcgcuaccaggauagcgccuug

SEQ ID NO: 3759877 - RNA, 17 nt, Salmonella typhimurium LT2
gcgcuacgcuuaucagg

SEQ ID NO: 3759878 - RNA, 23 nt, Salmonella typhimurium LT2
gcgcuacggcguuucacuucuga

SEQ ID NO: 3759879 - RNA, 19 nt, Salmonella typhimurium LT2
gcgcuacggcuuccggcgu

SEQ ID NO: 3759880 - RNA, 17 nt, Salmonella typhimurium LT2
gcgcuagcuggcagggg

SEQ ID NO: 3759881 - RNA, 21 nt, Salmonella typhimurium LT2
gcgcuagcuucagguguuagu

SEQ ID NO: 3759882 - RNA, 23 nt, Salmonella typhimurium LT2
gcgcuagcuucagguguuagugu

SEQ ID NO: 3759883 - RNA, 12 nt, Salmonella typhimurium LT2
gcgcuaucaggc

SEQ ID NO: 3759884 - RNA, 16 nt, Salmonella typhimurium LT2
gcgcuaucgguaucau

SEQ ID NO: 3759885 - RNA, 13 nt, Salmonella typhimurium LT2
gcgcuaucuucaa

SEQ ID NO: 3759886 - RNA, 18 nt, Salmonella typhimurium LT2
gcgcuaugcgcuccagga

SEQ ID NO: 3759887 - RNA, 17 nt, Salmonella typhimurium LT2
gcgcuauucccaggcaa

SEQ ID NO: 3759888 - RNA, 13 nt, Salmonella typhimurium LT2
gcgcucaagcgaa

SEQ ID NO: 3759889 - RNA, 18 nt, Salmonella typhimurium LT2
gcgcucaccuccgccacc

SEQ ID NO: 3759890 - RNA, 23 nt, Salmonella typhimurium LT2
gcgcucaccuccgccaccagcgc

SEQ ID NO: 3759891 - RNA, 15 nt, Salmonella typhimurium LT2
gcgcucacgcggcgc

SEQ ID NO: 3759892 - RNA, 12 nt, Salmonella typhimurium LT2
gcgcucagcguc

SEQ ID NO: 3759893 - RNA, 16 nt, Salmonella typhimurium LT2
gcgcucaggaucgccg

SEQ ID NO: 3759894 - RNA, 19 nt, Salmonella typhimurium LT2
gcgcucaggaucgccgggu

SEQ ID NO: 3759895 - RNA, 11 nt, Salmonella typhimurium LT2
gcgcucaggca

SEQ ID NO: 3759896 - RNA, 22 nt, Salmonella typhimurium LT2
gcgcucaguucauuauuucaug

SEQ ID NO: 3759897 - RNA, 16 nt, Salmonella typhimurium LT2
gcgcucauaaccgcga

SEQ ID NO: 3759898 - RNA, 20 nt, Salmonella typhimurium LT2
gcgcuccagaccaccagcga

SEQ ID NO: 3759899 - RNA, 21 nt, Salmonella typhimurium LT2
gcgcuccagcuucaucaucag

SEQ ID NO: 3759900 - RNA, 22 nt, Salmonella typhimurium LT2
gcgcuccgacugaaccuucacg

SEQ ID NO: 3759901 - RNA, 15 nt, Salmonella typhimurium LT2
gcgcucgcauugcuc

SEQ ID NO: 3759902 - RNA, 15 nt, Salmonella typhimurium LT2
gcgcucgccagcgca

SEQ ID NO: 3759903 - RNA, 24 nt, Salmonella typhimurium LT2
gcgcucgcucaucacaucgcgcag

SEQ ID NO: 3759904 - RNA, 19 nt, Salmonella typhimurium LT2
gcgcucgcuuaucuggccu

SEQ ID NO: 3759905 - RNA, 15 nt, Salmonella typhimurium LT2
gcgcucggcagcagc

SEQ ID NO: 3759906 - RNA, 18 nt, Salmonella typhimurium LT2
gcgcucggcagcagcgcg

SEQ ID NO: 3759907 - RNA, 18 nt, Salmonella typhimurium LT2
gcgcucguaggccagcgc

SEQ ID NO: 3759908 - RNA, 17 nt, Salmonella typhimurium LT2
gcgcucuaucgccgccc

SEQ ID NO: 3759909 - RNA, 16 nt, Salmonella typhimurium LT2
gcgcucuuccgccagc

SEQ ID NO: 3759910 - RNA, 17 nt, Salmonella typhimurium LT2
gcgcucuucgcuccagu

SEQ ID NO: 3759911 - RNA, 20 nt, Salmonella typhimurium LT2
gcgcugaguuucucccgcca

SEQ ID NO: 3759912 - RNA, 14 nt, Salmonella typhimurium LT2
gcgcugaucgccac

SEQ ID NO: 3759913 - RNA, 16 nt, Salmonella typhimurium LT2
gcgcugaugugcggcc

SEQ ID NO: 3759914 - RNA, 17 nt, Salmonella typhimurium LT2
gcgcugaugugcggccu

SEQ ID NO: 3759915 - RNA, 15 nt, Salmonella typhimurium LT2
gcgcugauuuguuau

SEQ ID NO: 3759916 - RNA, 21 nt, Salmonella typhimurium LT2
gcgcugauuuucuccagcaga

SEQ ID NO: 3759917 - RNA, 20 nt, Salmonella typhimurium LT2
gcggauuccaguagcgcgcc

SEQ ID NO: 3759918 - RNA, 23 nt, Salmonella typhimurium LT2
gcggauuccaguagcgcgcccau

SEQ ID NO: 3759919 - RNA, 17 nt, Salmonella typhimurium LT2
gcggauugauuuuucug

SEQ ID NO: 3759920 - RNA, 16 nt, Salmonella typhimurium LT2
gcggcaaaaacgccgg

SEQ ID NO: 3759921 - RNA, 20 nt, Salmonella typhimurium LT2
gcggcaaagauaaucugaau

SEQ ID NO: 3759922 - RNA, 20 nt, Salmonella typhimurium LT2
gcggcaacaaauguugauaa

SEQ ID NO: 3759923 - RNA, 13 nt, Salmonella typhimurium LT2
gcggcaacacauc

SEQ ID NO: 3759924 - RNA, 17 nt, Salmonella typhimurium LT2
gcggcaacacauccggc

SEQ ID NO: 3759925 - RNA, 16 nt, Salmonella typhimurium LT2
gcggcaagaucauccg

SEQ ID NO: 3759926 - RNA, 18 nt, Salmonella typhimurium LT2
gcggcaagaucauccggg

SEQ ID NO: 3759927 - RNA, 15 nt, Salmonella typhimurium LT2
gcggcaagcgcgcca

SEQ ID NO: 3759928 - RNA, 19 nt, Salmonella typhimurium LT2
gcggcaaggauaaccauuc

SEQ ID NO: 3759929 - RNA, 23 nt, Salmonella typhimurium LT2
gcggcaauauccugugucggcag

SEQ ID NO: 3759930 - RNA, 14 nt, Salmonella typhimurium LT2
gcggcaauggccgc

SEQ ID NO: 3759931 - RNA, 16 nt, Salmonella typhimurium LT2
gcggcaauggccgcag

SEQ ID NO: 3759932 - RNA, 22 nt, Salmonella typhimurium LT2
gcggcaauuucacugucgccag

SEQ ID NO: 3759933 - RNA, 18 nt, Salmonella typhimurium LT2
gcggcaauuuguagcugc

SEQ ID NO: 3759934 - RNA, 21 nt, Salmonella typhimurium LT2
gcggcacacaacacggcggcu

SEQ ID NO: 3759935 - RNA, 16 nt, Salmonella typhimurium LT2
gcggcaccuuguccgg

SEQ ID NO: 3759936 - RNA, 22 nt, Salmonella typhimurium LT2
gcggcacggcgucaauuccgcg

SEQ ID NO: 3759937 - RNA, 19 nt, Salmonella typhimurium LT2
gcggcagaaauuaaaucau

SEQ ID NO: 3759938 - RNA, 22 nt, Salmonella typhimurium LT2
gcggcagcacgagcauccagau

SEQ ID NO: 3759939 - RNA, 15 nt, Salmonella typhimurium LT2
gcggcaggaucccca

SEQ ID NO: 3759940 - RNA, 22 nt, Salmonella typhimurium LT2
gcggcaggcuuucuuugcggaa

SEQ ID NO: 3759941 - RNA, 20 nt, Salmonella typhimurium LT2
gcggcaguaagccagcgggc

SEQ ID NO: 3759942 - RNA, 15 nt, Salmonella typhimurium LT2
gcggcaguuccggcg

SEQ ID NO: 3759943 - RNA, 14 nt, Salmonella typhimurium LT2
gcggcauaaacgcc

SEQ ID NO: 3759944 - RNA, 21 nt, Salmonella typhimurium LT2
gcggcauaaauccggugcguu

SEQ ID NO: 3759945 - RNA, 18 nt, Salmonella typhimurium LT2
gcggcauacuuucgcgcg

SEQ ID NO: 3759946 - RNA, 12 nt, Salmonella typhimurium LT2
gcggcauccggc

SEQ ID NO: 3759947 - RNA, 22 nt, Salmonella typhimurium LT2
gcggcaucgcccguuuuaccgg

SEQ ID NO: 3759948 - RNA, 19 nt, Salmonella typhimurium LT2
gcggcaucucgccaaacca

SEQ ID NO: 3759949 - RNA, 21 nt, Salmonella typhimurium LT2
gcggcauuggcguuaccggca

SEQ ID NO: 3759950 - RNA, 13 nt, Salmonella typhimurium LT2
gcggccaaaggga

SEQ ID NO: 3759951 - RNA, 16 nt, Salmonella typhimurium LT2
gcggccaaaucgucag

SEQ ID NO: 3759952 - RNA, 16 nt, Salmonella typhimurium LT2
gcggccaugaucgccg

SEQ ID NO: 3759953 - RNA, 21 nt, Salmonella typhimurium LT2
gcggcccacucauccagcaaa

SEQ ID NO: 3759954 - RNA, 23 nt, Salmonella typhimurium LT2
gcggcccgggagaacgccgggcc

SEQ ID NO: 3759955 - RNA, 16 nt, Salmonella typhimurium LT2
gcggccuaucaggccu

SEQ ID NO: 3759956 - RNA, 20 nt, Salmonella typhimurium LT2
gcggccuccggcgcgaacgg

SEQ ID NO: 3759957 - RNA, 19 nt, Salmonella typhimurium LT2
gcggccuccuggcuuaccu

SEQ ID NO: 3759958 - RNA, 17 nt, Salmonella typhimurium LT2
gcggccuucgcagaucg

SEQ ID NO: 3759959 - RNA, 21 nt, Salmonella typhimurium LT2
gcggccuucgcagaucgccug

SEQ ID NO: 3759960 - RNA, 22 nt, Salmonella typhimurium LT2
gcggccuucgcagaucgccugg

SEQ ID NO: 3759961 - RNA, 17 nt, Salmonella typhimurium LT2
gcggccuuuauccagcg

SEQ ID NO: 3759962 - RNA, 19 nt, Salmonella typhimurium LT2
gcggcgaagcaucuuuccg

SEQ ID NO: 3759963 - RNA, 18 nt, Salmonella typhimurium LT2
gcggcgaauuaaucgucg

SEQ ID NO: 3759964 - RNA, 18 nt, Salmonella typhimurium LT2
gcggcgagucgcgcccac

SEQ ID NO: 3759965 - RNA, 17 nt, Salmonella typhimurium LT2
gcggcgcaaaucgccau

SEQ ID NO: 3759966 - RNA, 13 nt, Salmonella typhimurium LT2
gcggcgcagggcg

SEQ ID NO: 3759967 - RNA, 14 nt, Salmonella typhimurium LT2
gcggcgccaguacu

SEQ ID NO: 3759968 - RNA, 12 nt, Salmonella typhimurium LT2
gcggcgccauca

SEQ ID NO: 3759969 - RNA, 16 nt, Salmonella typhimurium LT2
gcggcgccaucaccau

SEQ ID NO: 3759970 - RNA, 19 nt, Salmonella typhimurium LT2
gcggcgcgauaugucucuc

SEQ ID NO: 3759971 - RNA, 19 nt, Salmonella typhimurium LT2
gcggcgcuaucgccuccag

SEQ ID NO: 3759972 - RNA, 18 nt, Salmonella typhimurium LT2
gcggcgcucaauguggcu

SEQ ID NO: 3759973 - RNA, 18 nt, Salmonella typhimurium LT2
gcggcgcucgccagcccg

SEQ ID NO: 3759974 - RNA, 22 nt, Salmonella typhimurium LT2
gcggcgcuuauucggcuuaccc

SEQ ID NO: 3759975 - RNA, 11 nt, Salmonella typhimurium LT2
gcggcggauaa

SEQ ID NO: 3759976 - RNA, 16 nt, Salmonella typhimurium LT2
gcggcggguaaauaga

SEQ ID NO: 3759977 - RNA, 15 nt, Salmonella typhimurium LT2
gcggcggguuaaugg

SEQ ID NO: 3759978 - RNA, 19 nt, Salmonella typhimurium LT2
gcggcggguuaauggcagc

SEQ ID NO: 3759979 - RNA, 17 nt, Salmonella typhimurium LT2
gcggcggucugcgccug

SEQ ID NO: 3759980 - RNA, 18 nt, Salmonella typhimurium LT2
gcggcggucugcgccugc

SEQ ID NO: 3759981 - RNA, 15 nt, Salmonella typhimurium LT2
gcggcgguucauccu

SEQ ID NO: 3759982 - RNA, 21 nt, Salmonella typhimurium LT2
gcggcguaaaagcgauaaaga

SEQ ID NO: 3759983 - RNA, 22 nt, Salmonella typhimurium LT2
gcggcguaaacacguuaucuga

SEQ ID NO: 3759984 - RNA, 17 nt, Salmonella typhimurium LT2
gcggcguaccgcgcgcc

SEQ ID NO: 3759985 - RNA, 18 nt, Salmonella typhimurium LT2
gcggcguaccgcgcgccc

SEQ ID NO: 3759986 - RNA, 20 nt, Salmonella typhimurium LT2
gcggcguacugcaacgcgca

SEQ ID NO: 3759987 - RNA, 21 nt, Salmonella typhimurium LT2
gcggcguacugcaacgcgcau

SEQ ID NO: 3759988 - RNA, 16 nt, Salmonella typhimurium LT2
gcggcguagccgccga

SEQ ID NO: 3759989 - RNA, 15 nt, Salmonella typhimurium LT2
gcggcguagcguuca

SEQ ID NO: 3759990 - RNA, 20 nt, Salmonella typhimurium LT2
gcggcguaucauagcggcua

SEQ ID NO: 3759991 - RNA, 14 nt, Salmonella typhimurium LT2
gcggcgucauccgg

SEQ ID NO: 3759992 - RNA, 13 nt, Salmonella typhimurium LT2
gcggcgucgccag

SEQ ID NO: 3759993 - RNA, 17 nt, Salmonella typhimurium LT2
gcggcguucccgcaggc

SEQ ID NO: 3759994 - RNA, 14 nt, Salmonella typhimurium LT2
gcggcguugcccag

SEQ ID NO: 3759995 - RNA, 19 nt, Salmonella typhimurium LT2
gcggcuacgccugauaagc

SEQ ID NO: 3759996 - RNA, 21 nt, Salmonella typhimurium LT2
gcggcuauugccugauggcgc

SEQ ID NO: 3759997 - RNA, 15 nt, Salmonella typhimurium LT2
gcggcucauccagca

SEQ ID NO: 3759998 - RNA, 15 nt, Salmonella typhimurium LT2
gcggcugaugcagau

SEQ ID NO: 3759999 - RNA, 13 nt, Salmonella typhimurium LT2
gcggcugcgccug

SEQ ID NO: 3760000 - RNA, 16 nt, Salmonella typhimurium LT2
gcggcugcgccugugg

SEQ ID NO: 3760001 - RNA, 16 nt, Salmonella typhimurium LT2
gcggcugcgccuuauc

SEQ ID NO: 3760002 - RNA, 22 nt, Salmonella typhimurium LT2
gcggcuggcgcgaugacggcgc

SEQ ID NO: 3760003 - RNA, 17 nt, Salmonella typhimurium LT2
gcggcuguagccagccu

SEQ ID NO: 3760004 - RNA, 17 nt, Salmonella typhimurium LT2
gcggcuguguucauccc

SEQ ID NO: 3760005 - RNA, 16 nt, Salmonella typhimurium LT2
gcggcuguucaccacg

SEQ ID NO: 3760006 - RNA, 14 nt, Salmonella typhimurium LT2
gcggcuuacccuga

SEQ ID NO: 3760007 - RNA, 12 nt, Salmonella typhimurium LT2
gcggcuuauccg

SEQ ID NO: 3760008 - RNA, 12 nt, Salmonella typhimurium LT2
gcggcuucagcg

SEQ ID NO: 3760009 - RNA, 17 nt, Salmonella typhimurium LT2
gcggcuucagcgacauc

SEQ ID NO: 3760010 - RNA, 21 nt, Salmonella typhimurium LT2
gcggcuugaguuuuccgccau

SEQ ID NO: 3760011 - RNA, 22 nt, Salmonella typhimurium LT2
gcggcuugaguuuuccgccauu

SEQ ID NO: 3760012 - RNA, 13 nt, Salmonella typhimurium LT2
gcggcuuuuucac

SEQ ID NO: 3760013 - RNA, 13 nt, Salmonella typhimurium LT2
gcggcuuuuucau

SEQ ID NO: 3760014 - RNA, 11 nt, Salmonella typhimurium LT2
gcgggagcugu

SEQ ID NO: 3760015 - RNA, 13 nt, Salmonella typhimurium LT2
gcgggagcuguuc

SEQ ID NO: 3760016 - RNA, 19 nt, Salmonella typhimurium LT2
gcgggauauaacgcaacgu

SEQ ID NO: 3760017 - RNA, 21 nt, Salmonella typhimurium LT2
gcgggaugcuguaccgcccgc

SEQ ID NO: 3760018 - RNA, 18 nt, Salmonella typhimurium LT2
gcgggcaaccuucaaguu

SEQ ID NO: 3760019 - RNA, 19 nt, Salmonella typhimurium LT2
gcgggcaauuccggucauc

SEQ ID NO: 3760020 - RNA, 17 nt, Salmonella typhimurium LT2
gcgggcagaaaaaucag

SEQ ID NO: 3760021 - RNA, 17 nt, Salmonella typhimurium LT2
gcguaauuuuuccaguu

SEQ ID NO: 3760022 - RNA, 16 nt, Salmonella typhimurium LT2
gcguacaggcggauga

SEQ ID NO: 3760023 - RNA, 16 nt, Salmonella typhimurium LT2
gcguaccacuaauuua

SEQ ID NO: 3760024 - RNA, 14 nt, Salmonella typhimurium LT2
gcguaccagcgccc

SEQ ID NO: 3760025 - RNA, 12 nt, Salmonella typhimurium LT2
gcguaccagcgg

SEQ ID NO: 3760026 - RNA, 14 nt, Salmonella typhimurium LT2
gcguaccagcguca

SEQ ID NO: 3760027 - RNA, 18 nt, Salmonella typhimurium LT2
gcguaccgcuaucgccaa

SEQ ID NO: 3760028 - RNA, 22 nt, Salmonella typhimurium LT2
gcguaccggccacaauugccag

SEQ ID NO: 3760029 - RNA, 17 nt, Salmonella typhimurium LT2
gcguaccgucucggccu

SEQ ID NO: 3760030 - RNA, 19 nt, Salmonella typhimurium LT2
gcguacuuucgccaguuca

SEQ ID NO: 3760031 - RNA, 17 nt, Salmonella typhimurium LT2
gcguagccaaaagcgcc

SEQ ID NO: 3760032 - RNA, 14 nt, Salmonella typhimurium LT2
gcguagcccagcgc

SEQ ID NO: 3760033 - RNA, 20 nt, Salmonella typhimurium LT2
gcguagcccagcgccgcauc

SEQ ID NO: 3760034 - RNA, 15 nt, Salmonella typhimurium LT2
gcguagcgcgcggau

SEQ ID NO: 3760035 - RNA, 19 nt, Salmonella typhimurium LT2
gcguagcguguauuccagu

SEQ ID NO: 3760036 - RNA, 21 nt, Salmonella typhimurium LT2
gcguaggccacaaaggccuca

SEQ ID NO: 3760037 - RNA, 19 nt, Salmonella typhimurium LT2
gcguaggucgcgaacagcu

SEQ ID NO: 3760038 - RNA, 15 nt, Salmonella typhimurium LT2
gcguauagccaggca

SEQ ID NO: 3760039 - RNA, 14 nt, Salmonella typhimurium LT2
gcguauagcgcuug

SEQ ID NO: 3760040 - RNA, 12 nt, Salmonella typhimurium LT2
gcguauccagca

SEQ ID NO: 3760041 - RNA, 17 nt, Salmonella typhimurium LT2
gcguaucguaagccacu

SEQ ID NO: 3760042 - RNA, 14 nt, Salmonella typhimurium LT2
gcguauucagcgca

SEQ ID NO: 3760043 - RNA, 20 nt, Salmonella typhimurium LT2
gcguauucucaaccagccga

SEQ ID NO: 3760044 - RNA, 22 nt, Salmonella typhimurium LT2
gcguauuuaaaacgcacgacaa

SEQ ID NO: 3760045 - RNA, 13 nt, Salmonella typhimurium LT2
gcgucaaaacagg

SEQ ID NO: 3760046 - RNA, 14 nt, Salmonella typhimurium LT2
gcgucaaaacuuau

SEQ ID NO: 3760047 - RNA, 15 nt, Salmonella typhimurium LT2
gcgucaaagcacaug

SEQ ID NO: 3760048 - RNA, 20 nt, Salmonella typhimurium LT2
gcgucaaagcacaugcagau

SEQ ID NO: 3760049 - RNA, 17 nt, Salmonella typhimurium LT2
gcgucaaaguugcauca

SEQ ID NO: 3760050 - RNA, 16 nt, Salmonella typhimurium LT2
gcgucaacggcgcggc

SEQ ID NO: 3760051 - RNA, 18 nt, Salmonella typhimurium LT2
gcgucaacgugaaaaauc

SEQ ID NO: 3760052 - RNA, 13 nt, Salmonella typhimurium LT2
gcgucaauauuaa

SEQ ID NO: 3760053 - RNA, 13 nt, Salmonella typhimurium LT2
gcgucacaacagc

SEQ ID NO: 3760054 - RNA, 15 nt, Salmonella typhimurium LT2
gcgucacauggcgaa

SEQ ID NO: 3760055 - RNA, 16 nt, Salmonella typhimurium LT2
gcgucacgaccggcga

SEQ ID NO: 3760056 - RNA, 20 nt, Salmonella typhimurium LT2
gcgucacucuuacggcgccc

SEQ ID NO: 3760057 - RNA, 15 nt, Salmonella typhimurium LT2
gcgucagcauggugu

SEQ ID NO: 3760058 - RNA, 12 nt, Salmonella typhimurium LT2
gcgucagcgccu

SEQ ID NO: 3760059 - RNA, 15 nt, Salmonella typhimurium LT2
gcgucagcgugcggu

SEQ ID NO: 3760060 - RNA, 20 nt, Salmonella typhimurium LT2
gcgucagcguguaaucgccg

SEQ ID NO: 3760061 - RNA, 18 nt, Salmonella typhimurium LT2
gcgucaggaacgcggcgc

SEQ ID NO: 3760062 - RNA, 22 nt, Salmonella typhimurium LT2
gcgucauccacauuauucacgc

SEQ ID NO: 3760063 - RNA, 14 nt, Salmonella typhimurium LT2
gcgucaucccgguu

SEQ ID NO: 3760064 - RNA, 12 nt, Salmonella typhimurium LT2
gcgucauccggc

SEQ ID NO: 3760065 - RNA, 14 nt, Salmonella typhimurium LT2
gcgucauccggcgu

SEQ ID NO: 3760066 - RNA, 23 nt, Salmonella typhimurium LT2
gcgucaucggcgcgcuggcguga

SEQ ID NO: 3760067 - RNA, 16 nt, Salmonella typhimurium LT2
gcgucaucggcucauc

SEQ ID NO: 3760068 - RNA, 13 nt, Salmonella typhimurium LT2
gcgucauguaaug

SEQ ID NO: 3760069 - RNA, 18 nt, Salmonella typhimurium LT2
gcguccaacuggcuuuca

SEQ ID NO: 3760070 - RNA, 15 nt, Salmonella typhimurium LT2
gcguccagaggaucu

SEQ ID NO: 3760071 - RNA, 13 nt, Salmonella typhimurium LT2
gcguccagcggca

SEQ ID NO: 3760072 - RNA, 22 nt, Salmonella typhimurium LT2
gcguccaguacuuucuuuugau

SEQ ID NO: 3760073 - RNA, 13 nt, Salmonella typhimurium LT2
gcgucccagcaca

SEQ ID NO: 3760074 - RNA, 17 nt, Salmonella typhimurium LT2
gcgucccggcagugcau

SEQ ID NO: 3760075 - RNA, 17 nt, Salmonella typhimurium LT2
gcgucccgucccaccac

SEQ ID NO: 3760076 - RNA, 14 nt, Salmonella typhimurium LT2
gcgucccucuccag

SEQ ID NO: 3760077 - RNA, 21 nt, Salmonella typhimurium LT2
gcgucccuuucccuuccagcg

SEQ ID NO: 3760078 - RNA, 21 nt, Salmonella typhimurium LT2
gcguccggggccagcgccagu

SEQ ID NO: 3760079 - RNA, 17 nt, Salmonella typhimurium LT2
gcguccucguacccggu

SEQ ID NO: 3760080 - RNA, 17 nt, Salmonella typhimurium LT2
gcgucgaccagacgaau

SEQ ID NO: 3760081 - RNA, 12 nt, Salmonella typhimurium LT2
gcgucgagcgcc

SEQ ID NO: 3760082 - RNA, 21 nt, Salmonella typhimurium LT2
gcgucgauaauugcgcgcgua

SEQ ID NO: 3760083 - RNA, 18 nt, Salmonella typhimurium LT2
gcgucgcauucgauacgc

SEQ ID NO: 3760084 - RNA, 16 nt, Salmonella typhimurium LT2
gcgucgccauaaagcu

SEQ ID NO: 3760085 - RNA, 19 nt, Salmonella typhimurium LT2
gcgucgccccaaucgccag

SEQ ID NO: 3760086 - RNA, 12 nt, Salmonella typhimurium LT2
gcgucgccgccg

SEQ ID NO: 3760087 - RNA, 22 nt, Salmonella typhimurium LT2
gcgucgccuguccggccuguaa

SEQ ID NO: 3760088 - RNA, 22 nt, Salmonella typhimurium LT2
gcgucgcgcuuucaaucgucag

SEQ ID NO: 3760089 - RNA, 18 nt, Salmonella typhimurium LT2
gcgucgcggcaauagcga

SEQ ID NO: 3760090 - RNA, 19 nt, Salmonella typhimurium LT2
gcgucgcguaccagcgccc

SEQ ID NO: 3760091 - RNA, 12 nt, Salmonella typhimurium LT2
gcgucgcugguc

SEQ ID NO: 3760092 - RNA, 14 nt, Salmonella typhimurium LT2
gcgucgcuuccugu

SEQ ID NO: 3760093 - RNA, 16 nt, Salmonella typhimurium LT2
gcgucgcuucguucug

SEQ ID NO: 3760094 - RNA, 17 nt, Salmonella typhimurium LT2
gcgucggcaccauuccc

SEQ ID NO: 3760095 - RNA, 22 nt, Salmonella typhimurium LT2
gcgucggcgcggggaacacaau

SEQ ID NO: 3760096 - RNA, 15 nt, Salmonella typhimurium LT2
gcgucggcuucauca

SEQ ID NO: 3760097 - RNA, 14 nt, Salmonella typhimurium LT2
gcgucgggccgcgc

SEQ ID NO: 3760098 - RNA, 23 nt, Salmonella typhimurium LT2
gcgucgggggcgacaaacagcgc

SEQ ID NO: 3760099 - RNA, 19 nt, Salmonella typhimurium LT2
gcgucgucgguaaacgggc

SEQ ID NO: 3760100 - RNA, 21 nt, Salmonella typhimurium LT2
gcgucuacgucaggaaacgcg

SEQ ID NO: 3760101 - RNA, 22 nt, Salmonella typhimurium LT2
gcgucucacuuuucgggugaga

SEQ ID NO: 3760102 - RNA, 17 nt, Salmonella typhimurium LT2
gcgucucaucaaaaagg

SEQ ID NO: 3760103 - RNA, 18 nt, Salmonella typhimurium LT2
gcgucucaucaaaaaggc

SEQ ID NO: 3760104 - RNA, 11 nt, Salmonella typhimurium LT2
gcgucucuccc

SEQ ID NO: 3760105 - RNA, 16 nt, Salmonella typhimurium LT2
gcgucugaaugacgcc

SEQ ID NO: 3760106 - RNA, 16 nt, Salmonella typhimurium LT2
gcgucugacagcgcgc

SEQ ID NO: 3760107 - RNA, 19 nt, Salmonella typhimurium LT2
gcgucuggguuugcagcag

SEQ ID NO: 3760108 - RNA, 17 nt, Salmonella typhimurium LT2
gcgucuuauccggccuc

SEQ ID NO: 3760109 - RNA, 15 nt, Salmonella typhimurium LT2
gcgucuuaucuggcc

SEQ ID NO: 3760110 - RNA, 16 nt, Salmonella typhimurium LT2
gcgucuuaucuggccu

SEQ ID NO: 3760111 - RNA, 21 nt, Salmonella typhimurium LT2
gcgucuucgaugccaugaacg

SEQ ID NO: 3760112 - RNA, 22 nt, Salmonella typhimurium LT2
gcgucuucuuccacuucagcca

SEQ ID NO: 3760113 - RNA, 14 nt, Salmonella typhimurium LT2
gcgugaacacaccc

SEQ ID NO: 3760114 - RNA, 21 nt, Salmonella typhimurium LT2
gcgugaacgccuuauccggcc

SEQ ID NO: 3760115 - RNA, 16 nt, Salmonella typhimurium LT2
gcgugaccaucgcguu

SEQ ID NO: 3760116 - RNA, 15 nt, Salmonella typhimurium LT2
gcgugacgacuaccg

SEQ ID NO: 3760117 - RNA, 13 nt, Salmonella typhimurium LT2
gcgugacgcgcca

SEQ ID NO: 3760118 - RNA, 20 nt, Salmonella typhimurium LT2
gcgugacguucaucauuuuc

SEQ ID NO: 3760119 - RNA, 17 nt, Salmonella typhimurium LT2
gcgugagccacuaucca

SEQ ID NO: 3760120 - RNA, 21 nt, Salmonella typhimurium LT2
gcgugauccacagcguaggcc

SEQ ID NO: 3760121 - RNA, 21 nt, Salmonella typhimurium LT2
gcgugaugcgauccagcgggc

SEQ ID NO: 3760122 - RNA, 20 nt, Salmonella typhimurium LT2
gcgugauggaacaucuccca

SEQ ID NO: 3760123 - RNA, 20 nt, Salmonella typhimurium LT2
gcgugcaagggaaggcgccc

SEQ ID NO: 3760124 - RNA, 16 nt, Salmonella typhimurium LT2
gcgugccugccgcaga

SEQ ID NO: 3760125 - RNA, 14 nt, Salmonella typhimurium LT2
gcuaccgcgcgaac

SEQ ID NO: 3760126 - RNA, 16 nt, Salmonella typhimurium LT2
gcuaccguccaaauca

SEQ ID NO: 3760127 - RNA, 21 nt, Salmonella typhimurium LT2
gcuaccgucgacgucuuucuu

SEQ ID NO: 3760128 - RNA, 16 nt, Salmonella typhimurium LT2
gcuacgauaaagcugg

SEQ ID NO: 3760129 - RNA, 17 nt, Salmonella typhimurium LT2
gcuacgauaaagcuggg

SEQ ID NO: 3760130 - RNA, 22 nt, Salmonella typhimurium LT2
gcuacgauaaagcugggucagg

SEQ ID NO: 3760131 - RNA, 13 nt, Salmonella typhimurium LT2
gcuacgcaggcca

SEQ ID NO: 3760132 - RNA, 14 nt, Salmonella typhimurium LT2
gcuacgccugccug

SEQ ID NO: 3760133 - RNA, 20 nt, Salmonella typhimurium LT2
gcuacgccuuacccggccua

SEQ ID NO: 3760134 - RNA, 22 nt, Salmonella typhimurium LT2
gcuacgcgggcgggaugcugua

SEQ ID NO: 3760135 - RNA, 14 nt, Salmonella typhimurium LT2
gcuacgcgucgcca

SEQ ID NO: 3760136 - RNA, 19 nt, Salmonella typhimurium LT2
gcuacgcuuaucaggccua

SEQ ID NO: 3760137 - RNA, 15 nt, Salmonella typhimurium LT2
gcuacgcuuaucggg

SEQ ID NO: 3760138 - RNA, 15 nt, Salmonella typhimurium LT2
gcuacggcucccucg

SEQ ID NO: 3760139 - RNA, 19 nt, Salmonella typhimurium LT2
gcuacguaaccggccagcc

SEQ ID NO: 3760140 - RNA, 13 nt, Salmonella typhimurium LT2
gcuacugcaucug

SEQ ID NO: 3760141 - RNA, 13 nt, Salmonella typhimurium LT2
gcuacugccgcca

SEQ ID NO: 3760142 - RNA, 21 nt, Salmonella typhimurium LT2
gcuacuuuauaaaucaggaaa

SEQ ID NO: 3760143 - RNA, 16 nt, Salmonella typhimurium LT2
gcuagcccgcugcgcc

SEQ ID NO: 3760144 - RNA, 21 nt, Salmonella typhimurium LT2
gcuagcgccuuauccggccua

SEQ ID NO: 3760145 - RNA, 13 nt, Salmonella typhimurium LT2
gcuagcuucaggu

SEQ ID NO: 3760146 - RNA, 15 nt, Salmonella typhimurium LT2
gcuaguauauuaaau

SEQ ID NO: 3760147 - RNA, 18 nt, Salmonella typhimurium LT2
gcuauaaauaaggccuga

SEQ ID NO: 3760148 - RNA, 21 nt, Salmonella typhimurium LT2
gcuauaaauaaggccugagcu

SEQ ID NO: 3760149 - RNA, 15 nt, Salmonella typhimurium LT2
gcuauaagcggcguc

SEQ ID NO: 3760150 - RNA, 14 nt, Salmonella typhimurium LT2
gcuauacgccauac

SEQ ID NO: 3760151 - RNA, 14 nt, Salmonella typhimurium LT2
gcuauacgcggcgu

SEQ ID NO: 3760152 - RNA, 22 nt, Salmonella typhimurium LT2
gcuauagccgcguuugaguagc

SEQ ID NO: 3760153 - RNA, 18 nt, Salmonella typhimurium LT2
gcuauaggccaucacugg

SEQ ID NO: 3760154 - RNA, 22 nt, Salmonella typhimurium LT2
gcuauaguggauggcccacugu

SEQ ID NO: 3760155 - RNA, 22 nt, Salmonella typhimurium LT2
gcuauaugauagaaguuaugca

SEQ ID NO: 3760156 - RNA, 16 nt, Salmonella typhimurium LT2
gcuauaugcaggcaua

SEQ ID NO: 3760157 - RNA, 14 nt, Salmonella typhimurium LT2
gcuauauugcugcg

SEQ ID NO: 3760158 - RNA, 15 nt, Salmonella typhimurium LT2
gcuauauuuauaaaa

SEQ ID NO: 3760159 - RNA, 22 nt, Salmonella typhimurium LT2
gcuauauuuuuuaucagacugg

SEQ ID NO: 3760160 - RNA, 23 nt, Salmonella typhimurium LT2
gcuaucaacgccuccaggcuacc

SEQ ID NO: 3760161 - RNA, 20 nt, Salmonella typhimurium LT2
gcuaucaagauaaaaagaca

SEQ ID NO: 3760162 - RNA, 11 nt, Salmonella typhimurium LT2
gcuaucaagcu

SEQ ID NO: 3760163 - RNA, 20 nt, Salmonella typhimurium LT2
gcuaucaauaccgcuaauac

SEQ ID NO: 3760164 - RNA, 22 nt, Salmonella typhimurium LT2
gcuaucacagcggcaucgauuu

SEQ ID NO: 3760165 - RNA, 16 nt, Salmonella typhimurium LT2
gcuaucagccgccagu

SEQ ID NO: 3760166 - RNA, 20 nt, Salmonella typhimurium LT2
gcuaucaggaagaacacgcc

SEQ ID NO: 3760167 - RNA, 15 nt, Salmonella typhimurium LT2
gcuaucaggcaauac

SEQ ID NO: 3760168 - RNA, 18 nt, Salmonella typhimurium LT2
gcuauccacgcagacgcc

SEQ ID NO: 3760169 - RNA, 17 nt, Salmonella typhimurium LT2
gcuauccagcaguaaau

SEQ ID NO: 3760170 - RNA, 19 nt, Salmonella typhimurium LT2
gcuauccagcaguaaauaa

SEQ ID NO: 3760171 - RNA, 12 nt, Salmonella typhimurium LT2
gcuauccccauu

SEQ ID NO: 3760172 - RNA, 14 nt, Salmonella typhimurium LT2
gcuaucccgaugcu

SEQ ID NO: 3760173 - RNA, 23 nt, Salmonella typhimurium LT2
gcuaucccgaugcucagggcauc

SEQ ID NO: 3760174 - RNA, 14 nt, Salmonella typhimurium LT2
gcuauccgccgcca

SEQ ID NO: 3760175 - RNA, 16 nt, Salmonella typhimurium LT2
gcuauccgccgccagc

SEQ ID NO: 3760176 - RNA, 12 nt, Salmonella typhimurium LT2
gcuauccggcaa

SEQ ID NO: 3760177 - RNA, 19 nt, Salmonella typhimurium LT2
gcuauccucaacuugucug

SEQ ID NO: 3760178 - RNA, 14 nt, Salmonella typhimurium LT2
gcuaucgaccagca

SEQ ID NO: 3760179 - RNA, 14 nt, Salmonella typhimurium LT2
gcuaucgagaaugg

SEQ ID NO: 3760180 - RNA, 17 nt, Salmonella typhimurium LT2
gcuaucgagaaugguuu

SEQ ID NO: 3760181 - RNA, 22 nt, Salmonella typhimurium LT2
gcuaucgccguaaauuccuugu

SEQ ID NO: 3760182 - RNA, 21 nt, Salmonella typhimurium LT2
gcuaucgcgccggacagcagc

SEQ ID NO: 3760183 - RNA, 22 nt, Salmonella typhimurium LT2
gcuaucggguaaaguaacaauc

SEQ ID NO: 3760184 - RNA, 22 nt, Salmonella typhimurium LT2
gcuaucucuuccagcgucucca

SEQ ID NO: 3760185 - RNA, 16 nt, Salmonella typhimurium LT2
gcuaucugacagccaa

SEQ ID NO: 3760186 - RNA, 16 nt, Salmonella typhimurium LT2
gcuaucugcuccgcca

SEQ ID NO: 3760187 - RNA, 15 nt, Salmonella typhimurium LT2
gcuaucuuugcugcc

SEQ ID NO: 3760188 - RNA, 17 nt, Salmonella typhimurium LT2
gcuaugacaaguccgcc

SEQ ID NO: 3760189 - RNA, 22 nt, Salmonella typhimurium LT2
gcuaugccggaggauauuuauu

SEQ ID NO: 3760190 - RNA, 20 nt, Salmonella typhimurium LT2
gcuaugcugaucaucuggcc

SEQ ID NO: 3760191 - RNA, 14 nt, Salmonella typhimurium LT2
gcuauggcaacaaa

SEQ ID NO: 3760192 - RNA, 16 nt, Salmonella typhimurium LT2
gcuauggcaacaaagc

SEQ ID NO: 3760193 - RNA, 16 nt, Salmonella typhimurium LT2
gcuauguagcgcugaa

SEQ ID NO: 3760194 - RNA, 14 nt, Salmonella typhimurium LT2
gcuauucagcaguu

SEQ ID NO: 3760195 - RNA, 19 nt, Salmonella typhimurium LT2
gcuauucgguagucgcuga

SEQ ID NO: 3760196 - RNA, 16 nt, Salmonella typhimurium LT2
gcuauucugcuguucc

SEQ ID NO: 3760197 - RNA, 13 nt, Salmonella typhimurium LT2
gcuauuguugaug

SEQ ID NO: 3760198 - RNA, 21 nt, Salmonella typhimurium LT2
gcuauuugcgcaucauuuuua

SEQ ID NO: 3760199 - RNA, 18 nt, Salmonella typhimurium LT2
gcuauuuugaucccacug

SEQ ID NO: 3760200 - RNA, 15 nt, Salmonella typhimurium LT2
gcucaaaaaagagua

SEQ ID NO: 3760201 - RNA, 13 nt, Salmonella typhimurium LT2
gcucaaauaugau

SEQ ID NO: 3760202 - RNA, 20 nt, Salmonella typhimurium LT2
gcucaaauaugauaugugua

SEQ ID NO: 3760203 - RNA, 19 nt, Salmonella typhimurium LT2
gcucaacauugcucauacc

SEQ ID NO: 3760204 - RNA, 22 nt, Salmonella typhimurium LT2
gcucaacauugcucauaccgcc

SEQ ID NO: 3760205 - RNA, 15 nt, Salmonella typhimurium LT2
gcucaaccgcgcggc

SEQ ID NO: 3760206 - RNA, 21 nt, Salmonella typhimurium LT2
gcucaaccgcgcggcguucug

SEQ ID NO: 3760207 - RNA, 22 nt, Salmonella typhimurium LT2
gcucaaccgcgcggcguucugc

SEQ ID NO: 3760208 - RNA, 17 nt, Salmonella typhimurium LT2
gcucaacgcaggcugga

SEQ ID NO: 3760209 - RNA, 19 nt, Salmonella typhimurium LT2
gcucaacgccuuuacaauc

SEQ ID NO: 3760210 - RNA, 14 nt, Salmonella typhimurium LT2
gcucaacuggauga

SEQ ID NO: 3760211 - RNA, 18 nt, Salmonella typhimurium LT2
gcucaagaguaggccgga

SEQ ID NO: 3760212 - RNA, 15 nt, Salmonella typhimurium LT2
gcucaagcgaaaaaa

SEQ ID NO: 3760213 - RNA, 16 nt, Salmonella typhimurium LT2
gcucaagcgccgcgau

SEQ ID NO: 3760214 - RNA, 18 nt, Salmonella typhimurium LT2
gcucaauaauacgaugua

SEQ ID NO: 3760215 - RNA, 21 nt, Salmonella typhimurium LT2
gcucaauaucuuccuggcgcu

SEQ ID NO: 3760216 - RNA, 14 nt, Salmonella typhimurium LT2
gcucaauaugccag

SEQ ID NO: 3760217 - RNA, 15 nt, Salmonella typhimurium LT2
gcucaauguggcuua

SEQ ID NO: 3760218 - RNA, 12 nt, Salmonella typhimurium LT2
gcucaauuuuuu

SEQ ID NO: 3760219 - RNA, 20 nt, Salmonella typhimurium LT2
gcucaccagcugacgcagca

SEQ ID NO: 3760220 - RNA, 15 nt, Salmonella typhimurium LT2
gcucacccggcugga

SEQ ID NO: 3760221 - RNA, 15 nt, Salmonella typhimurium LT2
gcucaccgacuccuc

SEQ ID NO: 3760222 - RNA, 18 nt, Salmonella typhimurium LT2
gcucaccgacuccucaac

SEQ ID NO: 3760223 - RNA, 20 nt, Salmonella typhimurium LT2
gcucaccgagacugcccggc

SEQ ID NO: 3760224 - RNA, 22 nt, Salmonella typhimurium LT2
gcucaccgagacugcccggcau

SEQ ID NO: 3760225 - RNA, 16 nt, Salmonella typhimurium LT2
gcucaccuccgccacc

SEQ ID NO: 3760226 - RNA, 18 nt, Salmonella typhimurium LT2
gcucaccuccgccaccag

SEQ ID NO: 3760227 - RNA, 16 nt, Salmonella typhimurium LT2
gcucaccugcucgccc

SEQ ID NO: 3760228 - RNA, 16 nt, Salmonella typhimurium LT2
gcucacgcagggugua

SEQ ID NO: 3760229 - RNA, 20 nt, Salmonella typhimurium LT2
gcugcaguuuauuuuugcga

SEQ ID NO: 3760230 - RNA, 19 nt, Salmonella typhimurium LT2
gcugcaucuuacugaccgg

SEQ ID NO: 3760231 - RNA, 22 nt, Salmonella typhimurium LT2
gcugcaucuuacugaccggccc

SEQ ID NO: 3760232 - RNA, 21 nt, Salmonella typhimurium LT2
gcugcauuucuuguugacgac

SEQ ID NO: 3760233 - RNA, 14 nt, Salmonella typhimurium LT2
gcugccacacucuc

SEQ ID NO: 3760234 - RNA, 19 nt, Salmonella typhimurium LT2
gcugccacacucucuccag

SEQ ID NO: 3760235 - RNA, 12 nt, Salmonella typhimurium LT2
gcugccagcaug

SEQ ID NO: 3760236 - RNA, 14 nt, Salmonella typhimurium LT2
gcugccagccagcg

SEQ ID NO: 3760237 - RNA, 15 nt, Salmonella typhimurium LT2
gcugcccgccgccag

SEQ ID NO: 3760238 - RNA, 19 nt, Salmonella typhimurium LT2
gcugccgauacuccauugu

SEQ ID NO: 3760239 - RNA, 22 nt, Salmonella typhimurium LT2
gcugccgauagcaucgcugaug

SEQ ID NO: 3760240 - RNA, 19 nt, Salmonella typhimurium LT2
gcugccgaugaucccggcg

SEQ ID NO: 3760241 - RNA, 17 nt, Salmonella typhimurium LT2
gcugccgauugccgcuc

SEQ ID NO: 3760242 - RNA, 20 nt, Salmonella typhimurium LT2
gcugccgauugccgcucagc

SEQ ID NO: 3760243 - RNA, 19 nt, Salmonella typhimurium LT2
gcugccgcaacggucgguc

SEQ ID NO: 3760244 - RNA, 12 nt, Salmonella typhimurium LT2
gcugccgcccgg

SEQ ID NO: 3760245 - RNA, 15 nt, Salmonella typhimurium LT2
gcugccgucccagcg

SEQ ID NO: 3760246 - RNA, 14 nt, Salmonella typhimurium LT2
gcugccucuuuguu

SEQ ID NO: 3760247 - RNA, 17 nt, Salmonella typhimurium LT2
gcugccuuauccggccu

SEQ ID NO: 3760248 - RNA, 15 nt, Salmonella typhimurium LT2
gcugcgaagccaccg

SEQ ID NO: 3760249 - RNA, 13 nt, Salmonella typhimurium LT2
gcugcgacaacaa

SEQ ID NO: 3760250 - RNA, 18 nt, Salmonella typhimurium LT2
gcugcgacaaugaagcau

SEQ ID NO: 3760251 - RNA, 15 nt, Salmonella typhimurium LT2
gcugcgccagauccg

SEQ ID NO: 3760252 - RNA, 14 nt, Salmonella typhimurium LT2
gcugcgccagcagc

SEQ ID NO: 3760253 - RNA, 22 nt, Salmonella typhimurium LT2
gcugcgccagccagacggcgcc

SEQ ID NO: 3760254 - RNA, 13 nt, Salmonella typhimurium LT2
gcugcgccaucag

SEQ ID NO: 3760255 - RNA, 21 nt, Salmonella typhimurium LT2
gcugcgccaucaggcauggca

SEQ ID NO: 3760256 - RNA, 21 nt, Salmonella typhimurium LT2
gcugcgccgcaaagcgggcga

SEQ ID NO: 3760257 - RNA, 22 nt, Salmonella typhimurium LT2
gcugcgccugaaaggcacgcuc

SEQ ID NO: 3760258 - RNA, 18 nt, Salmonella typhimurium LT2
gcugcgccugcgggucca

SEQ ID NO: 3760259 - RNA, 20 nt, Salmonella typhimurium LT2
gcugcgccuuacccggccua

SEQ ID NO: 3760260 - RNA, 14 nt, Salmonella typhimurium LT2
gcugcgcggccaga

SEQ ID NO: 3760261 - RNA, 16 nt, Salmonella typhimurium LT2
gcugcgcucgcccuuc

SEQ ID NO: 3760262 - RNA, 17 nt, Salmonella typhimurium LT2
gcugcgcuuaccgggcc

SEQ ID NO: 3760263 - RNA, 11 nt, Salmonella typhimurium LT2
gcugcggauga

SEQ ID NO: 3760264 - RNA, 13 nt, Salmonella typhimurium LT2
gcugcggcacgcu

SEQ ID NO: 3760265 - RNA, 15 nt, Salmonella typhimurium LT2
gcugcggccuccgca

SEQ ID NO: 3760266 - RNA, 11 nt, Salmonella typhimurium LT2
gcugcggccug

SEQ ID NO: 3760267 - RNA, 16 nt, Salmonella typhimurium LT2
gcugcggcguccccca

SEQ ID NO: 3760268 - RNA, 23 nt, Salmonella typhimurium LT2
gcugcggcgucccccaauguuca

SEQ ID NO: 3760269 - RNA, 15 nt, Salmonella typhimurium LT2
gcugcgggaaaagca

SEQ ID NO: 3760270 - RNA, 16 nt, Salmonella typhimurium LT2
gcugcgggaaaagcau

SEQ ID NO: 3760271 - RNA, 12 nt, Salmonella typhimurium LT2
gcugcgggccgc

SEQ ID NO: 3760272 - RNA, 16 nt, Salmonella typhimurium LT2
gcugcguaaccgccag

SEQ ID NO: 3760273 - RNA, 22 nt, Salmonella typhimurium LT2
gcugcguaacgcuuaaccccuc

SEQ ID NO: 3760274 - RNA, 18 nt, Salmonella typhimurium LT2
gcugcguaacguaucggc

SEQ ID NO: 3760275 - RNA, 16 nt, Salmonella typhimurium LT2
gcugcgucgcuuccug

SEQ ID NO: 3760276 - RNA, 21 nt, Salmonella typhimurium LT2
gcugcgucgcuuccuguucac

SEQ ID NO: 3760277 - RNA, 16 nt, Salmonella typhimurium LT2
gcugcguugccgccuu

SEQ ID NO: 3760278 - RNA, 20 nt, Salmonella typhimurium LT2
gcugcguuugccgccuuguc

SEQ ID NO: 3760279 - RNA, 15 nt, Salmonella typhimurium LT2
gcugcucccggcgua

SEQ ID NO: 3760280 - RNA, 14 nt, Salmonella typhimurium LT2
gcugcucuucuugc

SEQ ID NO: 3760281 - RNA, 19 nt, Salmonella typhimurium LT2
gcugcugacguaaauucug

SEQ ID NO: 3760282 - RNA, 21 nt, Salmonella typhimurium LT2
gcugcugcgcuuuccaggcca

SEQ ID NO: 3760283 - RNA, 14 nt, Salmonella typhimurium LT2
gcugcuggacagga

SEQ ID NO: 3760284 - RNA, 19 nt, Salmonella typhimurium LT2
gcugcuggagaccaccggc

SEQ ID NO: 3760285 - RNA, 19 nt, Salmonella typhimurium LT2
gcugcuggccuuccagaua

SEQ ID NO: 3760286 - RNA, 14 nt, Salmonella typhimurium LT2
gcugcuggcgcguc

SEQ ID NO: 3760287 - RNA, 14 nt, Salmonella typhimurium LT2
gcugcuguaacaga

SEQ ID NO: 3760288 - RNA, 19 nt, Salmonella typhimurium LT2
gcugcuuuuugagcggcac

SEQ ID NO: 3760289 - RNA, 16 nt, Salmonella typhimurium LT2
gcuggaaacgcggccc

SEQ ID NO: 3760290 - RNA, 22 nt, Salmonella typhimurium LT2
gcuggaaagcucuucaugcagc

SEQ ID NO: 3760291 - RNA, 19 nt, Salmonella typhimurium LT2
gcuggaaccugaguucccg

SEQ ID NO: 3760292 - RNA, 21 nt, Salmonella typhimurium LT2
gcuggaacgcgucggcgcggg

SEQ ID NO: 3760293 - RNA, 14 nt, Salmonella typhimurium LT2
gcuggaagaggcgc

SEQ ID NO: 3760294 - RNA, 19 nt, Salmonella typhimurium LT2
gcuggacaugcuccgcccc

SEQ ID NO: 3760295 - RNA, 15 nt, Salmonella typhimurium LT2
gcuggaggcggacga

SEQ ID NO: 3760296 - RNA, 24 nt, Salmonella typhimurium LT2
gcuggaggugauggagccuucaac

SEQ ID NO: 3760297 - RNA, 16 nt, Salmonella typhimurium LT2
gcuggcaaaacgcauc

SEQ ID NO: 3760298 - RNA, 18 nt, Salmonella typhimurium LT2
gcuggcaaaacgcaucca

SEQ ID NO: 3760299 - RNA, 20 nt, Salmonella typhimurium LT2
gcuggcaaaacgcauccagc

SEQ ID NO: 3760300 - RNA, 15 nt, Salmonella typhimurium LT2
gcuggcacguucucg

SEQ ID NO: 3760301 - RNA, 14 nt, Salmonella typhimurium LT2
gcuggcagggggag

SEQ ID NO: 3760302 - RNA, 16 nt, Salmonella typhimurium LT2
gcuggcauaaccgcag

SEQ ID NO: 3760303 - RNA, 19 nt, Salmonella typhimurium LT2
gcuggcauuaucguccguc

SEQ ID NO: 3760304 - RNA, 14 nt, Salmonella typhimurium LT2
gcuggccgcgugcu

SEQ ID NO: 3760305 - RNA, 16 nt, Salmonella typhimurium LT2
gcuggccuuuauacca

SEQ ID NO: 3760306 - RNA, 17 nt, Salmonella typhimurium LT2
gcuggcgaaccaccagc

SEQ ID NO: 3760307 - RNA, 18 nt, Salmonella typhimurium LT2
gcuggcgagcagaaaaag

SEQ ID NO: 3760308 - RNA, 23 nt, Salmonella typhimurium LT2
gcuggcgauauccgugccgccgc

SEQ ID NO: 3760309 - RNA, 20 nt, Salmonella typhimurium LT2
gcuggcgcggggaacacaau

SEQ ID NO: 3760310 - RNA, 19 nt, Salmonella typhimurium LT2
gcuggcgcggggaacacua

SEQ ID NO: 3760311 - RNA, 14 nt, Salmonella typhimurium LT2
gcuggcgcuuaccg

SEQ ID NO: 3760312 - RNA, 21 nt, Salmonella typhimurium LT2
gcuggcgguaacaggcaccag

SEQ ID NO: 3760313 - RNA, 22 nt, Salmonella typhimurium LT2
gcuggcgguaacaggcaccagc

SEQ ID NO: 3760314 - RNA, 14 nt, Salmonella typhimurium LT2
gcuggcggucggga

SEQ ID NO: 3760315 - RNA, 17 nt, Salmonella typhimurium LT2
gcuggcugaaccccugu

SEQ ID NO: 3760316 - RNA, 18 nt, Salmonella typhimurium LT2
gcuggcuggcgcaauguu

SEQ ID NO: 3760317 - RNA, 15 nt, Salmonella typhimurium LT2
gcuggcuuaacucac

SEQ ID NO: 3760318 - RNA, 14 nt, Salmonella typhimurium LT2
gcuggcuuucgccu

SEQ ID NO: 3760319 - RNA, 18 nt, Salmonella typhimurium LT2
gcuggcuuucgccuggug

SEQ ID NO: 3760320 - RNA, 15 nt, Salmonella typhimurium LT2
gcugggucagugguc

SEQ ID NO: 3760321 - RNA, 14 nt, Salmonella typhimurium LT2
gcuggguucaucca

SEQ ID NO: 3760322 - RNA, 16 nt, Salmonella typhimurium LT2
gcuggguucauccagc

SEQ ID NO: 3760323 - RNA, 23 nt, Salmonella typhimurium LT2
gcugguaaauaacgggcgcgcgc

SEQ ID NO: 3760324 - RNA, 18 nt, Salmonella typhimurium LT2
gcugguagacaaacagcg

SEQ ID NO: 3760325 - RNA, 23 nt, Salmonella typhimurium LT2
gcuggucagcaacgccuccagcg

SEQ ID NO: 3760326 - RNA, 15 nt, Salmonella typhimurium LT2
gcuggucagcgcaau

SEQ ID NO: 3760327 - RNA, 19 nt, Salmonella typhimurium LT2
gcuggucagcguaccagcg

SEQ ID NO: 3760328 - RNA, 17 nt, Salmonella typhimurium LT2
gcuggucgccgcccauc

SEQ ID NO: 3760329 - RNA, 19 nt, Salmonella typhimurium LT2
gcuggucgccgcccaucgg

SEQ ID NO: 3760330 - RNA, 13 nt, Salmonella typhimurium LT2
gcuggucgcgaua

SEQ ID NO: 3760331 - RNA, 15 nt, Salmonella typhimurium LT2
gcuggugaagacgcu

SEQ ID NO: 3760332 - RNA, 19 nt, Salmonella typhimurium LT2
gcuggugccaaucuccagc

SEQ ID NO: 3760333 - RNA, 19 nt, Salmonella typhimurium LT2
gcuucgcucuccgccgcgg

SEQ ID NO: 3760334 - RNA, 17 nt, Salmonella typhimurium LT2
gcuucgcucucgugcca

SEQ ID NO: 3760335 - RNA, 14 nt, Salmonella typhimurium LT2
gcuucgcuuaccag

SEQ ID NO: 3760336 - RNA, 17 nt, Salmonella typhimurium LT2
gcuucgguccggcgcua

SEQ ID NO: 3760337 - RNA, 14 nt, Salmonella typhimurium LT2
gcuucgucuuuauu

SEQ ID NO: 3760338 - RNA, 15 nt, Salmonella typhimurium LT2
gcuucgugagaagua

SEQ ID NO: 3760339 - RNA, 16 nt, Salmonella typhimurium LT2
gcuucguucuguauca

SEQ ID NO: 3760340 - RNA, 22 nt, Salmonella typhimurium LT2
gcuucguucuguaucaucgauu

SEQ ID NO: 3760341 - RNA, 13 nt, Salmonella typhimurium LT2
gcuucuauccacu

SEQ ID NO: 3760342 - RNA, 13 nt, Salmonella typhimurium LT2
gcuucuccaccau

SEQ ID NO: 3760343 - RNA, 20 nt, Salmonella typhimurium LT2
gcuucuccaccauaucgcag

SEQ ID NO: 3760344 - RNA, 11 nt, Salmonella typhimurium LT2
gcuucucccaa

SEQ ID NO: 3760345 - RNA, 18 nt, Salmonella typhimurium LT2
gcuucucccugacuggcu

SEQ ID NO: 3760346 - RNA, 14 nt, Salmonella typhimurium LT2
gcuucucuuuccag

SEQ ID NO: 3760347 - RNA, 17 nt, Salmonella typhimurium LT2
gcuucugauacugcucc

SEQ ID NO: 3760348 - RNA, 15 nt, Salmonella typhimurium LT2
gcuucugcgccuuug

SEQ ID NO: 3760349 - RNA, 21 nt, Salmonella typhimurium LT2
gcuucugcgccuuuggcagga

SEQ ID NO: 3760350 - RNA, 12 nt, Salmonella typhimurium LT2
gcuucugguugu

SEQ ID NO: 3760351 - RNA, 16 nt, Salmonella typhimurium LT2
gcuucugucugcguga

SEQ ID NO: 3760352 - RNA, 18 nt, Salmonella typhimurium LT2
gcuucuuauuauccaggc

SEQ ID NO: 3760353 - RNA, 20 nt, Salmonella typhimurium LT2
gcuucuucaaacuuagcgac

SEQ ID NO: 3760354 - RNA, 13 nt, Salmonella typhimurium LT2
gcuucuucaacgu

SEQ ID NO: 3760355 - RNA, 18 nt, Salmonella typhimurium LT2
gcuucuucaacguuuuca

SEQ ID NO: 3760356 - RNA, 22 nt, Salmonella typhimurium LT2
gcuucuucaacguuuucaccug

SEQ ID NO: 3760357 - RNA, 21 nt, Salmonella typhimurium LT2
gcuucuuugaagcguuccagu

SEQ ID NO: 3760358 - RNA, 15 nt, Salmonella typhimurium LT2
gcuugacucugaagc

SEQ ID NO: 3760359 - RNA, 19 nt, Salmonella typhimurium LT2
gcuugaguuuuccgccauu

SEQ ID NO: 3760360 - RNA, 15 nt, Salmonella typhimurium LT2
gcuugcaccauggcg

SEQ ID NO: 3760361 - RNA, 14 nt, Salmonella typhimurium LT2
gcuugccaagcagg

SEQ ID NO: 3760362 - RNA, 20 nt, Salmonella typhimurium LT2
gcuugccacuacgcagcucc

SEQ ID NO: 3760363 - RNA, 20 nt, Salmonella typhimurium LT2
gcuugccaguacgccaggcu

SEQ ID NO: 3760364 - RNA, 19 nt, Salmonella typhimurium LT2
gcuugcccgauggcgcugc

SEQ ID NO: 3760365 - RNA, 21 nt, Salmonella typhimurium LT2
gcuugcccggccuacauucau

SEQ ID NO: 3760366 - RNA, 22 nt, Salmonella typhimurium LT2
gcuugccgucgcaggcggccag

SEQ ID NO: 3760367 - RNA, 21 nt, Salmonella typhimurium LT2
gcuugccgucgucauaagcaa

SEQ ID NO: 3760368 - RNA, 12 nt, Salmonella typhimurium LT2
gcuugccugcuu

SEQ ID NO: 3760369 - RNA, 14 nt, Salmonella typhimurium LT2
gcuugcgccgccau

SEQ ID NO: 3760370 - RNA, 15 nt, Salmonella typhimurium LT2
gcuugcgcuauccgc

SEQ ID NO: 3760371 - RNA, 14 nt, Salmonella typhimurium LT2
gcuugcggcugcca

SEQ ID NO: 3760372 - RNA, 20 nt, Salmonella typhimurium LT2
gcuugucacgaaguuccagu

SEQ ID NO: 3760373 - RNA, 13 nt, Salmonella typhimurium LT2
gcuugucgaucau

SEQ ID NO: 3760374 - RNA, 21 nt, Salmonella typhimurium LT2
gcuuguguaggccggauaaga

SEQ ID NO: 3760375 - RNA, 15 nt, Salmonella typhimurium LT2
gcuuguuaucuggca

SEQ ID NO: 3760376 - RNA, 19 nt, Salmonella typhimurium LT2
gcuuguuguuuauccugca

SEQ ID NO: 3760377 - RNA, 14 nt, Salmonella typhimurium LT2
gcuuuaaagcaggc

SEQ ID NO: 3760378 - RNA, 17 nt, Salmonella typhimurium LT2
gcuuuaauaccgguggc

SEQ ID NO: 3760379 - RNA, 18 nt, Salmonella typhimurium LT2
gcuuuaaucaccauggcg

SEQ ID NO: 3760380 - RNA, 23 nt, Salmonella typhimurium LT2
gcuuuaaucacccgcgccagcag

SEQ ID NO: 3760381 - RNA, 20 nt, Salmonella typhimurium LT2
gcuuuacccggcgcaaacag

SEQ ID NO: 3760382 - RNA, 20 nt, Salmonella typhimurium LT2
gcuuuacccgggccaucuuu

SEQ ID NO: 3760383 - RNA, 22 nt, Salmonella typhimurium LT2
gcuuuacccgggccaucuuuuu

SEQ ID NO: 3760384 - RNA, 22 nt, Salmonella typhimurium LT2
gcuuuaccgggccuauguuucu

SEQ ID NO: 3760385 - RNA, 12 nt, Salmonella typhimurium LT2
gcuuuagcuuua

SEQ ID NO: 3760386 - RNA, 16 nt, Salmonella typhimurium LT2
gcuuuagcuuuacucu

SEQ ID NO: 3760387 - RNA, 15 nt, Salmonella typhimurium LT2
gcuuuagggcuuccu

SEQ ID NO: 3760388 - RNA, 23 nt, Salmonella typhimurium LT2
gcuuuagugauaauuuuccgggu

SEQ ID NO: 3760389 - RNA, 16 nt, Salmonella typhimurium LT2
gcuuuagugccgccau

SEQ ID NO: 3760390 - RNA, 13 nt, Salmonella typhimurium LT2
gcuuuaugcacgc

SEQ ID NO: 3760391 - RNA, 13 nt, Salmonella typhimurium LT2
gcuuuauugacua

SEQ ID NO: 3760392 - RNA, 18 nt, Salmonella typhimurium LT2
gcuuucacaccguuaucc

SEQ ID NO: 3760393 - RNA, 23 nt, Salmonella typhimurium LT2
gcuuucaucauucgcaccaccgg

SEQ ID NO: 3760394 - RNA, 22 nt, Salmonella typhimurium LT2
gcuuucaucguauaaauuuuua

SEQ ID NO: 3760395 - RNA, 12 nt, Salmonella typhimurium LT2
gcuuuccagcuc

SEQ ID NO: 3760396 - RNA, 16 nt, Salmonella typhimurium LT2
gcuuuccauuacgcuu

SEQ ID NO: 3760397 - RNA, 15 nt, Salmonella typhimurium LT2
gcuuucccuucagau

SEQ ID NO: 3760398 - RNA, 20 nt, Salmonella typhimurium LT2
gcuuuccgccaugaaaaaaa

SEQ ID NO: 3760399 - RNA, 17 nt, Salmonella typhimurium LT2
gcuuucgccaccagcga

SEQ ID NO: 3760400 - RNA, 18 nt, Salmonella typhimurium LT2
gcuuucgccaccagcgau

SEQ ID NO: 3760401 - RNA, 18 nt, Salmonella typhimurium LT2
gcuuucgccagccgcagc

SEQ ID NO: 3760402 - RNA, 15 nt, Salmonella typhimurium LT2
gcuuucugccaggca

SEQ ID NO: 3760403 - RNA, 10 nt, Salmonella typhimurium LT2
gcuuucuucu

SEQ ID NO: 3760404 - RNA, 20 nt, Salmonella typhimurium LT2
gcuuucuugcucagcgaccg

SEQ ID NO: 3760405 - RNA, 23 nt, Salmonella typhimurium LT2
gcuuucuuucuccagcguacugc

SEQ ID NO: 3760406 - RNA, 19 nt, Salmonella typhimurium LT2
gcuuugaaucucuucccag

SEQ ID NO: 3760407 - RNA, 19 nt, Salmonella typhimurium LT2
gcuuugauauagggcuuga

SEQ ID NO: 3760408 - RNA, 17 nt, Salmonella typhimurium LT2
gcuuugcaagcaugaua

SEQ ID NO: 3760409 - RNA, 19 nt, Salmonella typhimurium LT2
gcuuugcaauguucaauau

SEQ ID NO: 3760410 - RNA, 22 nt, Salmonella typhimurium LT2
gcuuugccgucgcgaacgugcu

SEQ ID NO: 3760411 - RNA, 15 nt, Salmonella typhimurium LT2
gcuuugcgccacuuc

SEQ ID NO: 3760412 - RNA, 22 nt, Salmonella typhimurium LT2
gcuuugcguaaugugauccgcc

SEQ ID NO: 3760413 - RNA, 17 nt, Salmonella typhimurium LT2
gcuuugcuuauccggcc

SEQ ID NO: 3760414 - RNA, 19 nt, Salmonella typhimurium LT2
gcuuugcuuauccggccua

SEQ ID NO: 3760415 - RNA, 13 nt, Salmonella typhimurium LT2
gcuuuggcaggcc

SEQ ID NO: 3760416 - RNA, 20 nt, Salmonella typhimurium LT2
gcuuuuacaggccgcucuau

SEQ ID NO: 3760417 - RNA, 20 nt, Salmonella typhimurium LT2
gcuuuuauguuacccagccu

SEQ ID NO: 3760418 - RNA, 23 nt, Salmonella typhimurium LT2
gcuuuucagcccaggcuuuaguu

SEQ ID NO: 3760419 - RNA, 14 nt, Salmonella typhimurium LT2
gcuuuucagcgcca

SEQ ID NO: 3760420 - RNA, 12 nt, Salmonella typhimurium LT2
gcuuuucaggcu

SEQ ID NO: 3760421 - RNA, 22 nt, Salmonella typhimurium LT2
gcuuuucaugacgcucuccucc

SEQ ID NO: 3760422 - RNA, 19 nt, Salmonella typhimurium LT2
gcuuuuccaccccagcauu

SEQ ID NO: 3760423 - RNA, 17 nt, Salmonella typhimurium LT2
gcuuuuccauacgcuuu

SEQ ID NO: 3760424 - RNA, 21 nt, Salmonella typhimurium LT2
gcuuuugaauuugaaggacug

SEQ ID NO: 3760425 - RNA, 17 nt, Salmonella typhimurium LT2
gcuuuugguuccuucag

SEQ ID NO: 3760426 - RNA, 13 nt, Salmonella typhimurium LT2
gcuuuuucaucau

SEQ ID NO: 3760427 - RNA, 17 nt, Salmonella typhimurium LT2
gcuuuuucggcaaucug

SEQ ID NO: 3760428 - RNA, 19 nt, Salmonella typhimurium LT2
gcuuuuugcgccagcgcca

SEQ ID NO: 3760429 - RNA, 23 nt, Salmonella typhimurium LT2
ggaaaaaagcgcccagcgccgga

SEQ ID NO: 3760430 - RNA, 22 nt, Salmonella typhimurium LT2
ggaaaaaauuacugccugaacu

SEQ ID NO: 3760431 - RNA, 19 nt, Salmonella typhimurium LT2
ggaaaaauuccgcagagcu

SEQ ID NO: 3760432 - RNA, 17 nt, Salmonella typhimurium LT2
ggaaaacagcgccggca

SEQ ID NO: 3760433 - RNA, 16 nt, Salmonella typhimurium LT2
ggaaaaccccaucccg

SEQ ID NO: 3760434 - RNA, 13 nt, Salmonella typhimurium LT2
ggaaaacgcuucu

SEQ ID NO: 3760435 - RNA, 22 nt, Salmonella typhimurium LT2
ggaaaacggccagugaaauaaa

SEQ ID NO: 3760436 - RNA, 23 nt, Salmonella typhimurium LT2
ggaaaacggccagugaaauaaau

SEQ ID NO: 3760437 - RNA, 19 nt, Salmonella typhimurium LT2
ggagacgucaaagaguucc

SEQ ID NO: 3760438 - RNA, 19 nt, Salmonella typhimurium LT2
ggagacuucgcugaaaaug

SEQ ID NO: 3760439 - RNA, 17 nt, Salmonella typhimurium LT2
ggagagacguucauuuc

SEQ ID NO: 3760440 - RNA, 23 nt, Salmonella typhimurium LT2
ggagagaggacacguuaauuauu

SEQ ID NO: 3760441 - RNA, 23 nt, Salmonella typhimurium LT2
ggagagcauuuguagcggcaaca

SEQ ID NO: 3760442 - RNA, 18 nt, Salmonella typhimurium LT2
ggagaucgcuuuccagcg

SEQ ID NO: 3760443 - RNA, 14 nt, Salmonella typhimurium LT2
ggagaucggcugua

SEQ ID NO: 3760444 - RNA, 17 nt, Salmonella typhimurium LT2
ggagauuucauccucuu

SEQ ID NO: 3760445 - RNA, 16 nt, Salmonella typhimurium LT2
ggagccaaaagaagug

SEQ ID NO: 3760446 - RNA, 18 nt, Salmonella typhimurium LT2
ggagccgccuggccuguc

SEQ ID NO: 3760447 - RNA, 19 nt, Salmonella typhimurium LT2
ggagccucuucuggcuccc

SEQ ID NO: 3760448 - RNA, 18 nt, Salmonella typhimurium LT2
ggagcgaagaauucgcaa

SEQ ID NO: 3760449 - RNA, 14 nt, Salmonella typhimurium LT2
ggagcggcguccgc

SEQ ID NO: 3760450 - RNA, 17 nt, Salmonella typhimurium LT2
ggagcguuaaucaccuc

SEQ ID NO: 3760451 - RNA, 13 nt, Salmonella typhimurium LT2
ggagcuguucuua

SEQ ID NO: 3760452 - RNA, 12 nt, Salmonella typhimurium LT2
ggaggaacagcg

SEQ ID NO: 3760453 - RNA, 22 nt, Salmonella typhimurium LT2
ggaggaacagcgccgucacccg

SEQ ID NO: 3760454 - RNA, 14 nt, Salmonella typhimurium LT2
ggaggacgucuguc

SEQ ID NO: 3760455 - RNA, 16 nt, Salmonella typhimurium LT2
ggaggccugaauaaug

SEQ ID NO: 3760456 - RNA, 20 nt, Salmonella typhimurium LT2
ggaggcggacgaaacguugc

SEQ ID NO: 3760457 - RNA, 19 nt, Salmonella typhimurium LT2
ggagggguuuucgccagca

SEQ ID NO: 3760458 - RNA, 20 nt, Salmonella typhimurium LT2
ggagguauaaucagcaucac

SEQ ID NO: 3760459 - RNA, 18 nt, Salmonella typhimurium LT2
ggagguauacauccacug

SEQ ID NO: 3760460 - RNA, 15 nt, Salmonella typhimurium LT2
ggaggucauuauuca

SEQ ID NO: 3760461 - RNA, 23 nt, Salmonella typhimurium LT2
ggaggucauuauucaggccuccu

SEQ ID NO: 3760462 - RNA, 22 nt, Salmonella typhimurium LT2
ggagguucaccaccacccagug

SEQ ID NO: 3760463 - RNA, 13 nt, Salmonella typhimurium LT2
ggaguccagcaac

SEQ ID NO: 3760464 - RNA, 22 nt, Salmonella typhimurium LT2
ggaguugaugguuauuccuugu

SEQ ID NO: 3760465 - RNA, 15 nt, Salmonella typhimurium LT2
ggauaaaacagaaac

SEQ ID NO: 3760466 - RNA, 14 nt, Salmonella typhimurium LT2
ggauaaacgccccu

SEQ ID NO: 3760467 - RNA, 14 nt, Salmonella typhimurium LT2
ggauaaaucaucau

SEQ ID NO: 3760468 - RNA, 23 nt, Salmonella typhimurium LT2
ggauaaccguacggcugccuuug

SEQ ID NO: 3760469 - RNA, 17 nt, Salmonella typhimurium LT2
ggauaagcgcagcgcca

SEQ ID NO: 3760470 - RNA, 19 nt, Salmonella typhimurium LT2
ggauaagcguaagcgccau

SEQ ID NO: 3760471 - RNA, 18 nt, Salmonella typhimurium LT2
ggauaagcguagcgccau

SEQ ID NO: 3760472 - RNA, 18 nt, Salmonella typhimurium LT2
ggauaagcgucagcgcca

SEQ ID NO: 3760473 - RNA, 19 nt, Salmonella typhimurium LT2
ggauaagcgucagcgccau

SEQ ID NO: 3760474 - RNA, 23 nt, Salmonella typhimurium LT2
ggauaaggcauucacgccgccau

SEQ ID NO: 3760475 - RNA, 23 nt, Salmonella typhimurium LT2
ggauaaggcauuuaugccgccau

SEQ ID NO: 3760476 - RNA, 20 nt, Salmonella typhimurium LT2
ggauaaggcgcagccgccau

SEQ ID NO: 3760477 - RNA, 20 nt, Salmonella typhimurium LT2
ggauaaggcggagccgccau

SEQ ID NO: 3760478 - RNA, 14 nt, Salmonella typhimurium LT2
ggauaaggcgugag

SEQ ID NO: 3760479 - RNA, 23 nt, Salmonella typhimurium LT2
ggauaaggcguuugcgccgcuau

SEQ ID NO: 3760480 - RNA, 15 nt, Salmonella typhimurium LT2
ggauaaucagcagcg

SEQ ID NO: 3760481 - RNA, 19 nt, Salmonella typhimurium LT2
ggauaaucuugauccggcu

SEQ ID NO: 3760482 - RNA, 13 nt, Salmonella typhimurium LT2
ggauacagcgccg

SEQ ID NO: 3760483 - RNA, 17 nt, Salmonella typhimurium LT2
ggauacagcgccgcgca

SEQ ID NO: 3760484 - RNA, 15 nt, Salmonella typhimurium LT2
ggauaccacgcacau

SEQ ID NO: 3760485 - RNA, 14 nt, Salmonella typhimurium LT2
ggauacccagccac

SEQ ID NO: 3760486 - RNA, 16 nt, Salmonella typhimurium LT2
ggauacccagccacau

SEQ ID NO: 3760487 - RNA, 20 nt, Salmonella typhimurium LT2
ggauaccgaagacggcgaaa

SEQ ID NO: 3760488 - RNA, 20 nt, Salmonella typhimurium LT2
ggauaccguccaccagcaca

SEQ ID NO: 3760489 - RNA, 17 nt, Salmonella typhimurium LT2
ggauacggucgacacca

SEQ ID NO: 3760490 - RNA, 20 nt, Salmonella typhimurium LT2
ggauacguuccagcagcgca

SEQ ID NO: 3760491 - RNA, 16 nt, Salmonella typhimurium LT2
ggauagagaucuuccg

SEQ ID NO: 3760492 - RNA, 17 nt, Salmonella typhimurium LT2
ggauagagaucuuccgc

SEQ ID NO: 3760493 - RNA, 12 nt, Salmonella typhimurium LT2
ggauagcaaucu

SEQ ID NO: 3760494 - RNA, 15 nt, Salmonella typhimurium LT2
ggauagcuacgauaa

SEQ ID NO: 3760495 - RNA, 22 nt, Salmonella typhimurium LT2
ggauagcucgcuguaccgccau

SEQ ID NO: 3760496 - RNA, 19 nt, Salmonella typhimurium LT2
ggauagugccugccgucgc

SEQ ID NO: 3760497 - RNA, 19 nt, Salmonella typhimurium LT2
ggauaugcgacgaaagcgg

SEQ ID NO: 3760498 - RNA, 13 nt, Salmonella typhimurium LT2
ggauauggcaaaa

SEQ ID NO: 3760499 - RNA, 16 nt, Salmonella typhimurium LT2
ggauauguuugacaag

SEQ ID NO: 3760500 - RNA, 17 nt, Salmonella typhimurium LT2
ggauauguuugacaagc

SEQ ID NO: 3760501 - RNA, 23 nt, Salmonella typhimurium LT2
ggauauucguccaccuaaagagg

SEQ ID NO: 3760502 - RNA, 18 nt, Salmonella typhimurium LT2
ggauauugccgaagacca

SEQ ID NO: 3760503 - RNA, 21 nt, Salmonella typhimurium LT2
ggaucaaaaaggugagcauug

SEQ ID NO: 3760504 - RNA, 22 nt, Salmonella typhimurium LT2
ggaucaacggugggguccgauu

SEQ ID NO: 3760505 - RNA, 13 nt, Salmonella typhimurium LT2
ggaucaagccccc

SEQ ID NO: 3760506 - RNA, 20 nt, Salmonella typhimurium LT2
ggaucagccugagcgccagc

SEQ ID NO: 3760507 - RNA, 17 nt, Salmonella typhimurium LT2
ggaucaguaacaggacg

SEQ ID NO: 3760508 - RNA, 16 nt, Salmonella typhimurium LT2
ggaucaugauuucgac

SEQ ID NO: 3760509 - RNA, 21 nt, Salmonella typhimurium LT2
ggauccagaauauucacgaca

SEQ ID NO: 3760510 - RNA, 13 nt, Salmonella typhimurium LT2
ggaucgacgcuga

SEQ ID NO: 3760511 - RNA, 17 nt, Salmonella typhimurium LT2
ggaucgccaucgacagc

SEQ ID NO: 3760512 - RNA, 20 nt, Salmonella typhimurium LT2
ggaucgccgcaaucagcauu

SEQ ID NO: 3760513 - RNA, 23 nt, Salmonella typhimurium LT2
ggaucguucugcugauaauacug

SEQ ID NO: 3760514 - RNA, 14 nt, Salmonella typhimurium LT2
ggaucucaccacug

SEQ ID NO: 3760515 - RNA, 20 nt, Salmonella typhimurium LT2
ggaucugcgcauuaacgccg

SEQ ID NO: 3760516 - RNA, 18 nt, Salmonella typhimurium LT2
ggaugaacucaauccauu

SEQ ID NO: 3760517 - RNA, 17 nt, Salmonella typhimurium LT2
ggaugaccaguuaagca

SEQ ID NO: 3760518 - RNA, 19 nt, Salmonella typhimurium LT2
ggaugaccaguuaagcaaa

SEQ ID NO: 3760519 - RNA, 21 nt, Salmonella typhimurium LT2
ggaugacgccguucaaagccg

SEQ ID NO: 3760520 - RNA, 22 nt, Salmonella typhimurium LT2
ggaugaggcgcagccgccaucc

SEQ ID NO: 3760521 - RNA, 16 nt, Salmonella typhimurium LT2
ggaugauacugcucau

SEQ ID NO: 3760522 - RNA, 19 nt, Salmonella typhimurium LT2
ggaugcaucaugcuaaaag

SEQ ID NO: 3760523 - RNA, 20 nt, Salmonella typhimurium LT2
ggaugcgagaaugucgccau

SEQ ID NO: 3760524 - RNA, 16 nt, Salmonella typhimurium LT2
ggaugcggcuagcgcc

SEQ ID NO: 3760525 - RNA, 22 nt, Salmonella typhimurium LT2
ggaugcguaauccggccuggcg

SEQ ID NO: 3760526 - RNA, 14 nt, Salmonella typhimurium LT2
ggauggagcggcgc

SEQ ID NO: 3760527 - RNA, 16 nt, Salmonella typhimurium LT2
ggauggccucugccag

SEQ ID NO: 3760528 - RNA, 15 nt, Salmonella typhimurium LT2
ggauggccugcucga

SEQ ID NO: 3760529 - RNA, 22 nt, Salmonella typhimurium LT2
ggauggcgacgcaggcgccuua

SEQ ID NO: 3760530 - RNA, 20 nt, Salmonella typhimurium LT2
ggauggcgacguuaacgccg

SEQ ID NO: 3760531 - RNA, 14 nt, Salmonella typhimurium LT2
ggauggcggcgcuu

SEQ ID NO: 3760532 - RNA, 23 nt, Salmonella typhimurium LT2
ggauggggcaucagccgccaucc

SEQ ID NO: 3760533 - RNA, 11 nt, Salmonella typhimurium LT2
ggauggugguc

SEQ ID NO: 3760534 - RNA, 20 nt, Salmonella typhimurium LT2
ggauguacucauccauuucc

SEQ ID NO: 3760535 - RNA, 11 nt, Salmonella typhimurium LT2
ggauguauuuu

SEQ ID NO: 3760536 - RNA, 16 nt, Salmonella typhimurium LT2
ggauguuuucagcauu

SEQ ID NO: 3760537 - RNA, 15 nt, Salmonella typhimurium LT2
ggauuacgacccaca

SEQ ID NO: 3760538 - RNA, 19 nt, Salmonella typhimurium LT2
ggauucgacggccagcgcg

SEQ ID NO: 3760539 - RNA, 15 nt, Salmonella typhimurium LT2
ggauucgcucaccgc

SEQ ID NO: 3760540 - RNA, 21 nt, Salmonella typhimurium LT2
ggcagcgucguccagcccggc

SEQ ID NO: 3760541 - RNA, 20 nt, Salmonella typhimurium LT2
ggcagcgugaacgccuuauc

SEQ ID NO: 3760542 - RNA, 11 nt, Salmonella typhimurium LT2
ggcagcucucc

SEQ ID NO: 3760543 - RNA, 15 nt, Salmonella typhimurium LT2
ggcagcuuacugugc

SEQ ID NO: 3760544 - RNA, 14 nt, Salmonella typhimurium LT2
ggcaggaugaauga

SEQ ID NO: 3760545 - RNA, 17 nt, Salmonella typhimurium LT2
ggcaggaugaaugacug

SEQ ID NO: 3760546 - RNA, 14 nt, Salmonella typhimurium LT2
ggcaggcaaaaaga

SEQ ID NO: 3760547 - RNA, 21 nt, Salmonella typhimurium LT2
ggcaggcaacaugaccagcgc

SEQ ID NO: 3760548 - RNA, 16 nt, Salmonella typhimurium LT2
ggcaggcauggccaau

SEQ ID NO: 3760549 - RNA, 15 nt, Salmonella typhimurium LT2
ggcaggccggcagcc

SEQ ID NO: 3760550 - RNA, 15 nt, Salmonella typhimurium LT2
ggcaggccuaacaca

SEQ ID NO: 3760551 - RNA, 19 nt, Salmonella typhimurium LT2
ggcaggccuuucggcagcg

SEQ ID NO: 3760552 - RNA, 16 nt, Salmonella typhimurium LT2
ggcagggugccaggua

SEQ ID NO: 3760553 - RNA, 19 nt, Salmonella typhimurium LT2
ggcaggucugauaaaaaug

SEQ ID NO: 3760554 - RNA, 22 nt, Salmonella typhimurium LT2
ggcaguaaaaagaaagcugccg

SEQ ID NO: 3760555 - RNA, 22 nt, Salmonella typhimurium LT2
ggcagucccaaugcggaaacca

SEQ ID NO: 3760556 - RNA, 15 nt, Salmonella typhimurium LT2
ggcaguccggcggca

SEQ ID NO: 3760557 - RNA, 20 nt, Salmonella typhimurium LT2
ggcaguccuugcagccagaa

SEQ ID NO: 3760558 - RNA, 21 nt, Salmonella typhimurium LT2
ggcagucgcuacaaccagcgc

SEQ ID NO: 3760559 - RNA, 23 nt, Salmonella typhimurium LT2
ggcagucgcuacaaccagcgcgg

SEQ ID NO: 3760560 - RNA, 16 nt, Salmonella typhimurium LT2
ggcaguuacacuauug

SEQ ID NO: 3760561 - RNA, 22 nt, Salmonella typhimurium LT2
ggcaguucagucgggaucgcca

SEQ ID NO: 3760562 - RNA, 22 nt, Salmonella typhimurium LT2
ggcaguuuauggcgggcguccu

SEQ ID NO: 3760563 - RNA, 18 nt, Salmonella typhimurium LT2
ggcauaaacgccucaucc

SEQ ID NO: 3760564 - RNA, 22 nt, Salmonella typhimurium LT2
ggcauaaauaaaccgaaagggu

SEQ ID NO: 3760565 - RNA, 21 nt, Salmonella typhimurium LT2
ggcauaaauaauaccguccgc

SEQ ID NO: 3760566 - RNA, 14 nt, Salmonella typhimurium LT2
ggcauaacccgccg

SEQ ID NO: 3760567 - RNA, 16 nt, Salmonella typhimurium LT2
ggcauaagccagcccu

SEQ ID NO: 3760568 - RNA, 21 nt, Salmonella typhimurium LT2
ggcauaaugccacgagaaauc

SEQ ID NO: 3760569 - RNA, 15 nt, Salmonella typhimurium LT2
ggcauacaccgccag

SEQ ID NO: 3760570 - RNA, 17 nt, Salmonella typhimurium LT2
ggcauacucuccuccau

SEQ ID NO: 3760571 - RNA, 13 nt, Salmonella typhimurium LT2
ggcauagaaaaag

SEQ ID NO: 3760572 - RNA, 17 nt, Salmonella typhimurium LT2
ggcauagaaaaagaacu

SEQ ID NO: 3760573 - RNA, 21 nt, Salmonella typhimurium LT2
ggcauagaaaaagaacugcaa

SEQ ID NO: 3760574 - RNA, 15 nt, Salmonella typhimurium LT2
ggcauagacauccag

SEQ ID NO: 3760575 - RNA, 13 nt, Salmonella typhimurium LT2
ggcauagcaacga

SEQ ID NO: 3760576 - RNA, 13 nt, Salmonella typhimurium LT2
ggcauaucgccau

SEQ ID NO: 3760577 - RNA, 18 nt, Salmonella typhimurium LT2
ggcauauucuggcggcgg

SEQ ID NO: 3760578 - RNA, 14 nt, Salmonella typhimurium LT2
ggcaucacgccggu

SEQ ID NO: 3760579 - RNA, 16 nt, Salmonella typhimurium LT2
ggcaucauaaaaggca

SEQ ID NO: 3760580 - RNA, 18 nt, Salmonella typhimurium LT2
ggcauccggcccgugcca

SEQ ID NO: 3760581 - RNA, 14 nt, Salmonella typhimurium LT2
ggcaucgacgccag

SEQ ID NO: 3760582 - RNA, 18 nt, Salmonella typhimurium LT2
ggcaucggaaccggggcg

SEQ ID NO: 3760583 - RNA, 22 nt, Salmonella typhimurium LT2
ggcaucguagucaggcagcagg

SEQ ID NO: 3760584 - RNA, 14 nt, Salmonella typhimurium LT2
ggcaucgucggcga

SEQ ID NO: 3760585 - RNA, 20 nt, Salmonella typhimurium LT2
ggcaucucaucuugcaagaa

SEQ ID NO: 3760586 - RNA, 12 nt, Salmonella typhimurium LT2
ggcaucucgcca

SEQ ID NO: 3760587 - RNA, 13 nt, Salmonella typhimurium LT2
ggcaucucgccaa

SEQ ID NO: 3760588 - RNA, 18 nt, Salmonella typhimurium LT2
ggcaucucuucguucagg

SEQ ID NO: 3760589 - RNA, 17 nt, Salmonella typhimurium LT2
ggcaucugucaucgccg

SEQ ID NO: 3760590 - RNA, 23 nt, Salmonella typhimurium LT2
ggcaugaaaauaugaugcuaucu

SEQ ID NO: 3760591 - RNA, 19 nt, Salmonella typhimurium LT2
ggcaugacuuuaccgguuu

SEQ ID NO: 3760592 - RNA, 20 nt, Salmonella typhimurium LT2
ggcaugaucuauccaauaau

SEQ ID NO: 3760593 - RNA, 22 nt, Salmonella typhimurium LT2
ggcaugaucuauccaauaauaa

SEQ ID NO: 3760594 - RNA, 20 nt, Salmonella typhimurium LT2
ggcaugauggcgaacagccc

SEQ ID NO: 3760595 - RNA, 22 nt, Salmonella typhimurium LT2
ggcaugaugggcgcacagcgcc

SEQ ID NO: 3760596 - RNA, 14 nt, Salmonella typhimurium LT2
ggcaugccacuggg

SEQ ID NO: 3760597 - RNA, 15 nt, Salmonella typhimurium LT2
ggcauggcagcaggg

SEQ ID NO: 3760598 - RNA, 22 nt, Salmonella typhimurium LT2
ggcauggggucaggugggacca

SEQ ID NO: 3760599 - RNA, 15 nt, Salmonella typhimurium LT2
ggcauggucagcaua

SEQ ID NO: 3760600 - RNA, 21 nt, Salmonella typhimurium LT2
ggcauguccggcgacuccaga

SEQ ID NO: 3760601 - RNA, 20 nt, Salmonella typhimurium LT2
ggcauguucacaucgcucag

SEQ ID NO: 3760602 - RNA, 22 nt, Salmonella typhimurium LT2
ggcauguucccaugucagcgca

SEQ ID NO: 3760603 - RNA, 23 nt, Salmonella typhimurium LT2
ggcauuaaaaaaaagagcggcuu

SEQ ID NO: 3760604 - RNA, 18 nt, Salmonella typhimurium LT2
ggcauucgaauccuccug

SEQ ID NO: 3760605 - RNA, 19 nt, Salmonella typhimurium LT2
ggcauucgaauccuccugu

SEQ ID NO: 3760606 - RNA, 15 nt, Salmonella typhimurium LT2
ggcauugcagcgcgu

SEQ ID NO: 3760607 - RNA, 20 nt, Salmonella typhimurium LT2
ggcauugccggaaaccaacc

SEQ ID NO: 3760608 - RNA, 20 nt, Salmonella typhimurium LT2
ggcauuuacaccuuauccgg

SEQ ID NO: 3760609 - RNA, 19 nt, Salmonella typhimurium LT2
ggcauuucacuuaauacuc

SEQ ID NO: 3760610 - RNA, 15 nt, Salmonella typhimurium LT2
ggcauuucaggcacu

SEQ ID NO: 3760611 - RNA, 16 nt, Salmonella typhimurium LT2
ggcauuuucuuaccug

SEQ ID NO: 3760612 - RNA, 18 nt, Salmonella typhimurium LT2
ggcauuuucuuaccuggu

SEQ ID NO: 3760613 - RNA, 15 nt, Salmonella typhimurium LT2
ggccaaacagcggcu

SEQ ID NO: 3760614 - RNA, 17 nt, Salmonella typhimurium LT2
ggccaaagggagcagac

SEQ ID NO: 3760615 - RNA, 14 nt, Salmonella typhimurium LT2
ggccaaauaaccca

SEQ ID NO: 3760616 - RNA, 16 nt, Salmonella typhimurium LT2
ggccaacauagcggca

SEQ ID NO: 3760617 - RNA, 21 nt, Salmonella typhimurium LT2
ggccaacauagcggcaaggaa

SEQ ID NO: 3760618 - RNA, 22 nt, Salmonella typhimurium LT2
ggccaacauagcggcaaggaaa

SEQ ID NO: 3760619 - RNA, 21 nt, Salmonella typhimurium LT2
ggccaagcgccuguucaacau

SEQ ID NO: 3760620 - RNA, 12 nt, Salmonella typhimurium LT2
ggccacagcgcc

SEQ ID NO: 3760621 - RNA, 14 nt, Salmonella typhimurium LT2
ggccacagcgccag

SEQ ID NO: 3760622 - RNA, 23 nt, Salmonella typhimurium LT2
ggccacaucguuacccaucaccu

SEQ ID NO: 3760623 - RNA, 14 nt, Salmonella typhimurium LT2
ggccaccagcgcca

SEQ ID NO: 3760624 - RNA, 17 nt, Salmonella typhimurium LT2
ggccaccaggccugagc

SEQ ID NO: 3760625 - RNA, 15 nt, Salmonella typhimurium LT2
ggccacucuccagca

SEQ ID NO: 3760626 - RNA, 19 nt, Salmonella typhimurium LT2
ggccagaaccugcucggcu
